United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 107

SEQ ID NO: 3797752 - RNA, 16 nt, Salmonella typhimurium LT2
ugacaucgcuuaaugu

SEQ ID NO: 3797753 - RNA, 21 nt, Salmonella typhimurium LT2
ugacauuaauucaguccuucc

SEQ ID NO: 3797754 - RNA, 13 nt, Salmonella typhimurium LT2
ugacauucagcgc

SEQ ID NO: 3797755 - RNA, 18 nt, Salmonella typhimurium LT2
ugacauuccuuuuaauuu

SEQ ID NO: 3797756 - RNA, 20 nt, Salmonella typhimurium LT2
ugacauuccuuuuaauuuuc

SEQ ID NO: 3797757 - RNA, 21 nt, Salmonella typhimurium LT2
ugacauuugcucccuuaaaag

SEQ ID NO: 3797758 - RNA, 12 nt, Salmonella typhimurium LT2
ugaccaaacugc

SEQ ID NO: 3797759 - RNA, 19 nt, Salmonella typhimurium LT2
ugaccaacgucgugccagu

SEQ ID NO: 3797760 - RNA, 18 nt, Salmonella typhimurium LT2
ugaccaagcgucagcaug

SEQ ID NO: 3797761 - RNA, 20 nt, Salmonella typhimurium LT2
ugaccaaggcaaaguauccc

SEQ ID NO: 3797762 - RNA, 15 nt, Salmonella typhimurium LT2
ugaccaccagcgcga

SEQ ID NO: 3797763 - RNA, 18 nt, Salmonella typhimurium LT2
ugaccaccagcgcgaccg

SEQ ID NO: 3797764 - RNA, 14 nt, Salmonella typhimurium LT2
ugaccacgccgccg

SEQ ID NO: 3797765 - RNA, 21 nt, Salmonella typhimurium LT2
ugaccacuaacucaaugacga

SEQ ID NO: 3797766 - RNA, 14 nt, Salmonella typhimurium LT2
ugaccagcaauaaa

SEQ ID NO: 3797767 - RNA, 20 nt, Salmonella typhimurium LT2
ugaccaggaaacccucggcg

SEQ ID NO: 3797768 - RNA, 19 nt, Salmonella typhimurium LT2
ugaccagguugccagcggg

SEQ ID NO: 3797769 - RNA, 21 nt, Salmonella typhimurium LT2
ugaccauaauuuccggcgcau

SEQ ID NO: 3797770 - RNA, 17 nt, Salmonella typhimurium LT2
ugaccaucaaauaauac

SEQ ID NO: 3797771 - RNA, 14 nt, Salmonella typhimurium LT2
ugaccaucgccagc

SEQ ID NO: 3797772 - RNA, 16 nt, Salmonella typhimurium LT2
ugaccaucgccagcca

SEQ ID NO: 3797773 - RNA, 19 nt, Salmonella typhimurium LT2
ugacccagacaaaauucag

SEQ ID NO: 3797774 - RNA, 13 nt, Salmonella typhimurium LT2
ugacccgccgcac

SEQ ID NO: 3797775 - RNA, 14 nt, Salmonella typhimurium LT2
ugagcgucgccaga

SEQ ID NO: 3797776 - RNA, 15 nt, Salmonella typhimurium LT2
ugagcguguccucug

SEQ ID NO: 3797777 - RNA, 19 nt, Salmonella typhimurium LT2
ugagcguuacgggaacaga

SEQ ID NO: 3797778 - RNA, 21 nt, Salmonella typhimurium LT2
ugagcguuacgggaacagaau

SEQ ID NO: 3797779 - RNA, 14 nt, Salmonella typhimurium LT2
ugagcuauuucagu

SEQ ID NO: 3797780 - RNA, 15 nt, Salmonella typhimurium LT2
ugagcucucuuccag

SEQ ID NO: 3797781 - RNA, 13 nt, Salmonella typhimurium LT2
ugagcucuuucug

SEQ ID NO: 3797782 - RNA, 22 nt, Salmonella typhimurium LT2
ugagcugcugcuugcuuuucau

SEQ ID NO: 3797783 - RNA, 20 nt, Salmonella typhimurium LT2
ugagcugguggucuacggcg

SEQ ID NO: 3797784 - RNA, 16 nt, Salmonella typhimurium LT2
ugaggaugguagaggu

SEQ ID NO: 3797785 - RNA, 22 nt, Salmonella typhimurium LT2
ugaggauugccgccuugguugc

SEQ ID NO: 3797786 - RNA, 14 nt, Salmonella typhimurium LT2
ugaggcaagaggga

SEQ ID NO: 3797787 - RNA, 16 nt, Salmonella typhimurium LT2
ugaggccgcucgccau

SEQ ID NO: 3797788 - RNA, 21 nt, Salmonella typhimurium LT2
ugaggccguuuuuuuguuuua

SEQ ID NO: 3797789 - RNA, 19 nt, Salmonella typhimurium LT2
ugaggcuuugagcgucagc

SEQ ID NO: 3797790 - RNA, 17 nt, Salmonella typhimurium LT2
ugagguuaaucuucagg

SEQ ID NO: 3797791 - RNA, 20 nt, Salmonella typhimurium LT2
ugagguuaaucuucagggcg

SEQ ID NO: 3797792 - RNA, 20 nt, Salmonella typhimurium LT2
ugagguugagauccugaucc

SEQ ID NO: 3797793 - RNA, 20 nt, Salmonella typhimurium LT2
ugaguaaauaaaaaccauuu

SEQ ID NO: 3797794 - RNA, 14 nt, Salmonella typhimurium LT2
ugaguacggaacaa

SEQ ID NO: 3797795 - RNA, 20 nt, Salmonella typhimurium LT2
ugaguacggaacaaaacgga

SEQ ID NO: 3797796 - RNA, 19 nt, Salmonella typhimurium LT2
ugaguccauaccguuucaa

SEQ ID NO: 3797797 - RNA, 23 nt, Salmonella typhimurium LT2
ugagugcaaucuuuacccggcgc

SEQ ID NO: 3797798 - RNA, 13 nt, Salmonella typhimurium LT2
ugaguuauguauu

SEQ ID NO: 3797799 - RNA, 22 nt, Salmonella typhimurium LT2
ugaguucaauaugugcaucggc

SEQ ID NO: 3797800 - RNA, 15 nt, Salmonella typhimurium LT2
ugaguucagcugauu

SEQ ID NO: 3797801 - RNA, 22 nt, Salmonella typhimurium LT2
ugaguucccggugaguccgcga

SEQ ID NO: 3797802 - RNA, 17 nt, Salmonella typhimurium LT2
ugaguuugacugccaga

SEQ ID NO: 3797803 - RNA, 22 nt, Salmonella typhimurium LT2
ugaguuuuaacgaaggauuuau

SEQ ID NO: 3797804 - RNA, 13 nt, Salmonella typhimurium LT2
ugauaaaaaugcg

SEQ ID NO: 3797805 - RNA, 20 nt, Salmonella typhimurium LT2
ugauaaagcuuucaucuuua

SEQ ID NO: 3797806 - RNA, 16 nt, Salmonella typhimurium LT2
ugauaaaucgucggca

SEQ ID NO: 3797807 - RNA, 18 nt, Salmonella typhimurium LT2
ugauaaaucgucggcagg

SEQ ID NO: 3797808 - RNA, 15 nt, Salmonella typhimurium LT2
ugauaaccgccgcca

SEQ ID NO: 3797809 - RNA, 13 nt, Salmonella typhimurium LT2
ugauaagagaaaa

SEQ ID NO: 3797810 - RNA, 21 nt, Salmonella typhimurium LT2
ugauaagcauagcgccaucag

SEQ ID NO: 3797811 - RNA, 18 nt, Salmonella typhimurium LT2
ugauaagcgcagcgccau

SEQ ID NO: 3797812 - RNA, 18 nt, Salmonella typhimurium LT2
ugauaagcguagcgccau

SEQ ID NO: 3797813 - RNA, 21 nt, Salmonella typhimurium LT2
ugauaauaauuguaggcagga

SEQ ID NO: 3797814 - RNA, 13 nt, Salmonella typhimurium LT2
ugauaauaugcuc

SEQ ID NO: 3797815 - RNA, 23 nt, Salmonella typhimurium LT2
ugauaaucaacggucuugccagc

SEQ ID NO: 3797816 - RNA, 15 nt, Salmonella typhimurium LT2
ugauaaucagcaaga

SEQ ID NO: 3797817 - RNA, 16 nt, Salmonella typhimurium LT2
ugauaauggcauauaa

SEQ ID NO: 3797818 - RNA, 23 nt, Salmonella typhimurium LT2
ugauacagccaaaucagcaggac

SEQ ID NO: 3797819 - RNA, 16 nt, Salmonella typhimurium LT2
ugauacaggaauaacc

SEQ ID NO: 3797820 - RNA, 20 nt, Salmonella typhimurium LT2
ugauacauagucuauguuca

SEQ ID NO: 3797821 - RNA, 14 nt, Salmonella typhimurium LT2
ugauaccggaggag

SEQ ID NO: 3797822 - RNA, 17 nt, Salmonella typhimurium LT2
ugauaccggaggagugc

SEQ ID NO: 3797823 - RNA, 19 nt, Salmonella typhimurium LT2
ugauaccgucuuccuucca

SEQ ID NO: 3797824 - RNA, 20 nt, Salmonella typhimurium LT2
ugauaccgucuuccuuccac

SEQ ID NO: 3797825 - RNA, 21 nt, Salmonella typhimurium LT2
ugauacggcguuggcugcucu

SEQ ID NO: 3797826 - RNA, 23 nt, Salmonella typhimurium LT2
ugauacuuauuacgguaucagcg

SEQ ID NO: 3797827 - RNA, 13 nt, Salmonella typhimurium LT2
ugauagccacggc

SEQ ID NO: 3797828 - RNA, 15 nt, Salmonella typhimurium LT2
ugauagcgaggcagc

SEQ ID NO: 3797829 - RNA, 18 nt, Salmonella typhimurium LT2
ugauagcgaggcagcagg

SEQ ID NO: 3797830 - RNA, 18 nt, Salmonella typhimurium LT2
ugauagcgaucagcgcca

SEQ ID NO: 3797831 - RNA, 21 nt, Salmonella typhimurium LT2
ugauagcgaucagcgccacca

SEQ ID NO: 3797832 - RNA, 14 nt, Salmonella typhimurium LT2
ugauaggccgcuau

SEQ ID NO: 3797833 - RNA, 21 nt, Salmonella typhimurium LT2
ugauaggcucaauaugccagg

SEQ ID NO: 3797834 - RNA, 22 nt, Salmonella typhimurium LT2
ugauagugcguucgaaucagcu

SEQ ID NO: 3797835 - RNA, 15 nt, Salmonella typhimurium LT2
ugauaguguccacuu

SEQ ID NO: 3797836 - RNA, 18 nt, Salmonella typhimurium LT2
ugauaguuuaaauccagc

SEQ ID NO: 3797837 - RNA, 20 nt, Salmonella typhimurium LT2
ugauauaaccgucuucaucc

SEQ ID NO: 3797838 - RNA, 20 nt, Salmonella typhimurium LT2
ugauauaccguccagacucc

SEQ ID NO: 3797839 - RNA, 14 nt, Salmonella typhimurium LT2
ugauauagcgccau

SEQ ID NO: 3797840 - RNA, 16 nt, Salmonella typhimurium LT2
ugauaucgcaacagau

SEQ ID NO: 3797841 - RNA, 22 nt, Salmonella typhimurium LT2
ugauaucgcaacagauaagcac

SEQ ID NO: 3797842 - RNA, 16 nt, Salmonella typhimurium LT2
ugauaucgccccagaa

SEQ ID NO: 3797843 - RNA, 19 nt, Salmonella typhimurium LT2
ugauauucuuugguauuga

SEQ ID NO: 3797844 - RNA, 23 nt, Salmonella typhimurium LT2
ugauauugcguaagcagcugcuu

SEQ ID NO: 3797845 - RNA, 16 nt, Salmonella typhimurium LT2
ugauauugugcauacu

SEQ ID NO: 3797846 - RNA, 16 nt, Salmonella typhimurium LT2
ugauauuuucaccucc

SEQ ID NO: 3797847 - RNA, 17 nt, Salmonella typhimurium LT2
ugauauuuucaggcacc

SEQ ID NO: 3797848 - RNA, 18 nt, Salmonella typhimurium LT2
ugauauuuucaggcaccg

SEQ ID NO: 3797849 - RNA, 18 nt, Salmonella typhimurium LT2
ugaucaacgccgcgccau

SEQ ID NO: 3797850 - RNA, 23 nt, Salmonella typhimurium LT2
ugaucacgguacgcaucaccagg

SEQ ID NO: 3797851 - RNA, 19 nt, Salmonella typhimurium LT2
ugaucagaccaucggccgc

SEQ ID NO: 3797852 - RNA, 23 nt, Salmonella typhimurium LT2
ugaucagcaaaauaguguugaau

SEQ ID NO: 3797853 - RNA, 13 nt, Salmonella typhimurium LT2
ugaucagcgcucc

SEQ ID NO: 3797854 - RNA, 18 nt, Salmonella typhimurium LT2
ugaucaggaaaucuucca

SEQ ID NO: 3797855 - RNA, 19 nt, Salmonella typhimurium LT2
ugaucaggaaaucuuccag

SEQ ID NO: 3797856 - RNA, 20 nt, Salmonella typhimurium LT2
ugaucaggaaaucuuccagu

SEQ ID NO: 3797857 - RNA, 14 nt, Salmonella typhimurium LT2
ugaucauacugccg

SEQ ID NO: 3797858 - RNA, 15 nt, Salmonella typhimurium LT2
ugaucauacugccgc

SEQ ID NO: 3797859 - RNA, 16 nt, Salmonella typhimurium LT2
ugaucaugcugcaccg

SEQ ID NO: 3797860 - RNA, 15 nt, Salmonella typhimurium LT2
ugauccacacuggcg

SEQ ID NO: 3797861 - RNA, 22 nt, Salmonella typhimurium LT2
ugauccaccaccaguacauggc

SEQ ID NO: 3797862 - RNA, 17 nt, Salmonella typhimurium LT2
ugauccaccaucggcgc

SEQ ID NO: 3797863 - RNA, 11 nt, Salmonella typhimurium LT2
ugauccagcga

SEQ ID NO: 3797864 - RNA, 12 nt, Salmonella typhimurium LT2
ugaucccaaugu

SEQ ID NO: 3797865 - RNA, 11 nt, Salmonella typhimurium LT2
ugaucccacca

SEQ ID NO: 3797866 - RNA, 12 nt, Salmonella typhimurium LT2
ugaucccaccag

SEQ ID NO: 3797867 - RNA, 19 nt, Salmonella typhimurium LT2
ugauccgcccccuccagua

SEQ ID NO: 3797868 - RNA, 23 nt, Salmonella typhimurium LT2
ugauccgcccccuccaguagcag

SEQ ID NO: 3797869 - RNA, 14 nt, Salmonella typhimurium LT2
ugauccugcaacag

SEQ ID NO: 3797870 - RNA, 22 nt, Salmonella typhimurium LT2
ugauccugcaacagcaccagca

SEQ ID NO: 3797871 - RNA, 18 nt, Salmonella typhimurium LT2
ugaucgaacuugaccagc

SEQ ID NO: 3797872 - RNA, 12 nt, Salmonella typhimurium LT2
ugaucgaauuca

SEQ ID NO: 3797873 - RNA, 16 nt, Salmonella typhimurium LT2
ugaucgaauucauuac

SEQ ID NO: 3797874 - RNA, 18 nt, Salmonella typhimurium LT2
ugaucgauagcgacggcg

SEQ ID NO: 3797875 - RNA, 17 nt, Salmonella typhimurium LT2
ugaucgccaaagcguaa

SEQ ID NO: 3797876 - RNA, 21 nt, Salmonella typhimurium LT2
ugaucgccacgccuaaacuga

SEQ ID NO: 3797877 - RNA, 18 nt, Salmonella typhimurium LT2
ugaucggcggcccacuca

SEQ ID NO: 3797878 - RNA, 17 nt, Salmonella typhimurium LT2
ugcaccgcuaaaaaaca

SEQ ID NO: 3797879 - RNA, 16 nt, Salmonella typhimurium LT2
ugcacgaacugcugcc

SEQ ID NO: 3797880 - RNA, 14 nt, Salmonella typhimurium LT2
ugcacgcauggcac

SEQ ID NO: 3797881 - RNA, 20 nt, Salmonella typhimurium LT2
ugcacgccaggguaauacug

SEQ ID NO: 3797882 - RNA, 22 nt, Salmonella typhimurium LT2
ugcacgcccauacacaccagca

SEQ ID NO: 3797883 - RNA, 23 nt, Salmonella typhimurium LT2
ugcacgccgcgcucgcucaucac

SEQ ID NO: 3797884 - RNA, 14 nt, Salmonella typhimurium LT2
ugcacgccgggaau

SEQ ID NO: 3797885 - RNA, 17 nt, Salmonella typhimurium LT2
ugcacggcgucauccac

SEQ ID NO: 3797886 - RNA, 16 nt, Salmonella typhimurium LT2
ugcacguaccugcucc

SEQ ID NO: 3797887 - RNA, 13 nt, Salmonella typhimurium LT2
ugcacugccugau

SEQ ID NO: 3797888 - RNA, 21 nt, Salmonella typhimurium LT2
ugcacugguagaaaaacccuu

SEQ ID NO: 3797889 - RNA, 21 nt, Salmonella typhimurium LT2
ugcacuucgccgggauaaaac

SEQ ID NO: 3797890 - RNA, 21 nt, Salmonella typhimurium LT2
ugcagaaaauccuucagcguu

SEQ ID NO: 3797891 - RNA, 17 nt, Salmonella typhimurium LT2
ugcagaaaggcgugcag

SEQ ID NO: 3797892 - RNA, 19 nt, Salmonella typhimurium LT2
ugcagagaaguguacaaac

SEQ ID NO: 3797893 - RNA, 19 nt, Salmonella typhimurium LT2
ugcagaugguauaaaucac

SEQ ID NO: 3797894 - RNA, 17 nt, Salmonella typhimurium LT2
ugcagauuauuucacuu

SEQ ID NO: 3797895 - RNA, 15 nt, Salmonella typhimurium LT2
ugcagcaaauacaga

SEQ ID NO: 3797896 - RNA, 23 nt, Salmonella typhimurium LT2
ugcagcaacugauucaaaaggug

SEQ ID NO: 3797897 - RNA, 24 nt, Salmonella typhimurium LT2
ugcagcaagcggcugucaucaaug

SEQ ID NO: 3797898 - RNA, 17 nt, Salmonella typhimurium LT2
ugcagcaccucgguaug

SEQ ID NO: 3797899 - RNA, 12 nt, Salmonella typhimurium LT2
ugcagcagccag

SEQ ID NO: 3797900 - RNA, 18 nt, Salmonella typhimurium LT2
ugcagcaggacgcgcacu

SEQ ID NO: 3797901 - RNA, 18 nt, Salmonella typhimurium LT2
ugcagcauugggauggau

SEQ ID NO: 3797902 - RNA, 12 nt, Salmonella typhimurium LT2
ugcagccaggcc

SEQ ID NO: 3797903 - RNA, 13 nt, Salmonella typhimurium LT2
ugcagccaggcca

SEQ ID NO: 3797904 - RNA, 17 nt, Salmonella typhimurium LT2
ugcagcgccauccacgg

SEQ ID NO: 3797905 - RNA, 13 nt, Salmonella typhimurium LT2
ugcagcgccgccu

SEQ ID NO: 3797906 - RNA, 16 nt, Salmonella typhimurium LT2
ugcagcgcuguccaga

SEQ ID NO: 3797907 - RNA, 21 nt, Salmonella typhimurium LT2
ugcagcggaauuaacugcacu

SEQ ID NO: 3797908 - RNA, 21 nt, Salmonella typhimurium LT2
ugcagcggcaguuccggcguu

SEQ ID NO: 3797909 - RNA, 15 nt, Salmonella typhimurium LT2
ugcagcguuuccagc

SEQ ID NO: 3797910 - RNA, 16 nt, Salmonella typhimurium LT2
ugcagcguuuccagcc

SEQ ID NO: 3797911 - RNA, 16 nt, Salmonella typhimurium LT2
ugcagcucaagcgccg

SEQ ID NO: 3797912 - RNA, 13 nt, Salmonella typhimurium LT2
ugcagcuccacaa

SEQ ID NO: 3797913 - RNA, 18 nt, Salmonella typhimurium LT2
ugcagcuccacaaauagc

SEQ ID NO: 3797914 - RNA, 22 nt, Salmonella typhimurium LT2
ugcagcucuucgccguuaucgg

SEQ ID NO: 3797915 - RNA, 13 nt, Salmonella typhimurium LT2
ugcaggaaggucu

SEQ ID NO: 3797916 - RNA, 20 nt, Salmonella typhimurium LT2
ugcaggacagacagacguug

SEQ ID NO: 3797917 - RNA, 17 nt, Salmonella typhimurium LT2
ugcaggauucgaaccug

SEQ ID NO: 3797918 - RNA, 10 nt, Salmonella typhimurium LT2
ugcaggcaac

SEQ ID NO: 3797919 - RNA, 18 nt, Salmonella typhimurium LT2
ugcaggcaggucuccagc

SEQ ID NO: 3797920 - RNA, 18 nt, Salmonella typhimurium LT2
ugcaggcauaaaaaagag

SEQ ID NO: 3797921 - RNA, 15 nt, Salmonella typhimurium LT2
ugcaggccggaacga

SEQ ID NO: 3797922 - RNA, 20 nt, Salmonella typhimurium LT2
ugcagggaauaagcacccau

SEQ ID NO: 3797923 - RNA, 20 nt, Salmonella typhimurium LT2
ugcaggggcaguaaauuaaa

SEQ ID NO: 3797924 - RNA, 20 nt, Salmonella typhimurium LT2
ugcagggugaagauggcgcc

SEQ ID NO: 3797925 - RNA, 14 nt, Salmonella typhimurium LT2
ugcagguucccgcc

SEQ ID NO: 3797926 - RNA, 19 nt, Salmonella typhimurium LT2
ugcaguauugcaccaggaa

SEQ ID NO: 3797927 - RNA, 19 nt, Salmonella typhimurium LT2
ugcagucgcggaauaauca

SEQ ID NO: 3797928 - RNA, 17 nt, Salmonella typhimurium LT2
ugcagugacagaggaau

SEQ ID NO: 3797929 - RNA, 13 nt, Salmonella typhimurium LT2
ugcauaaaaaaac

SEQ ID NO: 3797930 - RNA, 14 nt, Salmonella typhimurium LT2
ugcauaaaacugag

SEQ ID NO: 3797931 - RNA, 17 nt, Salmonella typhimurium LT2
ugcauaaacgcggccau

SEQ ID NO: 3797932 - RNA, 13 nt, Salmonella typhimurium LT2
ugcauacauaaau

SEQ ID NO: 3797933 - RNA, 22 nt, Salmonella typhimurium LT2
ugcauacggucaaacagaucca

SEQ ID NO: 3797934 - RNA, 18 nt, Salmonella typhimurium LT2
ugcauagaacggccuguu

SEQ ID NO: 3797935 - RNA, 15 nt, Salmonella typhimurium LT2
ugcauagccccagcg

SEQ ID NO: 3797936 - RNA, 16 nt, Salmonella typhimurium LT2
ugcauagccccagcgc

SEQ ID NO: 3797937 - RNA, 16 nt, Salmonella typhimurium LT2
ugcauauaacuuucaa

SEQ ID NO: 3797938 - RNA, 12 nt, Salmonella typhimurium LT2
ugcauauauccu

SEQ ID NO: 3797939 - RNA, 22 nt, Salmonella typhimurium LT2
ugcauauucauaucgaagccca

SEQ ID NO: 3797940 - RNA, 13 nt, Salmonella typhimurium LT2
ugcauauuguauu

SEQ ID NO: 3797941 - RNA, 20 nt, Salmonella typhimurium LT2
ugcauccaacuuaugaaaac

SEQ ID NO: 3797942 - RNA, 22 nt, Salmonella typhimurium LT2
ugcauccaacuuaugaaaaccu

SEQ ID NO: 3797943 - RNA, 18 nt, Salmonella typhimurium LT2
ugcauccgcgcuuucugg

SEQ ID NO: 3797944 - RNA, 21 nt, Salmonella typhimurium LT2
ugcauccgggguucgaauccc

SEQ ID NO: 3797945 - RNA, 17 nt, Salmonella typhimurium LT2
ugcaucgcggucagcgg

SEQ ID NO: 3797946 - RNA, 19 nt, Salmonella typhimurium LT2
ugcaucgugagcgcgucau

SEQ ID NO: 3797947 - RNA, 22 nt, Salmonella typhimurium LT2
ugcaucguuugcaguuccgcaa

SEQ ID NO: 3797948 - RNA, 17 nt, Salmonella typhimurium LT2
ugcaucucguaaaucaa

SEQ ID NO: 3797949 - RNA, 18 nt, Salmonella typhimurium LT2
ugcaucucguaaaucaau

SEQ ID NO: 3797950 - RNA, 18 nt, Salmonella typhimurium LT2
ugcaucuggucaggagau

SEQ ID NO: 3797951 - RNA, 13 nt, Salmonella typhimurium LT2
ugcaugaaauccu

SEQ ID NO: 3797952 - RNA, 15 nt, Salmonella typhimurium LT2
ugcaugaagcgucau

SEQ ID NO: 3797953 - RNA, 14 nt, Salmonella typhimurium LT2
ugcaugaauaucaa

SEQ ID NO: 3797954 - RNA, 18 nt, Salmonella typhimurium LT2
ugcaugauagucguuaua

SEQ ID NO: 3797955 - RNA, 23 nt, Salmonella typhimurium LT2
ugcaugauagucguuauaauccu

SEQ ID NO: 3797956 - RNA, 17 nt, Salmonella typhimurium LT2
ugcaugauuaggcuggg

SEQ ID NO: 3797957 - RNA, 20 nt, Salmonella typhimurium LT2
ugcaugccucgaaaauauau

SEQ ID NO: 3797958 - RNA, 22 nt, Salmonella typhimurium LT2
ugcaugggauacgccagcagac

SEQ ID NO: 3797959 - RNA, 17 nt, Salmonella typhimurium LT2
ugcauguaguaagccau

SEQ ID NO: 3797960 - RNA, 17 nt, Salmonella typhimurium LT2
ugcauuaaccugaucca

SEQ ID NO: 3797961 - RNA, 21 nt, Salmonella typhimurium LT2
ugcauuaugggcaaugauaua

SEQ ID NO: 3797962 - RNA, 20 nt, Salmonella typhimurium LT2
ugcauuauuuuagugaaaaa

SEQ ID NO: 3797963 - RNA, 21 nt, Salmonella typhimurium LT2
ugcauuauuuuagugaaaaaa

SEQ ID NO: 3797964 - RNA, 13 nt, Salmonella typhimurium LT2
ugcauuggccagc

SEQ ID NO: 3797965 - RNA, 15 nt, Salmonella typhimurium LT2
ugcauuuaucuuuaa

SEQ ID NO: 3797966 - RNA, 17 nt, Salmonella typhimurium LT2
ugcauuucuuguugacg

SEQ ID NO: 3797967 - RNA, 17 nt, Salmonella typhimurium LT2
ugcauuuucaccuggau

SEQ ID NO: 3797968 - RNA, 13 nt, Salmonella typhimurium LT2
ugccaaaaaauca

SEQ ID NO: 3797969 - RNA, 12 nt, Salmonella typhimurium LT2
ugccaaaccacu

SEQ ID NO: 3797970 - RNA, 13 nt, Salmonella typhimurium LT2
ugccaaagucguc

SEQ ID NO: 3797971 - RNA, 18 nt, Salmonella typhimurium LT2
ugccaaguaauaaagaga

SEQ ID NO: 3797972 - RNA, 13 nt, Salmonella typhimurium LT2
ugccaaucuccag

SEQ ID NO: 3797973 - RNA, 23 nt, Salmonella typhimurium LT2
ugccaauggcgauaaaaauaucc

SEQ ID NO: 3797974 - RNA, 17 nt, Salmonella typhimurium LT2
ugccacacucucuccag

SEQ ID NO: 3797975 - RNA, 21 nt, Salmonella typhimurium LT2
ugccacauuuaugucgggugg

SEQ ID NO: 3797976 - RNA, 13 nt, Salmonella typhimurium LT2
ugccacccggcaa

SEQ ID NO: 3797977 - RNA, 21 nt, Salmonella typhimurium LT2
ugccacgccccuaaggcagcg

SEQ ID NO: 3797978 - RNA, 12 nt, Salmonella typhimurium LT2
ugccacuggccu

SEQ ID NO: 3797979 - RNA, 13 nt, Salmonella typhimurium LT2
ugccacuggguuu

SEQ ID NO: 3797980 - RNA, 21 nt, Salmonella typhimurium LT2
ugccagaaacaucgguaauag

SEQ ID NO: 3797981 - RNA, 22 nt, Salmonella typhimurium LT2
ugccagaggaaauccuuccagc

SEQ ID NO: 3797982 - RNA, 19 nt, Salmonella typhimurium LT2
ugccagauaguaaugcuca

SEQ ID NO: 3797983 - RNA, 22 nt, Salmonella typhimurium LT2
ugccagcaacccaccugccagu

SEQ ID NO: 3797984 - RNA, 12 nt, Salmonella typhimurium LT2
ugccagcaccag

SEQ ID NO: 3797985 - RNA, 13 nt, Salmonella typhimurium LT2
ugccagcaccagc

SEQ ID NO: 3797986 - RNA, 14 nt, Salmonella typhimurium LT2
ugccagcaccagca

SEQ ID NO: 3797987 - RNA, 18 nt, Salmonella typhimurium LT2
ugccagcagauuuucauc

SEQ ID NO: 3797988 - RNA, 15 nt, Salmonella typhimurium LT2
ugccagcggccaggg

SEQ ID NO: 3797989 - RNA, 18 nt, Salmonella typhimurium LT2
ugccagcggccagggcgu

SEQ ID NO: 3797990 - RNA, 18 nt, Salmonella typhimurium LT2
ugccagcucaaaucgcgg

SEQ ID NO: 3797991 - RNA, 20 nt, Salmonella typhimurium LT2
ugccagcucaaaucgcggcg

SEQ ID NO: 3797992 - RNA, 17 nt, Salmonella typhimurium LT2
ugccagcucguuauuuc

SEQ ID NO: 3797993 - RNA, 19 nt, Salmonella typhimurium LT2
ugccagcucguuauuuccg

SEQ ID NO: 3797994 - RNA, 18 nt, Salmonella typhimurium LT2
ugccaggaagucagcuuc

SEQ ID NO: 3797995 - RNA, 19 nt, Salmonella typhimurium LT2
ugccaggcauaccuccucu

SEQ ID NO: 3797996 - RNA, 14 nt, Salmonella typhimurium LT2
ugccaggcauuuuc

SEQ ID NO: 3797997 - RNA, 19 nt, Salmonella typhimurium LT2
ugccaggcgcuaucuucaa

SEQ ID NO: 3797998 - RNA, 21 nt, Salmonella typhimurium LT2
ugccagguuauuucgcgcagu

SEQ ID NO: 3797999 - RNA, 21 nt, Salmonella typhimurium LT2
ugccaguaacguucuucgaua

SEQ ID NO: 3798000 - RNA, 14 nt, Salmonella typhimurium LT2
ugccaguaccgccg

SEQ ID NO: 3798001 - RNA, 23 nt, Salmonella typhimurium LT2
ugccagucaauaagcuugcuuuc

SEQ ID NO: 3798002 - RNA, 17 nt, Salmonella typhimurium LT2
ugccaguucauuccgcc

SEQ ID NO: 3798003 - RNA, 19 nt, Salmonella typhimurium LT2
ugccaguuucucaaagcug

SEQ ID NO: 3798004 - RNA, 15 nt, Salmonella typhimurium LT2
ugccauaaaaugcug

SEQ ID NO: 3798005 - RNA, 21 nt, Salmonella typhimurium LT2
ugccauacuuuuccagcgccu

SEQ ID NO: 3798006 - RNA, 18 nt, Salmonella typhimurium LT2
ugccauaucguucaguuu

SEQ ID NO: 3798007 - RNA, 13 nt, Salmonella typhimurium LT2
ugccauauucaac

SEQ ID NO: 3798008 - RNA, 14 nt, Salmonella typhimurium LT2
ugccaucagcaccu

SEQ ID NO: 3798009 - RNA, 13 nt, Salmonella typhimurium LT2
ugccaucauccag

SEQ ID NO: 3798010 - RNA, 12 nt, Salmonella typhimurium LT2
ugccauccucau

SEQ ID NO: 3798011 - RNA, 20 nt, Salmonella typhimurium LT2
ugccaucgcuucuacagcca

SEQ ID NO: 3798012 - RNA, 19 nt, Salmonella typhimurium LT2
ugccaugucgccucgcuaa

SEQ ID NO: 3798013 - RNA, 16 nt, Salmonella typhimurium LT2
ugccauucgcccaguc

SEQ ID NO: 3798014 - RNA, 18 nt, Salmonella typhimurium LT2
ugccauuguuccggcgac

SEQ ID NO: 3798015 - RNA, 15 nt, Salmonella typhimurium LT2
ugcccacccgggccg

SEQ ID NO: 3798016 - RNA, 17 nt, Salmonella typhimurium LT2
ugcccaccgauuucagc

SEQ ID NO: 3798017 - RNA, 16 nt, Salmonella typhimurium LT2
ugcccacggcguagcg

SEQ ID NO: 3798018 - RNA, 22 nt, Salmonella typhimurium LT2
ugcccagccgaaacguauggug

SEQ ID NO: 3798019 - RNA, 16 nt, Salmonella typhimurium LT2
ugcccagcgcaaucac

SEQ ID NO: 3798020 - RNA, 12 nt, Salmonella typhimurium LT2
ugcccagcgcga

SEQ ID NO: 3798021 - RNA, 22 nt, Salmonella typhimurium LT2
ugcccagcgcgaccugcauccc

SEQ ID NO: 3798022 - RNA, 19 nt, Salmonella typhimurium LT2
ugcccagcucaucgaaccu

SEQ ID NO: 3798023 - RNA, 13 nt, Salmonella typhimurium LT2
ugcccaguuuacc

SEQ ID NO: 3798024 - RNA, 23 nt, Salmonella typhimurium LT2
ugcccaguuuacccagcgaaugc

SEQ ID NO: 3798025 - RNA, 17 nt, Salmonella typhimurium LT2
ugcccaucgcgccauga

SEQ ID NO: 3798026 - RNA, 19 nt, Salmonella typhimurium LT2
ugcccaucgcgccaugauu

SEQ ID NO: 3798027 - RNA, 13 nt, Salmonella typhimurium LT2
ugcccaucggcac

SEQ ID NO: 3798028 - RNA, 18 nt, Salmonella typhimurium LT2
ugcccauucuucgucguc

SEQ ID NO: 3798029 - RNA, 18 nt, Salmonella typhimurium LT2
ugcccauuuaacagauag

SEQ ID NO: 3798030 - RNA, 15 nt, Salmonella typhimurium LT2
ugcccauuuccugca

SEQ ID NO: 3798031 - RNA, 19 nt, Salmonella typhimurium LT2
ugcccauuuccugcauuaa

SEQ ID NO: 3798032 - RNA, 19 nt, Salmonella typhimurium LT2
ugccccccgacuucacgcu

SEQ ID NO: 3798033 - RNA, 23 nt, Salmonella typhimurium LT2
ugcccccgccaaaauccggccca

SEQ ID NO: 3798034 - RNA, 14 nt, Salmonella typhimurium LT2
ugccccucuuuuua

SEQ ID NO: 3798035 - RNA, 21 nt, Salmonella typhimurium LT2
ugccccuuccgccacggcuuu

SEQ ID NO: 3798036 - RNA, 19 nt, Salmonella typhimurium LT2
ugcccgaacgcaauacugu

SEQ ID NO: 3798037 - RNA, 20 nt, Salmonella typhimurium LT2
ugcccgcaaucucuggccag

SEQ ID NO: 3798038 - RNA, 13 nt, Salmonella typhimurium LT2
ugcccgccagcgg

SEQ ID NO: 3798039 - RNA, 14 nt, Salmonella typhimurium LT2
ugcccgccagcggg

SEQ ID NO: 3798040 - RNA, 17 nt, Salmonella typhimurium LT2
ugcccgccagcgggccg

SEQ ID NO: 3798041 - RNA, 21 nt, Salmonella typhimurium LT2
ugcccgccaggguaucaucaa

SEQ ID NO: 3798042 - RNA, 15 nt, Salmonella typhimurium LT2
ugcccgccgccagcc

SEQ ID NO: 3798043 - RNA, 17 nt, Salmonella typhimurium LT2
ugcccgcgaucgagcgc

SEQ ID NO: 3798044 - RNA, 21 nt, Salmonella typhimurium LT2
ugcccgcucgcuuacgcggcg

SEQ ID NO: 3798045 - RNA, 19 nt, Salmonella typhimurium LT2
ugcccggcaugucgccagc

SEQ ID NO: 3798046 - RNA, 20 nt, Salmonella typhimurium LT2
ugcccggcaugucgccagcc

SEQ ID NO: 3798047 - RNA, 21 nt, Salmonella typhimurium LT2
ugcccggcaugucgccagcca

SEQ ID NO: 3798048 - RNA, 15 nt, Salmonella typhimurium LT2
ugcccggccuccggu

SEQ ID NO: 3798049 - RNA, 16 nt, Salmonella typhimurium LT2
ugcccggcgccauccg

SEQ ID NO: 3798050 - RNA, 19 nt, Salmonella typhimurium LT2
ugcccggcgcggcaucauc

SEQ ID NO: 3798051 - RNA, 12 nt, Salmonella typhimurium LT2
ugcccggcugua

SEQ ID NO: 3798052 - RNA, 17 nt, Salmonella typhimurium LT2
ugcccgguggcgcuggc

SEQ ID NO: 3798053 - RNA, 21 nt, Salmonella typhimurium LT2
ugcccuaacagggcgugcgcu

SEQ ID NO: 3798054 - RNA, 16 nt, Salmonella typhimurium LT2
ugcccucuuccagcgc

SEQ ID NO: 3798055 - RNA, 23 nt, Salmonella typhimurium LT2
ugcccugcuugucgaucaucaga

SEQ ID NO: 3798056 - RNA, 17 nt, Salmonella typhimurium LT2
ugcccuuaaauccggcc

SEQ ID NO: 3798057 - RNA, 19 nt, Salmonella typhimurium LT2
ugcccuucuaccgucagca

SEQ ID NO: 3798058 - RNA, 12 nt, Salmonella typhimurium LT2
ugcccuuuaucc

SEQ ID NO: 3798059 - RNA, 14 nt, Salmonella typhimurium LT2
ugcccuuucuuaug

SEQ ID NO: 3798060 - RNA, 23 nt, Salmonella typhimurium LT2
ugcccuuuuugcauucgcuccuc

SEQ ID NO: 3798061 - RNA, 14 nt, Salmonella typhimurium LT2
ugccgaacgcggcu

SEQ ID NO: 3798062 - RNA, 12 nt, Salmonella typhimurium LT2
ugccgaacgcgu

SEQ ID NO: 3798063 - RNA, 19 nt, Salmonella typhimurium LT2
ugccgaagaaagcuaucgc

SEQ ID NO: 3798064 - RNA, 20 nt, Salmonella typhimurium LT2
ugccgacaaagagcucccca

SEQ ID NO: 3798065 - RNA, 17 nt, Salmonella typhimurium LT2
ugccgacagaacugauu

SEQ ID NO: 3798066 - RNA, 18 nt, Salmonella typhimurium LT2
ugccgaccgcucggaagu

SEQ ID NO: 3798067 - RNA, 18 nt, Salmonella typhimurium LT2
ugccgagguuaaccgacu

SEQ ID NO: 3798068 - RNA, 19 nt, Salmonella typhimurium LT2
ugccgauaauacgcgcgau

SEQ ID NO: 3798069 - RNA, 18 nt, Salmonella typhimurium LT2
ugccgauaccgggguuca

SEQ ID NO: 3798070 - RNA, 15 nt, Salmonella typhimurium LT2
ugccgaucaccagcg

SEQ ID NO: 3798071 - RNA, 14 nt, Salmonella typhimurium LT2
ugccgaucaugacg

SEQ ID NO: 3798072 - RNA, 13 nt, Salmonella typhimurium LT2
ugccgaugaaaua

SEQ ID NO: 3798073 - RNA, 16 nt, Salmonella typhimurium LT2
ugccgaugccgccgca

SEQ ID NO: 3798074 - RNA, 22 nt, Salmonella typhimurium LT2
ugccgauuccaugcccaguuca

SEQ ID NO: 3798075 - RNA, 19 nt, Salmonella typhimurium LT2
ugccgauugccgcucagcu

SEQ ID NO: 3798076 - RNA, 23 nt, Salmonella typhimurium LT2
ugccgauuuaccucucaccagua

SEQ ID NO: 3798077 - RNA, 15 nt, Salmonella typhimurium LT2
ugccgauuuucuaug

SEQ ID NO: 3798078 - RNA, 22 nt, Salmonella typhimurium LT2
ugccgcaacagaaacuucugca

SEQ ID NO: 3798079 - RNA, 15 nt, Salmonella typhimurium LT2
ugccgcaauaaacac

SEQ ID NO: 3798080 - RNA, 21 nt, Salmonella typhimurium LT2
ugccgcagccgcucaggguaa

SEQ ID NO: 3798081 - RNA, 21 nt, Salmonella typhimurium LT2
ugccgccagaaucaccucuuu

SEQ ID NO: 3798082 - RNA, 15 nt, Salmonella typhimurium LT2
ugccgccagcaguug

SEQ ID NO: 3798083 - RNA, 21 nt, Salmonella typhimurium LT2
ugccgccauaacgccggcgcu

SEQ ID NO: 3798084 - RNA, 13 nt, Salmonella typhimurium LT2
ugccgccaucgcu

SEQ ID NO: 3798085 - RNA, 20 nt, Salmonella typhimurium LT2
ugccgccauucgcuuccgcc

SEQ ID NO: 3798086 - RNA, 17 nt, Salmonella typhimurium LT2
ugcgaguagcaaauccc

SEQ ID NO: 3798087 - RNA, 19 nt, Salmonella typhimurium LT2
ugcgaguuaucuuuuauuu

SEQ ID NO: 3798088 - RNA, 12 nt, Salmonella typhimurium LT2
ugcgauaaccgu

SEQ ID NO: 3798089 - RNA, 17 nt, Salmonella typhimurium LT2
ugcgauaaccguauugc

SEQ ID NO: 3798090 - RNA, 23 nt, Salmonella typhimurium LT2
ugcgaucguaaucacccgcuucc

SEQ ID NO: 3798091 - RNA, 19 nt, Salmonella typhimurium LT2
ugcgaucuccuuuaaugaa

SEQ ID NO: 3798092 - RNA, 16 nt, Salmonella typhimurium LT2
ugcgauuugacaucag

SEQ ID NO: 3798093 - RNA, 20 nt, Salmonella typhimurium LT2
ugcgcaaaaagcccuuugcc

SEQ ID NO: 3798094 - RNA, 21 nt, Salmonella typhimurium LT2
ugcgcaacagcuugcgcccau

SEQ ID NO: 3798095 - RNA, 18 nt, Salmonella typhimurium LT2
ugcgcaacguuucuuuca

SEQ ID NO: 3798096 - RNA, 20 nt, Salmonella typhimurium LT2
ugcgcaaggccguuauccag

SEQ ID NO: 3798097 - RNA, 14 nt, Salmonella typhimurium LT2
ugcgcaauguucau

SEQ ID NO: 3798098 - RNA, 15 nt, Salmonella typhimurium LT2
ugcgcacgccagcgg

SEQ ID NO: 3798099 - RNA, 15 nt, Salmonella typhimurium LT2
ugcgcagauaccggc

SEQ ID NO: 3798100 - RNA, 23 nt, Salmonella typhimurium LT2
ugcgcagauaccggcgcagcauc

SEQ ID NO: 3798101 - RNA, 22 nt, Salmonella typhimurium LT2
ugcgcagccacggcgcacacgc

SEQ ID NO: 3798102 - RNA, 17 nt, Salmonella typhimurium LT2
ugcgcagcguuuccaga

SEQ ID NO: 3798103 - RNA, 18 nt, Salmonella typhimurium LT2
ugcgcagcguuuccagac

SEQ ID NO: 3798104 - RNA, 14 nt, Salmonella typhimurium LT2
ugcgcauuaacgcc

SEQ ID NO: 3798105 - RNA, 14 nt, Salmonella typhimurium LT2
ugcgccaaaucggu

SEQ ID NO: 3798106 - RNA, 19 nt, Salmonella typhimurium LT2
ugcgccaacugcauuucau

SEQ ID NO: 3798107 - RNA, 14 nt, Salmonella typhimurium LT2
ugcgccacaucauu

SEQ ID NO: 3798108 - RNA, 15 nt, Salmonella typhimurium LT2
ugcgccaccaucggg

SEQ ID NO: 3798109 - RNA, 11 nt, Salmonella typhimurium LT2
ugcgccacgac

SEQ ID NO: 3798110 - RNA, 12 nt, Salmonella typhimurium LT2
ugcgccacggau

SEQ ID NO: 3798111 - RNA, 13 nt, Salmonella typhimurium LT2
ugcgccagauuca

SEQ ID NO: 3798112 - RNA, 15 nt, Salmonella typhimurium LT2
ugcgccagcagcggc

SEQ ID NO: 3798113 - RNA, 12 nt, Salmonella typhimurium LT2
ugcgccagcaug

SEQ ID NO: 3798114 - RNA, 15 nt, Salmonella typhimurium LT2
ugcgccagccagcuc

SEQ ID NO: 3798115 - RNA, 20 nt, Salmonella typhimurium LT2
ugcgccagccagucgccagg

SEQ ID NO: 3798116 - RNA, 23 nt, Salmonella typhimurium LT2
ugcgccagccagucgccaggcaa

SEQ ID NO: 3798117 - RNA, 13 nt, Salmonella typhimurium LT2
ugcgccagccgcu

SEQ ID NO: 3798118 - RNA, 22 nt, Salmonella typhimurium LT2
ugcgccagccggauacugcgcu

SEQ ID NO: 3798119 - RNA, 13 nt, Salmonella typhimurium LT2
ugcgccagcgcca

SEQ ID NO: 3798120 - RNA, 15 nt, Salmonella typhimurium LT2
ugcgccagcgcgcgu

SEQ ID NO: 3798121 - RNA, 17 nt, Salmonella typhimurium LT2
ugcgccaguucauccag

SEQ ID NO: 3798122 - RNA, 22 nt, Salmonella typhimurium LT2
ugcgccauauaggcauguuccu

SEQ ID NO: 3798123 - RNA, 22 nt, Salmonella typhimurium LT2
ugcgccauccaccaggcaugca

SEQ ID NO: 3798124 - RNA, 15 nt, Salmonella typhimurium LT2
ugcgccaucgggccg

SEQ ID NO: 3798125 - RNA, 20 nt, Salmonella typhimurium LT2
ugcgccaucuaaauuucagu

SEQ ID NO: 3798126 - RNA, 14 nt, Salmonella typhimurium LT2
ugcgccauuuccag

SEQ ID NO: 3798127 - RNA, 15 nt, Salmonella typhimurium LT2
ugcgcccaucaucau

SEQ ID NO: 3798128 - RNA, 17 nt, Salmonella typhimurium LT2
ugcgcccaucaucaucg

SEQ ID NO: 3798129 - RNA, 19 nt, Salmonella typhimurium LT2
ugcgcccaugcucaccgau

SEQ ID NO: 3798130 - RNA, 21 nt, Salmonella typhimurium LT2
ugcgccccagcaugagccagc

SEQ ID NO: 3798131 - RNA, 22 nt, Salmonella typhimurium LT2
ugcgccccgcaacgccgauaag

SEQ ID NO: 3798132 - RNA, 20 nt, Salmonella typhimurium LT2
ugcgcccgcgaucgcuucca

SEQ ID NO: 3798133 - RNA, 19 nt, Salmonella typhimurium LT2
ugcgccgaauucguuaccc

SEQ ID NO: 3798134 - RNA, 16 nt, Salmonella typhimurium LT2
ugcgccgacaucgcca

SEQ ID NO: 3798135 - RNA, 23 nt, Salmonella typhimurium LT2
ugcgccgacaucgccaccgcaug

SEQ ID NO: 3798136 - RNA, 15 nt, Salmonella typhimurium LT2
ugcgccgcacuucac

SEQ ID NO: 3798137 - RNA, 15 nt, Salmonella typhimurium LT2
ugcgccgcagcgccu

SEQ ID NO: 3798138 - RNA, 16 nt, Salmonella typhimurium LT2
ugcgccgcagcgccug

SEQ ID NO: 3798139 - RNA, 22 nt, Salmonella typhimurium LT2
ugcgccgccgggaucagcggcu

SEQ ID NO: 3798140 - RNA, 18 nt, Salmonella typhimurium LT2
ugcgccgcgaacaucggu

SEQ ID NO: 3798141 - RNA, 12 nt, Salmonella typhimurium LT2
ugcgccgcgccg

SEQ ID NO: 3798142 - RNA, 15 nt, Salmonella typhimurium LT2
ugcgccgcgccgccc

SEQ ID NO: 3798143 - RNA, 15 nt, Salmonella typhimurium LT2
ugcgccuaccgccau

SEQ ID NO: 3798144 - RNA, 14 nt, Salmonella typhimurium LT2
ugcgccucaagcgc

SEQ ID NO: 3798145 - RNA, 13 nt, Salmonella typhimurium LT2
ugcgccucagcca

SEQ ID NO: 3798146 - RNA, 12 nt, Salmonella typhimurium LT2
ugcgccugcuca

SEQ ID NO: 3798147 - RNA, 12 nt, Salmonella typhimurium LT2
ugcgccuggcag

SEQ ID NO: 3798148 - RNA, 13 nt, Salmonella typhimurium LT2
ugcgccuguuagg

SEQ ID NO: 3798149 - RNA, 20 nt, Salmonella typhimurium LT2
ugcgccuuaaaaagaacaag

SEQ ID NO: 3798150 - RNA, 20 nt, Salmonella typhimurium LT2
ugcgccuuacccggccuaca

SEQ ID NO: 3798151 - RNA, 20 nt, Salmonella typhimurium LT2
ugcgccuuaucaagccuaca

SEQ ID NO: 3798152 - RNA, 20 nt, Salmonella typhimurium LT2
ugcgccuuauccggccugua

SEQ ID NO: 3798153 - RNA, 13 nt, Salmonella typhimurium LT2
ugcgccuuccagu

SEQ ID NO: 3798154 - RNA, 19 nt, Salmonella typhimurium LT2
ugcgcgaccacgccagcca

SEQ ID NO: 3798155 - RNA, 21 nt, Salmonella typhimurium LT2
ugcgcgaccacgccagccagc

SEQ ID NO: 3798156 - RNA, 21 nt, Salmonella typhimurium LT2
ugcgcgaucucuuuggccagu

SEQ ID NO: 3798157 - RNA, 18 nt, Salmonella typhimurium LT2
ugcgcgccacgcccagcg

SEQ ID NO: 3798158 - RNA, 21 nt, Salmonella typhimurium LT2
ugcgcgcgagugaucccaaca

SEQ ID NO: 3798159 - RNA, 17 nt, Salmonella typhimurium LT2
ugcgcgcuauguucaug

SEQ ID NO: 3798160 - RNA, 12 nt, Salmonella typhimurium LT2
ugcgcgcuauuc

SEQ ID NO: 3798161 - RNA, 19 nt, Salmonella typhimurium LT2
ugcgcggcaauuuccgcug

SEQ ID NO: 3798162 - RNA, 23 nt, Salmonella typhimurium LT2
ugcgcggcacacuuucaucagcc

SEQ ID NO: 3798163 - RNA, 14 nt, Salmonella typhimurium LT2
ugcgcggcugcgga

SEQ ID NO: 3798164 - RNA, 15 nt, Salmonella typhimurium LT2
ugcgcgggcgguaag

SEQ ID NO: 3798165 - RNA, 20 nt, Salmonella typhimurium LT2
ugcgcgggcguauagccagg

SEQ ID NO: 3798166 - RNA, 17 nt, Salmonella typhimurium LT2
ugcgcgucaggccaggg

SEQ ID NO: 3798167 - RNA, 15 nt, Salmonella typhimurium LT2
ugcgcgucccucucc

SEQ ID NO: 3798168 - RNA, 17 nt, Salmonella typhimurium LT2
ugcgcgucccucuccag

SEQ ID NO: 3798169 - RNA, 19 nt, Salmonella typhimurium LT2
ugcgcgucgccugaaugca

SEQ ID NO: 3798170 - RNA, 16 nt, Salmonella typhimurium LT2
ugcgcgucucucccuc

SEQ ID NO: 3798171 - RNA, 23 nt, Salmonella typhimurium LT2
ugcgcguuccccaacagcgacca

SEQ ID NO: 3798172 - RNA, 17 nt, Salmonella typhimurium LT2
ugcgcguuuagcgccag

SEQ ID NO: 3798173 - RNA, 21 nt, Salmonella typhimurium LT2
ugcgcguuuagcgccagcagc

SEQ ID NO: 3798174 - RNA, 17 nt, Salmonella typhimurium LT2
ugcgcguuuuccaccag

SEQ ID NO: 3798175 - RNA, 12 nt, Salmonella typhimurium LT2
ugcgcuaagcgu

SEQ ID NO: 3798176 - RNA, 20 nt, Salmonella typhimurium LT2
ugcgcuauccgcgcucgcca

SEQ ID NO: 3798177 - RNA, 23 nt, Salmonella typhimurium LT2
ugcgcuauguaagguucccugcg

SEQ ID NO: 3798178 - RNA, 22 nt, Salmonella typhimurium LT2
ugcgcucacgcuuauccggccu

SEQ ID NO: 3798179 - RNA, 18 nt, Salmonella typhimurium LT2
ugcgcucauaaccgcgau

SEQ ID NO: 3798180 - RNA, 22 nt, Salmonella typhimurium LT2
ugcgcuccagcuucaucaucag

SEQ ID NO: 3798181 - RNA, 13 nt, Salmonella typhimurium LT2
ugcgcucgcgcca

SEQ ID NO: 3798182 - RNA, 17 nt, Salmonella typhimurium LT2
ugcgcucuaucaccgcc

SEQ ID NO: 3798183 - RNA, 14 nt, Salmonella typhimurium LT2
ugcgcuggaacgcg

SEQ ID NO: 3798184 - RNA, 15 nt, Salmonella typhimurium LT2
ugcgcugucaccagc

SEQ ID NO: 3798185 - RNA, 16 nt, Salmonella typhimurium LT2
ugcgcugucaccagca

SEQ ID NO: 3798186 - RNA, 16 nt, Salmonella typhimurium LT2
ugcgcugugacaggcg

SEQ ID NO: 3798187 - RNA, 19 nt, Salmonella typhimurium LT2
ugcgcuuaccaggccuaca

SEQ ID NO: 3798188 - RNA, 20 nt, Salmonella typhimurium LT2
ugcgcuuaucaggccuacgu

SEQ ID NO: 3798189 - RNA, 20 nt, Salmonella typhimurium LT2
ugcgcuuauccggccuacgg

SEQ ID NO: 3798190 - RNA, 13 nt, Salmonella typhimurium LT2
ugcucccacagcu

SEQ ID NO: 3798191 - RNA, 13 nt, Salmonella typhimurium LT2
ugcuccgccagag

SEQ ID NO: 3798192 - RNA, 14 nt, Salmonella typhimurium LT2
ugcuccgccagcaa

SEQ ID NO: 3798193 - RNA, 22 nt, Salmonella typhimurium LT2
ugcuccggcuuaaugcccggcc

SEQ ID NO: 3798194 - RNA, 12 nt, Salmonella typhimurium LT2
ugcuccgggccg

SEQ ID NO: 3798195 - RNA, 14 nt, Salmonella typhimurium LT2
ugcucgacaauaaa

SEQ ID NO: 3798196 - RNA, 21 nt, Salmonella typhimurium LT2
ugcucgccauaaaucgcggcg

SEQ ID NO: 3798197 - RNA, 17 nt, Salmonella typhimurium LT2
ugcucguaccaggcccc

SEQ ID NO: 3798198 - RNA, 19 nt, Salmonella typhimurium LT2
ugcucguagcguuuaaaga

SEQ ID NO: 3798199 - RNA, 13 nt, Salmonella typhimurium LT2
ugcucguuuuuau

SEQ ID NO: 3798200 - RNA, 12 nt, Salmonella typhimurium LT2
ugcucucaggca

SEQ ID NO: 3798201 - RNA, 23 nt, Salmonella typhimurium LT2
ugcucucccagcugagcuaauca

SEQ ID NO: 3798202 - RNA, 17 nt, Salmonella typhimurium LT2
ugcucugcugugccagu

SEQ ID NO: 3798203 - RNA, 19 nt, Salmonella typhimurium LT2
ugcucuggacguugagcgu

SEQ ID NO: 3798204 - RNA, 17 nt, Salmonella typhimurium LT2
ugcucuugucagaagaa

SEQ ID NO: 3798205 - RNA, 13 nt, Salmonella typhimurium LT2
ugcucuuuaacaa

SEQ ID NO: 3798206 - RNA, 12 nt, Salmonella typhimurium LT2
ugcucuuuuguc

SEQ ID NO: 3798207 - RNA, 15 nt, Salmonella typhimurium LT2
ugcugaaaugauaag

SEQ ID NO: 3798208 - RNA, 20 nt, Salmonella typhimurium LT2
ugcugaaaugauaagugaua

SEQ ID NO: 3798209 - RNA, 16 nt, Salmonella typhimurium LT2
ugcugaagauaaaauu

SEQ ID NO: 3798210 - RNA, 19 nt, Salmonella typhimurium LT2
ugcugaauauugucggcgu

SEQ ID NO: 3798211 - RNA, 21 nt, Salmonella typhimurium LT2
ugcugacaaaauaaagugaaa

SEQ ID NO: 3798212 - RNA, 18 nt, Salmonella typhimurium LT2
ugcugacaaucugcugga

SEQ ID NO: 3798213 - RNA, 20 nt, Salmonella typhimurium LT2
ugcugacauuccuuuuaauu

SEQ ID NO: 3798214 - RNA, 12 nt, Salmonella typhimurium LT2
ugcugacgcuga

SEQ ID NO: 3798215 - RNA, 16 nt, Salmonella typhimurium LT2
ugcugacguaaauucu

SEQ ID NO: 3798216 - RNA, 15 nt, Salmonella typhimurium LT2
ugcugagcagccagc

SEQ ID NO: 3798217 - RNA, 23 nt, Salmonella typhimurium LT2
ugcugauaguccaguacccgcac

SEQ ID NO: 3798218 - RNA, 21 nt, Salmonella typhimurium LT2
ugcugauguccgcagccgcau

SEQ ID NO: 3798219 - RNA, 14 nt, Salmonella typhimurium LT2
ugcugcaccgcauc

SEQ ID NO: 3798220 - RNA, 16 nt, Salmonella typhimurium LT2
ugcugcacgccgcgcu

SEQ ID NO: 3798221 - RNA, 22 nt, Salmonella typhimurium LT2
ugcugcagacugccggcaaaac

SEQ ID NO: 3798222 - RNA, 16 nt, Salmonella typhimurium LT2
ugcugccagucugccc

SEQ ID NO: 3798223 - RNA, 15 nt, Salmonella typhimurium LT2
ugcugcccgccgcca

SEQ ID NO: 3798224 - RNA, 16 nt, Salmonella typhimurium LT2
ugcugcccgccgccag

SEQ ID NO: 3798225 - RNA, 19 nt, Salmonella typhimurium LT2
ugcugcgaggccaacggcc

SEQ ID NO: 3798226 - RNA, 20 nt, Salmonella typhimurium LT2
ugcugcgcaacgagugcuca

SEQ ID NO: 3798227 - RNA, 13 nt, Salmonella typhimurium LT2
ugcugcgccagcc

SEQ ID NO: 3798228 - RNA, 23 nt, Salmonella typhimurium LT2
ugcugcgcuuuccaggccagcga

SEQ ID NO: 3798229 - RNA, 14 nt, Salmonella typhimurium LT2
ugcugcgcuuuguc

SEQ ID NO: 3798230 - RNA, 17 nt, Salmonella typhimurium LT2
ugcugcguaaccgccag

SEQ ID NO: 3798231 - RNA, 13 nt, Salmonella typhimurium LT2
ugcugcuguuacc

SEQ ID NO: 3798232 - RNA, 17 nt, Salmonella typhimurium LT2
ugcugcuucgcugacga

SEQ ID NO: 3798233 - RNA, 17 nt, Salmonella typhimurium LT2
ugcuggaaacgcggccc

SEQ ID NO: 3798234 - RNA, 14 nt, Salmonella typhimurium LT2
ugcuggcgaugagu

SEQ ID NO: 3798235 - RNA, 20 nt, Salmonella typhimurium LT2
ugcuggcgcuacguuuguca

SEQ ID NO: 3798236 - RNA, 22 nt, Salmonella typhimurium LT2
ugcuggcgcuacguuugucagu

SEQ ID NO: 3798237 - RNA, 16 nt, Salmonella typhimurium LT2
ugcuggcgugaaccgg

SEQ ID NO: 3798238 - RNA, 14 nt, Salmonella typhimurium LT2
ugcuggcuuugcug

SEQ ID NO: 3798239 - RNA, 18 nt, Salmonella typhimurium LT2
ugcuggguuaacgcgcca

SEQ ID NO: 3798240 - RNA, 20 nt, Salmonella typhimurium LT2
ugcuggucagcaacgccucc

SEQ ID NO: 3798241 - RNA, 19 nt, Salmonella typhimurium LT2
ugcuggugaagacgcugca

SEQ ID NO: 3798242 - RNA, 14 nt, Salmonella typhimurium LT2
ugcugguuaacucu

SEQ ID NO: 3798243 - RNA, 17 nt, Salmonella typhimurium LT2
ugcuguaaguuuccguc

SEQ ID NO: 3798244 - RNA, 15 nt, Salmonella typhimurium LT2
ugcuguacauaucca

SEQ ID NO: 3798245 - RNA, 18 nt, Salmonella typhimurium LT2
ugcuguagcucagguucg

SEQ ID NO: 3798246 - RNA, 22 nt, Salmonella typhimurium LT2
ugcuguagcugcccggauaacc

SEQ ID NO: 3798247 - RNA, 22 nt, Salmonella typhimurium LT2
ugcuguauaaacucagcaauau

SEQ ID NO: 3798248 - RNA, 18 nt, Salmonella typhimurium LT2
ugcuguauuaacagcuuc

SEQ ID NO: 3798249 - RNA, 16 nt, Salmonella typhimurium LT2
ugcuguccgccagcaa

SEQ ID NO: 3798250 - RNA, 18 nt, Salmonella typhimurium LT2
ugcugucgcccauugaaa

SEQ ID NO: 3798251 - RNA, 18 nt, Salmonella typhimurium LT2
ugcuguugcggaauacac

SEQ ID NO: 3798252 - RNA, 21 nt, Salmonella typhimurium LT2
ugcuuaagccagccaaagcug

SEQ ID NO: 3798253 - RNA, 21 nt, Salmonella typhimurium LT2
ugcuuaauccccgauaucgcu

SEQ ID NO: 3798254 - RNA, 14 nt, Salmonella typhimurium LT2
ugcuuaauucauaa

SEQ ID NO: 3798255 - RNA, 13 nt, Salmonella typhimurium LT2
ugcuuaccagacc

SEQ ID NO: 3798256 - RNA, 20 nt, Salmonella typhimurium LT2
ugcuuaccuuguucuuccau

SEQ ID NO: 3798257 - RNA, 16 nt, Salmonella typhimurium LT2
ugcuuaucgccaaacc

SEQ ID NO: 3798258 - RNA, 19 nt, Salmonella typhimurium LT2
ugcuuaucgccaaaccaga

SEQ ID NO: 3798259 - RNA, 22 nt, Salmonella typhimurium LT2
ugcuuaucgccaaaccagaccc

SEQ ID NO: 3798260 - RNA, 18 nt, Salmonella typhimurium LT2
ugcuuauguaggccugau

SEQ ID NO: 3798261 - RNA, 21 nt, Salmonella typhimurium LT2
ugcuuauuauuuuuucuuuaa

SEQ ID NO: 3798262 - RNA, 19 nt, Salmonella typhimurium LT2
ugcuucaccgcuuucaaaa

SEQ ID NO: 3798263 - RNA, 16 nt, Salmonella typhimurium LT2
ugcuucauaucgccau

SEQ ID NO: 3798264 - RNA, 14 nt, Salmonella typhimurium LT2
ugcuucaugcacaa

SEQ ID NO: 3798265 - RNA, 22 nt, Salmonella typhimurium LT2
ugcuucaugcacaaaacccgca

SEQ ID NO: 3798266 - RNA, 19 nt, Salmonella typhimurium LT2
ugcuuccagcuccauccac

SEQ ID NO: 3798267 - RNA, 15 nt, Salmonella typhimurium LT2
ugcuuccgccuucuc

SEQ ID NO: 3798268 - RNA, 16 nt, Salmonella typhimurium LT2
ugcuuccggcagguuc

SEQ ID NO: 3798269 - RNA, 16 nt, Salmonella typhimurium LT2
ugcuuccuugauauuu

SEQ ID NO: 3798270 - RNA, 16 nt, Salmonella typhimurium LT2
ugcuucguccagaucc

SEQ ID NO: 3798271 - RNA, 13 nt, Salmonella typhimurium LT2
ugcuucucuucaa

SEQ ID NO: 3798272 - RNA, 13 nt, Salmonella typhimurium LT2
ugcuuuauaaaaa

SEQ ID NO: 3798273 - RNA, 15 nt, Salmonella typhimurium LT2
ugcuuucaauaagca

SEQ ID NO: 3798274 - RNA, 13 nt, Salmonella typhimurium LT2
ugcuuucgccagc

SEQ ID NO: 3798275 - RNA, 14 nt, Salmonella typhimurium LT2
ugcuuucgccagcc

SEQ ID NO: 3798276 - RNA, 19 nt, Salmonella typhimurium LT2
ugcuuucgcgauaaucaac

SEQ ID NO: 3798277 - RNA, 21 nt, Salmonella typhimurium LT2
ugcuuuggccgguucggccag

SEQ ID NO: 3798278 - RNA, 13 nt, Salmonella typhimurium LT2
uggaaaagaaaac

SEQ ID NO: 3798279 - RNA, 18 nt, Salmonella typhimurium LT2
uggaaaagagcgucguua

SEQ ID NO: 3798280 - RNA, 19 nt, Salmonella typhimurium LT2
uggaaaaucagcgacuggu

SEQ ID NO: 3798281 - RNA, 21 nt, Salmonella typhimurium LT2
uggaaaaucagcgacugguca

SEQ ID NO: 3798282 - RNA, 18 nt, Salmonella typhimurium LT2
uggaaaggaugcagcauc

SEQ ID NO: 3798283 - RNA, 19 nt, Salmonella typhimurium LT2
uggaaauaaucuguagauu

SEQ ID NO: 3798284 - RNA, 15 nt, Salmonella typhimurium LT2
uggaaauguucucag

SEQ ID NO: 3798285 - RNA, 23 nt, Salmonella typhimurium LT2
uggaacagauguuuacgcugcuc

SEQ ID NO: 3798286 - RNA, 18 nt, Salmonella typhimurium LT2
uggaaccagguuuccaga

SEQ ID NO: 3798287 - RNA, 14 nt, Salmonella typhimurium LT2
uggaagaaaauaua

SEQ ID NO: 3798288 - RNA, 12 nt, Salmonella typhimurium LT2
uggaagacuuca

SEQ ID NO: 3798289 - RNA, 15 nt, Salmonella typhimurium LT2
uggaagagaauuuuu

SEQ ID NO: 3798290 - RNA, 15 nt, Salmonella typhimurium LT2
uggaagcggaacuga

SEQ ID NO: 3798291 - RNA, 19 nt, Salmonella typhimurium LT2
uggaagcuacaggucgacg

SEQ ID NO: 3798292 - RNA, 22 nt, Salmonella typhimurium LT2
uggaagguauucaucgugccag

SEQ ID NO: 3798293 - RNA, 22 nt, Salmonella typhimurium LT2
uggaaguacgccucgcgcacca

SEQ ID NO: 3798294 - RNA, 21 nt, Salmonella typhimurium LT2
uggcccgcuuuuuuuauucag

SEQ ID NO: 3798295 - RNA, 17 nt, Salmonella typhimurium LT2
uggcccguuucgggcgc

SEQ ID NO: 3798296 - RNA, 22 nt, Salmonella typhimurium LT2
uggccgaugucaauuacgcacc

SEQ ID NO: 3798297 - RNA, 14 nt, Salmonella typhimurium LT2
uggccgccagagag

SEQ ID NO: 3798298 - RNA, 19 nt, Salmonella typhimurium LT2
uggccgcgugcucgcggcg

SEQ ID NO: 3798299 - RNA, 19 nt, Salmonella typhimurium LT2
uggccgcuuugcgaacagc

SEQ ID NO: 3798300 - RNA, 20 nt, Salmonella typhimurium LT2
uggccgucucuuucauggaa

SEQ ID NO: 3798301 - RNA, 14 nt, Salmonella typhimurium LT2
uggccguggugaag

SEQ ID NO: 3798302 - RNA, 17 nt, Salmonella typhimurium LT2
uggccuagaugaaugac

SEQ ID NO: 3798303 - RNA, 19 nt, Salmonella typhimurium LT2
uggccuagaugaaugacug

SEQ ID NO: 3798304 - RNA, 12 nt, Salmonella typhimurium LT2
uggccucauccg

SEQ ID NO: 3798305 - RNA, 14 nt, Salmonella typhimurium LT2
uggccuccagcacu

SEQ ID NO: 3798306 - RNA, 16 nt, Salmonella typhimurium LT2
uggccucccaguuccc

SEQ ID NO: 3798307 - RNA, 14 nt, Salmonella typhimurium LT2
uggccucugccagu

SEQ ID NO: 3798308 - RNA, 16 nt, Salmonella typhimurium LT2
uggccugcuuaaacag

SEQ ID NO: 3798309 - RNA, 19 nt, Salmonella typhimurium LT2
uggccugcuuaaacagaau

SEQ ID NO: 3798310 - RNA, 19 nt, Salmonella typhimurium LT2
uggccuuuuuuauggcuuu

SEQ ID NO: 3798311 - RNA, 14 nt, Salmonella typhimurium LT2
uggcgaaacgccug

SEQ ID NO: 3798312 - RNA, 20 nt, Salmonella typhimurium LT2
uggcgaacagccccaccgcc

SEQ ID NO: 3798313 - RNA, 19 nt, Salmonella typhimurium LT2
uggcgaacgacucacgcgc

SEQ ID NO: 3798314 - RNA, 23 nt, Salmonella typhimurium LT2
uggcgaacguuacccggccagcc

SEQ ID NO: 3798315 - RNA, 13 nt, Salmonella typhimurium LT2
uggcgaauacugu

SEQ ID NO: 3798316 - RNA, 22 nt, Salmonella typhimurium LT2
uggcgaauacuguuccaggcga

SEQ ID NO: 3798317 - RNA, 14 nt, Salmonella typhimurium LT2
uggcgaauagcgcc

SEQ ID NO: 3798318 - RNA, 14 nt, Salmonella typhimurium LT2
uggcgacaaucaau

SEQ ID NO: 3798319 - RNA, 12 nt, Salmonella typhimurium LT2
uggcgacagacg

SEQ ID NO: 3798320 - RNA, 15 nt, Salmonella typhimurium LT2
uggcgaccgggucga

SEQ ID NO: 3798321 - RNA, 18 nt, Salmonella typhimurium LT2
uggcgacgaucagcgcca

SEQ ID NO: 3798322 - RNA, 21 nt, Salmonella typhimurium LT2
uggcgacgcaggcgccuuauc

SEQ ID NO: 3798323 - RNA, 18 nt, Salmonella typhimurium LT2
uggcgacgccuucaguca

SEQ ID NO: 3798324 - RNA, 14 nt, Salmonella typhimurium LT2
uggcgacggcgguc

SEQ ID NO: 3798325 - RNA, 22 nt, Salmonella typhimurium LT2
uggcgaggcuuuguccuuugcu

SEQ ID NO: 3798326 - RNA, 19 nt, Salmonella typhimurium LT2
uggcgauaaagucaugacg

SEQ ID NO: 3798327 - RNA, 22 nt, Salmonella typhimurium LT2
uggcgauaauagaaccgaacaa

SEQ ID NO: 3798328 - RNA, 20 nt, Salmonella typhimurium LT2
uggcgauaggggauaucgcu

SEQ ID NO: 3798329 - RNA, 16 nt, Salmonella typhimurium LT2
uggcgaucacaauuac

SEQ ID NO: 3798330 - RNA, 15 nt, Salmonella typhimurium LT2
uggcgaucaccagca

SEQ ID NO: 3798331 - RNA, 14 nt, Salmonella typhimurium LT2
uggcgaucaggcag

SEQ ID NO: 3798332 - RNA, 21 nt, Salmonella typhimurium LT2
uggcgaugcuaucgguagugu

SEQ ID NO: 3798333 - RNA, 14 nt, Salmonella typhimurium LT2
uggcgauuuccagc

SEQ ID NO: 3798334 - RNA, 16 nt, Salmonella typhimurium LT2
uggcgauuuccagcga

SEQ ID NO: 3798335 - RNA, 19 nt, Salmonella typhimurium LT2
uggcgcaaaugggccuacg

SEQ ID NO: 3798336 - RNA, 20 nt, Salmonella typhimurium LT2
uggcgcacaguacgcggccg

SEQ ID NO: 3798337 - RNA, 23 nt, Salmonella typhimurium LT2
uggcgcagcuucugauacugcuc

SEQ ID NO: 3798338 - RNA, 16 nt, Salmonella typhimurium LT2
uggcgcaggccaggcg

SEQ ID NO: 3798339 - RNA, 12 nt, Salmonella typhimurium LT2
uggcgccaauau

SEQ ID NO: 3798340 - RNA, 17 nt, Salmonella typhimurium LT2
uggcgccaccgcugcgc

SEQ ID NO: 3798341 - RNA, 19 nt, Salmonella typhimurium LT2
uggcgcccgguucgaacga

SEQ ID NO: 3798342 - RNA, 21 nt, Salmonella typhimurium LT2
uggcgccuuuuggcagcagcg

SEQ ID NO: 3798343 - RNA, 18 nt, Salmonella typhimurium LT2
uggcgcgacgcuuaucag

SEQ ID NO: 3798344 - RNA, 15 nt, Salmonella typhimurium LT2
uggcgcgccacuucu

SEQ ID NO: 3798345 - RNA, 23 nt, Salmonella typhimurium LT2
uggcgcgcuaucaagauaaaaag

SEQ ID NO: 3798346 - RNA, 18 nt, Salmonella typhimurium LT2
uggcgcugcgcuuaucag

SEQ ID NO: 3798347 - RNA, 19 nt, Salmonella typhimurium LT2
uggcgcuggcgcuuaccgg

SEQ ID NO: 3798348 - RNA, 17 nt, Salmonella typhimurium LT2
uggcgcugucgcuuacc

SEQ ID NO: 3798349 - RNA, 17 nt, Salmonella typhimurium LT2
uggcgcuuaauacgcga

SEQ ID NO: 3798350 - RNA, 18 nt, Salmonella typhimurium LT2
uggcgcuucgcuuaucag

SEQ ID NO: 3798351 - RNA, 17 nt, Salmonella typhimurium LT2
uggcgcuucgcuuaucg

SEQ ID NO: 3798352 - RNA, 16 nt, Salmonella typhimurium LT2
uggcgcuugcuuaucg

SEQ ID NO: 3798353 - RNA, 20 nt, Salmonella typhimurium LT2
uggcgcuuuaagugcaucgc

SEQ ID NO: 3798354 - RNA, 18 nt, Salmonella typhimurium LT2
uggcgcuuugcuuauccg

SEQ ID NO: 3798355 - RNA, 14 nt, Salmonella typhimurium LT2
uggcggaaaauagc

SEQ ID NO: 3798356 - RNA, 14 nt, Salmonella typhimurium LT2
uggcggaaagaagc

SEQ ID NO: 3798357 - RNA, 13 nt, Salmonella typhimurium LT2
uggcggaacugcg

SEQ ID NO: 3798358 - RNA, 22 nt, Salmonella typhimurium LT2
uggcggaauugguagacgcgcu

SEQ ID NO: 3798359 - RNA, 18 nt, Salmonella typhimurium LT2
uggcggagaucuccagau

SEQ ID NO: 3798360 - RNA, 17 nt, Salmonella typhimurium LT2
uggcggcaaaaacgccg

SEQ ID NO: 3798361 - RNA, 16 nt, Salmonella typhimurium LT2
uggcggcaagaucauc

SEQ ID NO: 3798362 - RNA, 15 nt, Salmonella typhimurium LT2
uggcggcauaauaug

SEQ ID NO: 3798363 - RNA, 22 nt, Salmonella typhimurium LT2
uggcggcgaaacgccuuauccg

SEQ ID NO: 3798364 - RNA, 23 nt, Salmonella typhimurium LT2
uggcggcgcgaacgccuuauccg

SEQ ID NO: 3798365 - RNA, 23 nt, Salmonella typhimurium LT2
uggcggcggaaaggacuuaucag

SEQ ID NO: 3798366 - RNA, 16 nt, Salmonella typhimurium LT2
uggcggcggcguuaca

SEQ ID NO: 3798367 - RNA, 23 nt, Salmonella typhimurium LT2
uggcggcgugaacgucuuauccg

SEQ ID NO: 3798368 - RNA, 23 nt, Salmonella typhimurium LT2
uggcggcgugaccgccuuauccg

SEQ ID NO: 3798369 - RNA, 22 nt, Salmonella typhimurium LT2
uggcggcuaccucuuauccggc

SEQ ID NO: 3798370 - RNA, 14 nt, Salmonella typhimurium LT2
uggcggcugaugcc

SEQ ID NO: 3798371 - RNA, 20 nt, Salmonella typhimurium LT2
uggcggcugcgccuuauccg

SEQ ID NO: 3798372 - RNA, 16 nt, Salmonella typhimurium LT2
uggcggcuucgccauc

SEQ ID NO: 3798373 - RNA, 17 nt, Salmonella typhimurium LT2
uggcgguauaacugccu

SEQ ID NO: 3798374 - RNA, 16 nt, Salmonella typhimurium LT2
uggcgguauaguccgu

SEQ ID NO: 3798375 - RNA, 15 nt, Salmonella typhimurium LT2
uggcggucaacgcgg

SEQ ID NO: 3798376 - RNA, 16 nt, Salmonella typhimurium LT2
uggcgguugccacugc

SEQ ID NO: 3798377 - RNA, 15 nt, Salmonella typhimurium LT2
uggcguaaacgccau

SEQ ID NO: 3798378 - RNA, 16 nt, Salmonella typhimurium LT2
uggcguaaaucaggcc

SEQ ID NO: 3798379 - RNA, 19 nt, Salmonella typhimurium LT2
uggcguaaaugugcgccag

SEQ ID NO: 3798380 - RNA, 17 nt, Salmonella typhimurium LT2
uggcguacgcauccgcg

SEQ ID NO: 3798381 - RNA, 20 nt, Salmonella typhimurium LT2
uggcguacgguuggaucggc

SEQ ID NO: 3798382 - RNA, 18 nt, Salmonella typhimurium LT2
uggcguagaagcuuacca

SEQ ID NO: 3798383 - RNA, 17 nt, Salmonella typhimurium LT2
uggcgucagaccggcaa

SEQ ID NO: 3798384 - RNA, 18 nt, Salmonella typhimurium LT2
uggcgucagaccggcaau

SEQ ID NO: 3798385 - RNA, 22 nt, Salmonella typhimurium LT2
uggcgucgauaauugcgcgcgu

SEQ ID NO: 3798386 - RNA, 21 nt, Salmonella typhimurium LT2
uggcgucgccaaagcagcugc

SEQ ID NO: 3798387 - RNA, 13 nt, Salmonella typhimurium LT2
uggcgucucagcg

SEQ ID NO: 3798388 - RNA, 17 nt, Salmonella typhimurium LT2
uggcgugaaccgguaaa

SEQ ID NO: 3798389 - RNA, 17 nt, Salmonella typhimurium LT2
uggcguggauagccauc

SEQ ID NO: 3798390 - RNA, 19 nt, Salmonella typhimurium LT2
uggcguuaacggcgccacg

SEQ ID NO: 3798391 - RNA, 19 nt, Salmonella typhimurium LT2
uggcguuccacccaguuca

SEQ ID NO: 3798392 - RNA, 21 nt, Salmonella typhimurium LT2
uggcguuccgguugccgagcc

SEQ ID NO: 3798393 - RNA, 15 nt, Salmonella typhimurium LT2
uggcuaaauaagguc

SEQ ID NO: 3798394 - RNA, 15 nt, Salmonella typhimurium LT2
uggcuaacgggcuga

SEQ ID NO: 3798395 - RNA, 21 nt, Salmonella typhimurium LT2
uggcuaccgggcgcaaucauc

SEQ ID NO: 3798396 - RNA, 18 nt, Salmonella typhimurium LT2
uggcuaucccgaugcuca

SEQ ID NO: 3798397 - RNA, 23 nt, Salmonella typhimurium LT2
uggugcagugcacugccugaugg

SEQ ID NO: 3798398 - RNA, 21 nt, Salmonella typhimurium LT2
uggugcguucaauuggacucg

SEQ ID NO: 3798399 - RNA, 13 nt, Salmonella typhimurium LT2
uggugcuuagcug

SEQ ID NO: 3798400 - RNA, 16 nt, Salmonella typhimurium LT2
ugguggcgaauacugu

SEQ ID NO: 3798401 - RNA, 21 nt, Salmonella typhimurium LT2
uggugggacuguucagcugac

SEQ ID NO: 3798402 - RNA, 15 nt, Salmonella typhimurium LT2
ugguguaggcguagc

SEQ ID NO: 3798403 - RNA, 15 nt, Salmonella typhimurium LT2
uggugugaacaucac

SEQ ID NO: 3798404 - RNA, 15 nt, Salmonella typhimurium LT2
uggugugcauggugu

SEQ ID NO: 3798405 - RNA, 16 nt, Salmonella typhimurium LT2
ugguguuaguuucuau

SEQ ID NO: 3798406 - RNA, 20 nt, Salmonella typhimurium LT2
ugguguucagauggccgaug

SEQ ID NO: 3798407 - RNA, 15 nt, Salmonella typhimurium LT2
ugguguugguacaca

SEQ ID NO: 3798408 - RNA, 22 nt, Salmonella typhimurium LT2
ugguuaaauucauauuuaaaua

SEQ ID NO: 3798409 - RNA, 16 nt, Salmonella typhimurium LT2
ugguuaacucaagcga

SEQ ID NO: 3798410 - RNA, 16 nt, Salmonella typhimurium LT2
ugguuaauacaucaac

SEQ ID NO: 3798411 - RNA, 16 nt, Salmonella typhimurium LT2
ugguuaauuaaauguu

SEQ ID NO: 3798412 - RNA, 15 nt, Salmonella typhimurium LT2
ugguuaauuccgcau

SEQ ID NO: 3798413 - RNA, 14 nt, Salmonella typhimurium LT2
ugguuacgcgacgu

SEQ ID NO: 3798414 - RNA, 16 nt, Salmonella typhimurium LT2
ugguuacuauuuuuca

SEQ ID NO: 3798415 - RNA, 22 nt, Salmonella typhimurium LT2
ugguuacuggcuaguauauuaa

SEQ ID NO: 3798416 - RNA, 18 nt, Salmonella typhimurium LT2
ugguuagaauaccugccu

SEQ ID NO: 3798417 - RNA, 16 nt, Salmonella typhimurium LT2
ugguuauccagcagcc

SEQ ID NO: 3798418 - RNA, 15 nt, Salmonella typhimurium LT2
ugguucaaaaugccc

SEQ ID NO: 3798419 - RNA, 18 nt, Salmonella typhimurium LT2
ugguucaacaucagcgcu

SEQ ID NO: 3798420 - RNA, 19 nt, Salmonella typhimurium LT2
ugguucaacaucagcgcua

SEQ ID NO: 3798421 - RNA, 15 nt, Salmonella typhimurium LT2
ugguuccgccguuaa

SEQ ID NO: 3798422 - RNA, 21 nt, Salmonella typhimurium LT2
ugguugcgaaccgcacagauu

SEQ ID NO: 3798423 - RNA, 16 nt, Salmonella typhimurium LT2
ugguugcuucguccag

SEQ ID NO: 3798424 - RNA, 17 nt, Salmonella typhimurium LT2
ugguuguccugguacau

SEQ ID NO: 3798425 - RNA, 23 nt, Salmonella typhimurium LT2
ugguugugccaguaaucccgguc

SEQ ID NO: 3798426 - RNA, 18 nt, Salmonella typhimurium LT2
ugguuuaaacucugaaaa

SEQ ID NO: 3798427 - RNA, 22 nt, Salmonella typhimurium LT2
ugguuuaaacucugaaaacggu

SEQ ID NO: 3798428 - RNA, 13 nt, Salmonella typhimurium LT2
ugguuucccugcc

SEQ ID NO: 3798429 - RNA, 16 nt, Salmonella typhimurium LT2
ugguuucccugccuca

SEQ ID NO: 3798430 - RNA, 13 nt, Salmonella typhimurium LT2
ugguuucggcgua

SEQ ID NO: 3798431 - RNA, 23 nt, Salmonella typhimurium LT2
ugguuugccgcauacaucgcaga

SEQ ID NO: 3798432 - RNA, 22 nt, Salmonella typhimurium LT2
ugguuuuaagcuucuuauuauc

SEQ ID NO: 3798433 - RNA, 16 nt, Salmonella typhimurium LT2
uguaaaaaaauaaaaa

SEQ ID NO: 3798434 - RNA, 13 nt, Salmonella typhimurium LT2
uguaaaaaugccu

SEQ ID NO: 3798435 - RNA, 21 nt, Salmonella typhimurium LT2
uguaaaacgguaugaaacaua

SEQ ID NO: 3798436 - RNA, 12 nt, Salmonella typhimurium LT2
uguaaaccggcc

SEQ ID NO: 3798437 - RNA, 22 nt, Salmonella typhimurium LT2
uguaaagaaugaaaaaaaauua

SEQ ID NO: 3798438 - RNA, 12 nt, Salmonella typhimurium LT2
uguaaagcgcca

SEQ ID NO: 3798439 - RNA, 22 nt, Salmonella typhimurium LT2
uguaaaggccucgcacccugcg

SEQ ID NO: 3798440 - RNA, 22 nt, Salmonella typhimurium LT2
uguaaagucggccauuuuuuua

SEQ ID NO: 3798441 - RNA, 22 nt, Salmonella typhimurium LT2
uguaaauaacgccagaucucac

SEQ ID NO: 3798442 - RNA, 10 nt, Salmonella typhimurium LT2
uguaaaucug

SEQ ID NO: 3798443 - RNA, 23 nt, Salmonella typhimurium LT2
uguaaauuuguuuaaucauaaaa

SEQ ID NO: 3798444 - RNA, 20 nt, Salmonella typhimurium LT2
uguaacagcaggacccgaga

SEQ ID NO: 3798445 - RNA, 16 nt, Salmonella typhimurium LT2
uguaacauauuuuuau

SEQ ID NO: 3798446 - RNA, 16 nt, Salmonella typhimurium LT2
uguaaccaaagcacca

SEQ ID NO: 3798447 - RNA, 17 nt, Salmonella typhimurium LT2
uguaaccaacaaacgcg

SEQ ID NO: 3798448 - RNA, 18 nt, Salmonella typhimurium LT2
uguaaccuuaaaaggcgc

SEQ ID NO: 3798449 - RNA, 22 nt, Salmonella typhimurium LT2
uguaacgggugaucuuuauaaa

SEQ ID NO: 3798450 - RNA, 19 nt, Salmonella typhimurium LT2
uguaacuucggccagcgag

SEQ ID NO: 3798451 - RNA, 18 nt, Salmonella typhimurium LT2
uguaagagguauccugaa

SEQ ID NO: 3798452 - RNA, 21 nt, Salmonella typhimurium LT2
uguaagggaggugcucuccca

SEQ ID NO: 3798453 - RNA, 22 nt, Salmonella typhimurium LT2
uguaagggaggugcucucccag

SEQ ID NO: 3798454 - RNA, 20 nt, Salmonella typhimurium LT2
uguaaguuacuaaaaguaaa

SEQ ID NO: 3798455 - RNA, 16 nt, Salmonella typhimurium LT2
uguaauaaacagcguu

SEQ ID NO: 3798456 - RNA, 17 nt, Salmonella typhimurium LT2
uguaauaauuuaaaauu

SEQ ID NO: 3798457 - RNA, 17 nt, Salmonella typhimurium LT2
uguaaugcuugcugcuu

SEQ ID NO: 3798458 - RNA, 21 nt, Salmonella typhimurium LT2
uguaauguuuucugccagcag

SEQ ID NO: 3798459 - RNA, 18 nt, Salmonella typhimurium LT2
uguaauucaccaaauccu

SEQ ID NO: 3798460 - RNA, 22 nt, Salmonella typhimurium LT2
uguaauucucacagaaucauca

SEQ ID NO: 3798461 - RNA, 22 nt, Salmonella typhimurium LT2
uguaauugaggauugccgccuu

SEQ ID NO: 3798462 - RNA, 20 nt, Salmonella typhimurium LT2
uguacacaauugccaugguu

SEQ ID NO: 3798463 - RNA, 19 nt, Salmonella typhimurium LT2
uguacagcaauaaaaggaa

SEQ ID NO: 3798464 - RNA, 12 nt, Salmonella typhimurium LT2
uguacauccagg

SEQ ID NO: 3798465 - RNA, 15 nt, Salmonella typhimurium LT2
uguaccaacugcugc

SEQ ID NO: 3798466 - RNA, 16 nt, Salmonella typhimurium LT2
uguaccaacugcugcg

SEQ ID NO: 3798467 - RNA, 16 nt, Salmonella typhimurium LT2
uguaccagcaacgcca

SEQ ID NO: 3798468 - RNA, 17 nt, Salmonella typhimurium LT2
uguaccugauccagcuc

SEQ ID NO: 3798469 - RNA, 19 nt, Salmonella typhimurium LT2
uguaccugauccagcucuu

SEQ ID NO: 3798470 - RNA, 13 nt, Salmonella typhimurium LT2
uguacgacuggau

SEQ ID NO: 3798471 - RNA, 15 nt, Salmonella typhimurium LT2
uguacgcugaacaac

SEQ ID NO: 3798472 - RNA, 20 nt, Salmonella typhimurium LT2
uguacuaccugaugaacagg

SEQ ID NO: 3798473 - RNA, 16 nt, Salmonella typhimurium LT2
uguacuugcgccgcca

SEQ ID NO: 3798474 - RNA, 19 nt, Salmonella typhimurium LT2
uguacuuguugcuggcagg

SEQ ID NO: 3798475 - RNA, 15 nt, Salmonella typhimurium LT2
uguagauacugauau

SEQ ID NO: 3798476 - RNA, 18 nt, Salmonella typhimurium LT2
uguagauacugauauacg

SEQ ID NO: 3798477 - RNA, 23 nt, Salmonella typhimurium LT2
uguagcaaccucggcuugcuuca

SEQ ID NO: 3798478 - RNA, 13 nt, Salmonella typhimurium LT2
uguagcaguggag

SEQ ID NO: 3798479 - RNA, 19 nt, Salmonella typhimurium LT2
uguagcgccgccugacugg

SEQ ID NO: 3798480 - RNA, 17 nt, Salmonella typhimurium LT2
uguagcgcugaagcccg

SEQ ID NO: 3798481 - RNA, 18 nt, Salmonella typhimurium LT2
uguagcggcaacagcacc

SEQ ID NO: 3798482 - RNA, 20 nt, Salmonella typhimurium LT2
uguaggcccgguaagcgcag

SEQ ID NO: 3798483 - RNA, 21 nt, Salmonella typhimurium LT2
uguaggcccgguaagcgcagc

SEQ ID NO: 3798484 - RNA, 18 nt, Salmonella typhimurium LT2
uguaggccggauaagcaa

SEQ ID NO: 3798485 - RNA, 20 nt, Salmonella typhimurium LT2
uguaggccggauaagcauua

SEQ ID NO: 3798486 - RNA, 21 nt, Salmonella typhimurium LT2
uguaggccggauaagcgucag

SEQ ID NO: 3798487 - RNA, 21 nt, Salmonella typhimurium LT2
uguaggccggauaagcguuag

SEQ ID NO: 3798488 - RNA, 19 nt, Salmonella typhimurium LT2
uguaggccggauaaggcag

SEQ ID NO: 3798489 - RNA, 20 nt, Salmonella typhimurium LT2
uguaggccggauaaggcagc

SEQ ID NO: 3798490 - RNA, 19 nt, Salmonella typhimurium LT2
uguaggccggauaaggcgc

SEQ ID NO: 3798491 - RNA, 21 nt, Salmonella typhimurium LT2
uguaggccggaugaggcgcag

SEQ ID NO: 3798492 - RNA, 20 nt, Salmonella typhimurium LT2
uguaggccgggcaagcgaag

SEQ ID NO: 3798493 - RNA, 20 nt, Salmonella typhimurium LT2
uguaggccugauaagcgcag

SEQ ID NO: 3798494 - RNA, 20 nt, Salmonella typhimurium LT2
uguaggccugauaagcguag

SEQ ID NO: 3798495 - RNA, 19 nt, Salmonella typhimurium LT2
uguaggccugguaagcgca

SEQ ID NO: 3798496 - RNA, 21 nt, Salmonella typhimurium LT2
uguaggccugguaagcgcagc

SEQ ID NO: 3798497 - RNA, 20 nt, Salmonella typhimurium LT2
uguaggccugguaagcguag

SEQ ID NO: 3798498 - RNA, 17 nt, Salmonella typhimurium LT2
uguaggguacagcgcga

SEQ ID NO: 3798499 - RNA, 21 nt, Salmonella typhimurium LT2
uguaggucagguaagcgcuag

SEQ ID NO: 3798500 - RNA, 20 nt, Salmonella typhimurium LT2
ugugagacaaaaaagcugcg

SEQ ID NO: 3798501 - RNA, 20 nt, Salmonella typhimurium LT2
ugugaggaaagcgaaaauaa

SEQ ID NO: 3798502 - RNA, 21 nt, Salmonella typhimurium LT2
ugugauccgcccccuccagua

SEQ ID NO: 3798503 - RNA, 22 nt, Salmonella typhimurium LT2
ugugauugcagauaauuuugca

SEQ ID NO: 3798504 - RNA, 19 nt, Salmonella typhimurium LT2
ugugcagugacagaggaau

SEQ ID NO: 3798505 - RNA, 18 nt, Salmonella typhimurium LT2
ugugcauaucuggcgagg

SEQ ID NO: 3798506 - RNA, 21 nt, Salmonella typhimurium LT2
ugugccagcucguuauuuccg

SEQ ID NO: 3798507 - RNA, 17 nt, Salmonella typhimurium LT2
ugugccaguaaucccgg

SEQ ID NO: 3798508 - RNA, 21 nt, Salmonella typhimurium LT2
ugugccaguaccgccgccggg

SEQ ID NO: 3798509 - RNA, 13 nt, Salmonella typhimurium LT2
ugugccgcgcugg

SEQ ID NO: 3798510 - RNA, 15 nt, Salmonella typhimurium LT2
ugugccgucauccag

SEQ ID NO: 3798511 - RNA, 18 nt, Salmonella typhimurium LT2
ugugcgccagccuuaucc

SEQ ID NO: 3798512 - RNA, 21 nt, Salmonella typhimurium LT2
ugugcgcuaaaaccaaugcgu

SEQ ID NO: 3798513 - RNA, 17 nt, Salmonella typhimurium LT2
ugugcgcuuuggcugcc

SEQ ID NO: 3798514 - RNA, 13 nt, Salmonella typhimurium LT2
ugugcguggcgcc

SEQ ID NO: 3798515 - RNA, 15 nt, Salmonella typhimurium LT2
ugugcuccaccagcc

SEQ ID NO: 3798516 - RNA, 21 nt, Salmonella typhimurium LT2
ugugcuccaccagcccgcgaa

SEQ ID NO: 3798517 - RNA, 16 nt, Salmonella typhimurium LT2
ugugcucguuuuuaua

SEQ ID NO: 3798518 - RNA, 16 nt, Salmonella typhimurium LT2
ugugcugauugucagc

SEQ ID NO: 3798519 - RNA, 22 nt, Salmonella typhimurium LT2
ugugcuuaucacguagccagag

SEQ ID NO: 3798520 - RNA, 11 nt, Salmonella typhimurium LT2
ugugcuuuagc

SEQ ID NO: 3798521 - RNA, 15 nt, Salmonella typhimurium LT2
uguggacccgcuuaa

SEQ ID NO: 3798522 - RNA, 15 nt, Salmonella typhimurium LT2
uguggagguuucuuc

SEQ ID NO: 3798523 - RNA, 18 nt, Salmonella typhimurium LT2
uguggcauaaauaaaccg

SEQ ID NO: 3798524 - RNA, 21 nt, Salmonella typhimurium LT2
uguggcguguuguaaaacgcg

SEQ ID NO: 3798525 - RNA, 20 nt, Salmonella typhimurium LT2
ugugggaagggcgaagggcc

SEQ ID NO: 3798526 - RNA, 22 nt, Salmonella typhimurium LT2
uguggggggaacggcagacagc

SEQ ID NO: 3798527 - RNA, 20 nt, Salmonella typhimurium LT2
ugugggucugcggcggugcc

SEQ ID NO: 3798528 - RNA, 18 nt, Salmonella typhimurium LT2
uguggucgucugaguaua

SEQ ID NO: 3798529 - RNA, 13 nt, Salmonella typhimurium LT2
uguggugcggcuu

SEQ ID NO: 3798530 - RNA, 19 nt, Salmonella typhimurium LT2
ugugguguuccauugcugc

SEQ ID NO: 3798531 - RNA, 14 nt, Salmonella typhimurium LT2
ugugucgggccagg

SEQ ID NO: 3798532 - RNA, 18 nt, Salmonella typhimurium LT2
ugugucgggccaggcucc

SEQ ID NO: 3798533 - RNA, 20 nt, Salmonella typhimurium LT2
ugugugccgcccaggccuga

SEQ ID NO: 3798534 - RNA, 18 nt, Salmonella typhimurium LT2
uguguggagguuucuuca

SEQ ID NO: 3798535 - RNA, 24 nt, Salmonella typhimurium LT2
uguguugcucaaaaaagaguaaag

SEQ ID NO: 3798536 - RNA, 20 nt, Salmonella typhimurium LT2
uguuaacgucgucauucaug

SEQ ID NO: 3798537 - RNA, 20 nt, Salmonella typhimurium LT2
uguuaauggccgcucgccug

SEQ ID NO: 3798538 - RNA, 16 nt, Salmonella typhimurium LT2
uguuagcgaaacugcc

SEQ ID NO: 3798539 - RNA, 15 nt, Salmonella typhimurium LT2
uguuaguguccuuac

SEQ ID NO: 3798540 - RNA, 14 nt, Salmonella typhimurium LT2
uguuaguuucuauu

SEQ ID NO: 3798541 - RNA, 15 nt, Salmonella typhimurium LT2
uguuaguuucuauua

SEQ ID NO: 3798542 - RNA, 20 nt, Salmonella typhimurium LT2
uguuauagccuaaucucgcc

SEQ ID NO: 3798543 - RNA, 22 nt, Salmonella typhimurium LT2
uguuauagccuaaucucgccgg

SEQ ID NO: 3798544 - RNA, 21 nt, Salmonella typhimurium LT2
uguuauuaugugaucuauaua

SEQ ID NO: 3798545 - RNA, 18 nt, Salmonella typhimurium LT2
uguucaacgucagcugga

SEQ ID NO: 3798546 - RNA, 16 nt, Salmonella typhimurium LT2
uguucaagcugguuaa

SEQ ID NO: 3798547 - RNA, 18 nt, Salmonella typhimurium LT2
uguucaauagagcgcagc

SEQ ID NO: 3798548 - RNA, 13 nt, Salmonella typhimurium LT2
uguucaauauuca

SEQ ID NO: 3798549 - RNA, 13 nt, Salmonella typhimurium LT2
uguucacaauugu

SEQ ID NO: 3798550 - RNA, 16 nt, Salmonella typhimurium LT2
uguucacaucgcucag

SEQ ID NO: 3798551 - RNA, 14 nt, Salmonella typhimurium LT2
uguucagccagcaa

SEQ ID NO: 3798552 - RNA, 18 nt, Salmonella typhimurium LT2
uguucauaaagugccagg

SEQ ID NO: 3798553 - RNA, 21 nt, Salmonella typhimurium LT2
uguucaucaaagaaaaccacg

SEQ ID NO: 3798554 - RNA, 13 nt, Salmonella typhimurium LT2
uguucaucgccgu

SEQ ID NO: 3798555 - RNA, 14 nt, Salmonella typhimurium LT2
uguucaucgccgug

SEQ ID NO: 3798556 - RNA, 14 nt, Salmonella typhimurium LT2
uguuccaccugcgg

SEQ ID NO: 3798557 - RNA, 11 nt, Salmonella typhimurium LT2
uguuccagcug

SEQ ID NO: 3798558 - RNA, 16 nt, Salmonella typhimurium LT2
uguuccagggcuucca

SEQ ID NO: 3798559 - RNA, 21 nt, Salmonella typhimurium LT2
uguucccgacggcaggcggca

SEQ ID NO: 3798560 - RNA, 11 nt, Salmonella typhimurium LT2
uguucccugcc

SEQ ID NO: 3798561 - RNA, 18 nt, Salmonella typhimurium LT2
uguuccggaugcgggccg

SEQ ID NO: 3798562 - RNA, 14 nt, Salmonella typhimurium LT2
uguuccugagcaga

SEQ ID NO: 3798563 - RNA, 19 nt, Salmonella typhimurium LT2
uguuccugagucacagaau

SEQ ID NO: 3798564 - RNA, 17 nt, Salmonella typhimurium LT2
uguuccugcuggcaaaa

SEQ ID NO: 3798565 - RNA, 22 nt, Salmonella typhimurium LT2
uguuccuggacguggguuucaa

SEQ ID NO: 3798566 - RNA, 14 nt, Salmonella typhimurium LT2
uguucgauccggcg

SEQ ID NO: 3798567 - RNA, 23 nt, Salmonella typhimurium LT2
uguucgcaaccuaaccaaacaga

SEQ ID NO: 3798568 - RNA, 14 nt, Salmonella typhimurium LT2
uguucgccacccgc

SEQ ID NO: 3798569 - RNA, 15 nt, Salmonella typhimurium LT2
uguucgccacccgcc

SEQ ID NO: 3798570 - RNA, 20 nt, Salmonella typhimurium LT2
uguucgcuuauuccuccgcc

SEQ ID NO: 3798571 - RNA, 19 nt, Salmonella typhimurium LT2
uguucggcgcgauagcgau

SEQ ID NO: 3798572 - RNA, 23 nt, Salmonella typhimurium LT2
uguucuaaaaaguucauguaagu

SEQ ID NO: 3798573 - RNA, 19 nt, Salmonella typhimurium LT2
uguucuguccauguuuuau

SEQ ID NO: 3798574 - RNA, 20 nt, Salmonella typhimurium LT2
uguucuguccggaagacagc

SEQ ID NO: 3798575 - RNA, 13 nt, Salmonella typhimurium LT2
uguucuuccauug

SEQ ID NO: 3798576 - RNA, 17 nt, Salmonella typhimurium LT2
uguucuucuuucaucau

SEQ ID NO: 3798577 - RNA, 17 nt, Salmonella typhimurium LT2
uguugaaagccccggcu

SEQ ID NO: 3798578 - RNA, 20 nt, Salmonella typhimurium LT2
uguugaagauuagccguuga

SEQ ID NO: 3798579 - RNA, 13 nt, Salmonella typhimurium LT2
uguugaaguccuc

SEQ ID NO: 3798580 - RNA, 13 nt, Salmonella typhimurium LT2
uguugaccagguu

SEQ ID NO: 3798581 - RNA, 15 nt, Salmonella typhimurium LT2
uguugcacgcauggc

SEQ ID NO: 3798582 - RNA, 13 nt, Salmonella typhimurium LT2
uguugccaugauc

SEQ ID NO: 3798583 - RNA, 23 nt, Salmonella typhimurium LT2
uguugccgcccguuuuuuccagu

SEQ ID NO: 3798584 - RNA, 20 nt, Salmonella typhimurium LT2
uguugccggauagcucgcug

SEQ ID NO: 3798585 - RNA, 16 nt, Salmonella typhimurium LT2
uguugcgcaagcacug

SEQ ID NO: 3798586 - RNA, 13 nt, Salmonella typhimurium LT2
uguugcuggcagg

SEQ ID NO: 3798587 - RNA, 14 nt, Salmonella typhimurium LT2
uguuguacagcaau

SEQ ID NO: 3798588 - RNA, 22 nt, Salmonella typhimurium LT2
uguuguacagcaauaaaaggaa

SEQ ID NO: 3798589 - RNA, 22 nt, Salmonella typhimurium LT2
uguuguagaaugaauuucuuca

SEQ ID NO: 3798590 - RNA, 14 nt, Salmonella typhimurium LT2
uguugucaauaucg

SEQ ID NO: 3798591 - RNA, 17 nt, Salmonella typhimurium LT2
uguuguccggccacgga

SEQ ID NO: 3798592 - RNA, 19 nt, Salmonella typhimurium LT2
uguuguccggccacggauu

SEQ ID NO: 3798593 - RNA, 19 nt, Salmonella typhimurium LT2
uguuuaagcgccuccacaa

SEQ ID NO: 3798594 - RNA, 16 nt, Salmonella typhimurium LT2
uguuuaauacgcuguc

SEQ ID NO: 3798595 - RNA, 17 nt, Salmonella typhimurium LT2
uguuuaaugcuuucaau

SEQ ID NO: 3798596 - RNA, 18 nt, Salmonella typhimurium LT2
uguuuaauggcagaauaa

SEQ ID NO: 3798597 - RNA, 19 nt, Salmonella typhimurium LT2
uguuuaccaagcaccgcca

SEQ ID NO: 3798598 - RNA, 21 nt, Salmonella typhimurium LT2
uguuuaccaugcgccaugagu

SEQ ID NO: 3798599 - RNA, 14 nt, Salmonella typhimurium LT2
uguuuaccuuuacg

SEQ ID NO: 3798600 - RNA, 14 nt, Salmonella typhimurium LT2
uguuuacgccgcca

SEQ ID NO: 3798601 - RNA, 16 nt, Salmonella typhimurium LT2
uguuuaugacccugcg

SEQ ID NO: 3798602 - RNA, 19 nt, Salmonella typhimurium LT2
uguuucaccucauuuuuag

SEQ ID NO: 3798603 - RNA, 18 nt, Salmonella typhimurium LT2
uguuucagcaccucuuug

SEQ ID NO: 3798604 - RNA, 16 nt, Salmonella typhimurium LT2
uuaaucagcgcugucg

SEQ ID NO: 3798605 - RNA, 14 nt, Salmonella typhimurium LT2
uuaaucccaacccg

SEQ ID NO: 3798606 - RNA, 20 nt, Salmonella typhimurium LT2
uuaauccgcggauagacgau

SEQ ID NO: 3798607 - RNA, 16 nt, Salmonella typhimurium LT2
uuaauccggucaucca

SEQ ID NO: 3798608 - RNA, 15 nt, Salmonella typhimurium LT2
uuaaucgcuucaauc

SEQ ID NO: 3798609 - RNA, 14 nt, Salmonella typhimurium LT2
uuaaucgucauccc

SEQ ID NO: 3798610 - RNA, 15 nt, Salmonella typhimurium LT2
uuaaucgucaucccg

SEQ ID NO: 3798611 - RNA, 16 nt, Salmonella typhimurium LT2
uuaaugacuuuuuaua

SEQ ID NO: 3798612 - RNA, 18 nt, Salmonella typhimurium LT2
uuaaugacuuuuuauaua

SEQ ID NO: 3798613 - RNA, 18 nt, Salmonella typhimurium LT2
uuaaugcgcacgccagcg

SEQ ID NO: 3798614 - RNA, 21 nt, Salmonella typhimurium LT2
uuaaugcgccccugcaggcga

SEQ ID NO: 3798615 - RNA, 16 nt, Salmonella typhimurium LT2
uuaaugcucuccagca

SEQ ID NO: 3798616 - RNA, 15 nt, Salmonella typhimurium LT2
uuaaugcucugcugu

SEQ ID NO: 3798617 - RNA, 17 nt, Salmonella typhimurium LT2
uuaaugcuuuaaaugcc

SEQ ID NO: 3798618 - RNA, 15 nt, Salmonella typhimurium LT2
uuaauggcuuucacc

SEQ ID NO: 3798619 - RNA, 16 nt, Salmonella typhimurium LT2
uuaauggucagaucug

SEQ ID NO: 3798620 - RNA, 16 nt, Salmonella typhimurium LT2
uuaaugucacaaugcc

SEQ ID NO: 3798621 - RNA, 17 nt, Salmonella typhimurium LT2
uuaaugucacaaugccu

SEQ ID NO: 3798622 - RNA, 20 nt, Salmonella typhimurium LT2
uuaaugucaccaucaucgau

SEQ ID NO: 3798623 - RNA, 13 nt, Salmonella typhimurium LT2
uuaauuaaauguu

SEQ ID NO: 3798624 - RNA, 12 nt, Salmonella typhimurium LT2
uuaauuaaauuu

SEQ ID NO: 3798625 - RNA, 11 nt, Salmonella typhimurium LT2
uuaauuauucc

SEQ ID NO: 3798626 - RNA, 21 nt, Salmonella typhimurium LT2
uuaauugcugaagauaaaauu

SEQ ID NO: 3798627 - RNA, 19 nt, Salmonella typhimurium LT2
uuaauuuaauaauaaauuu

SEQ ID NO: 3798628 - RNA, 12 nt, Salmonella typhimurium LT2
uuaauuuaauug

SEQ ID NO: 3798629 - RNA, 19 nt, Salmonella typhimurium LT2
uuaauuucuuugccccaua

SEQ ID NO: 3798630 - RNA, 15 nt, Salmonella typhimurium LT2
uuaauuugugccagc

SEQ ID NO: 3798631 - RNA, 14 nt, Salmonella typhimurium LT2
uuaauuuucuuuua

SEQ ID NO: 3798632 - RNA, 17 nt, Salmonella typhimurium LT2
uuaauuuucuuuuauug

SEQ ID NO: 3798633 - RNA, 21 nt, Salmonella typhimurium LT2
uuaauuuuuagcuaacucuau

SEQ ID NO: 3798634 - RNA, 19 nt, Salmonella typhimurium LT2
uuacaaaugaccucaagaa

SEQ ID NO: 3798635 - RNA, 17 nt, Salmonella typhimurium LT2
uuacaccccacuauuca

SEQ ID NO: 3798636 - RNA, 16 nt, Salmonella typhimurium LT2
uuacagauauccaccg

SEQ ID NO: 3798637 - RNA, 14 nt, Salmonella typhimurium LT2
uuacagcauacgcc

SEQ ID NO: 3798638 - RNA, 19 nt, Salmonella typhimurium LT2
uuacaggccggacaggcga

SEQ ID NO: 3798639 - RNA, 14 nt, Salmonella typhimurium LT2
uuacaguuuaucug

SEQ ID NO: 3798640 - RNA, 18 nt, Salmonella typhimurium LT2
uuacaguuuaucugcgug

SEQ ID NO: 3798641 - RNA, 19 nt, Salmonella typhimurium LT2
uuacauccagcuauagacg

SEQ ID NO: 3798642 - RNA, 21 nt, Salmonella typhimurium LT2
uuacaucggcguguuucauuu

SEQ ID NO: 3798643 - RNA, 11 nt, Salmonella typhimurium LT2
uuacaucuuuc

SEQ ID NO: 3798644 - RNA, 15 nt, Salmonella typhimurium LT2
uuacaugcugaagca

SEQ ID NO: 3798645 - RNA, 21 nt, Salmonella typhimurium LT2
uuaccaaacagccguaccugc

SEQ ID NO: 3798646 - RNA, 12 nt, Salmonella typhimurium LT2
uuaccaaaucaa

SEQ ID NO: 3798647 - RNA, 17 nt, Salmonella typhimurium LT2
uuaccacaauaaucgcg

SEQ ID NO: 3798648 - RNA, 13 nt, Salmonella typhimurium LT2
uuaccacuuugcg

SEQ ID NO: 3798649 - RNA, 19 nt, Salmonella typhimurium LT2
uuaccacuuugcgcuccug

SEQ ID NO: 3798650 - RNA, 22 nt, Salmonella typhimurium LT2
uuaccagaccggcaucucaucu

SEQ ID NO: 3798651 - RNA, 13 nt, Salmonella typhimurium LT2
uuacccaccagcc

SEQ ID NO: 3798652 - RNA, 18 nt, Salmonella typhimurium LT2
uuacccaccagccgcaua

SEQ ID NO: 3798653 - RNA, 21 nt, Salmonella typhimurium LT2
uuacccaccagccgcauaaua

SEQ ID NO: 3798654 - RNA, 22 nt, Salmonella typhimurium LT2
uuacccaguaccauaccggugc

SEQ ID NO: 3798655 - RNA, 19 nt, Salmonella typhimurium LT2
uuacccauaaaaaagcccu

SEQ ID NO: 3798656 - RNA, 18 nt, Salmonella typhimurium LT2
uuacccggccuacacauc

SEQ ID NO: 3798657 - RNA, 18 nt, Salmonella typhimurium LT2
uuacccuucaugcagccc

SEQ ID NO: 3798658 - RNA, 14 nt, Salmonella typhimurium LT2
uuaccgcccgcuuc

SEQ ID NO: 3798659 - RNA, 16 nt, Salmonella typhimurium LT2
uuaccggacagcacga

SEQ ID NO: 3798660 - RNA, 14 nt, Salmonella typhimurium LT2
uuaccgggcaucug

SEQ ID NO: 3798661 - RNA, 16 nt, Salmonella typhimurium LT2
uuaccgguucaacugg

SEQ ID NO: 3798662 - RNA, 16 nt, Salmonella typhimurium LT2
uuaccguucaggcaaa

SEQ ID NO: 3798663 - RNA, 17 nt, Salmonella typhimurium LT2
uuaccguuugucuucug

SEQ ID NO: 3798664 - RNA, 23 nt, Salmonella typhimurium LT2
uuaccuacaauuugaauuacccc

SEQ ID NO: 3798665 - RNA, 13 nt, Salmonella typhimurium LT2
uuaccuaccaguu

SEQ ID NO: 3798666 - RNA, 12 nt, Salmonella typhimurium LT2
uuaccucuuucg

SEQ ID NO: 3798667 - RNA, 23 nt, Salmonella typhimurium LT2
uuaccuucauuguccucggcaac

SEQ ID NO: 3798668 - RNA, 22 nt, Salmonella typhimurium LT2
uuacgaaucgaauacagcgccu

SEQ ID NO: 3798669 - RNA, 18 nt, Salmonella typhimurium LT2
uuacgaucgccaccgcau

SEQ ID NO: 3798670 - RNA, 17 nt, Salmonella typhimurium LT2
uuacgcacgccagauaa

SEQ ID NO: 3798671 - RNA, 18 nt, Salmonella typhimurium LT2
uuacgcacgccagauaaa

SEQ ID NO: 3798672 - RNA, 20 nt, Salmonella typhimurium LT2
uuacgcacgccagauaaauc

SEQ ID NO: 3798673 - RNA, 13 nt, Salmonella typhimurium LT2
uuacgcacuuuua

SEQ ID NO: 3798674 - RNA, 22 nt, Salmonella typhimurium LT2
uuacgcagcaagaacagagcaa

SEQ ID NO: 3798675 - RNA, 16 nt, Salmonella typhimurium LT2
uuacgcagccggucag

SEQ ID NO: 3798676 - RNA, 13 nt, Salmonella typhimurium LT2
uuacgcaggcuug

SEQ ID NO: 3798677 - RNA, 21 nt, Salmonella typhimurium LT2
uuacgccaggaucgucgguca

SEQ ID NO: 3798678 - RNA, 18 nt, Salmonella typhimurium LT2
uuacgccaucagggacga

SEQ ID NO: 3798679 - RNA, 18 nt, Salmonella typhimurium LT2
uuacgcgacgugcugugg

SEQ ID NO: 3798680 - RNA, 11 nt, Salmonella typhimurium LT2
uuacgcgcugc

SEQ ID NO: 3798681 - RNA, 19 nt, Salmonella typhimurium LT2
uuacgcguuacgcccugug

SEQ ID NO: 3798682 - RNA, 21 nt, Salmonella typhimurium LT2
uuacgcucgucaaacaguuca

SEQ ID NO: 3798683 - RNA, 14 nt, Salmonella typhimurium LT2
uuacgcugccucuu

SEQ ID NO: 3798684 - RNA, 22 nt, Salmonella typhimurium LT2
uuacggaaaaaauacugauaaa

SEQ ID NO: 3798685 - RNA, 15 nt, Salmonella typhimurium LT2
uuacggacagaaaaa

SEQ ID NO: 3798686 - RNA, 19 nt, Salmonella typhimurium LT2
uuacggauguacucaucca

SEQ ID NO: 3798687 - RNA, 17 nt, Salmonella typhimurium LT2
uuacgggaacagaauua

SEQ ID NO: 3798688 - RNA, 19 nt, Salmonella typhimurium LT2
uuacggugcguggcgcugg

SEQ ID NO: 3798689 - RNA, 12 nt, Salmonella typhimurium LT2
uuacguaacugc

SEQ ID NO: 3798690 - RNA, 16 nt, Salmonella typhimurium LT2
uuacguucaacgggaa

SEQ ID NO: 3798691 - RNA, 21 nt, Salmonella typhimurium LT2
uuacguucggcaaaacgccgc

SEQ ID NO: 3798692 - RNA, 15 nt, Salmonella typhimurium LT2
uuacguuugcagcgg

SEQ ID NO: 3798693 - RNA, 17 nt, Salmonella typhimurium LT2
uuacuaaaaguaaauaa

SEQ ID NO: 3798694 - RNA, 16 nt, Salmonella typhimurium LT2
uuacuaccaucaauac

SEQ ID NO: 3798695 - RNA, 18 nt, Salmonella typhimurium LT2
uuacuauagauauuaaac

SEQ ID NO: 3798696 - RNA, 13 nt, Salmonella typhimurium LT2
uuacuaucuucaa

SEQ ID NO: 3798697 - RNA, 12 nt, Salmonella typhimurium LT2
uuacuauuuuuc

SEQ ID NO: 3798698 - RNA, 13 nt, Salmonella typhimurium LT2
uuacuauuuuuca

SEQ ID NO: 3798699 - RNA, 14 nt, Salmonella typhimurium LT2
uuacuauuuuucac

SEQ ID NO: 3798700 - RNA, 11 nt, Salmonella typhimurium LT2
uuacucuucca

SEQ ID NO: 3798701 - RNA, 15 nt, Salmonella typhimurium LT2
uuacugacaauaagu

SEQ ID NO: 3798702 - RNA, 23 nt, Salmonella typhimurium LT2
uuacugacuaucuuuaugucagu

SEQ ID NO: 3798703 - RNA, 23 nt, Salmonella typhimurium LT2
uuacugcuuugaucacccacacc

SEQ ID NO: 3798704 - RNA, 14 nt, Salmonella typhimurium LT2
uuacugugccgccg

SEQ ID NO: 3798705 - RNA, 20 nt, Salmonella typhimurium LT2
uuacuuccggcgaugccacc

SEQ ID NO: 3798706 - RNA, 18 nt, Salmonella typhimurium LT2
uuacuuucaaaauacugg

SEQ ID NO: 3798707 - RNA, 13 nt, Salmonella typhimurium LT2
uuacuuucauucc

SEQ ID NO: 3798708 - RNA, 15 nt, Salmonella typhimurium LT2
uuacuuucauuccuu

SEQ ID NO: 3798709 - RNA, 22 nt, Salmonella typhimurium LT2
uuaugcaguuccguugcaauau

SEQ ID NO: 3798710 - RNA, 22 nt, Salmonella typhimurium LT2
uuaugccgaccaaugacgcuau

SEQ ID NO: 3798711 - RNA, 17 nt, Salmonella typhimurium LT2
uuaugccuuuuucaaca

SEQ ID NO: 3798712 - RNA, 22 nt, Salmonella typhimurium LT2
uuaugcgucaaaguugcaucaa

SEQ ID NO: 3798713 - RNA, 19 nt, Salmonella typhimurium LT2
uuaugcucauugccuuuca

SEQ ID NO: 3798714 - RNA, 18 nt, Salmonella typhimurium LT2
uuaugggcauuucauuua

SEQ ID NO: 3798715 - RNA, 13 nt, Salmonella typhimurium LT2
uuauggguuugcu

SEQ ID NO: 3798716 - RNA, 15 nt, Salmonella typhimurium LT2
uuauguauuuaauuu

SEQ ID NO: 3798717 - RNA, 18 nt, Salmonella typhimurium LT2
uuauguauuucucgccgc

SEQ ID NO: 3798718 - RNA, 15 nt, Salmonella typhimurium LT2
uuauuaaaauuaucc

SEQ ID NO: 3798719 - RNA, 13 nt, Salmonella typhimurium LT2
uuauuaacgugcu

SEQ ID NO: 3798720 - RNA, 20 nt, Salmonella typhimurium LT2
uuauuacgcaagaucacaua

SEQ ID NO: 3798721 - RNA, 21 nt, Salmonella typhimurium LT2
uuauuauguagcaacagacua

SEQ ID NO: 3798722 - RNA, 12 nt, Salmonella typhimurium LT2
uuauuauuuuuu

SEQ ID NO: 3798723 - RNA, 19 nt, Salmonella typhimurium LT2
uuauuccauuuuaaccuua

SEQ ID NO: 3798724 - RNA, 23 nt, Salmonella typhimurium LT2
uuauucgccuuucacgcguucaa

SEQ ID NO: 3798725 - RNA, 17 nt, Salmonella typhimurium LT2
uuauucggcgagaaaac

SEQ ID NO: 3798726 - RNA, 17 nt, Salmonella typhimurium LT2
uuauucggcuuacccaa

SEQ ID NO: 3798727 - RNA, 17 nt, Salmonella typhimurium LT2
uuauucggcuuuuacau

SEQ ID NO: 3798728 - RNA, 23 nt, Salmonella typhimurium LT2
uuauucuuugucugucggacuca

SEQ ID NO: 3798729 - RNA, 15 nt, Salmonella typhimurium LT2
uuauugacgcuuucu

SEQ ID NO: 3798730 - RNA, 15 nt, Salmonella typhimurium LT2
uuauugcguugcuuu

SEQ ID NO: 3798731 - RNA, 22 nt, Salmonella typhimurium LT2
uuauuggcacacgucuacccag

SEQ ID NO: 3798732 - RNA, 21 nt, Salmonella typhimurium LT2
uuauuggcccccaucgccagc

SEQ ID NO: 3798733 - RNA, 15 nt, Salmonella typhimurium LT2
uuauuuaacgccagu

SEQ ID NO: 3798734 - RNA, 12 nt, Salmonella typhimurium LT2
uuauuuaauaca

SEQ ID NO: 3798735 - RNA, 22 nt, Salmonella typhimurium LT2
uuauuucgucagcacuucccac

SEQ ID NO: 3798736 - RNA, 21 nt, Salmonella typhimurium LT2
uuauuugaauagucaaccguu

SEQ ID NO: 3798737 - RNA, 18 nt, Salmonella typhimurium LT2
uuauuuggcguacuuagg

SEQ ID NO: 3798738 - RNA, 19 nt, Salmonella typhimurium LT2
uuauuuguaugacaaauaa

SEQ ID NO: 3798739 - RNA, 15 nt, Salmonella typhimurium LT2
uuauuuugauaauca

SEQ ID NO: 3798740 - RNA, 13 nt, Salmonella typhimurium LT2
uuauuuuuaauug

SEQ ID NO: 3798741 - RNA, 20 nt, Salmonella typhimurium LT2
uuauuuuucgccagaucgau

SEQ ID NO: 3798742 - RNA, 16 nt, Salmonella typhimurium LT2
uuauuuuuuuaucgaa

SEQ ID NO: 3798743 - RNA, 11 nt, Salmonella typhimurium LT2
uucaaaaagag

SEQ ID NO: 3798744 - RNA, 17 nt, Salmonella typhimurium LT2
uucaaaaaugauguguu

SEQ ID NO: 3798745 - RNA, 17 nt, Salmonella typhimurium LT2
uucaaaccuucaagaau

SEQ ID NO: 3798746 - RNA, 20 nt, Salmonella typhimurium LT2
uucaaacggcuggaaucuac

SEQ ID NO: 3798747 - RNA, 21 nt, Salmonella typhimurium LT2
uucaaaugauuuuuauaaaau

SEQ ID NO: 3798748 - RNA, 14 nt, Salmonella typhimurium LT2
uucaacaaacucag

SEQ ID NO: 3798749 - RNA, 19 nt, Salmonella typhimurium LT2
uucaacagcucgccaugca

SEQ ID NO: 3798750 - RNA, 18 nt, Salmonella typhimurium LT2
uucaacauauuuuucaca

SEQ ID NO: 3798751 - RNA, 18 nt, Salmonella typhimurium LT2
uucaaccucacuguugau

SEQ ID NO: 3798752 - RNA, 15 nt, Salmonella typhimurium LT2
uucaaccuccugcaa

SEQ ID NO: 3798753 - RNA, 16 nt, Salmonella typhimurium LT2
uucaaccuccugcaau

SEQ ID NO: 3798754 - RNA, 19 nt, Salmonella typhimurium LT2
uucaacgcguugccugaaa

SEQ ID NO: 3798755 - RNA, 14 nt, Salmonella typhimurium LT2
uucaacggcaucaa

SEQ ID NO: 3798756 - RNA, 12 nt, Salmonella typhimurium LT2
uucaagcaauaa

SEQ ID NO: 3798757 - RNA, 14 nt, Salmonella typhimurium LT2
uucaagcaguucca

SEQ ID NO: 3798758 - RNA, 23 nt, Salmonella typhimurium LT2
uucaagccguuuuggcagcgccc

SEQ ID NO: 3798759 - RNA, 14 nt, Salmonella typhimurium LT2
uucaaguccccccc

SEQ ID NO: 3798760 - RNA, 22 nt, Salmonella typhimurium LT2
uucaaguccccccccucgcacc

SEQ ID NO: 3798761 - RNA, 21 nt, Salmonella typhimurium LT2
uucaauaaauugaaauucuau

SEQ ID NO: 3798762 - RNA, 22 nt, Salmonella typhimurium LT2
uucaauaaauugaaauucuaug

SEQ ID NO: 3798763 - RNA, 14 nt, Salmonella typhimurium LT2
uucaauaauaaaac

SEQ ID NO: 3798764 - RNA, 19 nt, Salmonella typhimurium LT2
uucaauagucgacagcccg

SEQ ID NO: 3798765 - RNA, 17 nt, Salmonella typhimurium LT2
uucaaucaacaccagca

SEQ ID NO: 3798766 - RNA, 14 nt, Salmonella typhimurium LT2
uucaaucagcacgc

SEQ ID NO: 3798767 - RNA, 20 nt, Salmonella typhimurium LT2
uucaauccccccuuuaccca

SEQ ID NO: 3798768 - RNA, 17 nt, Salmonella typhimurium LT2
uucaaucgccaguuuuu

SEQ ID NO: 3798769 - RNA, 19 nt, Salmonella typhimurium LT2
uucaaucuggugacgauga

SEQ ID NO: 3798770 - RNA, 13 nt, Salmonella typhimurium LT2
uucaauuuccagu

SEQ ID NO: 3798771 - RNA, 13 nt, Salmonella typhimurium LT2
uucacaaaaagua

SEQ ID NO: 3798772 - RNA, 22 nt, Salmonella typhimurium LT2
uucacaaacaauuucccccacu

SEQ ID NO: 3798773 - RNA, 20 nt, Salmonella typhimurium LT2
uucacaccguuauccggcaa

SEQ ID NO: 3798774 - RNA, 16 nt, Salmonella typhimurium LT2
uucacacgaauuccuu

SEQ ID NO: 3798775 - RNA, 16 nt, Salmonella typhimurium LT2
uucaccaaauccucac

SEQ ID NO: 3798776 - RNA, 19 nt, Salmonella typhimurium LT2
uucaccacuuugcgguuac

SEQ ID NO: 3798777 - RNA, 16 nt, Salmonella typhimurium LT2
uucaccagacgcuggc

SEQ ID NO: 3798778 - RNA, 12 nt, Salmonella typhimurium LT2
uucaccagcgcg

SEQ ID NO: 3798779 - RNA, 22 nt, Salmonella typhimurium LT2
uucaccagcgguuucaggccag

SEQ ID NO: 3798780 - RNA, 16 nt, Salmonella typhimurium LT2
uucacccccaucgccc

SEQ ID NO: 3798781 - RNA, 20 nt, Salmonella typhimurium LT2
uucacccgcgugaacacacc

SEQ ID NO: 3798782 - RNA, 15 nt, Salmonella typhimurium LT2
uucaccggcacccag

SEQ ID NO: 3798783 - RNA, 21 nt, Salmonella typhimurium LT2
uucaccugccguaccguugcc

SEQ ID NO: 3798784 - RNA, 17 nt, Salmonella typhimurium LT2
uucaccuggaaaggcuu

SEQ ID NO: 3798785 - RNA, 16 nt, Salmonella typhimurium LT2
uucaccuuacccggcg

SEQ ID NO: 3798786 - RNA, 14 nt, Salmonella typhimurium LT2
uucaccuuuccagu

SEQ ID NO: 3798787 - RNA, 15 nt, Salmonella typhimurium LT2
uucacgaaaccggcg

SEQ ID NO: 3798788 - RNA, 19 nt, Salmonella typhimurium LT2
uucacgagcggucaggcca

SEQ ID NO: 3798789 - RNA, 20 nt, Salmonella typhimurium LT2
uucacgagcggucaggccag

SEQ ID NO: 3798790 - RNA, 14 nt, Salmonella typhimurium LT2
uucacgaucgaacg

SEQ ID NO: 3798791 - RNA, 22 nt, Salmonella typhimurium LT2
uucacgccacaguugguucugc

SEQ ID NO: 3798792 - RNA, 20 nt, Salmonella typhimurium LT2
uucacgccgccauccggcaa

SEQ ID NO: 3798793 - RNA, 20 nt, Salmonella typhimurium LT2
uucacgccuuuugacgcuuc

SEQ ID NO: 3798794 - RNA, 22 nt, Salmonella typhimurium LT2
uucacgcuauguuugcugagaa

SEQ ID NO: 3798795 - RNA, 12 nt, Salmonella typhimurium LT2
uucacgcugcag

SEQ ID NO: 3798796 - RNA, 23 nt, Salmonella typhimurium LT2
uucacgggaacggcguaccagaa

SEQ ID NO: 3798797 - RNA, 22 nt, Salmonella typhimurium LT2
uucacgggucauuaagaaacug

SEQ ID NO: 3798798 - RNA, 17 nt, Salmonella typhimurium LT2
uucacgucgcgaagcug

SEQ ID NO: 3798799 - RNA, 23 nt, Salmonella typhimurium LT2
uucacuaaacuaaugccuggcag

SEQ ID NO: 3798800 - RNA, 18 nt, Salmonella typhimurium LT2
uucacuccuaagagaaaa

SEQ ID NO: 3798801 - RNA, 14 nt, Salmonella typhimurium LT2
uucacuuuuucucu

SEQ ID NO: 3798802 - RNA, 19 nt, Salmonella typhimurium LT2
uucagaaauguauucuccc

SEQ ID NO: 3798803 - RNA, 17 nt, Salmonella typhimurium LT2
uucagaauaugccaggg

SEQ ID NO: 3798804 - RNA, 16 nt, Salmonella typhimurium LT2
uucagaccauagucca

SEQ ID NO: 3798805 - RNA, 22 nt, Salmonella typhimurium LT2
uucagagcgucuacgccaucau

SEQ ID NO: 3798806 - RNA, 19 nt, Salmonella typhimurium LT2
uucagauggugauagcgcg

SEQ ID NO: 3798807 - RNA, 15 nt, Salmonella typhimurium LT2
uucagcaaauaaucg

SEQ ID NO: 3798808 - RNA, 15 nt, Salmonella typhimurium LT2
uucagcaagaagcag

SEQ ID NO: 3798809 - RNA, 23 nt, Salmonella typhimurium LT2
uucagcaauuacccgguguuuuu

SEQ ID NO: 3798810 - RNA, 19 nt, Salmonella typhimurium LT2
uucagcauauccagcgccu

SEQ ID NO: 3798811 - RNA, 16 nt, Salmonella typhimurium LT2
uucagcaucauaucaa

SEQ ID NO: 3798812 - RNA, 19 nt, Salmonella typhimurium LT2
uuccagcgccauaagacua

SEQ ID NO: 3798813 - RNA, 11 nt, Salmonella typhimurium LT2
uuccagcgccg

SEQ ID NO: 3798814 - RNA, 21 nt, Salmonella typhimurium LT2
uuccagcgcgccgucaucgcu

SEQ ID NO: 3798815 - RNA, 24 nt, Salmonella typhimurium LT2
uuccagcgcgccgucaucgcucau

SEQ ID NO: 3798816 - RNA, 12 nt, Salmonella typhimurium LT2
uuccagcggcag

SEQ ID NO: 3798817 - RNA, 19 nt, Salmonella typhimurium LT2
uuccagcuguaccaucacc

SEQ ID NO: 3798818 - RNA, 17 nt, Salmonella typhimurium LT2
uuccaggccagcgacac

SEQ ID NO: 3798819 - RNA, 17 nt, Salmonella typhimurium LT2
uuccagguugugacgaa

SEQ ID NO: 3798820 - RNA, 14 nt, Salmonella typhimurium LT2
uuccaguaauuuca

SEQ ID NO: 3798821 - RNA, 18 nt, Salmonella typhimurium LT2
uuccaguagucgcgccau

SEQ ID NO: 3798822 - RNA, 17 nt, Salmonella typhimurium LT2
uuccagugccgccagaa

SEQ ID NO: 3798823 - RNA, 21 nt, Salmonella typhimurium LT2
uuccaguucauaagucaucca

SEQ ID NO: 3798824 - RNA, 20 nt, Salmonella typhimurium LT2
uuccaguugcgcuacuuuau

SEQ ID NO: 3798825 - RNA, 17 nt, Salmonella typhimurium LT2
uuccaguugcggcauca

SEQ ID NO: 3798826 - RNA, 14 nt, Salmonella typhimurium LT2
uuccauauccagcg

SEQ ID NO: 3798827 - RNA, 12 nt, Salmonella typhimurium LT2
uuccaucaccau

SEQ ID NO: 3798828 - RNA, 19 nt, Salmonella typhimurium LT2
uuccaucgcgacuucaauc

SEQ ID NO: 3798829 - RNA, 12 nt, Salmonella typhimurium LT2
uuccaucggcau

SEQ ID NO: 3798830 - RNA, 15 nt, Salmonella typhimurium LT2
uuccaucucuuuaaa

SEQ ID NO: 3798831 - RNA, 15 nt, Salmonella typhimurium LT2
uuccaugacguucaa

SEQ ID NO: 3798832 - RNA, 13 nt, Salmonella typhimurium LT2
uuccauucccgcc

SEQ ID NO: 3798833 - RNA, 11 nt, Salmonella typhimurium LT2
uuccauuuuuc

SEQ ID NO: 3798834 - RNA, 13 nt, Salmonella typhimurium LT2
uuccauuuuucag

SEQ ID NO: 3798835 - RNA, 14 nt, Salmonella typhimurium LT2
uucccaauaguuua

SEQ ID NO: 3798836 - RNA, 14 nt, Salmonella typhimurium LT2
uucccacagucggc

SEQ ID NO: 3798837 - RNA, 13 nt, Salmonella typhimurium LT2
uucccacaucgcg

SEQ ID NO: 3798838 - RNA, 14 nt, Salmonella typhimurium LT2
uucccacuccgccc

SEQ ID NO: 3798839 - RNA, 16 nt, Salmonella typhimurium LT2
uucccaggucacgccc

SEQ ID NO: 3798840 - RNA, 18 nt, Salmonella typhimurium LT2
uucccaguauugcaccug

SEQ ID NO: 3798841 - RNA, 24 nt, Salmonella typhimurium LT2
uucccaguauugcaccugggaguc

SEQ ID NO: 3798842 - RNA, 17 nt, Salmonella typhimurium LT2
uucccaucaaucaccuu

SEQ ID NO: 3798843 - RNA, 14 nt, Salmonella typhimurium LT2
uucccaucgcuuug

SEQ ID NO: 3798844 - RNA, 23 nt, Salmonella typhimurium LT2
uuccccaccacauuuagcgcagu

SEQ ID NO: 3798845 - RNA, 19 nt, Salmonella typhimurium LT2
uuccccacgccaucgcggc

SEQ ID NO: 3798846 - RNA, 12 nt, Salmonella typhimurium LT2
uuccccauaauc

SEQ ID NO: 3798847 - RNA, 14 nt, Salmonella typhimurium LT2
uuccccaucaaaac

SEQ ID NO: 3798848 - RNA, 12 nt, Salmonella typhimurium LT2
uuccccaucgcg

SEQ ID NO: 3798849 - RNA, 17 nt, Salmonella typhimurium LT2
uucccccauccgcgccg

SEQ ID NO: 3798850 - RNA, 16 nt, Salmonella typhimurium LT2
uuccccugaugcguau

SEQ ID NO: 3798851 - RNA, 20 nt, Salmonella typhimurium LT2
uuccccuuuaggcggcgccg

SEQ ID NO: 3798852 - RNA, 11 nt, Salmonella typhimurium LT2
uucccgagcgg

SEQ ID NO: 3798853 - RNA, 15 nt, Salmonella typhimurium LT2
uucccgaugccagca

SEQ ID NO: 3798854 - RNA, 13 nt, Salmonella typhimurium LT2
uucccgcaggccg

SEQ ID NO: 3798855 - RNA, 19 nt, Salmonella typhimurium LT2
uucccgcccgucaggggcg

SEQ ID NO: 3798856 - RNA, 16 nt, Salmonella typhimurium LT2
uucccgccgcaauucc

SEQ ID NO: 3798857 - RNA, 17 nt, Salmonella typhimurium LT2
uucccgcugguugccuu

SEQ ID NO: 3798858 - RNA, 18 nt, Salmonella typhimurium LT2
uucccggcaauuaccgcc

SEQ ID NO: 3798859 - RNA, 21 nt, Salmonella typhimurium LT2
uucccuaccagacgcgccugc

SEQ ID NO: 3798860 - RNA, 20 nt, Salmonella typhimurium LT2
uucccucauauuuguaucug

SEQ ID NO: 3798861 - RNA, 22 nt, Salmonella typhimurium LT2
uucccugcaauauuuaagccca

SEQ ID NO: 3798862 - RNA, 15 nt, Salmonella typhimurium LT2
uucccuuaucugcaa

SEQ ID NO: 3798863 - RNA, 16 nt, Salmonella typhimurium LT2
uucccuuccagcgacg

SEQ ID NO: 3798864 - RNA, 16 nt, Salmonella typhimurium LT2
uucccuucugaaauga

SEQ ID NO: 3798865 - RNA, 17 nt, Salmonella typhimurium LT2
uucccuuuuuaaaauga

SEQ ID NO: 3798866 - RNA, 21 nt, Salmonella typhimurium LT2
uuccgacaauaaaaaugccgc

SEQ ID NO: 3798867 - RNA, 23 nt, Salmonella typhimurium LT2
uuccgacagugaacggcauaauc

SEQ ID NO: 3798868 - RNA, 22 nt, Salmonella typhimurium LT2
uuccgcaaacgccgugaacgcc

SEQ ID NO: 3798869 - RNA, 15 nt, Salmonella typhimurium LT2
uuccgcaauacagcc

SEQ ID NO: 3798870 - RNA, 22 nt, Salmonella typhimurium LT2
uuccgcaauaugcgucagcgcg

SEQ ID NO: 3798871 - RNA, 15 nt, Salmonella typhimurium LT2
uuccgccaccacgcc

SEQ ID NO: 3798872 - RNA, 16 nt, Salmonella typhimurium LT2
uuccgccaccacgccc

SEQ ID NO: 3798873 - RNA, 19 nt, Salmonella typhimurium LT2
uuccgccaccagauaguca

SEQ ID NO: 3798874 - RNA, 23 nt, Salmonella typhimurium LT2
uuccgccaccagauagucaucac

SEQ ID NO: 3798875 - RNA, 14 nt, Salmonella typhimurium LT2
uuccgccagauaca

SEQ ID NO: 3798876 - RNA, 21 nt, Salmonella typhimurium LT2
uuccgccagcgccagcagcag

SEQ ID NO: 3798877 - RNA, 19 nt, Salmonella typhimurium LT2
uuccgcccgcgcucccgcc

SEQ ID NO: 3798878 - RNA, 19 nt, Salmonella typhimurium LT2
uuccgccgcgguauucaua

SEQ ID NO: 3798879 - RNA, 16 nt, Salmonella typhimurium LT2
uuccgccguuaaccgu

SEQ ID NO: 3798880 - RNA, 19 nt, Salmonella typhimurium LT2
uuccgcgagagaaaaaaau

SEQ ID NO: 3798881 - RNA, 16 nt, Salmonella typhimurium LT2
uuccgcgguguccugc

SEQ ID NO: 3798882 - RNA, 20 nt, Salmonella typhimurium LT2
uuccgcuaaaugggcaggag

SEQ ID NO: 3798883 - RNA, 14 nt, Salmonella typhimurium LT2
uuccgcucagcguc

SEQ ID NO: 3798884 - RNA, 21 nt, Salmonella typhimurium LT2
uuccggcaccagaauccacuc

SEQ ID NO: 3798885 - RNA, 18 nt, Salmonella typhimurium LT2
uuccggcacucugcgcca

SEQ ID NO: 3798886 - RNA, 12 nt, Salmonella typhimurium LT2
uuccggcagacg

SEQ ID NO: 3798887 - RNA, 23 nt, Salmonella typhimurium LT2
uuccggcagacgaaaaugcgccu

SEQ ID NO: 3798888 - RNA, 19 nt, Salmonella typhimurium LT2
uuccggcggcagaugcucg

SEQ ID NO: 3798889 - RNA, 18 nt, Salmonella typhimurium LT2
uuccggcggucagccagc

SEQ ID NO: 3798890 - RNA, 16 nt, Salmonella typhimurium LT2
uuccgggccgacagac

SEQ ID NO: 3798891 - RNA, 15 nt, Salmonella typhimurium LT2
uuccggguauucauc

SEQ ID NO: 3798892 - RNA, 17 nt, Salmonella typhimurium LT2
uuccgguacacgcaguc

SEQ ID NO: 3798893 - RNA, 15 nt, Salmonella typhimurium LT2
uuccgguugcccauu

SEQ ID NO: 3798894 - RNA, 14 nt, Salmonella typhimurium LT2
uuccgucaugguga

SEQ ID NO: 3798895 - RNA, 20 nt, Salmonella typhimurium LT2
uuccgucauggugaugaucg

SEQ ID NO: 3798896 - RNA, 17 nt, Salmonella typhimurium LT2
uuccgugaaucccggaa

SEQ ID NO: 3798897 - RNA, 17 nt, Salmonella typhimurium LT2
uuccucgucgcgcgccg

SEQ ID NO: 3798898 - RNA, 15 nt, Salmonella typhimurium LT2
uuccucgucggcaag

SEQ ID NO: 3798899 - RNA, 23 nt, Salmonella typhimurium LT2
uuccucgucggcaagaauuucaa

SEQ ID NO: 3798900 - RNA, 22 nt, Salmonella typhimurium LT2
uuccucucuuaaguauauauga

SEQ ID NO: 3798901 - RNA, 17 nt, Salmonella typhimurium LT2
uuccugaguuuaugagg

SEQ ID NO: 3798902 - RNA, 18 nt, Salmonella typhimurium LT2
uuccugccaggccggacu

SEQ ID NO: 3798903 - RNA, 21 nt, Salmonella typhimurium LT2
uuccugcgcugucaccagcag

SEQ ID NO: 3798904 - RNA, 16 nt, Salmonella typhimurium LT2
uuccugcugcgcuuug

SEQ ID NO: 3798905 - RNA, 11 nt, Salmonella typhimurium LT2
uuccugucaac

SEQ ID NO: 3798906 - RNA, 18 nt, Salmonella typhimurium LT2
uuccuguucgcuuauucc

SEQ ID NO: 3798907 - RNA, 19 nt, Salmonella typhimurium LT2
uuccuguucguucaaaucg

SEQ ID NO: 3798908 - RNA, 17 nt, Salmonella typhimurium LT2
uuccuugauauuuucca

SEQ ID NO: 3798909 - RNA, 12 nt, Salmonella typhimurium LT2
uuccuuuuucag

SEQ ID NO: 3798910 - RNA, 18 nt, Salmonella typhimurium LT2
uucgaacgccgacaucac

SEQ ID NO: 3798911 - RNA, 12 nt, Salmonella typhimurium LT2
uucgaacucuac

SEQ ID NO: 3798912 - RNA, 14 nt, Salmonella typhimurium LT2
uucgaauccuccug

SEQ ID NO: 3798913 - RNA, 12 nt, Salmonella typhimurium LT2
uucgaauucuga

SEQ ID NO: 3798914 - RNA, 21 nt, Salmonella typhimurium LT2
uucgacaauauuuuucagcca

SEQ ID NO: 3798915 - RNA, 12 nt, Salmonella typhimurium LT2
uucgacaucuuc

SEQ ID NO: 3798916 - RNA, 22 nt, Salmonella typhimurium LT2
uucgacggagauuaacagcgcg

SEQ ID NO: 3798917 - RNA, 18 nt, Salmonella typhimurium LT2
uucuggagaguauuuccu

SEQ ID NO: 3798918 - RNA, 20 nt, Salmonella typhimurium LT2
uucuggccccugagcaauca

SEQ ID NO: 3798919 - RNA, 15 nt, Salmonella typhimurium LT2
uucuggcgcagauac

SEQ ID NO: 3798920 - RNA, 12 nt, Salmonella typhimurium LT2
uucuggcgcuga

SEQ ID NO: 3798921 - RNA, 16 nt, Salmonella typhimurium LT2
uucuggcguuacggaa

SEQ ID NO: 3798922 - RNA, 18 nt, Salmonella typhimurium LT2
uucuguaauuugaaauug

SEQ ID NO: 3798923 - RNA, 17 nt, Salmonella typhimurium LT2
uucuguaggcugugcaa

SEQ ID NO: 3798924 - RNA, 16 nt, Salmonella typhimurium LT2
uucuguauaauuauuu

SEQ ID NO: 3798925 - RNA, 16 nt, Salmonella typhimurium LT2
uucugucagcguuuuu

SEQ ID NO: 3798926 - RNA, 23 nt, Salmonella typhimurium LT2
uucuguccauguuuuauacucaa

SEQ ID NO: 3798927 - RNA, 18 nt, Salmonella typhimurium LT2
uucugucguguccuugcc

SEQ ID NO: 3798928 - RNA, 13 nt, Salmonella typhimurium LT2
uucuguuccuaau

SEQ ID NO: 3798929 - RNA, 19 nt, Salmonella typhimurium LT2
uucuguuuguuuuuauuac

SEQ ID NO: 3798930 - RNA, 15 nt, Salmonella typhimurium LT2
uucuuaauggauucu

SEQ ID NO: 3798931 - RNA, 14 nt, Salmonella typhimurium LT2
uucuuaauuccuca

SEQ ID NO: 3798932 - RNA, 17 nt, Salmonella typhimurium LT2
uucuuaucccacagcgu

SEQ ID NO: 3798933 - RNA, 16 nt, Salmonella typhimurium LT2
uucuuaucuguggguc

SEQ ID NO: 3798934 - RNA, 17 nt, Salmonella typhimurium LT2
uucuucaagccaggcuu

SEQ ID NO: 3798935 - RNA, 20 nt, Salmonella typhimurium LT2
uucuucaagcguuuccagag

SEQ ID NO: 3798936 - RNA, 12 nt, Salmonella typhimurium LT2
uucuucaaugaa

SEQ ID NO: 3798937 - RNA, 23 nt, Salmonella typhimurium LT2
uucuucauauuguagguuuuccu

SEQ ID NO: 3798938 - RNA, 23 nt, Salmonella typhimurium LT2
uucuucaucaaagaaauacccuu

SEQ ID NO: 3798939 - RNA, 13 nt, Salmonella typhimurium LT2
uucuucaucuuca

SEQ ID NO: 3798940 - RNA, 14 nt, Salmonella typhimurium LT2
uucuuccauuccca

SEQ ID NO: 3798941 - RNA, 22 nt, Salmonella typhimurium LT2
uucuuccgcaauaugcgucagc

SEQ ID NO: 3798942 - RNA, 19 nt, Salmonella typhimurium LT2
uucuucgccgucauaaaac

SEQ ID NO: 3798943 - RNA, 12 nt, Salmonella typhimurium LT2
uucuucgcuuuc

SEQ ID NO: 3798944 - RNA, 13 nt, Salmonella typhimurium LT2
uucuucugaauau

SEQ ID NO: 3798945 - RNA, 13 nt, Salmonella typhimurium LT2
uucuucuggcugc

SEQ ID NO: 3798946 - RNA, 22 nt, Salmonella typhimurium LT2
uucuugcggugagaaacgcgcc

SEQ ID NO: 3798947 - RNA, 20 nt, Salmonella typhimurium LT2
uucuuuaagaacgguuggaa

SEQ ID NO: 3798948 - RNA, 15 nt, Salmonella typhimurium LT2
uucuuuaaucagauu

SEQ ID NO: 3798949 - RNA, 15 nt, Salmonella typhimurium LT2
uucuuuaauuugugc

SEQ ID NO: 3798950 - RNA, 19 nt, Salmonella typhimurium LT2
uucuuuauucacuuuuucu

SEQ ID NO: 3798951 - RNA, 16 nt, Salmonella typhimurium LT2
uucuuucauuuuaccu

SEQ ID NO: 3798952 - RNA, 14 nt, Salmonella typhimurium LT2
uucuuuccugcaaa

SEQ ID NO: 3798953 - RNA, 16 nt, Salmonella typhimurium LT2
uucuuucgccagaacc

SEQ ID NO: 3798954 - RNA, 17 nt, Salmonella typhimurium LT2
uucuuugcgccuuauuc

SEQ ID NO: 3798955 - RNA, 19 nt, Salmonella typhimurium LT2
uucuuugcgccuuauucag

SEQ ID NO: 3798956 - RNA, 13 nt, Salmonella typhimurium LT2
uucuuugguauug

SEQ ID NO: 3798957 - RNA, 16 nt, Salmonella typhimurium LT2
uucuuuucaauaaagc

SEQ ID NO: 3798958 - RNA, 19 nt, Salmonella typhimurium LT2
uugaaaaccauaauaaugc

SEQ ID NO: 3798959 - RNA, 14 nt, Salmonella typhimurium LT2
uugaaaaggaaaac

SEQ ID NO: 3798960 - RNA, 18 nt, Salmonella typhimurium LT2
uugaaacaucauuucuac

SEQ ID NO: 3798961 - RNA, 22 nt, Salmonella typhimurium LT2
uugaaauacucuuugaacagcc

SEQ ID NO: 3798962 - RNA, 16 nt, Salmonella typhimurium LT2
uugaaaucacgccaca

SEQ ID NO: 3798963 - RNA, 16 nt, Salmonella typhimurium LT2
uugaacauuuuuucag

SEQ ID NO: 3798964 - RNA, 20 nt, Salmonella typhimurium LT2
uugaacggcgucauccggcg

SEQ ID NO: 3798965 - RNA, 15 nt, Salmonella typhimurium LT2
uugaacucuuucaga

SEQ ID NO: 3798966 - RNA, 13 nt, Salmonella typhimurium LT2
uugaagaaaaacc

SEQ ID NO: 3798967 - RNA, 18 nt, Salmonella typhimurium LT2
uugaauaaccauacugac

SEQ ID NO: 3798968 - RNA, 21 nt, Salmonella typhimurium LT2
uugaauaaugcccguugacga

SEQ ID NO: 3798969 - RNA, 12 nt, Salmonella typhimurium LT2
uugaaucugcag

SEQ ID NO: 3798970 - RNA, 13 nt, Salmonella typhimurium LT2
uugaauggcugcu

SEQ ID NO: 3798971 - RNA, 13 nt, Salmonella typhimurium LT2
uugacaaccugcc

SEQ ID NO: 3798972 - RNA, 14 nt, Salmonella typhimurium LT2
uugacacuauauug

SEQ ID NO: 3798973 - RNA, 15 nt, Salmonella typhimurium LT2
uugacauccauaaua

SEQ ID NO: 3798974 - RNA, 15 nt, Salmonella typhimurium LT2
uugaccaacaaucgc

SEQ ID NO: 3798975 - RNA, 18 nt, Salmonella typhimurium LT2
uugaccagauaaucaaac

SEQ ID NO: 3798976 - RNA, 14 nt, Salmonella typhimurium LT2
uugaccaucgccag

SEQ ID NO: 3798977 - RNA, 16 nt, Salmonella typhimurium LT2
uugaccgucauccacg

SEQ ID NO: 3798978 - RNA, 18 nt, Salmonella typhimurium LT2
uugaccgucauccacgcc

SEQ ID NO: 3798979 - RNA, 17 nt, Salmonella typhimurium LT2
uugaccguccccagcca

SEQ ID NO: 3798980 - RNA, 14 nt, Salmonella typhimurium LT2
uugacgaaaagaua

SEQ ID NO: 3798981 - RNA, 15 nt, Salmonella typhimurium LT2
uugacgauaucaucu

SEQ ID NO: 3798982 - RNA, 16 nt, Salmonella typhimurium LT2
uugacgauaucaucuu

SEQ ID NO: 3798983 - RNA, 21 nt, Salmonella typhimurium LT2
uugacgauuuuuaagcugcgc

SEQ ID NO: 3798984 - RNA, 13 nt, Salmonella typhimurium LT2
uugacgcaaacug

SEQ ID NO: 3798985 - RNA, 13 nt, Salmonella typhimurium LT2
uugacgcuuugca

SEQ ID NO: 3798986 - RNA, 15 nt, Salmonella typhimurium LT2
uugacgcuuugcauu

SEQ ID NO: 3798987 - RNA, 16 nt, Salmonella typhimurium LT2
uugacuacucccgucg

SEQ ID NO: 3798988 - RNA, 22 nt, Salmonella typhimurium LT2
uugacuacucccgucgccuguu

SEQ ID NO: 3798989 - RNA, 18 nt, Salmonella typhimurium LT2
uugacucaaaaagaggaa

SEQ ID NO: 3798990 - RNA, 20 nt, Salmonella typhimurium LT2
uugacugaaauuacgccaua

SEQ ID NO: 3798991 - RNA, 18 nt, Salmonella typhimurium LT2
uugacuggauuuuugacu

SEQ ID NO: 3798992 - RNA, 19 nt, Salmonella typhimurium LT2
uugacuucaacgcaggcga

SEQ ID NO: 3798993 - RNA, 17 nt, Salmonella typhimurium LT2
uugacuuuuacgccacg

SEQ ID NO: 3798994 - RNA, 18 nt, Salmonella typhimurium LT2
uugagcgcaaaacgcugc

SEQ ID NO: 3798995 - RNA, 21 nt, Salmonella typhimurium LT2
uugagcgccuuaucgacggcg

SEQ ID NO: 3798996 - RNA, 20 nt, Salmonella typhimurium LT2
uugagcucucuuccagguua

SEQ ID NO: 3798997 - RNA, 15 nt, Salmonella typhimurium LT2
uugaggauugccgcc

SEQ ID NO: 3798998 - RNA, 19 nt, Salmonella typhimurium LT2
uugaguagcaaggcuauug

SEQ ID NO: 3798999 - RNA, 14 nt, Salmonella typhimurium LT2
uugaguaucaaugc

SEQ ID NO: 3799000 - RNA, 12 nt, Salmonella typhimurium LT2
uugauaaagcgc

SEQ ID NO: 3799001 - RNA, 13 nt, Salmonella typhimurium LT2
uugauaacccaac

SEQ ID NO: 3799002 - RNA, 21 nt, Salmonella typhimurium LT2
uugauaacgacucauaauguc

SEQ ID NO: 3799003 - RNA, 18 nt, Salmonella typhimurium LT2
uugauaccuuuaaccucu

SEQ ID NO: 3799004 - RNA, 20 nt, Salmonella typhimurium LT2
uugauacucugcuuuuucac

SEQ ID NO: 3799005 - RNA, 20 nt, Salmonella typhimurium LT2
uugauagcgaucagcgccac

SEQ ID NO: 3799006 - RNA, 20 nt, Salmonella typhimurium LT2
uugaucaggaaaucuuccag

SEQ ID NO: 3799007 - RNA, 18 nt, Salmonella typhimurium LT2
uugaucccgcugaagacu

SEQ ID NO: 3799008 - RNA, 13 nt, Salmonella typhimurium LT2
uugaucguccauc

SEQ ID NO: 3799009 - RNA, 18 nt, Salmonella typhimurium LT2
uugaucuccgcgcaaucg

SEQ ID NO: 3799010 - RNA, 12 nt, Salmonella typhimurium LT2
uugaucugcuug

SEQ ID NO: 3799011 - RNA, 20 nt, Salmonella typhimurium LT2
uugaugauaaccgccgccaa

SEQ ID NO: 3799012 - RNA, 18 nt, Salmonella typhimurium LT2
uugaugaugccaggacca

SEQ ID NO: 3799013 - RNA, 22 nt, Salmonella typhimurium LT2
uugaugcaaauggcggauuugc

SEQ ID NO: 3799014 - RNA, 16 nt, Salmonella typhimurium LT2
uugaugccugcccguc

SEQ ID NO: 3799015 - RNA, 12 nt, Salmonella typhimurium LT2
uugaugccuggc

SEQ ID NO: 3799016 - RNA, 15 nt, Salmonella typhimurium LT2
uugaugccuggcagu

SEQ ID NO: 3799017 - RNA, 23 nt, Salmonella typhimurium LT2
uugaugcuggggauuuuuucugc

SEQ ID NO: 3799018 - RNA, 21 nt, Salmonella typhimurium LT2
uugauucaguucaucuuccac

SEQ ID NO: 3799019 - RNA, 12 nt, Salmonella typhimurium LT2
uugauuuuucau

SEQ ID NO: 3799020 - RNA, 15 nt, Salmonella typhimurium LT2
uugcaaagcccauaa

SEQ ID NO: 3799021 - RNA, 15 nt, Salmonella typhimurium LT2
uugcacguucugcug

SEQ ID NO: 3799022 - RNA, 20 nt, Salmonella typhimurium LT2
uuggccggcuucuccaccau

SEQ ID NO: 3799023 - RNA, 13 nt, Salmonella typhimurium LT2
uuggccugauauc

SEQ ID NO: 3799024 - RNA, 22 nt, Salmonella typhimurium LT2
uuggcgaggaacaucagccagc

SEQ ID NO: 3799025 - RNA, 14 nt, Salmonella typhimurium LT2
uuggcgaucacaau

SEQ ID NO: 3799026 - RNA, 19 nt, Salmonella typhimurium LT2
uuggcguaaaucaggccaa

SEQ ID NO: 3799027 - RNA, 22 nt, Salmonella typhimurium LT2
uuggcguacuuagguacuuccu

SEQ ID NO: 3799028 - RNA, 18 nt, Salmonella typhimurium LT2
uuggcuauuuuuugcugg

SEQ ID NO: 3799029 - RNA, 22 nt, Salmonella typhimurium LT2
uuggcucaauggguacgccaac

SEQ ID NO: 3799030 - RNA, 18 nt, Salmonella typhimurium LT2
uugggaacuagcgaauca

SEQ ID NO: 3799031 - RNA, 20 nt, Salmonella typhimurium LT2
uugggaaggugauguccaga

SEQ ID NO: 3799032 - RNA, 18 nt, Salmonella typhimurium LT2
uugggccggauacgucac

SEQ ID NO: 3799033 - RNA, 23 nt, Salmonella typhimurium LT2
uugggcgcgaaacugcugccgca

SEQ ID NO: 3799034 - RNA, 13 nt, Salmonella typhimurium LT2
uuggggucgucac

SEQ ID NO: 3799035 - RNA, 17 nt, Salmonella typhimurium LT2
uugguaauccacgccaa

SEQ ID NO: 3799036 - RNA, 23 nt, Salmonella typhimurium LT2
uugguaauccacgccaauaauca

SEQ ID NO: 3799037 - RNA, 21 nt, Salmonella typhimurium LT2
uuggugauuaacagcgccauc

SEQ ID NO: 3799038 - RNA, 16 nt, Salmonella typhimurium LT2
uuggugggugaugacg

SEQ ID NO: 3799039 - RNA, 22 nt, Salmonella typhimurium LT2
uuggugugacagcaacaucuau

SEQ ID NO: 3799040 - RNA, 22 nt, Salmonella typhimurium LT2
uugguuaacuucaagguuaugc

SEQ ID NO: 3799041 - RNA, 17 nt, Salmonella typhimurium LT2
uugguuauccagcagcc

SEQ ID NO: 3799042 - RNA, 16 nt, Salmonella typhimurium LT2
uugguucauaccaggu

SEQ ID NO: 3799043 - RNA, 14 nt, Salmonella typhimurium LT2
uugguugccgcaua

SEQ ID NO: 3799044 - RNA, 20 nt, Salmonella typhimurium LT2
uugguuucgccuaagcccac

SEQ ID NO: 3799045 - RNA, 19 nt, Salmonella typhimurium LT2
uuguaaaaccgacuaucag

SEQ ID NO: 3799046 - RNA, 12 nt, Salmonella typhimurium LT2
uuguaacagcag

SEQ ID NO: 3799047 - RNA, 16 nt, Salmonella typhimurium LT2
uuguaauaauuuaaaa

SEQ ID NO: 3799048 - RNA, 16 nt, Salmonella typhimurium LT2
uuguacagcaauaaaa

SEQ ID NO: 3799049 - RNA, 17 nt, Salmonella typhimurium LT2
uuguacagcuugccguc

SEQ ID NO: 3799050 - RNA, 20 nt, Salmonella typhimurium LT2
uuguaccuuuaccccucuuu

SEQ ID NO: 3799051 - RNA, 21 nt, Salmonella typhimurium LT2
uuguacgcuuaguuugcgcga

SEQ ID NO: 3799052 - RNA, 23 nt, Salmonella typhimurium LT2
uuguacuuuugccaggcggauaa

SEQ ID NO: 3799053 - RNA, 12 nt, Salmonella typhimurium LT2
uuguagaccuga

SEQ ID NO: 3799054 - RNA, 16 nt, Salmonella typhimurium LT2
uuguaucagcauuuac

SEQ ID NO: 3799055 - RNA, 12 nt, Salmonella typhimurium LT2
uuguaucgauaa

SEQ ID NO: 3799056 - RNA, 14 nt, Salmonella typhimurium LT2
uugucaccaauaau

SEQ ID NO: 3799057 - RNA, 15 nt, Salmonella typhimurium LT2
uugucaccaauaauu

SEQ ID NO: 3799058 - RNA, 23 nt, Salmonella typhimurium LT2
uugucagcugaacagucccacca

SEQ ID NO: 3799059 - RNA, 15 nt, Salmonella typhimurium LT2
uugucaucagucuca

SEQ ID NO: 3799060 - RNA, 17 nt, Salmonella typhimurium LT2
uugucaucagucucaaa

SEQ ID NO: 3799061 - RNA, 13 nt, Salmonella typhimurium LT2
uuguccacaaacg

SEQ ID NO: 3799062 - RNA, 17 nt, Salmonella typhimurium LT2
uuguccauaaaaugaug

SEQ ID NO: 3799063 - RNA, 12 nt, Salmonella typhimurium LT2
uugucccaggcc

SEQ ID NO: 3799064 - RNA, 13 nt, Salmonella typhimurium LT2
uugucccaggcca

SEQ ID NO: 3799065 - RNA, 13 nt, Salmonella typhimurium LT2
uugucccgccuug

SEQ ID NO: 3799066 - RNA, 22 nt, Salmonella typhimurium LT2
uuguccucaucauucgguuagg

SEQ ID NO: 3799067 - RNA, 13 nt, Salmonella typhimurium LT2
uuguccugguaca

SEQ ID NO: 3799068 - RNA, 18 nt, Salmonella typhimurium LT2
uuguccuuuaucugcccu

SEQ ID NO: 3799069 - RNA, 16 nt, Salmonella typhimurium LT2
uugucgaaauugccgc

SEQ ID NO: 3799070 - RNA, 17 nt, Salmonella typhimurium LT2
uugucggccaggugccg

SEQ ID NO: 3799071 - RNA, 18 nt, Salmonella typhimurium LT2
uugucgugacaugcgcau

SEQ ID NO: 3799072 - RNA, 14 nt, Salmonella typhimurium LT2
uugucuaacuuacc

SEQ ID NO: 3799073 - RNA, 14 nt, Salmonella typhimurium LT2
uugucugaccgggc

SEQ ID NO: 3799074 - RNA, 22 nt, Salmonella typhimurium LT2
uugucugaugauccucggccua

SEQ ID NO: 3799075 - RNA, 17 nt, Salmonella typhimurium LT2
uugugacgaaaaaagac

SEQ ID NO: 3799076 - RNA, 22 nt, Salmonella typhimurium LT2
uugugagcuauacgguaaauca

SEQ ID NO: 3799077 - RNA, 15 nt, Salmonella typhimurium LT2
uugugaguucauaaa

SEQ ID NO: 3799078 - RNA, 13 nt, Salmonella typhimurium LT2
uugugauaauacu

SEQ ID NO: 3799079 - RNA, 23 nt, Salmonella typhimurium LT2
uugugccgacgucgcucccggca

SEQ ID NO: 3799080 - RNA, 23 nt, Salmonella typhimurium LT2
uugugcgcaagaaaaguuucgcu

SEQ ID NO: 3799081 - RNA, 15 nt, Salmonella typhimurium LT2
uuguggcaauauuuu

SEQ ID NO: 3799082 - RNA, 18 nt, Salmonella typhimurium LT2
uuguggcaauauuuugua

SEQ ID NO: 3799083 - RNA, 19 nt, Salmonella typhimurium LT2
uuguggcaauauuuuguag

SEQ ID NO: 3799084 - RNA, 20 nt, Salmonella typhimurium LT2
uuguggguugauaacccaac

SEQ ID NO: 3799085 - RNA, 23 nt, Salmonella typhimurium LT2
uuguucaauagagcgcagcaaaa

SEQ ID NO: 3799086 - RNA, 21 nt, Salmonella typhimurium LT2
uuguucaaucggauaauccgc

SEQ ID NO: 3799087 - RNA, 13 nt, Salmonella typhimurium LT2
uuguucauaucga

SEQ ID NO: 3799088 - RNA, 14 nt, Salmonella typhimurium LT2
uuguuccagcagcu

SEQ ID NO: 3799089 - RNA, 19 nt, Salmonella typhimurium LT2
uuguuccugcuggcaaaac

SEQ ID NO: 3799090 - RNA, 18 nt, Salmonella typhimurium LT2
uuguucgucuuuugaaua

SEQ ID NO: 3799091 - RNA, 19 nt, Salmonella typhimurium LT2
uuguucuuucaccauuaag

SEQ ID NO: 3799092 - RNA, 21 nt, Salmonella typhimurium LT2
uuguugaaacaucauuucuac

SEQ ID NO: 3799093 - RNA, 17 nt, Salmonella typhimurium LT2
uuguugacaucgcacgc

SEQ ID NO: 3799094 - RNA, 13 nt, Salmonella typhimurium LT2
uuguuuaccccag

SEQ ID NO: 3799095 - RNA, 19 nt, Salmonella typhimurium LT2
uuguuuacgcccucaucgg

SEQ ID NO: 3799096 - RNA, 16 nt, Salmonella typhimurium LT2
uuguuugaaaagugaa

SEQ ID NO: 3799097 - RNA, 12 nt, Salmonella typhimurium LT2
uuguuuuuauua

SEQ ID NO: 3799098 - RNA, 16 nt, Salmonella typhimurium LT2
uuuaaaaucagauuga

SEQ ID NO: 3799099 - RNA, 16 nt, Salmonella typhimurium LT2
uuuaaaauccggcugc

SEQ ID NO: 3799100 - RNA, 15 nt, Salmonella typhimurium LT2
uuuaaaccacaccug

SEQ ID NO: 3799101 - RNA, 16 nt, Salmonella typhimurium LT2
uuuaaccucuuuuuca

SEQ ID NO: 3799102 - RNA, 14 nt, Salmonella typhimurium LT2
uuuaacgaacgcgc

SEQ ID NO: 3799103 - RNA, 21 nt, Salmonella typhimurium LT2
uuuaacgcaaccgucucacca

SEQ ID NO: 3799104 - RNA, 15 nt, Salmonella typhimurium LT2
uuuaacuuaaauaaa

SEQ ID NO: 3799105 - RNA, 18 nt, Salmonella typhimurium LT2
uuuaagacuacauacgcg

SEQ ID NO: 3799106 - RNA, 19 nt, Salmonella typhimurium LT2
uuuaagacuuuuuaauuca

SEQ ID NO: 3799107 - RNA, 16 nt, Salmonella typhimurium LT2
uuuaagccgauugaau

SEQ ID NO: 3799108 - RNA, 17 nt, Salmonella typhimurium LT2
uuuaagccgauugaaua

SEQ ID NO: 3799109 - RNA, 23 nt, Salmonella typhimurium LT2
uuuaaggaauaacgcgcuuuuuu

SEQ ID NO: 3799110 - RNA, 16 nt, Salmonella typhimurium LT2
uuuaaggcggcaaaga

SEQ ID NO: 3799111 - RNA, 19 nt, Salmonella typhimurium LT2
uuuaaggcggcaaagauaa

SEQ ID NO: 3799112 - RNA, 20 nt, Salmonella typhimurium LT2
uuuaauauaugaaccaagau

SEQ ID NO: 3799113 - RNA, 22 nt, Salmonella typhimurium LT2
uuuaaugcccuccgcaucaaaa

SEQ ID NO: 3799114 - RNA, 18 nt, Salmonella typhimurium LT2
uuuaaugcuuuccagcca

SEQ ID NO: 3799115 - RNA, 23 nt, Salmonella typhimurium LT2
uuuaauuccaccagcuuaucuga

SEQ ID NO: 3799116 - RNA, 14 nt, Salmonella typhimurium LT2
uuuaauuuaauaau

SEQ ID NO: 3799117 - RNA, 14 nt, Salmonella typhimurium LT2
uuuaauuuuuccuu

SEQ ID NO: 3799118 - RNA, 22 nt, Salmonella typhimurium LT2
uuuacaggcgauuuuuuacugu

SEQ ID NO: 3799119 - RNA, 21 nt, Salmonella typhimurium LT2
uuuacaucggcguguuucauu

SEQ ID NO: 3799120 - RNA, 21 nt, Salmonella typhimurium LT2
uuuaccaucuacuaucaucug

SEQ ID NO: 3799121 - RNA, 20 nt, Salmonella typhimurium LT2
uuuacccacuucuuccagcg

SEQ ID NO: 3799122 - RNA, 21 nt, Salmonella typhimurium LT2
uuuacccggcguauccaguaa

SEQ ID NO: 3799123 - RNA, 14 nt, Salmonella typhimurium LT2
uuuaccgccgccgu

SEQ ID NO: 3799124 - RNA, 18 nt, Salmonella typhimurium LT2
uuuaccgccgcuuuucag

SEQ ID NO: 3799125 - RNA, 14 nt, Salmonella typhimurium LT2
uuuaccgucacgcg

SEQ ID NO: 3799126 - RNA, 21 nt, Salmonella typhimurium LT2
uuugaucccguccgcgcucau

SEQ ID NO: 3799127 - RNA, 20 nt, Salmonella typhimurium LT2
uuugauccguuucagaaaga

SEQ ID NO: 3799128 - RNA, 23 nt, Salmonella typhimurium LT2
uuugaucugaagcguauuucugu

SEQ ID NO: 3799129 - RNA, 13 nt, Salmonella typhimurium LT2
uuugcaacagggc

SEQ ID NO: 3799130 - RNA, 19 nt, Salmonella typhimurium LT2
uuugcaaugcgcuccagcu

SEQ ID NO: 3799131 - RNA, 13 nt, Salmonella typhimurium LT2
uuugcaauggccc

SEQ ID NO: 3799132 - RNA, 16 nt, Salmonella typhimurium LT2
uuugcaccgcuaaaaa

SEQ ID NO: 3799133 - RNA, 17 nt, Salmonella typhimurium LT2
uuugcaccgcuaaaaaa

SEQ ID NO: 3799134 - RNA, 20 nt, Salmonella typhimurium LT2
uuugcaccgcuaaaaaacag

SEQ ID NO: 3799135 - RNA, 12 nt, Salmonella typhimurium LT2
uuugcagaaaau

SEQ ID NO: 3799136 - RNA, 15 nt, Salmonella typhimurium LT2
uuugcagcaaauaca

SEQ ID NO: 3799137 - RNA, 16 nt, Salmonella typhimurium LT2
uuugcagcaaauacag

SEQ ID NO: 3799138 - RNA, 18 nt, Salmonella typhimurium LT2
uuugcagcaacugauuca

SEQ ID NO: 3799139 - RNA, 22 nt, Salmonella typhimurium LT2
uuugcagccagauaucgcguac

SEQ ID NO: 3799140 - RNA, 13 nt, Salmonella typhimurium LT2
uuugcauaaauaa

SEQ ID NO: 3799141 - RNA, 17 nt, Salmonella typhimurium LT2
uuugcauaccaaguuug

SEQ ID NO: 3799142 - RNA, 20 nt, Salmonella typhimurium LT2
uuugcauaggccccgguggc

SEQ ID NO: 3799143 - RNA, 13 nt, Salmonella typhimurium LT2
uuugcaucacgcg

SEQ ID NO: 3799144 - RNA, 19 nt, Salmonella typhimurium LT2
uuugccagacgggccaggc

SEQ ID NO: 3799145 - RNA, 22 nt, Salmonella typhimurium LT2
uuugcccagcgcuggcagaucg

SEQ ID NO: 3799146 - RNA, 23 nt, Salmonella typhimurium LT2
uuugcccgagcgcuggcauuccc

SEQ ID NO: 3799147 - RNA, 17 nt, Salmonella typhimurium LT2
uuugcccgcguucugcu

SEQ ID NO: 3799148 - RNA, 23 nt, Salmonella typhimurium LT2
uuugccgaauggcggcuucgcca

SEQ ID NO: 3799149 - RNA, 15 nt, Salmonella typhimurium LT2
uuugccgcaaacgcc

SEQ ID NO: 3799150 - RNA, 22 nt, Salmonella typhimurium LT2
uuugccgcgcucuuuaaacgcc

SEQ ID NO: 3799151 - RNA, 15 nt, Salmonella typhimurium LT2
uuugccucuggccag

SEQ ID NO: 3799152 - RNA, 21 nt, Salmonella typhimurium LT2
uuugccucuggccaguuucaa

SEQ ID NO: 3799153 - RNA, 16 nt, Salmonella typhimurium LT2
uuugccugaaacgugc

SEQ ID NO: 3799154 - RNA, 14 nt, Salmonella typhimurium LT2
uuugccuuucuuau

SEQ ID NO: 3799155 - RNA, 19 nt, Salmonella typhimurium LT2
uuugccuuuugacagcaca

SEQ ID NO: 3799156 - RNA, 15 nt, Salmonella typhimurium LT2
uuugcgacacgcugc

SEQ ID NO: 3799157 - RNA, 22 nt, Salmonella typhimurium LT2
uuugcgcccgcgaucgcuucca

SEQ ID NO: 3799158 - RNA, 23 nt, Salmonella typhimurium LT2
uuugcgccgccagugaggugaua

SEQ ID NO: 3799159 - RNA, 15 nt, Salmonella typhimurium LT2
uuugcgccuuccagu

SEQ ID NO: 3799160 - RNA, 24 nt, Salmonella typhimurium LT2
uuugcgcggauugagcgaauccag

SEQ ID NO: 3799161 - RNA, 11 nt, Salmonella typhimurium LT2
uuugcgcggcu

SEQ ID NO: 3799162 - RNA, 22 nt, Salmonella typhimurium LT2
uuugcggacuagacagccucuc

SEQ ID NO: 3799163 - RNA, 22 nt, Salmonella typhimurium LT2
uuugcggcguccaguacuuucu

SEQ ID NO: 3799164 - RNA, 19 nt, Salmonella typhimurium LT2
uuugcggcgucgccuggug

SEQ ID NO: 3799165 - RNA, 16 nt, Salmonella typhimurium LT2
uuugcgguuuuaauuu

SEQ ID NO: 3799166 - RNA, 16 nt, Salmonella typhimurium LT2
uuugcguaaaaaaaca

SEQ ID NO: 3799167 - RNA, 17 nt, Salmonella typhimurium LT2
uuugcguaaaaaaacau

SEQ ID NO: 3799168 - RNA, 19 nt, Salmonella typhimurium LT2
uuugcuacaccccuucugg

SEQ ID NO: 3799169 - RNA, 20 nt, Salmonella typhimurium LT2
uuugcucccuggugcgaucg

SEQ ID NO: 3799170 - RNA, 12 nt, Salmonella typhimurium LT2
uuugcucgccau

SEQ ID NO: 3799171 - RNA, 15 nt, Salmonella typhimurium LT2
uuugcugacaaucug

SEQ ID NO: 3799172 - RNA, 19 nt, Salmonella typhimurium LT2
uuugcugacaaucugcugg

SEQ ID NO: 3799173 - RNA, 23 nt, Salmonella typhimurium LT2
uuugcugcaacgacgcgggaucg

SEQ ID NO: 3799174 - RNA, 21 nt, Salmonella typhimurium LT2
uuugcugggcuuuuaaccacg

SEQ ID NO: 3799175 - RNA, 16 nt, Salmonella typhimurium LT2
uuugcuuauccggccu

SEQ ID NO: 3799176 - RNA, 18 nt, Salmonella typhimurium LT2
uuugcuuccgccuucucg

SEQ ID NO: 3799177 - RNA, 14 nt, Salmonella typhimurium LT2
uuugcuucucgccu

SEQ ID NO: 3799178 - RNA, 19 nt, Salmonella typhimurium LT2
uuugcuuuguaaagcgcca

SEQ ID NO: 3799179 - RNA, 18 nt, Salmonella typhimurium LT2
uuuggcaaucaaauccaa

SEQ ID NO: 3799180 - RNA, 15 nt, Salmonella typhimurium LT2
uuuggcaaucuuuag

SEQ ID NO: 3799181 - RNA, 19 nt, Salmonella typhimurium LT2
uuuggcaccguuagugauu

SEQ ID NO: 3799182 - RNA, 19 nt, Salmonella typhimurium LT2
uuuggcacgacuuuuccuu

SEQ ID NO: 3799183 - RNA, 23 nt, Salmonella typhimurium LT2
uuuggcguacuuagguacuuccu

SEQ ID NO: 3799184 - RNA, 17 nt, Salmonella typhimurium LT2
uuuggcuuaaauaaucu

SEQ ID NO: 3799185 - RNA, 19 nt, Salmonella typhimurium LT2
uuuggcuuuaugaauauca

SEQ ID NO: 3799186 - RNA, 15 nt, Salmonella typhimurium LT2
uuuggugugacagca

SEQ ID NO: 3799187 - RNA, 20 nt, Salmonella typhimurium LT2
uuugguuauccagcagccag

SEQ ID NO: 3799188 - RNA, 18 nt, Salmonella typhimurium LT2
uuugguuccuucagcuuc

SEQ ID NO: 3799189 - RNA, 15 nt, Salmonella typhimurium LT2
uuugguugccugcag

SEQ ID NO: 3799190 - RNA, 17 nt, Salmonella typhimurium LT2
uuuguaaaauacauucu

SEQ ID NO: 3799191 - RNA, 19 nt, Salmonella typhimurium LT2
uuuguaaaauacauucucu

SEQ ID NO: 3799192 - RNA, 13 nt, Salmonella typhimurium LT2
uuuguaaauacug

SEQ ID NO: 3799193 - RNA, 15 nt, Salmonella typhimurium LT2
uuuguaacaggaacg

SEQ ID NO: 3799194 - RNA, 17 nt, Salmonella typhimurium LT2
uuuguaacauauuuuua

SEQ ID NO: 3799195 - RNA, 18 nt, Salmonella typhimurium LT2
uuuguaacauauuuuuau

SEQ ID NO: 3799196 - RNA, 21 nt, Salmonella typhimurium LT2
uuuguaacgaacgcugcaucg

SEQ ID NO: 3799197 - RNA, 22 nt, Salmonella typhimurium LT2
uuuguaauacaggcguguggca

SEQ ID NO: 3799198 - RNA, 18 nt, Salmonella typhimurium LT2
uuuguacguauuuacaaa

SEQ ID NO: 3799199 - RNA, 16 nt, Salmonella typhimurium LT2
uuuguaggccuaaaaa

SEQ ID NO: 3799200 - RNA, 19 nt, Salmonella typhimurium LT2
uuuguaggccuaaaaauag

SEQ ID NO: 3799201 - RNA, 16 nt, Salmonella typhimurium LT2
uuugucagagggccaa

SEQ ID NO: 3799202 - RNA, 17 nt, Salmonella typhimurium LT2
uuugucucuucaugccu

SEQ ID NO: 3799203 - RNA, 18 nt, Salmonella typhimurium LT2
uuugucugucggacucag

SEQ ID NO: 3799204 - RNA, 13 nt, Salmonella typhimurium LT2
uuugugagacaaa

SEQ ID NO: 3799205 - RNA, 18 nt, Salmonella typhimurium LT2
uuugugaguucauaaaag

SEQ ID NO: 3799206 - RNA, 22 nt, Salmonella typhimurium LT2
uuugugcccguuuuacaucuuu

SEQ ID NO: 3799207 - RNA, 23 nt, Salmonella typhimurium LT2
uuuguggccugcuuaaacagaau

SEQ ID NO: 3799208 - RNA, 16 nt, Salmonella typhimurium LT2
uuuguggcguguggcu

SEQ ID NO: 3799209 - RNA, 22 nt, Salmonella typhimurium LT2
uuuguucagacacauucuguga

SEQ ID NO: 3799210 - RNA, 21 nt, Salmonella typhimurium LT2
uuuguugcuccagcaucacau

SEQ ID NO: 3799211 - RNA, 12 nt, Salmonella typhimurium LT2
uuuguuuaaaaa

SEQ ID NO: 3799212 - RNA, 23 nt, Salmonella typhimurium LT2
uuuuaaaaaauuggguaguaaua

SEQ ID NO: 3799213 - RNA, 12 nt, Salmonella typhimurium LT2
uuuuaaaaauaa

SEQ ID NO: 3799214 - RNA, 12 nt, Salmonella typhimurium LT2
uuuuaaaaguua

SEQ ID NO: 3799215 - RNA, 13 nt, Salmonella typhimurium LT2
uuuuaaaaguuag

SEQ ID NO: 3799216 - RNA, 14 nt, Salmonella typhimurium LT2
uuuuaaaccaaucu

SEQ ID NO: 3799217 - RNA, 19 nt, Salmonella typhimurium LT2
uuuuaaaccgcgauaaacc

SEQ ID NO: 3799218 - RNA, 12 nt, Salmonella typhimurium LT2
uuuuaaauuccu

SEQ ID NO: 3799219 - RNA, 14 nt, Salmonella typhimurium LT2
uuuuaaccuucuac

SEQ ID NO: 3799220 - RNA, 18 nt, Salmonella typhimurium LT2
uuuuaaccuucuaccccg

SEQ ID NO: 3799221 - RNA, 17 nt, Salmonella typhimurium LT2
uuuuaacgucaucacca

SEQ ID NO: 3799222 - RNA, 17 nt, Salmonella typhimurium LT2
uuuuaagacuuuuuaau

SEQ ID NO: 3799223 - RNA, 18 nt, Salmonella typhimurium LT2
uuuuaagacuuuuuaauu

SEQ ID NO: 3799224 - RNA, 21 nt, Salmonella typhimurium LT2
uuuuaagccguagaccuggcu

SEQ ID NO: 3799225 - RNA, 16 nt, Salmonella typhimurium LT2
uuuuaagcuucuuauu

SEQ ID NO: 3799226 - RNA, 20 nt, Salmonella typhimurium LT2
uuuuaaggcggcaaagauaa

SEQ ID NO: 3799227 - RNA, 17 nt, Salmonella typhimurium LT2
uuuuaagguuaauucug

SEQ ID NO: 3799228 - RNA, 22 nt, Salmonella typhimurium LT2
uuuuaauguccagcagugucug

SEQ ID NO: 3799229 - RNA, 21 nt, Salmonella typhimurium LT2
uuuuuccagcacggcauaagc

SEQ ID NO: 3799230 - RNA, 22 nt, Salmonella typhimurium LT2
uuuuuccguguggacccgcuua

SEQ ID NO: 3799231 - RNA, 18 nt, Salmonella typhimurium LT2
uuuuucguaccguaaacc

SEQ ID NO: 3799232 - RNA, 22 nt, Salmonella typhimurium LT2
uuuuucugucguguccuugcca

SEQ ID NO: 3799233 - RNA, 12 nt, Salmonella typhimurium LT2
uuuuucuucagu

SEQ ID NO: 3799234 - RNA, 22 nt, Salmonella typhimurium LT2
uuuuugacgcuauaacugaagg

SEQ ID NO: 3799235 - RNA, 21 nt, Salmonella typhimurium LT2
uuuuugcgacacgcugcauau

SEQ ID NO: 3799236 - RNA, 16 nt, Salmonella typhimurium LT2
uuuuugguucauacca

SEQ ID NO: 3799237 - RNA, 12 nt, Salmonella typhimurium LT2
uuuuuuaccauu

SEQ ID NO: 3799238 - RNA, 19 nt, Salmonella typhimurium LT2
uuuuuuacuuucaaaauac

SEQ ID NO: 3799239 - RNA, 13 nt, Salmonella typhimurium LT2
uuuuuuauccauu

SEQ ID NO: 3799240 - RNA, 10 nt, Salmonella typhimurium LT2
uuuuuuccug

SEQ ID NO: 3799241 - RNA, 21 nt, Salmonella typhimurium LT2
uuuuuucuguuauuuccgcaa

SEQ ID NO: 3799242 - RNA, 15 nt, Salmonella typhimurium LT2
uuuuuucuucaguuc

SEQ ID NO: 3799243 - RNA, 11 nt, Salmonella typhimurium LT2
uuuuuuugccc

SEQ ID NO: 3799244 - RNA, 19 nt, Salmonella typhimurium LT2
aacauuacaauguacagaa

SEQ ID NO: 3799245 - RNA, 17 nt, Salmonella typhimurium LT2
aacauucaaaccuucaa

SEQ ID NO: 3799246 - RNA, 22 nt, Salmonella typhimurium LT2
aacauuccgcccaggaacauga

SEQ ID NO: 3799247 - RNA, 12 nt, Salmonella typhimurium LT2
aacauugcgccg

SEQ ID NO: 3799248 - RNA, 18 nt, Salmonella typhimurium LT2
aacauugguuaucaaaaa

SEQ ID NO: 3799249 - RNA, 18 nt, Salmonella typhimurium LT2
aacauuuuuguaauacag

SEQ ID NO: 3799250 - RNA, 14 nt, Salmonella typhimurium LT2
aaccaaaugcccag

SEQ ID NO: 3799251 - RNA, 14 nt, Salmonella typhimurium LT2
aaccaacugagcua

SEQ ID NO: 3799252 - RNA, 12 nt, Salmonella typhimurium LT2
aaccaagauaag

SEQ ID NO: 3799253 - RNA, 15 nt, Salmonella typhimurium LT2
aaccacaaguuuauc

SEQ ID NO: 3799254 - RNA, 19 nt, Salmonella typhimurium LT2
aaccacaaucacagcgcag

SEQ ID NO: 3799255 - RNA, 13 nt, Salmonella typhimurium LT2
aaccaccagcagu

SEQ ID NO: 3799256 - RNA, 19 nt, Salmonella typhimurium LT2
aaccaccagcggaaucccc

SEQ ID NO: 3799257 - RNA, 20 nt, Salmonella typhimurium LT2
aaccaccauacccaacagca

SEQ ID NO: 3799258 - RNA, 21 nt, Salmonella typhimurium LT2
aaccaccggcgcgccagcgca

SEQ ID NO: 3799259 - RNA, 19 nt, Salmonella typhimurium LT2
aaccacgaaguaccacuaa

SEQ ID NO: 3799260 - RNA, 10 nt, Salmonella typhimurium LT2
aaccacgcca

SEQ ID NO: 3799261 - RNA, 17 nt, Salmonella typhimurium LT2
aaccacgccaaccaucg

SEQ ID NO: 3799262 - RNA, 20 nt, Salmonella typhimurium LT2
aaccacgccauggccgcagc

SEQ ID NO: 3799263 - RNA, 19 nt, Salmonella typhimurium LT2
aaccacuggugacaucgcc

SEQ ID NO: 3799264 - RNA, 22 nt, Salmonella typhimurium LT2
aaccagaaaaccgacagcaaua

SEQ ID NO: 3799265 - RNA, 14 nt, Salmonella typhimurium LT2
aaccagaauuuguu

SEQ ID NO: 3799266 - RNA, 21 nt, Salmonella typhimurium LT2
aaccagacccgcugcgucacg

SEQ ID NO: 3799267 - RNA, 23 nt, Salmonella typhimurium LT2
aaccagacgguuuauccccgcug

SEQ ID NO: 3799268 - RNA, 22 nt, Salmonella typhimurium LT2
aaccagauaccccgccaaaccg

SEQ ID NO: 3799269 - RNA, 17 nt, Salmonella typhimurium LT2
aaccagcauaauauuca

SEQ ID NO: 3799270 - RNA, 18 nt, Salmonella typhimurium LT2
aaccagccccagaaaauu

SEQ ID NO: 3799271 - RNA, 19 nt, Salmonella typhimurium LT2
aaccagccccagaaaauua

SEQ ID NO: 3799272 - RNA, 11 nt, Salmonella typhimurium LT2
aaccagcgaaa

SEQ ID NO: 3799273 - RNA, 17 nt, Salmonella typhimurium LT2
aaccagcgcgccgccaa

SEQ ID NO: 3799274 - RNA, 17 nt, Salmonella typhimurium LT2
aaccagcgcggccagaa

SEQ ID NO: 3799275 - RNA, 15 nt, Salmonella typhimurium LT2
aaccagcuauccagc

SEQ ID NO: 3799276 - RNA, 18 nt, Salmonella typhimurium LT2
aaccaggacccgugacgc

SEQ ID NO: 3799277 - RNA, 23 nt, Salmonella typhimurium LT2
aaccaggauucaacgcgugaucc

SEQ ID NO: 3799278 - RNA, 18 nt, Salmonella typhimurium LT2
aaccaggcaaaccagcac

SEQ ID NO: 3799279 - RNA, 11 nt, Salmonella typhimurium LT2
aaccaggcaac

SEQ ID NO: 3799280 - RNA, 14 nt, Salmonella typhimurium LT2
aaccaggcauuuuc

SEQ ID NO: 3799281 - RNA, 16 nt, Salmonella typhimurium LT2
aaccaggcgaaaauag

SEQ ID NO: 3799282 - RNA, 15 nt, Salmonella typhimurium LT2
aaccagguuuccaga

SEQ ID NO: 3799283 - RNA, 16 nt, Salmonella typhimurium LT2
aaccagguuuccagau

SEQ ID NO: 3799284 - RNA, 16 nt, Salmonella typhimurium LT2
aaccaguaacggcagu

SEQ ID NO: 3799285 - RNA, 18 nt, Salmonella typhimurium LT2
aaccagugaauacugcgc

SEQ ID NO: 3799286 - RNA, 19 nt, Salmonella typhimurium LT2
aaccagugaauacugcgcg

SEQ ID NO: 3799287 - RNA, 14 nt, Salmonella typhimurium LT2
aaccauaauaaaua

SEQ ID NO: 3799288 - RNA, 14 nt, Salmonella typhimurium LT2
aaccauaauaaugc

SEQ ID NO: 3799289 - RNA, 18 nt, Salmonella typhimurium LT2
aaccauaauaaugccaaa

SEQ ID NO: 3799290 - RNA, 12 nt, Salmonella typhimurium LT2
aaccauacauug

SEQ ID NO: 3799291 - RNA, 23 nt, Salmonella typhimurium LT2
aaccauacauugaguaaauaaau

SEQ ID NO: 3799292 - RNA, 17 nt, Salmonella typhimurium LT2
aaccaucaguucagggc

SEQ ID NO: 3799293 - RNA, 16 nt, Salmonella typhimurium LT2
aaccaucgacccccac

SEQ ID NO: 3799294 - RNA, 21 nt, Salmonella typhimurium LT2
aaccaugaacgauguaucgcg

SEQ ID NO: 3799295 - RNA, 19 nt, Salmonella typhimurium LT2
aaccaugcccgggcgcugu

SEQ ID NO: 3799296 - RNA, 22 nt, Salmonella typhimurium LT2
aaccauguugaucguaaaauga

SEQ ID NO: 3799297 - RNA, 21 nt, Salmonella typhimurium LT2
aaccauucccguaaaagaaga

SEQ ID NO: 3799298 - RNA, 17 nt, Salmonella typhimurium LT2
aaccauugcuaaaaaua

SEQ ID NO: 3799299 - RNA, 14 nt, Salmonella typhimurium LT2
aacccacuuugcuu

SEQ ID NO: 3799300 - RNA, 19 nt, Salmonella typhimurium LT2
aacccauauucgucuucau

SEQ ID NO: 3799301 - RNA, 11 nt, Salmonella typhimurium LT2
aacccauggcu

SEQ ID NO: 3799302 - RNA, 15 nt, Salmonella typhimurium LT2
aaccccaaacaccaa

SEQ ID NO: 3799303 - RNA, 19 nt, Salmonella typhimurium LT2
aaccccacccgcugauaaa

SEQ ID NO: 3799304 - RNA, 16 nt, Salmonella typhimurium LT2
aaccccagcugcggca

SEQ ID NO: 3799305 - RNA, 22 nt, Salmonella typhimurium LT2
aaccccaggucagcaguuuuuc

SEQ ID NO: 3799306 - RNA, 22 nt, Salmonella typhimurium LT2
aaccccggcaaaccuaccggca

SEQ ID NO: 3799307 - RNA, 14 nt, Salmonella typhimurium LT2
aacccgauacccug

SEQ ID NO: 3799308 - RNA, 16 nt, Salmonella typhimurium LT2
aacccgauucugccag

SEQ ID NO: 3799309 - RNA, 17 nt, Salmonella typhimurium LT2
aacccgcuacgcgugau

SEQ ID NO: 3799310 - RNA, 15 nt, Salmonella typhimurium LT2
aacccggcugagcgu

SEQ ID NO: 3799311 - RNA, 22 nt, Salmonella typhimurium LT2
aacccggugaaaaacaucggca

SEQ ID NO: 3799312 - RNA, 23 nt, Salmonella typhimurium LT2
aacccgucaccgccagugcauag

SEQ ID NO: 3799313 - RNA, 12 nt, Salmonella typhimurium LT2
aacccuccugcc

SEQ ID NO: 3799314 - RNA, 16 nt, Salmonella typhimurium LT2
aaccgaacaacgccag

SEQ ID NO: 3799315 - RNA, 16 nt, Salmonella typhimurium LT2
aaccgaauccuuugga

SEQ ID NO: 3799316 - RNA, 15 nt, Salmonella typhimurium LT2
aaccgaauucgucca

SEQ ID NO: 3799317 - RNA, 22 nt, Salmonella typhimurium LT2
aaccgacagcaauaucagccau

SEQ ID NO: 3799318 - RNA, 23 nt, Salmonella typhimurium LT2
aaccgacugucgaaaccagcaua

SEQ ID NO: 3799319 - RNA, 13 nt, Salmonella typhimurium LT2
aaccgagauacau

SEQ ID NO: 3799320 - RNA, 19 nt, Salmonella typhimurium LT2
aaccgagguucaccagcgc

SEQ ID NO: 3799321 - RNA, 21 nt, Salmonella typhimurium LT2
aaccgauguaucaaccgcuuu

SEQ ID NO: 3799322 - RNA, 13 nt, Salmonella typhimurium LT2
aaccgcaaauaau

SEQ ID NO: 3799323 - RNA, 19 nt, Salmonella typhimurium LT2
aaccgcagaaaaagccccc

SEQ ID NO: 3799324 - RNA, 14 nt, Salmonella typhimurium LT2
aaccgccagaugau

SEQ ID NO: 3799325 - RNA, 15 nt, Salmonella typhimurium LT2
aaccgcccccaacug

SEQ ID NO: 3799326 - RNA, 17 nt, Salmonella typhimurium LT2
aaccgccgcgauagacc

SEQ ID NO: 3799327 - RNA, 23 nt, Salmonella typhimurium LT2
aaccgccggauggcggcuaccuc

SEQ ID NO: 3799328 - RNA, 22 nt, Salmonella typhimurium LT2
aaccgcgcggcguucugcgcca

SEQ ID NO: 3799329 - RNA, 14 nt, Salmonella typhimurium LT2
aaccgcgcguaaau

SEQ ID NO: 3799330 - RNA, 19 nt, Salmonella typhimurium LT2
aaccgcgcuggaaagcggc

SEQ ID NO: 3799331 - RNA, 23 nt, Salmonella typhimurium LT2
aaccgcuaaugaggaaaaagccg

SEQ ID NO: 3799332 - RNA, 23 nt, Salmonella typhimurium LT2
aaccgcucacgguuucuacuucc

SEQ ID NO: 3799333 - RNA, 15 nt, Salmonella typhimurium LT2
aaccgcucuccgcaa

SEQ ID NO: 3799334 - RNA, 14 nt, Salmonella typhimurium LT2
aaccgcugaccauc

SEQ ID NO: 3799335 - RNA, 18 nt, Salmonella typhimurium LT2
aaccggcaacucgccggu

SEQ ID NO: 3799336 - RNA, 15 nt, Salmonella typhimurium LT2
aaccggcaugaagac

SEQ ID NO: 3799337 - RNA, 17 nt, Salmonella typhimurium LT2
aaccggcgaauagcgcc

SEQ ID NO: 3799338 - RNA, 23 nt, Salmonella typhimurium LT2
aaccggcgauguuggcgcccuga

SEQ ID NO: 3799339 - RNA, 21 nt, Salmonella typhimurium LT2
aaccggcgcgccuuccagcaa

SEQ ID NO: 3799340 - RNA, 16 nt, Salmonella typhimurium LT2
aaccggguugcggaag

SEQ ID NO: 3799341 - RNA, 13 nt, Salmonella typhimurium LT2
aaccggguuuuuc

SEQ ID NO: 3799342 - RNA, 22 nt, Salmonella typhimurium LT2
aaccgguggucaucgcggccag

SEQ ID NO: 3799343 - RNA, 20 nt, Salmonella typhimurium LT2
aaccguaaacgccugcacca

SEQ ID NO: 3799344 - RNA, 19 nt, Salmonella typhimurium LT2
aaccgucacgaucuggcaa

SEQ ID NO: 3799345 - RNA, 18 nt, Salmonella typhimurium LT2
aaccgucucaccaggcgu

SEQ ID NO: 3799346 - RNA, 17 nt, Salmonella typhimurium LT2
aaccguggcaccccucu

SEQ ID NO: 3799347 - RNA, 16 nt, Salmonella typhimurium LT2
aaccguugcgcccauc

SEQ ID NO: 3799348 - RNA, 20 nt, Salmonella typhimurium LT2
aacgccuuauccggccuacu

SEQ ID NO: 3799349 - RNA, 18 nt, Salmonella typhimurium LT2
aacgccuuccugccagca

SEQ ID NO: 3799350 - RNA, 14 nt, Salmonella typhimurium LT2
aacgccuucguccg

SEQ ID NO: 3799351 - RNA, 11 nt, Salmonella typhimurium LT2
aacgcgaaaau

SEQ ID NO: 3799352 - RNA, 21 nt, Salmonella typhimurium LT2
aacgcgaaaauaccccagcgc

SEQ ID NO: 3799353 - RNA, 15 nt, Salmonella typhimurium LT2
aacgcgaagauuaau

SEQ ID NO: 3799354 - RNA, 17 nt, Salmonella typhimurium LT2
aacgcgaaggccagcac

SEQ ID NO: 3799355 - RNA, 13 nt, Salmonella typhimurium LT2
aacgcgacaacgc

SEQ ID NO: 3799356 - RNA, 17 nt, Salmonella typhimurium LT2
aacgcgcauaccgcuuu

SEQ ID NO: 3799357 - RNA, 18 nt, Salmonella typhimurium LT2
aacgcgcaucaacgccag

SEQ ID NO: 3799358 - RNA, 15 nt, Salmonella typhimurium LT2
aacgcgccacgaaca

SEQ ID NO: 3799359 - RNA, 16 nt, Salmonella typhimurium LT2
aacgcgccacgcgcca

SEQ ID NO: 3799360 - RNA, 18 nt, Salmonella typhimurium LT2
aacgcgccaugcgcggca

SEQ ID NO: 3799361 - RNA, 18 nt, Salmonella typhimurium LT2
aacgcgcccaacggaugc

SEQ ID NO: 3799362 - RNA, 17 nt, Salmonella typhimurium LT2
aacgcgcucgccagcgc

SEQ ID NO: 3799363 - RNA, 20 nt, Salmonella typhimurium LT2
aacgcggauggcguuaacgc

SEQ ID NO: 3799364 - RNA, 12 nt, Salmonella typhimurium LT2
aacgcggccugg

SEQ ID NO: 3799365 - RNA, 23 nt, Salmonella typhimurium LT2
aacgcggcgacuauugcgccgac

SEQ ID NO: 3799366 - RNA, 18 nt, Salmonella typhimurium LT2
aacgcgggcguaauacau

SEQ ID NO: 3799367 - RNA, 23 nt, Salmonella typhimurium LT2
aacgcgucggcgcggggaacaca

SEQ ID NO: 3799368 - RNA, 16 nt, Salmonella typhimurium LT2
aacgcgugcaagggaa

SEQ ID NO: 3799369 - RNA, 14 nt, Salmonella typhimurium LT2
aacgcgugcucuuu

SEQ ID NO: 3799370 - RNA, 23 nt, Salmonella typhimurium LT2
aacgcucuuaccgcuaaaauacc

SEQ ID NO: 3799371 - RNA, 13 nt, Salmonella typhimurium LT2
aacgcugauacug

SEQ ID NO: 3799372 - RNA, 22 nt, Salmonella typhimurium LT2
aacgcuggccgcaaauccacug

SEQ ID NO: 3799373 - RNA, 12 nt, Salmonella typhimurium LT2
aacgcuggucag

SEQ ID NO: 3799374 - RNA, 22 nt, Salmonella typhimurium LT2
aacgcuguugccgcugcuggca

SEQ ID NO: 3799375 - RNA, 15 nt, Salmonella typhimurium LT2
aacgcuuaaucccuu

SEQ ID NO: 3799376 - RNA, 20 nt, Salmonella typhimurium LT2
aacgcuuccggaucgcggcu

SEQ ID NO: 3799377 - RNA, 21 nt, Salmonella typhimurium LT2
aacgcuuuccaguugcggcau

SEQ ID NO: 3799378 - RNA, 15 nt, Salmonella typhimurium LT2
aacgcuuucgccagc

SEQ ID NO: 3799379 - RNA, 17 nt, Salmonella typhimurium LT2
aacgcuuuugcgcacug

SEQ ID NO: 3799380 - RNA, 22 nt, Salmonella typhimurium LT2
aacgcuuuugcgcacugcucgu

SEQ ID NO: 3799381 - RNA, 13 nt, Salmonella typhimurium LT2
aacggaaccaaau

SEQ ID NO: 3799382 - RNA, 23 nt, Salmonella typhimurium LT2
aacggaauguuccccguugagaa

SEQ ID NO: 3799383 - RNA, 22 nt, Salmonella typhimurium LT2
aacggagauauagaccagcgcc

SEQ ID NO: 3799384 - RNA, 23 nt, Salmonella typhimurium LT2
aacggagauauagaccagcgccg

SEQ ID NO: 3799385 - RNA, 22 nt, Salmonella typhimurium LT2
aacggaucagccugagcgccag

SEQ ID NO: 3799386 - RNA, 20 nt, Salmonella typhimurium LT2
aacggaugcgccaucccaug

SEQ ID NO: 3799387 - RNA, 22 nt, Salmonella typhimurium LT2
aacggcaacaguaccugauaaa

SEQ ID NO: 3799388 - RNA, 23 nt, Salmonella typhimurium LT2
aacggcagggauucgcucaccgc

SEQ ID NO: 3799389 - RNA, 14 nt, Salmonella typhimurium LT2
aacggcauccauuu

SEQ ID NO: 3799390 - RNA, 12 nt, Salmonella typhimurium LT2
aacggccagcgc

SEQ ID NO: 3799391 - RNA, 14 nt, Salmonella typhimurium LT2
aacggccagcgcag

SEQ ID NO: 3799392 - RNA, 19 nt, Salmonella typhimurium LT2
aacggccagugaaauaaau

SEQ ID NO: 3799393 - RNA, 20 nt, Salmonella typhimurium LT2
aacggcgacgcccgccaucu

SEQ ID NO: 3799394 - RNA, 13 nt, Salmonella typhimurium LT2
aacggcgccagcu

SEQ ID NO: 3799395 - RNA, 21 nt, Salmonella typhimurium LT2
aacggcgccgugagcuguggu

SEQ ID NO: 3799396 - RNA, 15 nt, Salmonella typhimurium LT2
aacggcgcuuuuaaa

SEQ ID NO: 3799397 - RNA, 19 nt, Salmonella typhimurium LT2
aacggcgcuuuuaaaauaa

SEQ ID NO: 3799398 - RNA, 23 nt, Salmonella typhimurium LT2
aacggcggaaccauuuuccccag

SEQ ID NO: 3799399 - RNA, 23 nt, Salmonella typhimurium LT2
aacggcgguuuuuuuauccauuu

SEQ ID NO: 3799400 - RNA, 19 nt, Salmonella typhimurium LT2
aacggcgugaaucccccug

SEQ ID NO: 3799401 - RNA, 22 nt, Salmonella typhimurium LT2
aacggcucggguggcgcaguuu

SEQ ID NO: 3799402 - RNA, 12 nt, Salmonella typhimurium LT2
aacggcucugca

SEQ ID NO: 3799403 - RNA, 17 nt, Salmonella typhimurium LT2
aacggcugacgcccauc

SEQ ID NO: 3799404 - RNA, 22 nt, Salmonella typhimurium LT2
aacgggacggcggccagcauuu

SEQ ID NO: 3799405 - RNA, 14 nt, Salmonella typhimurium LT2
aacgggccacugcu

SEQ ID NO: 3799406 - RNA, 15 nt, Salmonella typhimurium LT2
aacgggcccggcuuu

SEQ ID NO: 3799407 - RNA, 14 nt, Salmonella typhimurium LT2
aacgggcugaccgc

SEQ ID NO: 3799408 - RNA, 14 nt, Salmonella typhimurium LT2
aacggggaaccagc

SEQ ID NO: 3799409 - RNA, 21 nt, Salmonella typhimurium LT2
aacgggguauaacucagcggc

SEQ ID NO: 3799410 - RNA, 16 nt, Salmonella typhimurium LT2
aacgguaaguugaaag

SEQ ID NO: 3799411 - RNA, 21 nt, Salmonella typhimurium LT2
aacgguaccgaacggcgucgg

SEQ ID NO: 3799412 - RNA, 13 nt, Salmonella typhimurium LT2
aacgguccugguc

SEQ ID NO: 3799413 - RNA, 13 nt, Salmonella typhimurium LT2
aacggucucaggc

SEQ ID NO: 3799414 - RNA, 14 nt, Salmonella typhimurium LT2
aacgguuuauaccg

SEQ ID NO: 3799415 - RNA, 23 nt, Salmonella typhimurium LT2
aacguaaagcuggccuucagguu

SEQ ID NO: 3799416 - RNA, 17 nt, Salmonella typhimurium LT2
aacgucacauuuugacu

SEQ ID NO: 3799417 - RNA, 20 nt, Salmonella typhimurium LT2
aacgucacauuuugacuggu

SEQ ID NO: 3799418 - RNA, 20 nt, Salmonella typhimurium LT2
aacgucagcgccacccauuu

SEQ ID NO: 3799419 - RNA, 11 nt, Salmonella typhimurium LT2
aacgucaguac

SEQ ID NO: 3799420 - RNA, 18 nt, Salmonella typhimurium LT2
aacgucaguggaaaacag

SEQ ID NO: 3799421 - RNA, 21 nt, Salmonella typhimurium LT2
aacgucaguggaaaacagcau

SEQ ID NO: 3799422 - RNA, 12 nt, Salmonella typhimurium LT2
aacgucaucauc

SEQ ID NO: 3799423 - RNA, 19 nt, Salmonella typhimurium LT2
aacgucccacgucagccca

SEQ ID NO: 3799424 - RNA, 17 nt, Salmonella typhimurium LT2
aacguccuaggacgaaa

SEQ ID NO: 3799425 - RNA, 22 nt, Salmonella typhimurium LT2
aacguccuaggacgaaaaauga

SEQ ID NO: 3799426 - RNA, 21 nt, Salmonella typhimurium LT2
aacguccucggacgaaaaaug

SEQ ID NO: 3799427 - RNA, 18 nt, Salmonella typhimurium LT2
aacgucgccauccggcaa

SEQ ID NO: 3799428 - RNA, 14 nt, Salmonella typhimurium LT2
aacgucuugccaug

SEQ ID NO: 3799429 - RNA, 16 nt, Salmonella typhimurium LT2
aacgucuuuuuccagc

SEQ ID NO: 3799430 - RNA, 19 nt, Salmonella typhimurium LT2
aacgucuuuuuccagcagc

SEQ ID NO: 3799431 - RNA, 20 nt, Salmonella typhimurium LT2
aacgugaaaaaucccccauu

SEQ ID NO: 3799432 - RNA, 17 nt, Salmonella typhimurium LT2
aacgugcuccagcgccu

SEQ ID NO: 3799433 - RNA, 12 nt, Salmonella typhimurium LT2
aacguguuaucg

SEQ ID NO: 3799434 - RNA, 22 nt, Salmonella typhimurium LT2
aacguguuuucgauuucauuca

SEQ ID NO: 3799435 - RNA, 14 nt, Salmonella typhimurium LT2
aacguuaacgccgc

SEQ ID NO: 3799436 - RNA, 13 nt, Salmonella typhimurium LT2
aacguuaccuuua

SEQ ID NO: 3799437 - RNA, 15 nt, Salmonella typhimurium LT2
aacguuaccuuuaau

SEQ ID NO: 3799438 - RNA, 16 nt, Salmonella typhimurium LT2
aacguugaugauaaau

SEQ ID NO: 3799439 - RNA, 20 nt, Salmonella typhimurium LT2
aacguugcuuauucagucug

SEQ ID NO: 3799440 - RNA, 15 nt, Salmonella typhimurium LT2
aacguuguauaaaca

SEQ ID NO: 3799441 - RNA, 22 nt, Salmonella typhimurium LT2
aacguuuccggaaugagaugca

SEQ ID NO: 3799442 - RNA, 14 nt, Salmonella typhimurium LT2
aacguuugccagcg

SEQ ID NO: 3799443 - RNA, 17 nt, Salmonella typhimurium LT2
aacguuuguaacagcag

SEQ ID NO: 3799444 - RNA, 12 nt, Salmonella typhimurium LT2
aacguuuucacc

SEQ ID NO: 3799445 - RNA, 21 nt, Salmonella typhimurium LT2
aacuaaacgacguggaguccg

SEQ ID NO: 3799446 - RNA, 13 nt, Salmonella typhimurium LT2
aacuaccgggcau

SEQ ID NO: 3799447 - RNA, 16 nt, Salmonella typhimurium LT2
aacuacuggcugguuu

SEQ ID NO: 3799448 - RNA, 21 nt, Salmonella typhimurium LT2
aacuagcccuuaggaggggcu

SEQ ID NO: 3799449 - RNA, 17 nt, Salmonella typhimurium LT2
aacuauaggaaaauaau

SEQ ID NO: 3799450 - RNA, 18 nt, Salmonella typhimurium LT2
aacuauaggaaaauaaug

SEQ ID NO: 3799451 - RNA, 15 nt, Salmonella typhimurium LT2
aacuaugcaaaacgu

SEQ ID NO: 3799452 - RNA, 17 nt, Salmonella typhimurium LT2
aagaauuauuaccaaug

SEQ ID NO: 3799453 - RNA, 14 nt, Salmonella typhimurium LT2
aagaauuucaauca

SEQ ID NO: 3799454 - RNA, 18 nt, Salmonella typhimurium LT2
aagaauuucaaucaucau

SEQ ID NO: 3799455 - RNA, 16 nt, Salmonella typhimurium LT2
aagaauuugaacucuu

SEQ ID NO: 3799456 - RNA, 16 nt, Salmonella typhimurium LT2
aagacaaaaauggaua

SEQ ID NO: 3799457 - RNA, 15 nt, Salmonella typhimurium LT2
aagacacgcuuccag

SEQ ID NO: 3799458 - RNA, 16 nt, Salmonella typhimurium LT2
aagacagaacuuggcu

SEQ ID NO: 3799459 - RNA, 16 nt, Salmonella typhimurium LT2
aagacagcuuauacug

SEQ ID NO: 3799460 - RNA, 23 nt, Salmonella typhimurium LT2
aagacauccgggccaacggcauc

SEQ ID NO: 3799461 - RNA, 23 nt, Salmonella typhimurium LT2
aagacauucgggacaaaccccca

SEQ ID NO: 3799462 - RNA, 16 nt, Salmonella typhimurium LT2
aagaccccgccaggcg

SEQ ID NO: 3799463 - RNA, 17 nt, Salmonella typhimurium LT2
aagacccgaaccugcga

SEQ ID NO: 3799464 - RNA, 22 nt, Salmonella typhimurium LT2
aagaccggcgguacgcugacga

SEQ ID NO: 3799465 - RNA, 13 nt, Salmonella typhimurium LT2
aagaccuccgccc

SEQ ID NO: 3799466 - RNA, 18 nt, Salmonella typhimurium LT2
aagacgaaggggacaaaa

SEQ ID NO: 3799467 - RNA, 19 nt, Salmonella typhimurium LT2
aagacggcuuuugguuccu

SEQ ID NO: 3799468 - RNA, 19 nt, Salmonella typhimurium LT2
aagacgguuguuuuucaga

SEQ ID NO: 3799469 - RNA, 20 nt, Salmonella typhimurium LT2
aagacgguuguuuuucagau

SEQ ID NO: 3799470 - RNA, 20 nt, Salmonella typhimurium LT2
aagacgguuucagugauaaa

SEQ ID NO: 3799471 - RNA, 19 nt, Salmonella typhimurium LT2
aagacuauccagccaggga

SEQ ID NO: 3799472 - RNA, 15 nt, Salmonella typhimurium LT2
aagacuccccugcag

SEQ ID NO: 3799473 - RNA, 18 nt, Salmonella typhimurium LT2
aagacuggcccugccgga

SEQ ID NO: 3799474 - RNA, 11 nt, Salmonella typhimurium LT2
aagagaaaaaa

SEQ ID NO: 3799475 - RNA, 11 nt, Salmonella typhimurium LT2
aagagaaaacc

SEQ ID NO: 3799476 - RNA, 13 nt, Salmonella typhimurium LT2
aagagaaaauacc

SEQ ID NO: 3799477 - RNA, 14 nt, Salmonella typhimurium LT2
aagagaaaauaccg

SEQ ID NO: 3799478 - RNA, 17 nt, Salmonella typhimurium LT2
aagagacacgcugaccu

SEQ ID NO: 3799479 - RNA, 12 nt, Salmonella typhimurium LT2
aagagagcaaca

SEQ ID NO: 3799480 - RNA, 15 nt, Salmonella typhimurium LT2
aagagagccuuauag

SEQ ID NO: 3799481 - RNA, 22 nt, Salmonella typhimurium LT2
aagagaggcuuuaugcugacaa

SEQ ID NO: 3799482 - RNA, 19 nt, Salmonella typhimurium LT2
aagagauggaaugagcauc

SEQ ID NO: 3799483 - RNA, 18 nt, Salmonella typhimurium LT2
aagagauuaacgaccagg

SEQ ID NO: 3799484 - RNA, 14 nt, Salmonella typhimurium LT2
aagagauuagaacg

SEQ ID NO: 3799485 - RNA, 22 nt, Salmonella typhimurium LT2
aagaggaugcuccgccagagcu

SEQ ID NO: 3799486 - RNA, 12 nt, Salmonella typhimurium LT2
aagaggcagcaa

SEQ ID NO: 3799487 - RNA, 15 nt, Salmonella typhimurium LT2
aagagguauccugaa

SEQ ID NO: 3799488 - RNA, 21 nt, Salmonella typhimurium LT2
aagaguaucucucuggcgcau

SEQ ID NO: 3799489 - RNA, 17 nt, Salmonella typhimurium LT2
aagagucgauacgcuga

SEQ ID NO: 3799490 - RNA, 22 nt, Salmonella typhimurium LT2
aagagugaacacguaauucauu

SEQ ID NO: 3799491 - RNA, 19 nt, Salmonella typhimurium LT2
aagagugacgguuuucacu

SEQ ID NO: 3799492 - RNA, 16 nt, Salmonella typhimurium LT2
aagagugccagaaaca

SEQ ID NO: 3799493 - RNA, 20 nt, Salmonella typhimurium LT2
aagaguucaacgccgaacag

SEQ ID NO: 3799494 - RNA, 15 nt, Salmonella typhimurium LT2
aagauaaaaagacag

SEQ ID NO: 3799495 - RNA, 16 nt, Salmonella typhimurium LT2
aagauaaacagcagcg

SEQ ID NO: 3799496 - RNA, 19 nt, Salmonella typhimurium LT2
aagauaaacgacagcgcca

SEQ ID NO: 3799497 - RNA, 13 nt, Salmonella typhimurium LT2
aagauaaauaaaa

SEQ ID NO: 3799498 - RNA, 20 nt, Salmonella typhimurium LT2
aagauaagccgucauaaaau

SEQ ID NO: 3799499 - RNA, 20 nt, Salmonella typhimurium LT2
aagauacauaucauuauguc

SEQ ID NO: 3799500 - RNA, 17 nt, Salmonella typhimurium LT2
aagauacggauucuuaa

SEQ ID NO: 3799501 - RNA, 17 nt, Salmonella typhimurium LT2
aagauaggagacgccgc

SEQ ID NO: 3799502 - RNA, 13 nt, Salmonella typhimurium LT2
aagaucagcagag

SEQ ID NO: 3799503 - RNA, 11 nt, Salmonella typhimurium LT2
aagaucaggag

SEQ ID NO: 3799504 - RNA, 20 nt, Salmonella typhimurium LT2
aagaucgcaggccaaaaaaa

SEQ ID NO: 3799505 - RNA, 14 nt, Salmonella typhimurium LT2
aagaucgcgaggca

SEQ ID NO: 3799506 - RNA, 19 nt, Salmonella typhimurium LT2
aagaucgcgaggcaacaga

SEQ ID NO: 3799507 - RNA, 13 nt, Salmonella typhimurium LT2
aagaucgcgcagc

SEQ ID NO: 3799508 - RNA, 22 nt, Salmonella typhimurium LT2
aagaucggagauauaaaccuga

SEQ ID NO: 3799509 - RNA, 16 nt, Salmonella typhimurium LT2
aagaucguuauccagc

SEQ ID NO: 3799510 - RNA, 22 nt, Salmonella typhimurium LT2
aagaugccugaaaauagcgcca

SEQ ID NO: 3799511 - RNA, 22 nt, Salmonella typhimurium LT2
aagaugguaauauuaaaaccau

SEQ ID NO: 3799512 - RNA, 19 nt, Salmonella typhimurium LT2
aagaugugccacuccgcca

SEQ ID NO: 3799513 - RNA, 18 nt, Salmonella typhimurium LT2
aagauucacucugaaaaa

SEQ ID NO: 3799514 - RNA, 12 nt, Salmonella typhimurium LT2
aagauuccagau

SEQ ID NO: 3799515 - RNA, 13 nt, Salmonella typhimurium LT2
aagauuugcgccg

SEQ ID NO: 3799516 - RNA, 15 nt, Salmonella typhimurium LT2
aagauuuuuauuaaa

SEQ ID NO: 3799517 - RNA, 20 nt, Salmonella typhimurium LT2
aagcaaaaaaugacacccag

SEQ ID NO: 3799518 - RNA, 22 nt, Salmonella typhimurium LT2
aagcaaaaauuucgcucagaug

SEQ ID NO: 3799519 - RNA, 18 nt, Salmonella typhimurium LT2
aagcaaaccuauuucagu

SEQ ID NO: 3799520 - RNA, 20 nt, Salmonella typhimurium LT2
aagcaaagcgccauccggca

SEQ ID NO: 3799521 - RNA, 22 nt, Salmonella typhimurium LT2
aagcaaagcgccauccggcaau

SEQ ID NO: 3799522 - RNA, 20 nt, Salmonella typhimurium LT2
aagcaacugauuaaucugcc

SEQ ID NO: 3799523 - RNA, 23 nt, Salmonella typhimurium LT2
aagcaacugauuaaucugccgac

SEQ ID NO: 3799524 - RNA, 16 nt, Salmonella typhimurium LT2
aagcaacuguagaaug

SEQ ID NO: 3799525 - RNA, 14 nt, Salmonella typhimurium LT2
aagcaagugcugga

SEQ ID NO: 3799526 - RNA, 15 nt, Salmonella typhimurium LT2
aagcaauaauccgcu

SEQ ID NO: 3799527 - RNA, 16 nt, Salmonella typhimurium LT2
aagcaauaccacgccc

SEQ ID NO: 3799528 - RNA, 15 nt, Salmonella typhimurium LT2
aagcaaucgccagcg

SEQ ID NO: 3799529 - RNA, 22 nt, Salmonella typhimurium LT2
aagcaauuacggacagaaaaaa

SEQ ID NO: 3799530 - RNA, 16 nt, Salmonella typhimurium LT2
aagcacauagcugaga

SEQ ID NO: 3799531 - RNA, 20 nt, Salmonella typhimurium LT2
aagcacauagcugagacuca

SEQ ID NO: 3799532 - RNA, 14 nt, Salmonella typhimurium LT2
aagcacaucaggaa

SEQ ID NO: 3799533 - RNA, 19 nt, Salmonella typhimurium LT2
aagcacaucaggaaaugaa

SEQ ID NO: 3799534 - RNA, 19 nt, Salmonella typhimurium LT2
aagcaccaucgcaaauuca

SEQ ID NO: 3799535 - RNA, 18 nt, Salmonella typhimurium LT2
aagcaccggcgggcugau

SEQ ID NO: 3799536 - RNA, 23 nt, Salmonella typhimurium LT2
aagcacuagucaggcacaaaaaa

SEQ ID NO: 3799537 - RNA, 17 nt, Salmonella typhimurium LT2
aagcacuauuauauuuu

SEQ ID NO: 3799538 - RNA, 19 nt, Salmonella typhimurium LT2
aagcacucguaagaggcgu

SEQ ID NO: 3799539 - RNA, 19 nt, Salmonella typhimurium LT2
aagcagaccggggcaggcg

SEQ ID NO: 3799540 - RNA, 15 nt, Salmonella typhimurium LT2
aagcagcgacaauau

SEQ ID NO: 3799541 - RNA, 12 nt, Salmonella typhimurium LT2
aagcagcuugcu

SEQ ID NO: 3799542 - RNA, 16 nt, Salmonella typhimurium LT2
aagcagcuugcugcuu

SEQ ID NO: 3799543 - RNA, 11 nt, Salmonella typhimurium LT2
aagcaggccga

SEQ ID NO: 3799544 - RNA, 18 nt, Salmonella typhimurium LT2
aagcaggcgggacgccau

SEQ ID NO: 3799545 - RNA, 21 nt, Salmonella typhimurium LT2
aagcagguguuauuuuuguau

SEQ ID NO: 3799546 - RNA, 15 nt, Salmonella typhimurium LT2
aagcagugaaucccc

SEQ ID NO: 3799547 - RNA, 23 nt, Salmonella typhimurium LT2
aagcauacccuuccccaucaaaa

SEQ ID NO: 3799548 - RNA, 19 nt, Salmonella typhimurium LT2
aagcauagcgccaucagac

SEQ ID NO: 3799549 - RNA, 19 nt, Salmonella typhimurium LT2
aagcauagcgucaucaaca

SEQ ID NO: 3799550 - RNA, 15 nt, Salmonella typhimurium LT2
aagcauccguuuccc

SEQ ID NO: 3799551 - RNA, 15 nt, Salmonella typhimurium LT2
aagcaucugauauau

SEQ ID NO: 3799552 - RNA, 16 nt, Salmonella typhimurium LT2
aagcaugauaccgaua

SEQ ID NO: 3799553 - RNA, 20 nt, Salmonella typhimurium LT2
aagcaugguuaacuccuucu

SEQ ID NO: 3799554 - RNA, 13 nt, Salmonella typhimurium LT2
aagcauuagcgcc

SEQ ID NO: 3799555 - RNA, 12 nt, Salmonella typhimurium LT2
aagcauucagau

SEQ ID NO: 3799556 - RNA, 18 nt, Salmonella typhimurium LT2
aagcuuucaucuuuaaaa

SEQ ID NO: 3799557 - RNA, 19 nt, Salmonella typhimurium LT2
aagcuuucugaauuucacg

SEQ ID NO: 3799558 - RNA, 18 nt, Salmonella typhimurium LT2
aagcuuugcguaaaaaaa

SEQ ID NO: 3799559 - RNA, 22 nt, Salmonella typhimurium LT2
aagcuuugcguaaaaaaacauc

SEQ ID NO: 3799560 - RNA, 20 nt, Salmonella typhimurium LT2
aagcuuuuaguuacgcacgc

SEQ ID NO: 3799561 - RNA, 22 nt, Salmonella typhimurium LT2
aagcuuuuaguuacgcacgcca

SEQ ID NO: 3799562 - RNA, 12 nt, Salmonella typhimurium LT2
aagcuuuucacc

SEQ ID NO: 3799563 - RNA, 21 nt, Salmonella typhimurium LT2
aagcuuuucgcuugcggcugc

SEQ ID NO: 3799564 - RNA, 18 nt, Salmonella typhimurium LT2
aaggacauucagcacgcu

SEQ ID NO: 3799565 - RNA, 20 nt, Salmonella typhimurium LT2
aaggacuuaucaggccuacg

SEQ ID NO: 3799566 - RNA, 22 nt, Salmonella typhimurium LT2
aaggcaaaguaucccuuccuca

SEQ ID NO: 3799567 - RNA, 21 nt, Salmonella typhimurium LT2
aaggcaaucgcuuccagcgcc

SEQ ID NO: 3799568 - RNA, 17 nt, Salmonella typhimurium LT2
aaggcaguguaauucuc

SEQ ID NO: 3799569 - RNA, 14 nt, Salmonella typhimurium LT2
aaggcaucuucaga

SEQ ID NO: 3799570 - RNA, 15 nt, Salmonella typhimurium LT2
aaggcaucuucagac

SEQ ID NO: 3799571 - RNA, 20 nt, Salmonella typhimurium LT2
aaggcaucuucagacaguuu

SEQ ID NO: 3799572 - RNA, 16 nt, Salmonella typhimurium LT2
aaggcauucacgccgc

SEQ ID NO: 3799573 - RNA, 16 nt, Salmonella typhimurium LT2
aaggcauuuaugccgc

SEQ ID NO: 3799574 - RNA, 19 nt, Salmonella typhimurium LT2
aaggcauuucaaucgccac

SEQ ID NO: 3799575 - RNA, 20 nt, Salmonella typhimurium LT2
aaggcauuucuaccggcaga

SEQ ID NO: 3799576 - RNA, 14 nt, Salmonella typhimurium LT2
aaggccagcaccag

SEQ ID NO: 3799577 - RNA, 23 nt, Salmonella typhimurium LT2
aaggccagcaccagcgaguagcc

SEQ ID NO: 3799578 - RNA, 21 nt, Salmonella typhimurium LT2
aaggcccggugugccgcuugc

SEQ ID NO: 3799579 - RNA, 24 nt, Salmonella typhimurium LT2
aaggcccggugugccgcuugccag

SEQ ID NO: 3799580 - RNA, 22 nt, Salmonella typhimurium LT2
aaggccgcgaaccggaccagca

SEQ ID NO: 3799581 - RNA, 22 nt, Salmonella typhimurium LT2
aaggccucaucgggacggcggu

SEQ ID NO: 3799582 - RNA, 22 nt, Salmonella typhimurium LT2
aaggcgacgaugugcauaaccg

SEQ ID NO: 3799583 - RNA, 15 nt, Salmonella typhimurium LT2
aaggcgcuaccagga

SEQ ID NO: 3799584 - RNA, 19 nt, Salmonella typhimurium LT2
aaggcgcuauccugguagc

SEQ ID NO: 3799585 - RNA, 16 nt, Salmonella typhimurium LT2
aaggcggcaaagauaa

SEQ ID NO: 3799586 - RNA, 17 nt, Salmonella typhimurium LT2
aaggcggcaaagauaau

SEQ ID NO: 3799587 - RNA, 17 nt, Salmonella typhimurium LT2
aaggcggugucaucuuc

SEQ ID NO: 3799588 - RNA, 21 nt, Salmonella typhimurium LT2
aaggcgguuuuauugucagaa

SEQ ID NO: 3799589 - RNA, 24 nt, Salmonella typhimurium LT2
aaggcguaaccgccauccggcgau

SEQ ID NO: 3799590 - RNA, 22 nt, Salmonella typhimurium LT2
aaggcguaagucguaccggcgc

SEQ ID NO: 3799591 - RNA, 17 nt, Salmonella typhimurium LT2
aaggcguugaugaaggu

SEQ ID NO: 3799592 - RNA, 20 nt, Salmonella typhimurium LT2
aaggcuaccgguugcguagc

SEQ ID NO: 3799593 - RNA, 13 nt, Salmonella typhimurium LT2
aaggcuugacuca

SEQ ID NO: 3799594 - RNA, 13 nt, Salmonella typhimurium LT2
aaggcuugguugu

SEQ ID NO: 3799595 - RNA, 20 nt, Salmonella typhimurium LT2
aaggcuuuggccucagcaaa

SEQ ID NO: 3799596 - RNA, 20 nt, Salmonella typhimurium LT2
aaggcuuuuuaaucaaaaug

SEQ ID NO: 3799597 - RNA, 21 nt, Salmonella typhimurium LT2
aagggaaaagccauugccgcg

SEQ ID NO: 3799598 - RNA, 22 nt, Salmonella typhimurium LT2
aagggaaaagccauugccgcga

SEQ ID NO: 3799599 - RNA, 16 nt, Salmonella typhimurium LT2
aagggagcagacugua

SEQ ID NO: 3799600 - RNA, 20 nt, Salmonella typhimurium LT2
aagggauaagaaagauaaaa

SEQ ID NO: 3799601 - RNA, 14 nt, Salmonella typhimurium LT2
aagggcaagggcaa

SEQ ID NO: 3799602 - RNA, 15 nt, Salmonella typhimurium LT2
aagggcaccagcaac

SEQ ID NO: 3799603 - RNA, 21 nt, Salmonella typhimurium LT2
aagggcagccgagacuaucga

SEQ ID NO: 3799604 - RNA, 22 nt, Salmonella typhimurium LT2
aaggggcaggcgucaaaacagg

SEQ ID NO: 3799605 - RNA, 22 nt, Salmonella typhimurium LT2
aaggggccacaggcggcauggg

SEQ ID NO: 3799606 - RNA, 13 nt, Salmonella typhimurium LT2
aaggguaagcaau

SEQ ID NO: 3799607 - RNA, 14 nt, Salmonella typhimurium LT2
aaggguaccugggc

SEQ ID NO: 3799608 - RNA, 18 nt, Salmonella typhimurium LT2
aaggguuuucgccuggcg

SEQ ID NO: 3799609 - RNA, 20 nt, Salmonella typhimurium LT2
aaggguuuucgccuggcggc

SEQ ID NO: 3799610 - RNA, 13 nt, Salmonella typhimurium LT2
aagguaaaaguag

SEQ ID NO: 3799611 - RNA, 14 nt, Salmonella typhimurium LT2
aagguaauuuucac

SEQ ID NO: 3799612 - RNA, 15 nt, Salmonella typhimurium LT2
aagguagccacgccc

SEQ ID NO: 3799613 - RNA, 19 nt, Salmonella typhimurium LT2
aaggucacaucaucgccaa

SEQ ID NO: 3799614 - RNA, 21 nt, Salmonella typhimurium LT2
aaggucagguuaugcgcgcca

SEQ ID NO: 3799615 - RNA, 15 nt, Salmonella typhimurium LT2
aaggucaucacaucc

SEQ ID NO: 3799616 - RNA, 18 nt, Salmonella typhimurium LT2
aaggucgauauuuaauga

SEQ ID NO: 3799617 - RNA, 17 nt, Salmonella typhimurium LT2
aaggucgcuauccagca

SEQ ID NO: 3799618 - RNA, 19 nt, Salmonella typhimurium LT2
aaggucgcuauccagcagu

SEQ ID NO: 3799619 - RNA, 23 nt, Salmonella typhimurium LT2
aaggucugacaacuauugcugcc

SEQ ID NO: 3799620 - RNA, 15 nt, Salmonella typhimurium LT2
aaggucuugauagcg

SEQ ID NO: 3799621 - RNA, 14 nt, Salmonella typhimurium LT2
aaggugagaaaaag

SEQ ID NO: 3799622 - RNA, 21 nt, Salmonella typhimurium LT2
aagguguuuacgccgccaucc

SEQ ID NO: 3799623 - RNA, 16 nt, Salmonella typhimurium LT2
aagguucccugcgcca

SEQ ID NO: 3799624 - RNA, 16 nt, Salmonella typhimurium LT2
aagguugcacggcauu

SEQ ID NO: 3799625 - RNA, 23 nt, Salmonella typhimurium LT2
aagguugccaaaaaaucagcaau

SEQ ID NO: 3799626 - RNA, 19 nt, Salmonella typhimurium LT2
aagguugccugccagagga

SEQ ID NO: 3799627 - RNA, 16 nt, Salmonella typhimurium LT2
aaguaaagauuuuuau

SEQ ID NO: 3799628 - RNA, 20 nt, Salmonella typhimurium LT2
aaguaaagauuuuuauuaaa

SEQ ID NO: 3799629 - RNA, 21 nt, Salmonella typhimurium LT2
aaguaaagauuuuuauuaaaa

SEQ ID NO: 3799630 - RNA, 18 nt, Salmonella typhimurium LT2
aaguaaauaagaaaaugc

SEQ ID NO: 3799631 - RNA, 23 nt, Salmonella typhimurium LT2
aaguaaggcugauuauauaacac

SEQ ID NO: 3799632 - RNA, 12 nt, Salmonella typhimurium LT2
aaguaauaaaaa

SEQ ID NO: 3799633 - RNA, 14 nt, Salmonella typhimurium LT2
aaguaauaaaaaac

SEQ ID NO: 3799634 - RNA, 22 nt, Salmonella typhimurium LT2
aaguaccagcgcgaacauuaca

SEQ ID NO: 3799635 - RNA, 23 nt, Salmonella typhimurium LT2
aaguacgccuuucaccaucagca

SEQ ID NO: 3799636 - RNA, 21 nt, Salmonella typhimurium LT2
aaguagaacuuccaacuaaag

SEQ ID NO: 3799637 - RNA, 14 nt, Salmonella typhimurium LT2
aaguagaucaccag

SEQ ID NO: 3799638 - RNA, 22 nt, Salmonella typhimurium LT2
aaguagccugccagcaacccac

SEQ ID NO: 3799639 - RNA, 18 nt, Salmonella typhimurium LT2
aaguaggguugccagucg

SEQ ID NO: 3799640 - RNA, 12 nt, Salmonella typhimurium LT2
aaguaguuccag

SEQ ID NO: 3799641 - RNA, 15 nt, Salmonella typhimurium LT2
aagucaaaauaaaau

SEQ ID NO: 3799642 - RNA, 22 nt, Salmonella typhimurium LT2
aagucaccuuagcgaaauguuc

SEQ ID NO: 3799643 - RNA, 12 nt, Salmonella typhimurium LT2
aagucagacaag

SEQ ID NO: 3799644 - RNA, 14 nt, Salmonella typhimurium LT2
aagucagcuuuuag

SEQ ID NO: 3799645 - RNA, 16 nt, Salmonella typhimurium LT2
aagucagcuuuuagca

SEQ ID NO: 3799646 - RNA, 17 nt, Salmonella typhimurium LT2
aagucaguuuucaauau

SEQ ID NO: 3799647 - RNA, 20 nt, Salmonella typhimurium LT2
aagucaugagcuauuucagu

SEQ ID NO: 3799648 - RNA, 15 nt, Salmonella typhimurium LT2
aagucccagaaagua

SEQ ID NO: 3799649 - RNA, 21 nt, Salmonella typhimurium LT2
aaguccccagccgccacuagc

SEQ ID NO: 3799650 - RNA, 22 nt, Salmonella typhimurium LT2
aaguccccagccgccacuagcu

SEQ ID NO: 3799651 - RNA, 10 nt, Salmonella typhimurium LT2
aagucccccc

SEQ ID NO: 3799652 - RNA, 13 nt, Salmonella typhimurium LT2
aaguccuucuccu

SEQ ID NO: 3799653 - RNA, 23 nt, Salmonella typhimurium LT2
aaguccuucuccuucgccaaaau

SEQ ID NO: 3799654 - RNA, 16 nt, Salmonella typhimurium LT2
aagucgcgggcgcuaa

SEQ ID NO: 3799655 - RNA, 18 nt, Salmonella typhimurium LT2
aagucucaagagugaaca

SEQ ID NO: 3799656 - RNA, 14 nt, Salmonella typhimurium LT2
aagucugugaggaa

SEQ ID NO: 3799657 - RNA, 21 nt, Salmonella typhimurium LT2
aagucugugaggaaagcgaaa

SEQ ID NO: 3799658 - RNA, 23 nt, Salmonella typhimurium LT2
aagucugugaggaaagcgaaaau

SEQ ID NO: 3799659 - RNA, 20 nt, Salmonella typhimurium LT2
aauaagacauggaguuccag

SEQ ID NO: 3799660 - RNA, 22 nt, Salmonella typhimurium LT2
aauaagcagaacguagcccauu

SEQ ID NO: 3799661 - RNA, 12 nt, Salmonella typhimurium LT2
aauaaggcuggc

SEQ ID NO: 3799662 - RNA, 13 nt, Salmonella typhimurium LT2
aauaaggcuggca

SEQ ID NO: 3799663 - RNA, 16 nt, Salmonella typhimurium LT2
aauaauaaauuuucau

SEQ ID NO: 3799664 - RNA, 21 nt, Salmonella typhimurium LT2
aauaauacacgcgacaaugcc

SEQ ID NO: 3799665 - RNA, 20 nt, Salmonella typhimurium LT2
aauaauaugccccgacauca

SEQ ID NO: 3799666 - RNA, 23 nt, Salmonella typhimurium LT2
aauaauaugccccgacaucagau

SEQ ID NO: 3799667 - RNA, 20 nt, Salmonella typhimurium LT2
aauaauauguuccacaauca

SEQ ID NO: 3799668 - RNA, 13 nt, Salmonella typhimurium LT2
aauaauauuauug

SEQ ID NO: 3799669 - RNA, 18 nt, Salmonella typhimurium LT2
aauaaucagaucaauacg

SEQ ID NO: 3799670 - RNA, 12 nt, Salmonella typhimurium LT2
aauaaucccaaa

SEQ ID NO: 3799671 - RNA, 23 nt, Salmonella typhimurium LT2
aauaaucccgcagaaaagaccgg

SEQ ID NO: 3799672 - RNA, 17 nt, Salmonella typhimurium LT2
aauaaucccuucuuuua

SEQ ID NO: 3799673 - RNA, 18 nt, Salmonella typhimurium LT2
aauaaucgaacugacggu

SEQ ID NO: 3799674 - RNA, 18 nt, Salmonella typhimurium LT2
aauaaucgccgccgguaa

SEQ ID NO: 3799675 - RNA, 18 nt, Salmonella typhimurium LT2
aauaaucgcgagaaaaua

SEQ ID NO: 3799676 - RNA, 23 nt, Salmonella typhimurium LT2
aauaaugcauccgccagaugaac

SEQ ID NO: 3799677 - RNA, 19 nt, Salmonella typhimurium LT2
aauaaugccaaaauggaca

SEQ ID NO: 3799678 - RNA, 14 nt, Salmonella typhimurium LT2
aauaauguaaaaaa

SEQ ID NO: 3799679 - RNA, 16 nt, Salmonella typhimurium LT2
aauaauguaaaaaaau

SEQ ID NO: 3799680 - RNA, 15 nt, Salmonella typhimurium LT2
aauaauugagcgcaa

SEQ ID NO: 3799681 - RNA, 23 nt, Salmonella typhimurium LT2
aauaauugcgguggcgcaaaucg

SEQ ID NO: 3799682 - RNA, 13 nt, Salmonella typhimurium LT2
aauaauuuaaaau

SEQ ID NO: 3799683 - RNA, 14 nt, Salmonella typhimurium LT2
aauaauuuaaaauu

SEQ ID NO: 3799684 - RNA, 18 nt, Salmonella typhimurium LT2
aauaauuuaaaauucaga

SEQ ID NO: 3799685 - RNA, 15 nt, Salmonella typhimurium LT2
aauaauuucuucuuu

SEQ ID NO: 3799686 - RNA, 14 nt, Salmonella typhimurium LT2
aauaauuuuguuaa

SEQ ID NO: 3799687 - RNA, 24 nt, Salmonella typhimurium LT2
aauacaauccgccgcaauagccaa

SEQ ID NO: 3799688 - RNA, 19 nt, Salmonella typhimurium LT2
aauacacgcgacaaugcca

SEQ ID NO: 3799689 - RNA, 19 nt, Salmonella typhimurium LT2
aauacaggcguguggcaua

SEQ ID NO: 3799690 - RNA, 21 nt, Salmonella typhimurium LT2
aauacaggcguguggcauaaa

SEQ ID NO: 3799691 - RNA, 13 nt, Salmonella typhimurium LT2
aauacaguuuucc

SEQ ID NO: 3799692 - RNA, 14 nt, Salmonella typhimurium LT2
aauacaucuuccuc

SEQ ID NO: 3799693 - RNA, 18 nt, Salmonella typhimurium LT2
aauaccaaagaacgcggu

SEQ ID NO: 3799694 - RNA, 17 nt, Salmonella typhimurium LT2
aauaccaaauauuucuu

SEQ ID NO: 3799695 - RNA, 20 nt, Salmonella typhimurium LT2
aauaccaauauuaaagaugc

SEQ ID NO: 3799696 - RNA, 13 nt, Salmonella typhimurium LT2
aauaccacaaauu

SEQ ID NO: 3799697 - RNA, 20 nt, Salmonella typhimurium LT2
aauaccacaaauuuugauaa

SEQ ID NO: 3799698 - RNA, 16 nt, Salmonella typhimurium LT2
aauauguucuggcggu

SEQ ID NO: 3799699 - RNA, 21 nt, Salmonella typhimurium LT2
aauauguuguggcaauauuuu

SEQ ID NO: 3799700 - RNA, 15 nt, Salmonella typhimurium LT2
aauauuaaaaccauu

SEQ ID NO: 3799701 - RNA, 17 nt, Salmonella typhimurium LT2
aauauuaacggucuuuc

SEQ ID NO: 3799702 - RNA, 14 nt, Salmonella typhimurium LT2
aauauuaucagcaa

SEQ ID NO: 3799703 - RNA, 16 nt, Salmonella typhimurium LT2
aauauuaucagcaaua

SEQ ID NO: 3799704 - RNA, 19 nt, Salmonella typhimurium LT2
aauauuauucuguuuuuuc

SEQ ID NO: 3799705 - RNA, 18 nt, Salmonella typhimurium LT2
aauauucaauuucccuuu

SEQ ID NO: 3799706 - RNA, 14 nt, Salmonella typhimurium LT2
aauauucauuucca

SEQ ID NO: 3799707 - RNA, 17 nt, Salmonella typhimurium LT2
aauauucuggcuuucug

SEQ ID NO: 3799708 - RNA, 16 nt, Salmonella typhimurium LT2
aauauugaacauuuuu

SEQ ID NO: 3799709 - RNA, 18 nt, Salmonella typhimurium LT2
aauauuguuuaacguuuc

SEQ ID NO: 3799710 - RNA, 21 nt, Salmonella typhimurium LT2
aauauuguuuaacguuucaug

SEQ ID NO: 3799711 - RNA, 23 nt, Salmonella typhimurium LT2
aauauuucuuuaugggcauuuca

SEQ ID NO: 3799712 - RNA, 18 nt, Salmonella typhimurium LT2
aaucaaauccaacucagu

SEQ ID NO: 3799713 - RNA, 16 nt, Salmonella typhimurium LT2
aaucaacgcauuauau

SEQ ID NO: 3799714 - RNA, 20 nt, Salmonella typhimurium LT2
aaucaacugcgccacaucau

SEQ ID NO: 3799715 - RNA, 22 nt, Salmonella typhimurium LT2
aaucaaugcgacgcccaaccag

SEQ ID NO: 3799716 - RNA, 22 nt, Salmonella typhimurium LT2
aaucaauuaacugacagcguuu

SEQ ID NO: 3799717 - RNA, 17 nt, Salmonella typhimurium LT2
aaucaauuccuacaaug

SEQ ID NO: 3799718 - RNA, 18 nt, Salmonella typhimurium LT2
aaucaauuuuaauuuaau

SEQ ID NO: 3799719 - RNA, 17 nt, Salmonella typhimurium LT2
aaucacaacguaaugau

SEQ ID NO: 3799720 - RNA, 20 nt, Salmonella typhimurium LT2
aaucacauacagcacuuccc

SEQ ID NO: 3799721 - RNA, 13 nt, Salmonella typhimurium LT2
aaucacauccgcc

SEQ ID NO: 3799722 - RNA, 22 nt, Salmonella typhimurium LT2
aaucacccagaugcgaaucuuc

SEQ ID NO: 3799723 - RNA, 17 nt, Salmonella typhimurium LT2
aaucaccgacagcaccg

SEQ ID NO: 3799724 - RNA, 12 nt, Salmonella typhimurium LT2
aaucaccgccag

SEQ ID NO: 3799725 - RNA, 15 nt, Salmonella typhimurium LT2
aaucaccgccagcaa

SEQ ID NO: 3799726 - RNA, 19 nt, Salmonella typhimurium LT2
aaucaccuuaucguuaccg

SEQ ID NO: 3799727 - RNA, 11 nt, Salmonella typhimurium LT2
aaucacgcaga

SEQ ID NO: 3799728 - RNA, 18 nt, Salmonella typhimurium LT2
aaucacgcaucacuuuug

SEQ ID NO: 3799729 - RNA, 18 nt, Salmonella typhimurium LT2
aaucacgccagucaccag

SEQ ID NO: 3799730 - RNA, 16 nt, Salmonella typhimurium LT2
aaucacgcguuauacg

SEQ ID NO: 3799731 - RNA, 15 nt, Salmonella typhimurium LT2
aaucacgucauuaaa

SEQ ID NO: 3799732 - RNA, 15 nt, Salmonella typhimurium LT2
aaucacgucgcccac

SEQ ID NO: 3799733 - RNA, 20 nt, Salmonella typhimurium LT2
aaucacguuuugcagcgcca

SEQ ID NO: 3799734 - RNA, 18 nt, Salmonella typhimurium LT2
aaucacuaacuagccaua

SEQ ID NO: 3799735 - RNA, 16 nt, Salmonella typhimurium LT2
aaucacuuaucaaacc

SEQ ID NO: 3799736 - RNA, 15 nt, Salmonella typhimurium LT2
aaucacuuauguaca

SEQ ID NO: 3799737 - RNA, 22 nt, Salmonella typhimurium LT2
aaucacuucauccggauaaagc

SEQ ID NO: 3799738 - RNA, 19 nt, Salmonella typhimurium LT2
aaucagaagcgucauaagu

SEQ ID NO: 3799739 - RNA, 18 nt, Salmonella typhimurium LT2
aaucagagacaaauacau

SEQ ID NO: 3799740 - RNA, 21 nt, Salmonella typhimurium LT2
aaucagauccgcgucauuaau

SEQ ID NO: 3799741 - RNA, 20 nt, Salmonella typhimurium LT2
aaucagaugcgcuucagcga

SEQ ID NO: 3799742 - RNA, 13 nt, Salmonella typhimurium LT2
aaucagaugcuca

SEQ ID NO: 3799743 - RNA, 15 nt, Salmonella typhimurium LT2
aaucagaugcugacu

SEQ ID NO: 3799744 - RNA, 23 nt, Salmonella typhimurium LT2
aaucagcacacgccaaaaucgcc

SEQ ID NO: 3799745 - RNA, 21 nt, Salmonella typhimurium LT2
aaucagcagccgggccagacg

SEQ ID NO: 3799746 - RNA, 11 nt, Salmonella typhimurium LT2
aaucagcagcg

SEQ ID NO: 3799747 - RNA, 13 nt, Salmonella typhimurium LT2
aaucagcaucacc

SEQ ID NO: 3799748 - RNA, 18 nt, Salmonella typhimurium LT2
aaucagccacggcaacgc

SEQ ID NO: 3799749 - RNA, 17 nt, Salmonella typhimurium LT2
aaucagccgacggcgau

SEQ ID NO: 3799750 - RNA, 15 nt, Salmonella typhimurium LT2
aaucagcgcaauaaa

SEQ ID NO: 3799751 - RNA, 12 nt, Salmonella typhimurium LT2
aaucagcgcugu

SEQ ID NO: 3799752 - RNA, 22 nt, Salmonella typhimurium LT2
aaucagcgcugucgccaucacc

SEQ ID NO: 3799753 - RNA, 20 nt, Salmonella typhimurium LT2
aaucagcugcugcgcuuucc

SEQ ID NO: 3799754 - RNA, 13 nt, Salmonella typhimurium LT2
aaucaggaaaaag

SEQ ID NO: 3799755 - RNA, 23 nt, Salmonella typhimurium LT2
aaucaggcacaacccaaaggcca

SEQ ID NO: 3799756 - RNA, 21 nt, Salmonella typhimurium LT2
aaucagguaaguguaaguuca

SEQ ID NO: 3799757 - RNA, 20 nt, Salmonella typhimurium LT2
aaucaguacgcgcgcggcgu

SEQ ID NO: 3799758 - RNA, 18 nt, Salmonella typhimurium LT2
aaucaguacugcgcccgc

SEQ ID NO: 3799759 - RNA, 17 nt, Salmonella typhimurium LT2
aaucaguucaggaacau

SEQ ID NO: 3799760 - RNA, 14 nt, Salmonella typhimurium LT2
aaucauacagcgca

SEQ ID NO: 3799761 - RNA, 19 nt, Salmonella typhimurium LT2
aaucauacauagcaggcca

SEQ ID NO: 3799762 - RNA, 13 nt, Salmonella typhimurium LT2
aaucauaccagcg

SEQ ID NO: 3799763 - RNA, 19 nt, Salmonella typhimurium LT2
aaucauauaaucugaaaga

SEQ ID NO: 3799764 - RNA, 14 nt, Salmonella typhimurium LT2
aaucaucaaucgcu

SEQ ID NO: 3799765 - RNA, 17 nt, Salmonella typhimurium LT2
aaucaucagcaucuuug

SEQ ID NO: 3799766 - RNA, 22 nt, Salmonella typhimurium LT2
aaucaugaacgcuaucggcaua

SEQ ID NO: 3799767 - RNA, 17 nt, Salmonella typhimurium LT2
aaucaugcccaacugcc

SEQ ID NO: 3799768 - RNA, 15 nt, Salmonella typhimurium LT2
aaucauguuuuucuc

SEQ ID NO: 3799769 - RNA, 19 nt, Salmonella typhimurium LT2
aaucauuacggcgcuuucg

SEQ ID NO: 3799770 - RNA, 18 nt, Salmonella typhimurium LT2
aaucauucgagaugcaua

SEQ ID NO: 3799771 - RNA, 19 nt, Salmonella typhimurium LT2
aaucauucgagaugcauaa

SEQ ID NO: 3799772 - RNA, 18 nt, Salmonella typhimurium LT2
aaucauugugguuucccu

SEQ ID NO: 3799773 - RNA, 15 nt, Salmonella typhimurium LT2
aaucauuucauuaau

SEQ ID NO: 3799774 - RNA, 15 nt, Salmonella typhimurium LT2
aaucauuuguacaaa

SEQ ID NO: 3799775 - RNA, 12 nt, Salmonella typhimurium LT2
aauccaccagcg

SEQ ID NO: 3799776 - RNA, 21 nt, Salmonella typhimurium LT2
aauccacuggucgucugaaag

SEQ ID NO: 3799777 - RNA, 16 nt, Salmonella typhimurium LT2
aauccacuguccagau

SEQ ID NO: 3799778 - RNA, 20 nt, Salmonella typhimurium LT2
aauccagaggguaauuucuu

SEQ ID NO: 3799779 - RNA, 15 nt, Salmonella typhimurium LT2
aauccagauccgguu

SEQ ID NO: 3799780 - RNA, 22 nt, Salmonella typhimurium LT2
aauccaggccagauauugccga

SEQ ID NO: 3799781 - RNA, 23 nt, Salmonella typhimurium LT2
aauccaguaaugccauaauuuau

SEQ ID NO: 3799782 - RNA, 18 nt, Salmonella typhimurium LT2
aauccaugagaagaaaaa

SEQ ID NO: 3799783 - RNA, 17 nt, Salmonella typhimurium LT2
aaucccacgccgcugau

SEQ ID NO: 3799784 - RNA, 19 nt, Salmonella typhimurium LT2
aauccccagcgcuccacca

SEQ ID NO: 3799785 - RNA, 20 nt, Salmonella typhimurium LT2
aaucccccauacccuguuca

SEQ ID NO: 3799786 - RNA, 16 nt, Salmonella typhimurium LT2
aauccccccuuuaccc

SEQ ID NO: 3799787 - RNA, 23 nt, Salmonella typhimurium LT2
aauccccccuuuacccaccagcc

SEQ ID NO: 3799788 - RNA, 17 nt, Salmonella typhimurium LT2
aaucccccugccacaac

SEQ ID NO: 3799789 - RNA, 17 nt, Salmonella typhimurium LT2
aauccccgccgccauca

SEQ ID NO: 3799790 - RNA, 20 nt, Salmonella typhimurium LT2
aauccccggcgaaagaaaau

SEQ ID NO: 3799791 - RNA, 22 nt, Salmonella typhimurium LT2
aaucccgacgcgcgauaucagc

SEQ ID NO: 3799792 - RNA, 22 nt, Salmonella typhimurium LT2
aaucccggcaacugcgccaaau

SEQ ID NO: 3799793 - RNA, 16 nt, Salmonella typhimurium LT2
aaucccuggcgaauaa

SEQ ID NO: 3799794 - RNA, 19 nt, Salmonella typhimurium LT2
aaucccuggcgaauaaaau

SEQ ID NO: 3799795 - RNA, 21 nt, Salmonella typhimurium LT2
aauccggcugccugccggauu

SEQ ID NO: 3799796 - RNA, 17 nt, Salmonella typhimurium LT2
aauccgguuuucguuaa

SEQ ID NO: 3799797 - RNA, 11 nt, Salmonella typhimurium LT2
aauccguugau

SEQ ID NO: 3799798 - RNA, 15 nt, Salmonella typhimurium LT2
aauccucgucaaggc

SEQ ID NO: 3799799 - RNA, 21 nt, Salmonella typhimurium LT2
aauccucuaccggaaaacagc

SEQ ID NO: 3799800 - RNA, 19 nt, Salmonella typhimurium LT2
aauccugauuaaguuuuuu

SEQ ID NO: 3799801 - RNA, 23 nt, Salmonella typhimurium LT2
aauccuguuccaucguauagcga

SEQ ID NO: 3799802 - RNA, 20 nt, Salmonella typhimurium LT2
aaugccacgagaaauccaca

SEQ ID NO: 3799803 - RNA, 17 nt, Salmonella typhimurium LT2
aaugccauccagcacca

SEQ ID NO: 3799804 - RNA, 19 nt, Salmonella typhimurium LT2
aaugccauuuuugcaucau

SEQ ID NO: 3799805 - RNA, 19 nt, Salmonella typhimurium LT2
aaugcccaccgauuucagc

SEQ ID NO: 3799806 - RNA, 13 nt, Salmonella typhimurium LT2
aaugcccacgccg

SEQ ID NO: 3799807 - RNA, 19 nt, Salmonella typhimurium LT2
aaugcccagcgcaaucacg

SEQ ID NO: 3799808 - RNA, 16 nt, Salmonella typhimurium LT2
aaugcccauccacgcc

SEQ ID NO: 3799809 - RNA, 21 nt, Salmonella typhimurium LT2
aaugccccagguuauagaccu

SEQ ID NO: 3799810 - RNA, 15 nt, Salmonella typhimurium LT2
aaugcccccucggca

SEQ ID NO: 3799811 - RNA, 21 nt, Salmonella typhimurium LT2
aaugccccgugacuuuccagu

SEQ ID NO: 3799812 - RNA, 21 nt, Salmonella typhimurium LT2
aaugcccgucccauuucugga

SEQ ID NO: 3799813 - RNA, 16 nt, Salmonella typhimurium LT2
aaugcccguugacgaa

SEQ ID NO: 3799814 - RNA, 11 nt, Salmonella typhimurium LT2
aaugcccuucu

SEQ ID NO: 3799815 - RNA, 20 nt, Salmonella typhimurium LT2
aaugccgauagucuccgcca

SEQ ID NO: 3799816 - RNA, 22 nt, Salmonella typhimurium LT2
aaugccgaucaccagcgcaucg

SEQ ID NO: 3799817 - RNA, 23 nt, Salmonella typhimurium LT2
aaugccggauggcgucgcuaaag

SEQ ID NO: 3799818 - RNA, 17 nt, Salmonella typhimurium LT2
aaugccgggcagacgac

SEQ ID NO: 3799819 - RNA, 18 nt, Salmonella typhimurium LT2
aaugccguaccugcugac

SEQ ID NO: 3799820 - RNA, 20 nt, Salmonella typhimurium LT2
aaugccguauaccagcguca

SEQ ID NO: 3799821 - RNA, 17 nt, Salmonella typhimurium LT2
aaugccgucaucagcaa

SEQ ID NO: 3799822 - RNA, 15 nt, Salmonella typhimurium LT2
aaugccucauuaaaa

SEQ ID NO: 3799823 - RNA, 14 nt, Salmonella typhimurium LT2
aaugccucuuguuu

SEQ ID NO: 3799824 - RNA, 14 nt, Salmonella typhimurium LT2
aaugccugaccaac

SEQ ID NO: 3799825 - RNA, 21 nt, Salmonella typhimurium LT2
aaugccugacgccaccacgcc

SEQ ID NO: 3799826 - RNA, 13 nt, Salmonella typhimurium LT2
aaugccuguuuau

SEQ ID NO: 3799827 - RNA, 16 nt, Salmonella typhimurium LT2
aaugccuguuuauauu

SEQ ID NO: 3799828 - RNA, 17 nt, Salmonella typhimurium LT2
aaugccuuauccggccu

SEQ ID NO: 3799829 - RNA, 14 nt, Salmonella typhimurium LT2
aaugcgaauccggc

SEQ ID NO: 3799830 - RNA, 19 nt, Salmonella typhimurium LT2
aaugcgcaaucccggagag

SEQ ID NO: 3799831 - RNA, 13 nt, Salmonella typhimurium LT2
aaugcgcacgcca

SEQ ID NO: 3799832 - RNA, 15 nt, Salmonella typhimurium LT2
aaugcgccccggcgg

SEQ ID NO: 3799833 - RNA, 18 nt, Salmonella typhimurium LT2
aaugcgccccggcggcgu

SEQ ID NO: 3799834 - RNA, 22 nt, Salmonella typhimurium LT2
aaugcgcgcggcugccggacug

SEQ ID NO: 3799835 - RNA, 15 nt, Salmonella typhimurium LT2
aaugcgcuagcuggc

SEQ ID NO: 3799836 - RNA, 22 nt, Salmonella typhimurium LT2
aaugcgcuccagcuucaucauc

SEQ ID NO: 3799837 - RNA, 19 nt, Salmonella typhimurium LT2
aaugcgcuuuuuuugcccu

SEQ ID NO: 3799838 - RNA, 14 nt, Salmonella typhimurium LT2
aaugcguaaaaagc

SEQ ID NO: 3799839 - RNA, 20 nt, Salmonella typhimurium LT2
aaugcgucggcaccauuccc

SEQ ID NO: 3799840 - RNA, 13 nt, Salmonella typhimurium LT2
aaugcuauuugug

SEQ ID NO: 3799841 - RNA, 18 nt, Salmonella typhimurium LT2
aaugcuccaauaaauauu

SEQ ID NO: 3799842 - RNA, 23 nt, Salmonella typhimurium LT2
aaugcugacgcguuuuuucauga

SEQ ID NO: 3799843 - RNA, 18 nt, Salmonella typhimurium LT2
aaugcuggcggagccaaa

SEQ ID NO: 3799844 - RNA, 13 nt, Salmonella typhimurium LT2
aaugcuuuaaaug

SEQ ID NO: 3799845 - RNA, 14 nt, Salmonella typhimurium LT2
aaugcuuuaaaugc

SEQ ID NO: 3799846 - RNA, 15 nt, Salmonella typhimurium LT2
aaugcuuucaauacu

SEQ ID NO: 3799847 - RNA, 19 nt, Salmonella typhimurium LT2
aauggcagaauaaaacagc

SEQ ID NO: 3799848 - RNA, 18 nt, Salmonella typhimurium LT2
aauggcaggcagcagaua

SEQ ID NO: 3799849 - RNA, 14 nt, Salmonella typhimurium LT2
aauggcagggacaa

SEQ ID NO: 3799850 - RNA, 15 nt, Salmonella typhimurium LT2
aauggccaccagcac

SEQ ID NO: 3799851 - RNA, 16 nt, Salmonella typhimurium LT2
aauggccgcagcgcca

SEQ ID NO: 3799852 - RNA, 12 nt, Salmonella typhimurium LT2
aauggccgcccc

SEQ ID NO: 3799853 - RNA, 20 nt, Salmonella typhimurium LT2
aauggcggagaucuccagau

SEQ ID NO: 3799854 - RNA, 16 nt, Salmonella typhimurium LT2
aauggcggcgcgaacg

SEQ ID NO: 3799855 - RNA, 17 nt, Salmonella typhimurium LT2
aauggcggcuucgccau

SEQ ID NO: 3799856 - RNA, 20 nt, Salmonella typhimurium LT2
aauggcgggaaaagguuccg

SEQ ID NO: 3799857 - RNA, 14 nt, Salmonella typhimurium LT2
aauggcgugaauca

SEQ ID NO: 3799858 - RNA, 15 nt, Salmonella typhimurium LT2
aauggcguugcuggc

SEQ ID NO: 3799859 - RNA, 19 nt, Salmonella typhimurium LT2
aauggcucaacuccgccgg

SEQ ID NO: 3799860 - RNA, 16 nt, Salmonella typhimurium LT2
aaugggcaggagauga

SEQ ID NO: 3799861 - RNA, 22 nt, Salmonella typhimurium LT2
aaugguauaugggcaauuauau

SEQ ID NO: 3799862 - RNA, 14 nt, Salmonella typhimurium LT2
aauggucagcgccg

SEQ ID NO: 3799863 - RNA, 14 nt, Salmonella typhimurium LT2
aauggucgcgccag

SEQ ID NO: 3799864 - RNA, 21 nt, Salmonella typhimurium LT2
aauggucuuaaaugccgccgg

SEQ ID NO: 3799865 - RNA, 23 nt, Salmonella typhimurium LT2
aauggugucuuuuacuuuaagcg

SEQ ID NO: 3799866 - RNA, 13 nt, Salmonella typhimurium LT2
aaugguuauuaau

SEQ ID NO: 3799867 - RNA, 12 nt, Salmonella typhimurium LT2
aaugguuuugcc

SEQ ID NO: 3799868 - RNA, 17 nt, Salmonella typhimurium LT2
aauguaaaaaaauaaaa

SEQ ID NO: 3799869 - RNA, 15 nt, Salmonella typhimurium LT2
aauguaagaauaaca

SEQ ID NO: 3799870 - RNA, 20 nt, Salmonella typhimurium LT2
aauguaauucaccaaauccu

SEQ ID NO: 3799871 - RNA, 21 nt, Salmonella typhimurium LT2
aauguaguaccaggcagaagg

SEQ ID NO: 3799872 - RNA, 22 nt, Salmonella typhimurium LT2
aauguauucucccgucagcaac

SEQ ID NO: 3799873 - RNA, 14 nt, Salmonella typhimurium LT2
aauguauuucagac

SEQ ID NO: 3799874 - RNA, 22 nt, Salmonella typhimurium LT2
aaugucagaucguaugcgccug

SEQ ID NO: 3799875 - RNA, 14 nt, Salmonella typhimurium LT2
aaugucaugcgcca

SEQ ID NO: 3799876 - RNA, 20 nt, Salmonella typhimurium LT2
aauguccagcagugucugcu

SEQ ID NO: 3799877 - RNA, 13 nt, Salmonella typhimurium LT2
aauguccccugac

SEQ ID NO: 3799878 - RNA, 12 nt, Salmonella typhimurium LT2
aauguccgccaa

SEQ ID NO: 3799879 - RNA, 20 nt, Salmonella typhimurium LT2
aauguccguuuucgacaugg

SEQ ID NO: 3799880 - RNA, 13 nt, Salmonella typhimurium LT2
aauguccugaauu

SEQ ID NO: 3799881 - RNA, 14 nt, Salmonella typhimurium LT2
aaugucgcgucagg

SEQ ID NO: 3799882 - RNA, 16 nt, Salmonella typhimurium LT2
aaugucgcgucagguu

SEQ ID NO: 3799883 - RNA, 17 nt, Salmonella typhimurium LT2
aaugucgcgucagguuu

SEQ ID NO: 3799884 - RNA, 21 nt, Salmonella typhimurium LT2
aaugucggccugauuucugac

SEQ ID NO: 3799885 - RNA, 22 nt, Salmonella typhimurium LT2
aaugucguuaucgccccaggcg

SEQ ID NO: 3799886 - RNA, 21 nt, Salmonella typhimurium LT2
aaugugcagcaggacgcgcac

SEQ ID NO: 3799887 - RNA, 20 nt, Salmonella typhimurium LT2
aaugugcggcguacugcaac

SEQ ID NO: 3799888 - RNA, 17 nt, Salmonella typhimurium LT2
aauguuaggaguaaaua

SEQ ID NO: 3799889 - RNA, 20 nt, Salmonella typhimurium LT2
aauguucauaucucaugcau

SEQ ID NO: 3799890 - RNA, 18 nt, Salmonella typhimurium LT2
aauguucauguacgccgc

SEQ ID NO: 3799891 - RNA, 20 nt, Salmonella typhimurium LT2
aauguugaaucccacgccgc

SEQ ID NO: 3799892 - RNA, 12 nt, Salmonella typhimurium LT2
aauuaaaaagag

SEQ ID NO: 3799893 - RNA, 19 nt, Salmonella typhimurium LT2
aauuaaaaagagaaaaaau

SEQ ID NO: 3799894 - RNA, 22 nt, Salmonella typhimurium LT2
aauuaaaauucauuauaaaaca

SEQ ID NO: 3799895 - RNA, 17 nt, Salmonella typhimurium LT2
aauuaaauguuugcuuu

SEQ ID NO: 3799896 - RNA, 16 nt, Salmonella typhimurium LT2
aauuaaauuauuuaag

SEQ ID NO: 3799897 - RNA, 13 nt, Salmonella typhimurium LT2
aauuaaccgauaa

SEQ ID NO: 3799898 - RNA, 21 nt, Salmonella typhimurium LT2
aauuaacgacaaaaauaccac

SEQ ID NO: 3799899 - RNA, 18 nt, Salmonella typhimurium LT2
aauuaacgacauuuuugc

SEQ ID NO: 3799900 - RNA, 13 nt, Salmonella typhimurium LT2
aauuaacugcacu

SEQ ID NO: 3799901 - RNA, 23 nt, Salmonella typhimurium LT2
aauuaagccggguagaugccgau

SEQ ID NO: 3799902 - RNA, 17 nt, Salmonella typhimurium LT2
aauuaaucacaauguca

SEQ ID NO: 3799903 - RNA, 17 nt, Salmonella typhimurium LT2
aauuacaucaauaaaca

SEQ ID NO: 3799904 - RNA, 18 nt, Salmonella typhimurium LT2
aauuacggacagaaaaaa

SEQ ID NO: 3799905 - RNA, 21 nt, Salmonella typhimurium LT2
aauuacggacagaaaaaauag

SEQ ID NO: 3799906 - RNA, 18 nt, Salmonella typhimurium LT2
acaaaccccacccgcuga

SEQ ID NO: 3799907 - RNA, 15 nt, Salmonella typhimurium LT2
acaaaccgauaauca

SEQ ID NO: 3799908 - RNA, 16 nt, Salmonella typhimurium LT2
acaaacgcaauauugg

SEQ ID NO: 3799909 - RNA, 22 nt, Salmonella typhimurium LT2
acaaacgccgucacaaagccca

SEQ ID NO: 3799910 - RNA, 16 nt, Salmonella typhimurium LT2
acaaacgcuucuauuu

SEQ ID NO: 3799911 - RNA, 15 nt, Salmonella typhimurium LT2
acaaacuccagcacg

SEQ ID NO: 3799912 - RNA, 23 nt, Salmonella typhimurium LT2
acaaacugcgcuagccgccgugu

SEQ ID NO: 3799913 - RNA, 15 nt, Salmonella typhimurium LT2
acaaagagcucccca

SEQ ID NO: 3799914 - RNA, 22 nt, Salmonella typhimurium LT2
acaaagagcuccccacgaaagu

SEQ ID NO: 3799915 - RNA, 14 nt, Salmonella typhimurium LT2
acaaagccggauau

SEQ ID NO: 3799916 - RNA, 14 nt, Salmonella typhimurium LT2
acaaagcguucggc

SEQ ID NO: 3799917 - RNA, 14 nt, Salmonella typhimurium LT2
acaaagcucaccug

SEQ ID NO: 3799918 - RNA, 20 nt, Salmonella typhimurium LT2
acaaagcucaccugcucgcc

SEQ ID NO: 3799919 - RNA, 19 nt, Salmonella typhimurium LT2
acaaaggcaaaauggguuc

SEQ ID NO: 3799920 - RNA, 13 nt, Salmonella typhimurium LT2
acaaagguaaacg

SEQ ID NO: 3799921 - RNA, 14 nt, Salmonella typhimurium LT2
acaaagguaaacgc

SEQ ID NO: 3799922 - RNA, 20 nt, Salmonella typhimurium LT2
acaaagguugcgccaaagca

SEQ ID NO: 3799923 - RNA, 23 nt, Salmonella typhimurium LT2
acaaagguugcgccaaagcaauc

SEQ ID NO: 3799924 - RNA, 17 nt, Salmonella typhimurium LT2
acaaagguuuguuuaau

SEQ ID NO: 3799925 - RNA, 12 nt, Salmonella typhimurium LT2
acaaagucgccu

SEQ ID NO: 3799926 - RNA, 13 nt, Salmonella typhimurium LT2
acaaauaaaauaa

SEQ ID NO: 3799927 - RNA, 13 nt, Salmonella typhimurium LT2
acaaauaaaucca

SEQ ID NO: 3799928 - RNA, 23 nt, Salmonella typhimurium LT2
acaaauagaagccacaaucugau

SEQ ID NO: 3799929 - RNA, 16 nt, Salmonella typhimurium LT2
acaaauccaaucugac

SEQ ID NO: 3799930 - RNA, 19 nt, Salmonella typhimurium LT2
acaaauccaaucugacaca

SEQ ID NO: 3799931 - RNA, 20 nt, Salmonella typhimurium LT2
acaaaugaccucaagaauau

SEQ ID NO: 3799932 - RNA, 19 nt, Salmonella typhimurium LT2
acaaauuacacaauaucaa

SEQ ID NO: 3799933 - RNA, 13 nt, Salmonella typhimurium LT2
acaaauuauaaac

SEQ ID NO: 3799934 - RNA, 15 nt, Salmonella typhimurium LT2
acaaauuauaaacua

SEQ ID NO: 3799935 - RNA, 15 nt, Salmonella typhimurium LT2
acaaauucugaagag

SEQ ID NO: 3799936 - RNA, 20 nt, Salmonella typhimurium LT2
acaaauuguuuaaaaacagg

SEQ ID NO: 3799937 - RNA, 17 nt, Salmonella typhimurium LT2
acaaauuuugauaaaaa

SEQ ID NO: 3799938 - RNA, 16 nt, Salmonella typhimurium LT2
acaacaagaauauauu

SEQ ID NO: 3799939 - RNA, 15 nt, Salmonella typhimurium LT2
acaacacgcuuuuca

SEQ ID NO: 3799940 - RNA, 15 nt, Salmonella typhimurium LT2
acaacauuguuacgu

SEQ ID NO: 3799941 - RNA, 14 nt, Salmonella typhimurium LT2
acaaccagcagggc

SEQ ID NO: 3799942 - RNA, 23 nt, Salmonella typhimurium LT2
acaaccaggauucaacgcgugau

SEQ ID NO: 3799943 - RNA, 20 nt, Salmonella typhimurium LT2
acaaccgcccccaacugagc

SEQ ID NO: 3799944 - RNA, 13 nt, Salmonella typhimurium LT2
acaaccugcccuu

SEQ ID NO: 3799945 - RNA, 20 nt, Salmonella typhimurium LT2
acaacgccgguacgcagcag

SEQ ID NO: 3799946 - RNA, 16 nt, Salmonella typhimurium LT2
acaacgccugccgcgc

SEQ ID NO: 3799947 - RNA, 22 nt, Salmonella typhimurium LT2
acaacgccugccgcgcccaguu

SEQ ID NO: 3799948 - RNA, 17 nt, Salmonella typhimurium LT2
acaacggcgaccuucac

SEQ ID NO: 3799949 - RNA, 19 nt, Salmonella typhimurium LT2
acaacguaauauuaagcag

SEQ ID NO: 3799950 - RNA, 21 nt, Salmonella typhimurium LT2
acaacgucaguggaaaacagc

SEQ ID NO: 3799951 - RNA, 14 nt, Salmonella typhimurium LT2
acaacguuacgcca

SEQ ID NO: 3799952 - RNA, 15 nt, Salmonella typhimurium LT2
acaacguuacgccag

SEQ ID NO: 3799953 - RNA, 14 nt, Salmonella typhimurium LT2
acaacuagcaaaac

SEQ ID NO: 3799954 - RNA, 12 nt, Salmonella typhimurium LT2
acaacuccagca

SEQ ID NO: 3799955 - RNA, 17 nt, Salmonella typhimurium LT2
acaacucuauuaaaaua

SEQ ID NO: 3799956 - RNA, 13 nt, Salmonella typhimurium LT2
acaacuucuuugc

SEQ ID NO: 3799957 - RNA, 23 nt, Salmonella typhimurium LT2
acaagaaggccucuauccggagg

SEQ ID NO: 3799958 - RNA, 21 nt, Salmonella typhimurium LT2
acaagaauuuaucgcaauaua

SEQ ID NO: 3799959 - RNA, 23 nt, Salmonella typhimurium LT2
acaagaucgcaacgugcaggcgc

SEQ ID NO: 3799960 - RNA, 21 nt, Salmonella typhimurium LT2
acaagauuaauuuaauugaua

SEQ ID NO: 3799961 - RNA, 19 nt, Salmonella typhimurium LT2
acaagccccccgcacagca

SEQ ID NO: 3799962 - RNA, 17 nt, Salmonella typhimurium LT2
acaagccgauaucgacc

SEQ ID NO: 3799963 - RNA, 15 nt, Salmonella typhimurium LT2
acaagcuaaucccca

SEQ ID NO: 3799964 - RNA, 18 nt, Salmonella typhimurium LT2
acaagcugcgccauaccc

SEQ ID NO: 3799965 - RNA, 18 nt, Salmonella typhimurium LT2
acaaguagccugccagca

SEQ ID NO: 3799966 - RNA, 20 nt, Salmonella typhimurium LT2
acaaguagccugccagcaac

SEQ ID NO: 3799967 - RNA, 21 nt, Salmonella typhimurium LT2
acaauaaaguuauacagcacc

SEQ ID NO: 3799968 - RNA, 22 nt, Salmonella typhimurium LT2
acaauaacgcgccggauauguu

SEQ ID NO: 3799969 - RNA, 22 nt, Salmonella typhimurium LT2
acaauaaucgcgagaaaauaga

SEQ ID NO: 3799970 - RNA, 12 nt, Salmonella typhimurium LT2
acaauaccaaua

SEQ ID NO: 3799971 - RNA, 16 nt, Salmonella typhimurium LT2
acaauacuucaaauga

SEQ ID NO: 3799972 - RNA, 18 nt, Salmonella typhimurium LT2
acaauagcaaucuguaac

SEQ ID NO: 3799973 - RNA, 23 nt, Salmonella typhimurium LT2
acaauagcgcuaaacagcgccgc

SEQ ID NO: 3799974 - RNA, 18 nt, Salmonella typhimurium LT2
acaauauccucgcauccu

SEQ ID NO: 3799975 - RNA, 22 nt, Salmonella typhimurium LT2
acaauauucgccgcgauaauaa

SEQ ID NO: 3799976 - RNA, 14 nt, Salmonella typhimurium LT2
acaauauugcgcua

SEQ ID NO: 3799977 - RNA, 20 nt, Salmonella typhimurium LT2
acaaucaaauggcuggcgcu

SEQ ID NO: 3799978 - RNA, 17 nt, Salmonella typhimurium LT2
acaaucagcacacuaca

SEQ ID NO: 3799979 - RNA, 20 nt, Salmonella typhimurium LT2
acaaucaggcugcggaugau

SEQ ID NO: 3799980 - RNA, 16 nt, Salmonella typhimurium LT2
acaauccccgaaagcc

SEQ ID NO: 3799981 - RNA, 16 nt, Salmonella typhimurium LT2
acaauccguuccaauc

SEQ ID NO: 3799982 - RNA, 18 nt, Salmonella typhimurium LT2
acaauccguuccaaucuc

SEQ ID NO: 3799983 - RNA, 18 nt, Salmonella typhimurium LT2
acaaucgcauaaccggcg

SEQ ID NO: 3799984 - RNA, 14 nt, Salmonella typhimurium LT2
acaaucgccagccc

SEQ ID NO: 3799985 - RNA, 19 nt, Salmonella typhimurium LT2
acaaucgccgugaucccaa

SEQ ID NO: 3799986 - RNA, 20 nt, Salmonella typhimurium LT2
acaaucucaaugccacgccg

SEQ ID NO: 3799987 - RNA, 19 nt, Salmonella typhimurium LT2
acaaugaagcauaaaaaga

SEQ ID NO: 3799988 - RNA, 21 nt, Salmonella typhimurium LT2
acaaugaauauuauucuguuu

SEQ ID NO: 3799989 - RNA, 19 nt, Salmonella typhimurium LT2
acaaugaugguuaacggaa

SEQ ID NO: 3799990 - RNA, 13 nt, Salmonella typhimurium LT2
acaaugcaaacga

SEQ ID NO: 3799991 - RNA, 16 nt, Salmonella typhimurium LT2
acaaugccauaaagcg

SEQ ID NO: 3799992 - RNA, 18 nt, Salmonella typhimurium LT2
acaaugccauuuuugcau

SEQ ID NO: 3799993 - RNA, 14 nt, Salmonella typhimurium LT2
acaaugcugacacu

SEQ ID NO: 3799994 - RNA, 18 nt, Salmonella typhimurium LT2
acaaugggauaaaaugga

SEQ ID NO: 3799995 - RNA, 14 nt, Salmonella typhimurium LT2
acaauguacagaau

SEQ ID NO: 3799996 - RNA, 22 nt, Salmonella typhimurium LT2
acaaugugccggauggcgcuaa

SEQ ID NO: 3799997 - RNA, 21 nt, Salmonella typhimurium LT2
acaauuacgcaagagagcaac

SEQ ID NO: 3799998 - RNA, 15 nt, Salmonella typhimurium LT2
acaauuagucgggaa

SEQ ID NO: 3799999 - RNA, 13 nt, Salmonella typhimurium LT2
acaauuauauacg

SEQ ID NO: 3800000 - RNA, 15 nt, Salmonella typhimurium LT2
acaauuuaucagaca

SEQ ID NO: 3800001 - RNA, 22 nt, Salmonella typhimurium LT2
acaauuucccccacuucugaca

SEQ ID NO: 3800002 - RNA, 15 nt, Salmonella typhimurium LT2
acaauuugcccagcg

SEQ ID NO: 3800003 - RNA, 20 nt, Salmonella typhimurium LT2
acaauuuugauaagagaaaa

SEQ ID NO: 3800004 - RNA, 22 nt, Salmonella typhimurium LT2
acacaaaagcaucguaccuuca

SEQ ID NO: 3800005 - RNA, 15 nt, Salmonella typhimurium LT2
acacaauagcaaucu

SEQ ID NO: 3800006 - RNA, 16 nt, Salmonella typhimurium LT2
acacaaucacacccag

SEQ ID NO: 3800007 - RNA, 13 nt, Salmonella typhimurium LT2
acacaccagcagg

SEQ ID NO: 3800008 - RNA, 21 nt, Salmonella typhimurium LT2
acacacucggugcauuugucg

SEQ ID NO: 3800009 - RNA, 20 nt, Salmonella typhimurium LT2
acacagacugcuuguuuaau

SEQ ID NO: 3800010 - RNA, 14 nt, Salmonella typhimurium LT2
acagcagcgcggca

SEQ ID NO: 3800011 - RNA, 21 nt, Salmonella typhimurium LT2
acagcagcgcuuucaccgcgu

SEQ ID NO: 3800012 - RNA, 14 nt, Salmonella typhimurium LT2
acagcauugaggcu

SEQ ID NO: 3800013 - RNA, 23 nt, Salmonella typhimurium LT2
acagcauugaggcuacccagaca

SEQ ID NO: 3800014 - RNA, 12 nt, Salmonella typhimurium LT2
acagccaaaaau

SEQ ID NO: 3800015 - RNA, 15 nt, Salmonella typhimurium LT2
acagccaaucauaaa

SEQ ID NO: 3800016 - RNA, 14 nt, Salmonella typhimurium LT2
acagccacacugcu

SEQ ID NO: 3800017 - RNA, 20 nt, Salmonella typhimurium LT2
acagccagcgagcgcagucc

SEQ ID NO: 3800018 - RNA, 22 nt, Salmonella typhimurium LT2
acagcccauaccacaacagaau

SEQ ID NO: 3800019 - RNA, 17 nt, Salmonella typhimurium LT2
acagcccauaccagcgc

SEQ ID NO: 3800020 - RNA, 20 nt, Salmonella typhimurium LT2
acagccgaucaggccgcaga

SEQ ID NO: 3800021 - RNA, 16 nt, Salmonella typhimurium LT2
acagccgcauuuuuuc

SEQ ID NO: 3800022 - RNA, 24 nt, Salmonella typhimurium LT2
acagccgcguugcgcugaaguaau

SEQ ID NO: 3800023 - RNA, 21 nt, Salmonella typhimurium LT2
acagccgcuaucacagcggca

SEQ ID NO: 3800024 - RNA, 23 nt, Salmonella typhimurium LT2
acagccgcuguuuuucaucauca

SEQ ID NO: 3800025 - RNA, 23 nt, Salmonella typhimurium LT2
acagccuuguuuaccgcaauaac

SEQ ID NO: 3800026 - RNA, 23 nt, Salmonella typhimurium LT2
acagcgaacaguguaaacgccag

SEQ ID NO: 3800027 - RNA, 15 nt, Salmonella typhimurium LT2
acagcgccagaauag

SEQ ID NO: 3800028 - RNA, 11 nt, Salmonella typhimurium LT2
acagcgccauc

SEQ ID NO: 3800029 - RNA, 15 nt, Salmonella typhimurium LT2
acagcgcgaccagga

SEQ ID NO: 3800030 - RNA, 20 nt, Salmonella typhimurium LT2
acagcgcgccaauccaugcc

SEQ ID NO: 3800031 - RNA, 17 nt, Salmonella typhimurium LT2
acagcgcgcccagcagg

SEQ ID NO: 3800032 - RNA, 16 nt, Salmonella typhimurium LT2
acagcgcggcaggccg

SEQ ID NO: 3800033 - RNA, 18 nt, Salmonella typhimurium LT2
acagcgcguccagcggca

SEQ ID NO: 3800034 - RNA, 14 nt, Salmonella typhimurium LT2
acagcgcuccacgc

SEQ ID NO: 3800035 - RNA, 13 nt, Salmonella typhimurium LT2
acagcggagagac

SEQ ID NO: 3800036 - RNA, 21 nt, Salmonella typhimurium LT2
acagcggcgcagacacugcca

SEQ ID NO: 3800037 - RNA, 14 nt, Salmonella typhimurium LT2
acagcggcgcgcca

SEQ ID NO: 3800038 - RNA, 20 nt, Salmonella typhimurium LT2
acagcguaagaauucgucca

SEQ ID NO: 3800039 - RNA, 17 nt, Salmonella typhimurium LT2
acagcguaaugcgccag

SEQ ID NO: 3800040 - RNA, 17 nt, Salmonella typhimurium LT2
acagcguacaauggcag

SEQ ID NO: 3800041 - RNA, 17 nt, Salmonella typhimurium LT2
acagcguaggccaggca

SEQ ID NO: 3800042 - RNA, 22 nt, Salmonella typhimurium LT2
acagcguaguuuauucuucucc

SEQ ID NO: 3800043 - RNA, 14 nt, Salmonella typhimurium LT2
acagcguauuaagc

SEQ ID NO: 3800044 - RNA, 20 nt, Salmonella typhimurium LT2
acagcguauuaagccaacgu

SEQ ID NO: 3800045 - RNA, 21 nt, Salmonella typhimurium LT2
acagcuggcgauauccgugcc

SEQ ID NO: 3800046 - RNA, 17 nt, Salmonella typhimurium LT2
acagcuuagauguaauu

SEQ ID NO: 3800047 - RNA, 22 nt, Salmonella typhimurium LT2
acagcuucaugugccgcgacaa

SEQ ID NO: 3800048 - RNA, 16 nt, Salmonella typhimurium LT2
acaggaaacagguacu

SEQ ID NO: 3800049 - RNA, 17 nt, Salmonella typhimurium LT2
acaggaaacagguacuu

SEQ ID NO: 3800050 - RNA, 19 nt, Salmonella typhimurium LT2
acaggaacaucguguccug

SEQ ID NO: 3800051 - RNA, 16 nt, Salmonella typhimurium LT2
acaggaauaaccacug

SEQ ID NO: 3800052 - RNA, 17 nt, Salmonella typhimurium LT2
acaggauguaagacagc

SEQ ID NO: 3800053 - RNA, 21 nt, Salmonella typhimurium LT2
acaggauguaagacagcgcgc

SEQ ID NO: 3800054 - RNA, 13 nt, Salmonella typhimurium LT2
acaggcagcguca

SEQ ID NO: 3800055 - RNA, 20 nt, Salmonella typhimurium LT2
acaggcauccgugaccugcu

SEQ ID NO: 3800056 - RNA, 18 nt, Salmonella typhimurium LT2
acaggcaugguuaacaau

SEQ ID NO: 3800057 - RNA, 20 nt, Salmonella typhimurium LT2
acaggccaacauagcggcaa

SEQ ID NO: 3800058 - RNA, 18 nt, Salmonella typhimurium LT2
acaggccauuaagcuucg

SEQ ID NO: 3800059 - RNA, 17 nt, Salmonella typhimurium LT2
acaggccgcgaaagcgg

SEQ ID NO: 3800060 - RNA, 22 nt, Salmonella typhimurium LT2
acaggccgcucuauuugcauag

SEQ ID NO: 3800061 - RNA, 15 nt, Salmonella typhimurium LT2
acaggccuggccuuc

SEQ ID NO: 3800062 - RNA, 16 nt, Salmonella typhimurium LT2
acaggcggaugaaaca

SEQ ID NO: 3800063 - RNA, 17 nt, Salmonella typhimurium LT2
acaggcggguauggcgc

SEQ ID NO: 3800064 - RNA, 21 nt, Salmonella typhimurium LT2
acaggcggguauggcgccaau

SEQ ID NO: 3800065 - RNA, 22 nt, Salmonella typhimurium LT2
acaggcggguauggcgccaaua

SEQ ID NO: 3800066 - RNA, 16 nt, Salmonella typhimurium LT2
acaggcguguggcaua

SEQ ID NO: 3800067 - RNA, 23 nt, Salmonella typhimurium LT2
acaggcguguggcauaaauaaac

SEQ ID NO: 3800068 - RNA, 18 nt, Salmonella typhimurium LT2
acaggcuauaacgcacca

SEQ ID NO: 3800069 - RNA, 21 nt, Salmonella typhimurium LT2
acaggcuauaacgcaccaccu

SEQ ID NO: 3800070 - RNA, 22 nt, Salmonella typhimurium LT2
acaggcuauaacgcaccaccug

SEQ ID NO: 3800071 - RNA, 21 nt, Salmonella typhimurium LT2
acaggcuucgguugccugcgu

SEQ ID NO: 3800072 - RNA, 16 nt, Salmonella typhimurium LT2
acaggcuuuucaggcu

SEQ ID NO: 3800073 - RNA, 18 nt, Salmonella typhimurium LT2
acagggcggcgcgcugcc

SEQ ID NO: 3800074 - RNA, 19 nt, Salmonella typhimurium LT2
acagggcggcgcgcugccg

SEQ ID NO: 3800075 - RNA, 23 nt, Salmonella typhimurium LT2
acagggcguuuuauaagccgcuc

SEQ ID NO: 3800076 - RNA, 14 nt, Salmonella typhimurium LT2
acagggcuucuuua

SEQ ID NO: 3800077 - RNA, 13 nt, Salmonella typhimurium LT2
acagguaaaacaa

SEQ ID NO: 3800078 - RNA, 14 nt, Salmonella typhimurium LT2
acagguaaaacaaa

SEQ ID NO: 3800079 - RNA, 22 nt, Salmonella typhimurium LT2
acagguaaaacaaaaaaacggc

SEQ ID NO: 3800080 - RNA, 16 nt, Salmonella typhimurium LT2
acagguacagaugcug

SEQ ID NO: 3800081 - RNA, 15 nt, Salmonella typhimurium LT2
acagguacaggccgc

SEQ ID NO: 3800082 - RNA, 16 nt, Salmonella typhimurium LT2
acagguagcugcacaa

SEQ ID NO: 3800083 - RNA, 19 nt, Salmonella typhimurium LT2
acaggucgaugauuuucaa

SEQ ID NO: 3800084 - RNA, 12 nt, Salmonella typhimurium LT2
acaggugcaggg

SEQ ID NO: 3800085 - RNA, 15 nt, Salmonella typhimurium LT2
acagguuaaccaugc

SEQ ID NO: 3800086 - RNA, 16 nt, Salmonella typhimurium LT2
acagguucgaaucccg

SEQ ID NO: 3800087 - RNA, 20 nt, Salmonella typhimurium LT2
acagguugcguaacgccaca

SEQ ID NO: 3800088 - RNA, 22 nt, Salmonella typhimurium LT2
acagguugcguaacgccacaua

SEQ ID NO: 3800089 - RNA, 19 nt, Salmonella typhimurium LT2
acaguaccagcagaacggu

SEQ ID NO: 3800090 - RNA, 18 nt, Salmonella typhimurium LT2
acaguacgaucaugaauc

SEQ ID NO: 3800091 - RNA, 18 nt, Salmonella typhimurium LT2
acaguagcggcgaggcag

SEQ ID NO: 3800092 - RNA, 19 nt, Salmonella typhimurium LT2
acaguauuuguucagacac

SEQ ID NO: 3800093 - RNA, 16 nt, Salmonella typhimurium LT2
acaguccaggaaagag

SEQ ID NO: 3800094 - RNA, 22 nt, Salmonella typhimurium LT2
acaguccgaugguuaaauugaa

SEQ ID NO: 3800095 - RNA, 19 nt, Salmonella typhimurium LT2
acaguccgggccgugacac

SEQ ID NO: 3800096 - RNA, 22 nt, Salmonella typhimurium LT2
acagucgaucccaacguugguu

SEQ ID NO: 3800097 - RNA, 21 nt, Salmonella typhimurium LT2
acagugaagugugaacuaugc

SEQ ID NO: 3800098 - RNA, 13 nt, Salmonella typhimurium LT2
acagugcgccaua

SEQ ID NO: 3800099 - RNA, 19 nt, Salmonella typhimurium LT2
acagugcgcgaccgcauca

SEQ ID NO: 3800100 - RNA, 18 nt, Salmonella typhimurium LT2
acagugugccgucaucca

SEQ ID NO: 3800101 - RNA, 16 nt, Salmonella typhimurium LT2
acaguucacgacugau

SEQ ID NO: 3800102 - RNA, 18 nt, Salmonella typhimurium LT2
acaguucagacaccacgc

SEQ ID NO: 3800103 - RNA, 13 nt, Salmonella typhimurium LT2
acaguuuaucugc

SEQ ID NO: 3800104 - RNA, 12 nt, Salmonella typhimurium LT2
acaguuugucaa

SEQ ID NO: 3800105 - RNA, 20 nt, Salmonella typhimurium LT2
acaguuuuuucguuccagag

SEQ ID NO: 3800106 - RNA, 15 nt, Salmonella typhimurium LT2
acauaaaaacgcgcu

SEQ ID NO: 3800107 - RNA, 16 nt, Salmonella typhimurium LT2
acauaaagauaaauaa

SEQ ID NO: 3800108 - RNA, 21 nt, Salmonella typhimurium LT2
acauaaagcccagaauaguga

SEQ ID NO: 3800109 - RNA, 15 nt, Salmonella typhimurium LT2
acauaacaucucacu

SEQ ID NO: 3800110 - RNA, 16 nt, Salmonella typhimurium LT2
acauaacaucucacua

SEQ ID NO: 3800111 - RNA, 20 nt, Salmonella typhimurium LT2
acauaaccugaauauggcca

SEQ ID NO: 3800112 - RNA, 20 nt, Salmonella typhimurium LT2
acauaauguaaaggugagcu

SEQ ID NO: 3800113 - RNA, 17 nt, Salmonella typhimurium LT2
acauuucgcacccuguc

SEQ ID NO: 3800114 - RNA, 18 nt, Salmonella typhimurium LT2
acauuugcucccuuaaaa

SEQ ID NO: 3800115 - RNA, 19 nt, Salmonella typhimurium LT2
acauuuggggcuggcgaca

SEQ ID NO: 3800116 - RNA, 13 nt, Salmonella typhimurium LT2
acauuuucccaac

SEQ ID NO: 3800117 - RNA, 20 nt, Salmonella typhimurium LT2
acauuuuuagcguuucaucg

SEQ ID NO: 3800118 - RNA, 15 nt, Salmonella typhimurium LT2
acauuuuuuucuugc

SEQ ID NO: 3800119 - RNA, 17 nt, Salmonella typhimurium LT2
accaaaaacgcccccag

SEQ ID NO: 3800120 - RNA, 16 nt, Salmonella typhimurium LT2
accaaaaucaaacuga

SEQ ID NO: 3800121 - RNA, 15 nt, Salmonella typhimurium LT2
accaaacacgaggcu

SEQ ID NO: 3800122 - RNA, 18 nt, Salmonella typhimurium LT2
accaaacacgaggcugcc

SEQ ID NO: 3800123 - RNA, 22 nt, Salmonella typhimurium LT2
accaaacccuuuggcaaaaaag

SEQ ID NO: 3800124 - RNA, 11 nt, Salmonella typhimurium LT2
accaaagcaaa

SEQ ID NO: 3800125 - RNA, 19 nt, Salmonella typhimurium LT2
accaaagcccgcaaacaga

SEQ ID NO: 3800126 - RNA, 15 nt, Salmonella typhimurium LT2
accaaaguuaaucag

SEQ ID NO: 3800127 - RNA, 16 nt, Salmonella typhimurium LT2
accaaaucucaagagu

SEQ ID NO: 3800128 - RNA, 21 nt, Salmonella typhimurium LT2
accaaaucucaagagugaaca

SEQ ID NO: 3800129 - RNA, 20 nt, Salmonella typhimurium LT2
accaaccaggcaaaccagca

SEQ ID NO: 3800130 - RNA, 18 nt, Salmonella typhimurium LT2
accaacgacccccaccau

SEQ ID NO: 3800131 - RNA, 22 nt, Salmonella typhimurium LT2
accaacgacccccaccauguca

SEQ ID NO: 3800132 - RNA, 19 nt, Salmonella typhimurium LT2
accaacgucgugccaguga

SEQ ID NO: 3800133 - RNA, 17 nt, Salmonella typhimurium LT2
accaacguugaagagcu

SEQ ID NO: 3800134 - RNA, 18 nt, Salmonella typhimurium LT2
accaacguugaagagcua

SEQ ID NO: 3800135 - RNA, 21 nt, Salmonella typhimurium LT2
accaagaucggagauauaaac

SEQ ID NO: 3800136 - RNA, 21 nt, Salmonella typhimurium LT2
accaaguuuggcaaucaaauc

SEQ ID NO: 3800137 - RNA, 23 nt, Salmonella typhimurium LT2
accaauaauaaucccaacauggu

SEQ ID NO: 3800138 - RNA, 14 nt, Salmonella typhimurium LT2
accaauaaugcagg

SEQ ID NO: 3800139 - RNA, 21 nt, Salmonella typhimurium LT2
accaauaauugccgaauauug

SEQ ID NO: 3800140 - RNA, 13 nt, Salmonella typhimurium LT2
accaauagccuug

SEQ ID NO: 3800141 - RNA, 18 nt, Salmonella typhimurium LT2
accaauauuaaagaugcc

SEQ ID NO: 3800142 - RNA, 19 nt, Salmonella typhimurium LT2
accaaugacgcuauccgca

SEQ ID NO: 3800143 - RNA, 13 nt, Salmonella typhimurium LT2
accaaugugcaaa

SEQ ID NO: 3800144 - RNA, 20 nt, Salmonella typhimurium LT2
accaauguuaauaagcagaa

SEQ ID NO: 3800145 - RNA, 14 nt, Salmonella typhimurium LT2
accaauuaaauuau

SEQ ID NO: 3800146 - RNA, 17 nt, Salmonella typhimurium LT2
accaauucccagacccg

SEQ ID NO: 3800147 - RNA, 22 nt, Salmonella typhimurium LT2
accacaaacgccgucacaaagc

SEQ ID NO: 3800148 - RNA, 15 nt, Salmonella typhimurium LT2
accacaaaggcgcgu

SEQ ID NO: 3800149 - RNA, 17 nt, Salmonella typhimurium LT2
accacaaguuuauccgg

SEQ ID NO: 3800150 - RNA, 12 nt, Salmonella typhimurium LT2
accacaccugau

SEQ ID NO: 3800151 - RNA, 18 nt, Salmonella typhimurium LT2
accacaccugaugguuau

SEQ ID NO: 3800152 - RNA, 21 nt, Salmonella typhimurium LT2
accacagcaaaucguuuaacg

SEQ ID NO: 3800153 - RNA, 20 nt, Salmonella typhimurium LT2
accacaucagaccgccaagc

SEQ ID NO: 3800154 - RNA, 20 nt, Salmonella typhimurium LT2
accacauuggguaauuuuuu

SEQ ID NO: 3800155 - RNA, 12 nt, Salmonella typhimurium LT2
accaccacgccu

SEQ ID NO: 3800156 - RNA, 16 nt, Salmonella typhimurium LT2
accaccaguaaccgcc

SEQ ID NO: 3800157 - RNA, 21 nt, Salmonella typhimurium LT2
accaccaguaaccgccacagc

SEQ ID NO: 3800158 - RNA, 14 nt, Salmonella typhimurium LT2
accaccaguacaug

SEQ ID NO: 3800159 - RNA, 20 nt, Salmonella typhimurium LT2
accaccauacccaacagcag

SEQ ID NO: 3800160 - RNA, 17 nt, Salmonella typhimurium LT2
accaccccacagcaaug

SEQ ID NO: 3800161 - RNA, 17 nt, Salmonella typhimurium LT2
accacccgugaaaaaug

SEQ ID NO: 3800162 - RNA, 23 nt, Salmonella typhimurium LT2
accaccgaauuccgcuaaucuuu

SEQ ID NO: 3800163 - RNA, 21 nt, Salmonella typhimurium LT2
accaccgcgcuagugccgcca

SEQ ID NO: 3800164 - RNA, 21 nt, Salmonella typhimurium LT2
accaccggaugauucaguaaa

SEQ ID NO: 3800165 - RNA, 19 nt, Salmonella typhimurium LT2
accaccggcaaagcguaug

SEQ ID NO: 3800166 - RNA, 16 nt, Salmonella typhimurium LT2
accaccguuauuucca

SEQ ID NO: 3800167 - RNA, 21 nt, Salmonella typhimurium LT2
accaccuuaaacuugccguuu

SEQ ID NO: 3800168 - RNA, 19 nt, Salmonella typhimurium LT2
accacgaaggaaacgccag

SEQ ID NO: 3800169 - RNA, 14 nt, Salmonella typhimurium LT2
accacgauaaccag

SEQ ID NO: 3800170 - RNA, 22 nt, Salmonella typhimurium LT2
accacgaucuugucacaauaac

SEQ ID NO: 3800171 - RNA, 13 nt, Salmonella typhimurium LT2
accacgcagccau

SEQ ID NO: 3800172 - RNA, 15 nt, Salmonella typhimurium LT2
accacgccaccgccg

SEQ ID NO: 3800173 - RNA, 16 nt, Salmonella typhimurium LT2
accacgccaucaacag

SEQ ID NO: 3800174 - RNA, 19 nt, Salmonella typhimurium LT2
accacgccauggccgcagc

SEQ ID NO: 3800175 - RNA, 17 nt, Salmonella typhimurium LT2
accacgcccgccgccag

SEQ ID NO: 3800176 - RNA, 22 nt, Salmonella typhimurium LT2
accacgcgggcgguauuauccg

SEQ ID NO: 3800177 - RNA, 16 nt, Salmonella typhimurium LT2
accacggauaagccag

SEQ ID NO: 3800178 - RNA, 18 nt, Salmonella typhimurium LT2
accacggauaagccagcc

SEQ ID NO: 3800179 - RNA, 14 nt, Salmonella typhimurium LT2
accacggcuucagc

SEQ ID NO: 3800180 - RNA, 13 nt, Salmonella typhimurium LT2
accacgucauccg

SEQ ID NO: 3800181 - RNA, 16 nt, Salmonella typhimurium LT2
accacgucauccggca

SEQ ID NO: 3800182 - RNA, 17 nt, Salmonella typhimurium LT2
accacgucauccggcaa

SEQ ID NO: 3800183 - RNA, 19 nt, Salmonella typhimurium LT2
accacgucauccggcaagc

SEQ ID NO: 3800184 - RNA, 13 nt, Salmonella typhimurium LT2
accacgugacgcc

SEQ ID NO: 3800185 - RNA, 14 nt, Salmonella typhimurium LT2
accacguuaucuuc

SEQ ID NO: 3800186 - RNA, 17 nt, Salmonella typhimurium LT2
accacguuaucuucuuu

SEQ ID NO: 3800187 - RNA, 19 nt, Salmonella typhimurium LT2
accacuaacagugcgcgua

SEQ ID NO: 3800188 - RNA, 16 nt, Salmonella typhimurium LT2
accacuagcgccgcca

SEQ ID NO: 3800189 - RNA, 18 nt, Salmonella typhimurium LT2
accacucggcgagcagua

SEQ ID NO: 3800190 - RNA, 18 nt, Salmonella typhimurium LT2
accacugacacggaacaa

SEQ ID NO: 3800191 - RNA, 22 nt, Salmonella typhimurium LT2
accacugacacggaacaacgca

SEQ ID NO: 3800192 - RNA, 19 nt, Salmonella typhimurium LT2
accacuuugcgcuccugcu

SEQ ID NO: 3800193 - RNA, 21 nt, Salmonella typhimurium LT2
accagaaaaccgacagcaaua

SEQ ID NO: 3800194 - RNA, 22 nt, Salmonella typhimurium LT2
accagaaaaccgacagcaauau

SEQ ID NO: 3800195 - RNA, 13 nt, Salmonella typhimurium LT2
accagaaccucac

SEQ ID NO: 3800196 - RNA, 22 nt, Salmonella typhimurium LT2
accagaaccucacggagaaaag

SEQ ID NO: 3800197 - RNA, 17 nt, Salmonella typhimurium LT2
accagaauacacuucuc

SEQ ID NO: 3800198 - RNA, 17 nt, Salmonella typhimurium LT2
accagaaucauuaauaa

SEQ ID NO: 3800199 - RNA, 14 nt, Salmonella typhimurium LT2
accagacccgcugc

SEQ ID NO: 3800200 - RNA, 21 nt, Salmonella typhimurium LT2
accagaccggcaucucaucuu

SEQ ID NO: 3800201 - RNA, 15 nt, Salmonella typhimurium LT2
accagacgaauaauc

SEQ ID NO: 3800202 - RNA, 22 nt, Salmonella typhimurium LT2
accagacgcuggcacuggcagc

SEQ ID NO: 3800203 - RNA, 14 nt, Salmonella typhimurium LT2
accagacugauaag

SEQ ID NO: 3800204 - RNA, 22 nt, Salmonella typhimurium LT2
accagaguaaccacgauaaaga

SEQ ID NO: 3800205 - RNA, 16 nt, Salmonella typhimurium LT2
accagauaccccgcca

SEQ ID NO: 3800206 - RNA, 20 nt, Salmonella typhimurium LT2
accagaucaacaugguguuu

SEQ ID NO: 3800207 - RNA, 19 nt, Salmonella typhimurium LT2
accagaucgagacgcguca

SEQ ID NO: 3800208 - RNA, 14 nt, Salmonella typhimurium LT2
accagauuccccaa

SEQ ID NO: 3800209 - RNA, 20 nt, Salmonella typhimurium LT2
accagauuccccaaucccac

SEQ ID NO: 3800210 - RNA, 21 nt, Salmonella typhimurium LT2
accagauuucgcaacagcaua

SEQ ID NO: 3800211 - RNA, 17 nt, Salmonella typhimurium LT2
accagcaacgccagcga

SEQ ID NO: 3800212 - RNA, 22 nt, Salmonella typhimurium LT2
accagcaacugaccaucuucgu

SEQ ID NO: 3800213 - RNA, 13 nt, Salmonella typhimurium LT2
accagcaauaaca

SEQ ID NO: 3800214 - RNA, 20 nt, Salmonella typhimurium LT2
accagcaaugauaacggcgc

SEQ ID NO: 3800215 - RNA, 22 nt, Salmonella typhimurium LT2
accagcaaugauaacggcgcca

SEQ ID NO: 3800216 - RNA, 19 nt, Salmonella typhimurium LT2
accauuuauaaaauauuua

SEQ ID NO: 3800217 - RNA, 22 nt, Salmonella typhimurium LT2
accauuuuccccagaaucccgc

SEQ ID NO: 3800218 - RNA, 17 nt, Salmonella typhimurium LT2
acccaaaaugccauaua

SEQ ID NO: 3800219 - RNA, 13 nt, Salmonella typhimurium LT2
acccaaauaacca

SEQ ID NO: 3800220 - RNA, 16 nt, Salmonella typhimurium LT2
acccaaauaucaaaua

SEQ ID NO: 3800221 - RNA, 13 nt, Salmonella typhimurium LT2
acccaaauccgca

SEQ ID NO: 3800222 - RNA, 15 nt, Salmonella typhimurium LT2
acccaaugauccgga

SEQ ID NO: 3800223 - RNA, 15 nt, Salmonella typhimurium LT2
acccacaacgcacca

SEQ ID NO: 3800224 - RNA, 14 nt, Salmonella typhimurium LT2
acccaccagcgugg

SEQ ID NO: 3800225 - RNA, 16 nt, Salmonella typhimurium LT2
acccaccauaaaacca

SEQ ID NO: 3800226 - RNA, 18 nt, Salmonella typhimurium LT2
acccaccgacaaccccaa

SEQ ID NO: 3800227 - RNA, 21 nt, Salmonella typhimurium LT2
acccaccgauaaaguuaaaca

SEQ ID NO: 3800228 - RNA, 21 nt, Salmonella typhimurium LT2
acccacgucauccgagaccag

SEQ ID NO: 3800229 - RNA, 13 nt, Salmonella typhimurium LT2
acccagacggcga

SEQ ID NO: 3800230 - RNA, 18 nt, Salmonella typhimurium LT2
acccagaguuuguuguuu

SEQ ID NO: 3800231 - RNA, 22 nt, Salmonella typhimurium LT2
acccagcaauacagccagcaca

SEQ ID NO: 3800232 - RNA, 20 nt, Salmonella typhimurium LT2
acccagccacaugauguugu

SEQ ID NO: 3800233 - RNA, 22 nt, Salmonella typhimurium LT2
acccagccccccuaaagcucau

SEQ ID NO: 3800234 - RNA, 16 nt, Salmonella typhimurium LT2
acccagcgaauuauga

SEQ ID NO: 3800235 - RNA, 18 nt, Salmonella typhimurium LT2
acccagcgccaacgccac

SEQ ID NO: 3800236 - RNA, 15 nt, Salmonella typhimurium LT2
acccagcgcggccca

SEQ ID NO: 3800237 - RNA, 19 nt, Salmonella typhimurium LT2
acccagcgcuaacggcggu

SEQ ID NO: 3800238 - RNA, 19 nt, Salmonella typhimurium LT2
acccagcgucccggcgucu

SEQ ID NO: 3800239 - RNA, 18 nt, Salmonella typhimurium LT2
acccagcuuucucacuug

SEQ ID NO: 3800240 - RNA, 14 nt, Salmonella typhimurium LT2
acccaggauggcgg

SEQ ID NO: 3800241 - RNA, 15 nt, Salmonella typhimurium LT2
acccaggcaucagau

SEQ ID NO: 3800242 - RNA, 17 nt, Salmonella typhimurium LT2
acccaguaccauaccgg

SEQ ID NO: 3800243 - RNA, 14 nt, Salmonella typhimurium LT2
acccagugccacca

SEQ ID NO: 3800244 - RNA, 20 nt, Salmonella typhimurium LT2
acccauacccuguuugauca

SEQ ID NO: 3800245 - RNA, 19 nt, Salmonella typhimurium LT2
acccauacucuuucccggc

SEQ ID NO: 3800246 - RNA, 23 nt, Salmonella typhimurium LT2
acccauaguuucauauccgacag

SEQ ID NO: 3800247 - RNA, 18 nt, Salmonella typhimurium LT2
acccauauucgucuucau

SEQ ID NO: 3800248 - RNA, 21 nt, Salmonella typhimurium LT2
acccauauucgucuucaucuu

SEQ ID NO: 3800249 - RNA, 14 nt, Salmonella typhimurium LT2
acccaucaauaacg

SEQ ID NO: 3800250 - RNA, 19 nt, Salmonella typhimurium LT2
acccaucaccuggcaacau

SEQ ID NO: 3800251 - RNA, 19 nt, Salmonella typhimurium LT2
acccaucagggaaaaaugu

SEQ ID NO: 3800252 - RNA, 15 nt, Salmonella typhimurium LT2
acccaugacgguagc

SEQ ID NO: 3800253 - RNA, 19 nt, Salmonella typhimurium LT2
accccaaacaccaacaaag

SEQ ID NO: 3800254 - RNA, 18 nt, Salmonella typhimurium LT2
accccaaaucagcaaaaa

SEQ ID NO: 3800255 - RNA, 12 nt, Salmonella typhimurium LT2
accccagcugcg

SEQ ID NO: 3800256 - RNA, 17 nt, Salmonella typhimurium LT2
accccagcugcggcauc

SEQ ID NO: 3800257 - RNA, 19 nt, Salmonella typhimurium LT2
accccagguaaauccgcca

SEQ ID NO: 3800258 - RNA, 20 nt, Salmonella typhimurium LT2
accccagguaaauccgccag

SEQ ID NO: 3800259 - RNA, 16 nt, Salmonella typhimurium LT2
accccaggucagcagu

SEQ ID NO: 3800260 - RNA, 21 nt, Salmonella typhimurium LT2
accccagguuauucaggugga

SEQ ID NO: 3800261 - RNA, 16 nt, Salmonella typhimurium LT2
accccagguugaugca

SEQ ID NO: 3800262 - RNA, 17 nt, Salmonella typhimurium LT2
accccaguaauccggca

SEQ ID NO: 3800263 - RNA, 18 nt, Salmonella typhimurium LT2
accccaguaauccggcaa

SEQ ID NO: 3800264 - RNA, 17 nt, Salmonella typhimurium LT2
acccccagcacauuaca

SEQ ID NO: 3800265 - RNA, 21 nt, Salmonella typhimurium LT2
acccccagccauuuccgccau

SEQ ID NO: 3800266 - RNA, 17 nt, Salmonella typhimurium LT2
acccccucagcaaugau

SEQ ID NO: 3800267 - RNA, 16 nt, Salmonella typhimurium LT2
accccgccaaaccggc

SEQ ID NO: 3800268 - RNA, 16 nt, Salmonella typhimurium LT2
accccgccaccgccgc

SEQ ID NO: 3800269 - RNA, 22 nt, Salmonella typhimurium LT2
accccgccagcagguaaacaga

SEQ ID NO: 3800270 - RNA, 19 nt, Salmonella typhimurium LT2
accccgccaucagacaggc

SEQ ID NO: 3800271 - RNA, 14 nt, Salmonella typhimurium LT2
accccggccucgcc

SEQ ID NO: 3800272 - RNA, 19 nt, Salmonella typhimurium LT2
accccgucgaggaucaucu

SEQ ID NO: 3800273 - RNA, 18 nt, Salmonella typhimurium LT2
accccgugauucacccgc

SEQ ID NO: 3800274 - RNA, 18 nt, Salmonella typhimurium LT2
accccucuuucacagcuc

SEQ ID NO: 3800275 - RNA, 22 nt, Salmonella typhimurium LT2
accccugauaaugugagauucg

SEQ ID NO: 3800276 - RNA, 20 nt, Salmonella typhimurium LT2
accccuguucaaaagccugu

SEQ ID NO: 3800277 - RNA, 14 nt, Salmonella typhimurium LT2
acccgacacggcuc

SEQ ID NO: 3800278 - RNA, 17 nt, Salmonella typhimurium LT2
acccgacaguaaaaccc

SEQ ID NO: 3800279 - RNA, 19 nt, Salmonella typhimurium LT2
acccgauaccgccagcccc

SEQ ID NO: 3800280 - RNA, 20 nt, Salmonella typhimurium LT2
acccgauaccgccagcccca

SEQ ID NO: 3800281 - RNA, 12 nt, Salmonella typhimurium LT2
acccgauagugu

SEQ ID NO: 3800282 - RNA, 20 nt, Salmonella typhimurium LT2
acccgaucgccauccugcac

SEQ ID NO: 3800283 - RNA, 22 nt, Salmonella typhimurium LT2
acccgaucgccauccugcaccg

SEQ ID NO: 3800284 - RNA, 15 nt, Salmonella typhimurium LT2
acccgauucugccag

SEQ ID NO: 3800285 - RNA, 20 nt, Salmonella typhimurium LT2
acccgauucugccaguucac

SEQ ID NO: 3800286 - RNA, 15 nt, Salmonella typhimurium LT2
acccgcaaugugcag

SEQ ID NO: 3800287 - RNA, 21 nt, Salmonella typhimurium LT2
acccgcaguagcuaaugauua

SEQ ID NO: 3800288 - RNA, 18 nt, Salmonella typhimurium LT2
acccgccaucaugcccac

SEQ ID NO: 3800289 - RNA, 15 nt, Salmonella typhimurium LT2
acccgccugcgccuu

SEQ ID NO: 3800290 - RNA, 19 nt, Salmonella typhimurium LT2
acccgcgacgacaacgccu

SEQ ID NO: 3800291 - RNA, 15 nt, Salmonella typhimurium LT2
acccgcgccagcagg

SEQ ID NO: 3800292 - RNA, 21 nt, Salmonella typhimurium LT2
acccgcguacaggaagccggu

SEQ ID NO: 3800293 - RNA, 13 nt, Salmonella typhimurium LT2
acccgcuccagaa

SEQ ID NO: 3800294 - RNA, 22 nt, Salmonella typhimurium LT2
acccgcucgcccgcagcaaaaa

SEQ ID NO: 3800295 - RNA, 16 nt, Salmonella typhimurium LT2
acccggagagaaacaa

SEQ ID NO: 3800296 - RNA, 23 nt, Salmonella typhimurium LT2
acccggcaaaggaauuacggacg

SEQ ID NO: 3800297 - RNA, 19 nt, Salmonella typhimurium LT2
acccggcguauccaguaac

SEQ ID NO: 3800298 - RNA, 18 nt, Salmonella typhimurium LT2
acccggcguauugguaca

SEQ ID NO: 3800299 - RNA, 14 nt, Salmonella typhimurium LT2
acccggcguuuuca

SEQ ID NO: 3800300 - RNA, 15 nt, Salmonella typhimurium LT2
acccggcguuuucag

SEQ ID NO: 3800301 - RNA, 22 nt, Salmonella typhimurium LT2
acccggugaaaaacaucggcaa

SEQ ID NO: 3800302 - RNA, 20 nt, Salmonella typhimurium LT2
acccggugcggcaagcgcgc

SEQ ID NO: 3800303 - RNA, 16 nt, Salmonella typhimurium LT2
acccguauucuuugcg

SEQ ID NO: 3800304 - RNA, 15 nt, Salmonella typhimurium LT2
acccguccggcaguc

SEQ ID NO: 3800305 - RNA, 17 nt, Salmonella typhimurium LT2
acccguggcugcgccug

SEQ ID NO: 3800306 - RNA, 18 nt, Salmonella typhimurium LT2
acccguggcugcgccugc

SEQ ID NO: 3800307 - RNA, 13 nt, Salmonella typhimurium LT2
acccguucgcugc

SEQ ID NO: 3800308 - RNA, 16 nt, Salmonella typhimurium LT2
acccuacaucuccuua

SEQ ID NO: 3800309 - RNA, 14 nt, Salmonella typhimurium LT2
acccuauccgccag

SEQ ID NO: 3800310 - RNA, 18 nt, Salmonella typhimurium LT2
acccuauugccacaauau

SEQ ID NO: 3800311 - RNA, 19 nt, Salmonella typhimurium LT2
acccuauugccacaauauc

SEQ ID NO: 3800312 - RNA, 18 nt, Salmonella typhimurium LT2
acccuauuuugcgccugg

SEQ ID NO: 3800313 - RNA, 19 nt, Salmonella typhimurium LT2
acccuauuuugcgccuggg

SEQ ID NO: 3800314 - RNA, 18 nt, Salmonella typhimurium LT2
acccucacugacauuacg

SEQ ID NO: 3800315 - RNA, 20 nt, Salmonella typhimurium LT2
acccucccuuucuucucaac

SEQ ID NO: 3800316 - RNA, 16 nt, Salmonella typhimurium LT2
acccugaaauccggcu

SEQ ID NO: 3800317 - RNA, 14 nt, Salmonella typhimurium LT2
acccuguucagcac

SEQ ID NO: 3800318 - RNA, 18 nt, Salmonella typhimurium LT2
acccuguuugaucauggg

SEQ ID NO: 3800319 - RNA, 16 nt, Salmonella typhimurium LT2
acccuuuaucgcgcag

SEQ ID NO: 3800320 - RNA, 19 nt, Salmonella typhimurium LT2
accggaaaacagccgccau

SEQ ID NO: 3800321 - RNA, 18 nt, Salmonella typhimurium LT2
accggaaauaaagguuuc

SEQ ID NO: 3800322 - RNA, 14 nt, Salmonella typhimurium LT2
accggacaaacauu

SEQ ID NO: 3800323 - RNA, 17 nt, Salmonella typhimurium LT2
accggaccgccgagccc

SEQ ID NO: 3800324 - RNA, 21 nt, Salmonella typhimurium LT2
accggaccuaauaaccagccc

SEQ ID NO: 3800325 - RNA, 14 nt, Salmonella typhimurium LT2
accggacgcaucgc

SEQ ID NO: 3800326 - RNA, 13 nt, Salmonella typhimurium LT2
accggacgugcca

SEQ ID NO: 3800327 - RNA, 15 nt, Salmonella typhimurium LT2
accggacuccaggca

SEQ ID NO: 3800328 - RNA, 20 nt, Salmonella typhimurium LT2
accggagccugggaucgcau

SEQ ID NO: 3800329 - RNA, 22 nt, Salmonella typhimurium LT2
accggauacccagccacaugau

SEQ ID NO: 3800330 - RNA, 17 nt, Salmonella typhimurium LT2
accggauauggcaaaaa

SEQ ID NO: 3800331 - RNA, 20 nt, Salmonella typhimurium LT2
accggauuggucugauucag

SEQ ID NO: 3800332 - RNA, 17 nt, Salmonella typhimurium LT2
accggauuuagcggcag

SEQ ID NO: 3800333 - RNA, 14 nt, Salmonella typhimurium LT2
accggcaaucgccu

SEQ ID NO: 3800334 - RNA, 17 nt, Salmonella typhimurium LT2
accggcaccagcaauga

SEQ ID NO: 3800335 - RNA, 13 nt, Salmonella typhimurium LT2
accggcacccagu

SEQ ID NO: 3800336 - RNA, 21 nt, Salmonella typhimurium LT2
accggcacgguuaaugaaauc

SEQ ID NO: 3800337 - RNA, 18 nt, Salmonella typhimurium LT2
accggcacucaccucuuc

SEQ ID NO: 3800338 - RNA, 22 nt, Salmonella typhimurium LT2
accggcagcgucggcuucauca

SEQ ID NO: 3800339 - RNA, 21 nt, Salmonella typhimurium LT2
accggcauacacgccgggcac

SEQ ID NO: 3800340 - RNA, 16 nt, Salmonella typhimurium LT2
accggcaucggcagcg

SEQ ID NO: 3800341 - RNA, 16 nt, Salmonella typhimurium LT2
accggcaucucaucuu

SEQ ID NO: 3800342 - RNA, 15 nt, Salmonella typhimurium LT2
accggcaugauggcg

SEQ ID NO: 3800343 - RNA, 17 nt, Salmonella typhimurium LT2
accggcaugauggcgaa

SEQ ID NO: 3800344 - RNA, 13 nt, Salmonella typhimurium LT2
accggcauuucac

SEQ ID NO: 3800345 - RNA, 15 nt, Salmonella typhimurium LT2
accggcccuuccgua

SEQ ID NO: 3800346 - RNA, 17 nt, Salmonella typhimurium LT2
accggcgaacgcuggcu

SEQ ID NO: 3800347 - RNA, 17 nt, Salmonella typhimurium LT2
accggcgauguuggcgc

SEQ ID NO: 3800348 - RNA, 22 nt, Salmonella typhimurium LT2
accggcgccagaagcuggcggu

SEQ ID NO: 3800349 - RNA, 15 nt, Salmonella typhimurium LT2
accggcgccagcucu

SEQ ID NO: 3800350 - RNA, 12 nt, Salmonella typhimurium LT2
accggcgcgccu

SEQ ID NO: 3800351 - RNA, 20 nt, Salmonella typhimurium LT2
accggcgcgccuuccagcaa

SEQ ID NO: 3800352 - RNA, 19 nt, Salmonella typhimurium LT2
accggcguaauugcgccug

SEQ ID NO: 3800353 - RNA, 19 nt, Salmonella typhimurium LT2
accggcuaucagccgccag

SEQ ID NO: 3800354 - RNA, 17 nt, Salmonella typhimurium LT2
accggcucgucguugaa

SEQ ID NO: 3800355 - RNA, 20 nt, Salmonella typhimurium LT2
accgggagaaaacgcggccu

SEQ ID NO: 3800356 - RNA, 16 nt, Salmonella typhimurium LT2
accgggaucgggacau

SEQ ID NO: 3800357 - RNA, 19 nt, Salmonella typhimurium LT2
accgggcagacaugaccgc

SEQ ID NO: 3800358 - RNA, 14 nt, Salmonella typhimurium LT2
accgggcaggauac

SEQ ID NO: 3800359 - RNA, 19 nt, Salmonella typhimurium LT2
accgggcaggauacggcgc

SEQ ID NO: 3800360 - RNA, 20 nt, Salmonella typhimurium LT2
accgggcaggauacggcgcu

SEQ ID NO: 3800361 - RNA, 20 nt, Salmonella typhimurium LT2
accgggcugcagcccuuacg

SEQ ID NO: 3800362 - RNA, 13 nt, Salmonella typhimurium LT2
accgggcuuuaau

SEQ ID NO: 3800363 - RNA, 15 nt, Salmonella typhimurium LT2
accgguaaggcaggc

SEQ ID NO: 3800364 - RNA, 18 nt, Salmonella typhimurium LT2
accgguaaucccuucacg

SEQ ID NO: 3800365 - RNA, 15 nt, Salmonella typhimurium LT2
accgguacucuucca

SEQ ID NO: 3800366 - RNA, 18 nt, Salmonella typhimurium LT2
accgguagccaggcgcga

SEQ ID NO: 3800367 - RNA, 20 nt, Salmonella typhimurium LT2
accgguauuaccaauauuaa

SEQ ID NO: 3800368 - RNA, 13 nt, Salmonella typhimurium LT2
accggugcgcccc

SEQ ID NO: 3800369 - RNA, 14 nt, Salmonella typhimurium LT2
accggugcgcccca

SEQ ID NO: 3800370 - RNA, 16 nt, Salmonella typhimurium LT2
accggugcgccccagc

SEQ ID NO: 3800371 - RNA, 19 nt, Salmonella typhimurium LT2
accggugcgccccagcaug

SEQ ID NO: 3800372 - RNA, 15 nt, Salmonella typhimurium LT2
accgguucgcggcag

SEQ ID NO: 3800373 - RNA, 13 nt, Salmonella typhimurium LT2
accgguuuuuccg

SEQ ID NO: 3800374 - RNA, 17 nt, Salmonella typhimurium LT2
accgguuuuucgccgac

SEQ ID NO: 3800375 - RNA, 18 nt, Salmonella typhimurium LT2
accguaaacgccugcacc

SEQ ID NO: 3800376 - RNA, 16 nt, Salmonella typhimurium LT2
accguaaucaucgcga

SEQ ID NO: 3800377 - RNA, 20 nt, Salmonella typhimurium LT2
accguaaucaucgcgaucgc

SEQ ID NO: 3800378 - RNA, 18 nt, Salmonella typhimurium LT2
accguagcuuugcgccag

SEQ ID NO: 3800379 - RNA, 20 nt, Salmonella typhimurium LT2
accguauagcccauaauaac

SEQ ID NO: 3800380 - RNA, 14 nt, Salmonella typhimurium LT2
accguauccgccac

SEQ ID NO: 3800381 - RNA, 16 nt, Salmonella typhimurium LT2
accguaucggcaguca

SEQ ID NO: 3800382 - RNA, 18 nt, Salmonella typhimurium LT2
accguauuagcaaaucuu

SEQ ID NO: 3800383 - RNA, 21 nt, Salmonella typhimurium LT2
accgucaaaacgcccauccug

SEQ ID NO: 3800384 - RNA, 19 nt, Salmonella typhimurium LT2
accgucaccacgcgcgaag

SEQ ID NO: 3800385 - RNA, 15 nt, Salmonella typhimurium LT2
accgucauccacgcc

SEQ ID NO: 3800386 - RNA, 15 nt, Salmonella typhimurium LT2
accgucauccugcaa

SEQ ID NO: 3800387 - RNA, 17 nt, Salmonella typhimurium LT2
accguccaccagcacag

SEQ ID NO: 3800388 - RNA, 12 nt, Salmonella typhimurium LT2
accguccagcgc

SEQ ID NO: 3800389 - RNA, 15 nt, Salmonella typhimurium LT2
accguccccagccag

SEQ ID NO: 3800390 - RNA, 19 nt, Salmonella typhimurium LT2
accguccccagccagagau

SEQ ID NO: 3800391 - RNA, 17 nt, Salmonella typhimurium LT2
accguccgccaggccca

SEQ ID NO: 3800392 - RNA, 23 nt, Salmonella typhimurium LT2
accgucgaccagcguaccgucuc

SEQ ID NO: 3800393 - RNA, 18 nt, Salmonella typhimurium LT2
accgucgacgucuuucuu

SEQ ID NO: 3800394 - RNA, 13 nt, Salmonella typhimurium LT2
accgucgcccguc

SEQ ID NO: 3800395 - RNA, 18 nt, Salmonella typhimurium LT2
accgucgcgcccuccucc

SEQ ID NO: 3800396 - RNA, 21 nt, Salmonella typhimurium LT2
accgucgcgcccuccuccagc

SEQ ID NO: 3800397 - RNA, 13 nt, Salmonella typhimurium LT2
accgucgcggcau

SEQ ID NO: 3800398 - RNA, 20 nt, Salmonella typhimurium LT2
accgucggccacgcuaaagu

SEQ ID NO: 3800399 - RNA, 13 nt, Salmonella typhimurium LT2
accgucuggcgag

SEQ ID NO: 3800400 - RNA, 13 nt, Salmonella typhimurium LT2
accgugagcgcgc

SEQ ID NO: 3800401 - RNA, 23 nt, Salmonella typhimurium LT2
accgugcccggaguccauauccg

SEQ ID NO: 3800402 - RNA, 17 nt, Salmonella typhimurium LT2
accgugguuaccgccag

SEQ ID NO: 3800403 - RNA, 22 nt, Salmonella typhimurium LT2
accgugugcagugacagaggaa

SEQ ID NO: 3800404 - RNA, 14 nt, Salmonella typhimurium LT2
accguuauccggca

SEQ ID NO: 3800405 - RNA, 20 nt, Salmonella typhimurium LT2
accguucaucuaucgccagc

SEQ ID NO: 3800406 - RNA, 19 nt, Salmonella typhimurium LT2
accguucuuccuggggauc

SEQ ID NO: 3800407 - RNA, 15 nt, Salmonella typhimurium LT2
accguugcgcccauc

SEQ ID NO: 3800408 - RNA, 19 nt, Salmonella typhimurium LT2
accguugcgcccaucauca

SEQ ID NO: 3800409 - RNA, 20 nt, Salmonella typhimurium LT2
accguugcgcccaucaucau

SEQ ID NO: 3800410 - RNA, 19 nt, Salmonella typhimurium LT2
accguuuaaaaacaucauu

SEQ ID NO: 3800411 - RNA, 17 nt, Salmonella typhimurium LT2
accguuuaaacgggcag

SEQ ID NO: 3800412 - RNA, 20 nt, Salmonella typhimurium LT2
accguuuaaucgcccugcgg

SEQ ID NO: 3800413 - RNA, 14 nt, Salmonella typhimurium LT2
accguuuccgccag

SEQ ID NO: 3800414 - RNA, 23 nt, Salmonella typhimurium LT2
accuaaaaaccagaacuuccaga

SEQ ID NO: 3800415 - RNA, 15 nt, Salmonella typhimurium LT2
accuaaauaaauacc

SEQ ID NO: 3800416 - RNA, 14 nt, Salmonella typhimurium LT2
accuacaaauuaca

SEQ ID NO: 3800417 - RNA, 21 nt, Salmonella typhimurium LT2
accuacaaucgucuucagcaa

SEQ ID NO: 3800418 - RNA, 18 nt, Salmonella typhimurium LT2
accuaccuuauacccaua

SEQ ID NO: 3800419 - RNA, 17 nt, Salmonella typhimurium LT2
accuacgccaagcaccu

SEQ ID NO: 3800420 - RNA, 18 nt, Salmonella typhimurium LT2
accuacgcucauaaaaaa

SEQ ID NO: 3800421 - RNA, 13 nt, Salmonella typhimurium LT2
accuauuuuaaau

SEQ ID NO: 3800422 - RNA, 11 nt, Salmonella typhimurium LT2
accucaauaug

SEQ ID NO: 3800423 - RNA, 18 nt, Salmonella typhimurium LT2
accucaaugauuuccgca

SEQ ID NO: 3800424 - RNA, 18 nt, Salmonella typhimurium LT2
acgcagcaucucaauauc

SEQ ID NO: 3800425 - RNA, 16 nt, Salmonella typhimurium LT2
acgcagcauuucgucg

SEQ ID NO: 3800426 - RNA, 23 nt, Salmonella typhimurium LT2
acgcagccgaggcuuaauacagc

SEQ ID NO: 3800427 - RNA, 19 nt, Salmonella typhimurium LT2
acgcagccggucagcguca

SEQ ID NO: 3800428 - RNA, 11 nt, Salmonella typhimurium LT2
acgcagcgccu

SEQ ID NO: 3800429 - RNA, 18 nt, Salmonella typhimurium LT2
acgcagcgccuuauccag

SEQ ID NO: 3800430 - RNA, 18 nt, Salmonella typhimurium LT2
acgcagcucauacccuuc

SEQ ID NO: 3800431 - RNA, 20 nt, Salmonella typhimurium LT2
acgcagcucauacccuucca

SEQ ID NO: 3800432 - RNA, 18 nt, Salmonella typhimurium LT2
acgcaggcgaaggaggac

SEQ ID NO: 3800433 - RNA, 22 nt, Salmonella typhimurium LT2
acgcaggcgauagccccaguaa

SEQ ID NO: 3800434 - RNA, 19 nt, Salmonella typhimurium LT2
acgcaggcgcaaaaaauau

SEQ ID NO: 3800435 - RNA, 16 nt, Salmonella typhimurium LT2
acgcaggcuaacgcgc

SEQ ID NO: 3800436 - RNA, 16 nt, Salmonella typhimurium LT2
acgcaggcuugcccau

SEQ ID NO: 3800437 - RNA, 15 nt, Salmonella typhimurium LT2
acgcaguacgcgcaa

SEQ ID NO: 3800438 - RNA, 17 nt, Salmonella typhimurium LT2
acgcaguuuaaagccaa

SEQ ID NO: 3800439 - RNA, 19 nt, Salmonella typhimurium LT2
acgcauaaaaaaugagaaa

SEQ ID NO: 3800440 - RNA, 18 nt, Salmonella typhimurium LT2
acgcauacgcagcacuuu

SEQ ID NO: 3800441 - RNA, 21 nt, Salmonella typhimurium LT2
acgcauaguccugccgacagg

SEQ ID NO: 3800442 - RNA, 24 nt, Salmonella typhimurium LT2
acgcauaucccacugcacgccagg

SEQ ID NO: 3800443 - RNA, 12 nt, Salmonella typhimurium LT2
acgcaucaaaua

SEQ ID NO: 3800444 - RNA, 23 nt, Salmonella typhimurium LT2
acgcaucaaauaccuuuucauug

SEQ ID NO: 3800445 - RNA, 22 nt, Salmonella typhimurium LT2
acgcaucauauucgcagcucug

SEQ ID NO: 3800446 - RNA, 13 nt, Salmonella typhimurium LT2
acgcauccgccau

SEQ ID NO: 3800447 - RNA, 17 nt, Salmonella typhimurium LT2
acgcaucguggccgaua

SEQ ID NO: 3800448 - RNA, 17 nt, Salmonella typhimurium LT2
acgcaucugggcugaca

SEQ ID NO: 3800449 - RNA, 18 nt, Salmonella typhimurium LT2
acgcaucugggcugacaa

SEQ ID NO: 3800450 - RNA, 23 nt, Salmonella typhimurium LT2
acgcaucugggcugacaaaaauu

SEQ ID NO: 3800451 - RNA, 18 nt, Salmonella typhimurium LT2
acgcaugacccaggcauc

SEQ ID NO: 3800452 - RNA, 22 nt, Salmonella typhimurium LT2
acgcaugacccaggcaucagau

SEQ ID NO: 3800453 - RNA, 14 nt, Salmonella typhimurium LT2
acgcauugcagcau

SEQ ID NO: 3800454 - RNA, 16 nt, Salmonella typhimurium LT2
acgcauuucuccugau

SEQ ID NO: 3800455 - RNA, 20 nt, Salmonella typhimurium LT2
acgccacaaacugcgcuagc

SEQ ID NO: 3800456 - RNA, 14 nt, Salmonella typhimurium LT2
acgccaccgcuacc

SEQ ID NO: 3800457 - RNA, 20 nt, Salmonella typhimurium LT2
acgccacgauuaaccccccg

SEQ ID NO: 3800458 - RNA, 18 nt, Salmonella typhimurium LT2
acgccagaccgacgccaa

SEQ ID NO: 3800459 - RNA, 24 nt, Salmonella typhimurium LT2
acgccagacuauccguccucuuuc

SEQ ID NO: 3800460 - RNA, 20 nt, Salmonella typhimurium LT2
acgccagauaaucacgccag

SEQ ID NO: 3800461 - RNA, 20 nt, Salmonella typhimurium LT2
acgccagaucguuaauaauc

SEQ ID NO: 3800462 - RNA, 11 nt, Salmonella typhimurium LT2
acgccagcaga

SEQ ID NO: 3800463 - RNA, 12 nt, Salmonella typhimurium LT2
acgccagcagac

SEQ ID NO: 3800464 - RNA, 23 nt, Salmonella typhimurium LT2
acgccagcuucgcuauuuucuau

SEQ ID NO: 3800465 - RNA, 19 nt, Salmonella typhimurium LT2
acgccagcuuggguauaga

SEQ ID NO: 3800466 - RNA, 21 nt, Salmonella typhimurium LT2
acgccaggcacgccggcaauc

SEQ ID NO: 3800467 - RNA, 18 nt, Salmonella typhimurium LT2
acgccaggguaauacugg

SEQ ID NO: 3800468 - RNA, 21 nt, Salmonella typhimurium LT2
acgccagguagccgacggcca

SEQ ID NO: 3800469 - RNA, 13 nt, Salmonella typhimurium LT2
acgccagucacca

SEQ ID NO: 3800470 - RNA, 16 nt, Salmonella typhimurium LT2
acgccauaauccacaa

SEQ ID NO: 3800471 - RNA, 18 nt, Salmonella typhimurium LT2
acgccauaauccacaacg

SEQ ID NO: 3800472 - RNA, 14 nt, Salmonella typhimurium LT2
acgccaucaacagc

SEQ ID NO: 3800473 - RNA, 13 nt, Salmonella typhimurium LT2
acgccaucgcggc

SEQ ID NO: 3800474 - RNA, 21 nt, Salmonella typhimurium LT2
acgccaugacgccaagcugca

SEQ ID NO: 3800475 - RNA, 18 nt, Salmonella typhimurium LT2
acgccaugcaucaauggc

SEQ ID NO: 3800476 - RNA, 20 nt, Salmonella typhimurium LT2
acgccauuccuuuaaauauc

SEQ ID NO: 3800477 - RNA, 19 nt, Salmonella typhimurium LT2
acgccauugcugucgacaa

SEQ ID NO: 3800478 - RNA, 15 nt, Salmonella typhimurium LT2
acgcccaauccggcu

SEQ ID NO: 3800479 - RNA, 18 nt, Salmonella typhimurium LT2
acgcccagcgccgggaaa

SEQ ID NO: 3800480 - RNA, 17 nt, Salmonella typhimurium LT2
acgcccagcuauuuuuc

SEQ ID NO: 3800481 - RNA, 18 nt, Salmonella typhimurium LT2
acgcccagggcacgcucu

SEQ ID NO: 3800482 - RNA, 19 nt, Salmonella typhimurium LT2
acgcccaggucgcccagcc

SEQ ID NO: 3800483 - RNA, 17 nt, Salmonella typhimurium LT2
acgcccaucagcauccc

SEQ ID NO: 3800484 - RNA, 21 nt, Salmonella typhimurium LT2
acgcccaucagcaucccaccg

SEQ ID NO: 3800485 - RNA, 23 nt, Salmonella typhimurium LT2
acgcccaucagcaucccaccgga

SEQ ID NO: 3800486 - RNA, 18 nt, Salmonella typhimurium LT2
acgccccaauaccacaac

SEQ ID NO: 3800487 - RNA, 15 nt, Salmonella typhimurium LT2
acgcccccuuccccc

SEQ ID NO: 3800488 - RNA, 16 nt, Salmonella typhimurium LT2
acgccccuaaggcagc

SEQ ID NO: 3800489 - RNA, 22 nt, Salmonella typhimurium LT2
acgccccuaaggcagcgaggua

SEQ ID NO: 3800490 - RNA, 20 nt, Salmonella typhimurium LT2
acgcccgaccacgcccagcu

SEQ ID NO: 3800491 - RNA, 14 nt, Salmonella typhimurium LT2
acgcccgauaaugu

SEQ ID NO: 3800492 - RNA, 15 nt, Salmonella typhimurium LT2
acgcccgcauucaua

SEQ ID NO: 3800493 - RNA, 13 nt, Salmonella typhimurium LT2
acgcccgccgaag

SEQ ID NO: 3800494 - RNA, 21 nt, Salmonella typhimurium LT2
acgcccgguugcgaauaaaca

SEQ ID NO: 3800495 - RNA, 13 nt, Salmonella typhimurium LT2
acgcccucaauau

SEQ ID NO: 3800496 - RNA, 16 nt, Salmonella typhimurium LT2
acgcccucaauaucuu

SEQ ID NO: 3800497 - RNA, 17 nt, Salmonella typhimurium LT2
acgcccucaauaucuuu

SEQ ID NO: 3800498 - RNA, 16 nt, Salmonella typhimurium LT2
acgcccuccuguugaa

SEQ ID NO: 3800499 - RNA, 23 nt, Salmonella typhimurium LT2
acgcccucucgccaaaucaugcc

SEQ ID NO: 3800500 - RNA, 19 nt, Salmonella typhimurium LT2
acgccgacucacgcagcgc

SEQ ID NO: 3800501 - RNA, 14 nt, Salmonella typhimurium LT2
acgccgauagcggc

SEQ ID NO: 3800502 - RNA, 16 nt, Salmonella typhimurium LT2
acgccgaugacguggu

SEQ ID NO: 3800503 - RNA, 19 nt, Salmonella typhimurium LT2
acgccgaugguugccagac

SEQ ID NO: 3800504 - RNA, 16 nt, Salmonella typhimurium LT2
acgccgauuaaugcuc

SEQ ID NO: 3800505 - RNA, 16 nt, Salmonella typhimurium LT2
acgccgccauccggca

SEQ ID NO: 3800506 - RNA, 17 nt, Salmonella typhimurium LT2
acgccgccauccggcac

SEQ ID NO: 3800507 - RNA, 20 nt, Salmonella typhimurium LT2
acgccgccauccggcacagc

SEQ ID NO: 3800508 - RNA, 17 nt, Salmonella typhimurium LT2
acgccgccauccggcau

SEQ ID NO: 3800509 - RNA, 15 nt, Salmonella typhimurium LT2
acgccgccgcccaga

SEQ ID NO: 3800510 - RNA, 23 nt, Salmonella typhimurium LT2
aggcauuuaugccgccauccggc

SEQ ID NO: 3800511 - RNA, 17 nt, Salmonella typhimurium LT2
aggcauuucuaccggca

SEQ ID NO: 3800512 - RNA, 12 nt, Salmonella typhimurium LT2
aggccaaacccu

SEQ ID NO: 3800513 - RNA, 21 nt, Salmonella typhimurium LT2
aggccagcguuaccucuuucg

SEQ ID NO: 3800514 - RNA, 13 nt, Salmonella typhimurium LT2
aggccaggcaucc

SEQ ID NO: 3800515 - RNA, 14 nt, Salmonella typhimurium LT2
aggccagucugucg

SEQ ID NO: 3800516 - RNA, 23 nt, Salmonella typhimurium LT2
aggccagugccaaguaacacggc

SEQ ID NO: 3800517 - RNA, 14 nt, Salmonella typhimurium LT2
aggccccgccaucc

SEQ ID NO: 3800518 - RNA, 17 nt, Salmonella typhimurium LT2
aggccccgccauccggc

SEQ ID NO: 3800519 - RNA, 18 nt, Salmonella typhimurium LT2
aggccccgccauccggca

SEQ ID NO: 3800520 - RNA, 20 nt, Salmonella typhimurium LT2
aggcccgauaagcaaagcgc

SEQ ID NO: 3800521 - RNA, 22 nt, Salmonella typhimurium LT2
aggcccgguggcgccgcgccac

SEQ ID NO: 3800522 - RNA, 23 nt, Salmonella typhimurium LT2
aggcccgguggcgccgcgccacc

SEQ ID NO: 3800523 - RNA, 22 nt, Salmonella typhimurium LT2
aggcccguucacguuuuuacuc

SEQ ID NO: 3800524 - RNA, 19 nt, Salmonella typhimurium LT2
aggccgaaacgcagcaucc

SEQ ID NO: 3800525 - RNA, 22 nt, Salmonella typhimurium LT2
aggccgaauaagcgacagcgcc

SEQ ID NO: 3800526 - RNA, 23 nt, Salmonella typhimurium LT2
aggccgaauaagcgacagcgcca

SEQ ID NO: 3800527 - RNA, 23 nt, Salmonella typhimurium LT2
aggccgacaaaugacgucagcaa

SEQ ID NO: 3800528 - RNA, 21 nt, Salmonella typhimurium LT2
aggccgccagcgugacccaga

SEQ ID NO: 3800529 - RNA, 17 nt, Salmonella typhimurium LT2
aggccgccgcacaggcg

SEQ ID NO: 3800530 - RNA, 21 nt, Salmonella typhimurium LT2
aggccgccgggucagaaaagc

SEQ ID NO: 3800531 - RNA, 15 nt, Salmonella typhimurium LT2
aggccggauaagccg

SEQ ID NO: 3800532 - RNA, 19 nt, Salmonella typhimurium LT2
aggccggauaagcgaaucc

SEQ ID NO: 3800533 - RNA, 23 nt, Salmonella typhimurium LT2
aggccggauaagcgaauccgaca

SEQ ID NO: 3800534 - RNA, 23 nt, Salmonella typhimurium LT2
aggccggauaagcgucagcgcca

SEQ ID NO: 3800535 - RNA, 18 nt, Salmonella typhimurium LT2
aggccggauaaggcgcag

SEQ ID NO: 3800536 - RNA, 20 nt, Salmonella typhimurium LT2
aggccggauaaggcgcagcc

SEQ ID NO: 3800537 - RNA, 23 nt, Salmonella typhimurium LT2
aggccggguaggacauagccgcc

SEQ ID NO: 3800538 - RNA, 23 nt, Salmonella typhimurium LT2
aggccguagcuaucgaucccaau

SEQ ID NO: 3800539 - RNA, 23 nt, Salmonella typhimurium LT2
aggccguggaucucgucgccggu

SEQ ID NO: 3800540 - RNA, 15 nt, Salmonella typhimurium LT2
aggccguuauccagu

SEQ ID NO: 3800541 - RNA, 20 nt, Salmonella typhimurium LT2
aggccguucauucgccccag

SEQ ID NO: 3800542 - RNA, 22 nt, Salmonella typhimurium LT2
aggccguuggcuuuaugcacgc

SEQ ID NO: 3800543 - RNA, 16 nt, Salmonella typhimurium LT2
aggccuaacacaugca

SEQ ID NO: 3800544 - RNA, 16 nt, Salmonella typhimurium LT2
aggccuaccagccgag

SEQ ID NO: 3800545 - RNA, 15 nt, Salmonella typhimurium LT2
aggccuacgacagcg

SEQ ID NO: 3800546 - RNA, 14 nt, Salmonella typhimurium LT2
aggccuacgcucga

SEQ ID NO: 3800547 - RNA, 19 nt, Salmonella typhimurium LT2
aggccucgaccaguuuuuc

SEQ ID NO: 3800548 - RNA, 13 nt, Salmonella typhimurium LT2
aggccucuaucuu

SEQ ID NO: 3800549 - RNA, 12 nt, Salmonella typhimurium LT2
aggccucuccuc

SEQ ID NO: 3800550 - RNA, 22 nt, Salmonella typhimurium LT2
aggccucuuucaugcggucuuc

SEQ ID NO: 3800551 - RNA, 14 nt, Salmonella typhimurium LT2
aggccugauaagcg

SEQ ID NO: 3800552 - RNA, 22 nt, Salmonella typhimurium LT2
aggccugauaagcgcagcgcca

SEQ ID NO: 3800553 - RNA, 23 nt, Salmonella typhimurium LT2
aggccugauucaggucaugcagg

SEQ ID NO: 3800554 - RNA, 15 nt, Salmonella typhimurium LT2
aggccuggccuucaa

SEQ ID NO: 3800555 - RNA, 16 nt, Salmonella typhimurium LT2
aggccuuuuaugaagg

SEQ ID NO: 3800556 - RNA, 23 nt, Salmonella typhimurium LT2
aggccuuuuauuuuggcauuucg

SEQ ID NO: 3800557 - RNA, 21 nt, Salmonella typhimurium LT2
aggcgaaacggcggaaccauu

SEQ ID NO: 3800558 - RNA, 16 nt, Salmonella typhimurium LT2
aggcgaacuccagcgc

SEQ ID NO: 3800559 - RNA, 22 nt, Salmonella typhimurium LT2
aggcgaacuucauccacgccga

SEQ ID NO: 3800560 - RNA, 19 nt, Salmonella typhimurium LT2
aggcgaagccgccacccgg

SEQ ID NO: 3800561 - RNA, 13 nt, Salmonella typhimurium LT2
aggcgaaucccca

SEQ ID NO: 3800562 - RNA, 15 nt, Salmonella typhimurium LT2
aggcgacaaucucac

SEQ ID NO: 3800563 - RNA, 22 nt, Salmonella typhimurium LT2
aggcgaccauccaccagaaccu

SEQ ID NO: 3800564 - RNA, 23 nt, Salmonella typhimurium LT2
aggcgauaccuaaucccuggcga

SEQ ID NO: 3800565 - RNA, 19 nt, Salmonella typhimurium LT2
aggcgauagcgaacggcga

SEQ ID NO: 3800566 - RNA, 16 nt, Salmonella typhimurium LT2
aggcgauagucauauu

SEQ ID NO: 3800567 - RNA, 23 nt, Salmonella typhimurium LT2
aggcgauauuguccgucagcgca

SEQ ID NO: 3800568 - RNA, 19 nt, Salmonella typhimurium LT2
aggcgcaaaaaauauguuc

SEQ ID NO: 3800569 - RNA, 17 nt, Salmonella typhimurium LT2
aggcgcaaacgcgugcu

SEQ ID NO: 3800570 - RNA, 16 nt, Salmonella typhimurium LT2
aggcgcaaggcgucgc

SEQ ID NO: 3800571 - RNA, 18 nt, Salmonella typhimurium LT2
aggcgccaguuggcguac

SEQ ID NO: 3800572 - RNA, 14 nt, Salmonella typhimurium LT2
aggcgcccacaaug

SEQ ID NO: 3800573 - RNA, 18 nt, Salmonella typhimurium LT2
aggcgccgccauccggca

SEQ ID NO: 3800574 - RNA, 22 nt, Salmonella typhimurium LT2
aggcgccucgcgcggcgguuca

SEQ ID NO: 3800575 - RNA, 18 nt, Salmonella typhimurium LT2
aggcgcgaccucaucaaa

SEQ ID NO: 3800576 - RNA, 14 nt, Salmonella typhimurium LT2
aggcgcgcagcugc

SEQ ID NO: 3800577 - RNA, 20 nt, Salmonella typhimurium LT2
aggcgcuagccgcauccggc

SEQ ID NO: 3800578 - RNA, 17 nt, Salmonella typhimurium LT2
aggcgcuaucuucaaua

SEQ ID NO: 3800579 - RNA, 13 nt, Salmonella typhimurium LT2
aggcgcuaugcug

SEQ ID NO: 3800580 - RNA, 22 nt, Salmonella typhimurium LT2
aggcgcucggccagauaacgcg

SEQ ID NO: 3800581 - RNA, 13 nt, Salmonella typhimurium LT2
aggcgcugcuggc

SEQ ID NO: 3800582 - RNA, 14 nt, Salmonella typhimurium LT2
aggcgcuggcgagc

SEQ ID NO: 3800583 - RNA, 16 nt, Salmonella typhimurium LT2
aggcgcuugcgccgcc

SEQ ID NO: 3800584 - RNA, 17 nt, Salmonella typhimurium LT2
aggcggaaaucagcaca

SEQ ID NO: 3800585 - RNA, 15 nt, Salmonella typhimurium LT2
aggcggauaaggcgc

SEQ ID NO: 3800586 - RNA, 15 nt, Salmonella typhimurium LT2
aggcggcaaaaaacg

SEQ ID NO: 3800587 - RNA, 13 nt, Salmonella typhimurium LT2
aggcggcaaagau

SEQ ID NO: 3800588 - RNA, 17 nt, Salmonella typhimurium LT2
aggcggcaaucagcgcc

SEQ ID NO: 3800589 - RNA, 14 nt, Salmonella typhimurium LT2
aggcggccugcggc

SEQ ID NO: 3800590 - RNA, 13 nt, Salmonella typhimurium LT2
aggcggcgccgcg

SEQ ID NO: 3800591 - RNA, 13 nt, Salmonella typhimurium LT2
aggcggcuaccgc

SEQ ID NO: 3800592 - RNA, 16 nt, Salmonella typhimurium LT2
aggcggcuaccgccgu

SEQ ID NO: 3800593 - RNA, 22 nt, Salmonella typhimurium LT2
aggcggcuuuuucaucaucggc

SEQ ID NO: 3800594 - RNA, 18 nt, Salmonella typhimurium LT2
aggcgggcuuuuuuugcc

SEQ ID NO: 3800595 - RNA, 14 nt, Salmonella typhimurium LT2
aggcggucuggauu

SEQ ID NO: 3800596 - RNA, 14 nt, Salmonella typhimurium LT2
aggcgguuuauccg

SEQ ID NO: 3800597 - RNA, 18 nt, Salmonella typhimurium LT2
aggcguaaaaaggcgcau

SEQ ID NO: 3800598 - RNA, 18 nt, Salmonella typhimurium LT2
aggcgucacggcgacggc

SEQ ID NO: 3800599 - RNA, 12 nt, Salmonella typhimurium LT2
aggcgugcagcg

SEQ ID NO: 3800600 - RNA, 21 nt, Salmonella typhimurium LT2
aggcgugguggauauccagca

SEQ ID NO: 3800601 - RNA, 21 nt, Salmonella typhimurium LT2
aggcguuaccgggcaaacagc

SEQ ID NO: 3800602 - RNA, 23 nt, Salmonella typhimurium LT2
aggcguucacgcugccacccggc

SEQ ID NO: 3800603 - RNA, 15 nt, Salmonella typhimurium LT2
aggcguucaugccuu

SEQ ID NO: 3800604 - RNA, 18 nt, Salmonella typhimurium LT2
aggcguugaacauuucau

SEQ ID NO: 3800605 - RNA, 22 nt, Salmonella typhimurium LT2
aggcuaacaguuggcuugccag

SEQ ID NO: 3800606 - RNA, 16 nt, Salmonella typhimurium LT2
aggcuaagaucgccuu

SEQ ID NO: 3800607 - RNA, 13 nt, Salmonella typhimurium LT2
aggcuacccagac

SEQ ID NO: 3800608 - RNA, 16 nt, Salmonella typhimurium LT2
aggcuacccagacaag

SEQ ID NO: 3800609 - RNA, 19 nt, Salmonella typhimurium LT2
aggcuacccgcaauaccaa

SEQ ID NO: 3800610 - RNA, 21 nt, Salmonella typhimurium LT2
aggcuacgguacugcccaccu

SEQ ID NO: 3800611 - RNA, 16 nt, Salmonella typhimurium LT2
aggcuauucaauauca

SEQ ID NO: 3800612 - RNA, 19 nt, Salmonella typhimurium LT2
aggcucaauaugccaggca

SEQ ID NO: 3800613 - RNA, 13 nt, Salmonella typhimurium LT2
aggcucagcgcca

SEQ ID NO: 3800614 - RNA, 22 nt, Salmonella typhimurium LT2
aggcuccagguauugauaccuu

SEQ ID NO: 3800615 - RNA, 20 nt, Salmonella typhimurium LT2
aggcuccgagacucaaagaa

SEQ ID NO: 3800616 - RNA, 21 nt, Salmonella typhimurium LT2
aggcuccggcaccaaaccaua

SEQ ID NO: 3800617 - RNA, 22 nt, Salmonella typhimurium LT2
aggcugacaaagguugcgccaa

SEQ ID NO: 3800618 - RNA, 23 nt, Salmonella typhimurium LT2
aggcugccgacuacgccuccugc

SEQ ID NO: 3800619 - RNA, 15 nt, Salmonella typhimurium LT2
aggcugccgccagaa

SEQ ID NO: 3800620 - RNA, 13 nt, Salmonella typhimurium LT2
aggcugcggauga

SEQ ID NO: 3800621 - RNA, 21 nt, Salmonella typhimurium LT2
aggcugcggcacgcuaaacca

SEQ ID NO: 3800622 - RNA, 11 nt, Salmonella typhimurium LT2
aggcuggaaca

SEQ ID NO: 3800623 - RNA, 17 nt, Salmonella typhimurium LT2
aggcuggaucaggcgcu

SEQ ID NO: 3800624 - RNA, 19 nt, Salmonella typhimurium LT2
aggcuggcgacaaucaauc

SEQ ID NO: 3800625 - RNA, 14 nt, Salmonella typhimurium LT2
aggcugguuguggu

SEQ ID NO: 3800626 - RNA, 17 nt, Salmonella typhimurium LT2
aggcuuaacacccggau

SEQ ID NO: 3800627 - RNA, 16 nt, Salmonella typhimurium LT2
aggcuucaaccguuuc

SEQ ID NO: 3800628 - RNA, 15 nt, Salmonella typhimurium LT2
aggcuuccagauaca

SEQ ID NO: 3800629 - RNA, 16 nt, Salmonella typhimurium LT2
aggcuucgacaaacag

SEQ ID NO: 3800630 - RNA, 19 nt, Salmonella typhimurium LT2
aggcuugccaaagcgggca

SEQ ID NO: 3800631 - RNA, 15 nt, Salmonella typhimurium LT2
aggcuugcgcucacc

SEQ ID NO: 3800632 - RNA, 16 nt, Salmonella typhimurium LT2
aggcuuuucaggcugu

SEQ ID NO: 3800633 - RNA, 19 nt, Salmonella typhimurium LT2
aggcuuuuuaaucaaaaug

SEQ ID NO: 3800634 - RNA, 17 nt, Salmonella typhimurium LT2
agggaacacggcaugaa

SEQ ID NO: 3800635 - RNA, 20 nt, Salmonella typhimurium LT2
agggaacacggcaugaagca

SEQ ID NO: 3800636 - RNA, 13 nt, Salmonella typhimurium LT2
agggaacuccagc

SEQ ID NO: 3800637 - RNA, 19 nt, Salmonella typhimurium LT2
agggaacuccagcagggcg

SEQ ID NO: 3800638 - RNA, 19 nt, Salmonella typhimurium LT2
agggaaggggauuuuccgg

SEQ ID NO: 3800639 - RNA, 16 nt, Salmonella typhimurium LT2
agggaauaucuuccgg

SEQ ID NO: 3800640 - RNA, 15 nt, Salmonella typhimurium LT2
agggaccgcgaagau

SEQ ID NO: 3800641 - RNA, 18 nt, Salmonella typhimurium LT2
agggacgcauccugcacu

SEQ ID NO: 3800642 - RNA, 20 nt, Salmonella typhimurium LT2
agggacuccugcgccggacg

SEQ ID NO: 3800643 - RNA, 18 nt, Salmonella typhimurium LT2
agggagguucgccucccu

SEQ ID NO: 3800644 - RNA, 23 nt, Salmonella typhimurium LT2
agggauaacaguauuuguucaga

SEQ ID NO: 3800645 - RNA, 20 nt, Salmonella typhimurium LT2
agggauaagaaagauaaaau

SEQ ID NO: 3800646 - RNA, 21 nt, Salmonella typhimurium LT2
agggauaagaaagauaaaaua

SEQ ID NO: 3800647 - RNA, 22 nt, Salmonella typhimurium LT2
agggauaagguugccaaaaaau

SEQ ID NO: 3800648 - RNA, 17 nt, Salmonella typhimurium LT2
agggcaaucugaguauu

SEQ ID NO: 3800649 - RNA, 23 nt, Salmonella typhimurium LT2
agggcaguuacacuauugucguc

SEQ ID NO: 3800650 - RNA, 23 nt, Salmonella typhimurium LT2
agggcaugauuacagauauccac

SEQ ID NO: 3800651 - RNA, 18 nt, Salmonella typhimurium LT2
agggcauuuuuuccagua

SEQ ID NO: 3800652 - RNA, 18 nt, Salmonella typhimurium LT2
agggccacaacggagaua

SEQ ID NO: 3800653 - RNA, 13 nt, Salmonella typhimurium LT2
agggccaggcgcg

SEQ ID NO: 3800654 - RNA, 14 nt, Salmonella typhimurium LT2
agggccgcguuaac

SEQ ID NO: 3800655 - RNA, 21 nt, Salmonella typhimurium LT2
agggccgcguuaacgccguug

SEQ ID NO: 3800656 - RNA, 14 nt, Salmonella typhimurium LT2
agggcgacgucaga

SEQ ID NO: 3800657 - RNA, 18 nt, Salmonella typhimurium LT2
agggcgauauccagcgcc

SEQ ID NO: 3800658 - RNA, 19 nt, Salmonella typhimurium LT2
agggcgauauccagcgcca

SEQ ID NO: 3800659 - RNA, 22 nt, Salmonella typhimurium LT2
agggcgauauccagcgccagga

SEQ ID NO: 3800660 - RNA, 22 nt, Salmonella typhimurium LT2
agggcggaagcagauaccagcc

SEQ ID NO: 3800661 - RNA, 16 nt, Salmonella typhimurium LT2
agggcggcaggaugaa

SEQ ID NO: 3800662 - RNA, 16 nt, Salmonella typhimurium LT2
agggcgugaaccagca

SEQ ID NO: 3800663 - RNA, 16 nt, Salmonella typhimurium LT2
agggcgugacgcgcca

SEQ ID NO: 3800664 - RNA, 17 nt, Salmonella typhimurium LT2
agggcgugacgcgccag

SEQ ID NO: 3800665 - RNA, 16 nt, Salmonella typhimurium LT2
agggcguuuuauaagc

SEQ ID NO: 3800666 - RNA, 18 nt, Salmonella typhimurium LT2
agggcugaaucggcaccu

SEQ ID NO: 3800667 - RNA, 14 nt, Salmonella typhimurium LT2
agggcuuacucccu

SEQ ID NO: 3800668 - RNA, 21 nt, Salmonella typhimurium LT2
agggcuucuuuaccagugaca

SEQ ID NO: 3800669 - RNA, 20 nt, Salmonella typhimurium LT2
aggggaaaaggguggugaau

SEQ ID NO: 3800670 - RNA, 13 nt, Salmonella typhimurium LT2
aggggcaguaaau

SEQ ID NO: 3800671 - RNA, 14 nt, Salmonella typhimurium LT2
aggggcaguaaauu

SEQ ID NO: 3800672 - RNA, 18 nt, Salmonella typhimurium LT2
aggggccacaggcggcau

SEQ ID NO: 3800673 - RNA, 18 nt, Salmonella typhimurium LT2
aggggcucuaaaaaggaa

SEQ ID NO: 3800674 - RNA, 23 nt, Salmonella typhimurium LT2
aggggggccugauggcgcugcgc

SEQ ID NO: 3800675 - RNA, 16 nt, Salmonella typhimurium LT2
agggguguuacgccau

SEQ ID NO: 3800676 - RNA, 17 nt, Salmonella typhimurium LT2
agggguugaugccgacc

SEQ ID NO: 3800677 - RNA, 22 nt, Salmonella typhimurium LT2
agggguuucaauuccacaggcg

SEQ ID NO: 3800678 - RNA, 23 nt, Salmonella typhimurium LT2
agggguuucaauuccacaggcgc

SEQ ID NO: 3800679 - RNA, 22 nt, Salmonella typhimurium LT2
agggguuuucgccagcaacgcc

SEQ ID NO: 3800680 - RNA, 14 nt, Salmonella typhimurium LT2
aggguaccugggca

SEQ ID NO: 3800681 - RNA, 16 nt, Salmonella typhimurium LT2
aggguauugccgagcg

SEQ ID NO: 3800682 - RNA, 22 nt, Salmonella typhimurium LT2
agggugaaccaaagcaaaaaau

SEQ ID NO: 3800683 - RNA, 20 nt, Salmonella typhimurium LT2
agggugaauaccagcggcaa

SEQ ID NO: 3800684 - RNA, 21 nt, Salmonella typhimurium LT2
agggugaauaccagcggcaaa

SEQ ID NO: 3800685 - RNA, 23 nt, Salmonella typhimurium LT2
agggugccguucauuugcaaugg

SEQ ID NO: 3800686 - RNA, 18 nt, Salmonella typhimurium LT2
aggguggacaugauaagc

SEQ ID NO: 3800687 - RNA, 18 nt, Salmonella typhimurium LT2
aggguuuucaggaaggag

SEQ ID NO: 3800688 - RNA, 12 nt, Salmonella typhimurium LT2
aggguuuugccg

SEQ ID NO: 3800689 - RNA, 17 nt, Salmonella typhimurium LT2
agguaaagagcggcuua

SEQ ID NO: 3800690 - RNA, 22 nt, Salmonella typhimurium LT2
agguaaagagcggcuuauaaaa

SEQ ID NO: 3800691 - RNA, 23 nt, Salmonella typhimurium LT2
agguaaagccgccauccggcauu

SEQ ID NO: 3800692 - RNA, 20 nt, Salmonella typhimurium LT2
agguaaaggucguuaggcca

SEQ ID NO: 3800693 - RNA, 14 nt, Salmonella typhimurium LT2
agguaaauccgcca

SEQ ID NO: 3800694 - RNA, 13 nt, Salmonella typhimurium LT2
agguaacauacaa

SEQ ID NO: 3800695 - RNA, 19 nt, Salmonella typhimurium LT2
agguaacgccuggggggga

SEQ ID NO: 3800696 - RNA, 12 nt, Salmonella typhimurium LT2
agguaagcccuu

SEQ ID NO: 3800697 - RNA, 23 nt, Salmonella typhimurium LT2
agguaccgcuuaaugaguacggg

SEQ ID NO: 3800698 - RNA, 21 nt, Salmonella typhimurium LT2
agguacuuucccccagauugu

SEQ ID NO: 3800699 - RNA, 17 nt, Salmonella typhimurium LT2
agguaggaaacuuauuu

SEQ ID NO: 3800700 - RNA, 18 nt, Salmonella typhimurium LT2
agguauccgccauauccc

SEQ ID NO: 3800701 - RNA, 16 nt, Salmonella typhimurium LT2
agguauccuaaugcca

SEQ ID NO: 3800702 - RNA, 23 nt, Salmonella typhimurium LT2
agguaucgauacagacgccaacg

SEQ ID NO: 3800703 - RNA, 14 nt, Salmonella typhimurium LT2
agguauuuagccac

SEQ ID NO: 3800704 - RNA, 21 nt, Salmonella typhimurium LT2
aggucaaccacgagagcaccg

SEQ ID NO: 3800705 - RNA, 23 nt, Salmonella typhimurium LT2
aggucaacccuauugccacaaua

SEQ ID NO: 3800706 - RNA, 15 nt, Salmonella typhimurium LT2
aggucacaucaucgc

SEQ ID NO: 3800707 - RNA, 16 nt, Salmonella typhimurium LT2
aggucacaucaucgcc

SEQ ID NO: 3800708 - RNA, 19 nt, Salmonella typhimurium LT2
aggucacgccggaaaucac

SEQ ID NO: 3800709 - RNA, 16 nt, Salmonella typhimurium LT2
aggucagguaagcgcu

SEQ ID NO: 3800710 - RNA, 22 nt, Salmonella typhimurium LT2
aggucauaacccuucagcaacg

SEQ ID NO: 3800711 - RNA, 18 nt, Salmonella typhimurium LT2
aggucaucaacuggcggc

SEQ ID NO: 3800712 - RNA, 17 nt, Salmonella typhimurium LT2
aggucaucacaucccag

SEQ ID NO: 3800713 - RNA, 18 nt, Salmonella typhimurium LT2
aggucaucaccuccagca

SEQ ID NO: 3800714 - RNA, 16 nt, Salmonella typhimurium LT2
aggucauuauucaggc

SEQ ID NO: 3800715 - RNA, 17 nt, Salmonella typhimurium LT2
aggucgcgguggguagc

SEQ ID NO: 3800716 - RNA, 16 nt, Salmonella typhimurium LT2
aggucgcuauccagca

SEQ ID NO: 3800717 - RNA, 22 nt, Salmonella typhimurium LT2
aggucguuaggccacuucacac

SEQ ID NO: 3800718 - RNA, 13 nt, Salmonella typhimurium LT2
aggucguuucccc

SEQ ID NO: 3800719 - RNA, 19 nt, Salmonella typhimurium LT2
aggugaacauuacaaugua

SEQ ID NO: 3800720 - RNA, 20 nt, Salmonella typhimurium LT2
aggugaauaguauugccguc

SEQ ID NO: 3800721 - RNA, 15 nt, Salmonella typhimurium LT2
aggugagcucuuucu

SEQ ID NO: 3800722 - RNA, 14 nt, Salmonella typhimurium LT2
aggugauaccuguu

SEQ ID NO: 3800723 - RNA, 23 nt, Salmonella typhimurium LT2
aggugauagugcguucgaaucag

SEQ ID NO: 3800724 - RNA, 14 nt, Salmonella typhimurium LT2
aggugaucuguuca

SEQ ID NO: 3800725 - RNA, 13 nt, Salmonella typhimurium LT2
aggugauggugcc

SEQ ID NO: 3800726 - RNA, 15 nt, Salmonella typhimurium LT2
agguggaauacaaac

SEQ ID NO: 3800727 - RNA, 21 nt, Salmonella typhimurium LT2
agguggcccauuuuggccgcu

SEQ ID NO: 3800728 - RNA, 17 nt, Salmonella typhimurium LT2
agguggccgagaggcug

SEQ ID NO: 3800729 - RNA, 20 nt, Salmonella typhimurium LT2
agguggcuagcccgcugcgc

SEQ ID NO: 3800730 - RNA, 16 nt, Salmonella typhimurium LT2
agguggguuccagcgc

SEQ ID NO: 3800731 - RNA, 21 nt, Salmonella typhimurium LT2
agguguaauaaccguggcggc

SEQ ID NO: 3800732 - RNA, 17 nt, Salmonella typhimurium LT2
aggugucagauccuuca

SEQ ID NO: 3800733 - RNA, 17 nt, Salmonella typhimurium LT2
agguguuuacgccgcca

SEQ ID NO: 3800734 - RNA, 13 nt, Salmonella typhimurium LT2
agguuaaccaugc

SEQ ID NO: 3800735 - RNA, 16 nt, Salmonella typhimurium LT2
agguuacguucaucag

SEQ ID NO: 3800736 - RNA, 13 nt, Salmonella typhimurium LT2
agguuagcagcca

SEQ ID NO: 3800737 - RNA, 16 nt, Salmonella typhimurium LT2
agguuauucaggugga

SEQ ID NO: 3800738 - RNA, 17 nt, Salmonella typhimurium LT2
agguuauucagguggau

SEQ ID NO: 3800739 - RNA, 19 nt, Salmonella typhimurium LT2
agguucagcgugcguucau

SEQ ID NO: 3800740 - RNA, 19 nt, Salmonella typhimurium LT2
agguucauauugcgccgca

SEQ ID NO: 3800741 - RNA, 13 nt, Salmonella typhimurium LT2
agguucccgcccu

SEQ ID NO: 3800742 - RNA, 17 nt, Salmonella typhimurium LT2
agguucgaauccuuccc

SEQ ID NO: 3800743 - RNA, 17 nt, Salmonella typhimurium LT2
agguugaaagaccuaaa

SEQ ID NO: 3800744 - RNA, 15 nt, Salmonella typhimurium LT2
agguugcgcccggcg

SEQ ID NO: 3800745 - RNA, 21 nt, Salmonella typhimurium LT2
agguugcucagguaggugaua

SEQ ID NO: 3800746 - RNA, 14 nt, Salmonella typhimurium LT2
agguuggcugaggc

SEQ ID NO: 3800747 - RNA, 15 nt, Salmonella typhimurium LT2
agguuuaaaccacuc

SEQ ID NO: 3800748 - RNA, 20 nt, Salmonella typhimurium LT2
agguuugaccagauaaucaa

SEQ ID NO: 3800749 - RNA, 17 nt, Salmonella typhimurium LT2
aguaaaaaaaaccguau

SEQ ID NO: 3800750 - RNA, 18 nt, Salmonella typhimurium LT2
aguaaaacccaauaacug

SEQ ID NO: 3800751 - RNA, 18 nt, Salmonella typhimurium LT2
aguaaaacuuagggggcu

SEQ ID NO: 3800752 - RNA, 16 nt, Salmonella typhimurium LT2
aguaaaauuuuuuuca

SEQ ID NO: 3800753 - RNA, 15 nt, Salmonella typhimurium LT2
aguaaacagaaucaa

SEQ ID NO: 3800754 - RNA, 23 nt, Salmonella typhimurium LT2
aguaaaccggucaggcagcagac

SEQ ID NO: 3800755 - RNA, 17 nt, Salmonella typhimurium LT2
aguaaacggcgcugaaa

SEQ ID NO: 3800756 - RNA, 21 nt, Salmonella typhimurium LT2
aguaaagauuuuuauuaaaau

SEQ ID NO: 3800757 - RNA, 16 nt, Salmonella typhimurium LT2
aguaaauaaaaaccau

SEQ ID NO: 3800758 - RNA, 14 nt, Salmonella typhimurium LT2
aguaaauaacaaaa

SEQ ID NO: 3800759 - RNA, 21 nt, Salmonella typhimurium LT2
aguaaauuuacucaguuugcu

SEQ ID NO: 3800760 - RNA, 16 nt, Salmonella typhimurium LT2
aguaacaccgcggcgc

SEQ ID NO: 3800761 - RNA, 17 nt, Salmonella typhimurium LT2
aguaaccuauuuuaaaa

SEQ ID NO: 3800762 - RNA, 21 nt, Salmonella typhimurium LT2
aguaacggcaguguuucccaa

SEQ ID NO: 3800763 - RNA, 22 nt, Salmonella typhimurium LT2
aguaacucuauaucgacaggcg

SEQ ID NO: 3800764 - RNA, 20 nt, Salmonella typhimurium LT2
aguaacuggcuccacgggcg

SEQ ID NO: 3800765 - RNA, 17 nt, Salmonella typhimurium LT2
aguaacugguuaccaca

SEQ ID NO: 3800766 - RNA, 18 nt, Salmonella typhimurium LT2
aguaagaggguggcgagc

SEQ ID NO: 3800767 - RNA, 17 nt, Salmonella typhimurium LT2
aguaagcucaggccaau

SEQ ID NO: 3800768 - RNA, 21 nt, Salmonella typhimurium LT2
aguaauaaaaaacaacucuau

SEQ ID NO: 3800769 - RNA, 13 nt, Salmonella typhimurium LT2
aguaauauaacca

SEQ ID NO: 3800770 - RNA, 21 nt, Salmonella typhimurium LT2
aguaauauaaccaauuuaaaa

SEQ ID NO: 3800771 - RNA, 15 nt, Salmonella typhimurium LT2
aguaaugacaaaaau

SEQ ID NO: 3800772 - RNA, 17 nt, Salmonella typhimurium LT2
aguaaugccuucugaaa

SEQ ID NO: 3800773 - RNA, 20 nt, Salmonella typhimurium LT2
aguaauuugaacauauccgc

SEQ ID NO: 3800774 - RNA, 13 nt, Salmonella typhimurium LT2
aguaauuuuuccg

SEQ ID NO: 3800775 - RNA, 17 nt, Salmonella typhimurium LT2
aguaauuuuuccgccuc

SEQ ID NO: 3800776 - RNA, 12 nt, Salmonella typhimurium LT2
aguaauuuuucu

SEQ ID NO: 3800777 - RNA, 21 nt, Salmonella typhimurium LT2
aguacaaacaaauaaauccau

SEQ ID NO: 3800778 - RNA, 13 nt, Salmonella typhimurium LT2
aguacaagcaggc

SEQ ID NO: 3800779 - RNA, 21 nt, Salmonella typhimurium LT2
aguacaauaccuuuaagcgcu

SEQ ID NO: 3800780 - RNA, 17 nt, Salmonella typhimurium LT2
aguacaauuuccugcca

SEQ ID NO: 3800781 - RNA, 15 nt, Salmonella typhimurium LT2
aguacaggguuuguc

SEQ ID NO: 3800782 - RNA, 23 nt, Salmonella typhimurium LT2
aguacaggguuugucagcauaaa

SEQ ID NO: 3800783 - RNA, 19 nt, Salmonella typhimurium LT2
aguacauaguucuggcuuu

SEQ ID NO: 3800784 - RNA, 22 nt, Salmonella typhimurium LT2
aguaccauaccggugcgcccca

SEQ ID NO: 3800785 - RNA, 20 nt, Salmonella typhimurium LT2
aguaccgaacagccaggcuu

SEQ ID NO: 3800786 - RNA, 21 nt, Salmonella typhimurium LT2
aguaccgaacagccaggcuuu

SEQ ID NO: 3800787 - RNA, 20 nt, Salmonella typhimurium LT2
aguaccgccuuguccggccu

SEQ ID NO: 3800788 - RNA, 17 nt, Salmonella typhimurium LT2
aguaccugacuuuucca

SEQ ID NO: 3800789 - RNA, 14 nt, Salmonella typhimurium LT2
aguacgccaaaaaa

SEQ ID NO: 3800790 - RNA, 17 nt, Salmonella typhimurium LT2
aguacgccucgcgcacc

SEQ ID NO: 3800791 - RNA, 15 nt, Salmonella typhimurium LT2
aguacggugaauauu

SEQ ID NO: 3800792 - RNA, 14 nt, Salmonella typhimurium LT2
aguacguaaugcga

SEQ ID NO: 3800793 - RNA, 16 nt, Salmonella typhimurium LT2
aguacuucacaaucag

SEQ ID NO: 3800794 - RNA, 20 nt, Salmonella typhimurium LT2
aguacuuucaccugcauacc

SEQ ID NO: 3800795 - RNA, 18 nt, Salmonella typhimurium LT2
aguacuuucuccugggau

SEQ ID NO: 3800796 - RNA, 16 nt, Salmonella typhimurium LT2
aguacuuucuuuugau

SEQ ID NO: 3800797 - RNA, 14 nt, Salmonella typhimurium LT2
aguagaucaccagc

SEQ ID NO: 3800798 - RNA, 11 nt, Salmonella typhimurium LT2
aguagauggcg

SEQ ID NO: 3800799 - RNA, 14 nt, Salmonella typhimurium LT2
aguagcagagaaaa

SEQ ID NO: 3800800 - RNA, 17 nt, Salmonella typhimurium LT2
aguagccaugcauaaug

SEQ ID NO: 3800801 - RNA, 16 nt, Salmonella typhimurium LT2
aguagccugccagcaa

SEQ ID NO: 3800802 - RNA, 16 nt, Salmonella typhimurium LT2
aguagcgcgcccaugc

SEQ ID NO: 3800803 - RNA, 21 nt, Salmonella typhimurium LT2
aguagcguucucuccaguucu

SEQ ID NO: 3800804 - RNA, 14 nt, Salmonella typhimurium LT2
aguagcuaaugauu

SEQ ID NO: 3800805 - RNA, 16 nt, Salmonella typhimurium LT2
aguagcugagaguaaa

SEQ ID NO: 3800806 - RNA, 19 nt, Salmonella typhimurium LT2
aguaggccggauaaggcgu

SEQ ID NO: 3800807 - RNA, 20 nt, Salmonella typhimurium LT2
aguagguggcccauuuuggc

SEQ ID NO: 3800808 - RNA, 22 nt, Salmonella typhimurium LT2
aguaguauccccggcaaccuua

SEQ ID NO: 3800809 - RNA, 15 nt, Salmonella typhimurium LT2
aguaguuccagcaua

SEQ ID NO: 3800810 - RNA, 15 nt, Salmonella typhimurium LT2
aguaguuccuggaga

SEQ ID NO: 3800811 - RNA, 16 nt, Salmonella typhimurium LT2
aguaguuccuggagaa

SEQ ID NO: 3800812 - RNA, 18 nt, Salmonella typhimurium LT2
aguaguugaauaaccuca

SEQ ID NO: 3800813 - RNA, 12 nt, Salmonella typhimurium LT2
aguaguuggugg

SEQ ID NO: 3800814 - RNA, 14 nt, Salmonella typhimurium LT2
aguauaaauaccuu

SEQ ID NO: 3800815 - RNA, 21 nt, Salmonella typhimurium LT2
aguauaaauaccuuauucagc

SEQ ID NO: 3800816 - RNA, 15 nt, Salmonella typhimurium LT2
aguauacagacagca

SEQ ID NO: 3800817 - RNA, 16 nt, Salmonella typhimurium LT2
aguauacagacagcag

SEQ ID NO: 3800818 - RNA, 22 nt, Salmonella typhimurium LT2
aguauagcgacgcuuugcucug

SEQ ID NO: 3800819 - RNA, 16 nt, Salmonella typhimurium LT2
aguaucaaugccgcga

SEQ ID NO: 3800820 - RNA, 15 nt, Salmonella typhimurium LT2
aguaucgcgccgcca

SEQ ID NO: 3800821 - RNA, 22 nt, Salmonella typhimurium LT2
aguaucggcaggacuuaaaaac

SEQ ID NO: 3800822 - RNA, 14 nt, Salmonella typhimurium LT2
aguaucuuauccgg

SEQ ID NO: 3800823 - RNA, 17 nt, Salmonella typhimurium LT2
aguaucuuuuauuauua

SEQ ID NO: 3800824 - RNA, 15 nt, Salmonella typhimurium LT2
aguaugacccgcccc

SEQ ID NO: 3800825 - RNA, 17 nt, Salmonella typhimurium LT2
aguaugccgcauaaaau

SEQ ID NO: 3800826 - RNA, 16 nt, Salmonella typhimurium LT2
aguauggccagaugcg

SEQ ID NO: 3800827 - RNA, 19 nt, Salmonella typhimurium LT2
aguauggccagaugcgcuu

SEQ ID NO: 3800828 - RNA, 14 nt, Salmonella typhimurium LT2
aguauuauccauug

SEQ ID NO: 3800829 - RNA, 18 nt, Salmonella typhimurium LT2
aguauugacgaaaagaua

SEQ ID NO: 3800830 - RNA, 14 nt, Salmonella typhimurium LT2
aguauugcaccagg

SEQ ID NO: 3800831 - RNA, 14 nt, Salmonella typhimurium LT2
aguauuggcaagaa

SEQ ID NO: 3800832 - RNA, 15 nt, Salmonella typhimurium LT2
aguauuggcugccga

SEQ ID NO: 3800833 - RNA, 15 nt, Salmonella typhimurium LT2
aguauuucccuuccc

SEQ ID NO: 3800834 - RNA, 20 nt, Salmonella typhimurium LT2
aguauuucccuucccagccc

SEQ ID NO: 3800835 - RNA, 20 nt, Salmonella typhimurium LT2
aguauuucgacuuucuucgg

SEQ ID NO: 3800836 - RNA, 22 nt, Salmonella typhimurium LT2
agucaaaacgacauaaccggca

SEQ ID NO: 3800837 - RNA, 22 nt, Salmonella typhimurium LT2
agucaaaauaaaauuauauucu

SEQ ID NO: 3800838 - RNA, 21 nt, Salmonella typhimurium LT2
agucaaacacgaccagcgaca

SEQ ID NO: 3800839 - RNA, 13 nt, Salmonella typhimurium LT2
agucaaacccuuc

SEQ ID NO: 3800840 - RNA, 15 nt, Salmonella typhimurium LT2
agucaaauuccagca

SEQ ID NO: 3800841 - RNA, 16 nt, Salmonella typhimurium LT2
agucaaauuccagcaa

SEQ ID NO: 3800842 - RNA, 21 nt, Salmonella typhimurium LT2
agucaaccagcccuuccgccg

SEQ ID NO: 3800843 - RNA, 16 nt, Salmonella typhimurium LT2
agucaagcuugccgcu

SEQ ID NO: 3800844 - RNA, 17 nt, Salmonella typhimurium LT2
agucaaguuagcccccg

SEQ ID NO: 3800845 - RNA, 21 nt, Salmonella typhimurium LT2
agucacagaauacccuccgcc

SEQ ID NO: 3800846 - RNA, 17 nt, Salmonella typhimurium LT2
agucacagauccagaca

SEQ ID NO: 3800847 - RNA, 20 nt, Salmonella typhimurium LT2
agucacggcucgaucccgac

SEQ ID NO: 3800848 - RNA, 17 nt, Salmonella typhimurium LT2
agucacuucaaccuuua

SEQ ID NO: 3800849 - RNA, 21 nt, Salmonella typhimurium LT2
agucagacaaguagccugcca

SEQ ID NO: 3800850 - RNA, 23 nt, Salmonella typhimurium LT2
agucagacaccagcccuggcugc

SEQ ID NO: 3800851 - RNA, 16 nt, Salmonella typhimurium LT2
agucagcauaaaaaag

SEQ ID NO: 3800852 - RNA, 16 nt, Salmonella typhimurium LT2
agucagcguuacuggc

SEQ ID NO: 3800853 - RNA, 21 nt, Salmonella typhimurium LT2
agucagcucgguggcgguauc

SEQ ID NO: 3800854 - RNA, 16 nt, Salmonella typhimurium LT2
agucaggcacaaaaaa

SEQ ID NO: 3800855 - RNA, 18 nt, Salmonella typhimurium LT2
agucaggcacaaaaaaca

SEQ ID NO: 3800856 - RNA, 15 nt, Salmonella typhimurium LT2
agucaggcgccagag

SEQ ID NO: 3800857 - RNA, 16 nt, Salmonella typhimurium LT2
agucaguuuucaauau

SEQ ID NO: 3800858 - RNA, 17 nt, Salmonella typhimurium LT2
agucaguuuucaauauu

SEQ ID NO: 3800859 - RNA, 23 nt, Salmonella typhimurium LT2
agucauaauacucaauauccugc

SEQ ID NO: 3800860 - RNA, 22 nt, Salmonella typhimurium LT2
agucauaauccuuccuuucauu

SEQ ID NO: 3800861 - RNA, 17 nt, Salmonella typhimurium LT2
agucauauuaucgcgcu

SEQ ID NO: 3800862 - RNA, 21 nt, Salmonella typhimurium LT2
agucauauuaucgcgcugaau

SEQ ID NO: 3800863 - RNA, 19 nt, Salmonella typhimurium LT2
agucauccgguucauaauc

SEQ ID NO: 3800864 - RNA, 12 nt, Salmonella typhimurium LT2
agucaucgccgc

SEQ ID NO: 3800865 - RNA, 13 nt, Salmonella typhimurium LT2
agucaucugccag

SEQ ID NO: 3800866 - RNA, 16 nt, Salmonella typhimurium LT2
agucaucugccaguua

SEQ ID NO: 3800867 - RNA, 18 nt, Salmonella typhimurium LT2
agucauucuguagauacu

SEQ ID NO: 3800868 - RNA, 18 nt, Salmonella typhimurium LT2
agucauugcuaugccuga

SEQ ID NO: 3800869 - RNA, 20 nt, Salmonella typhimurium LT2
aguccacccucgucagugaa

SEQ ID NO: 3800870 - RNA, 15 nt, Salmonella typhimurium LT2
aguccacuuucugua

SEQ ID NO: 3800871 - RNA, 15 nt, Salmonella typhimurium LT2
aguccagccauaauc

SEQ ID NO: 3800872 - RNA, 21 nt, Salmonella typhimurium LT2
aguccaguacccgcacgcuuu

SEQ ID NO: 3800873 - RNA, 21 nt, Salmonella typhimurium LT2
aguccauaccguuucaacugc

SEQ ID NO: 3800874 - RNA, 17 nt, Salmonella typhimurium LT2
aguccauuuccucaacc

SEQ ID NO: 3800875 - RNA, 17 nt, Salmonella typhimurium LT2
agucccaaugcggaaac

SEQ ID NO: 3800876 - RNA, 15 nt, Salmonella typhimurium LT2
aguccccagccgcca

SEQ ID NO: 3800877 - RNA, 17 nt, Salmonella typhimurium LT2
agucccgggcuaaucgc

SEQ ID NO: 3800878 - RNA, 15 nt, Salmonella typhimurium LT2
agucccuaauagcgc

SEQ ID NO: 3800879 - RNA, 16 nt, Salmonella typhimurium LT2
agucccuguucgccac

SEQ ID NO: 3800880 - RNA, 19 nt, Salmonella typhimurium LT2
agucccuguucgccacccg

SEQ ID NO: 3800881 - RNA, 15 nt, Salmonella typhimurium LT2
aguccgcaaagaacc

SEQ ID NO: 3800882 - RNA, 16 nt, Salmonella typhimurium LT2
aguccgcaaagaacca

SEQ ID NO: 3800883 - RNA, 14 nt, Salmonella typhimurium LT2
aguccggauggcag

SEQ ID NO: 3800884 - RNA, 22 nt, Salmonella typhimurium LT2
aguccgggugcaaacccaucuc

SEQ ID NO: 3800885 - RNA, 14 nt, Salmonella typhimurium LT2
aguccgucagaaua

SEQ ID NO: 3800886 - RNA, 19 nt, Salmonella typhimurium LT2
aguccgucguuaaucagcg

SEQ ID NO: 3800887 - RNA, 22 nt, Salmonella typhimurium LT2
aguccguggcacgguaaacucc

SEQ ID NO: 3800888 - RNA, 16 nt, Salmonella typhimurium LT2
aguccucuauuuuuuc

SEQ ID NO: 3800889 - RNA, 15 nt, Salmonella typhimurium LT2
agucgacaacaucau

SEQ ID NO: 3800890 - RNA, 19 nt, Salmonella typhimurium LT2
agucgacagcccgccagca

SEQ ID NO: 3800891 - RNA, 17 nt, Salmonella typhimurium LT2
agucgauaaaucgccac

SEQ ID NO: 3800892 - RNA, 19 nt, Salmonella typhimurium LT2
agucgauguggccuuccuc

SEQ ID NO: 3800893 - RNA, 14 nt, Salmonella typhimurium LT2
agucgcacaaagcg

SEQ ID NO: 3800894 - RNA, 21 nt, Salmonella typhimurium LT2
agucgcagagcccagcgcgau

SEQ ID NO: 3800895 - RNA, 14 nt, Salmonella typhimurium LT2
agucgccagaaggc

SEQ ID NO: 3800896 - RNA, 12 nt, Salmonella typhimurium LT2
agucgccaggca

SEQ ID NO: 3800897 - RNA, 14 nt, Salmonella typhimurium LT2
agucgccaggcaag

SEQ ID NO: 3800898 - RNA, 21 nt, Salmonella typhimurium LT2
agucgccuucguucaggacga

SEQ ID NO: 3800899 - RNA, 15 nt, Salmonella typhimurium LT2
agucgcuauggugcg

SEQ ID NO: 3800900 - RNA, 20 nt, Salmonella typhimurium LT2
agucguaggcucaaaguuac

SEQ ID NO: 3800901 - RNA, 24 nt, Salmonella typhimurium LT2
agucgucauugaguuaguggucau

SEQ ID NO: 3800902 - RNA, 15 nt, Salmonella typhimurium LT2
agucguuauaauccu

SEQ ID NO: 3800903 - RNA, 16 nt, Salmonella typhimurium LT2
agucguuauccagauc

SEQ ID NO: 3800904 - RNA, 21 nt, Salmonella typhimurium LT2
agucguuauccagaucuucag

SEQ ID NO: 3800905 - RNA, 14 nt, Salmonella typhimurium LT2
agucuaaaaauaau

SEQ ID NO: 3800906 - RNA, 20 nt, Salmonella typhimurium LT2
agucuauguucaguaagaca

SEQ ID NO: 3800907 - RNA, 20 nt, Salmonella typhimurium LT2
agucuccugccgaugaaaua

SEQ ID NO: 3800908 - RNA, 20 nt, Salmonella typhimurium LT2
agucuccuguuuacaggcga

SEQ ID NO: 3800909 - RNA, 18 nt, Salmonella typhimurium LT2
agucucgaguucggaagc

SEQ ID NO: 3800910 - RNA, 22 nt, Salmonella typhimurium LT2
agucugccauuuccugauuuuu

SEQ ID NO: 3800911 - RNA, 17 nt, Salmonella typhimurium LT2
agucugugaggaaagcg

SEQ ID NO: 3800912 - RNA, 13 nt, Salmonella typhimurium LT2
agucuguuuuucg

SEQ ID NO: 3800913 - RNA, 11 nt, Salmonella typhimurium LT2
agucuuccugc

SEQ ID NO: 3800914 - RNA, 19 nt, Salmonella typhimurium LT2
agucuuuuguuuuucucuu

SEQ ID NO: 3800915 - RNA, 15 nt, Salmonella typhimurium LT2
agugaaaaaacggaa

SEQ ID NO: 3800916 - RNA, 12 nt, Salmonella typhimurium LT2
agugaaauaaau

SEQ ID NO: 3800917 - RNA, 20 nt, Salmonella typhimurium LT2
agugaagaugguaauauuaa

SEQ ID NO: 3800918 - RNA, 20 nt, Salmonella typhimurium LT2
agugaagugcaggauagaaa

SEQ ID NO: 3800919 - RNA, 22 nt, Salmonella typhimurium LT2
agugaauacugcgcgucgucag

SEQ ID NO: 3800920 - RNA, 19 nt, Salmonella typhimurium LT2
agugaauuaugaccaaugu

SEQ ID NO: 3800921 - RNA, 21 nt, Salmonella typhimurium LT2
agugaccacgguuaucuggcg

SEQ ID NO: 3800922 - RNA, 23 nt, Salmonella typhimurium LT2
agugacgacgccagauaaggcuc

SEQ ID NO: 3800923 - RNA, 12 nt, Salmonella typhimurium LT2
agugacggcaau

SEQ ID NO: 3800924 - RNA, 22 nt, Salmonella typhimurium LT2
agugagauugacagaauaaugc

SEQ ID NO: 3800925 - RNA, 15 nt, Salmonella typhimurium LT2
agugagcauuacguc

SEQ ID NO: 3800926 - RNA, 21 nt, Salmonella typhimurium LT2
agugagcgauugcuggccuag

SEQ ID NO: 3800927 - RNA, 15 nt, Salmonella typhimurium LT2
agugaggcugguugu

SEQ ID NO: 3800928 - RNA, 17 nt, Salmonella typhimurium LT2
agugaguacgcaggagg

SEQ ID NO: 3800929 - RNA, 13 nt, Salmonella typhimurium LT2
agugauaaagcac

SEQ ID NO: 3800930 - RNA, 14 nt, Salmonella typhimurium LT2
agugauacauaguc

SEQ ID NO: 3800931 - RNA, 19 nt, Salmonella typhimurium LT2
agugauaccagccaacagu

SEQ ID NO: 3800932 - RNA, 13 nt, Salmonella typhimurium LT2
agugaucccaaca

SEQ ID NO: 3800933 - RNA, 21 nt, Salmonella typhimurium LT2
agugaucccaacauaggccag

SEQ ID NO: 3800934 - RNA, 16 nt, Salmonella typhimurium LT2
agugauggauuucaca

SEQ ID NO: 3800935 - RNA, 17 nt, Salmonella typhimurium LT2
agugauuauaaaucaau

SEQ ID NO: 3800936 - RNA, 16 nt, Salmonella typhimurium LT2
agugauucacuuucuu

SEQ ID NO: 3800937 - RNA, 15 nt, Salmonella typhimurium LT2
agugauuccuuugaa

SEQ ID NO: 3800938 - RNA, 22 nt, Salmonella typhimurium LT2
agugcaaacucaccugauuacc

SEQ ID NO: 3800939 - RNA, 15 nt, Salmonella typhimurium LT2
agugcaaaggccucu

SEQ ID NO: 3800940 - RNA, 18 nt, Salmonella typhimurium LT2
agugcaacagagagcaaa

SEQ ID NO: 3800941 - RNA, 17 nt, Salmonella typhimurium LT2
agugcagcguuuccagc

SEQ ID NO: 3800942 - RNA, 16 nt, Salmonella typhimurium LT2
agugcaggaucaccgg

SEQ ID NO: 3800943 - RNA, 18 nt, Salmonella typhimurium LT2
agugccagaaacaucggu

SEQ ID NO: 3800944 - RNA, 20 nt, Salmonella typhimurium LT2
agugccgguggcaugaaaau

SEQ ID NO: 3800945 - RNA, 18 nt, Salmonella typhimurium LT2
agugcgauuugacaucag

SEQ ID NO: 3800946 - RNA, 15 nt, Salmonella typhimurium LT2
agugcgcacucagaa

SEQ ID NO: 3800947 - RNA, 11 nt, Salmonella typhimurium LT2
agugcgccgcc

SEQ ID NO: 3800948 - RNA, 12 nt, Salmonella typhimurium LT2
agugcugcgcaa

SEQ ID NO: 3800949 - RNA, 22 nt, Salmonella typhimurium LT2
aguggagaggccaccagcgcca

SEQ ID NO: 3800950 - RNA, 14 nt, Salmonella typhimurium LT2
aguggaucagcaga

SEQ ID NO: 3800951 - RNA, 19 nt, Salmonella typhimurium LT2
aguggcauccgaagaacca

SEQ ID NO: 3800952 - RNA, 23 nt, Salmonella typhimurium LT2
aguggcgcggaaagccuucauca

SEQ ID NO: 3800953 - RNA, 15 nt, Salmonella typhimurium LT2
aguggcggcaaaaaa

SEQ ID NO: 3800954 - RNA, 17 nt, Salmonella typhimurium LT2
aguggcgggcguuugug

SEQ ID NO: 3800955 - RNA, 21 nt, Salmonella typhimurium LT2
aguggcguagcguacugcagc

SEQ ID NO: 3800956 - RNA, 19 nt, Salmonella typhimurium LT2
agugggucacaucgcccug

SEQ ID NO: 3800957 - RNA, 12 nt, Salmonella typhimurium LT2
agugguggguga

SEQ ID NO: 3800958 - RNA, 14 nt, Salmonella typhimurium LT2
aguggugggugaug

SEQ ID NO: 3800959 - RNA, 15 nt, Salmonella typhimurium LT2
agugguuccauucca

SEQ ID NO: 3800960 - RNA, 22 nt, Salmonella typhimurium LT2
agugguucguccaucaguucuu

SEQ ID NO: 3800961 - RNA, 16 nt, Salmonella typhimurium LT2
agugguucuggcggcg

SEQ ID NO: 3800962 - RNA, 14 nt, Salmonella typhimurium LT2
aguguaaacgccag

SEQ ID NO: 3800963 - RNA, 23 nt, Salmonella typhimurium LT2
aguguccuuacggacgugggggu

SEQ ID NO: 3800964 - RNA, 13 nt, Salmonella typhimurium LT2
agugucgccauaa

SEQ ID NO: 3800965 - RNA, 17 nt, Salmonella typhimurium LT2
agugucgccauaaauca

SEQ ID NO: 3800966 - RNA, 23 nt, Salmonella typhimurium LT2
agugucuucccugaccagcgacg

SEQ ID NO: 3800967 - RNA, 19 nt, Salmonella typhimurium LT2
agugugauaagccccuuua

SEQ ID NO: 3800968 - RNA, 20 nt, Salmonella typhimurium LT2
agugugccgccggguuuaag

SEQ ID NO: 3800969 - RNA, 21 nt, Salmonella typhimurium LT2
agugugucuuuuacgccagga

SEQ ID NO: 3800970 - RNA, 17 nt, Salmonella typhimurium LT2
aguguuaaacauauggc

SEQ ID NO: 3800971 - RNA, 23 nt, Salmonella typhimurium LT2
aguguucuuacggacgugggggu

SEQ ID NO: 3800972 - RNA, 21 nt, Salmonella typhimurium LT2
aguguuggaugaaccauauca

SEQ ID NO: 3800973 - RNA, 22 nt, Salmonella typhimurium LT2
aguguuggauuacgugcccggc

SEQ ID NO: 3800974 - RNA, 14 nt, Salmonella typhimurium LT2
aguguuuccauaca

SEQ ID NO: 3800975 - RNA, 15 nt, Salmonella typhimurium LT2
aguuaacuucuccuc

SEQ ID NO: 3800976 - RNA, 16 nt, Salmonella typhimurium LT2
aguuaagcgcccgcgc

SEQ ID NO: 3800977 - RNA, 22 nt, Salmonella typhimurium LT2
aguuaagcggggguaacaauag

SEQ ID NO: 3800978 - RNA, 20 nt, Salmonella typhimurium LT2
aguuaaugccgucaucagca

SEQ ID NO: 3800979 - RNA, 17 nt, Salmonella typhimurium LT2
aguuaccgcgccaggcg

SEQ ID NO: 3800980 - RNA, 24 nt, Salmonella typhimurium LT2
aguuaccguaaucaucgcgaucgc

SEQ ID NO: 3800981 - RNA, 16 nt, Salmonella typhimurium LT2
aguuacggacaugcga

SEQ ID NO: 3800982 - RNA, 16 nt, Salmonella typhimurium LT2
aguuacguugcggcgu

SEQ ID NO: 3800983 - RNA, 16 nt, Salmonella typhimurium LT2
aguuagcgaccgcgcc

SEQ ID NO: 3800984 - RNA, 15 nt, Salmonella typhimurium LT2
aguuagcgcccauaa

SEQ ID NO: 3800985 - RNA, 19 nt, Salmonella typhimurium LT2
aguuagcgcccauaaugca

SEQ ID NO: 3800986 - RNA, 22 nt, Salmonella typhimurium LT2
aguuauacagcaccugcucagg

SEQ ID NO: 3800987 - RNA, 12 nt, Salmonella typhimurium LT2
aguuaucgccga

SEQ ID NO: 3800988 - RNA, 13 nt, Salmonella typhimurium LT2
aguuaucgccgaa

SEQ ID NO: 3800989 - RNA, 15 nt, Salmonella typhimurium LT2
aguuauguauuuaau

SEQ ID NO: 3800990 - RNA, 17 nt, Salmonella typhimurium LT2
aguuauuaacaucagcc

SEQ ID NO: 3800991 - RNA, 15 nt, Salmonella typhimurium LT2
aguucaauauccagc

SEQ ID NO: 3800992 - RNA, 16 nt, Salmonella typhimurium LT2
aguucaauauccagcc

SEQ ID NO: 3800993 - RNA, 14 nt, Salmonella typhimurium LT2
aguucaaucagguu

SEQ ID NO: 3800994 - RNA, 21 nt, Salmonella typhimurium LT2
aguucaccaguuuuucgccaa

SEQ ID NO: 3800995 - RNA, 19 nt, Salmonella typhimurium LT2
aguucacgcgccgccugca

SEQ ID NO: 3800996 - RNA, 20 nt, Salmonella typhimurium LT2
aguucacuccuaagagaaaa

SEQ ID NO: 3800997 - RNA, 13 nt, Salmonella typhimurium LT2
aguucagcagcac

SEQ ID NO: 3800998 - RNA, 16 nt, Salmonella typhimurium LT2
aguucagcagcaccac

SEQ ID NO: 3800999 - RNA, 12 nt, Salmonella typhimurium LT2
aguucagccgcc

SEQ ID NO: 3801000 - RNA, 19 nt, Salmonella typhimurium LT2
aguucaggaacaucagcau

SEQ ID NO: 3801001 - RNA, 17 nt, Salmonella typhimurium LT2
aguucaggcacgugcau

SEQ ID NO: 3801002 - RNA, 17 nt, Salmonella typhimurium LT2
aguucaguuaagcgggg

SEQ ID NO: 3801003 - RNA, 14 nt, Salmonella typhimurium LT2
aguucauaaaugua

SEQ ID NO: 3801004 - RNA, 19 nt, Salmonella typhimurium LT2
aguucaucacaaaaucauu

SEQ ID NO: 3801005 - RNA, 20 nt, Salmonella typhimurium LT2
aguucaucauccugcagggu

SEQ ID NO: 3801006 - RNA, 13 nt, Salmonella typhimurium LT2
aguucauccagca

SEQ ID NO: 3801007 - RNA, 18 nt, Salmonella typhimurium LT2
aguucaucuuccacacua

SEQ ID NO: 3801008 - RNA, 20 nt, Salmonella typhimurium LT2
aguuccacauaaaguagcca

SEQ ID NO: 3801009 - RNA, 15 nt, Salmonella typhimurium LT2
aguuccaccaguucu

SEQ ID NO: 3801010 - RNA, 17 nt, Salmonella typhimurium LT2
aguuccaucuccggcga

SEQ ID NO: 3801011 - RNA, 22 nt, Salmonella typhimurium LT2
aguuccaucuccggcgaccaau

SEQ ID NO: 3801012 - RNA, 17 nt, Salmonella typhimurium LT2
aguucccagcgguggau

SEQ ID NO: 3801013 - RNA, 15 nt, Salmonella typhimurium LT2
aguuccgccacggcg

SEQ ID NO: 3801014 - RNA, 12 nt, Salmonella typhimurium LT2
aguuccuccugg

SEQ ID NO: 3801015 - RNA, 20 nt, Salmonella typhimurium LT2
aguuccuggagaacgagaaa

SEQ ID NO: 3801016 - RNA, 19 nt, Salmonella typhimurium LT2
aguucgccuucuucaucuu

SEQ ID NO: 3801017 - RNA, 15 nt, Salmonella typhimurium LT2
aguucgcugaggcgu

SEQ ID NO: 3801018 - RNA, 16 nt, Salmonella typhimurium LT2
aguucgcugaggcguu

SEQ ID NO: 3801019 - RNA, 16 nt, Salmonella typhimurium LT2
aguucuacgcugccau

SEQ ID NO: 3801020 - RNA, 18 nt, Salmonella typhimurium LT2
aguucucgucugcugaaa

SEQ ID NO: 3801021 - RNA, 19 nt, Salmonella typhimurium LT2
aguucuucaucccacucaa

SEQ ID NO: 3801022 - RNA, 14 nt, Salmonella typhimurium LT2
aguucuucauuuau

SEQ ID NO: 3801023 - RNA, 23 nt, Salmonella typhimurium LT2
aguucuucccaccggacgaaaaa

SEQ ID NO: 3801024 - RNA, 14 nt, Salmonella typhimurium LT2
aguucuugcaggca

SEQ ID NO: 3801025 - RNA, 18 nt, Salmonella typhimurium LT2
aguugaaaggaaaggucg

SEQ ID NO: 3801026 - RNA, 16 nt, Salmonella typhimurium LT2
aguugaacgguaaaca

SEQ ID NO: 3801027 - RNA, 23 nt, Salmonella typhimurium LT2
aguugauaauauuaucagcaaua

SEQ ID NO: 3801028 - RNA, 16 nt, Salmonella typhimurium LT2
aguugauacauuuuuu

SEQ ID NO: 3801029 - RNA, 12 nt, Salmonella typhimurium LT2
aguugcagcgcc

SEQ ID NO: 3801030 - RNA, 21 nt, Salmonella typhimurium LT2
aguugcauauaaggcccauac

SEQ ID NO: 3801031 - RNA, 21 nt, Salmonella typhimurium LT2
aguugcauucccuacgcccag

SEQ ID NO: 3801032 - RNA, 16 nt, Salmonella typhimurium LT2
aguugccgccauaggu

SEQ ID NO: 3801033 - RNA, 14 nt, Salmonella typhimurium LT2
aguugccuucgauu

SEQ ID NO: 3801034 - RNA, 21 nt, Salmonella typhimurium LT2
aguugcgauccuuccggcgcc

SEQ ID NO: 3801035 - RNA, 17 nt, Salmonella typhimurium LT2
aguugcggcaacgugaa

SEQ ID NO: 3801036 - RNA, 14 nt, Salmonella typhimurium LT2
aguugcguucccag

SEQ ID NO: 3801037 - RNA, 18 nt, Salmonella typhimurium LT2
aguugcguucccaguucc

SEQ ID NO: 3801038 - RNA, 15 nt, Salmonella typhimurium LT2
aguugcugauuaaaa

SEQ ID NO: 3801039 - RNA, 15 nt, Salmonella typhimurium LT2
aguugcuuaccuugu

SEQ ID NO: 3801040 - RNA, 22 nt, Salmonella typhimurium LT2
aguugcuuaccuuguucuucca

SEQ ID NO: 3801041 - RNA, 16 nt, Salmonella typhimurium LT2
aguuggcauaaugaac

SEQ ID NO: 3801042 - RNA, 14 nt, Salmonella typhimurium LT2
aguuggugggugau

SEQ ID NO: 3801043 - RNA, 15 nt, Salmonella typhimurium LT2
aguuggugggugaug

SEQ ID NO: 3801044 - RNA, 17 nt, Salmonella typhimurium LT2
aguuguucacgggaacg

SEQ ID NO: 3801045 - RNA, 13 nt, Salmonella typhimurium LT2
aguuuaucugcgu

SEQ ID NO: 3801046 - RNA, 15 nt, Salmonella typhimurium LT2
aguuuauugagauaa

SEQ ID NO: 3801047 - RNA, 16 nt, Salmonella typhimurium LT2
aguuuauugagauaau

SEQ ID NO: 3801048 - RNA, 23 nt, Salmonella typhimurium LT2
aguuucagcccaaaagcgaccuc

SEQ ID NO: 3801049 - RNA, 15 nt, Salmonella typhimurium LT2
aguuucaucagcaca

SEQ ID NO: 3801050 - RNA, 17 nt, Salmonella typhimurium LT2
aguuucaucagcacaaa

SEQ ID NO: 3801051 - RNA, 14 nt, Salmonella typhimurium LT2
aguuuccgguaaau

SEQ ID NO: 3801052 - RNA, 19 nt, Salmonella typhimurium LT2
aguuucucccgccagaugc

SEQ ID NO: 3801053 - RNA, 19 nt, Salmonella typhimurium LT2
aguuucuguucgaccguca

SEQ ID NO: 3801054 - RNA, 14 nt, Salmonella typhimurium LT2
aguuucuuaccuac

SEQ ID NO: 3801055 - RNA, 21 nt, Salmonella typhimurium LT2
aguuucuucggcuucaccgau

SEQ ID NO: 3801056 - RNA, 21 nt, Salmonella typhimurium LT2
aguuucuuuuuccaaauaguu

SEQ ID NO: 3801057 - RNA, 22 nt, Salmonella typhimurium LT2
aguuugauagcgcuauguaaga

SEQ ID NO: 3801058 - RNA, 21 nt, Salmonella typhimurium LT2
aguuugcgaaguucauauggc

SEQ ID NO: 3801059 - RNA, 20 nt, Salmonella typhimurium LT2
aguuugcgcgauuuauagag

SEQ ID NO: 3801060 - RNA, 20 nt, Salmonella typhimurium LT2
aguuugguuaauuccgcauc

SEQ ID NO: 3801061 - RNA, 15 nt, Salmonella typhimurium LT2
aguuuguccauuucu

SEQ ID NO: 3801062 - RNA, 22 nt, Salmonella typhimurium LT2
aguuugucuucgaugcgcucau

SEQ ID NO: 3801063 - RNA, 10 nt, Salmonella typhimurium LT2
aguuuuaacg

SEQ ID NO: 3801064 - RNA, 22 nt, Salmonella typhimurium LT2
aguuuuccccccuccaucaaau

SEQ ID NO: 3801065 - RNA, 23 nt, Salmonella typhimurium LT2
aguuuuccccccuccaucaaaua

SEQ ID NO: 3801066 - RNA, 14 nt, Salmonella typhimurium LT2
aguuuuccgccauu

SEQ ID NO: 3801067 - RNA, 15 nt, Salmonella typhimurium LT2
aguuuuccuucagca

SEQ ID NO: 3801068 - RNA, 18 nt, Salmonella typhimurium LT2
aguuuugcauucugcaac

SEQ ID NO: 3801069 - RNA, 14 nt, Salmonella typhimurium LT2
aguuuuucaaucuu

SEQ ID NO: 3801070 - RNA, 15 nt, Salmonella typhimurium LT2
aguuuuuucaguagc

SEQ ID NO: 3801071 - RNA, 20 nt, Salmonella typhimurium LT2
aguuuuuuuaagaaggucag

SEQ ID NO: 3801072 - RNA, 14 nt, Salmonella typhimurium LT2
aguuuuuuucugcc

SEQ ID NO: 3801073 - RNA, 14 nt, Salmonella typhimurium LT2
auaaaaaacaucau

SEQ ID NO: 3801074 - RNA, 11 nt, Salmonella typhimurium LT2
auaaaaaagaa

SEQ ID NO: 3801075 - RNA, 13 nt, Salmonella typhimurium LT2
auaaaaaaggcag

SEQ ID NO: 3801076 - RNA, 12 nt, Salmonella typhimurium LT2
auaaaaaauuau

SEQ ID NO: 3801077 - RNA, 22 nt, Salmonella typhimurium LT2
auaaaaacgcgcucgccagcgc

SEQ ID NO: 3801078 - RNA, 14 nt, Salmonella typhimurium LT2
auaaaaauagcugg

SEQ ID NO: 3801079 - RNA, 12 nt, Salmonella typhimurium LT2
auaaaaaucauu

SEQ ID NO: 3801080 - RNA, 15 nt, Salmonella typhimurium LT2
auaaaacauaaagau

SEQ ID NO: 3801081 - RNA, 14 nt, Salmonella typhimurium LT2
auaaaaccauucaa

SEQ ID NO: 3801082 - RNA, 18 nt, Salmonella typhimurium LT2
auaaaacuacaacaauaa

SEQ ID NO: 3801083 - RNA, 20 nt, Salmonella typhimurium LT2
auaaaacucccggcggaaau

SEQ ID NO: 3801084 - RNA, 22 nt, Salmonella typhimurium LT2
auaaaacuucgauaauaaaaua

SEQ ID NO: 3801085 - RNA, 12 nt, Salmonella typhimurium LT2
auaaaagaucau

SEQ ID NO: 3801086 - RNA, 14 nt, Salmonella typhimurium LT2
auaaaagccgccau

SEQ ID NO: 3801087 - RNA, 21 nt, Salmonella typhimurium LT2
auaaaagccgccauguuuuuu

SEQ ID NO: 3801088 - RNA, 22 nt, Salmonella typhimurium LT2
auaaaagccgccauguuuuuua

SEQ ID NO: 3801089 - RNA, 22 nt, Salmonella typhimurium LT2
auaaaagcucgucuguuguucu

SEQ ID NO: 3801090 - RNA, 14 nt, Salmonella typhimurium LT2
auaaaauagcgauc

SEQ ID NO: 3801091 - RNA, 19 nt, Salmonella typhimurium LT2
auaaaauagugaucaucau

SEQ ID NO: 3801092 - RNA, 17 nt, Salmonella typhimurium LT2
auaaaauauuauuuuuu

SEQ ID NO: 3801093 - RNA, 13 nt, Salmonella typhimurium LT2
auaaaauauuuaa

SEQ ID NO: 3801094 - RNA, 21 nt, Salmonella typhimurium LT2
auaaaauauuuaacuuaaaua

SEQ ID NO: 3801095 - RNA, 12 nt, Salmonella typhimurium LT2
auaaaauuauau

SEQ ID NO: 3801096 - RNA, 17 nt, Salmonella typhimurium LT2
auaaaauuauuggcuuu

SEQ ID NO: 3801097 - RNA, 13 nt, Salmonella typhimurium LT2
auaaaauuguuau

SEQ ID NO: 3801098 - RNA, 20 nt, Salmonella typhimurium LT2
auaaaauuuugcauaaauaa

SEQ ID NO: 3801099 - RNA, 22 nt, Salmonella typhimurium LT2
auaaaauuuugcauaaauaaug

SEQ ID NO: 3801100 - RNA, 15 nt, Salmonella typhimurium LT2
auaaacacacaccga

SEQ ID NO: 3801101 - RNA, 12 nt, Salmonella typhimurium LT2
auaaacaccuua

SEQ ID NO: 3801102 - RNA, 16 nt, Salmonella typhimurium LT2
auaaacagguaaaaca

SEQ ID NO: 3801103 - RNA, 15 nt, Salmonella typhimurium LT2
auaaacauuacguuu

SEQ ID NO: 3801104 - RNA, 14 nt, Salmonella typhimurium LT2
auaaaccaacagcc

SEQ ID NO: 3801105 - RNA, 17 nt, Salmonella typhimurium LT2
auaaaccgaaaggguau

SEQ ID NO: 3801106 - RNA, 22 nt, Salmonella typhimurium LT2
auaaaccugauugccgguuguu

SEQ ID NO: 3801107 - RNA, 13 nt, Salmonella typhimurium LT2
auaaacgacauca

SEQ ID NO: 3801108 - RNA, 14 nt, Salmonella typhimurium LT2
auaaacgacaucaa

SEQ ID NO: 3801109 - RNA, 15 nt, Salmonella typhimurium LT2
auaaacgacaucaau

SEQ ID NO: 3801110 - RNA, 16 nt, Salmonella typhimurium LT2
auaaacgacaucaaua

SEQ ID NO: 3801111 - RNA, 16 nt, Salmonella typhimurium LT2
auaaacgccucauccg

SEQ ID NO: 3801112 - RNA, 15 nt, Salmonella typhimurium LT2
auaaacgccugacga

SEQ ID NO: 3801113 - RNA, 22 nt, Salmonella typhimurium LT2
auaaacgcggccaucacgcugc

SEQ ID NO: 3801114 - RNA, 21 nt, Salmonella typhimurium LT2
auaaacgcuugacucugaagc

SEQ ID NO: 3801115 - RNA, 14 nt, Salmonella typhimurium LT2
auaaacgggaagua

SEQ ID NO: 3801116 - RNA, 22 nt, Salmonella typhimurium LT2
auaaacgggcccggcuuucugu

SEQ ID NO: 3801117 - RNA, 22 nt, Salmonella typhimurium LT2
auaaacgucccgacgaauaaca

SEQ ID NO: 3801118 - RNA, 23 nt, Salmonella typhimurium LT2
auaaacgucccgacgaauaacaa

SEQ ID NO: 3801119 - RNA, 14 nt, Salmonella typhimurium LT2
auaaacucagcgcc

SEQ ID NO: 3801120 - RNA, 21 nt, Salmonella typhimurium LT2
auaaacucuguguuaugaaug

SEQ ID NO: 3801121 - RNA, 20 nt, Salmonella typhimurium LT2
auaaagaccggcacaaccgu

SEQ ID NO: 3801122 - RNA, 21 nt, Salmonella typhimurium LT2
auaaagagcaggccaaaaaag

SEQ ID NO: 3801123 - RNA, 22 nt, Salmonella typhimurium LT2
auaaagauugguaucugcaauu

SEQ ID NO: 3801124 - RNA, 16 nt, Salmonella typhimurium LT2
auaaagcacagcccca

SEQ ID NO: 3801125 - RNA, 17 nt, Salmonella typhimurium LT2
auaaagcacagccccag

SEQ ID NO: 3801126 - RNA, 23 nt, Salmonella typhimurium LT2
auaaagcagaccaccccacagca

SEQ ID NO: 3801127 - RNA, 12 nt, Salmonella typhimurium LT2
auaaagcagggc

SEQ ID NO: 3801128 - RNA, 17 nt, Salmonella typhimurium LT2
auaaagcgaauaauuaa

SEQ ID NO: 3801129 - RNA, 20 nt, Salmonella typhimurium LT2
auaaagcgaccgaucaucau

SEQ ID NO: 3801130 - RNA, 14 nt, Salmonella typhimurium LT2
auaaaggucacauc

SEQ ID NO: 3801131 - RNA, 16 nt, Salmonella typhimurium LT2
auaaaggucacaucau

SEQ ID NO: 3801132 - RNA, 21 nt, Salmonella typhimurium LT2
auaaaggucacaucaucgcca

SEQ ID NO: 3801133 - RNA, 13 nt, Salmonella typhimurium LT2
auaaaguauguuu

SEQ ID NO: 3801134 - RNA, 22 nt, Salmonella typhimurium LT2
auaaaguauguuuugaauggcu

SEQ ID NO: 3801135 - RNA, 15 nt, Salmonella typhimurium LT2
auaaaguguuauuau

SEQ ID NO: 3801136 - RNA, 17 nt, Salmonella typhimurium LT2
auaaaguuauacagcac

SEQ ID NO: 3801137 - RNA, 13 nt, Salmonella typhimurium LT2
auaaauaaaaaau

SEQ ID NO: 3801138 - RNA, 12 nt, Salmonella typhimurium LT2
auaaauaaaauu

SEQ ID NO: 3801139 - RNA, 14 nt, Salmonella typhimurium LT2
auaaauaaaauugu

SEQ ID NO: 3801140 - RNA, 18 nt, Salmonella typhimurium LT2
auaaauagccagcaucau

SEQ ID NO: 3801141 - RNA, 22 nt, Salmonella typhimurium LT2
auaaauagcucggcaaagccca

SEQ ID NO: 3801142 - RNA, 18 nt, Salmonella typhimurium LT2
auaaauaggcgccgccga

SEQ ID NO: 3801143 - RNA, 19 nt, Salmonella typhimurium LT2
auaaauaucgcguuaauuu

SEQ ID NO: 3801144 - RNA, 23 nt, Salmonella typhimurium LT2
auaaauauugcaacgaucccuaa

SEQ ID NO: 3801145 - RNA, 23 nt, Salmonella typhimurium LT2
auaaaucaguuguacuuguugcu

SEQ ID NO: 3801146 - RNA, 12 nt, Salmonella typhimurium LT2
auaaaucaucau

SEQ ID NO: 3801147 - RNA, 14 nt, Salmonella typhimurium LT2
auaaaucaucaucg

SEQ ID NO: 3801148 - RNA, 18 nt, Salmonella typhimurium LT2
auaaauccccgccgccau

SEQ ID NO: 3801149 - RNA, 20 nt, Salmonella typhimurium LT2
auaaaucgucggcaggguuu

SEQ ID NO: 3801150 - RNA, 20 nt, Salmonella typhimurium LT2
auaaaugccgcaauaaacac

SEQ ID NO: 3801151 - RNA, 21 nt, Salmonella typhimurium LT2
auaaauggcaggaaggggaaa

SEQ ID NO: 3801152 - RNA, 21 nt, Salmonella typhimurium LT2
auaaaugguacuuuucaucca

SEQ ID NO: 3801153 - RNA, 17 nt, Salmonella typhimurium LT2
auaaauguuuaucucau

SEQ ID NO: 3801154 - RNA, 15 nt, Salmonella typhimurium LT2
auaaauucgaaauaa

SEQ ID NO: 3801155 - RNA, 19 nt, Salmonella typhimurium LT2
auaaauugcggcaugaucu

SEQ ID NO: 3801156 - RNA, 14 nt, Salmonella typhimurium LT2
auaaauuucagugg

SEQ ID NO: 3801157 - RNA, 21 nt, Salmonella typhimurium LT2
auaaauuuucauuauaaaacu

SEQ ID NO: 3801158 - RNA, 12 nt, Salmonella typhimurium LT2
auaaauuuuuac

SEQ ID NO: 3801159 - RNA, 14 nt, Salmonella typhimurium LT2
auaaauuuuuuaac

SEQ ID NO: 3801160 - RNA, 21 nt, Salmonella typhimurium LT2
auaacaaucugcuacugaaua

SEQ ID NO: 3801161 - RNA, 16 nt, Salmonella typhimurium LT2
auaacacaauacuuca

SEQ ID NO: 3801162 - RNA, 14 nt, Salmonella typhimurium LT2
auaacaucuuccau

SEQ ID NO: 3801163 - RNA, 20 nt, Salmonella typhimurium LT2
auaacauugguuaucaaaaa

SEQ ID NO: 3801164 - RNA, 12 nt, Salmonella typhimurium LT2
auaaccaauaau

SEQ ID NO: 3801165 - RNA, 23 nt, Salmonella typhimurium LT2
auaacccggauugucuuaaauau

SEQ ID NO: 3801166 - RNA, 16 nt, Salmonella typhimurium LT2
auaaccgccagcagca

SEQ ID NO: 3801167 - RNA, 14 nt, Salmonella typhimurium LT2
auaaccgcccgcgg

SEQ ID NO: 3801168 - RNA, 20 nt, Salmonella typhimurium LT2
auaaccggcgccaacaaucg

SEQ ID NO: 3801169 - RNA, 21 nt, Salmonella typhimurium LT2
auaaccguagauuuucaucau

SEQ ID NO: 3801170 - RNA, 23 nt, Salmonella typhimurium LT2
auaaccucaacgucgcucagaau

SEQ ID NO: 3801171 - RNA, 19 nt, Salmonella typhimurium LT2
auaaccucaaugauuuccg

SEQ ID NO: 3801172 - RNA, 21 nt, Salmonella typhimurium LT2
auaaccucuacacauuuuaaa

SEQ ID NO: 3801173 - RNA, 20 nt, Salmonella typhimurium LT2
auaaccugccgggguuuuug

SEQ ID NO: 3801174 - RNA, 20 nt, Salmonella typhimurium LT2
auaacgaccaaacaagaucg

SEQ ID NO: 3801175 - RNA, 14 nt, Salmonella typhimurium LT2
auaacgauaaauuu

SEQ ID NO: 3801176 - RNA, 19 nt, Salmonella typhimurium LT2
auaacgccgcccccaugcc

SEQ ID NO: 3801177 - RNA, 17 nt, Salmonella typhimurium LT2
auaacgccgguuccaac

SEQ ID NO: 3801178 - RNA, 20 nt, Salmonella typhimurium LT2
auaacgcggcccgggagaac

SEQ ID NO: 3801179 - RNA, 18 nt, Salmonella typhimurium LT2
auaacgcguucuggcgau

SEQ ID NO: 3801180 - RNA, 14 nt, Salmonella typhimurium LT2
auaacguuaacgcc

SEQ ID NO: 3801181 - RNA, 20 nt, Salmonella typhimurium LT2
auaacguuaccgcagcgaau

SEQ ID NO: 3801182 - RNA, 15 nt, Salmonella typhimurium LT2
auaacguuguggaau

SEQ ID NO: 3801183 - RNA, 22 nt, Salmonella typhimurium LT2
auaacucgcauugcagcgcagc

SEQ ID NO: 3801184 - RNA, 12 nt, Salmonella typhimurium LT2
auaacucuucau

SEQ ID NO: 3801185 - RNA, 20 nt, Salmonella typhimurium LT2
auaacuuccuuugccuuucu

SEQ ID NO: 3801186 - RNA, 21 nt, Salmonella typhimurium LT2
auaacuuccuuugccuuucuu

SEQ ID NO: 3801187 - RNA, 21 nt, Salmonella typhimurium LT2
auaacuugccgccugccugca

SEQ ID NO: 3801188 - RNA, 16 nt, Salmonella typhimurium LT2
auaagaaagauaaaau

SEQ ID NO: 3801189 - RNA, 15 nt, Salmonella typhimurium LT2
auaagaacuuuauca

SEQ ID NO: 3801190 - RNA, 17 nt, Salmonella typhimurium LT2
auaagaaguaaacagaa

SEQ ID NO: 3801191 - RNA, 16 nt, Salmonella typhimurium LT2
auaagagggcgccaug

SEQ ID NO: 3801192 - RNA, 15 nt, Salmonella typhimurium LT2
auaagagucaggauc

SEQ ID NO: 3801193 - RNA, 21 nt, Salmonella typhimurium LT2
auaagauaggagacgccgccc

SEQ ID NO: 3801194 - RNA, 18 nt, Salmonella typhimurium LT2
auaagcaaacagggggaa

SEQ ID NO: 3801195 - RNA, 18 nt, Salmonella typhimurium LT2
auaagcaaagcgccaucc

SEQ ID NO: 3801196 - RNA, 14 nt, Salmonella typhimurium LT2
auaagcaauuacua

SEQ ID NO: 3801197 - RNA, 18 nt, Salmonella typhimurium LT2
auaagcacaccauuucac

SEQ ID NO: 3801198 - RNA, 21 nt, Salmonella typhimurium LT2
auaagcacaccauuucacaaa

SEQ ID NO: 3801199 - RNA, 20 nt, Salmonella typhimurium LT2
auaagcaccugcgacgcaug

SEQ ID NO: 3801200 - RNA, 11 nt, Salmonella typhimurium LT2
auaagcagaac

SEQ ID NO: 3801201 - RNA, 22 nt, Salmonella typhimurium LT2
auaagcagaacaaacagaccgc

SEQ ID NO: 3801202 - RNA, 17 nt, Salmonella typhimurium LT2
auaagccacuucaacca

SEQ ID NO: 3801203 - RNA, 12 nt, Salmonella typhimurium LT2
auaagccagccc

SEQ ID NO: 3801204 - RNA, 15 nt, Salmonella typhimurium LT2
auaagcgaacaggcc

SEQ ID NO: 3801205 - RNA, 22 nt, Salmonella typhimurium LT2
auaagcgacagcgccauccggc

SEQ ID NO: 3801206 - RNA, 13 nt, Salmonella typhimurium LT2
auaagcgcagcgc

SEQ ID NO: 3801207 - RNA, 21 nt, Salmonella typhimurium LT2
auaagcgcagcgccauccggc

SEQ ID NO: 3801208 - RNA, 21 nt, Salmonella typhimurium LT2
auaagcgccgcgccaucgggc

SEQ ID NO: 3801209 - RNA, 15 nt, Salmonella typhimurium LT2
auaagcgcucaggca

SEQ ID NO: 3801210 - RNA, 13 nt, Salmonella typhimurium LT2
auaagcggcguca

SEQ ID NO: 3801211 - RNA, 17 nt, Salmonella typhimurium LT2
auaagcggcgucauccg

SEQ ID NO: 3801212 - RNA, 20 nt, Salmonella typhimurium LT2
auaagcguagcgcauccggc

SEQ ID NO: 3801213 - RNA, 21 nt, Salmonella typhimurium LT2
auaagcguagcgccaucaggc

SEQ ID NO: 3801214 - RNA, 17 nt, Salmonella typhimurium LT2
auaagcguuaaugcguu

SEQ ID NO: 3801215 - RNA, 13 nt, Salmonella typhimurium LT2
auaagcugaaugg

SEQ ID NO: 3801216 - RNA, 19 nt, Salmonella typhimurium LT2
auaagcugcgacaacaagu

SEQ ID NO: 3801217 - RNA, 22 nt, Salmonella typhimurium LT2
auaagcugggcgucaacgugaa

SEQ ID NO: 3801218 - RNA, 14 nt, Salmonella typhimurium LT2
auaagcuuauaaac

SEQ ID NO: 3801219 - RNA, 21 nt, Salmonella typhimurium LT2
auaaggcaccgaugacaauaa

SEQ ID NO: 3801220 - RNA, 16 nt, Salmonella typhimurium LT2
auaagggccggaaaaa

SEQ ID NO: 3801221 - RNA, 14 nt, Salmonella typhimurium LT2
auaagggcucagca

SEQ ID NO: 3801222 - RNA, 15 nt, Salmonella typhimurium LT2
auaagggcucagcau

SEQ ID NO: 3801223 - RNA, 18 nt, Salmonella typhimurium LT2
auaaggugaaugcguuug

SEQ ID NO: 3801224 - RNA, 12 nt, Salmonella typhimurium LT2
auaauaaaauau

SEQ ID NO: 3801225 - RNA, 13 nt, Salmonella typhimurium LT2
auaauaaaauauu

SEQ ID NO: 3801226 - RNA, 18 nt, Salmonella typhimurium LT2
auaauaaaauauuauuuu

SEQ ID NO: 3801227 - RNA, 12 nt, Salmonella typhimurium LT2
auaauaaauuuu

SEQ ID NO: 3801228 - RNA, 18 nt, Salmonella typhimurium LT2
auaauaaauuuucauuau

SEQ ID NO: 3801229 - RNA, 16 nt, Salmonella typhimurium LT2
auaauaagaauuaccg

SEQ ID NO: 3801230 - RNA, 16 nt, Salmonella typhimurium LT2
auaauaagaucaaagc

SEQ ID NO: 3801231 - RNA, 12 nt, Salmonella typhimurium LT2
auaauaauaucc

SEQ ID NO: 3801232 - RNA, 14 nt, Salmonella typhimurium LT2
auaauaauauccuu

SEQ ID NO: 3801233 - RNA, 19 nt, Salmonella typhimurium LT2
auaauaauauccuuuuugc

SEQ ID NO: 3801234 - RNA, 12 nt, Salmonella typhimurium LT2
auaauaccucaa

SEQ ID NO: 3801235 - RNA, 21 nt, Salmonella typhimurium LT2
auaauaccucaaauauugaau

SEQ ID NO: 3801236 - RNA, 15 nt, Salmonella typhimurium LT2
auaauacgccggcau

SEQ ID NO: 3801237 - RNA, 15 nt, Salmonella typhimurium LT2
auaauagaacccaaa

SEQ ID NO: 3801238 - RNA, 16 nt, Salmonella typhimurium LT2
auaauauccagcacgc

SEQ ID NO: 3801239 - RNA, 13 nt, Salmonella typhimurium LT2
auaauaugcucaa

SEQ ID NO: 3801240 - RNA, 16 nt, Salmonella typhimurium LT2
auaauaugcucaacuu

SEQ ID NO: 3801241 - RNA, 17 nt, Salmonella typhimurium LT2
auaauauguuuauuugc

SEQ ID NO: 3801242 - RNA, 17 nt, Salmonella typhimurium LT2
auaauauuaucagcaau

SEQ ID NO: 3801243 - RNA, 20 nt, Salmonella typhimurium LT2
auaaucaacggucuugccag

SEQ ID NO: 3801244 - RNA, 12 nt, Salmonella typhimurium LT2
auaaucaccacg

SEQ ID NO: 3801245 - RNA, 14 nt, Salmonella typhimurium LT2
auaaucaccacgua

SEQ ID NO: 3801246 - RNA, 17 nt, Salmonella typhimurium LT2
auaaucagcaagaugac

SEQ ID NO: 3801247 - RNA, 14 nt, Salmonella typhimurium LT2
auaaucagcaucac

SEQ ID NO: 3801248 - RNA, 15 nt, Salmonella typhimurium LT2
auaaucaucauaauc

SEQ ID NO: 3801249 - RNA, 12 nt, Salmonella typhimurium LT2
auaauccuuccu

SEQ ID NO: 3801250 - RNA, 20 nt, Salmonella typhimurium LT2
auaauccuuccuuucauuuu

SEQ ID NO: 3801251 - RNA, 18 nt, Salmonella typhimurium LT2
auaauccuuguccaugua

SEQ ID NO: 3801252 - RNA, 17 nt, Salmonella typhimurium LT2
auaaucgauuccuauuu

SEQ ID NO: 3801253 - RNA, 15 nt, Salmonella typhimurium LT2
auaaucgcccacuug

SEQ ID NO: 3801254 - RNA, 17 nt, Salmonella typhimurium LT2
auaaucgccgccagcuc

SEQ ID NO: 3801255 - RNA, 14 nt, Salmonella typhimurium LT2
auaaucgccgccgg

SEQ ID NO: 3801256 - RNA, 16 nt, Salmonella typhimurium LT2
auaaucgcguuuuccu

SEQ ID NO: 3801257 - RNA, 22 nt, Salmonella typhimurium LT2
auaaucgguagcacuuuaaaca

SEQ ID NO: 3801258 - RNA, 15 nt, Salmonella typhimurium LT2
auaaucguguaaucu

SEQ ID NO: 3801259 - RNA, 16 nt, Salmonella typhimurium LT2
auaaugcagccauccu

SEQ ID NO: 3801260 - RNA, 21 nt, Salmonella typhimurium LT2
auaaugcccaccgauuucagc

SEQ ID NO: 3801261 - RNA, 23 nt, Salmonella typhimurium LT2
auaaugccucauuaaaaaaacau

SEQ ID NO: 3801262 - RNA, 14 nt, Salmonella typhimurium LT2
auaaugcgccacca

SEQ ID NO: 3801263 - RNA, 16 nt, Salmonella typhimurium LT2
auaaugcgccaccacu

SEQ ID NO: 3801264 - RNA, 21 nt, Salmonella typhimurium LT2
auaaugcgccuugaguaucaa

SEQ ID NO: 3801265 - RNA, 13 nt, Salmonella typhimurium LT2
auaauggcgccga

SEQ ID NO: 3801266 - RNA, 19 nt, Salmonella typhimurium LT2
auaauggcgccgauaacac

SEQ ID NO: 3801267 - RNA, 19 nt, Salmonella typhimurium LT2
auaauggcgcgaaaacagc

SEQ ID NO: 3801268 - RNA, 19 nt, Salmonella typhimurium LT2
auaaugguggaaugcccca

SEQ ID NO: 3801269 - RNA, 19 nt, Salmonella typhimurium LT2
auaauguaaaaaaauaaaa

SEQ ID NO: 3801270 - RNA, 22 nt, Salmonella typhimurium LT2
auaauguuguccacaaacgccg

SEQ ID NO: 3801271 - RNA, 22 nt, Salmonella typhimurium LT2
auaauuaugccugucaucauca

SEQ ID NO: 3801272 - RNA, 14 nt, Salmonella typhimurium LT2
auaauugauaauaa

SEQ ID NO: 3801273 - RNA, 13 nt, Salmonella typhimurium LT2
auaauugcgcgcg

SEQ ID NO: 3801274 - RNA, 12 nt, Salmonella typhimurium LT2
auaauugcugcc

SEQ ID NO: 3801275 - RNA, 15 nt, Salmonella typhimurium LT2
auaauuucaggcugc

SEQ ID NO: 3801276 - RNA, 19 nt, Salmonella typhimurium LT2
auaauuucguuuuacccau

SEQ ID NO: 3801277 - RNA, 13 nt, Salmonella typhimurium LT2
auacaaaaaagac

SEQ ID NO: 3801278 - RNA, 15 nt, Salmonella typhimurium LT2
auacaaaaaagacag

SEQ ID NO: 3801279 - RNA, 14 nt, Salmonella typhimurium LT2
auacaaaacccaua

SEQ ID NO: 3801280 - RNA, 13 nt, Salmonella typhimurium LT2
auacaaacccagg

SEQ ID NO: 3801281 - RNA, 15 nt, Salmonella typhimurium LT2
auacaaagcagauag

SEQ ID NO: 3801282 - RNA, 14 nt, Salmonella typhimurium LT2
auacacaauacgcc

SEQ ID NO: 3801283 - RNA, 21 nt, Salmonella typhimurium LT2
auacaccagcucccgcgucac

SEQ ID NO: 3801284 - RNA, 11 nt, Salmonella typhimurium LT2
auacaccuuca

SEQ ID NO: 3801285 - RNA, 14 nt, Salmonella typhimurium LT2
auacacgaacacag

SEQ ID NO: 3801286 - RNA, 23 nt, Salmonella typhimurium LT2
auacacgcccucucgccaaauca

SEQ ID NO: 3801287 - RNA, 15 nt, Salmonella typhimurium LT2
auacacgcgacaaug

SEQ ID NO: 3801288 - RNA, 13 nt, Salmonella typhimurium LT2
auacagacagcag

SEQ ID NO: 3801289 - RNA, 11 nt, Salmonella typhimurium LT2
auacagcacgg

SEQ ID NO: 3801290 - RNA, 18 nt, Salmonella typhimurium LT2
auacagcacuucccgcuc

SEQ ID NO: 3801291 - RNA, 14 nt, Salmonella typhimurium LT2
auacagccagcaca

SEQ ID NO: 3801292 - RNA, 15 nt, Salmonella typhimurium LT2
auacagccagcacaa

SEQ ID NO: 3801293 - RNA, 16 nt, Salmonella typhimurium LT2
auacagcgccgcgcag

SEQ ID NO: 3801294 - RNA, 18 nt, Salmonella typhimurium LT2
auacagcggcgcgccaau

SEQ ID NO: 3801295 - RNA, 23 nt, Salmonella typhimurium LT2
auacaggccuggccuucaaucag

SEQ ID NO: 3801296 - RNA, 17 nt, Salmonella typhimurium LT2
auacaggcgcaguugaa

SEQ ID NO: 3801297 - RNA, 23 nt, Salmonella typhimurium LT2
auacaggcguguggcauaaauaa

SEQ ID NO: 3801298 - RNA, 14 nt, Salmonella typhimurium LT2
auacaggcuuaaca

SEQ ID NO: 3801299 - RNA, 11 nt, Salmonella typhimurium LT2
auacauaaauc

SEQ ID NO: 3801300 - RNA, 13 nt, Salmonella typhimurium LT2
auacauaaauccg

SEQ ID NO: 3801301 - RNA, 15 nt, Salmonella typhimurium LT2
auacauaaauccgga

SEQ ID NO: 3801302 - RNA, 16 nt, Salmonella typhimurium LT2
auacauaaauccggau

SEQ ID NO: 3801303 - RNA, 22 nt, Salmonella typhimurium LT2
auacauagcaggccauaaugca

SEQ ID NO: 3801304 - RNA, 18 nt, Salmonella typhimurium LT2
auacauauggaugaggau

SEQ ID NO: 3801305 - RNA, 17 nt, Salmonella typhimurium LT2
auacaucgccacuacca

SEQ ID NO: 3801306 - RNA, 22 nt, Salmonella typhimurium LT2
auacaucugauuaccgguuguu

SEQ ID NO: 3801307 - RNA, 16 nt, Salmonella typhimurium LT2
auacaucuuccuccug

SEQ ID NO: 3801308 - RNA, 13 nt, Salmonella typhimurium LT2
auacauucuguuu

SEQ ID NO: 3801309 - RNA, 22 nt, Salmonella typhimurium LT2
auacauugaguaaauaaaucag

SEQ ID NO: 3801310 - RNA, 20 nt, Salmonella typhimurium LT2
auacauuuuuguaauaaaaa

SEQ ID NO: 3801311 - RNA, 14 nt, Salmonella typhimurium LT2
auaccaaagaacgc

SEQ ID NO: 3801312 - RNA, 21 nt, Salmonella typhimurium LT2
auaccaaagcccgcaaacaga

SEQ ID NO: 3801313 - RNA, 23 nt, Salmonella typhimurium LT2
auaccaagucucaagagugaaca

SEQ ID NO: 3801314 - RNA, 13 nt, Salmonella typhimurium LT2
auaccaauauuaa

SEQ ID NO: 3801315 - RNA, 19 nt, Salmonella typhimurium LT2
auaccaauauuaaagaugc

SEQ ID NO: 3801316 - RNA, 13 nt, Salmonella typhimurium LT2
auaccacaaauuu

SEQ ID NO: 3801317 - RNA, 22 nt, Salmonella typhimurium LT2
auaccacaacaagaauauauuc

SEQ ID NO: 3801318 - RNA, 15 nt, Salmonella typhimurium LT2
auaccacaacagaau

SEQ ID NO: 3801319 - RNA, 17 nt, Salmonella typhimurium LT2
auaccacaucgaccuga

SEQ ID NO: 3801320 - RNA, 17 nt, Salmonella typhimurium LT2
auaccacgcagcggcau

SEQ ID NO: 3801321 - RNA, 20 nt, Salmonella typhimurium LT2
auaccagcccucauuaucca

SEQ ID NO: 3801322 - RNA, 15 nt, Salmonella typhimurium LT2
auaccagcgcggcac

SEQ ID NO: 3801323 - RNA, 21 nt, Salmonella typhimurium LT2
auaccaggcacuugagaaauu

SEQ ID NO: 3801324 - RNA, 19 nt, Salmonella typhimurium LT2
auaccagggcgaugccccc

SEQ ID NO: 3801325 - RNA, 15 nt, Salmonella typhimurium LT2
auaccaguacaacaa

SEQ ID NO: 3801326 - RNA, 16 nt, Salmonella typhimurium LT2
auaccaguacaacaau

SEQ ID NO: 3801327 - RNA, 22 nt, Salmonella typhimurium LT2
auaccauaaaugaaaccucaau

SEQ ID NO: 3801328 - RNA, 14 nt, Salmonella typhimurium LT2
auaccauccccuuu

SEQ ID NO: 3801329 - RNA, 16 nt, Salmonella typhimurium LT2
auaccaugauucauac

SEQ ID NO: 3801330 - RNA, 12 nt, Salmonella typhimurium LT2
auaccaugccgc

SEQ ID NO: 3801331 - RNA, 20 nt, Salmonella typhimurium LT2
auaccaugccgccauuuuau

SEQ ID NO: 3801332 - RNA, 13 nt, Salmonella typhimurium LT2
auacccaaaauaa

SEQ ID NO: 3801333 - RNA, 15 nt, Salmonella typhimurium LT2
auacccaacagcaga

SEQ ID NO: 3801334 - RNA, 22 nt, Salmonella typhimurium LT2
auacccugcggcaaaacagagu

SEQ ID NO: 3801335 - RNA, 20 nt, Salmonella typhimurium LT2
auacccuuccccaucaaaac

SEQ ID NO: 3801336 - RNA, 15 nt, Salmonella typhimurium LT2
auaccgaaauccgcu

SEQ ID NO: 3801337 - RNA, 12 nt, Salmonella typhimurium LT2
auaccgcauuca

SEQ ID NO: 3801338 - RNA, 15 nt, Salmonella typhimurium LT2
auaccgccagcccca

SEQ ID NO: 3801339 - RNA, 18 nt, Salmonella typhimurium LT2
auaccgccugaugagguu

SEQ ID NO: 3801340 - RNA, 17 nt, Salmonella typhimurium LT2
auaccgcguuugcgcaa

SEQ ID NO: 3801341 - RNA, 17 nt, Salmonella typhimurium LT2
auagccauugcugcuau

SEQ ID NO: 3801342 - RNA, 14 nt, Salmonella typhimurium LT2
auagcccagcgugc

SEQ ID NO: 3801343 - RNA, 19 nt, Salmonella typhimurium LT2
auagcccagcgugccugcc

SEQ ID NO: 3801344 - RNA, 18 nt, Salmonella typhimurium LT2
auagcccagucgcacaaa

SEQ ID NO: 3801345 - RNA, 14 nt, Salmonella typhimurium LT2
auagccccaguaaa

SEQ ID NO: 3801346 - RNA, 16 nt, Salmonella typhimurium LT2
auagccccaguaaauu

SEQ ID NO: 3801347 - RNA, 22 nt, Salmonella typhimurium LT2
auagcccggcauguccaucaga

SEQ ID NO: 3801348 - RNA, 15 nt, Salmonella typhimurium LT2
auagcccguuaugcc

SEQ ID NO: 3801349 - RNA, 23 nt, Salmonella typhimurium LT2
auagccggauaauuuauccagua

SEQ ID NO: 3801350 - RNA, 20 nt, Salmonella typhimurium LT2
auagccuacccuuucacccg

SEQ ID NO: 3801351 - RNA, 13 nt, Salmonella typhimurium LT2
auagccugggcaa

SEQ ID NO: 3801352 - RNA, 21 nt, Salmonella typhimurium LT2
auagccuugauccuguaacgc

SEQ ID NO: 3801353 - RNA, 22 nt, Salmonella typhimurium LT2
auagccuuugucgaaauugccg

SEQ ID NO: 3801354 - RNA, 13 nt, Salmonella typhimurium LT2
auagcgauacuga

SEQ ID NO: 3801355 - RNA, 16 nt, Salmonella typhimurium LT2
auagcgcaaacgcgcg

SEQ ID NO: 3801356 - RNA, 18 nt, Salmonella typhimurium LT2
auagcgccacgaguggcg

SEQ ID NO: 3801357 - RNA, 15 nt, Salmonella typhimurium LT2
auagcgccaucagac

SEQ ID NO: 3801358 - RNA, 11 nt, Salmonella typhimurium LT2
auagcgcccca

SEQ ID NO: 3801359 - RNA, 16 nt, Salmonella typhimurium LT2
auagcgccccaaagcg

SEQ ID NO: 3801360 - RNA, 14 nt, Salmonella typhimurium LT2
auagcgcgcuaaac

SEQ ID NO: 3801361 - RNA, 14 nt, Salmonella typhimurium LT2
auagcgcggaauau

SEQ ID NO: 3801362 - RNA, 20 nt, Salmonella typhimurium LT2
auagcgcgucguugucuuug

SEQ ID NO: 3801363 - RNA, 15 nt, Salmonella typhimurium LT2
auagcgcugcgccag

SEQ ID NO: 3801364 - RNA, 21 nt, Salmonella typhimurium LT2
auagcggacuuccuucuaccg

SEQ ID NO: 3801365 - RNA, 14 nt, Salmonella typhimurium LT2
auagcggguaaaca

SEQ ID NO: 3801366 - RNA, 18 nt, Salmonella typhimurium LT2
auagcggugaacuugaag

SEQ ID NO: 3801367 - RNA, 13 nt, Salmonella typhimurium LT2
auagcgucaacgc

SEQ ID NO: 3801368 - RNA, 16 nt, Salmonella typhimurium LT2
auagcguugauaugcu

SEQ ID NO: 3801369 - RNA, 20 nt, Salmonella typhimurium LT2
auagcguugauaugcucgac

SEQ ID NO: 3801370 - RNA, 15 nt, Salmonella typhimurium LT2
auagcguuuuccagc

SEQ ID NO: 3801371 - RNA, 17 nt, Salmonella typhimurium LT2
auagcuaaccagcgagc

SEQ ID NO: 3801372 - RNA, 15 nt, Salmonella typhimurium LT2
auagcuaaugcaaua

SEQ ID NO: 3801373 - RNA, 17 nt, Salmonella typhimurium LT2
auagcuaaugcgguagc

SEQ ID NO: 3801374 - RNA, 15 nt, Salmonella typhimurium LT2
auagcuauauuuuuu

SEQ ID NO: 3801375 - RNA, 23 nt, Salmonella typhimurium LT2
auagcuauauuuuuuaucagacu

SEQ ID NO: 3801376 - RNA, 16 nt, Salmonella typhimurium LT2
auagcugagacucagu

SEQ ID NO: 3801377 - RNA, 17 nt, Salmonella typhimurium LT2
auagcugcugacguaaa

SEQ ID NO: 3801378 - RNA, 19 nt, Salmonella typhimurium LT2
auagcugcugacguaaauu

SEQ ID NO: 3801379 - RNA, 23 nt, Salmonella typhimurium LT2
auagcuggcguagccaguaccga

SEQ ID NO: 3801380 - RNA, 18 nt, Salmonella typhimurium LT2
auagcuggcugucuuccg

SEQ ID NO: 3801381 - RNA, 20 nt, Salmonella typhimurium LT2
auagcuggcuuuauauaaaa

SEQ ID NO: 3801382 - RNA, 18 nt, Salmonella typhimurium LT2
auagcugugagaauucug

SEQ ID NO: 3801383 - RNA, 18 nt, Salmonella typhimurium LT2
auagcuguuccgcaacac

SEQ ID NO: 3801384 - RNA, 13 nt, Salmonella typhimurium LT2
auaggaaaauaau

SEQ ID NO: 3801385 - RNA, 19 nt, Salmonella typhimurium LT2
auaggauguugcugcugcg

SEQ ID NO: 3801386 - RNA, 13 nt, Salmonella typhimurium LT2
auaggccaggcua

SEQ ID NO: 3801387 - RNA, 17 nt, Salmonella typhimurium LT2
auaggcgcaucugaaaa

SEQ ID NO: 3801388 - RNA, 21 nt, Salmonella typhimurium LT2
auaggcucaauaugccaggca

SEQ ID NO: 3801389 - RNA, 16 nt, Salmonella typhimurium LT2
auagggcgcuugcgca

SEQ ID NO: 3801390 - RNA, 20 nt, Salmonella typhimurium LT2
auaggggauaucgcuggccu

SEQ ID NO: 3801391 - RNA, 19 nt, Salmonella typhimurium LT2
auaggugacuuuccuggcu

SEQ ID NO: 3801392 - RNA, 20 nt, Salmonella typhimurium LT2
auagguuaagccaaacucac

SEQ ID NO: 3801393 - RNA, 20 nt, Salmonella typhimurium LT2
auagucaaugcccccgccaa

SEQ ID NO: 3801394 - RNA, 13 nt, Salmonella typhimurium LT2
auagucagcuuaa

SEQ ID NO: 3801395 - RNA, 20 nt, Salmonella typhimurium LT2
auagucauaauacucaauau

SEQ ID NO: 3801396 - RNA, 20 nt, Salmonella typhimurium LT2
auagucaucgccuucauccg

SEQ ID NO: 3801397 - RNA, 15 nt, Salmonella typhimurium LT2
auagucauugacagc

SEQ ID NO: 3801398 - RNA, 16 nt, Salmonella typhimurium LT2
auaguccacuuucugu

SEQ ID NO: 3801399 - RNA, 12 nt, Salmonella typhimurium LT2
auaguccagcag

SEQ ID NO: 3801400 - RNA, 17 nt, Salmonella typhimurium LT2
auagucgccgcggcgca

SEQ ID NO: 3801401 - RNA, 14 nt, Salmonella typhimurium LT2
auagucgcuuuuca

SEQ ID NO: 3801402 - RNA, 14 nt, Salmonella typhimurium LT2
auagucguuaaaac

SEQ ID NO: 3801403 - RNA, 14 nt, Salmonella typhimurium LT2
auagucuccgccac

SEQ ID NO: 3801404 - RNA, 12 nt, Salmonella typhimurium LT2
auagugcagaaa

SEQ ID NO: 3801405 - RNA, 19 nt, Salmonella typhimurium LT2
auagugccgguggcaugaa

SEQ ID NO: 3801406 - RNA, 15 nt, Salmonella typhimurium LT2
auagugcgcuaucau

SEQ ID NO: 3801407 - RNA, 20 nt, Salmonella typhimurium LT2
auaguggcgacaaaagccag

SEQ ID NO: 3801408 - RNA, 22 nt, Salmonella typhimurium LT2
auaguguucauucguuuugcug

SEQ ID NO: 3801409 - RNA, 23 nt, Salmonella typhimurium LT2
auaguuacugucgacaaagccgc

SEQ ID NO: 3801410 - RNA, 15 nt, Salmonella typhimurium LT2
auaguugagcagcgc

SEQ ID NO: 3801411 - RNA, 17 nt, Salmonella typhimurium LT2
auaguuuaaauccagcg

SEQ ID NO: 3801412 - RNA, 18 nt, Salmonella typhimurium LT2
auaguuuuuaauuccacc

SEQ ID NO: 3801413 - RNA, 18 nt, Salmonella typhimurium LT2
auauaaacgcccgaccac

SEQ ID NO: 3801414 - RNA, 21 nt, Salmonella typhimurium LT2
auauaaauuucauccaugcca

SEQ ID NO: 3801415 - RNA, 12 nt, Salmonella typhimurium LT2
auauaacagaau

SEQ ID NO: 3801416 - RNA, 17 nt, Salmonella typhimurium LT2
auauaacagaauaagcc

SEQ ID NO: 3801417 - RNA, 19 nt, Salmonella typhimurium LT2
auauaagcgccgucauccg

SEQ ID NO: 3801418 - RNA, 17 nt, Salmonella typhimurium LT2
auauaaucgcccacuug

SEQ ID NO: 3801419 - RNA, 14 nt, Salmonella typhimurium LT2
auauaaucuaccau

SEQ ID NO: 3801420 - RNA, 23 nt, Salmonella typhimurium LT2
auauacagccuuuugagcagcau

SEQ ID NO: 3801421 - RNA, 15 nt, Salmonella typhimurium LT2
auauacccccugcaa

SEQ ID NO: 3801422 - RNA, 15 nt, Salmonella typhimurium LT2
auauacgccacggcc

SEQ ID NO: 3801423 - RNA, 13 nt, Salmonella typhimurium LT2
auauacuucauca

SEQ ID NO: 3801424 - RNA, 23 nt, Salmonella typhimurium LT2
auauagagcccucuauccacaca

SEQ ID NO: 3801425 - RNA, 14 nt, Salmonella typhimurium LT2
auauagcaaucaua

SEQ ID NO: 3801426 - RNA, 15 nt, Salmonella typhimurium LT2
auauagccauuuaau

SEQ ID NO: 3801427 - RNA, 16 nt, Salmonella typhimurium LT2
auauagccguggcugg

SEQ ID NO: 3801428 - RNA, 17 nt, Salmonella typhimurium LT2
auauagccguggcuggc

SEQ ID NO: 3801429 - RNA, 13 nt, Salmonella typhimurium LT2
auauagcgccaug

SEQ ID NO: 3801430 - RNA, 17 nt, Salmonella typhimurium LT2
auauagcuuuucaugac

SEQ ID NO: 3801431 - RNA, 16 nt, Salmonella typhimurium LT2
auauaggggccaagcg

SEQ ID NO: 3801432 - RNA, 16 nt, Salmonella typhimurium LT2
auauaguccugaugaa

SEQ ID NO: 3801433 - RNA, 22 nt, Salmonella typhimurium LT2
auauaguugagccauuccagcg

SEQ ID NO: 3801434 - RNA, 18 nt, Salmonella typhimurium LT2
auauaguuuuuaccauau

SEQ ID NO: 3801435 - RNA, 13 nt, Salmonella typhimurium LT2
auauauagagcag

SEQ ID NO: 3801436 - RNA, 20 nt, Salmonella typhimurium LT2
auauauccgcuauuaccagu

SEQ ID NO: 3801437 - RNA, 16 nt, Salmonella typhimurium LT2
auauauccuaacuuau

SEQ ID NO: 3801438 - RNA, 12 nt, Salmonella typhimurium LT2
auauaugaaauc

SEQ ID NO: 3801439 - RNA, 20 nt, Salmonella typhimurium LT2
auauaugaaccaagauaaga

SEQ ID NO: 3801440 - RNA, 15 nt, Salmonella typhimurium LT2
auauaugcaaaacug

SEQ ID NO: 3801441 - RNA, 20 nt, Salmonella typhimurium LT2
auauaugcaaaacuguagca

SEQ ID NO: 3801442 - RNA, 13 nt, Salmonella typhimurium LT2
auauauuauugcc

SEQ ID NO: 3801443 - RNA, 17 nt, Salmonella typhimurium LT2
auauauugaccuuguga

SEQ ID NO: 3801444 - RNA, 18 nt, Salmonella typhimurium LT2
auauauuucacuucauca

SEQ ID NO: 3801445 - RNA, 16 nt, Salmonella typhimurium LT2
auauuuuuuccccgcu

SEQ ID NO: 3801446 - RNA, 15 nt, Salmonella typhimurium LT2
aucaaaaaccuuggu

SEQ ID NO: 3801447 - RNA, 15 nt, Salmonella typhimurium LT2
aucaaaaguaucaac

SEQ ID NO: 3801448 - RNA, 19 nt, Salmonella typhimurium LT2
aucaaacaaaccaaacuga

SEQ ID NO: 3801449 - RNA, 23 nt, Salmonella typhimurium LT2
aucaaacucgcccagcgccuucu

SEQ ID NO: 3801450 - RNA, 20 nt, Salmonella typhimurium LT2
aucaaacugaaaaucaaaua

SEQ ID NO: 3801451 - RNA, 21 nt, Salmonella typhimurium LT2
aucaaacuuuuaaauugaaga

SEQ ID NO: 3801452 - RNA, 13 nt, Salmonella typhimurium LT2
aucaaagcgugau

SEQ ID NO: 3801453 - RNA, 22 nt, Salmonella typhimurium LT2
aucaaaggcgucgccgaauaaa

SEQ ID NO: 3801454 - RNA, 17 nt, Salmonella typhimurium LT2
aucaaauaagacaugga

SEQ ID NO: 3801455 - RNA, 17 nt, Salmonella typhimurium LT2
aucaaauaagguggcua

SEQ ID NO: 3801456 - RNA, 16 nt, Salmonella typhimurium LT2
aucaaaugagaauaga

SEQ ID NO: 3801457 - RNA, 19 nt, Salmonella typhimurium LT2
aucaaauuugcccagcacg

SEQ ID NO: 3801458 - RNA, 18 nt, Salmonella typhimurium LT2
aucaacaccagcagcgcg

SEQ ID NO: 3801459 - RNA, 19 nt, Salmonella typhimurium LT2
aucaacagcggagagacau

SEQ ID NO: 3801460 - RNA, 14 nt, Salmonella typhimurium LT2
aucaaccaccuuca

SEQ ID NO: 3801461 - RNA, 12 nt, Salmonella typhimurium LT2
aucaaccgguuu

SEQ ID NO: 3801462 - RNA, 18 nt, Salmonella typhimurium LT2
aucaacgccauaauccac

SEQ ID NO: 3801463 - RNA, 17 nt, Salmonella typhimurium LT2
aucaacgccgcgccauc

SEQ ID NO: 3801464 - RNA, 17 nt, Salmonella typhimurium LT2
aucaacgccuccaggcu

SEQ ID NO: 3801465 - RNA, 14 nt, Salmonella typhimurium LT2
aucaacuccuccgg

SEQ ID NO: 3801466 - RNA, 14 nt, Salmonella typhimurium LT2
aucaacucuccuuu

SEQ ID NO: 3801467 - RNA, 20 nt, Salmonella typhimurium LT2
aucaacuucguucaguucca

SEQ ID NO: 3801468 - RNA, 13 nt, Salmonella typhimurium LT2
aucaagaaaacug

SEQ ID NO: 3801469 - RNA, 23 nt, Salmonella typhimurium LT2
aucaagagauaucccaucgacuu

SEQ ID NO: 3801470 - RNA, 17 nt, Salmonella typhimurium LT2
aucaagauugaguccau

SEQ ID NO: 3801471 - RNA, 13 nt, Salmonella typhimurium LT2
aucaagcccagcu

SEQ ID NO: 3801472 - RNA, 15 nt, Salmonella typhimurium LT2
aucaagcccauguuc

SEQ ID NO: 3801473 - RNA, 20 nt, Salmonella typhimurium LT2
aucaagcuuugcguaaaaaa

SEQ ID NO: 3801474 - RNA, 21 nt, Salmonella typhimurium LT2
aucaagcuuugcguaaaaaaa

SEQ ID NO: 3801475 - RNA, 14 nt, Salmonella typhimurium LT2
aucaauaaaauuau

SEQ ID NO: 3801476 - RNA, 17 nt, Salmonella typhimurium LT2
aucaauaaaauuaucca

SEQ ID NO: 3801477 - RNA, 22 nt, Salmonella typhimurium LT2
aucaauaaagccgcauuuuucc

SEQ ID NO: 3801478 - RNA, 22 nt, Salmonella typhimurium LT2
aucaauaagcgaauugccgucg

SEQ ID NO: 3801479 - RNA, 21 nt, Salmonella typhimurium LT2
aucaauacagagauauuaaaa

SEQ ID NO: 3801480 - RNA, 9 nt, Salmonella typhimurium LT2
aucaauacg

SEQ ID NO: 3801481 - RNA, 18 nt, Salmonella typhimurium LT2
aucaauagcaagggcaag

SEQ ID NO: 3801482 - RNA, 16 nt, Salmonella typhimurium LT2
aucaaucaccaccagg

SEQ ID NO: 3801483 - RNA, 17 nt, Salmonella typhimurium LT2
aucaaucgcuaucugac

SEQ ID NO: 3801484 - RNA, 17 nt, Salmonella typhimurium LT2
aucaaugcaucuucacu

SEQ ID NO: 3801485 - RNA, 14 nt, Salmonella typhimurium LT2
aucaaugcgaugau

SEQ ID NO: 3801486 - RNA, 15 nt, Salmonella typhimurium LT2
aucaaugucugaugg

SEQ ID NO: 3801487 - RNA, 15 nt, Salmonella typhimurium LT2
aucaauuccuacaau

SEQ ID NO: 3801488 - RNA, 16 nt, Salmonella typhimurium LT2
aucaauuuuaauuuaa

SEQ ID NO: 3801489 - RNA, 17 nt, Salmonella typhimurium LT2
aucaauuuuaauuuaau

SEQ ID NO: 3801490 - RNA, 19 nt, Salmonella typhimurium LT2
aucaauuuuaauuuaauaa

SEQ ID NO: 3801491 - RNA, 21 nt, Salmonella typhimurium LT2
aucaauuuuaauuuaauaaua

SEQ ID NO: 3801492 - RNA, 24 nt, Salmonella typhimurium LT2
aucaauuuuaauuuaauaauaaau

SEQ ID NO: 3801493 - RNA, 12 nt, Salmonella typhimurium LT2
aucaauuuuucg

SEQ ID NO: 3801494 - RNA, 19 nt, Salmonella typhimurium LT2
aucaauuuuucgcccgguu

SEQ ID NO: 3801495 - RNA, 19 nt, Salmonella typhimurium LT2
aucacaacgucaucccgaa

SEQ ID NO: 3801496 - RNA, 19 nt, Salmonella typhimurium LT2
aucacaagcuguuucuccg

SEQ ID NO: 3801497 - RNA, 21 nt, Salmonella typhimurium LT2
aucacaaucagccacggcaac

SEQ ID NO: 3801498 - RNA, 13 nt, Salmonella typhimurium LT2
aucacacaaguca

SEQ ID NO: 3801499 - RNA, 17 nt, Salmonella typhimurium LT2
aucacacugacaauaaa

SEQ ID NO: 3801500 - RNA, 15 nt, Salmonella typhimurium LT2
aucacagacagaugc

SEQ ID NO: 3801501 - RNA, 22 nt, Salmonella typhimurium LT2
aucacaggggucaucggcacgu

SEQ ID NO: 3801502 - RNA, 18 nt, Salmonella typhimurium LT2
aucacaucgcgcagcagg

SEQ ID NO: 3801503 - RNA, 16 nt, Salmonella typhimurium LT2
aucaccaaguagacag

SEQ ID NO: 3801504 - RNA, 22 nt, Salmonella typhimurium LT2
aucaccacguaacucggcagcg

SEQ ID NO: 3801505 - RNA, 15 nt, Salmonella typhimurium LT2
aucaccagcaccgcc

SEQ ID NO: 3801506 - RNA, 17 nt, Salmonella typhimurium LT2
aucaccagcaccgccag

SEQ ID NO: 3801507 - RNA, 20 nt, Salmonella typhimurium LT2
aucaccagcccgaauccacu

SEQ ID NO: 3801508 - RNA, 14 nt, Salmonella typhimurium LT2
aucaccagccgauc

SEQ ID NO: 3801509 - RNA, 13 nt, Salmonella typhimurium LT2
aucaccaucccau

SEQ ID NO: 3801510 - RNA, 17 nt, Salmonella typhimurium LT2
aucaccauucccagcgc

SEQ ID NO: 3801511 - RNA, 17 nt, Salmonella typhimurium LT2
aucacccaacguucaug

SEQ ID NO: 3801512 - RNA, 12 nt, Salmonella typhimurium LT2
aucacccgcuuc

SEQ ID NO: 3801513 - RNA, 13 nt, Salmonella typhimurium LT2
aucaccggcagau

SEQ ID NO: 3801514 - RNA, 17 nt, Salmonella typhimurium LT2
aucaccggcauuucacc

SEQ ID NO: 3801515 - RNA, 14 nt, Salmonella typhimurium LT2
aucaccuccagcac

SEQ ID NO: 3801516 - RNA, 23 nt, Salmonella typhimurium LT2
aucaccugcuggcggcguaagcg

SEQ ID NO: 3801517 - RNA, 17 nt, Salmonella typhimurium LT2
aucacgcauaucccacu

SEQ ID NO: 3801518 - RNA, 13 nt, Salmonella typhimurium LT2
aucacgcaucacu

SEQ ID NO: 3801519 - RNA, 16 nt, Salmonella typhimurium LT2
aucacgccgaugacca

SEQ ID NO: 3801520 - RNA, 17 nt, Salmonella typhimurium LT2
aucacgccguccagcac

SEQ ID NO: 3801521 - RNA, 23 nt, Salmonella typhimurium LT2
aucacgcugggcgaauacccagc

SEQ ID NO: 3801522 - RNA, 21 nt, Salmonella typhimurium LT2
aucacggguuuuacuggcgcg

SEQ ID NO: 3801523 - RNA, 22 nt, Salmonella typhimurium LT2
aucacgguacgcaucaccaggc

SEQ ID NO: 3801524 - RNA, 18 nt, Salmonella typhimurium LT2
aucacguuuugcagcgcc

SEQ ID NO: 3801525 - RNA, 22 nt, Salmonella typhimurium LT2
aucacguuuuuuacgucagcaa

SEQ ID NO: 3801526 - RNA, 14 nt, Salmonella typhimurium LT2
aucacuaauuugcg

SEQ ID NO: 3801527 - RNA, 19 nt, Salmonella typhimurium LT2
aucacuauuugugcggcau

SEQ ID NO: 3801528 - RNA, 21 nt, Salmonella typhimurium LT2
aucacuggagcgcauuuuacu

SEQ ID NO: 3801529 - RNA, 23 nt, Salmonella typhimurium LT2
aucacuggagcgcauuuuacugc

SEQ ID NO: 3801530 - RNA, 13 nt, Salmonella typhimurium LT2
aucacuuccgcca

SEQ ID NO: 3801531 - RNA, 20 nt, Salmonella typhimurium LT2
aucacuuccgccaccacgcc

SEQ ID NO: 3801532 - RNA, 13 nt, Salmonella typhimurium LT2
aucacuuucaguu

SEQ ID NO: 3801533 - RNA, 16 nt, Salmonella typhimurium LT2
aucacuuuugccguca

SEQ ID NO: 3801534 - RNA, 14 nt, Salmonella typhimurium LT2
aucagaaaaaauua

SEQ ID NO: 3801535 - RNA, 23 nt, Salmonella typhimurium LT2
aucagaacaaacuuaucccacaa

SEQ ID NO: 3801536 - RNA, 15 nt, Salmonella typhimurium LT2
aucagaagaagacaa

SEQ ID NO: 3801537 - RNA, 14 nt, Salmonella typhimurium LT2
aucagaauaaugcu

SEQ ID NO: 3801538 - RNA, 17 nt, Salmonella typhimurium LT2
aucagaauuucgcccug

SEQ ID NO: 3801539 - RNA, 23 nt, Salmonella typhimurium LT2
aucagaauuucgcccuguauaca

SEQ ID NO: 3801540 - RNA, 17 nt, Salmonella typhimurium LT2
aucagacauuguugcgu

SEQ ID NO: 3801541 - RNA, 16 nt, Salmonella typhimurium LT2
aucagaccgacaaaac

SEQ ID NO: 3801542 - RNA, 18 nt, Salmonella typhimurium LT2
aucagaccgagacccagc

SEQ ID NO: 3801543 - RNA, 16 nt, Salmonella typhimurium LT2
aucagaccgauaaaua

SEQ ID NO: 3801544 - RNA, 14 nt, Salmonella typhimurium LT2
aucagaccugccug

SEQ ID NO: 3801545 - RNA, 14 nt, Salmonella typhimurium LT2
aucagacuaucuuc

SEQ ID NO: 3801546 - RNA, 16 nt, Salmonella typhimurium LT2
aucagacuguuacgcu

SEQ ID NO: 3801547 - RNA, 22 nt, Salmonella typhimurium LT2
aucagacuuuggauaaagccaa

SEQ ID NO: 3801548 - RNA, 14 nt, Salmonella typhimurium LT2
aucagagacaaaua

SEQ ID NO: 3801549 - RNA, 22 nt, Salmonella typhimurium LT2
aucaucgccgauuucuucuggc

SEQ ID NO: 3801550 - RNA, 19 nt, Salmonella typhimurium LT2
aucaucgcuuaacggccca

SEQ ID NO: 3801551 - RNA, 16 nt, Salmonella typhimurium LT2
aucaucggcacagcca

SEQ ID NO: 3801552 - RNA, 15 nt, Salmonella typhimurium LT2
aucaucguaccaaua

SEQ ID NO: 3801553 - RNA, 19 nt, Salmonella typhimurium LT2
aucaucuauagccugcugg

SEQ ID NO: 3801554 - RNA, 12 nt, Salmonella typhimurium LT2
aucaucuucacu

SEQ ID NO: 3801555 - RNA, 16 nt, Salmonella typhimurium LT2
aucaucuucacuucac

SEQ ID NO: 3801556 - RNA, 19 nt, Salmonella typhimurium LT2
aucaucuucacuucacaaa

SEQ ID NO: 3801557 - RNA, 14 nt, Salmonella typhimurium LT2
aucaucuuuaucca

SEQ ID NO: 3801558 - RNA, 11 nt, Salmonella typhimurium LT2
aucaugacacu

SEQ ID NO: 3801559 - RNA, 15 nt, Salmonella typhimurium LT2
aucaugccagccgac

SEQ ID NO: 3801560 - RNA, 17 nt, Salmonella typhimurium LT2
aucaugcuaaaagcgac

SEQ ID NO: 3801561 - RNA, 23 nt, Salmonella typhimurium LT2
aucaugcuaaaagcgacuucacc

SEQ ID NO: 3801562 - RNA, 14 nt, Salmonella typhimurium LT2
aucaugcugcaccg

SEQ ID NO: 3801563 - RNA, 20 nt, Salmonella typhimurium LT2
aucaugcugcaccgcaucaa

SEQ ID NO: 3801564 - RNA, 13 nt, Salmonella typhimurium LT2
aucaugcuugcaa

SEQ ID NO: 3801565 - RNA, 14 nt, Salmonella typhimurium LT2
aucauggcucagau

SEQ ID NO: 3801566 - RNA, 19 nt, Salmonella typhimurium LT2
aucauggcucagauugaac

SEQ ID NO: 3801567 - RNA, 19 nt, Salmonella typhimurium LT2
aucaugggcucaucaaaca

SEQ ID NO: 3801568 - RNA, 16 nt, Salmonella typhimurium LT2
aucaugucaaauucaa

SEQ ID NO: 3801569 - RNA, 17 nt, Salmonella typhimurium LT2
aucaugucacccacgcc

SEQ ID NO: 3801570 - RNA, 16 nt, Salmonella typhimurium LT2
aucauguuuuucuccc

SEQ ID NO: 3801571 - RNA, 13 nt, Salmonella typhimurium LT2
aucauuacaggcg

SEQ ID NO: 3801572 - RNA, 22 nt, Salmonella typhimurium LT2
aucauuaccuacgcgauaaaaa

SEQ ID NO: 3801573 - RNA, 17 nt, Salmonella typhimurium LT2
aucauucaacgcaucaa

SEQ ID NO: 3801574 - RNA, 18 nt, Salmonella typhimurium LT2
aucauucaacgcaucaaa

SEQ ID NO: 3801575 - RNA, 12 nt, Salmonella typhimurium LT2
aucauucaucuc

SEQ ID NO: 3801576 - RNA, 16 nt, Salmonella typhimurium LT2
aucauucccgcccagu

SEQ ID NO: 3801577 - RNA, 12 nt, Salmonella typhimurium LT2
cacccugccccg

SEQ ID NO: 3801578 - RNA, 22 nt, Salmonella typhimurium LT2
cacccuucuucuggcucagacc

SEQ ID NO: 3801579 - RNA, 17 nt, Salmonella typhimurium LT2
cacccuugcggcuugca

SEQ ID NO: 3801580 - RNA, 18 nt, Salmonella typhimurium LT2
cacccuuugcagcgcgau

SEQ ID NO: 3801581 - RNA, 22 nt, Salmonella typhimurium LT2
caccgaaagaccaacagaaggc

SEQ ID NO: 3801582 - RNA, 11 nt, Salmonella typhimurium LT2
caccgacagca

SEQ ID NO: 3801583 - RNA, 22 nt, Salmonella typhimurium LT2
caccgacguuggcgauuacuau

SEQ ID NO: 3801584 - RNA, 22 nt, Salmonella typhimurium LT2
caccgacucccccagauucuga

SEQ ID NO: 3801585 - RNA, 12 nt, Salmonella typhimurium LT2
caccgacuccuc

SEQ ID NO: 3801586 - RNA, 18 nt, Salmonella typhimurium LT2
caccgauaaacgccagcg

SEQ ID NO: 3801587 - RNA, 16 nt, Salmonella typhimurium LT2
caccgauccaauauua

SEQ ID NO: 3801588 - RNA, 23 nt, Salmonella typhimurium LT2
caccgauccgaagaacagauuca

SEQ ID NO: 3801589 - RNA, 16 nt, Salmonella typhimurium LT2
caccgcaaauucgucg

SEQ ID NO: 3801590 - RNA, 22 nt, Salmonella typhimurium LT2
caccgcaaauucgucgccgcca

SEQ ID NO: 3801591 - RNA, 16 nt, Salmonella typhimurium LT2
caccgcauagacgugc

SEQ ID NO: 3801592 - RNA, 15 nt, Salmonella typhimurium LT2
caccgcaucgcgccc

SEQ ID NO: 3801593 - RNA, 15 nt, Salmonella typhimurium LT2
caccgccaaacgcgg

SEQ ID NO: 3801594 - RNA, 18 nt, Salmonella typhimurium LT2
caccgccagacgccccaa

SEQ ID NO: 3801595 - RNA, 15 nt, Salmonella typhimurium LT2
caccgccagagcacg

SEQ ID NO: 3801596 - RNA, 13 nt, Salmonella typhimurium LT2
caccgccagcagu

SEQ ID NO: 3801597 - RNA, 14 nt, Salmonella typhimurium LT2
caccgccagcagua

SEQ ID NO: 3801598 - RNA, 17 nt, Salmonella typhimurium LT2
caccgccagcauaucca

SEQ ID NO: 3801599 - RNA, 16 nt, Salmonella typhimurium LT2
caccgccagcgccgcg

SEQ ID NO: 3801600 - RNA, 13 nt, Salmonella typhimurium LT2
caccgccagcguc

SEQ ID NO: 3801601 - RNA, 14 nt, Salmonella typhimurium LT2
caccgccagcgucu

SEQ ID NO: 3801602 - RNA, 18 nt, Salmonella typhimurium LT2
caccgccagucccagcac

SEQ ID NO: 3801603 - RNA, 15 nt, Salmonella typhimurium LT2
caccgcccgccgggc

SEQ ID NO: 3801604 - RNA, 23 nt, Salmonella typhimurium LT2
caccgccggacaguucgccaacg

SEQ ID NO: 3801605 - RNA, 23 nt, Salmonella typhimurium LT2
caccgccguaaagggaaggucau

SEQ ID NO: 3801606 - RNA, 17 nt, Salmonella typhimurium LT2
caccgccuugacaggaa

SEQ ID NO: 3801607 - RNA, 20 nt, Salmonella typhimurium LT2
caccgcgaugaccaucaaau

SEQ ID NO: 3801608 - RNA, 20 nt, Salmonella typhimurium LT2
caccgcggagaucgcucccg

SEQ ID NO: 3801609 - RNA, 22 nt, Salmonella typhimurium LT2
caccgcggagaucgcucccgcg

SEQ ID NO: 3801610 - RNA, 20 nt, Salmonella typhimurium LT2
caccgcggcaaccagcccau

SEQ ID NO: 3801611 - RNA, 22 nt, Salmonella typhimurium LT2
caccgcgucguuacgcucguca

SEQ ID NO: 3801612 - RNA, 20 nt, Salmonella typhimurium LT2
caccgcuaaaaaacaggcgc

SEQ ID NO: 3801613 - RNA, 18 nt, Salmonella typhimurium LT2
caccgcuaaucccagcgc

SEQ ID NO: 3801614 - RNA, 23 nt, Salmonella typhimurium LT2
caccgcuaaucccagcgcgcgcg

SEQ ID NO: 3801615 - RNA, 18 nt, Salmonella typhimurium LT2
caccgcuaccugcccuuu

SEQ ID NO: 3801616 - RNA, 21 nt, Salmonella typhimurium LT2
caccgcuucacauacccgcuu

SEQ ID NO: 3801617 - RNA, 20 nt, Salmonella typhimurium LT2
caccggaauggucgcgccag

SEQ ID NO: 3801618 - RNA, 14 nt, Salmonella typhimurium LT2
caccggauacccag

SEQ ID NO: 3801619 - RNA, 15 nt, Salmonella typhimurium LT2
caccggaugauucag

SEQ ID NO: 3801620 - RNA, 21 nt, Salmonella typhimurium LT2
caccggcagcgucguccagcc

SEQ ID NO: 3801621 - RNA, 22 nt, Salmonella typhimurium LT2
caccggcagcgucguccagccc

SEQ ID NO: 3801622 - RNA, 22 nt, Salmonella typhimurium LT2
caccggccccggaauggcgaac

SEQ ID NO: 3801623 - RNA, 14 nt, Salmonella typhimurium LT2
caccggcgcgccag

SEQ ID NO: 3801624 - RNA, 12 nt, Salmonella typhimurium LT2
caccggcggcca

SEQ ID NO: 3801625 - RNA, 18 nt, Salmonella typhimurium LT2
caccgggcaggauacggc

SEQ ID NO: 3801626 - RNA, 16 nt, Salmonella typhimurium LT2
caccgggguucagacc

SEQ ID NO: 3801627 - RNA, 17 nt, Salmonella typhimurium LT2
caccgggguucagacca

SEQ ID NO: 3801628 - RNA, 20 nt, Salmonella typhimurium LT2
caccggguccagucgcgccg

SEQ ID NO: 3801629 - RNA, 21 nt, Salmonella typhimurium LT2
caccgguuaacauaugggcaa

SEQ ID NO: 3801630 - RNA, 16 nt, Salmonella typhimurium LT2
caccgguuuuuuccug

SEQ ID NO: 3801631 - RNA, 18 nt, Salmonella typhimurium LT2
caccgguuuuuuccugca

SEQ ID NO: 3801632 - RNA, 14 nt, Salmonella typhimurium LT2
caccgucuugcugc

SEQ ID NO: 3801633 - RNA, 16 nt, Salmonella typhimurium LT2
caccguuauccggcaa

SEQ ID NO: 3801634 - RNA, 14 nt, Salmonella typhimurium LT2
caccguuauuucca

SEQ ID NO: 3801635 - RNA, 19 nt, Salmonella typhimurium LT2
caccguuuaaucgcccugc

SEQ ID NO: 3801636 - RNA, 20 nt, Salmonella typhimurium LT2
caccguuuuucaucaagaga

SEQ ID NO: 3801637 - RNA, 15 nt, Salmonella typhimurium LT2
caccuaacccaccau

SEQ ID NO: 3801638 - RNA, 16 nt, Salmonella typhimurium LT2
caccuaacccaccaua

SEQ ID NO: 3801639 - RNA, 21 nt, Salmonella typhimurium LT2
caccuacccucaacgcgccca

SEQ ID NO: 3801640 - RNA, 17 nt, Salmonella typhimurium LT2
caccucaucccccagcc

SEQ ID NO: 3801641 - RNA, 17 nt, Salmonella typhimurium LT2
caccuccagcgaggccu

SEQ ID NO: 3801642 - RNA, 15 nt, Salmonella typhimurium LT2
caccuccaguucagu

SEQ ID NO: 3801643 - RNA, 15 nt, Salmonella typhimurium LT2
caccucuuccagcgu

SEQ ID NO: 3801644 - RNA, 15 nt, Salmonella typhimurium LT2
caccucuuccgccag

SEQ ID NO: 3801645 - RNA, 19 nt, Salmonella typhimurium LT2
caccucuuccgccaggucg

SEQ ID NO: 3801646 - RNA, 16 nt, Salmonella typhimurium LT2
caccugaauaacccgc

SEQ ID NO: 3801647 - RNA, 12 nt, Salmonella typhimurium LT2
caccugaauauc

SEQ ID NO: 3801648 - RNA, 16 nt, Salmonella typhimurium LT2
caccugaauauccuga

SEQ ID NO: 3801649 - RNA, 15 nt, Salmonella typhimurium LT2
caccugacggcagcc

SEQ ID NO: 3801650 - RNA, 21 nt, Salmonella typhimurium LT2
caccugauuaccuaccagcgc

SEQ ID NO: 3801651 - RNA, 19 nt, Salmonella typhimurium LT2
caccugcaucacgcccggc

SEQ ID NO: 3801652 - RNA, 14 nt, Salmonella typhimurium LT2
caccugcaugggga

SEQ ID NO: 3801653 - RNA, 18 nt, Salmonella typhimurium LT2
caccugccaguccgcccg

SEQ ID NO: 3801654 - RNA, 14 nt, Salmonella typhimurium LT2
caccugcucaggcu

SEQ ID NO: 3801655 - RNA, 20 nt, Salmonella typhimurium LT2
caccugcuguugcggaauac

SEQ ID NO: 3801656 - RNA, 17 nt, Salmonella typhimurium LT2
caccuggaugcugccug

SEQ ID NO: 3801657 - RNA, 18 nt, Salmonella typhimurium LT2
caccuggaugcugccugc

SEQ ID NO: 3801658 - RNA, 21 nt, Salmonella typhimurium LT2
caccuggucuauucguucucu

SEQ ID NO: 3801659 - RNA, 23 nt, Salmonella typhimurium LT2
caccuggucuauucguucucuga

SEQ ID NO: 3801660 - RNA, 21 nt, Salmonella typhimurium LT2
caccuguccgguguccaucag

SEQ ID NO: 3801661 - RNA, 22 nt, Salmonella typhimurium LT2
caccuguccgguguccaucagg

SEQ ID NO: 3801662 - RNA, 15 nt, Salmonella typhimurium LT2
caccuuacccggcgu

SEQ ID NO: 3801663 - RNA, 15 nt, Salmonella typhimurium LT2
caccuuauccggccu

SEQ ID NO: 3801664 - RNA, 12 nt, Salmonella typhimurium LT2
caccuucaucau

SEQ ID NO: 3801665 - RNA, 15 nt, Salmonella typhimurium LT2
caccuuccacuuuca

SEQ ID NO: 3801666 - RNA, 22 nt, Salmonella typhimurium LT2
caccuucggucccaucgcgcca

SEQ ID NO: 3801667 - RNA, 23 nt, Salmonella typhimurium LT2
caccuuuacuuaauucugcugcc

SEQ ID NO: 3801668 - RNA, 21 nt, Salmonella typhimurium LT2
caccuuugaaaaucacaucgc

SEQ ID NO: 3801669 - RNA, 22 nt, Salmonella typhimurium LT2
caccuuugaacgucgcugauag

SEQ ID NO: 3801670 - RNA, 13 nt, Salmonella typhimurium LT2
caccuuugacgcc

SEQ ID NO: 3801671 - RNA, 19 nt, Salmonella typhimurium LT2
cacgaacgggaucaugauu

SEQ ID NO: 3801672 - RNA, 14 nt, Salmonella typhimurium LT2
cacgaacugcugcc

SEQ ID NO: 3801673 - RNA, 15 nt, Salmonella typhimurium LT2
cacgaaggaaacgcc

SEQ ID NO: 3801674 - RNA, 17 nt, Salmonella typhimurium LT2
cacgaaggaaacgccag

SEQ ID NO: 3801675 - RNA, 19 nt, Salmonella typhimurium LT2
cacgaaguaccacuaacag

SEQ ID NO: 3801676 - RNA, 13 nt, Salmonella typhimurium LT2
cacgaaucaggau

SEQ ID NO: 3801677 - RNA, 22 nt, Salmonella typhimurium LT2
cacgaauuuggucguaagaauu

SEQ ID NO: 3801678 - RNA, 14 nt, Salmonella typhimurium LT2
cacgacagaacccg

SEQ ID NO: 3801679 - RNA, 14 nt, Salmonella typhimurium LT2
cacgaccagcgaca

SEQ ID NO: 3801680 - RNA, 13 nt, Salmonella typhimurium LT2
cacgacgccgccg

SEQ ID NO: 3801681 - RNA, 15 nt, Salmonella typhimurium LT2
cacgacggugcuaua

SEQ ID NO: 3801682 - RNA, 22 nt, Salmonella typhimurium LT2
cacgacuaucguuacccuauuu

SEQ ID NO: 3801683 - RNA, 13 nt, Salmonella typhimurium LT2
cacgacuuuuccu

SEQ ID NO: 3801684 - RNA, 23 nt, Salmonella typhimurium LT2
cacgacuuuuccuuccgccgcaa

SEQ ID NO: 3801685 - RNA, 14 nt, Salmonella typhimurium LT2
cacgagccuucugg

SEQ ID NO: 3801686 - RNA, 21 nt, Salmonella typhimurium LT2
cacgagccuucuggccaaagc

SEQ ID NO: 3801687 - RNA, 17 nt, Salmonella typhimurium LT2
cacgagcggucaggcca

SEQ ID NO: 3801688 - RNA, 12 nt, Salmonella typhimurium LT2
cacgauaaagac

SEQ ID NO: 3801689 - RNA, 18 nt, Salmonella typhimurium LT2
cacgauaaauugccugau

SEQ ID NO: 3801690 - RNA, 17 nt, Salmonella typhimurium LT2
cacgauacgucccugcu

SEQ ID NO: 3801691 - RNA, 22 nt, Salmonella typhimurium LT2
cacgaucgaugcccugugcaau

SEQ ID NO: 3801692 - RNA, 20 nt, Salmonella typhimurium LT2
cacgaucuugucacaauaac

SEQ ID NO: 3801693 - RNA, 15 nt, Salmonella typhimurium LT2
cacgaugcauaugca

SEQ ID NO: 3801694 - RNA, 19 nt, Salmonella typhimurium LT2
cacgauguucaacgucagc

SEQ ID NO: 3801695 - RNA, 21 nt, Salmonella typhimurium LT2
cacgcaaaaaagcccguccgu

SEQ ID NO: 3801696 - RNA, 13 nt, Salmonella typhimurium LT2
cacgcaacaacag

SEQ ID NO: 3801697 - RNA, 17 nt, Salmonella typhimurium LT2
cacgcaacaacaggcca

SEQ ID NO: 3801698 - RNA, 19 nt, Salmonella typhimurium LT2
cacgcacgacggugcuaua

SEQ ID NO: 3801699 - RNA, 19 nt, Salmonella typhimurium LT2
cacgcagauaucuuccagc

SEQ ID NO: 3801700 - RNA, 12 nt, Salmonella typhimurium LT2
cacgcagccaug

SEQ ID NO: 3801701 - RNA, 14 nt, Salmonella typhimurium LT2
cacgcaggcucucg

SEQ ID NO: 3801702 - RNA, 19 nt, Salmonella typhimurium LT2
cacgcagggggucgcgggu

SEQ ID NO: 3801703 - RNA, 15 nt, Salmonella typhimurium LT2
cacgcaguccaacaa

SEQ ID NO: 3801704 - RNA, 16 nt, Salmonella typhimurium LT2
cacgcaguccaacaag

SEQ ID NO: 3801705 - RNA, 14 nt, Salmonella typhimurium LT2
cacgcauaucccac

SEQ ID NO: 3801706 - RNA, 22 nt, Salmonella typhimurium LT2
cacgcauaucccacugcacgcc

SEQ ID NO: 3801707 - RNA, 19 nt, Salmonella typhimurium LT2
cacgcaucgggucgcgugc

SEQ ID NO: 3801708 - RNA, 17 nt, Salmonella typhimurium LT2
cacgcauggaaauaaag

SEQ ID NO: 3801709 - RNA, 18 nt, Salmonella typhimurium LT2
cacgccagauaaaucagc

SEQ ID NO: 3801710 - RNA, 19 nt, Salmonella typhimurium LT2
cacgccagauaaaucagcc

SEQ ID NO: 3801711 - RNA, 22 nt, Salmonella typhimurium LT2
cacgccagcuuggguauagagc

SEQ ID NO: 3801712 - RNA, 14 nt, Salmonella typhimurium LT2
cacgccaguucaug

SEQ ID NO: 3801713 - RNA, 16 nt, Salmonella typhimurium LT2
cacgccaucgccugau

SEQ ID NO: 3801714 - RNA, 13 nt, Salmonella typhimurium LT2
cacgccaucgcgg

SEQ ID NO: 3801715 - RNA, 15 nt, Salmonella typhimurium LT2
cacgccauugcuguc

SEQ ID NO: 3801716 - RNA, 20 nt, Salmonella typhimurium LT2
cacgcccgccaucgccgccu

SEQ ID NO: 3801717 - RNA, 18 nt, Salmonella typhimurium LT2
cacgcccggaugcgcaau

SEQ ID NO: 3801718 - RNA, 15 nt, Salmonella typhimurium LT2
cacgcccugaagggc

SEQ ID NO: 3801719 - RNA, 22 nt, Salmonella typhimurium LT2
cacgcccugaagggcggcugga

SEQ ID NO: 3801720 - RNA, 18 nt, Salmonella typhimurium LT2
cacgccgacgacaggcag

SEQ ID NO: 3801721 - RNA, 19 nt, Salmonella typhimurium LT2
cacgccgacgcauccgcca

SEQ ID NO: 3801722 - RNA, 23 nt, Salmonella typhimurium LT2
cacgccgaugguugccagaccau

SEQ ID NO: 3801723 - RNA, 19 nt, Salmonella typhimurium LT2
cacgccgccauccggcaac

SEQ ID NO: 3801724 - RNA, 12 nt, Salmonella typhimurium LT2
cacgccgcgcug

SEQ ID NO: 3801725 - RNA, 21 nt, Salmonella typhimurium LT2
cacgccgcuaucgaccagcac

SEQ ID NO: 3801726 - RNA, 21 nt, Salmonella typhimurium LT2
cacgccggaaucgcgauccag

SEQ ID NO: 3801727 - RNA, 18 nt, Salmonella typhimurium LT2
cacgccggagagcgcguu

SEQ ID NO: 3801728 - RNA, 17 nt, Salmonella typhimurium LT2
cacgccggcaaucccuu

SEQ ID NO: 3801729 - RNA, 14 nt, Salmonella typhimurium LT2
cacgccguccagca

SEQ ID NO: 3801730 - RNA, 20 nt, Salmonella typhimurium LT2
cacgccguccagcaccaccu

SEQ ID NO: 3801731 - RNA, 15 nt, Salmonella typhimurium LT2
cacgccgucgaugau

SEQ ID NO: 3801732 - RNA, 21 nt, Salmonella typhimurium LT2
cacgccgucgaugauggcggc

SEQ ID NO: 3801733 - RNA, 17 nt, Salmonella typhimurium LT2
cacgccuaaugaagcgc

SEQ ID NO: 3801734 - RNA, 17 nt, Salmonella typhimurium LT2
cacgccugcauaaagga

SEQ ID NO: 3801735 - RNA, 14 nt, Salmonella typhimurium LT2
cacgccuuccuggu

SEQ ID NO: 3801736 - RNA, 16 nt, Salmonella typhimurium LT2
cacgcgaagcgccgau

SEQ ID NO: 3801737 - RNA, 21 nt, Salmonella typhimurium LT2
cacgcgacaaugccauaaagc

SEQ ID NO: 3801738 - RNA, 20 nt, Salmonella typhimurium LT2
cacgcgcaguacggcgcaca

SEQ ID NO: 3801739 - RNA, 16 nt, Salmonella typhimurium LT2
cacgcgcgaaggcgac

SEQ ID NO: 3801740 - RNA, 17 nt, Salmonella typhimurium LT2
cacgcgcuggcgcgccu

SEQ ID NO: 3801741 - RNA, 22 nt, Salmonella typhimurium LT2
cacgcggaaucgucacagaccc

SEQ ID NO: 3801742 - RNA, 15 nt, Salmonella typhimurium LT2
cacgcggccuccggc

SEQ ID NO: 3801743 - RNA, 21 nt, Salmonella typhimurium LT2
cacgcggccuccggcgcgaac

SEQ ID NO: 3801744 - RNA, 20 nt, Salmonella typhimurium LT2
cacgcuaaagucagcauaaa

SEQ ID NO: 3801745 - RNA, 13 nt, Salmonella typhimurium LT2
cacgcuaacgucc

SEQ ID NO: 3801746 - RNA, 19 nt, Salmonella typhimurium LT2
cacgcucaauggcgcgcca

SEQ ID NO: 3801747 - RNA, 13 nt, Salmonella typhimurium LT2
cacgcucccggaa

SEQ ID NO: 3801748 - RNA, 21 nt, Salmonella typhimurium LT2
cacgcuccuucuucgccguca

SEQ ID NO: 3801749 - RNA, 22 nt, Salmonella typhimurium LT2
cacgcuccuucuucgccgucau

SEQ ID NO: 3801750 - RNA, 19 nt, Salmonella typhimurium LT2
cacgcucgcggaagcgacc

SEQ ID NO: 3801751 - RNA, 19 nt, Salmonella typhimurium LT2
cacgcucuccuacaccacc

SEQ ID NO: 3801752 - RNA, 22 nt, Salmonella typhimurium LT2
cacgcugaaaaccgcaucaagc

SEQ ID NO: 3801753 - RNA, 18 nt, Salmonella typhimurium LT2
cacgcugaccacgccgcc

SEQ ID NO: 3801754 - RNA, 20 nt, Salmonella typhimurium LT2
cacgcugaccacgccgccgc

SEQ ID NO: 3801755 - RNA, 17 nt, Salmonella typhimurium LT2
cacgcugaccuuuuuca

SEQ ID NO: 3801756 - RNA, 23 nt, Salmonella typhimurium LT2
cacgcugacugcauaauggugga

SEQ ID NO: 3801757 - RNA, 15 nt, Salmonella typhimurium LT2
cacgcuggcaucaau

SEQ ID NO: 3801758 - RNA, 17 nt, Salmonella typhimurium LT2
cacgcuuauccagccac

SEQ ID NO: 3801759 - RNA, 21 nt, Salmonella typhimurium LT2
cacgcuuuuccuuccagcgca

SEQ ID NO: 3801760 - RNA, 15 nt, Salmonella typhimurium LT2
cacggacagcgcgca

SEQ ID NO: 3801761 - RNA, 17 nt, Salmonella typhimurium LT2
cacggagagcggcugga

SEQ ID NO: 3801762 - RNA, 20 nt, Salmonella typhimurium LT2
cacggauauuuaccgccgcu

SEQ ID NO: 3801763 - RNA, 15 nt, Salmonella typhimurium LT2
cacggauggccucug

SEQ ID NO: 3801764 - RNA, 21 nt, Salmonella typhimurium LT2
cacggcaacgccguacuccag

SEQ ID NO: 3801765 - RNA, 14 nt, Salmonella typhimurium LT2
cacggcaacggauu

SEQ ID NO: 3801766 - RNA, 15 nt, Salmonella typhimurium LT2
cacggcauaagccuc

SEQ ID NO: 3801767 - RNA, 17 nt, Salmonella typhimurium LT2
cacggcauaagccucau

SEQ ID NO: 3801768 - RNA, 14 nt, Salmonella typhimurium LT2
cacggccagcagcc

SEQ ID NO: 3801769 - RNA, 16 nt, Salmonella typhimurium LT2
cacggcgacaaccgga

SEQ ID NO: 3801770 - RNA, 11 nt, Salmonella typhimurium LT2
cacggcgcaca

SEQ ID NO: 3801771 - RNA, 13 nt, Salmonella typhimurium LT2
cacggcgcacacg

SEQ ID NO: 3801772 - RNA, 20 nt, Salmonella typhimurium LT2
cacggcgucaaauccaccgc

SEQ ID NO: 3801773 - RNA, 19 nt, Salmonella typhimurium LT2
cacggcgucaauuccgcgc

SEQ ID NO: 3801774 - RNA, 13 nt, Salmonella typhimurium LT2
cacggcguccugc

SEQ ID NO: 3801775 - RNA, 15 nt, Salmonella typhimurium LT2
cacggcgucgccugu

SEQ ID NO: 3801776 - RNA, 19 nt, Salmonella typhimurium LT2
cacggcucgaucccgaccc

SEQ ID NO: 3801777 - RNA, 13 nt, Salmonella typhimurium LT2
cacggcuggcaau

SEQ ID NO: 3801778 - RNA, 20 nt, Salmonella typhimurium LT2
cacgggcaucauaagagaga

SEQ ID NO: 3801779 - RNA, 18 nt, Salmonella typhimurium LT2
cacgggcuuaaucaguuc

SEQ ID NO: 3801780 - RNA, 14 nt, Salmonella typhimurium LT2
cacggggcggcaau

SEQ ID NO: 3801781 - RNA, 19 nt, Salmonella typhimurium LT2
cacggguuacaacugcgag

SEQ ID NO: 3801782 - RNA, 19 nt, Salmonella typhimurium LT2
cacggguuuuacuggcgcg

SEQ ID NO: 3801783 - RNA, 17 nt, Salmonella typhimurium LT2
cacggucaaucaucaga

SEQ ID NO: 3801784 - RNA, 18 nt, Salmonella typhimurium LT2
cacggucaaucaucagaa

SEQ ID NO: 3801785 - RNA, 17 nt, Salmonella typhimurium LT2
cacgguguaccccgccu

SEQ ID NO: 3801786 - RNA, 23 nt, Salmonella typhimurium LT2
cacgguuaucuggcgcaaccggc

SEQ ID NO: 3801787 - RNA, 23 nt, Salmonella typhimurium LT2
cacgguucacggccaaagcgcga

SEQ ID NO: 3801788 - RNA, 15 nt, Salmonella typhimurium LT2
cacgguucuuccguc

SEQ ID NO: 3801789 - RNA, 16 nt, Salmonella typhimurium LT2
cacgguuuauccccgc

SEQ ID NO: 3801790 - RNA, 21 nt, Salmonella typhimurium LT2
cacguaaauagagaaaucaac

SEQ ID NO: 3801791 - RNA, 17 nt, Salmonella typhimurium LT2
cacguaacucggcagcg

SEQ ID NO: 3801792 - RNA, 21 nt, Salmonella typhimurium LT2
cacguaacucggcagcgcgac

SEQ ID NO: 3801793 - RNA, 15 nt, Salmonella typhimurium LT2
cacguaguaaugcau

SEQ ID NO: 3801794 - RNA, 15 nt, Salmonella typhimurium LT2
cacgucauaacgcgc

SEQ ID NO: 3801795 - RNA, 17 nt, Salmonella typhimurium LT2
cacgucauaacgcgcau

SEQ ID NO: 3801796 - RNA, 17 nt, Salmonella typhimurium LT2
cacgucauccggcaagc

SEQ ID NO: 3801797 - RNA, 17 nt, Salmonella typhimurium LT2
cacguccucuucuacgc

SEQ ID NO: 3801798 - RNA, 15 nt, Salmonella typhimurium LT2
cacgucgauuuuccc

SEQ ID NO: 3801799 - RNA, 14 nt, Salmonella typhimurium LT2
cacgugcauaaagc

SEQ ID NO: 3801800 - RNA, 14 nt, Salmonella typhimurium LT2
cacguuaauuauuc

SEQ ID NO: 3801801 - RNA, 18 nt, Salmonella typhimurium LT2
cacguuacccgccagucg

SEQ ID NO: 3801802 - RNA, 17 nt, Salmonella typhimurium LT2
cacguuauaccacuggu

SEQ ID NO: 3801803 - RNA, 15 nt, Salmonella typhimurium LT2
cacguucagcgcggu

SEQ ID NO: 3801804 - RNA, 19 nt, Salmonella typhimurium LT2
cacguugagaaagggauaa

SEQ ID NO: 3801805 - RNA, 23 nt, Salmonella typhimurium LT2
cacguugucccaggccagaugcg

SEQ ID NO: 3801806 - RNA, 14 nt, Salmonella typhimurium LT2
cacuaacucaauga

SEQ ID NO: 3801807 - RNA, 18 nt, Salmonella typhimurium LT2
cacuaauccccauuuuuu

SEQ ID NO: 3801808 - RNA, 19 nt, Salmonella typhimurium LT2
cacuaauccccauuuuuuu

SEQ ID NO: 3801809 - RNA, 18 nt, Salmonella typhimurium LT2
cacuaccauuuccggcgc

SEQ ID NO: 3801810 - RNA, 22 nt, Salmonella typhimurium LT2
cacuaccauuuccggcgcgccu

SEQ ID NO: 3801811 - RNA, 13 nt, Salmonella typhimurium LT2
cacuaccgccacu

SEQ ID NO: 3801812 - RNA, 16 nt, Salmonella typhimurium LT2
cacuacgcagcuccag

SEQ ID NO: 3801813 - RNA, 19 nt, Salmonella typhimurium LT2
cacuacgcagcuccagcuc

SEQ ID NO: 3801814 - RNA, 16 nt, Salmonella typhimurium LT2
cacuacggugugccug

SEQ ID NO: 3801815 - RNA, 15 nt, Salmonella typhimurium LT2
cacuacuucuucagu

SEQ ID NO: 3801816 - RNA, 19 nt, Salmonella typhimurium LT2
cacuagucaggcacaaaaa

SEQ ID NO: 3801817 - RNA, 22 nt, Salmonella typhimurium LT2
cacuaugcuccgggccgugauc

SEQ ID NO: 3801818 - RNA, 14 nt, Salmonella typhimurium LT2
cacucaaccugugu

SEQ ID NO: 3801819 - RNA, 19 nt, Salmonella typhimurium LT2
cacucaaucauugucauua

SEQ ID NO: 3801820 - RNA, 15 nt, Salmonella typhimurium LT2
cacucauccagacca

SEQ ID NO: 3801821 - RNA, 14 nt, Salmonella typhimurium LT2
cacuccaucgccug

SEQ ID NO: 3801822 - RNA, 22 nt, Salmonella typhimurium LT2
cacucccccacccuuugcagcg

SEQ ID NO: 3801823 - RNA, 13 nt, Salmonella typhimurium LT2
cacucccugcguc

SEQ ID NO: 3801824 - RNA, 19 nt, Salmonella typhimurium LT2
cacuccggcugcaccagcg

SEQ ID NO: 3801825 - RNA, 20 nt, Salmonella typhimurium LT2
cacucgaagauacggauucu

SEQ ID NO: 3801826 - RNA, 14 nt, Salmonella typhimurium LT2
cacucgauggcuuu

SEQ ID NO: 3801827 - RNA, 20 nt, Salmonella typhimurium LT2
cacucggugcauuugucgcu

SEQ ID NO: 3801828 - RNA, 16 nt, Salmonella typhimurium LT2
cacucuccagcauccu

SEQ ID NO: 3801829 - RNA, 18 nt, Salmonella typhimurium LT2
cacucucggguacacaac

SEQ ID NO: 3801830 - RNA, 20 nt, Salmonella typhimurium LT2
cacucuucgggaauggggaa

SEQ ID NO: 3801831 - RNA, 22 nt, Salmonella typhimurium LT2
cacucuuuggacggcaucagga

SEQ ID NO: 3801832 - RNA, 14 nt, Salmonella typhimurium LT2
cacucuuuuuggcu

SEQ ID NO: 3801833 - RNA, 23 nt, Salmonella typhimurium LT2
cacugacauuuaaggcgcggccu

SEQ ID NO: 3801834 - RNA, 12 nt, Salmonella typhimurium LT2
cacugaccugcu

SEQ ID NO: 3801835 - RNA, 15 nt, Salmonella typhimurium LT2
cacugacuauccaca

SEQ ID NO: 3801836 - RNA, 18 nt, Salmonella typhimurium LT2
cacugacuauccacagcg

SEQ ID NO: 3801837 - RNA, 17 nt, Salmonella typhimurium LT2
cacugaguuucaccgcc

SEQ ID NO: 3801838 - RNA, 14 nt, Salmonella typhimurium LT2
cacugauaccccag

SEQ ID NO: 3801839 - RNA, 17 nt, Salmonella typhimurium LT2
cacugauaguccaucac

SEQ ID NO: 3801840 - RNA, 16 nt, Salmonella typhimurium LT2
cacugcaucucuucca

SEQ ID NO: 3801841 - RNA, 12 nt, Salmonella typhimurium LT2
cacugccaccgc

SEQ ID NO: 3801842 - RNA, 21 nt, Salmonella typhimurium LT2
cacugccacgagccuucuggc

SEQ ID NO: 3801843 - RNA, 14 nt, Salmonella typhimurium LT2
cacugcccagagaa

SEQ ID NO: 3801844 - RNA, 19 nt, Salmonella typhimurium LT2
cacugcccagagaauauug

SEQ ID NO: 3801845 - RNA, 22 nt, Salmonella typhimurium LT2
cacugccgacgcccucaauauc

SEQ ID NO: 3801846 - RNA, 16 nt, Salmonella typhimurium LT2
cacugcggacauuuuc

SEQ ID NO: 3801847 - RNA, 21 nt, Salmonella typhimurium LT2
cacugcggagguuucuuuuuc

SEQ ID NO: 3801848 - RNA, 23 nt, Salmonella typhimurium LT2
cacugcucguuaaauccucccau

SEQ ID NO: 3801849 - RNA, 23 nt, Salmonella typhimurium LT2
cacugcuguagcgucucaucaaa

SEQ ID NO: 3801850 - RNA, 23 nt, Salmonella typhimurium LT2
cacugcuuccugccgcgaucgcg

SEQ ID NO: 3801851 - RNA, 17 nt, Salmonella typhimurium LT2
cacuggaaacagccaau

SEQ ID NO: 3801852 - RNA, 20 nt, Salmonella typhimurium LT2
cacuggaauucguuaccucg

SEQ ID NO: 3801853 - RNA, 21 nt, Salmonella typhimurium LT2
cacuggagcgcauuuuacugc

SEQ ID NO: 3801854 - RNA, 16 nt, Salmonella typhimurium LT2
cacuggagggcauuaa

SEQ ID NO: 3801855 - RNA, 16 nt, Salmonella typhimurium LT2
cacuggcccccuguuc

SEQ ID NO: 3801856 - RNA, 19 nt, Salmonella typhimurium LT2
cacuggccucccaguuccc

SEQ ID NO: 3801857 - RNA, 19 nt, Salmonella typhimurium LT2
cacuggcgacggcaucggc

SEQ ID NO: 3801858 - RNA, 21 nt, Salmonella typhimurium LT2
cacuggcgaguugccggagac

SEQ ID NO: 3801859 - RNA, 14 nt, Salmonella typhimurium LT2
cacuggcgcuggcu

SEQ ID NO: 3801860 - RNA, 19 nt, Salmonella typhimurium LT2
cacugguaggcauccagau

SEQ ID NO: 3801861 - RNA, 22 nt, Salmonella typhimurium LT2
cacuggucgucugaaagcgacu

SEQ ID NO: 3801862 - RNA, 21 nt, Salmonella typhimurium LT2
cacuggugacaucgccaacgc

SEQ ID NO: 3801863 - RNA, 20 nt, Salmonella typhimurium LT2
cacugguuauccgggcugaa

SEQ ID NO: 3801864 - RNA, 13 nt, Salmonella typhimurium LT2
cacuguccugacg

SEQ ID NO: 3801865 - RNA, 21 nt, Salmonella typhimurium LT2
cacuguggcggcugcggcgca

SEQ ID NO: 3801866 - RNA, 16 nt, Salmonella typhimurium LT2
cacuguucggcgggga

SEQ ID NO: 3801867 - RNA, 21 nt, Salmonella typhimurium LT2
cacuguuuaaugcuuucaaua

SEQ ID NO: 3801868 - RNA, 23 nt, Salmonella typhimurium LT2
cacuuaauacucgccccguuccu

SEQ ID NO: 3801869 - RNA, 21 nt, Salmonella typhimurium LT2
cacuuacgguuuuaacaaccc

SEQ ID NO: 3801870 - RNA, 20 nt, Salmonella typhimurium LT2
cacuuacuuauguaagcucc

SEQ ID NO: 3801871 - RNA, 11 nt, Salmonella typhimurium LT2
cacuuaugguc

SEQ ID NO: 3801872 - RNA, 21 nt, Salmonella typhimurium LT2
cacuucaauguuagcauuauu

SEQ ID NO: 3801873 - RNA, 16 nt, Salmonella typhimurium LT2
cacuucacaaacaauu

SEQ ID NO: 3801874 - RNA, 19 nt, Salmonella typhimurium LT2
cacuucacacgaacuuuau

SEQ ID NO: 3801875 - RNA, 20 nt, Salmonella typhimurium LT2
cacuucagccagcugcuggc

SEQ ID NO: 3801876 - RNA, 15 nt, Salmonella typhimurium LT2
cacuucagccggaua

SEQ ID NO: 3801877 - RNA, 13 nt, Salmonella typhimurium LT2
cacuucauccgga

SEQ ID NO: 3801878 - RNA, 22 nt, Salmonella typhimurium LT2
cacuucauccuuuacgcugccu

SEQ ID NO: 3801879 - RNA, 12 nt, Salmonella typhimurium LT2
cacuuccagcgc

SEQ ID NO: 3801880 - RNA, 15 nt, Salmonella typhimurium LT2
cacuuccgccaccac

SEQ ID NO: 3801881 - RNA, 17 nt, Salmonella typhimurium LT2
cacuuccgccaccacgc

SEQ ID NO: 3801882 - RNA, 18 nt, Salmonella typhimurium LT2
cacuuccgccaccacgcc

SEQ ID NO: 3801883 - RNA, 17 nt, Salmonella typhimurium LT2
cacuuccugaaucacca

SEQ ID NO: 3801884 - RNA, 20 nt, Salmonella typhimurium LT2
cacuuccugaaucaccagcc

SEQ ID NO: 3801885 - RNA, 22 nt, Salmonella typhimurium LT2
cacuuccugaaucaccagccga

SEQ ID NO: 3801886 - RNA, 15 nt, Salmonella typhimurium LT2
cacuuccugcuccuu

SEQ ID NO: 3801887 - RNA, 14 nt, Salmonella typhimurium LT2
cacuucgauaaacg

SEQ ID NO: 3801888 - RNA, 23 nt, Salmonella typhimurium LT2
cacuucucgcgcaucaggaucuu

SEQ ID NO: 3801889 - RNA, 19 nt, Salmonella typhimurium LT2
cacuucugacauucagcgc

SEQ ID NO: 3801890 - RNA, 23 nt, Salmonella typhimurium LT2
cacuucugaguucggcauggggu

SEQ ID NO: 3801891 - RNA, 13 nt, Salmonella typhimurium LT2
cacuucugcggua

SEQ ID NO: 3801892 - RNA, 14 nt, Salmonella typhimurium LT2
cacuucuucauaaa

SEQ ID NO: 3801893 - RNA, 15 nt, Salmonella typhimurium LT2
cacuucuuccagcgu

SEQ ID NO: 3801894 - RNA, 23 nt, Salmonella typhimurium LT2
cacuucuucgcgaucgugauaaa

SEQ ID NO: 3801895 - RNA, 13 nt, Salmonella typhimurium LT2
cacuugauucugc

SEQ ID NO: 3801896 - RNA, 16 nt, Salmonella typhimurium LT2
cacuugauucugcagc

SEQ ID NO: 3801897 - RNA, 17 nt, Salmonella typhimurium LT2
cacuugcucccagaaac

SEQ ID NO: 3801898 - RNA, 19 nt, Salmonella typhimurium LT2
cacuuuaauacccgacagc

SEQ ID NO: 3801899 - RNA, 22 nt, Salmonella typhimurium LT2
cacuuuaccaggcauaauggaa

SEQ ID NO: 3801900 - RNA, 22 nt, Salmonella typhimurium LT2
cacuuuacugaauaacagcacc

SEQ ID NO: 3801901 - RNA, 13 nt, Salmonella typhimurium LT2
cacuuucagauac

SEQ ID NO: 3801902 - RNA, 14 nt, Salmonella typhimurium LT2
cacuuucagauacc

SEQ ID NO: 3801903 - RNA, 13 nt, Salmonella typhimurium LT2
cacuuucaucagc

SEQ ID NO: 3801904 - RNA, 19 nt, Salmonella typhimurium LT2
cacuuuccagaccaagauc

SEQ ID NO: 3801905 - RNA, 17 nt, Salmonella typhimurium LT2
cacuuuccagccccuuc

SEQ ID NO: 3801906 - RNA, 17 nt, Salmonella typhimurium LT2
cacuuuccgaaucaggc

SEQ ID NO: 3801907 - RNA, 23 nt, Salmonella typhimurium LT2
cacuuucgcccggcgccagcuca

SEQ ID NO: 3801908 - RNA, 21 nt, Salmonella typhimurium LT2
cacuuucucggcuuuccagcu

SEQ ID NO: 3801909 - RNA, 22 nt, Salmonella typhimurium LT2
cacuuucucggcuuuccagcuc

SEQ ID NO: 3801910 - RNA, 15 nt, Salmonella typhimurium LT2
cacuuugcgccgcca

SEQ ID NO: 3801911 - RNA, 19 nt, Salmonella typhimurium LT2
cacuuuuggcgacaggaac

SEQ ID NO: 3801912 - RNA, 22 nt, Salmonella typhimurium LT2
cacuuuuucucuuaucgccgcc

SEQ ID NO: 3801913 - RNA, 18 nt, Salmonella typhimurium LT2
cagaaaaaaugcaccgcc

SEQ ID NO: 3801914 - RNA, 15 nt, Salmonella typhimurium LT2
cagaaaaagccccca

SEQ ID NO: 3801915 - RNA, 18 nt, Salmonella typhimurium LT2
cagaaaaaucagcauuac

SEQ ID NO: 3801916 - RNA, 16 nt, Salmonella typhimurium LT2
cagaaaagaaccgacu

SEQ ID NO: 3801917 - RNA, 11 nt, Salmonella typhimurium LT2
cagaaaagcuu

SEQ ID NO: 3801918 - RNA, 19 nt, Salmonella typhimurium LT2
cagaaaauccuucagcguu

SEQ ID NO: 3801919 - RNA, 22 nt, Salmonella typhimurium LT2
cagaaacaagaagcacgacaca

SEQ ID NO: 3801920 - RNA, 14 nt, Salmonella typhimurium LT2
cagaaacaguuccg

SEQ ID NO: 3801921 - RNA, 20 nt, Salmonella typhimurium LT2
cagaaauaaaauacuuccau

SEQ ID NO: 3801922 - RNA, 22 nt, Salmonella typhimurium LT2
cagaaaucauauaaaacagccu

SEQ ID NO: 3801923 - RNA, 18 nt, Salmonella typhimurium LT2
cagaacaaacuuauccca

SEQ ID NO: 3801924 - RNA, 21 nt, Salmonella typhimurium LT2
cagaacaucuaccgcauacug

SEQ ID NO: 3801925 - RNA, 19 nt, Salmonella typhimurium LT2
cagaacaugaaauggcaug

SEQ ID NO: 3801926 - RNA, 22 nt, Salmonella typhimurium LT2
cagaacaugaaauggcaugagc

SEQ ID NO: 3801927 - RNA, 18 nt, Salmonella typhimurium LT2
cagaaccccaucgccuga

SEQ ID NO: 3801928 - RNA, 15 nt, Salmonella typhimurium LT2
cagaaccgccgcgau

SEQ ID NO: 3801929 - RNA, 13 nt, Salmonella typhimurium LT2
cagaacgagagga

SEQ ID NO: 3801930 - RNA, 15 nt, Salmonella typhimurium LT2
cagaacgagaggagg

SEQ ID NO: 3801931 - RNA, 16 nt, Salmonella typhimurium LT2
cagaacguagcccauu

SEQ ID NO: 3801932 - RNA, 21 nt, Salmonella typhimurium LT2
cagaacucacauauucaauaa

SEQ ID NO: 3801933 - RNA, 20 nt, Salmonella typhimurium LT2
cagaacucaucuucuuuuuc

SEQ ID NO: 3801934 - RNA, 15 nt, Salmonella typhimurium LT2
cagaacugcguaagc

SEQ ID NO: 3801935 - RNA, 20 nt, Salmonella typhimurium LT2
cagaacugguaggucaaccc

SEQ ID NO: 3801936 - RNA, 21 nt, Salmonella typhimurium LT2
cagaacugguaggucaacccu

SEQ ID NO: 3801937 - RNA, 19 nt, Salmonella typhimurium LT2
cagaacuuccagaaggcga

SEQ ID NO: 3801938 - RNA, 23 nt, Salmonella typhimurium LT2
cagaagaaaaucaacacgucgau

SEQ ID NO: 3801939 - RNA, 20 nt, Salmonella typhimurium LT2
cagaagaagguaaaaguagg

SEQ ID NO: 3801940 - RNA, 15 nt, Salmonella typhimurium LT2
cagaagaaucugccu

SEQ ID NO: 3801941 - RNA, 16 nt, Salmonella typhimurium LT2
cagaagaaucugccuu

SEQ ID NO: 3801942 - RNA, 18 nt, Salmonella typhimurium LT2
cagaagaaucugccuuuu

SEQ ID NO: 3801943 - RNA, 19 nt, Salmonella typhimurium LT2
cagaagagaagcuuuuucu

SEQ ID NO: 3801944 - RNA, 12 nt, Salmonella typhimurium LT2
cagaagagaaug

SEQ ID NO: 3801945 - RNA, 14 nt, Salmonella typhimurium LT2
cagaagcuaaggga

SEQ ID NO: 3801946 - RNA, 19 nt, Salmonella typhimurium LT2
cagaaggccagugguaaaa

SEQ ID NO: 3801947 - RNA, 22 nt, Salmonella typhimurium LT2
cagaaggccgucgacagacggc

SEQ ID NO: 3801948 - RNA, 14 nt, Salmonella typhimurium LT2
cagaaggcgaacau

SEQ ID NO: 3801949 - RNA, 17 nt, Salmonella typhimurium LT2
cagaaguccccagccgc

SEQ ID NO: 3801950 - RNA, 20 nt, Salmonella typhimurium LT2
cagaagugccaguaacucau

SEQ ID NO: 3801951 - RNA, 14 nt, Salmonella typhimurium LT2
cagaauaaacggca

SEQ ID NO: 3801952 - RNA, 20 nt, Salmonella typhimurium LT2
cagaauaaacggcagggcag

SEQ ID NO: 3801953 - RNA, 14 nt, Salmonella typhimurium LT2
cagaauaacgucgc

SEQ ID NO: 3801954 - RNA, 18 nt, Salmonella typhimurium LT2
cagaauacaaccucaaau

SEQ ID NO: 3801955 - RNA, 23 nt, Salmonella typhimurium LT2
cagaauaccgcguccuucuuccg

SEQ ID NO: 3801956 - RNA, 15 nt, Salmonella typhimurium LT2
cagaauaucuuuuac

SEQ ID NO: 3801957 - RNA, 12 nt, Salmonella typhimurium LT2
cagaauauguuu

SEQ ID NO: 3801958 - RNA, 13 nt, Salmonella typhimurium LT2
cagaauauugaca

SEQ ID NO: 3801959 - RNA, 22 nt, Salmonella typhimurium LT2
cagaaucaccgacagcaccgcc

SEQ ID NO: 3801960 - RNA, 21 nt, Salmonella typhimurium LT2
cagaaucacggccgaggcagc

SEQ ID NO: 3801961 - RNA, 23 nt, Salmonella typhimurium LT2
cagaaucagcaacacaaucaggc

SEQ ID NO: 3801962 - RNA, 14 nt, Salmonella typhimurium LT2
cagaaucagugacc

SEQ ID NO: 3801963 - RNA, 14 nt, Salmonella typhimurium LT2
cagaaucaucaugu

SEQ ID NO: 3801964 - RNA, 19 nt, Salmonella typhimurium LT2
cagaaucaucaugucguca

SEQ ID NO: 3801965 - RNA, 21 nt, Salmonella typhimurium LT2
cagaauccgucagguuuuuug

SEQ ID NO: 3801966 - RNA, 15 nt, Salmonella typhimurium LT2
cagaaugagcggaac

SEQ ID NO: 3801967 - RNA, 23 nt, Salmonella typhimurium LT2
cagaaugauaaugccgcugauaa

SEQ ID NO: 3801968 - RNA, 15 nt, Salmonella typhimurium LT2
cagaaugcccagcaa

SEQ ID NO: 3801969 - RNA, 14 nt, Salmonella typhimurium LT2
cagaaugcccaggc

SEQ ID NO: 3801970 - RNA, 15 nt, Salmonella typhimurium LT2
cagaaugcccugcug

SEQ ID NO: 3801971 - RNA, 20 nt, Salmonella typhimurium LT2
cagaaugcccugcuguucca

SEQ ID NO: 3801972 - RNA, 17 nt, Salmonella typhimurium LT2
cagaaugcguaaaaagc

SEQ ID NO: 3801973 - RNA, 15 nt, Salmonella typhimurium LT2
cagaauggggauaau

SEQ ID NO: 3801974 - RNA, 18 nt, Salmonella typhimurium LT2
cagaauuaacucaucaca

SEQ ID NO: 3801975 - RNA, 21 nt, Salmonella typhimurium LT2
cagaauuaacucaucacagcc

SEQ ID NO: 3801976 - RNA, 15 nt, Salmonella typhimurium LT2
cagaauuuaaaaauc

SEQ ID NO: 3801977 - RNA, 16 nt, Salmonella typhimurium LT2
cagaauuuccccaguu

SEQ ID NO: 3801978 - RNA, 18 nt, Salmonella typhimurium LT2
cagaauuuuuaaccguca

SEQ ID NO: 3801979 - RNA, 14 nt, Salmonella typhimurium LT2
cagacaaacaccgc

SEQ ID NO: 3801980 - RNA, 15 nt, Salmonella typhimurium LT2
cagacaaccagcagg

SEQ ID NO: 3801981 - RNA, 20 nt, Salmonella typhimurium LT2
cagacaaccauauuuaugca

SEQ ID NO: 3801982 - RNA, 17 nt, Salmonella typhimurium LT2
cagacaaccgggcauca

SEQ ID NO: 3801983 - RNA, 12 nt, Salmonella typhimurium LT2
cagacaagcaca

SEQ ID NO: 3801984 - RNA, 18 nt, Salmonella typhimurium LT2
cagacaauaaacgguccg

SEQ ID NO: 3801985 - RNA, 15 nt, Salmonella typhimurium LT2
cagacacugccaccg

SEQ ID NO: 3801986 - RNA, 18 nt, Salmonella typhimurium LT2
cagacacugccaccgcuc

SEQ ID NO: 3801987 - RNA, 12 nt, Salmonella typhimurium LT2
cagacacuggaa

SEQ ID NO: 3801988 - RNA, 20 nt, Salmonella typhimurium LT2
cagacacuggaaacagccaa

SEQ ID NO: 3801989 - RNA, 22 nt, Salmonella typhimurium LT2
cagacacuggaaacagccaauc

SEQ ID NO: 3801990 - RNA, 19 nt, Salmonella typhimurium LT2
cagacagauaacaccagcg

SEQ ID NO: 3801991 - RNA, 22 nt, Salmonella typhimurium LT2
cagacagauaacaccagcgauc

SEQ ID NO: 3801992 - RNA, 12 nt, Salmonella typhimurium LT2
cagacagcagau

SEQ ID NO: 3801993 - RNA, 12 nt, Salmonella typhimurium LT2
cagacagccgau

SEQ ID NO: 3801994 - RNA, 21 nt, Salmonella typhimurium LT2
cagacagccgaucaggccgca

SEQ ID NO: 3801995 - RNA, 23 nt, Salmonella typhimurium LT2
cagacaggcaugguuaacaauau

SEQ ID NO: 3801996 - RNA, 22 nt, Salmonella typhimurium LT2
cagacaguggccaucuuccagc

SEQ ID NO: 3801997 - RNA, 20 nt, Salmonella typhimurium LT2
cagacauauuuucaacggca

SEQ ID NO: 3801998 - RNA, 23 nt, Salmonella typhimurium LT2
cagacaucggagauuucauccuc

SEQ ID NO: 3801999 - RNA, 20 nt, Salmonella typhimurium LT2
cagacaugaccgcacagcag

SEQ ID NO: 3802000 - RNA, 15 nt, Salmonella typhimurium LT2
cagacaugcacaugg

SEQ ID NO: 3802001 - RNA, 15 nt, Salmonella typhimurium LT2
cagacaugcgccgga

SEQ ID NO: 3802002 - RNA, 16 nt, Salmonella typhimurium LT2
cagacauggcaauggc

SEQ ID NO: 3802003 - RNA, 17 nt, Salmonella typhimurium LT2
cagaccaaaaucaaacu

SEQ ID NO: 3802004 - RNA, 16 nt, Salmonella typhimurium LT2
cagaccaccagcgaca

SEQ ID NO: 3802005 - RNA, 17 nt, Salmonella typhimurium LT2
cagaccacgaaucagga

SEQ ID NO: 3802006 - RNA, 23 nt, Salmonella typhimurium LT2
cagacccaguacaaacaaauaaa

SEQ ID NO: 3802007 - RNA, 21 nt, Salmonella typhimurium LT2
cagaccccaguaauccggcaa

SEQ ID NO: 3802008 - RNA, 16 nt, Salmonella typhimurium LT2
cagaccccgcaucgcc

SEQ ID NO: 3802009 - RNA, 21 nt, Salmonella typhimurium LT2
cagacccgcguacaggaagcc

SEQ ID NO: 3802010 - RNA, 20 nt, Salmonella typhimurium LT2
cagaccgaucucaugcaacu

SEQ ID NO: 3802011 - RNA, 20 nt, Salmonella typhimurium LT2
cagaccgcuuaacuccggcg

SEQ ID NO: 3802012 - RNA, 22 nt, Salmonella typhimurium LT2
cagaccgcuuaacuccggcgac

SEQ ID NO: 3802013 - RNA, 14 nt, Salmonella typhimurium LT2
cagaccggauugcc

SEQ ID NO: 3802014 - RNA, 17 nt, Salmonella typhimurium LT2
cagaccggcaucucauc

SEQ ID NO: 3802015 - RNA, 20 nt, Salmonella typhimurium LT2
cagaccggcaucucaucuug

SEQ ID NO: 3802016 - RNA, 21 nt, Salmonella typhimurium LT2
cagaccggcaucucaucuugc

SEQ ID NO: 3802017 - RNA, 16 nt, Salmonella typhimurium LT2
cagaccguaugccagc

SEQ ID NO: 3802018 - RNA, 17 nt, Salmonella typhimurium LT2
cagaccgucaugacguc

SEQ ID NO: 3802019 - RNA, 21 nt, Salmonella typhimurium LT2
cagaccucguucggcgcaccu

SEQ ID NO: 3802020 - RNA, 19 nt, Salmonella typhimurium LT2
cagaccuuaucgcagucag

SEQ ID NO: 3802021 - RNA, 13 nt, Salmonella typhimurium LT2
cagaccuuuccag

SEQ ID NO: 3802022 - RNA, 20 nt, Salmonella typhimurium LT2
cagacgaacaaacuccagca

SEQ ID NO: 3802023 - RNA, 22 nt, Salmonella typhimurium LT2
cagacgaagaguucaacgccga

SEQ ID NO: 3802024 - RNA, 23 nt, Salmonella typhimurium LT2
cagacgaauaaucucaucgccuu

SEQ ID NO: 3802025 - RNA, 23 nt, Salmonella typhimurium LT2
cagacgagaaacgcuuucugggg

SEQ ID NO: 3802026 - RNA, 21 nt, Salmonella typhimurium LT2
cagacgauacucaaaccugcg

SEQ ID NO: 3802027 - RNA, 23 nt, Salmonella typhimurium LT2
cagacgauauucaagcuguugga

SEQ ID NO: 3802028 - RNA, 23 nt, Salmonella typhimurium LT2
cagacgaugauaauacauugccg

SEQ ID NO: 3802029 - RNA, 17 nt, Salmonella typhimurium LT2
cagacgaugugaacgcc

SEQ ID NO: 3802030 - RNA, 17 nt, Salmonella typhimurium LT2
cagacgcaucuuuuucc

SEQ ID NO: 3802031 - RNA, 16 nt, Salmonella typhimurium LT2
cagacgccgcgccgcg

SEQ ID NO: 3802032 - RNA, 15 nt, Salmonella typhimurium LT2
cagacgccugccguu

SEQ ID NO: 3802033 - RNA, 15 nt, Salmonella typhimurium LT2
cagacgcgcagcacc

SEQ ID NO: 3802034 - RNA, 20 nt, Salmonella typhimurium LT2
cagacgcgugauacaggcau

SEQ ID NO: 3802035 - RNA, 13 nt, Salmonella typhimurium LT2
cagacgcuccgca

SEQ ID NO: 3802036 - RNA, 19 nt, Salmonella typhimurium LT2
cagacgcugauagccacgg

SEQ ID NO: 3802037 - RNA, 14 nt, Salmonella typhimurium LT2
cagacgcugguugu

SEQ ID NO: 3802038 - RNA, 17 nt, Salmonella typhimurium LT2
cagacggcugggcugaa

SEQ ID NO: 3802039 - RNA, 16 nt, Salmonella typhimurium LT2
cagacgggccaggcga

SEQ ID NO: 3802040 - RNA, 22 nt, Salmonella typhimurium LT2
cagacgguuggcuauacgcggc

SEQ ID NO: 3802041 - RNA, 20 nt, Salmonella typhimurium LT2
cagacgguuuauccccgcug

SEQ ID NO: 3802042 - RNA, 13 nt, Salmonella typhimurium LT2
cagacgucaacac

SEQ ID NO: 3802043 - RNA, 14 nt, Salmonella typhimurium LT2
cagacgucaacacc

SEQ ID NO: 3802044 - RNA, 16 nt, Salmonella typhimurium LT2
cagacguuacaucucc

SEQ ID NO: 3802045 - RNA, 19 nt, Salmonella typhimurium LT2
cagacguuacaucuccugg

SEQ ID NO: 3802046 - RNA, 20 nt, Salmonella typhimurium LT2
cagacguuacaucuccuggu

SEQ ID NO: 3802047 - RNA, 17 nt, Salmonella typhimurium LT2
cagacguuuaucggcca

SEQ ID NO: 3802048 - RNA, 18 nt, Salmonella typhimurium LT2
cagacuaaaaagcgcguc

SEQ ID NO: 3802049 - RNA, 21 nt, Salmonella typhimurium LT2
cagacuaaccguucaucuauc

SEQ ID NO: 3802050 - RNA, 12 nt, Salmonella typhimurium LT2
cagacuaucuuc

SEQ ID NO: 3802051 - RNA, 13 nt, Salmonella typhimurium LT2
cagacucaacugc

SEQ ID NO: 3802052 - RNA, 14 nt, Salmonella typhimurium LT2
cagacucagccagg

SEQ ID NO: 3802053 - RNA, 23 nt, Salmonella typhimurium LT2
cagacucaguucgcgacccagau

SEQ ID NO: 3802054 - RNA, 17 nt, Salmonella typhimurium LT2
cagacucgacgcgacgu

SEQ ID NO: 3802055 - RNA, 19 nt, Salmonella typhimurium LT2
cagacucgcuucacgcgga

SEQ ID NO: 3802056 - RNA, 19 nt, Salmonella typhimurium LT2
cagacugggauagccaauc

SEQ ID NO: 3802057 - RNA, 14 nt, Salmonella typhimurium LT2
cagacugguuguuc

SEQ ID NO: 3802058 - RNA, 18 nt, Salmonella typhimurium LT2
cagacuguaaaucugccg

SEQ ID NO: 3802059 - RNA, 16 nt, Salmonella typhimurium LT2
cagacuguaugugcuc

SEQ ID NO: 3802060 - RNA, 17 nt, Salmonella typhimurium LT2
cagacugugauggcggu

SEQ ID NO: 3802061 - RNA, 18 nt, Salmonella typhimurium LT2
cagacuguggccgguaua

SEQ ID NO: 3802062 - RNA, 15 nt, Salmonella typhimurium LT2
cagacuuagggcgga

SEQ ID NO: 3802063 - RNA, 16 nt, Salmonella typhimurium LT2
cagacuucauuuucca

SEQ ID NO: 3802064 - RNA, 16 nt, Salmonella typhimurium LT2
cagacuuuuuugccga

SEQ ID NO: 3802065 - RNA, 15 nt, Salmonella typhimurium LT2
cagagauaauuuucc

SEQ ID NO: 3802066 - RNA, 22 nt, Salmonella typhimurium LT2
cagagaucuuucacccccagcu

SEQ ID NO: 3802067 - RNA, 21 nt, Salmonella typhimurium LT2
cagagcaacgagaacccacuu

SEQ ID NO: 3802068 - RNA, 16 nt, Salmonella typhimurium LT2
cagagccaacagaaga

SEQ ID NO: 3802069 - RNA, 16 nt, Salmonella typhimurium LT2
cagagcccagcgcgau

SEQ ID NO: 3802070 - RNA, 23 nt, Salmonella typhimurium LT2
cagagcccagcgcgauacgcaga

SEQ ID NO: 3802071 - RNA, 16 nt, Salmonella typhimurium LT2
cagagccggauggcga

SEQ ID NO: 3802072 - RNA, 17 nt, Salmonella typhimurium LT2
cagagcgcgcuggcaag

SEQ ID NO: 3802073 - RNA, 20 nt, Salmonella typhimurium LT2
cagagcgcgcuggcaagcgc

SEQ ID NO: 3802074 - RNA, 13 nt, Salmonella typhimurium LT2
cagagcggcaaca

SEQ ID NO: 3802075 - RNA, 20 nt, Salmonella typhimurium LT2
cagagcgucucauccggcag

SEQ ID NO: 3802076 - RNA, 17 nt, Salmonella typhimurium LT2
cagagcucgucaaaaau

SEQ ID NO: 3802077 - RNA, 23 nt, Salmonella typhimurium LT2
cagaggaaauccuuccagcgcca

SEQ ID NO: 3802078 - RNA, 15 nt, Salmonella typhimurium LT2
cagaggaaugaaaac

SEQ ID NO: 3802079 - RNA, 14 nt, Salmonella typhimurium LT2
cagaggcggcgcca

SEQ ID NO: 3802080 - RNA, 23 nt, Salmonella typhimurium LT2
cagaggcuaaucaggaagaaaga

SEQ ID NO: 3802081 - RNA, 18 nt, Salmonella typhimurium LT2
cagaguaaccacgauaaa

SEQ ID NO: 3802082 - RNA, 20 nt, Salmonella typhimurium LT2
cagaguaaccacgauaaaga

SEQ ID NO: 3802083 - RNA, 21 nt, Salmonella typhimurium LT2
cagaguaacccgauacccuga

SEQ ID NO: 3802084 - RNA, 12 nt, Salmonella typhimurium LT2
cagaguacauuc

SEQ ID NO: 3802085 - RNA, 17 nt, Salmonella typhimurium LT2
cagaguccagcggcagc

SEQ ID NO: 3802086 - RNA, 18 nt, Salmonella typhimurium LT2
cagaguccagcggcagcu

SEQ ID NO: 3802087 - RNA, 17 nt, Salmonella typhimurium LT2
cagagucugaaaacuca

SEQ ID NO: 3802088 - RNA, 15 nt, Salmonella typhimurium LT2
cagagugcucaauaa

SEQ ID NO: 3802089 - RNA, 16 nt, Salmonella typhimurium LT2
cagagugcucaauaag

SEQ ID NO: 3802090 - RNA, 14 nt, Salmonella typhimurium LT2
cagauaaaacaaaa

SEQ ID NO: 3802091 - RNA, 18 nt, Salmonella typhimurium LT2
cagauaaaacaaaaggcc

SEQ ID NO: 3802092 - RNA, 12 nt, Salmonella typhimurium LT2
cagauaaaccac

SEQ ID NO: 3802093 - RNA, 21 nt, Salmonella typhimurium LT2
cagauaacauaugaguuaugu

SEQ ID NO: 3802094 - RNA, 15 nt, Salmonella typhimurium LT2
cagauaaccaaucac

SEQ ID NO: 3802095 - RNA, 17 nt, Salmonella typhimurium LT2
cagauaacccggcgcag

SEQ ID NO: 3802096 - RNA, 15 nt, Salmonella typhimurium LT2
cagauaaucaaacgc

SEQ ID NO: 3802097 - RNA, 21 nt, Salmonella typhimurium LT2
cagauaauccacauugcaaug

SEQ ID NO: 3802098 - RNA, 22 nt, Salmonella typhimurium LT2
cagauaaugaucaacgcggcga

SEQ ID NO: 3802099 - RNA, 23 nt, Salmonella typhimurium LT2
cagauaauuuugcauaccaaguu

SEQ ID NO: 3802100 - RNA, 21 nt, Salmonella typhimurium LT2
cagauacacgcccucucgcca

SEQ ID NO: 3802101 - RNA, 23 nt, Salmonella typhimurium LT2
cagauacacgcccucucgccaaa

SEQ ID NO: 3802102 - RNA, 16 nt, Salmonella typhimurium LT2
cagauacggcgcgucg

SEQ ID NO: 3802103 - RNA, 17 nt, Salmonella typhimurium LT2
cagauacggcuccagca

SEQ ID NO: 3802104 - RNA, 19 nt, Salmonella typhimurium LT2
cagauacgucuuacgccau

SEQ ID NO: 3802105 - RNA, 20 nt, Salmonella typhimurium LT2
cagauacgucuuacgccaug

SEQ ID NO: 3802106 - RNA, 20 nt, Salmonella typhimurium LT2
cagauacugcgcguggcaaa

SEQ ID NO: 3802107 - RNA, 21 nt, Salmonella typhimurium LT2
cagauagagcauaauaaaaau

SEQ ID NO: 3802108 - RNA, 20 nt, Salmonella typhimurium LT2
cagauagcaaaaaagcgccu

SEQ ID NO: 3802109 - RNA, 19 nt, Salmonella typhimurium LT2
cagauagccugccagcacc

SEQ ID NO: 3802110 - RNA, 16 nt, Salmonella typhimurium LT2
cagauagcguauuaua

SEQ ID NO: 3802111 - RNA, 22 nt, Salmonella typhimurium LT2
cagauaguaaugcucaacucug

SEQ ID NO: 3802112 - RNA, 22 nt, Salmonella typhimurium LT2
cagauaguauuucccuucccag

SEQ ID NO: 3802113 - RNA, 19 nt, Salmonella typhimurium LT2
cagauaguggcugaggccg

SEQ ID NO: 3802114 - RNA, 21 nt, Salmonella typhimurium LT2
cagauaucccugcaaacugug

SEQ ID NO: 3802115 - RNA, 20 nt, Salmonella typhimurium LT2
cagauaucuguauaaauaaa

SEQ ID NO: 3802116 - RNA, 23 nt, Salmonella typhimurium LT2
cagauaucuuccagcgcguccag

SEQ ID NO: 3802117 - RNA, 15 nt, Salmonella typhimurium LT2
cagaucaaaaaucug

SEQ ID NO: 3802118 - RNA, 18 nt, Salmonella typhimurium LT2
cagaucaucaaucaucuc

SEQ ID NO: 3802119 - RNA, 14 nt, Salmonella typhimurium LT2
cagauccaaauggc

SEQ ID NO: 3802120 - RNA, 12 nt, Salmonella typhimurium LT2
cagauccagcgc

SEQ ID NO: 3802121 - RNA, 15 nt, Salmonella typhimurium LT2
cagauccagcgccgu

SEQ ID NO: 3802122 - RNA, 16 nt, Salmonella typhimurium LT2
cagauccaucgccugc

SEQ ID NO: 3802123 - RNA, 20 nt, Salmonella typhimurium LT2
cagauccgguuucagcguuu

SEQ ID NO: 3802124 - RNA, 12 nt, Salmonella typhimurium LT2
cagauccuggcg

SEQ ID NO: 3802125 - RNA, 22 nt, Salmonella typhimurium LT2
cagaucgacauaagaguccauu

SEQ ID NO: 3802126 - RNA, 15 nt, Salmonella typhimurium LT2
cagaucgaccagcgc

SEQ ID NO: 3802127 - RNA, 19 nt, Salmonella typhimurium LT2
cagaucgccaaagucauug

SEQ ID NO: 3802128 - RNA, 16 nt, Salmonella typhimurium LT2
cagaucgcgcugcgca

SEQ ID NO: 3802129 - RNA, 17 nt, Salmonella typhimurium LT2
cagaucgcggcaauggc

SEQ ID NO: 3802130 - RNA, 15 nt, Salmonella typhimurium LT2
cagaucguaugcgcc

SEQ ID NO: 3802131 - RNA, 21 nt, Salmonella typhimurium LT2
cagaucgucggcguucaacac

SEQ ID NO: 3802132 - RNA, 22 nt, Salmonella typhimurium LT2
cagaucgucggcguucaacacc

SEQ ID NO: 3802133 - RNA, 14 nt, Salmonella typhimurium LT2
cagaucucacaaga

SEQ ID NO: 3802134 - RNA, 22 nt, Salmonella typhimurium LT2
cagaucucacaagauucacucu

SEQ ID NO: 3802135 - RNA, 20 nt, Salmonella typhimurium LT2
cagaucugcgcccauuuccu

SEQ ID NO: 3802136 - RNA, 16 nt, Salmonella typhimurium LT2
cagaucugucgccaug

SEQ ID NO: 3802137 - RNA, 17 nt, Salmonella typhimurium LT2
cagaucuuuauccugca

SEQ ID NO: 3802138 - RNA, 21 nt, Salmonella typhimurium LT2
cagaucuuuauccugcacgaa

SEQ ID NO: 3802139 - RNA, 17 nt, Salmonella typhimurium LT2
cagaucuuuuugcuccu

SEQ ID NO: 3802140 - RNA, 17 nt, Salmonella typhimurium LT2
cagaugacagugcgcca

SEQ ID NO: 3802141 - RNA, 19 nt, Salmonella typhimurium LT2
cagaugcagguucccgccc

SEQ ID NO: 3802142 - RNA, 21 nt, Salmonella typhimurium LT2
cagaugcgccagauucaugau

SEQ ID NO: 3802143 - RNA, 14 nt, Salmonella typhimurium LT2
cagaugcugcugcg

SEQ ID NO: 3802144 - RNA, 21 nt, Salmonella typhimurium LT2
cagaugcugucuuagugaaau

SEQ ID NO: 3802145 - RNA, 23 nt, Salmonella typhimurium LT2
cagaugcuuaaugcucugcugug

SEQ ID NO: 3802146 - RNA, 14 nt, Salmonella typhimurium LT2
cagauggaaaccgg

SEQ ID NO: 3802147 - RNA, 22 nt, Salmonella typhimurium LT2
cagauggcgauucauaugcgcc

SEQ ID NO: 3802148 - RNA, 19 nt, Salmonella typhimurium LT2
cagauggcggcugcgccuu

SEQ ID NO: 3802149 - RNA, 21 nt, Salmonella typhimurium LT2
cagauggcgucacauggcgaa

SEQ ID NO: 3802150 - RNA, 13 nt, Salmonella typhimurium LT2
cagauggcugcac

SEQ ID NO: 3802151 - RNA, 20 nt, Salmonella typhimurium LT2
cagauggugauagcgcgcca

SEQ ID NO: 3802152 - RNA, 19 nt, Salmonella typhimurium LT2
cagaugucgcggauaugca

SEQ ID NO: 3802153 - RNA, 13 nt, Salmonella typhimurium LT2
cagaugugcuuuu

SEQ ID NO: 3802154 - RNA, 17 nt, Salmonella typhimurium LT2
cagauguuuacgcugcu

SEQ ID NO: 3802155 - RNA, 22 nt, Salmonella typhimurium LT2
cagauuaaagcagguagcgccu

SEQ ID NO: 3802156 - RNA, 15 nt, Salmonella typhimurium LT2
cagauuacccccuuc

SEQ ID NO: 3802157 - RNA, 14 nt, Salmonella typhimurium LT2
cagauuacuaugag

SEQ ID NO: 3802158 - RNA, 16 nt, Salmonella typhimurium LT2
cagauuauuucacuuc

SEQ ID NO: 3802159 - RNA, 18 nt, Salmonella typhimurium LT2
cagauucaugauuucuuc

SEQ ID NO: 3802160 - RNA, 20 nt, Salmonella typhimurium LT2
cagauuccccaaucccacca

SEQ ID NO: 3802161 - RNA, 23 nt, Salmonella typhimurium LT2
cagauuccccaaucccaccacuu

SEQ ID NO: 3802162 - RNA, 13 nt, Salmonella typhimurium LT2
cagauucuucugc

SEQ ID NO: 3802163 - RNA, 22 nt, Salmonella typhimurium LT2
cagauugauacggguaaucaga

SEQ ID NO: 3802164 - RNA, 16 nt, Salmonella typhimurium LT2
cagauugcgaaagaau

SEQ ID NO: 3802165 - RNA, 17 nt, Salmonella typhimurium LT2
cagauuucgcaacagca

SEQ ID NO: 3802166 - RNA, 14 nt, Salmonella typhimurium LT2
cagauuugaacguc

SEQ ID NO: 3802167 - RNA, 15 nt, Salmonella typhimurium LT2
cagauuuucuuuaau

SEQ ID NO: 3802168 - RNA, 18 nt, Salmonella typhimurium LT2
cagcaaaaagaaucgcca

SEQ ID NO: 3802169 - RNA, 21 nt, Salmonella typhimurium LT2
cagcaaaaagaaucgccaggc

SEQ ID NO: 3802170 - RNA, 22 nt, Salmonella typhimurium LT2
cagcaaaauggcaauugcgccg

SEQ ID NO: 3802171 - RNA, 15 nt, Salmonella typhimurium LT2
cagcaaauacagaug

SEQ ID NO: 3802172 - RNA, 22 nt, Salmonella typhimurium LT2
cagcaaaucgcccaucacaugu

SEQ ID NO: 3802173 - RNA, 21 nt, Salmonella typhimurium LT2
cagcaacaaaccgauaaucac

SEQ ID NO: 3802174 - RNA, 16 nt, Salmonella typhimurium LT2
cagcaacagcgcgucc

SEQ ID NO: 3802175 - RNA, 13 nt, Salmonella typhimurium LT2
cagcaacccugcc

SEQ ID NO: 3802176 - RNA, 14 nt, Salmonella typhimurium LT2
cagcaacgccagcg

SEQ ID NO: 3802177 - RNA, 13 nt, Salmonella typhimurium LT2
cagcaacgcgcca

SEQ ID NO: 3802178 - RNA, 20 nt, Salmonella typhimurium LT2
cagcaacgggacggcggcca

SEQ ID NO: 3802179 - RNA, 22 nt, Salmonella typhimurium LT2
cagcaacgggacggcggccagc

SEQ ID NO: 3802180 - RNA, 22 nt, Salmonella typhimurium LT2
cagcaacgugaacugcgccugc

SEQ ID NO: 3802181 - RNA, 19 nt, Salmonella typhimurium LT2
cagcaacuugaaguaugaa

SEQ ID NO: 3802182 - RNA, 19 nt, Salmonella typhimurium LT2
cagcaagaagagaaugucc

SEQ ID NO: 3802183 - RNA, 21 nt, Salmonella typhimurium LT2
cagcaagccggaagcgcgaau

SEQ ID NO: 3802184 - RNA, 18 nt, Salmonella typhimurium LT2
cagcaagucgcgggcgcu

SEQ ID NO: 3802185 - RNA, 14 nt, Salmonella typhimurium LT2
cagcaauaaaagga

SEQ ID NO: 3802186 - RNA, 15 nt, Salmonella typhimurium LT2
cagcaauaacacagg

SEQ ID NO: 3802187 - RNA, 15 nt, Salmonella typhimurium LT2
cagcaauaacaggca

SEQ ID NO: 3802188 - RNA, 17 nt, Salmonella typhimurium LT2
cagcaauaucagccauu

SEQ ID NO: 3802189 - RNA, 15 nt, Salmonella typhimurium LT2
cagcaaugagcaggc

SEQ ID NO: 3802190 - RNA, 18 nt, Salmonella typhimurium LT2
cagcaaugagcaggcccg

SEQ ID NO: 3802191 - RNA, 13 nt, Salmonella typhimurium LT2
cagcaaugauaac

SEQ ID NO: 3802192 - RNA, 16 nt, Salmonella typhimurium LT2
cagcaaugcacugcga

SEQ ID NO: 3802193 - RNA, 17 nt, Salmonella typhimurium LT2
cagcaauguuucaaccu

SEQ ID NO: 3802194 - RNA, 20 nt, Salmonella typhimurium LT2
cagcaauuccgccaucucau

SEQ ID NO: 3802195 - RNA, 23 nt, Salmonella typhimurium LT2
cagcaauuccgccaucucauucg

SEQ ID NO: 3802196 - RNA, 13 nt, Salmonella typhimurium LT2
cagcaauucugcu

SEQ ID NO: 3802197 - RNA, 22 nt, Salmonella typhimurium LT2
cagcaauuucucgcccgccaga

SEQ ID NO: 3802198 - RNA, 14 nt, Salmonella typhimurium LT2
cagcacaaaauccc

SEQ ID NO: 3802199 - RNA, 12 nt, Salmonella typhimurium LT2
cagcacaagggu

SEQ ID NO: 3802200 - RNA, 14 nt, Salmonella typhimurium LT2
cagcacaaucagcg

SEQ ID NO: 3802201 - RNA, 17 nt, Salmonella typhimurium LT2
cagcacaaugacauccg

SEQ ID NO: 3802202 - RNA, 22 nt, Salmonella typhimurium LT2
cagcacaaugccuucugcgccc

SEQ ID NO: 3802203 - RNA, 19 nt, Salmonella typhimurium LT2
cagcacaauggucagcgcc

SEQ ID NO: 3802204 - RNA, 15 nt, Salmonella typhimurium LT2
cagcacacuacacag

SEQ ID NO: 3802205 - RNA, 13 nt, Salmonella typhimurium LT2
cagcacagcaaaa

SEQ ID NO: 3802206 - RNA, 17 nt, Salmonella typhimurium LT2
cagcacaugauguuuua

SEQ ID NO: 3802207 - RNA, 14 nt, Salmonella typhimurium LT2
cagcacaugcaauu

SEQ ID NO: 3802208 - RNA, 18 nt, Salmonella typhimurium LT2
cagcacauuacaggcauc

SEQ ID NO: 3802209 - RNA, 16 nt, Salmonella typhimurium LT2
cagcaccaacgccgcu

SEQ ID NO: 3802210 - RNA, 13 nt, Salmonella typhimurium LT2
cagcaccacgccc

SEQ ID NO: 3802211 - RNA, 17 nt, Salmonella typhimurium LT2
cagcaccaucuuuuccg

SEQ ID NO: 3802212 - RNA, 13 nt, Salmonella typhimurium LT2
cagcaccauggcu

SEQ ID NO: 3802213 - RNA, 17 nt, Salmonella typhimurium LT2
cagcaccauggcuaucc

SEQ ID NO: 3802214 - RNA, 18 nt, Salmonella typhimurium LT2
cagcaccauggcuaucca

SEQ ID NO: 3802215 - RNA, 23 nt, Salmonella typhimurium LT2
cagcaccauguugaccagguugc

SEQ ID NO: 3802216 - RNA, 23 nt, Salmonella typhimurium LT2
cagcaccauuaucgcgccggaac

SEQ ID NO: 3802217 - RNA, 20 nt, Salmonella typhimurium LT2
cagcacccagcgaauuauga

SEQ ID NO: 3802218 - RNA, 13 nt, Salmonella typhimurium LT2
cagcacccaggca

SEQ ID NO: 3802219 - RNA, 16 nt, Salmonella typhimurium LT2
cagcaccgccagcgca

SEQ ID NO: 3802220 - RNA, 20 nt, Salmonella typhimurium LT2
cagcaccgguuuuuccgcuu

SEQ ID NO: 3802221 - RNA, 19 nt, Salmonella typhimurium LT2
cagcaccucaucccccagc

SEQ ID NO: 3802222 - RNA, 21 nt, Salmonella typhimurium LT2
cagcaccucaucccccagccg

SEQ ID NO: 3802223 - RNA, 14 nt, Salmonella typhimurium LT2
cagcacgauaucca

SEQ ID NO: 3802224 - RNA, 15 nt, Salmonella typhimurium LT2
cagcacgaucgccuu

SEQ ID NO: 3802225 - RNA, 16 nt, Salmonella typhimurium LT2
cagcacgaugcauaug

SEQ ID NO: 3802226 - RNA, 17 nt, Salmonella typhimurium LT2
cagcacgcaggcauccg

SEQ ID NO: 3802227 - RNA, 13 nt, Salmonella typhimurium LT2
cagcacgccaccg

SEQ ID NO: 3802228 - RNA, 22 nt, Salmonella typhimurium LT2
cagcacgccaccgggcuuuaau

SEQ ID NO: 3802229 - RNA, 12 nt, Salmonella typhimurium LT2
cagcacgccgga

SEQ ID NO: 3802230 - RNA, 23 nt, Salmonella typhimurium LT2
cagcacgccuaacgaaccauuug

SEQ ID NO: 3802231 - RNA, 19 nt, Salmonella typhimurium LT2
cagcacgcgcugcgccgca

SEQ ID NO: 3802232 - RNA, 19 nt, Salmonella typhimurium LT2
cagcacgcuuacccagcau

SEQ ID NO: 3802233 - RNA, 13 nt, Salmonella typhimurium LT2
cagcacuaacagc

SEQ ID NO: 3802234 - RNA, 14 nt, Salmonella typhimurium LT2
cagcacuaacagca

SEQ ID NO: 3802235 - RNA, 19 nt, Salmonella typhimurium LT2
cagcacuaacagcagcaac

SEQ ID NO: 3802236 - RNA, 21 nt, Salmonella typhimurium LT2
cagcacuaacgaggccaccau

SEQ ID NO: 3802237 - RNA, 15 nt, Salmonella typhimurium LT2
cagcacuucccacug

SEQ ID NO: 3802238 - RNA, 16 nt, Salmonella typhimurium LT2
cagcacuucccacugu

SEQ ID NO: 3802239 - RNA, 15 nt, Salmonella typhimurium LT2
cagcacuucccgcuc

SEQ ID NO: 3802240 - RNA, 17 nt, Salmonella typhimurium LT2
cagcagacaaccgacgc

SEQ ID NO: 3802241 - RNA, 19 nt, Salmonella typhimurium LT2
cagcagacaaccgacgcau

SEQ ID NO: 3802242 - RNA, 16 nt, Salmonella typhimurium LT2
cagcagacaggugaac

SEQ ID NO: 3802243 - RNA, 17 nt, Salmonella typhimurium LT2
cagcagacuauccgcgc

SEQ ID NO: 3802244 - RNA, 22 nt, Salmonella typhimurium LT2
cagcagacugccuacgcggcca

SEQ ID NO: 3802245 - RNA, 23 nt, Salmonella typhimurium LT2
cagcagauagccugccagcacca

SEQ ID NO: 3802246 - RNA, 18 nt, Salmonella typhimurium LT2
cagcagauuuucauccgu

SEQ ID NO: 3802247 - RNA, 23 nt, Salmonella typhimurium LT2
cagcagcacacgcuucugguugu

SEQ ID NO: 3802248 - RNA, 14 nt, Salmonella typhimurium LT2
cagcagcagcgcuu

SEQ ID NO: 3802249 - RNA, 17 nt, Salmonella typhimurium LT2
cagcagccacagaaugc

SEQ ID NO: 3802250 - RNA, 10 nt, Salmonella typhimurium LT2
cagcagccag

SEQ ID NO: 3802251 - RNA, 18 nt, Salmonella typhimurium LT2
cagcagccaugccagcgc

SEQ ID NO: 3802252 - RNA, 20 nt, Salmonella typhimurium LT2
cagcagccgguauccagcgc

SEQ ID NO: 3802253 - RNA, 14 nt, Salmonella typhimurium LT2
cagcagcgacguaa

SEQ ID NO: 3802254 - RNA, 12 nt, Salmonella typhimurium LT2
cagcagcgcgau

SEQ ID NO: 3802255 - RNA, 22 nt, Salmonella typhimurium LT2
cagcagcgcgaucgccccgacc

SEQ ID NO: 3802256 - RNA, 13 nt, Salmonella typhimurium LT2
cagcagcgcgccg

SEQ ID NO: 3802257 - RNA, 13 nt, Salmonella typhimurium LT2
cagcagcgcggca

SEQ ID NO: 3802258 - RNA, 16 nt, Salmonella typhimurium LT2
cagcagcgcuuucuuc

SEQ ID NO: 3802259 - RNA, 12 nt, Salmonella typhimurium LT2
cagcagcgggcu

SEQ ID NO: 3802260 - RNA, 17 nt, Salmonella typhimurium LT2
cagcagcguaauggcca

SEQ ID NO: 3802261 - RNA, 23 nt, Salmonella typhimurium LT2
cagcagcguaauggccaccagca

SEQ ID NO: 3802262 - RNA, 18 nt, Salmonella typhimurium LT2
cagcagcguuggccgccu

SEQ ID NO: 3802263 - RNA, 21 nt, Salmonella typhimurium LT2
cagcagcguuggccgccucgc

SEQ ID NO: 3802264 - RNA, 15 nt, Salmonella typhimurium LT2
cagcagcuccagagc

SEQ ID NO: 3802265 - RNA, 17 nt, Salmonella typhimurium LT2
cagcagcuccccgccgc

SEQ ID NO: 3802266 - RNA, 17 nt, Salmonella typhimurium LT2
cagcagcuucaugcauc

SEQ ID NO: 3802267 - RNA, 22 nt, Salmonella typhimurium LT2
cagcagcuugcgauccauauag

SEQ ID NO: 3802268 - RNA, 15 nt, Salmonella typhimurium LT2
cagcaggcagacgcg

SEQ ID NO: 3802269 - RNA, 15 nt, Salmonella typhimurium LT2
cagcaggccuccgaa

SEQ ID NO: 3802270 - RNA, 16 nt, Salmonella typhimurium LT2
cagcagggccacaacg

SEQ ID NO: 3802271 - RNA, 23 nt, Salmonella typhimurium LT2
cagcagggcguuuuccagcgcgc

SEQ ID NO: 3802272 - RNA, 19 nt, Salmonella typhimurium LT2
cagcagguaaacagacaau

SEQ ID NO: 3802273 - RNA, 15 nt, Salmonella typhimurium LT2
cagcagguagcguuu

SEQ ID NO: 3802274 - RNA, 20 nt, Salmonella typhimurium LT2
cagcaggucgaccaccugcu

SEQ ID NO: 3802275 - RNA, 20 nt, Salmonella typhimurium LT2
cagcaguagccacgguaaca

SEQ ID NO: 3802276 - RNA, 23 nt, Salmonella typhimurium LT2
cagcaguggcucagucagucccg

SEQ ID NO: 3802277 - RNA, 16 nt, Salmonella typhimurium LT2
cagcagugggaaaauu

SEQ ID NO: 3802278 - RNA, 19 nt, Salmonella typhimurium LT2
cagcagugucugcuucguc

SEQ ID NO: 3802279 - RNA, 16 nt, Salmonella typhimurium LT2
cagcaguuccaccagu

SEQ ID NO: 3802280 - RNA, 12 nt, Salmonella typhimurium LT2
cagcaguucgua

SEQ ID NO: 3802281 - RNA, 16 nt, Salmonella typhimurium LT2
cagcaguuugguaaua

SEQ ID NO: 3802282 - RNA, 18 nt, Salmonella typhimurium LT2
cagcaguuuguccauuuc

SEQ ID NO: 3802283 - RNA, 18 nt, Salmonella typhimurium LT2
cagcaguuuuucaaucuu

SEQ ID NO: 3802284 - RNA, 13 nt, Salmonella typhimurium LT2
cagcauaaacauc

SEQ ID NO: 3802285 - RNA, 22 nt, Salmonella typhimurium LT2
cagcauaauaaagcagcggcgg

SEQ ID NO: 3802286 - RNA, 23 nt, Salmonella typhimurium LT2
cagcauaauauccugcaccgccu

SEQ ID NO: 3802287 - RNA, 18 nt, Salmonella typhimurium LT2
cagcauaauauucauaac

SEQ ID NO: 3802288 - RNA, 18 nt, Salmonella typhimurium LT2
cagcauacgacaucgcca

SEQ ID NO: 3802289 - RNA, 13 nt, Salmonella typhimurium LT2
cagcauacgccgc

SEQ ID NO: 3802290 - RNA, 17 nt, Salmonella typhimurium LT2
cagcauacgucugcgcu

SEQ ID NO: 3802291 - RNA, 20 nt, Salmonella typhimurium LT2
cagcauagcgccuucaggca

SEQ ID NO: 3802292 - RNA, 15 nt, Salmonella typhimurium LT2
cagcauauccagcgc

SEQ ID NO: 3802293 - RNA, 23 nt, Salmonella typhimurium LT2
cagcauaucgauagcaucgguca

SEQ ID NO: 3802294 - RNA, 12 nt, Salmonella typhimurium LT2
cagcaucaucuc

SEQ ID NO: 3802295 - RNA, 17 nt, Salmonella typhimurium LT2
cagcaucaucucccagg

SEQ ID NO: 3802296 - RNA, 18 nt, Salmonella typhimurium LT2
cagcaucaucucccaggc

SEQ ID NO: 3802297 - RNA, 20 nt, Salmonella typhimurium LT2
cagcaucaucucccaggccg

SEQ ID NO: 3802298 - RNA, 19 nt, Salmonella typhimurium LT2
cagcaucauggcauacagc

SEQ ID NO: 3802299 - RNA, 21 nt, Salmonella typhimurium LT2
cagcaucaugggcucaucaaa

SEQ ID NO: 3802300 - RNA, 19 nt, Salmonella typhimurium LT2
cagcaucccgcuggcgcca

SEQ ID NO: 3802301 - RNA, 14 nt, Salmonella typhimurium LT2
cagcaucgaccagg

SEQ ID NO: 3802302 - RNA, 15 nt, Salmonella typhimurium LT2
cagcaucgccaucaa

SEQ ID NO: 3802303 - RNA, 14 nt, Salmonella typhimurium LT2
cagcaucugcggcu

SEQ ID NO: 3802304 - RNA, 24 nt, Salmonella typhimurium LT2
cagcaucugcggcuuucaucauuc

SEQ ID NO: 3802305 - RNA, 20 nt, Salmonella typhimurium LT2
cagcaugaauaaccucccgc

SEQ ID NO: 3802306 - RNA, 17 nt, Salmonella typhimurium LT2
cagcaugagccagcccu

SEQ ID NO: 3802307 - RNA, 17 nt, Salmonella typhimurium LT2
cagcaugaucauacugc

SEQ ID NO: 3802308 - RNA, 14 nt, Salmonella typhimurium LT2
cagcaugcccgcca

SEQ ID NO: 3802309 - RNA, 17 nt, Salmonella typhimurium LT2
cagcaugcccgccagcg

SEQ ID NO: 3802310 - RNA, 15 nt, Salmonella typhimurium LT2
cagcauggcgccugc

SEQ ID NO: 3802311 - RNA, 23 nt, Salmonella typhimurium LT2
cagcaugguguguucccgcgcca

SEQ ID NO: 3802312 - RNA, 20 nt, Salmonella typhimurium LT2
cagcauguucaugcgcggcg

SEQ ID NO: 3802313 - RNA, 22 nt, Salmonella typhimurium LT2
cagcauguuucuccugccagcg

SEQ ID NO: 3802314 - RNA, 23 nt, Salmonella typhimurium LT2
cagcauguuucuccugccagcga

SEQ ID NO: 3802315 - RNA, 17 nt, Salmonella typhimurium LT2
cagcauugaccaccaua

SEQ ID NO: 3802316 - RNA, 22 nt, Salmonella typhimurium LT2
cagcauugaggcuacccagaca

SEQ ID NO: 3802317 - RNA, 16 nt, Salmonella typhimurium LT2
cagcauuggucaucgc

SEQ ID NO: 3802318 - RNA, 17 nt, Salmonella typhimurium LT2
cagcauuggucaucgcc

SEQ ID NO: 3802319 - RNA, 21 nt, Salmonella typhimurium LT2
cagcauuggugagagaguugc

SEQ ID NO: 3802320 - RNA, 16 nt, Salmonella typhimurium LT2
cagcauuucaaagcgu

SEQ ID NO: 3802321 - RNA, 14 nt, Salmonella typhimurium LT2
cagcauuuccgccg

SEQ ID NO: 3802322 - RNA, 12 nt, Salmonella typhimurium LT2
cagcauuucuuc

SEQ ID NO: 3802323 - RNA, 19 nt, Salmonella typhimurium LT2
cagcauuuucacaaccgcu

SEQ ID NO: 3802324 - RNA, 14 nt, Salmonella typhimurium LT2
cagccaaagcugac

SEQ ID NO: 3802325 - RNA, 15 nt, Salmonella typhimurium LT2
cagccaaauagcgcc

SEQ ID NO: 3802326 - RNA, 18 nt, Salmonella typhimurium LT2
cagccaaauagcgccaga

SEQ ID NO: 3802327 - RNA, 19 nt, Salmonella typhimurium LT2
cagccaaauagcgccagac

SEQ ID NO: 3802328 - RNA, 16 nt, Salmonella typhimurium LT2
cagccaacaguauaga

SEQ ID NO: 3802329 - RNA, 19 nt, Salmonella typhimurium LT2
cagccaacaguauagaaau

SEQ ID NO: 3802330 - RNA, 21 nt, Salmonella typhimurium LT2
cagccaacaguauagaaauag

SEQ ID NO: 3802331 - RNA, 21 nt, Salmonella typhimurium LT2
cagccacaagagcagcaaccc

SEQ ID NO: 3802332 - RNA, 22 nt, Salmonella typhimurium LT2
cagccacaauuugcugcuguua

SEQ ID NO: 3802333 - RNA, 13 nt, Salmonella typhimurium LT2
cagccacacacug

SEQ ID NO: 3802334 - RNA, 20 nt, Salmonella typhimurium LT2
cagccacacacuguuuaaug

SEQ ID NO: 3802335 - RNA, 15 nt, Salmonella typhimurium LT2
cagccacacugcugu

SEQ ID NO: 3802336 - RNA, 17 nt, Salmonella typhimurium LT2
cagccacggcaacgccg

SEQ ID NO: 3802337 - RNA, 19 nt, Salmonella typhimurium LT2
cagccacggcgcacacgcc

SEQ ID NO: 3802338 - RNA, 20 nt, Salmonella typhimurium LT2
cagccacggcguguugaagu

SEQ ID NO: 3802339 - RNA, 21 nt, Salmonella typhimurium LT2
cagccacgguguggcccagcg

SEQ ID NO: 3802340 - RNA, 22 nt, Salmonella typhimurium LT2
cagccacguugucggcucaucc

SEQ ID NO: 3802341 - RNA, 23 nt, Salmonella typhimurium LT2
cagccacguugucggcucaucca

SEQ ID NO: 3802342 - RNA, 12 nt, Salmonella typhimurium LT2
cagccacucccg

SEQ ID NO: 3802343 - RNA, 14 nt, Salmonella typhimurium LT2
cagccacugcgcca

SEQ ID NO: 3802344 - RNA, 16 nt, Salmonella typhimurium LT2
cagccacugcgccauu

SEQ ID NO: 3802345 - RNA, 21 nt, Salmonella typhimurium LT2
cagccacuggcuggucagcgu

SEQ ID NO: 3802346 - RNA, 18 nt, Salmonella typhimurium LT2
cagccacuucuuccagcg

SEQ ID NO: 3802347 - RNA, 21 nt, Salmonella typhimurium LT2
cagccacuucuuccagcggca

SEQ ID NO: 3802348 - RNA, 13 nt, Salmonella typhimurium LT2
cagccagaagccc

SEQ ID NO: 3802349 - RNA, 16 nt, Salmonella typhimurium LT2
cagccagacggcgccc

SEQ ID NO: 3802350 - RNA, 13 nt, Salmonella typhimurium LT2
cagccagcccagc

SEQ ID NO: 3802351 - RNA, 15 nt, Salmonella typhimurium LT2
cagccagcccagcgc

SEQ ID NO: 3802352 - RNA, 13 nt, Salmonella typhimurium LT2
cagccagccggag

SEQ ID NO: 3802353 - RNA, 15 nt, Salmonella typhimurium LT2
cagccagcgccagcg

SEQ ID NO: 3802354 - RNA, 14 nt, Salmonella typhimurium LT2
cagccagcgccccu

SEQ ID NO: 3802355 - RNA, 11 nt, Salmonella typhimurium LT2
cagccaggcca

SEQ ID NO: 3802356 - RNA, 17 nt, Salmonella typhimurium LT2
cagccaggucugaacca

SEQ ID NO: 3802357 - RNA, 12 nt, Salmonella typhimurium LT2
cagccaguccuc

SEQ ID NO: 3802358 - RNA, 18 nt, Salmonella typhimurium LT2
cagccauaaucaguacug

SEQ ID NO: 3802359 - RNA, 23 nt, Salmonella typhimurium LT2
cagccauaauggauuagguugcu

SEQ ID NO: 3802360 - RNA, 24 nt, Salmonella typhimurium LT2
cagccauaccggcgcgcgccagcu

SEQ ID NO: 3802361 - RNA, 20 nt, Salmonella typhimurium LT2
cagccauguaaaauagcgcc

SEQ ID NO: 3802362 - RNA, 16 nt, Salmonella typhimurium LT2
cagccauuaauuucuu

SEQ ID NO: 3802363 - RNA, 20 nt, Salmonella typhimurium LT2
cagccauuaauuucuuacca

SEQ ID NO: 3802364 - RNA, 16 nt, Salmonella typhimurium LT2
cagcccagguuaccaa

SEQ ID NO: 3802365 - RNA, 20 nt, Salmonella typhimurium LT2
cagcccauaccacaacagaa

SEQ ID NO: 3802366 - RNA, 21 nt, Salmonella typhimurium LT2
cagcccauaccagcgcggcac

SEQ ID NO: 3802367 - RNA, 19 nt, Salmonella typhimurium LT2
cagcccaucggucgcgcgc

SEQ ID NO: 3802368 - RNA, 20 nt, Salmonella typhimurium LT2
cagcccaucggucgcgcgca

SEQ ID NO: 3802369 - RNA, 24 nt, Salmonella typhimurium LT2
cagcccaucuuuuuccugcaugau

SEQ ID NO: 3802370 - RNA, 14 nt, Salmonella typhimurium LT2
cagccccagcacca

SEQ ID NO: 3802371 - RNA, 16 nt, Salmonella typhimurium LT2
cagccccagcaccaga

SEQ ID NO: 3802372 - RNA, 13 nt, Salmonella typhimurium LT2
cagccccagcgcc

SEQ ID NO: 3802373 - RNA, 14 nt, Salmonella typhimurium LT2
cagccccagcgcca

SEQ ID NO: 3802374 - RNA, 16 nt, Salmonella typhimurium LT2
cagccccagcgccagc

SEQ ID NO: 3802375 - RNA, 13 nt, Salmonella typhimurium LT2
cagccccaggcca

SEQ ID NO: 3802376 - RNA, 16 nt, Salmonella typhimurium LT2
cagccccuucgcuguc

SEQ ID NO: 3802377 - RNA, 17 nt, Salmonella typhimurium LT2
cagccccuucgcugucc

SEQ ID NO: 3802378 - RNA, 21 nt, Salmonella typhimurium LT2
cagcccgacuaccggcaccag

SEQ ID NO: 3802379 - RNA, 16 nt, Salmonella typhimurium LT2
cagcccgauacccgcc

SEQ ID NO: 3802380 - RNA, 20 nt, Salmonella typhimurium LT2
cagcccgaucaucuccugua

SEQ ID NO: 3802381 - RNA, 13 nt, Salmonella typhimurium LT2
cagcccgccagca

SEQ ID NO: 3802382 - RNA, 14 nt, Salmonella typhimurium LT2
cagcccgccagcac

SEQ ID NO: 3802383 - RNA, 15 nt, Salmonella typhimurium LT2
cagcccggcgcacac

SEQ ID NO: 3802384 - RNA, 18 nt, Salmonella typhimurium LT2
cagcccggcgcacacccu

SEQ ID NO: 3802385 - RNA, 19 nt, Salmonella typhimurium LT2
cagcccggcgcacacccug

SEQ ID NO: 3802386 - RNA, 19 nt, Salmonella typhimurium LT2
cagcccuauaacagcgcca

SEQ ID NO: 3802387 - RNA, 22 nt, Salmonella typhimurium LT2
cagcccuauaacagcgccagua

SEQ ID NO: 3802388 - RNA, 12 nt, Salmonella typhimurium LT2
cagcccucauua

SEQ ID NO: 3802389 - RNA, 15 nt, Salmonella typhimurium LT2
cagcccugccaccag

SEQ ID NO: 3802390 - RNA, 19 nt, Salmonella typhimurium LT2
cagcccugccaccagcgua

SEQ ID NO: 3802391 - RNA, 21 nt, Salmonella typhimurium LT2
cagcccugccaccagcguacc

SEQ ID NO: 3802392 - RNA, 13 nt, Salmonella typhimurium LT2
cagcccugugccg

SEQ ID NO: 3802393 - RNA, 12 nt, Salmonella typhimurium LT2
cagcccuuccag

SEQ ID NO: 3802394 - RNA, 14 nt, Salmonella typhimurium LT2
cagcccuuccagcg

SEQ ID NO: 3802395 - RNA, 16 nt, Salmonella typhimurium LT2
cagcccuuccagcgga

SEQ ID NO: 3802396 - RNA, 13 nt, Salmonella typhimurium LT2
cagccgacgcauu

SEQ ID NO: 3802397 - RNA, 21 nt, Salmonella typhimurium LT2
cagccgacgcauuucuccuga

SEQ ID NO: 3802398 - RNA, 23 nt, Salmonella typhimurium LT2
cagccgacgcucuuccucaauau

SEQ ID NO: 3802399 - RNA, 20 nt, Salmonella typhimurium LT2
cagccgacuauuccgcaaac

SEQ ID NO: 3802400 - RNA, 11 nt, Salmonella typhimurium LT2
cagccgaggug

SEQ ID NO: 3802401 - RNA, 14 nt, Salmonella typhimurium LT2
cagccgaucaggcc

SEQ ID NO: 3802402 - RNA, 17 nt, Salmonella typhimurium LT2
cagccgaucaucacgaa

SEQ ID NO: 3802403 - RNA, 20 nt, Salmonella typhimurium LT2
cagccgaucuauuucauaau

SEQ ID NO: 3802404 - RNA, 17 nt, Salmonella typhimurium LT2
cagccgauuucauacca

SEQ ID NO: 3802405 - RNA, 12 nt, Salmonella typhimurium LT2
cagccgcaucuu

SEQ ID NO: 3802406 - RNA, 19 nt, Salmonella typhimurium LT2
cagccgcauuuuucauggu

SEQ ID NO: 3802407 - RNA, 23 nt, Salmonella typhimurium LT2
cagccgcauuuuucauggugaac

SEQ ID NO: 3802408 - RNA, 14 nt, Salmonella typhimurium LT2
cagccgcauuuuuu

SEQ ID NO: 3802409 - RNA, 12 nt, Salmonella typhimurium LT2
cagccgccaggc

SEQ ID NO: 3802410 - RNA, 12 nt, Salmonella typhimurium LT2
cagccgccagua

SEQ ID NO: 3802411 - RNA, 13 nt, Salmonella typhimurium LT2
cagccgccauccg

SEQ ID NO: 3802412 - RNA, 22 nt, Salmonella typhimurium LT2
cagccgccauccggcaucucuu

SEQ ID NO: 3802413 - RNA, 21 nt, Salmonella typhimurium LT2
cagccgcccgcgauaaaaauc

SEQ ID NO: 3802414 - RNA, 17 nt, Salmonella typhimurium LT2
cagccgcgccaucuccu

SEQ ID NO: 3802415 - RNA, 21 nt, Salmonella typhimurium LT2
cagccgcggcgcuuucgccac

SEQ ID NO: 3802416 - RNA, 17 nt, Salmonella typhimurium LT2
cagccgcguugcgcuga

SEQ ID NO: 3802417 - RNA, 21 nt, Salmonella typhimurium LT2
cagccgcguugcgcugaagua

SEQ ID NO: 3802418 - RNA, 22 nt, Salmonella typhimurium LT2
cagccgcuuuccgccgccgcca

SEQ ID NO: 3802419 - RNA, 21 nt, Salmonella typhimurium LT2
cagccggaaaucaauuccggu

SEQ ID NO: 3802420 - RNA, 16 nt, Salmonella typhimurium LT2
cagccgggcauaugau

SEQ ID NO: 3802421 - RNA, 17 nt, Salmonella typhimurium LT2
cagccgguauccagcgc

SEQ ID NO: 3802422 - RNA, 13 nt, Salmonella typhimurium LT2
cagccggucagcg

SEQ ID NO: 3802423 - RNA, 16 nt, Salmonella typhimurium LT2
cagccguaccacccgu

SEQ ID NO: 3802424 - RNA, 23 nt, Salmonella typhimurium LT2
cagccgucaaacaucgcgcucca

SEQ ID NO: 3802425 - RNA, 18 nt, Salmonella typhimurium LT2
cagccguuucuucugucc

SEQ ID NO: 3802426 - RNA, 12 nt, Salmonella typhimurium LT2
cagccuaaaaac

SEQ ID NO: 3802427 - RNA, 16 nt, Salmonella typhimurium LT2
cagccuaccugccgcc

SEQ ID NO: 3802428 - RNA, 13 nt, Salmonella typhimurium LT2
cagccuaucgcca

SEQ ID NO: 3802429 - RNA, 13 nt, Salmonella typhimurium LT2
cagccugaaucag

SEQ ID NO: 3802430 - RNA, 18 nt, Salmonella typhimurium LT2
cagccugaaucagcaucu

SEQ ID NO: 3802431 - RNA, 17 nt, Salmonella typhimurium LT2
cagccugagcgccagcg

SEQ ID NO: 3802432 - RNA, 19 nt, Salmonella typhimurium LT2
cagccugagcgccagcgug

SEQ ID NO: 3802433 - RNA, 16 nt, Salmonella typhimurium LT2
cagccugcccgccuga

SEQ ID NO: 3802434 - RNA, 15 nt, Salmonella typhimurium LT2
cagccugccgucuuu

SEQ ID NO: 3802435 - RNA, 16 nt, Salmonella typhimurium LT2
cagccuggcggcuucc

SEQ ID NO: 3802436 - RNA, 18 nt, Salmonella typhimurium LT2
cagccuugauaccgccgc

SEQ ID NO: 3802437 - RNA, 14 nt, Salmonella typhimurium LT2
cagccuuuuucucg

SEQ ID NO: 3802438 - RNA, 19 nt, Salmonella typhimurium LT2
cagcgaaacgcgcuaucaa

SEQ ID NO: 3802439 - RNA, 19 nt, Salmonella typhimurium LT2
cagcgaaacugcgcgccgg

SEQ ID NO: 3802440 - RNA, 21 nt, Salmonella typhimurium LT2
cagcgaaaugacagccaccag

SEQ ID NO: 3802441 - RNA, 23 nt, Salmonella typhimurium LT2
cagcgaaaugacagccaccagcg

SEQ ID NO: 3802442 - RNA, 16 nt, Salmonella typhimurium LT2
cagcgaaccgcagcgu

SEQ ID NO: 3802443 - RNA, 16 nt, Salmonella typhimurium LT2
cagcgaauuccggcca

SEQ ID NO: 3802444 - RNA, 13 nt, Salmonella typhimurium LT2
cagcgacagccag

SEQ ID NO: 3802445 - RNA, 17 nt, Salmonella typhimurium LT2
cagcgacauccucuuca

SEQ ID NO: 3802446 - RNA, 17 nt, Salmonella typhimurium LT2
cagcgaccacgccaccg

SEQ ID NO: 3802447 - RNA, 19 nt, Salmonella typhimurium LT2
cagcgacccuucauacugc

SEQ ID NO: 3802448 - RNA, 23 nt, Salmonella typhimurium LT2
cagcgacgaugaaauaaacgacc

SEQ ID NO: 3802449 - RNA, 23 nt, Salmonella typhimurium LT2
cagcgacgccagauuaucggcca

SEQ ID NO: 3802450 - RNA, 17 nt, Salmonella typhimurium LT2
cagcgacggaaccgucu

SEQ ID NO: 3802451 - RNA, 18 nt, Salmonella typhimurium LT2
cagcgacggaaccgucuu

SEQ ID NO: 3802452 - RNA, 20 nt, Salmonella typhimurium LT2
cagcgacucauucagcaacu

SEQ ID NO: 3802453 - RNA, 20 nt, Salmonella typhimurium LT2
cagcgacugcuuccccaauu

SEQ ID NO: 3802454 - RNA, 15 nt, Salmonella typhimurium LT2
cagcgacuucaggcg

SEQ ID NO: 3802455 - RNA, 15 nt, Salmonella typhimurium LT2
cagcgagccuuccau

SEQ ID NO: 3802456 - RNA, 17 nt, Salmonella typhimurium LT2
cagcgagcgcaguccag

SEQ ID NO: 3802457 - RNA, 16 nt, Salmonella typhimurium LT2
cagcgagcgcauacgc

SEQ ID NO: 3802458 - RNA, 19 nt, Salmonella typhimurium LT2
cagcgaggccucuccucga

SEQ ID NO: 3802459 - RNA, 20 nt, Salmonella typhimurium LT2
cagcgaguuccaccauaggc

SEQ ID NO: 3802460 - RNA, 22 nt, Salmonella typhimurium LT2
cagcgaguuccaccauaggcca

SEQ ID NO: 3802461 - RNA, 20 nt, Salmonella typhimurium LT2
cagcgauaaacgccagcccu

SEQ ID NO: 3802462 - RNA, 19 nt, Salmonella typhimurium LT2
cagcgauaaccgccgccgc

SEQ ID NO: 3802463 - RNA, 13 nt, Salmonella typhimurium LT2
cagcgauacgcac

SEQ ID NO: 3802464 - RNA, 14 nt, Salmonella typhimurium LT2
cagcgauagucguu

SEQ ID NO: 3802465 - RNA, 18 nt, Salmonella typhimurium LT2
cagcgauaguuguuacgg

SEQ ID NO: 3802466 - RNA, 15 nt, Salmonella typhimurium LT2
cagcgaucacgccgu

SEQ ID NO: 3802467 - RNA, 19 nt, Salmonella typhimurium LT2
cagcgaucaggggucagcg

SEQ ID NO: 3802468 - RNA, 20 nt, Salmonella typhimurium LT2
cagcgaucaggggucagcgu

SEQ ID NO: 3802469 - RNA, 21 nt, Salmonella typhimurium LT2
cagcgauccagaccggcauga

SEQ ID NO: 3802470 - RNA, 15 nt, Salmonella typhimurium LT2
cagcgauccagccgc

SEQ ID NO: 3802471 - RNA, 18 nt, Salmonella typhimurium LT2
cagcgauccagccgcagu

SEQ ID NO: 3802472 - RNA, 18 nt, Salmonella typhimurium LT2
cagcgauguaguuaacuc

SEQ ID NO: 3802473 - RNA, 14 nt, Salmonella typhimurium LT2
cagcgauugcgcca

SEQ ID NO: 3802474 - RNA, 16 nt, Salmonella typhimurium LT2
cagcgauugcgccaga

SEQ ID NO: 3802475 - RNA, 21 nt, Salmonella typhimurium LT2
cagcgauuuuuacgccauuca

SEQ ID NO: 3802476 - RNA, 19 nt, Salmonella typhimurium LT2
cagcgcaaacaacccggcu

SEQ ID NO: 3802477 - RNA, 22 nt, Salmonella typhimurium LT2
cagcgcaaacaacccggcugcc

SEQ ID NO: 3802478 - RNA, 20 nt, Salmonella typhimurium LT2
cagcgcaaaguuuucuuccg

SEQ ID NO: 3802479 - RNA, 14 nt, Salmonella typhimurium LT2
cagcgcaacgcgca

SEQ ID NO: 3802480 - RNA, 15 nt, Salmonella typhimurium LT2
cagcgcaacgcgcau

SEQ ID NO: 3802481 - RNA, 17 nt, Salmonella typhimurium LT2
cagcgcaaucugcucga

SEQ ID NO: 3802482 - RNA, 17 nt, Salmonella typhimurium LT2
cagcgcaccuucaacag

SEQ ID NO: 3802483 - RNA, 18 nt, Salmonella typhimurium LT2
cagcgcagucagugaaaa

SEQ ID NO: 3802484 - RNA, 17 nt, Salmonella typhimurium LT2
cagcgcauagcugcccu

SEQ ID NO: 3802485 - RNA, 21 nt, Salmonella typhimurium LT2
cagcgcaucauccccaccacu

SEQ ID NO: 3802486 - RNA, 14 nt, Salmonella typhimurium LT2
cagcgcaucauggu

SEQ ID NO: 3802487 - RNA, 23 nt, Salmonella typhimurium LT2
cagcgcaucgauauaagcgccgu

SEQ ID NO: 3802488 - RNA, 21 nt, Salmonella typhimurium LT2
cagcgcaucgcccugccagug

SEQ ID NO: 3802489 - RNA, 14 nt, Salmonella typhimurium LT2
cagcgcauggaaga

SEQ ID NO: 3802490 - RNA, 20 nt, Salmonella typhimurium LT2
cagcgcauuaccgccgccuu

SEQ ID NO: 3802491 - RNA, 16 nt, Salmonella typhimurium LT2
cagcgccaacgccacu

SEQ ID NO: 3802492 - RNA, 13 nt, Salmonella typhimurium LT2
cagcgccaauacc

SEQ ID NO: 3802493 - RNA, 12 nt, Salmonella typhimurium LT2
cagcgccaccgg

SEQ ID NO: 3802494 - RNA, 23 nt, Salmonella typhimurium LT2
cagcgccagaauagacgccaugu

SEQ ID NO: 3802495 - RNA, 14 nt, Salmonella typhimurium LT2
cagcgccagcagca

SEQ ID NO: 3802496 - RNA, 12 nt, Salmonella typhimurium LT2
cagcgccagcgc

SEQ ID NO: 3802497 - RNA, 15 nt, Salmonella typhimurium LT2
cagcgccagcgcuga

SEQ ID NO: 3802498 - RNA, 13 nt, Salmonella typhimurium LT2
cagcgccagcgua

SEQ ID NO: 3802499 - RNA, 15 nt, Salmonella typhimurium LT2
cagcgccagcuccau

SEQ ID NO: 3802500 - RNA, 21 nt, Salmonella typhimurium LT2
cagcgccagcugcgucauguc

SEQ ID NO: 3802501 - RNA, 18 nt, Salmonella typhimurium LT2
cagcgccaguuuuucccg

SEQ ID NO: 3802502 - RNA, 22 nt, Salmonella typhimurium LT2
cagcgccauaaucgcguuuucc

SEQ ID NO: 3802503 - RNA, 15 nt, Salmonella typhimurium LT2
cagcgccaucaggaa

SEQ ID NO: 3802504 - RNA, 17 nt, Salmonella typhimurium LT2
cagcgccaucaggcccc

SEQ ID NO: 3802505 - RNA, 17 nt, Salmonella typhimurium LT2
cagcgccaucaggccua

SEQ ID NO: 3802506 - RNA, 23 nt, Salmonella typhimurium LT2
cagcgccaucugcucgcgcggca

SEQ ID NO: 3802507 - RNA, 15 nt, Salmonella typhimurium LT2
cagcgcccccagcaa

SEQ ID NO: 3802508 - RNA, 18 nt, Salmonella typhimurium LT2
cagcgcccgagcgacgcc

SEQ ID NO: 3802509 - RNA, 22 nt, Salmonella typhimurium LT2
cagcgccgccuguacuuccggu

SEQ ID NO: 3802510 - RNA, 18 nt, Salmonella typhimurium LT2
cagcgccgcgaaugugcc

SEQ ID NO: 3802511 - RNA, 18 nt, Salmonella typhimurium LT2
cagcgccgcgcaggcgau

SEQ ID NO: 3802512 - RNA, 14 nt, Salmonella typhimurium LT2
cagcgccgcgccga

SEQ ID NO: 3802513 - RNA, 14 nt, Salmonella typhimurium LT2
cagcgccgcgggcu

SEQ ID NO: 3802514 - RNA, 20 nt, Salmonella typhimurium LT2
cagcgccggauaauccagac

SEQ ID NO: 3802515 - RNA, 17 nt, Salmonella typhimurium LT2
cagcgccggcaacagcu

SEQ ID NO: 3802516 - RNA, 17 nt, Salmonella typhimurium LT2
cagcgccucggcgccca

SEQ ID NO: 3802517 - RNA, 20 nt, Salmonella typhimurium LT2
cagcgccucggcgcccagcg

SEQ ID NO: 3802518 - RNA, 23 nt, Salmonella typhimurium LT2
cagcgccucggcgcccagcgugc

SEQ ID NO: 3802519 - RNA, 14 nt, Salmonella typhimurium LT2
cagcgccugacggc

SEQ ID NO: 3802520 - RNA, 16 nt, Salmonella typhimurium LT2
cagcgccugcgcggca

SEQ ID NO: 3802521 - RNA, 13 nt, Salmonella typhimurium LT2
cagcgccugcgcu

SEQ ID NO: 3802522 - RNA, 19 nt, Salmonella typhimurium LT2
cagcgccugcugcaacguc

SEQ ID NO: 3802523 - RNA, 19 nt, Salmonella typhimurium LT2
cagcgccuuuucaaaagag

SEQ ID NO: 3802524 - RNA, 14 nt, Salmonella typhimurium LT2
cagcgcgaccagcg

SEQ ID NO: 3802525 - RNA, 16 nt, Salmonella typhimurium LT2
cagcgcgaccagcgug

SEQ ID NO: 3802526 - RNA, 22 nt, Salmonella typhimurium LT2
cagcgcgaccugcaucccuuuc

SEQ ID NO: 3802527 - RNA, 20 nt, Salmonella typhimurium LT2
cagcgcgaguauucgcgccc

SEQ ID NO: 3802528 - RNA, 21 nt, Salmonella typhimurium LT2
cagcgcgaguauucgcgcccu

SEQ ID NO: 3802529 - RNA, 18 nt, Salmonella typhimurium LT2
cagcgcgauacgcagaac

SEQ ID NO: 3802530 - RNA, 15 nt, Salmonella typhimurium LT2
cagcgcgcaaaaacc

SEQ ID NO: 3802531 - RNA, 12 nt, Salmonella typhimurium LT2
cagcgcgccgca

SEQ ID NO: 3802532 - RNA, 14 nt, Salmonella typhimurium LT2
cagcgcgccgcagc

SEQ ID NO: 3802533 - RNA, 16 nt, Salmonella typhimurium LT2
cagcgcgccgccaacg

SEQ ID NO: 3802534 - RNA, 12 nt, Salmonella typhimurium LT2
cagcgcgccgcg

SEQ ID NO: 3802535 - RNA, 18 nt, Salmonella typhimurium LT2
cagcgcgccgucaucgcu

SEQ ID NO: 3802536 - RNA, 20 nt, Salmonella typhimurium LT2
cagcgcgcgcgcaaagcguc

SEQ ID NO: 3802537 - RNA, 18 nt, Salmonella typhimurium LT2
cagcgcgcgugggaacag

SEQ ID NO: 3802538 - RNA, 15 nt, Salmonella typhimurium LT2
cagcgcgcuccagac

SEQ ID NO: 3802539 - RNA, 17 nt, Salmonella typhimurium LT2
cagcgcgcuccagacca

SEQ ID NO: 3802540 - RNA, 17 nt, Salmonella typhimurium LT2
cagcgcggccugcgugc

SEQ ID NO: 3802541 - RNA, 14 nt, Salmonella typhimurium LT2
cagcgcggcgugau

SEQ ID NO: 3802542 - RNA, 20 nt, Salmonella typhimurium LT2
cagcgcgggcgaggccucgu

SEQ ID NO: 3802543 - RNA, 17 nt, Salmonella typhimurium LT2
cagcgcgguuuccacac

SEQ ID NO: 3802544 - RNA, 18 nt, Salmonella typhimurium LT2
cagcgcguccagcccgcu

SEQ ID NO: 3802545 - RNA, 17 nt, Salmonella typhimurium LT2
cagcgcguccagcggca

SEQ ID NO: 3802546 - RNA, 16 nt, Salmonella typhimurium LT2
cagcgcguccuccagc

SEQ ID NO: 3802547 - RNA, 20 nt, Salmonella typhimurium LT2
cagcgcguccuccagcgugc

SEQ ID NO: 3802548 - RNA, 12 nt, Salmonella typhimurium LT2
cagcgcguccuu

SEQ ID NO: 3802549 - RNA, 19 nt, Salmonella typhimurium LT2
cagcgcuaacggcgguacc

SEQ ID NO: 3802550 - RNA, 20 nt, Salmonella typhimurium LT2
cagcgcuaccagcgcggcgc

SEQ ID NO: 3802551 - RNA, 22 nt, Salmonella typhimurium LT2
cagcgcuaccagcgcggcgcca

SEQ ID NO: 3802552 - RNA, 15 nt, Salmonella typhimurium LT2
cagcgcuccaccaac

SEQ ID NO: 3802553 - RNA, 15 nt, Salmonella typhimurium LT2
cagcgcuccacgcgu

SEQ ID NO: 3802554 - RNA, 15 nt, Salmonella typhimurium LT2
cagcgcuccgacaaa

SEQ ID NO: 3802555 - RNA, 23 nt, Salmonella typhimurium LT2
cagcgcuccgggguucuuuuuaa

SEQ ID NO: 3802556 - RNA, 23 nt, Salmonella typhimurium LT2
cagcgcugcuguaacagacgcag

SEQ ID NO: 3802557 - RNA, 20 nt, Salmonella typhimurium LT2
cagcgcuguuuuuccgcuuu

SEQ ID NO: 3802558 - RNA, 16 nt, Salmonella typhimurium LT2
cagcgcuuagcggcac

SEQ ID NO: 3802559 - RNA, 18 nt, Salmonella typhimurium LT2
cagcgcuuugccgcugcu

SEQ ID NO: 3802560 - RNA, 22 nt, Salmonella typhimurium LT2
cagcgcuuugccgcugcugccu

SEQ ID NO: 3802561 - RNA, 23 nt, Salmonella typhimurium LT2
cagcgcuuugccgcugcugccuu

SEQ ID NO: 3802562 - RNA, 16 nt, Salmonella typhimurium LT2
cagcgcuuuugccgcg

SEQ ID NO: 3802563 - RNA, 23 nt, Salmonella typhimurium LT2
cagcgcuuuugccgcgcccagcg

SEQ ID NO: 3802564 - RNA, 20 nt, Salmonella typhimurium LT2
cagcggaaagugaaggccag

SEQ ID NO: 3802565 - RNA, 20 nt, Salmonella typhimurium LT2
cagcggaagggccuuuggca

SEQ ID NO: 3802566 - RNA, 13 nt, Salmonella typhimurium LT2
cagcggaaucccc

SEQ ID NO: 3802567 - RNA, 20 nt, Salmonella typhimurium LT2
cagcggaauccccgccgcca

SEQ ID NO: 3802568 - RNA, 19 nt, Salmonella typhimurium LT2
cagcggaauuaacugcacu

SEQ ID NO: 3802569 - RNA, 15 nt, Salmonella typhimurium LT2
cagcggaauucccac

SEQ ID NO: 3802570 - RNA, 16 nt, Salmonella typhimurium LT2
cagcggacggcuaaua

SEQ ID NO: 3802571 - RNA, 23 nt, Salmonella typhimurium LT2
cagcggauugccauacacgcggc

SEQ ID NO: 3802572 - RNA, 17 nt, Salmonella typhimurium LT2
cagcggcaagcgcgcca

SEQ ID NO: 3802573 - RNA, 15 nt, Salmonella typhimurium LT2
cagcggcaccccuuc

SEQ ID NO: 3802574 - RNA, 21 nt, Salmonella typhimurium LT2
cagcggcaggauccccauccc

SEQ ID NO: 3802575 - RNA, 15 nt, Salmonella typhimurium LT2
cagcggcaguaaauu

SEQ ID NO: 3802576 - RNA, 14 nt, Salmonella typhimurium LT2
cagcggccagggca

SEQ ID NO: 3802577 - RNA, 22 nt, Salmonella typhimurium LT2
cagcggcccgcgcugaauggca

SEQ ID NO: 3802578 - RNA, 19 nt, Salmonella typhimurium LT2
cagcggcgccaucaccauc

SEQ ID NO: 3802579 - RNA, 18 nt, Salmonella typhimurium LT2
cagcggcgccgcaaugcc

SEQ ID NO: 3802580 - RNA, 13 nt, Salmonella typhimurium LT2
cagcggcgcgcca

SEQ ID NO: 3802581 - RNA, 15 nt, Salmonella typhimurium LT2
cagcggcgcgccgcu

SEQ ID NO: 3802582 - RNA, 17 nt, Salmonella typhimurium LT2
cagcggcgguuauccgc

SEQ ID NO: 3802583 - RNA, 14 nt, Salmonella typhimurium LT2
cagcggcucgcguu

SEQ ID NO: 3802584 - RNA, 21 nt, Salmonella typhimurium LT2
cagcgggcuaugcugaagcag

SEQ ID NO: 3802585 - RNA, 17 nt, Salmonella typhimurium LT2
cagcgggcuggcauuca

SEQ ID NO: 3802586 - RNA, 21 nt, Salmonella typhimurium LT2
cagcgggugaucgcuugccac

SEQ ID NO: 3802587 - RNA, 15 nt, Salmonella typhimurium LT2
cagcgggugaugcgc

SEQ ID NO: 3802588 - RNA, 21 nt, Salmonella typhimurium LT2
cagcgggugaugcgccagcca

SEQ ID NO: 3802589 - RNA, 13 nt, Salmonella typhimurium LT2
cagcggugcgcca

SEQ ID NO: 3802590 - RNA, 22 nt, Salmonella typhimurium LT2
cagcgguuacuuuugaacauaa

SEQ ID NO: 3802591 - RNA, 23 nt, Salmonella typhimurium LT2
cagcgguuacuuuugaacauaaa

SEQ ID NO: 3802592 - RNA, 22 nt, Salmonella typhimurium LT2
cagcgguugcaugaaauccugg

SEQ ID NO: 3802593 - RNA, 17 nt, Salmonella typhimurium LT2
cagcgguuucaggccag

SEQ ID NO: 3802594 - RNA, 17 nt, Salmonella typhimurium LT2
cagcgguuucauauggg

SEQ ID NO: 3802595 - RNA, 21 nt, Salmonella typhimurium LT2
cagcguaacuguugccccgcu

SEQ ID NO: 3802596 - RNA, 22 nt, Salmonella typhimurium LT2
cagcguaauacaggcgauaucg

SEQ ID NO: 3802597 - RNA, 19 nt, Salmonella typhimurium LT2
cagcguaaugcgccaggca

SEQ ID NO: 3802598 - RNA, 18 nt, Salmonella typhimurium LT2
cagcguaauggccaccag

SEQ ID NO: 3802599 - RNA, 18 nt, Salmonella typhimurium LT2
cagcguacaauggcaggc

SEQ ID NO: 3802600 - RNA, 17 nt, Salmonella typhimurium LT2
cagcguaccacgccgca

SEQ ID NO: 3802601 - RNA, 15 nt, Salmonella typhimurium LT2
cagcguaccagcggu

SEQ ID NO: 3802602 - RNA, 21 nt, Salmonella typhimurium LT2
cagcguaccugcggcaauggc

SEQ ID NO: 3802603 - RNA, 23 nt, Salmonella typhimurium LT2
cagcguaguuuauucuucuccuc

SEQ ID NO: 3802604 - RNA, 16 nt, Salmonella typhimurium LT2
cagcguauacgccgga

SEQ ID NO: 3802605 - RNA, 22 nt, Salmonella typhimurium LT2
cagcgucacucuuacggcgccc

SEQ ID NO: 3802606 - RNA, 15 nt, Salmonella typhimurium LT2
cagcgucacuggcca

SEQ ID NO: 3802607 - RNA, 16 nt, Salmonella typhimurium LT2
cagcgucagcgggcca

SEQ ID NO: 3802608 - RNA, 13 nt, Salmonella typhimurium LT2
cagcgucauuaaa

SEQ ID NO: 3802609 - RNA, 16 nt, Salmonella typhimurium LT2
cagcgucccggcgucu

SEQ ID NO: 3802610 - RNA, 14 nt, Salmonella typhimurium LT2
cagcgucgcgcgau

SEQ ID NO: 3802611 - RNA, 15 nt, Salmonella typhimurium LT2
cagcgucguccagcc

SEQ ID NO: 3802612 - RNA, 16 nt, Salmonella typhimurium LT2
cagcgucucagcaggc

SEQ ID NO: 3802613 - RNA, 12 nt, Salmonella typhimurium LT2
cagcgucugccc

SEQ ID NO: 3802614 - RNA, 18 nt, Salmonella typhimurium LT2
cagcgugaagcugccgua

SEQ ID NO: 3802615 - RNA, 21 nt, Salmonella typhimurium LT2
cagcgugacguucaucauuuu

SEQ ID NO: 3802616 - RNA, 15 nt, Salmonella typhimurium LT2
cagcgugccgguaaa

SEQ ID NO: 3802617 - RNA, 23 nt, Salmonella typhimurium LT2
cagcgugcgguaagcguucagcg

SEQ ID NO: 3802618 - RNA, 18 nt, Salmonella typhimurium LT2
cagcguggccuuauccag

SEQ ID NO: 3802619 - RNA, 13 nt, Salmonella typhimurium LT2
cagcgugggaagc

SEQ ID NO: 3802620 - RNA, 16 nt, Salmonella typhimurium LT2
cagcguguuucaucuc

SEQ ID NO: 3802621 - RNA, 19 nt, Salmonella typhimurium LT2
cagcguguuucaucucauc

SEQ ID NO: 3802622 - RNA, 22 nt, Salmonella typhimurium LT2
cagcguuaccucuuucgccgcu

SEQ ID NO: 3802623 - RNA, 17 nt, Salmonella typhimurium LT2
cagcguuacuguagcug

SEQ ID NO: 3802624 - RNA, 22 nt, Salmonella typhimurium LT2
cagcguugcguguuguacagca

SEQ ID NO: 3802625 - RNA, 16 nt, Salmonella typhimurium LT2
cagcguuggccgccuc

SEQ ID NO: 3802626 - RNA, 17 nt, Salmonella typhimurium LT2
cagcguuggugccgcca

SEQ ID NO: 3802627 - RNA, 18 nt, Salmonella typhimurium LT2
cagcguuucuggaaguag

SEQ ID NO: 3802628 - RNA, 21 nt, Salmonella typhimurium LT2
cagcguuuucauaucugcgcc

SEQ ID NO: 3802629 - RNA, 15 nt, Salmonella typhimurium LT2
cagcguuuugcgcuc

SEQ ID NO: 3802630 - RNA, 19 nt, Salmonella typhimurium LT2
cagcuaaaaacagcgcaau

SEQ ID NO: 3802631 - RNA, 19 nt, Salmonella typhimurium LT2
cagcuaaaaacgccaauca

SEQ ID NO: 3802632 - RNA, 15 nt, Salmonella typhimurium LT2
cagcuaauuuuacuu

SEQ ID NO: 3802633 - RNA, 15 nt, Salmonella typhimurium LT2
cagcuauagacgaca

SEQ ID NO: 3802634 - RNA, 16 nt, Salmonella typhimurium LT2
cagcuauccagcuucu

SEQ ID NO: 3802635 - RNA, 16 nt, Salmonella typhimurium LT2
cagcucaaaucgcggc

SEQ ID NO: 3802636 - RNA, 18 nt, Salmonella typhimurium LT2
cagcucaaaucgcggcgc

SEQ ID NO: 3802637 - RNA, 21 nt, Salmonella typhimurium LT2
cagcucaauaucauagugccg

SEQ ID NO: 3802638 - RNA, 14 nt, Salmonella typhimurium LT2
cagcucaccagcca

SEQ ID NO: 3802639 - RNA, 20 nt, Salmonella typhimurium LT2
cagcucacggauauugcccg

SEQ ID NO: 3802640 - RNA, 14 nt, Salmonella typhimurium LT2
cagcucauaacggc

SEQ ID NO: 3802641 - RNA, 20 nt, Salmonella typhimurium LT2
cagcucauacccuuccaguu

SEQ ID NO: 3802642 - RNA, 12 nt, Salmonella typhimurium LT2
cagcuccagagc

SEQ ID NO: 3802643 - RNA, 17 nt, Salmonella typhimurium LT2
cagcuccagagcgccgu

SEQ ID NO: 3802644 - RNA, 20 nt, Salmonella typhimurium LT2
cagcuccagccgcugccuuc

SEQ ID NO: 3802645 - RNA, 16 nt, Salmonella typhimurium LT2
cagcuccagcucaggg

SEQ ID NO: 3802646 - RNA, 16 nt, Salmonella typhimurium LT2
cagcuccauagaaauc

SEQ ID NO: 3802647 - RNA, 15 nt, Salmonella typhimurium LT2
cagcuccauccacca

SEQ ID NO: 3802648 - RNA, 20 nt, Salmonella typhimurium LT2
cagcuccauccaccagcccc

SEQ ID NO: 3802649 - RNA, 22 nt, Salmonella typhimurium LT2
cagcuccaugucuugcuaucaa

SEQ ID NO: 3802650 - RNA, 14 nt, Salmonella typhimurium LT2
cagcuccccgccgc

SEQ ID NO: 3802651 - RNA, 20 nt, Salmonella typhimurium LT2
cagcuccgcaauuuccugau

SEQ ID NO: 3802652 - RNA, 14 nt, Salmonella typhimurium LT2
cagcucgacgacgu

SEQ ID NO: 3802653 - RNA, 18 nt, Salmonella typhimurium LT2
cagcucgacgccucccga

SEQ ID NO: 3802654 - RNA, 22 nt, Salmonella typhimurium LT2
cagcucgauaaucccggcgcgc

SEQ ID NO: 3802655 - RNA, 14 nt, Salmonella typhimurium LT2
cagcucgucggcca

SEQ ID NO: 3802656 - RNA, 22 nt, Salmonella typhimurium LT2
cagcucuucgaugaccgcuuuc

SEQ ID NO: 3802657 - RNA, 15 nt, Salmonella typhimurium LT2
cagcucuucgccggu

SEQ ID NO: 3802658 - RNA, 20 nt, Salmonella typhimurium LT2
cagcucuucgccguuaucgg

SEQ ID NO: 3802659 - RNA, 17 nt, Salmonella typhimurium LT2
cagcucuuucaacuucc

SEQ ID NO: 3802660 - RNA, 20 nt, Salmonella typhimurium LT2
cagcucuuucaauccuucuu

SEQ ID NO: 3802661 - RNA, 17 nt, Salmonella typhimurium LT2
cagcugacgcagcagcu

SEQ ID NO: 3802662 - RNA, 21 nt, Salmonella typhimurium LT2
cagcugagcuaaucacccacu

SEQ ID NO: 3802663 - RNA, 17 nt, Salmonella typhimurium LT2
cagcugauauaacgugc

SEQ ID NO: 3802664 - RNA, 21 nt, Salmonella typhimurium LT2
cagcugccacaccacaugcga

SEQ ID NO: 3802665 - RNA, 20 nt, Salmonella typhimurium LT2
cagcugcuggcgaugauaau

SEQ ID NO: 3802666 - RNA, 19 nt, Salmonella typhimurium LT2
cagcuggauagagcaucaa

SEQ ID NO: 3802667 - RNA, 22 nt, Salmonella typhimurium LT2
cagcuggcgauauccgugccgc

SEQ ID NO: 3802668 - RNA, 13 nt, Salmonella typhimurium LT2
cagcuggcuggca

SEQ ID NO: 3802669 - RNA, 16 nt, Salmonella typhimurium LT2
cagcugguauaggcca

SEQ ID NO: 3802670 - RNA, 16 nt, Salmonella typhimurium LT2
cagcuguuuaagcgcc

SEQ ID NO: 3802671 - RNA, 19 nt, Salmonella typhimurium LT2
cagcuguuuaagcgccucc

SEQ ID NO: 3802672 - RNA, 21 nt, Salmonella typhimurium LT2
cagcuguuuaagcgccuccac

SEQ ID NO: 3802673 - RNA, 18 nt, Salmonella typhimurium LT2
cagcuuaggauucgccau

SEQ ID NO: 3802674 - RNA, 14 nt, Salmonella typhimurium LT2
cagcuuauacugau

SEQ ID NO: 3802675 - RNA, 16 nt, Salmonella typhimurium LT2
cagcuuaucuuuuucg

SEQ ID NO: 3802676 - RNA, 21 nt, Salmonella typhimurium LT2
cagcuuaugaaucaucgccgu

SEQ ID NO: 3802677 - RNA, 21 nt, Salmonella typhimurium LT2
cagcuucacgaagucuggcug

SEQ ID NO: 3802678 - RNA, 12 nt, Salmonella typhimurium LT2
cagcuuccaguu

SEQ ID NO: 3802679 - RNA, 21 nt, Salmonella typhimurium LT2
cagcuuccuguacgccugcuu

SEQ ID NO: 3802680 - RNA, 17 nt, Salmonella typhimurium LT2
cagcuucgccagaugca

SEQ ID NO: 3802681 - RNA, 12 nt, Salmonella typhimurium LT2
cagcuucugaua

SEQ ID NO: 3802682 - RNA, 16 nt, Salmonella typhimurium LT2
cagcuugaucaucagg

SEQ ID NO: 3802683 - RNA, 15 nt, Salmonella typhimurium LT2
cagcuugcuggccgc

SEQ ID NO: 3802684 - RNA, 14 nt, Salmonella typhimurium LT2
cagcuuguggaaau

SEQ ID NO: 3802685 - RNA, 19 nt, Salmonella typhimurium LT2
cagcuuuaaugcuuuccag

SEQ ID NO: 3802686 - RNA, 15 nt, Salmonella typhimurium LT2
cagcuuuugcgcguu

SEQ ID NO: 3802687 - RNA, 20 nt, Salmonella typhimurium LT2
caggaaauccagcagaauaa

SEQ ID NO: 3802688 - RNA, 17 nt, Salmonella typhimurium LT2
caggaaaucuuccaguu

SEQ ID NO: 3802689 - RNA, 14 nt, Salmonella typhimurium LT2
caggaacagauacu

SEQ ID NO: 3802690 - RNA, 20 nt, Salmonella typhimurium LT2
caggaacagauacuggaagu

SEQ ID NO: 3802691 - RNA, 17 nt, Salmonella typhimurium LT2
caggaacaggcccgcca

SEQ ID NO: 3802692 - RNA, 19 nt, Salmonella typhimurium LT2
caggaacaucagcauuggu

SEQ ID NO: 3802693 - RNA, 15 nt, Salmonella typhimurium LT2
caggaaccgccgaug

SEQ ID NO: 3802694 - RNA, 15 nt, Salmonella typhimurium LT2
caggaacgagccgau

SEQ ID NO: 3802695 - RNA, 14 nt, Salmonella typhimurium LT2
caggaacuggcuga

SEQ ID NO: 3802696 - RNA, 13 nt, Salmonella typhimurium LT2
caggaagggcagc

SEQ ID NO: 3802697 - RNA, 21 nt, Salmonella typhimurium LT2
caggaauaacaucguaaauca

SEQ ID NO: 3802698 - RNA, 23 nt, Salmonella typhimurium LT2
caggaauaaccacugauggcugg

SEQ ID NO: 3802699 - RNA, 13 nt, Salmonella typhimurium LT2
caggacaaaaggc

SEQ ID NO: 3802700 - RNA, 23 nt, Salmonella typhimurium LT2
caggacaaaguuaucccugcuga

SEQ ID NO: 3802701 - RNA, 17 nt, Salmonella typhimurium LT2
caggacaucaaaggcag

SEQ ID NO: 3802702 - RNA, 19 nt, Salmonella typhimurium LT2
caggacauggucaccauga

SEQ ID NO: 3802703 - RNA, 18 nt, Salmonella typhimurium LT2
caggaccaaaacaauacu

SEQ ID NO: 3802704 - RNA, 12 nt, Salmonella typhimurium LT2
caggacgcgcgc

SEQ ID NO: 3802705 - RNA, 20 nt, Salmonella typhimurium LT2
caggacguugccgcccaccu

SEQ ID NO: 3802706 - RNA, 16 nt, Salmonella typhimurium LT2
caggacugacugcugu

SEQ ID NO: 3802707 - RNA, 15 nt, Salmonella typhimurium LT2
caggacuuaaaaaca

SEQ ID NO: 3802708 - RNA, 17 nt, Salmonella typhimurium LT2
caggacuuaaaaacaaa

SEQ ID NO: 3802709 - RNA, 15 nt, Salmonella typhimurium LT2
caggacuucccccuc

SEQ ID NO: 3802710 - RNA, 22 nt, Salmonella typhimurium LT2
caggacuuuuuccccgcgcuga

SEQ ID NO: 3802711 - RNA, 22 nt, Salmonella typhimurium LT2
caggagaucuuuccauuucagc

SEQ ID NO: 3802712 - RNA, 22 nt, Salmonella typhimurium LT2
caggagauugccccccagccau

SEQ ID NO: 3802713 - RNA, 18 nt, Salmonella typhimurium LT2
caggagcggaagaggcgu

SEQ ID NO: 3802714 - RNA, 12 nt, Salmonella typhimurium LT2
caggaggcaaaa

SEQ ID NO: 3802715 - RNA, 18 nt, Salmonella typhimurium LT2
caggaggcaaaaugccag

SEQ ID NO: 3802716 - RNA, 14 nt, Salmonella typhimurium LT2
caggaggccugaau

SEQ ID NO: 3802717 - RNA, 18 nt, Salmonella typhimurium LT2
caggaguaaauaacaaaa

SEQ ID NO: 3802718 - RNA, 18 nt, Salmonella typhimurium LT2
caggaguaugcgacggua

SEQ ID NO: 3802719 - RNA, 17 nt, Salmonella typhimurium LT2
caggagucuguuuuucg

SEQ ID NO: 3802720 - RNA, 19 nt, Salmonella typhimurium LT2
caggauaaaggccgggaaa

SEQ ID NO: 3802721 - RNA, 15 nt, Salmonella typhimurium LT2
caggauaauaaugau

SEQ ID NO: 3802722 - RNA, 15 nt, Salmonella typhimurium LT2
caggauaauuucacc

SEQ ID NO: 3802723 - RNA, 14 nt, Salmonella typhimurium LT2
caggauacagccga

SEQ ID NO: 3802724 - RNA, 15 nt, Salmonella typhimurium LT2
caggauacagccgac

SEQ ID NO: 3802725 - RNA, 12 nt, Salmonella typhimurium LT2
caggauagcgcu

SEQ ID NO: 3802726 - RNA, 19 nt, Salmonella typhimurium LT2
caggauauacuucaucagg

SEQ ID NO: 3802727 - RNA, 12 nt, Salmonella typhimurium LT2
caggauaucgcc

SEQ ID NO: 3802728 - RNA, 19 nt, Salmonella typhimurium LT2
caggaucaaaaucgcgccc

SEQ ID NO: 3802729 - RNA, 16 nt, Salmonella typhimurium LT2
caggaucaccgccacg

SEQ ID NO: 3802730 - RNA, 22 nt, Salmonella typhimurium LT2
caggaucaccgccacggcaaga

SEQ ID NO: 3802731 - RNA, 20 nt, Salmonella typhimurium LT2
caggaucgggaucagcgcgc

SEQ ID NO: 3802732 - RNA, 13 nt, Salmonella typhimurium LT2
caggaucgguaaa

SEQ ID NO: 3802733 - RNA, 13 nt, Salmonella typhimurium LT2
caggaucuucauc

SEQ ID NO: 3802734 - RNA, 17 nt, Salmonella typhimurium LT2
caggaucuucaucccau

SEQ ID NO: 3802735 - RNA, 13 nt, Salmonella typhimurium LT2
caggaucuuuuuc

SEQ ID NO: 3802736 - RNA, 14 nt, Salmonella typhimurium LT2
caggaucuuuuuca

SEQ ID NO: 3802737 - RNA, 19 nt, Salmonella typhimurium LT2
caggaugaaugacugucca

SEQ ID NO: 3802738 - RNA, 15 nt, Salmonella typhimurium LT2
caggaugccaaccac

SEQ ID NO: 3802739 - RNA, 19 nt, Salmonella typhimurium LT2
caggauggauauaacauuu

SEQ ID NO: 3802740 - RNA, 14 nt, Salmonella typhimurium LT2
caggauggcggcca

SEQ ID NO: 3802741 - RNA, 16 nt, Salmonella typhimurium LT2
caggauggcggccaaa

SEQ ID NO: 3802742 - RNA, 22 nt, Salmonella typhimurium LT2
caggaugggaggcuauucaaua

SEQ ID NO: 3802743 - RNA, 17 nt, Salmonella typhimurium LT2
caggaugggcuucuuca

SEQ ID NO: 3802744 - RNA, 16 nt, Salmonella typhimurium LT2
caggauguaagacagc

SEQ ID NO: 3802745 - RNA, 20 nt, Salmonella typhimurium LT2
caggaugugaggcagauacg

SEQ ID NO: 3802746 - RNA, 23 nt, Salmonella typhimurium LT2
caggaugugaggcagauacgcgg

SEQ ID NO: 3802747 - RNA, 14 nt, Salmonella typhimurium LT2
caggcaaaaauaac

SEQ ID NO: 3802748 - RNA, 15 nt, Salmonella typhimurium LT2
caggcaaaaauaacu

SEQ ID NO: 3802749 - RNA, 16 nt, Salmonella typhimurium LT2
caggcaaagcucaacg

SEQ ID NO: 3802750 - RNA, 15 nt, Salmonella typhimurium LT2
caggcaaauucuuug

SEQ ID NO: 3802751 - RNA, 13 nt, Salmonella typhimurium LT2
caggcaacaugac

SEQ ID NO: 3802752 - RNA, 14 nt, Salmonella typhimurium LT2
caggcaacguccug

SEQ ID NO: 3802753 - RNA, 13 nt, Salmonella typhimurium LT2
caggcaaggcauc

SEQ ID NO: 3802754 - RNA, 20 nt, Salmonella typhimurium LT2
caggcaauaaaaaaggcaga

SEQ ID NO: 3802755 - RNA, 23 nt, Salmonella typhimurium LT2
caggcaauauaccgucagcacca

SEQ ID NO: 3802756 - RNA, 17 nt, Salmonella typhimurium LT2
caggcaaucagcagccg

SEQ ID NO: 3802757 - RNA, 17 nt, Salmonella typhimurium LT2
caggcacaaaaaacaaa

SEQ ID NO: 3802758 - RNA, 18 nt, Salmonella typhimurium LT2
caggcacaguagacaacc

SEQ ID NO: 3802759 - RNA, 16 nt, Salmonella typhimurium LT2
caggcacgccggcaau

SEQ ID NO: 3802760 - RNA, 23 nt, Salmonella typhimurium LT2
caggcacuacggugugccugcgc

SEQ ID NO: 3802761 - RNA, 16 nt, Salmonella typhimurium LT2
caggcacuugagaaau

SEQ ID NO: 3802762 - RNA, 13 nt, Salmonella typhimurium LT2
caggcagaaauaa

SEQ ID NO: 3802763 - RNA, 15 nt, Salmonella typhimurium LT2
caggcagaaauaacu

SEQ ID NO: 3802764 - RNA, 18 nt, Salmonella typhimurium LT2
caggcagcagaccgguac

SEQ ID NO: 3802765 - RNA, 15 nt, Salmonella typhimurium LT2
caggcagccacaaug

SEQ ID NO: 3802766 - RNA, 21 nt, Salmonella typhimurium LT2
caggcaggcccgcgcuuuaau

SEQ ID NO: 3802767 - RNA, 14 nt, Salmonella typhimurium LT2
caggcaggucucca

SEQ ID NO: 3802768 - RNA, 17 nt, Salmonella typhimurium LT2
caggcaguuugcgaaaa

SEQ ID NO: 3802769 - RNA, 14 nt, Salmonella typhimurium LT2
caggcauaaaaaaa

SEQ ID NO: 3802770 - RNA, 17 nt, Salmonella typhimurium LT2
caggcauaaaaaagagg

SEQ ID NO: 3802771 - RNA, 23 nt, Salmonella typhimurium LT2
caggcauagaaaaagaacugcaa

SEQ ID NO: 3802772 - RNA, 17 nt, Salmonella typhimurium LT2
caggcauagagaggcau

SEQ ID NO: 3802773 - RNA, 18 nt, Salmonella typhimurium LT2
caggcaucgacgccagcg

SEQ ID NO: 3802774 - RNA, 13 nt, Salmonella typhimurium LT2
caggcaucgcgcc

SEQ ID NO: 3802775 - RNA, 18 nt, Salmonella typhimurium LT2
caggcaucguacgggcaa

SEQ ID NO: 3802776 - RNA, 20 nt, Salmonella typhimurium LT2
caggcaucuuccagcgucgg

SEQ ID NO: 3802777 - RNA, 15 nt, Salmonella typhimurium LT2
caggcauggcagcag

SEQ ID NO: 3802778 - RNA, 12 nt, Salmonella typhimurium LT2
caggcauggcca

SEQ ID NO: 3802779 - RNA, 15 nt, Salmonella typhimurium LT2
caggcauggccaaug

SEQ ID NO: 3802780 - RNA, 16 nt, Salmonella typhimurium LT2
caggcaugguuaacaa

SEQ ID NO: 3802781 - RNA, 20 nt, Salmonella typhimurium LT2
caggcauguugcgcaaucac

SEQ ID NO: 3802782 - RNA, 16 nt, Salmonella typhimurium LT2
caggcauugauaaagc

SEQ ID NO: 3802783 - RNA, 22 nt, Salmonella typhimurium LT2
caggcauuuuacaccccuggcu

SEQ ID NO: 3802784 - RNA, 13 nt, Salmonella typhimurium LT2
caggccaaaaaag

SEQ ID NO: 3802785 - RNA, 13 nt, Salmonella typhimurium LT2
caggccaaaagag

SEQ ID NO: 3802786 - RNA, 18 nt, Salmonella typhimurium LT2
caggccaaacagcggcuc

SEQ ID NO: 3802787 - RNA, 14 nt, Salmonella typhimurium LT2
caggccaacauagc

SEQ ID NO: 3802788 - RNA, 19 nt, Salmonella typhimurium LT2
caggccaacguaguuauug

SEQ ID NO: 3802789 - RNA, 20 nt, Salmonella typhimurium LT2
caggccaacguaguuauugu

SEQ ID NO: 3802790 - RNA, 16 nt, Salmonella typhimurium LT2
caggccaagcagcgcc

SEQ ID NO: 3802791 - RNA, 17 nt, Salmonella typhimurium LT2
caggccaagcagcgcca

SEQ ID NO: 3802792 - RNA, 14 nt, Salmonella typhimurium LT2
caggccacggcugu

SEQ ID NO: 3802793 - RNA, 14 nt, Salmonella typhimurium LT2
caggccagaauaac

SEQ ID NO: 3802794 - RNA, 14 nt, Salmonella typhimurium LT2
caggccagccugau

SEQ ID NO: 3802795 - RNA, 19 nt, Salmonella typhimurium LT2
caggccaucauugauacug

SEQ ID NO: 3802796 - RNA, 20 nt, Salmonella typhimurium LT2
caggccaugcgcaagcgccc

SEQ ID NO: 3802797 - RNA, 21 nt, Salmonella typhimurium LT2
caggccaugcuuuugcaggua

SEQ ID NO: 3802798 - RNA, 18 nt, Salmonella typhimurium LT2
caggcccaguaccauuga

SEQ ID NO: 3802799 - RNA, 20 nt, Salmonella typhimurium LT2
caggcccgauaagcgccgcg

SEQ ID NO: 3802800 - RNA, 23 nt, Salmonella typhimurium LT2
caggcccgauaagcgcuggcuug

SEQ ID NO: 3802801 - RNA, 13 nt, Salmonella typhimurium LT2
caggcccgccaga

SEQ ID NO: 3802802 - RNA, 14 nt, Salmonella typhimurium LT2
caggcccggcaggc

SEQ ID NO: 3802803 - RNA, 17 nt, Salmonella typhimurium LT2
caggccgacaauggcga

SEQ ID NO: 3802804 - RNA, 18 nt, Salmonella typhimurium LT2
caggccgccgggucagaa

SEQ ID NO: 3802805 - RNA, 15 nt, Salmonella typhimurium LT2
caggccggaacgacg

SEQ ID NO: 3802806 - RNA, 17 nt, Salmonella typhimurium LT2
caggccggauggcggcu

SEQ ID NO: 3802807 - RNA, 14 nt, Salmonella typhimurium LT2
caggccggcagccu

SEQ ID NO: 3802808 - RNA, 15 nt, Salmonella typhimurium LT2
caggccggcagccug

SEQ ID NO: 3802809 - RNA, 17 nt, Salmonella typhimurium LT2
caggccggcagccugcc

SEQ ID NO: 3802810 - RNA, 16 nt, Salmonella typhimurium LT2
caggccuaacacaugc

SEQ ID NO: 3802811 - RNA, 17 nt, Salmonella typhimurium LT2
caggccuaccagccgag

SEQ ID NO: 3802812 - RNA, 23 nt, Salmonella typhimurium LT2
caggccucuaucuucucaggcga

SEQ ID NO: 3802813 - RNA, 16 nt, Salmonella typhimurium LT2
caggccugagccgaac

SEQ ID NO: 3802814 - RNA, 19 nt, Salmonella typhimurium LT2
caggccugauaagcgcagc

SEQ ID NO: 3802815 - RNA, 17 nt, Salmonella typhimurium LT2
caggccugcaaaccucu

SEQ ID NO: 3802816 - RNA, 16 nt, Salmonella typhimurium LT2
caggccuguaaaccgc

SEQ ID NO: 3802817 - RNA, 18 nt, Salmonella typhimurium LT2
caggccuguaaaccgccu

SEQ ID NO: 3802818 - RNA, 22 nt, Salmonella typhimurium LT2
caggccuucuucauauuugcua

SEQ ID NO: 3802819 - RNA, 16 nt, Salmonella typhimurium LT2
caggccuuucggcagc

SEQ ID NO: 3802820 - RNA, 16 nt, Salmonella typhimurium LT2
caggcgaaaucaaaag

SEQ ID NO: 3802821 - RNA, 17 nt, Salmonella typhimurium LT2
caggcgaauagcgcgcu

SEQ ID NO: 3802822 - RNA, 18 nt, Salmonella typhimurium LT2
caggcgaauagcgcgcua

SEQ ID NO: 3802823 - RNA, 17 nt, Salmonella typhimurium LT2
caggcgaccagaugcag

SEQ ID NO: 3802824 - RNA, 17 nt, Salmonella typhimurium LT2
caggcgaccauccacca

SEQ ID NO: 3802825 - RNA, 20 nt, Salmonella typhimurium LT2
caggcgacgaaccgcguaac

SEQ ID NO: 3802826 - RNA, 13 nt, Salmonella typhimurium LT2
caggcgacgccgc

SEQ ID NO: 3802827 - RNA, 16 nt, Salmonella typhimurium LT2
caggcgacgccgccau

SEQ ID NO: 3802828 - RNA, 17 nt, Salmonella typhimurium LT2
caggcgacgccgccauc

SEQ ID NO: 3802829 - RNA, 20 nt, Salmonella typhimurium LT2
caggcgauagccguccaugu

SEQ ID NO: 3802830 - RNA, 14 nt, Salmonella typhimurium LT2
caggcgauggcgca

SEQ ID NO: 3802831 - RNA, 11 nt, Salmonella typhimurium LT2
caggcgcaccu

SEQ ID NO: 3802832 - RNA, 14 nt, Salmonella typhimurium LT2
caggcgccagaguc

SEQ ID NO: 3802833 - RNA, 19 nt, Salmonella typhimurium LT2
caggcgccgccauccggca

SEQ ID NO: 3802834 - RNA, 20 nt, Salmonella typhimurium LT2
caggcgccgccauccggcac

SEQ ID NO: 3802835 - RNA, 19 nt, Salmonella typhimurium LT2
caggcgcuauucccaggca

SEQ ID NO: 3802836 - RNA, 22 nt, Salmonella typhimurium LT2
caggcgcugcuggcagcgcuga

SEQ ID NO: 3802837 - RNA, 19 nt, Salmonella typhimurium LT2
caggcgcuugcgccgccau

SEQ ID NO: 3802838 - RNA, 19 nt, Salmonella typhimurium LT2
caggcggaugaaacagucc

SEQ ID NO: 3802839 - RNA, 16 nt, Salmonella typhimurium LT2
caggcggcaaaaaacg

SEQ ID NO: 3802840 - RNA, 14 nt, Salmonella typhimurium LT2
caggcggcaugggu

SEQ ID NO: 3802841 - RNA, 14 nt, Salmonella typhimurium LT2
caggcggccaggca

SEQ ID NO: 3802842 - RNA, 18 nt, Salmonella typhimurium LT2
caggcggguauggcgcca

SEQ ID NO: 3802843 - RNA, 19 nt, Salmonella typhimurium LT2
caggcgggugcgcagcccc

SEQ ID NO: 3802844 - RNA, 22 nt, Salmonella typhimurium LT2
caggcgggugcgcagccccagc

SEQ ID NO: 3802845 - RNA, 17 nt, Salmonella typhimurium LT2
caggcggugcgcagcca

SEQ ID NO: 3802846 - RNA, 17 nt, Salmonella typhimurium LT2
caggcguaagaucccag

SEQ ID NO: 3802847 - RNA, 20 nt, Salmonella typhimurium LT2
caggcguagcgccaucaggc

SEQ ID NO: 3802848 - RNA, 21 nt, Salmonella typhimurium LT2
caggcgucacggcgacggcca

SEQ ID NO: 3802849 - RNA, 18 nt, Salmonella typhimurium LT2
caggcgucauagccgcgc

SEQ ID NO: 3802850 - RNA, 19 nt, Salmonella typhimurium LT2
caggcgucauagccgcgcg

SEQ ID NO: 3802851 - RNA, 19 nt, Salmonella typhimurium LT2
caggcgucccggucggcgc

SEQ ID NO: 3802852 - RNA, 21 nt, Salmonella typhimurium LT2
caggcguguggcauaaauaaa

SEQ ID NO: 3802853 - RNA, 16 nt, Salmonella typhimurium LT2
caggcguuacgcgcca

SEQ ID NO: 3802854 - RNA, 21 nt, Salmonella typhimurium LT2
caggcguuauuggcgcagcca

SEQ ID NO: 3802855 - RNA, 14 nt, Salmonella typhimurium LT2
caggcguucauaaa

SEQ ID NO: 3802856 - RNA, 19 nt, Salmonella typhimurium LT2
caggcguugagauaauagc

SEQ ID NO: 3802857 - RNA, 15 nt, Salmonella typhimurium LT2
caggcuaaggcgucg

SEQ ID NO: 3802858 - RNA, 22 nt, Salmonella typhimurium LT2
caggcuacgguacugcccaccu

SEQ ID NO: 3802859 - RNA, 19 nt, Salmonella typhimurium LT2
caggcucgucguuugucca

SEQ ID NO: 3802860 - RNA, 21 nt, Salmonella typhimurium LT2
caggcugaugugcuccaucag

SEQ ID NO: 3802861 - RNA, 12 nt, Salmonella typhimurium LT2
caggcuggaaau

SEQ ID NO: 3802862 - RNA, 14 nt, Salmonella typhimurium LT2
caggcuggcaaagc

SEQ ID NO: 3802863 - RNA, 18 nt, Salmonella typhimurium LT2
caggcuggcgcagccgcu

SEQ ID NO: 3802864 - RNA, 16 nt, Salmonella typhimurium LT2
caggcuguccaaccag

SEQ ID NO: 3802865 - RNA, 19 nt, Salmonella typhimurium LT2
caggcuuccacgcacgccg

SEQ ID NO: 3802866 - RNA, 22 nt, Salmonella typhimurium LT2
caggcuucgcgcagccagcgcc

SEQ ID NO: 3802867 - RNA, 21 nt, Salmonella typhimurium LT2
caggcuucugauaagcgcagc

SEQ ID NO: 3802868 - RNA, 21 nt, Salmonella typhimurium LT2
caggcuugccaaagcgggcaa

SEQ ID NO: 3802869 - RNA, 15 nt, Salmonella typhimurium LT2
caggcuugccgcgcc

SEQ ID NO: 3802870 - RNA, 21 nt, Salmonella typhimurium LT2
caggcuugccgcgccagacgc

SEQ ID NO: 3802871 - RNA, 21 nt, Salmonella typhimurium LT2
caggcuuuaaauucagcaccc

SEQ ID NO: 3802872 - RNA, 20 nt, Salmonella typhimurium LT2
caggcuuucuuugcggaaca

SEQ ID NO: 3802873 - RNA, 21 nt, Salmonella typhimurium LT2
caggcuuuucaggcugugacu

SEQ ID NO: 3802874 - RNA, 18 nt, Salmonella typhimurium LT2
cagggaaacgagcgcggc

SEQ ID NO: 3802875 - RNA, 14 nt, Salmonella typhimurium LT2
cagggaaagccagu

SEQ ID NO: 3802876 - RNA, 19 nt, Salmonella typhimurium LT2
cagggaacacccgcccggu

SEQ ID NO: 3802877 - RNA, 19 nt, Salmonella typhimurium LT2
cagggaacguugcgccaug

SEQ ID NO: 3802878 - RNA, 19 nt, Salmonella typhimurium LT2
cagggaauaagcacccaug

SEQ ID NO: 3802879 - RNA, 14 nt, Salmonella typhimurium LT2
cagggacaacgcau

SEQ ID NO: 3802880 - RNA, 20 nt, Salmonella typhimurium LT2
cagggacgauaggcgcguca

SEQ ID NO: 3802881 - RNA, 19 nt, Salmonella typhimurium LT2
cagggacuccugcgccgga

SEQ ID NO: 3802882 - RNA, 17 nt, Salmonella typhimurium LT2
cagggauauacaaauau

SEQ ID NO: 3802883 - RNA, 16 nt, Salmonella typhimurium LT2
cagggcaacggccagc

SEQ ID NO: 3802884 - RNA, 23 nt, Salmonella typhimurium LT2
cagggcacgcucuccuacaccac

SEQ ID NO: 3802885 - RNA, 13 nt, Salmonella typhimurium LT2
cagggcagcgagc

SEQ ID NO: 3802886 - RNA, 13 nt, Salmonella typhimurium LT2
cagggcauccgcc

SEQ ID NO: 3802887 - RNA, 18 nt, Salmonella typhimurium LT2
cagggcgauauccagcgc

SEQ ID NO: 3802888 - RNA, 17 nt, Salmonella typhimurium LT2
cagggcgaugcccccag

SEQ ID NO: 3802889 - RNA, 19 nt, Salmonella typhimurium LT2
cagggcgaugcccccagac

SEQ ID NO: 3802890 - RNA, 14 nt, Salmonella typhimurium LT2
cagggcgauuuccg

SEQ ID NO: 3802891 - RNA, 13 nt, Salmonella typhimurium LT2
cagggcggaagca

SEQ ID NO: 3802892 - RNA, 19 nt, Salmonella typhimurium LT2
cagggcugaaucggcaccu

SEQ ID NO: 3802893 - RNA, 13 nt, Salmonella typhimurium LT2
cagggcugcuggc

SEQ ID NO: 3802894 - RNA, 21 nt, Salmonella typhimurium LT2
cagggcugcuggugcgccugu

SEQ ID NO: 3802895 - RNA, 17 nt, Salmonella typhimurium LT2
cagggcuuauucaagca

SEQ ID NO: 3802896 - RNA, 20 nt, Salmonella typhimurium LT2
caggggaugauuuucaggca

SEQ ID NO: 3802897 - RNA, 23 nt, Salmonella typhimurium LT2
caggggggaaaugagaaaaggaa

SEQ ID NO: 3802898 - RNA, 16 nt, Salmonella typhimurium LT2
caggggucaucggcac

SEQ ID NO: 3802899 - RNA, 21 nt, Salmonella typhimurium LT2
auccuucaaucgguacgccaa

SEQ ID NO: 3802900 - RNA, 14 nt, Salmonella typhimurium LT2
auccuuccagcgcc

SEQ ID NO: 3802901 - RNA, 17 nt, Salmonella typhimurium LT2
auccuuccagcgccaua

SEQ ID NO: 3802902 - RNA, 19 nt, Salmonella typhimurium LT2
auccuucccccaccaccau

SEQ ID NO: 3802903 - RNA, 19 nt, Salmonella typhimurium LT2
auccuuccuccaccaccau

SEQ ID NO: 3802904 - RNA, 11 nt, Salmonella typhimurium LT2
auccuucgccg

SEQ ID NO: 3802905 - RNA, 14 nt, Salmonella typhimurium LT2
auccuucuaccuuc

SEQ ID NO: 3802906 - RNA, 16 nt, Salmonella typhimurium LT2
auccuucuuccauucc

SEQ ID NO: 3802907 - RNA, 20 nt, Salmonella typhimurium LT2
auccuugagugcugcgcaaa

SEQ ID NO: 3802908 - RNA, 16 nt, Salmonella typhimurium LT2
auccuugcacgccaaa

SEQ ID NO: 3802909 - RNA, 20 nt, Salmonella typhimurium LT2
auccuuuacuauagauauua

SEQ ID NO: 3802910 - RNA, 16 nt, Salmonella typhimurium LT2
auccuuucucugguuu

SEQ ID NO: 3802911 - RNA, 22 nt, Salmonella typhimurium LT2
aucgaaaucucgcuaaucauca

SEQ ID NO: 3802912 - RNA, 16 nt, Salmonella typhimurium LT2
aucgaacugugagccu

SEQ ID NO: 3802913 - RNA, 17 nt, Salmonella typhimurium LT2
aucgaaggcaucuucag

SEQ ID NO: 3802914 - RNA, 15 nt, Salmonella typhimurium LT2
aucgaaguaauaaaa

SEQ ID NO: 3802915 - RNA, 19 nt, Salmonella typhimurium LT2
aucgaauucauuacguaau

SEQ ID NO: 3802916 - RNA, 15 nt, Salmonella typhimurium LT2
aucgacccccaccau

SEQ ID NO: 3802917 - RNA, 18 nt, Salmonella typhimurium LT2
aucgaccuuuuucgcgcc

SEQ ID NO: 3802918 - RNA, 13 nt, Salmonella typhimurium LT2
aucgacgaaaugg

SEQ ID NO: 3802919 - RNA, 18 nt, Salmonella typhimurium LT2
aucgacugcguuaucgcu

SEQ ID NO: 3802920 - RNA, 23 nt, Salmonella typhimurium LT2
aucgacuggcggaauggcgggcg

SEQ ID NO: 3802921 - RNA, 14 nt, Salmonella typhimurium LT2
aucgagagcgggug

SEQ ID NO: 3802922 - RNA, 13 nt, Salmonella typhimurium LT2
aucgagauaagau

SEQ ID NO: 3802923 - RNA, 18 nt, Salmonella typhimurium LT2
aucgagcggcaguagcag

SEQ ID NO: 3802924 - RNA, 18 nt, Salmonella typhimurium LT2
aucgaggccauauuuuac

SEQ ID NO: 3802925 - RNA, 23 nt, Salmonella typhimurium LT2
aucgaggcuggucgcgauagccg

SEQ ID NO: 3802926 - RNA, 20 nt, Salmonella typhimurium LT2
aucgagucaggcgccagagu

SEQ ID NO: 3802927 - RNA, 14 nt, Salmonella typhimurium LT2
aucgauacgcggau

SEQ ID NO: 3802928 - RNA, 15 nt, Salmonella typhimurium LT2
aucgauauaagcgcc

SEQ ID NO: 3802929 - RNA, 14 nt, Salmonella typhimurium LT2
aucgauauaaugcc

SEQ ID NO: 3802930 - RNA, 20 nt, Salmonella typhimurium LT2
aucgauccaguuaauucguc

SEQ ID NO: 3802931 - RNA, 22 nt, Salmonella typhimurium LT2
aucgauccgcaucagcaacgcg

SEQ ID NO: 3802932 - RNA, 14 nt, Salmonella typhimurium LT2
aucgaugugauaaa

SEQ ID NO: 3802933 - RNA, 22 nt, Salmonella typhimurium LT2
aucgauucugaauaauauguaa

SEQ ID NO: 3802934 - RNA, 17 nt, Salmonella typhimurium LT2
aucgauuuugaccugaa

SEQ ID NO: 3802935 - RNA, 14 nt, Salmonella typhimurium LT2
aucgcaaacgccag

SEQ ID NO: 3802936 - RNA, 18 nt, Salmonella typhimurium LT2
aucgcaaauugcgcgccc

SEQ ID NO: 3802937 - RNA, 19 nt, Salmonella typhimurium LT2
aucgcaacacgauccccau

SEQ ID NO: 3802938 - RNA, 23 nt, Salmonella typhimurium LT2
aucgcaacagauaagcaccugca

SEQ ID NO: 3802939 - RNA, 21 nt, Salmonella typhimurium LT2
aucgcaacgccggugccugcc

SEQ ID NO: 3802940 - RNA, 12 nt, Salmonella typhimurium LT2
aucgcacggcga

SEQ ID NO: 3802941 - RNA, 17 nt, Salmonella typhimurium LT2
aucgcaggcggucagca

SEQ ID NO: 3802942 - RNA, 21 nt, Salmonella typhimurium LT2
aucgcagucagccuugaccgc

SEQ ID NO: 3802943 - RNA, 17 nt, Salmonella typhimurium LT2
aucgcaguugauacauu

SEQ ID NO: 3802944 - RNA, 14 nt, Salmonella typhimurium LT2
aucgcauaaauauc

SEQ ID NO: 3802945 - RNA, 13 nt, Salmonella typhimurium LT2
aucgcauauugcg

SEQ ID NO: 3802946 - RNA, 22 nt, Salmonella typhimurium LT2
aucgcauuaacguccauaccgg

SEQ ID NO: 3802947 - RNA, 19 nt, Salmonella typhimurium LT2
aucgcauuuuuaagcuggc

SEQ ID NO: 3802948 - RNA, 24 nt, Salmonella typhimurium LT2
aucgccaaacgccaucacuucgcg

SEQ ID NO: 3802949 - RNA, 19 nt, Salmonella typhimurium LT2
aucgccaaagcguaaacag

SEQ ID NO: 3802950 - RNA, 16 nt, Salmonella typhimurium LT2
aucgccacaugcggca

SEQ ID NO: 3802951 - RNA, 18 nt, Salmonella typhimurium LT2
aucgccaccacauucagg

SEQ ID NO: 3802952 - RNA, 12 nt, Salmonella typhimurium LT2
aucgccacgcca

SEQ ID NO: 3802953 - RNA, 14 nt, Salmonella typhimurium LT2
aucgccagcagcgc

SEQ ID NO: 3802954 - RNA, 19 nt, Salmonella typhimurium LT2
aucgccagccccagcccug

SEQ ID NO: 3802955 - RNA, 17 nt, Salmonella typhimurium LT2
aucgccaggaucgccgc

SEQ ID NO: 3802956 - RNA, 11 nt, Salmonella typhimurium LT2
aucgccaggcg

SEQ ID NO: 3802957 - RNA, 18 nt, Salmonella typhimurium LT2
aucgccagggcuuccgcu

SEQ ID NO: 3802958 - RNA, 17 nt, Salmonella typhimurium LT2
aucgccauauacgccac

SEQ ID NO: 3802959 - RNA, 20 nt, Salmonella typhimurium LT2
aucgccaucaacuccuccgg

SEQ ID NO: 3802960 - RNA, 19 nt, Salmonella typhimurium LT2
aucgccauccugcaccgua

SEQ ID NO: 3802961 - RNA, 15 nt, Salmonella typhimurium LT2
aucgccaugaccaca

SEQ ID NO: 3802962 - RNA, 19 nt, Salmonella typhimurium LT2
aucgcccaugacauuccca

SEQ ID NO: 3802963 - RNA, 14 nt, Salmonella typhimurium LT2
aucgccccagccga

SEQ ID NO: 3802964 - RNA, 19 nt, Salmonella typhimurium LT2
aucgccccgaccaggauga

SEQ ID NO: 3802965 - RNA, 24 nt, Salmonella typhimurium LT2
aucgcccgguugcaauuccgccau

SEQ ID NO: 3802966 - RNA, 19 nt, Salmonella typhimurium LT2
aucgccgaaagcgaucaca

SEQ ID NO: 3802967 - RNA, 15 nt, Salmonella typhimurium LT2
aucgccgcaaucagc

SEQ ID NO: 3802968 - RNA, 19 nt, Salmonella typhimurium LT2
aucgucccacaugaacucg

SEQ ID NO: 3802969 - RNA, 21 nt, Salmonella typhimurium LT2
aucgucccuuuucccccgcug

SEQ ID NO: 3802970 - RNA, 13 nt, Salmonella typhimurium LT2
aucguccggcauc

SEQ ID NO: 3802971 - RNA, 20 nt, Salmonella typhimurium LT2
aucguccguugggcgguauu

SEQ ID NO: 3802972 - RNA, 21 nt, Salmonella typhimurium LT2
aucgucgauaaucauacagcg

SEQ ID NO: 3802973 - RNA, 23 nt, Salmonella typhimurium LT2
aucgucgccagacccagcgcuaa

SEQ ID NO: 3802974 - RNA, 23 nt, Salmonella typhimurium LT2
aucgucgcgaucgcgccagccuu

SEQ ID NO: 3802975 - RNA, 20 nt, Salmonella typhimurium LT2
aucgucgcgccaauggcgau

SEQ ID NO: 3802976 - RNA, 22 nt, Salmonella typhimurium LT2
aucgucggacaacguaccggca

SEQ ID NO: 3802977 - RNA, 21 nt, Salmonella typhimurium LT2
aucgucggcgauugucaucau

SEQ ID NO: 3802978 - RNA, 21 nt, Salmonella typhimurium LT2
aucgugauaaagcugacgcgc

SEQ ID NO: 3802979 - RNA, 20 nt, Salmonella typhimurium LT2
aucgugcgggcgaggggaga

SEQ ID NO: 3802980 - RNA, 12 nt, Salmonella typhimurium LT2
aucguguggcug

SEQ ID NO: 3802981 - RNA, 22 nt, Salmonella typhimurium LT2
aucguguggcuguuaguaaaca

SEQ ID NO: 3802982 - RNA, 18 nt, Salmonella typhimurium LT2
aucguuaauucauggcca

SEQ ID NO: 3802983 - RNA, 17 nt, Salmonella typhimurium LT2
aucguuacccaucaccu

SEQ ID NO: 3802984 - RNA, 16 nt, Salmonella typhimurium LT2
aucguuauccagcagc

SEQ ID NO: 3802985 - RNA, 17 nt, Salmonella typhimurium LT2
aucguuauccagcagcc

SEQ ID NO: 3802986 - RNA, 18 nt, Salmonella typhimurium LT2
aucguucgccagugacaa

SEQ ID NO: 3802987 - RNA, 15 nt, Salmonella typhimurium LT2
aucguucgcggaacg

SEQ ID NO: 3802988 - RNA, 16 nt, Salmonella typhimurium LT2
aucguugauauuauua

SEQ ID NO: 3802989 - RNA, 17 nt, Salmonella typhimurium LT2
aucguugccagcggcca

SEQ ID NO: 3802990 - RNA, 14 nt, Salmonella typhimurium LT2
aucguugccgccgu

SEQ ID NO: 3802991 - RNA, 15 nt, Salmonella typhimurium LT2
aucguuuccagcauc

SEQ ID NO: 3802992 - RNA, 19 nt, Salmonella typhimurium LT2
aucguuuuuguccauaaaa

SEQ ID NO: 3802993 - RNA, 21 nt, Salmonella typhimurium LT2
aucguuuuuguccauaaaaug

SEQ ID NO: 3802994 - RNA, 22 nt, Salmonella typhimurium LT2
aucuaauacgagcgggucagga

SEQ ID NO: 3802995 - RNA, 17 nt, Salmonella typhimurium LT2
aucuacaaacgcggaca

SEQ ID NO: 3802996 - RNA, 18 nt, Salmonella typhimurium LT2
aucuacgacaaaggcaaa

SEQ ID NO: 3802997 - RNA, 18 nt, Salmonella typhimurium LT2
aucuacgguaucugcaua

SEQ ID NO: 3802998 - RNA, 17 nt, Salmonella typhimurium LT2
aucuauauauucuucuu

SEQ ID NO: 3802999 - RNA, 15 nt, Salmonella typhimurium LT2
aucuauuauuuuucu

SEQ ID NO: 3803000 - RNA, 17 nt, Salmonella typhimurium LT2
aucuauuauuuuucuau

SEQ ID NO: 3803001 - RNA, 15 nt, Salmonella typhimurium LT2
aucucaagccccaug

SEQ ID NO: 3803002 - RNA, 17 nt, Salmonella typhimurium LT2
aucucaagcgccgccgc

SEQ ID NO: 3803003 - RNA, 19 nt, Salmonella typhimurium LT2
aucucacaagauucacucu

SEQ ID NO: 3803004 - RNA, 12 nt, Salmonella typhimurium LT2
aucucacuagca

SEQ ID NO: 3803005 - RNA, 18 nt, Salmonella typhimurium LT2
aucucagauaauagcugc

SEQ ID NO: 3803006 - RNA, 13 nt, Salmonella typhimurium LT2
aucucauaaaccg

SEQ ID NO: 3803007 - RNA, 18 nt, Salmonella typhimurium LT2
aucucauaaacgccugga

SEQ ID NO: 3803008 - RNA, 19 nt, Salmonella typhimurium LT2
aucucaucagacuguaugu

SEQ ID NO: 3803009 - RNA, 19 nt, Salmonella typhimurium LT2
aucucaucugcaaaauaua

SEQ ID NO: 3803010 - RNA, 18 nt, Salmonella typhimurium LT2
aucucauuguauuucuca

SEQ ID NO: 3803011 - RNA, 20 nt, Salmonella typhimurium LT2
aucuccaguuguucacggga

SEQ ID NO: 3803012 - RNA, 16 nt, Salmonella typhimurium LT2
aucuccaucauuuccg

SEQ ID NO: 3803013 - RNA, 23 nt, Salmonella typhimurium LT2
aucucccacccgcgcgcuuucca

SEQ ID NO: 3803014 - RNA, 23 nt, Salmonella typhimurium LT2
aucucccaggccgccaccgccuc

SEQ ID NO: 3803015 - RNA, 19 nt, Salmonella typhimurium LT2
aucuccgccgcuuuaucgu

SEQ ID NO: 3803016 - RNA, 16 nt, Salmonella typhimurium LT2
aucuccggcagcgaau

SEQ ID NO: 3803017 - RNA, 17 nt, Salmonella typhimurium LT2
aucuccggcgcugcgcu

SEQ ID NO: 3803018 - RNA, 22 nt, Salmonella typhimurium LT2
aucuccuccucauucagcggcu

SEQ ID NO: 3803019 - RNA, 19 nt, Salmonella typhimurium LT2
aucuccugacauagcucac

SEQ ID NO: 3803020 - RNA, 22 nt, Salmonella typhimurium LT2
aucuccugcgauagcugcugac

SEQ ID NO: 3803021 - RNA, 23 nt, Salmonella typhimurium LT2
aucucgaccuggugcucaaucag

SEQ ID NO: 3803022 - RNA, 21 nt, Salmonella typhimurium LT2
aucucgcacaucaugaugauc

SEQ ID NO: 3803023 - RNA, 12 nt, Salmonella typhimurium LT2
aucucgccgucg

SEQ ID NO: 3803024 - RNA, 19 nt, Salmonella typhimurium LT2
aucucgcuaaucaucagcg

SEQ ID NO: 3803025 - RNA, 20 nt, Salmonella typhimurium LT2
aucucgguacgccaaaucug

SEQ ID NO: 3803026 - RNA, 15 nt, Salmonella typhimurium LT2
aucucguaaaucaau

SEQ ID NO: 3803027 - RNA, 21 nt, Salmonella typhimurium LT2
aucucgucaaacucuuccggg

SEQ ID NO: 3803028 - RNA, 12 nt, Salmonella typhimurium LT2
aucucgucgcca

SEQ ID NO: 3803029 - RNA, 14 nt, Salmonella typhimurium LT2
aucucuacgccggc

SEQ ID NO: 3803030 - RNA, 19 nt, Salmonella typhimurium LT2
aucucugucgaccaucgca

SEQ ID NO: 3803031 - RNA, 14 nt, Salmonella typhimurium LT2
aucucuuccagcgu

SEQ ID NO: 3803032 - RNA, 15 nt, Salmonella typhimurium LT2
aucugaaaggcguca

SEQ ID NO: 3803033 - RNA, 17 nt, Salmonella typhimurium LT2
aucugaaauaaaagcaa

SEQ ID NO: 3803034 - RNA, 18 nt, Salmonella typhimurium LT2
aucugaaauaaaagcaau

SEQ ID NO: 3803035 - RNA, 16 nt, Salmonella typhimurium LT2
aucugacacagaggaa

SEQ ID NO: 3803036 - RNA, 14 nt, Salmonella typhimurium LT2
aucugacagccaaa

SEQ ID NO: 3803037 - RNA, 19 nt, Salmonella typhimurium LT2
aucugacagccaaacugcu

SEQ ID NO: 3803038 - RNA, 22 nt, Salmonella typhimurium LT2
aucugacagccaaacugcugua

SEQ ID NO: 3803039 - RNA, 16 nt, Salmonella typhimurium LT2
aucugaccaugccagc

SEQ ID NO: 3803040 - RNA, 15 nt, Salmonella typhimurium LT2
aucugacccgggcuu

SEQ ID NO: 3803041 - RNA, 16 nt, Salmonella typhimurium LT2
aucugacgcggcgccg

SEQ ID NO: 3803042 - RNA, 15 nt, Salmonella typhimurium LT2
aucugaguauuuaca

SEQ ID NO: 3803043 - RNA, 13 nt, Salmonella typhimurium LT2
aucugauaaaaug

SEQ ID NO: 3803044 - RNA, 22 nt, Salmonella typhimurium LT2
aucugauagcccauccagcaca

SEQ ID NO: 3803045 - RNA, 16 nt, Salmonella typhimurium LT2
aucugauauaucuuca

SEQ ID NO: 3803046 - RNA, 22 nt, Salmonella typhimurium LT2
aucugaugauggaacagacgcc

SEQ ID NO: 3803047 - RNA, 14 nt, Salmonella typhimurium LT2
aucugaugauuaau

SEQ ID NO: 3803048 - RNA, 13 nt, Salmonella typhimurium LT2
aucugcaaaauau

SEQ ID NO: 3803049 - RNA, 17 nt, Salmonella typhimurium LT2
aucugcacguaccugcu

SEQ ID NO: 3803050 - RNA, 20 nt, Salmonella typhimurium LT2
aucugcauguaguaagccau

SEQ ID NO: 3803051 - RNA, 17 nt, Salmonella typhimurium LT2
aucugcccuuucuuaug

SEQ ID NO: 3803052 - RNA, 16 nt, Salmonella typhimurium LT2
aucugccgggagcaga

SEQ ID NO: 3803053 - RNA, 18 nt, Salmonella typhimurium LT2
aucugccgggagcagauu

SEQ ID NO: 3803054 - RNA, 16 nt, Salmonella typhimurium LT2
aucugcgcccauuucc

SEQ ID NO: 3803055 - RNA, 21 nt, Salmonella typhimurium LT2
aucugcgccgacauucccugc

SEQ ID NO: 3803056 - RNA, 14 nt, Salmonella typhimurium LT2
aucugcgccgccgg

SEQ ID NO: 3803057 - RNA, 21 nt, Salmonella typhimurium LT2
aucugcggucuccugaacgcc

SEQ ID NO: 3803058 - RNA, 20 nt, Salmonella typhimurium LT2
aucugcgugaugcaucagaa

SEQ ID NO: 3803059 - RNA, 15 nt, Salmonella typhimurium LT2
aucugcguugcgcgc

SEQ ID NO: 3803060 - RNA, 18 nt, Salmonella typhimurium LT2
aucuggcgguuugacggc

SEQ ID NO: 3803061 - RNA, 18 nt, Salmonella typhimurium LT2
aucuggcugcguaaaauc

SEQ ID NO: 3803062 - RNA, 16 nt, Salmonella typhimurium LT2
aucugggucaggaacu

SEQ ID NO: 3803063 - RNA, 15 nt, Salmonella typhimurium LT2
aucuggugauaaagc

SEQ ID NO: 3803064 - RNA, 17 nt, Salmonella typhimurium LT2
aucuggugauaaagcag

SEQ ID NO: 3803065 - RNA, 18 nt, Salmonella typhimurium LT2
aucuggugauaaagcaga

SEQ ID NO: 3803066 - RNA, 16 nt, Salmonella typhimurium LT2
aucuguagauugcgcg

SEQ ID NO: 3803067 - RNA, 15 nt, Salmonella typhimurium LT2
aucuguucaaaaaca

SEQ ID NO: 3803068 - RNA, 16 nt, Salmonella typhimurium LT2
aucuguugcgcaagca

SEQ ID NO: 3803069 - RNA, 15 nt, Salmonella typhimurium LT2
aucuuagacaucaaa

SEQ ID NO: 3803070 - RNA, 18 nt, Salmonella typhimurium LT2
aucuuagacaucaaaauu

SEQ ID NO: 3803071 - RNA, 23 nt, Salmonella typhimurium LT2
aucuuauuuuccguuagccaaug

SEQ ID NO: 3803072 - RNA, 15 nt, Salmonella typhimurium LT2
augaguacggaacaa

SEQ ID NO: 3803073 - RNA, 22 nt, Salmonella typhimurium LT2
augaguacggaacaaaacggaa

SEQ ID NO: 3803074 - RNA, 18 nt, Salmonella typhimurium LT2
augaguucagcugauugg

SEQ ID NO: 3803075 - RNA, 20 nt, Salmonella typhimurium LT2
augauaaccgccgccaaacu

SEQ ID NO: 3803076 - RNA, 23 nt, Salmonella typhimurium LT2
augauaaccgccgccaaacugcg

SEQ ID NO: 3803077 - RNA, 21 nt, Salmonella typhimurium LT2
augauaauaugcucaacuucc

SEQ ID NO: 3803078 - RNA, 14 nt, Salmonella typhimurium LT2
augauaguguucau

SEQ ID NO: 3803079 - RNA, 20 nt, Salmonella typhimurium LT2
augauaucggccggaugcca

SEQ ID NO: 3803080 - RNA, 22 nt, Salmonella typhimurium LT2
augauaucggccggaugccagu

SEQ ID NO: 3803081 - RNA, 23 nt, Salmonella typhimurium LT2
augaucagacgcacaaucgccgu

SEQ ID NO: 3803082 - RNA, 13 nt, Salmonella typhimurium LT2
augaucaggcgac

SEQ ID NO: 3803083 - RNA, 15 nt, Salmonella typhimurium LT2
augaucauacugccg

SEQ ID NO: 3803084 - RNA, 13 nt, Salmonella typhimurium LT2
augauccaucucg

SEQ ID NO: 3803085 - RNA, 11 nt, Salmonella typhimurium LT2
augaucgccgc

SEQ ID NO: 3803086 - RNA, 15 nt, Salmonella typhimurium LT2
augaucgccucuucg

SEQ ID NO: 3803087 - RNA, 19 nt, Salmonella typhimurium LT2
augaucgcgauagcgcuga

SEQ ID NO: 3803088 - RNA, 16 nt, Salmonella typhimurium LT2
augaucguaugcagcc

SEQ ID NO: 3803089 - RNA, 20 nt, Salmonella typhimurium LT2
augaucguaugcagccaggc

SEQ ID NO: 3803090 - RNA, 14 nt, Salmonella typhimurium LT2
augaucgucaacga

SEQ ID NO: 3803091 - RNA, 23 nt, Salmonella typhimurium LT2
augaucuauccaauaauaagaau

SEQ ID NO: 3803092 - RNA, 15 nt, Salmonella typhimurium LT2
augaucuuuccuuuu

SEQ ID NO: 3803093 - RNA, 18 nt, Salmonella typhimurium LT2
augaugaccgaagcaggc

SEQ ID NO: 3803094 - RNA, 19 nt, Salmonella typhimurium LT2
augaugagauacgucauca

SEQ ID NO: 3803095 - RNA, 21 nt, Salmonella typhimurium LT2
augaugagaugcaggccaagc

SEQ ID NO: 3803096 - RNA, 22 nt, Salmonella typhimurium LT2
augaugaucgcgauagcgcuga

SEQ ID NO: 3803097 - RNA, 12 nt, Salmonella typhimurium LT2
augaugauuaau

SEQ ID NO: 3803098 - RNA, 13 nt, Salmonella typhimurium LT2
augaugccacagg

SEQ ID NO: 3803099 - RNA, 14 nt, Salmonella typhimurium LT2
augaugccacaggc

SEQ ID NO: 3803100 - RNA, 18 nt, Salmonella typhimurium LT2
augaugccaggaccaggu

SEQ ID NO: 3803101 - RNA, 23 nt, Salmonella typhimurium LT2
augaugccuugcgaauggagaag

SEQ ID NO: 3803102 - RNA, 19 nt, Salmonella typhimurium LT2
augauggcgaacagcccca

SEQ ID NO: 3803103 - RNA, 17 nt, Salmonella typhimurium LT2
augauggggucacaggu

SEQ ID NO: 3803104 - RNA, 15 nt, Salmonella typhimurium LT2
augauuaauuguacc

SEQ ID NO: 3803105 - RNA, 20 nt, Salmonella typhimurium LT2
augauucguggcucaaggau

SEQ ID NO: 3803106 - RNA, 15 nt, Salmonella typhimurium LT2
augauugagcguuuc

SEQ ID NO: 3803107 - RNA, 21 nt, Salmonella typhimurium LT2
augauuugcaaccgcucuuuu

SEQ ID NO: 3803108 - RNA, 14 nt, Salmonella typhimurium LT2
augauuuuaacauc

SEQ ID NO: 3803109 - RNA, 18 nt, Salmonella typhimurium LT2
augcaaagaaaaacagga

SEQ ID NO: 3803110 - RNA, 17 nt, Salmonella typhimurium LT2
augcaaagucaguuuuc

SEQ ID NO: 3803111 - RNA, 14 nt, Salmonella typhimurium LT2
augcaaccccugac

SEQ ID NO: 3803112 - RNA, 15 nt, Salmonella typhimurium LT2
augcaacuggcaagc

SEQ ID NO: 3803113 - RNA, 21 nt, Salmonella typhimurium LT2
augcaaugucuuuauccgcca

SEQ ID NO: 3803114 - RNA, 20 nt, Salmonella typhimurium LT2
augcacaugguguacguugc

SEQ ID NO: 3803115 - RNA, 16 nt, Salmonella typhimurium LT2
augcaccgccuugccc

SEQ ID NO: 3803116 - RNA, 17 nt, Salmonella typhimurium LT2
augcacugcgaaaagag

SEQ ID NO: 3803117 - RNA, 13 nt, Salmonella typhimurium LT2
augcacugcugau

SEQ ID NO: 3803118 - RNA, 21 nt, Salmonella typhimurium LT2
augcagcaucaugucacccac

SEQ ID NO: 3803119 - RNA, 23 nt, Salmonella typhimurium LT2
augcagcaucaugucacccacgc

SEQ ID NO: 3803120 - RNA, 21 nt, Salmonella typhimurium LT2
augcagcgcaaacucagagag

SEQ ID NO: 3803121 - RNA, 16 nt, Salmonella typhimurium LT2
augcaggcauaaaaaa

SEQ ID NO: 3803122 - RNA, 18 nt, Salmonella typhimurium LT2
augcaggcauaaaaaaga

SEQ ID NO: 3803123 - RNA, 20 nt, Salmonella typhimurium LT2
augcaggccaagcagcgcca

SEQ ID NO: 3803124 - RNA, 20 nt, Salmonella typhimurium LT2
augcaggcggucgaaacacg

SEQ ID NO: 3803125 - RNA, 19 nt, Salmonella typhimurium LT2
augcaggcuauccacaacg

SEQ ID NO: 3803126 - RNA, 23 nt, Salmonella typhimurium LT2
augcagggguccuguaacaacug

SEQ ID NO: 3803127 - RNA, 20 nt, Salmonella typhimurium LT2
augcaguucuuucgccagaa

SEQ ID NO: 3803128 - RNA, 15 nt, Salmonella typhimurium LT2
augcauaaaaaaacg

SEQ ID NO: 3803129 - RNA, 14 nt, Salmonella typhimurium LT2
augcauaaugcagc

SEQ ID NO: 3803130 - RNA, 15 nt, Salmonella typhimurium LT2
augcauaugaaugau

SEQ ID NO: 3803131 - RNA, 15 nt, Salmonella typhimurium LT2
augcauaugcacagc

SEQ ID NO: 3803132 - RNA, 18 nt, Salmonella typhimurium LT2
augcaucagaacaaacuu

SEQ ID NO: 3803133 - RNA, 17 nt, Salmonella typhimurium LT2
augcauccgccagauga

SEQ ID NO: 3803134 - RNA, 19 nt, Salmonella typhimurium LT2
augcaucgcggucagcggc

SEQ ID NO: 3803135 - RNA, 15 nt, Salmonella typhimurium LT2
augcaucuucacugu

SEQ ID NO: 3803136 - RNA, 23 nt, Salmonella typhimurium LT2
augcaugccucgaaaauauauuc

SEQ ID NO: 3803137 - RNA, 14 nt, Salmonella typhimurium LT2
augcauggcagaua

SEQ ID NO: 3803138 - RNA, 21 nt, Salmonella typhimurium LT2
augccaaacaucgcucgcgcc

SEQ ID NO: 3803139 - RNA, 19 nt, Salmonella typhimurium LT2
augccaaauagcacgugca

SEQ ID NO: 3803140 - RNA, 14 nt, Salmonella typhimurium LT2
augccaacuuuacu

SEQ ID NO: 3803141 - RNA, 21 nt, Salmonella typhimurium LT2
augccaacuuuacuuaguauc

SEQ ID NO: 3803142 - RNA, 14 nt, Salmonella typhimurium LT2
augccaagcggcau

SEQ ID NO: 3803143 - RNA, 20 nt, Salmonella typhimurium LT2
augccaaguaauaaagagaa

SEQ ID NO: 3803144 - RNA, 21 nt, Salmonella typhimurium LT2
augccaaguaauaaagagaac

SEQ ID NO: 3803145 - RNA, 12 nt, Salmonella typhimurium LT2
augccacaggcu

SEQ ID NO: 3803146 - RNA, 22 nt, Salmonella typhimurium LT2
augccaccagccuaaaaacaga

SEQ ID NO: 3803147 - RNA, 18 nt, Salmonella typhimurium LT2
augccaccagcgccauaa

SEQ ID NO: 3803148 - RNA, 16 nt, Salmonella typhimurium LT2
augccacggcugaggc

SEQ ID NO: 3803149 - RNA, 22 nt, Salmonella typhimurium LT2
augccagaagagaagcuuuuuc

SEQ ID NO: 3803150 - RNA, 16 nt, Salmonella typhimurium LT2
augccagaucugcauc

SEQ ID NO: 3803151 - RNA, 15 nt, Salmonella typhimurium LT2
augccagcucaaauc

SEQ ID NO: 3803152 - RNA, 21 nt, Salmonella typhimurium LT2
augccaggcuuccugcgcugu

SEQ ID NO: 3803153 - RNA, 20 nt, Salmonella typhimurium LT2
augccauauucaacgaaugc

SEQ ID NO: 3803154 - RNA, 12 nt, Salmonella typhimurium LT2
augccaucagag

SEQ ID NO: 3803155 - RNA, 13 nt, Salmonella typhimurium LT2
augccaucccuuc

SEQ ID NO: 3803156 - RNA, 19 nt, Salmonella typhimurium LT2
augccaucggccagcaggc

SEQ ID NO: 3803157 - RNA, 17 nt, Salmonella typhimurium LT2
augccaugaacgacccg

SEQ ID NO: 3803158 - RNA, 21 nt, Salmonella typhimurium LT2
augccauuucuuuaugcgucu

SEQ ID NO: 3803159 - RNA, 14 nt, Salmonella typhimurium LT2
augcccacaggcag

SEQ ID NO: 3803160 - RNA, 23 nt, Salmonella typhimurium LT2
augcccaccggaccuaauaacca

SEQ ID NO: 3803161 - RNA, 13 nt, Salmonella typhimurium LT2
augcccacggcgu

SEQ ID NO: 3803162 - RNA, 16 nt, Salmonella typhimurium LT2
augccccagaaaaugc

SEQ ID NO: 3803163 - RNA, 17 nt, Salmonella typhimurium LT2
augcccccgcgcaggcg

SEQ ID NO: 3803164 - RNA, 19 nt, Salmonella typhimurium LT2
augcccccuccagccagcg

SEQ ID NO: 3803165 - RNA, 22 nt, Salmonella typhimurium LT2
augcccccuccagccagcgcca

SEQ ID NO: 3803166 - RNA, 17 nt, Salmonella typhimurium LT2
augcccccucggcagca

SEQ ID NO: 3803167 - RNA, 17 nt, Salmonella typhimurium LT2
augccccgacaucagau

SEQ ID NO: 3803168 - RNA, 14 nt, Salmonella typhimurium LT2
augcccgauggcgc

SEQ ID NO: 3803169 - RNA, 20 nt, Salmonella typhimurium LT2
augcccuucuaccgucagca

SEQ ID NO: 3803170 - RNA, 16 nt, Salmonella typhimurium LT2
augccgaguuccggau

SEQ ID NO: 3803171 - RNA, 22 nt, Salmonella typhimurium LT2
augccgcaauaaacacgauggc

SEQ ID NO: 3803172 - RNA, 19 nt, Salmonella typhimurium LT2
augccgcacuccccagaau

SEQ ID NO: 3803173 - RNA, 15 nt, Salmonella typhimurium LT2
augccgcauaaaauu

SEQ ID NO: 3803174 - RNA, 10 nt, Salmonella typhimurium LT2
augccgccgc

SEQ ID NO: 3803175 - RNA, 19 nt, Salmonella typhimurium LT2
augccgccuguugcaugac

SEQ ID NO: 3803176 - RNA, 13 nt, Salmonella typhimurium LT2
auggaaguugccg

SEQ ID NO: 3803177 - RNA, 17 nt, Salmonella typhimurium LT2
auggacgggauacggcg

SEQ ID NO: 3803178 - RNA, 22 nt, Salmonella typhimurium LT2
auggagccuucaaccauugucu

SEQ ID NO: 3803179 - RNA, 18 nt, Salmonella typhimurium LT2
auggaguuccaguucauc

SEQ ID NO: 3803180 - RNA, 20 nt, Salmonella typhimurium LT2
auggaucggcuugccuucau

SEQ ID NO: 3803181 - RNA, 22 nt, Salmonella typhimurium LT2
auggauucaugguacucaacau

SEQ ID NO: 3803182 - RNA, 21 nt, Salmonella typhimurium LT2
auggcaaaagacauucccgcc

SEQ ID NO: 3803183 - RNA, 21 nt, Salmonella typhimurium LT2
auggcaaagucgaacgacuga

SEQ ID NO: 3803184 - RNA, 20 nt, Salmonella typhimurium LT2
auggcacuggcgacggcauc

SEQ ID NO: 3803185 - RNA, 15 nt, Salmonella typhimurium LT2
auggcagauaaacca

SEQ ID NO: 3803186 - RNA, 18 nt, Salmonella typhimurium LT2
auggcaggcauagacauc

SEQ ID NO: 3803187 - RNA, 17 nt, Salmonella typhimurium LT2
auggcagggacaacgca

SEQ ID NO: 3803188 - RNA, 18 nt, Salmonella typhimurium LT2
auggcagggcgauaucca

SEQ ID NO: 3803189 - RNA, 19 nt, Salmonella typhimurium LT2
auggcaguauaaauaccuu

SEQ ID NO: 3803190 - RNA, 22 nt, Salmonella typhimurium LT2
auggcauaacgcuguagcguuu

SEQ ID NO: 3803191 - RNA, 15 nt, Salmonella typhimurium LT2
auggcauacagcucg

SEQ ID NO: 3803192 - RNA, 22 nt, Salmonella typhimurium LT2
auggcauaugacgguauugcuu

SEQ ID NO: 3803193 - RNA, 16 nt, Salmonella typhimurium LT2
auggcaucaaucccgc

SEQ ID NO: 3803194 - RNA, 22 nt, Salmonella typhimurium LT2
auggccaauguacguaaaacca

SEQ ID NO: 3803195 - RNA, 14 nt, Salmonella typhimurium LT2
auggccauagacuu

SEQ ID NO: 3803196 - RNA, 17 nt, Salmonella typhimurium LT2
auggcccacguaagugg

SEQ ID NO: 3803197 - RNA, 19 nt, Salmonella typhimurium LT2
auggcccagcguacugcca

SEQ ID NO: 3803198 - RNA, 19 nt, Salmonella typhimurium LT2
auggccccggucaacgcgc

SEQ ID NO: 3803199 - RNA, 23 nt, Salmonella typhimurium LT2
auggccccggucaacgcgccgcc

SEQ ID NO: 3803200 - RNA, 22 nt, Salmonella typhimurium LT2
auggccgacauugaccagugca

SEQ ID NO: 3803201 - RNA, 15 nt, Salmonella typhimurium LT2
auggccgcagcgcca

SEQ ID NO: 3803202 - RNA, 14 nt, Salmonella typhimurium LT2
auggccugaugacg

SEQ ID NO: 3803203 - RNA, 22 nt, Salmonella typhimurium LT2
auggccugcucuacucaguaag

SEQ ID NO: 3803204 - RNA, 16 nt, Salmonella typhimurium LT2
auggcgaacagcccca

SEQ ID NO: 3803205 - RNA, 21 nt, Salmonella typhimurium LT2
auggcgaauccguugaucguc

SEQ ID NO: 3803206 - RNA, 14 nt, Salmonella typhimurium LT2
auggcgacgcaggc

SEQ ID NO: 3803207 - RNA, 13 nt, Salmonella typhimurium LT2
auggcgaggcuaa

SEQ ID NO: 3803208 - RNA, 15 nt, Salmonella typhimurium LT2
auggcgccaauauag

SEQ ID NO: 3803209 - RNA, 19 nt, Salmonella typhimurium LT2
auggcgcgaaaacagcugg

SEQ ID NO: 3803210 - RNA, 22 nt, Salmonella typhimurium LT2
auggcgcugcgcuuaucaggcc

SEQ ID NO: 3803211 - RNA, 20 nt, Salmonella typhimurium LT2
auggcgcugucgcuuauucg

SEQ ID NO: 3803212 - RNA, 20 nt, Salmonella typhimurium LT2
auggcggcauaaucaggaaa

SEQ ID NO: 3803213 - RNA, 24 nt, Salmonella typhimurium LT2
auggcggccaaaucgucagccgcc

SEQ ID NO: 3803214 - RNA, 17 nt, Salmonella typhimurium LT2
auggcggccagauggca

SEQ ID NO: 3803215 - RNA, 18 nt, Salmonella typhimurium LT2
auggcggcggaaaggacu

SEQ ID NO: 3803216 - RNA, 19 nt, Salmonella typhimurium LT2
auggcggcgugaccgccuu

SEQ ID NO: 3803217 - RNA, 17 nt, Salmonella typhimurium LT2
auggcggcguuuuccgg

SEQ ID NO: 3803218 - RNA, 22 nt, Salmonella typhimurium LT2
auggcgggcgcagguuuuacuu

SEQ ID NO: 3803219 - RNA, 17 nt, Salmonella typhimurium LT2
auggcgggcguccugcc

SEQ ID NO: 3803220 - RNA, 15 nt, Salmonella typhimurium LT2
auggcgguauaacug

SEQ ID NO: 3803221 - RNA, 16 nt, Salmonella typhimurium LT2
auggcgguauaacugc

SEQ ID NO: 3803222 - RNA, 17 nt, Salmonella typhimurium LT2
auggcgguuccggggaa

SEQ ID NO: 3803223 - RNA, 20 nt, Salmonella typhimurium LT2
auggcgguugccacugccac

SEQ ID NO: 3803224 - RNA, 15 nt, Salmonella typhimurium LT2
auggcgucgugcagc

SEQ ID NO: 3803225 - RNA, 15 nt, Salmonella typhimurium LT2
auggcgugaugcuuu

SEQ ID NO: 3803226 - RNA, 18 nt, Salmonella typhimurium LT2
auggcuacaccuuauccg

SEQ ID NO: 3803227 - RNA, 16 nt, Salmonella typhimurium LT2
auggcucagauugaac

SEQ ID NO: 3803228 - RNA, 23 nt, Salmonella typhimurium LT2
auggcugacugaauuuucagcca

SEQ ID NO: 3803229 - RNA, 17 nt, Salmonella typhimurium LT2
auggcugagaaucaccu

SEQ ID NO: 3803230 - RNA, 13 nt, Salmonella typhimurium LT2
auggcugauggcg

SEQ ID NO: 3803231 - RNA, 22 nt, Salmonella typhimurium LT2
auggcugcacccggagagaaac

SEQ ID NO: 3803232 - RNA, 23 nt, Salmonella typhimurium LT2
auggcugcgacaaugaagcauaa

SEQ ID NO: 3803233 - RNA, 23 nt, Salmonella typhimurium LT2
auggcuuacgguuguuucagcca

SEQ ID NO: 3803234 - RNA, 14 nt, Salmonella typhimurium LT2
auggcuucaaaaag

SEQ ID NO: 3803235 - RNA, 18 nt, Salmonella typhimurium LT2
auggcuuucagauuagcc

SEQ ID NO: 3803236 - RNA, 20 nt, Salmonella typhimurium LT2
auggcuuucagauuagccag

SEQ ID NO: 3803237 - RNA, 18 nt, Salmonella typhimurium LT2
augggauacgccagcaga

SEQ ID NO: 3803238 - RNA, 17 nt, Salmonella typhimurium LT2
augggccuacgccugga

SEQ ID NO: 3803239 - RNA, 20 nt, Salmonella typhimurium LT2
auggguaaaaauauggcggg

SEQ ID NO: 3803240 - RNA, 23 nt, Salmonella typhimurium LT2
auggguaucgccuucgacuuccg

SEQ ID NO: 3803241 - RNA, 21 nt, Salmonella typhimurium LT2
auggguuauccucuccugaag

SEQ ID NO: 3803242 - RNA, 23 nt, Salmonella typhimurium LT2
augguaaaauuauugugagaaaa

SEQ ID NO: 3803243 - RNA, 13 nt, Salmonella typhimurium LT2
augguaauuuaaa

SEQ ID NO: 3803244 - RNA, 14 nt, Salmonella typhimurium LT2
augguaauuuaaag

SEQ ID NO: 3803245 - RNA, 20 nt, Salmonella typhimurium LT2
augguacucaacaucauuaa

SEQ ID NO: 3803246 - RNA, 16 nt, Salmonella typhimurium LT2
augguagcugcggcua

SEQ ID NO: 3803247 - RNA, 24 nt, Salmonella typhimurium LT2
augguagcugcggcuauauaaaau

SEQ ID NO: 3803248 - RNA, 16 nt, Salmonella typhimurium LT2
auggucacauucugac

SEQ ID NO: 3803249 - RNA, 12 nt, Salmonella typhimurium LT2
auggucagcgcc

SEQ ID NO: 3803250 - RNA, 17 nt, Salmonella typhimurium LT2
auggucaucguuugggc

SEQ ID NO: 3803251 - RNA, 17 nt, Salmonella typhimurium LT2
auggucccugauauaca

SEQ ID NO: 3803252 - RNA, 20 nt, Salmonella typhimurium LT2
auggucgaaaauaucggccu

SEQ ID NO: 3803253 - RNA, 16 nt, Salmonella typhimurium LT2
auggucgccagcgucu

SEQ ID NO: 3803254 - RNA, 21 nt, Salmonella typhimurium LT2
auggucgcgccgucgccugcc

SEQ ID NO: 3803255 - RNA, 19 nt, Salmonella typhimurium LT2
auggucguauuuuggcgcu

SEQ ID NO: 3803256 - RNA, 13 nt, Salmonella typhimurium LT2
auggucuuaaaug

SEQ ID NO: 3803257 - RNA, 15 nt, Salmonella typhimurium LT2
auggugauagcgcgc

SEQ ID NO: 3803258 - RNA, 23 nt, Salmonella typhimurium LT2
auggugauagcgcgccagcacca

SEQ ID NO: 3803259 - RNA, 18 nt, Salmonella typhimurium LT2
auggugcagugcacugcc

SEQ ID NO: 3803260 - RNA, 13 nt, Salmonella typhimurium LT2
auggugcucagcc

SEQ ID NO: 3803261 - RNA, 17 nt, Salmonella typhimurium LT2
auggugguugcaucguc

SEQ ID NO: 3803262 - RNA, 22 nt, Salmonella typhimurium LT2
augguguuggcgaucagcggca

SEQ ID NO: 3803263 - RNA, 14 nt, Salmonella typhimurium LT2
augguuaaauucau

SEQ ID NO: 3803264 - RNA, 14 nt, Salmonella typhimurium LT2
augguuaaauugaa

SEQ ID NO: 3803265 - RNA, 18 nt, Salmonella typhimurium LT2
augguuauaguccacuuu

SEQ ID NO: 3803266 - RNA, 17 nt, Salmonella typhimurium LT2
augguuauccagcaggu

SEQ ID NO: 3803267 - RNA, 19 nt, Salmonella typhimurium LT2
augguuauuaauuacgcug

SEQ ID NO: 3803268 - RNA, 16 nt, Salmonella typhimurium LT2
augguucccgccacug

SEQ ID NO: 3803269 - RNA, 22 nt, Salmonella typhimurium LT2
augguugcaugauuaggcuggg

SEQ ID NO: 3803270 - RNA, 23 nt, Salmonella typhimurium LT2
auguaaacuccauuaaauuacuu

SEQ ID NO: 3803271 - RNA, 15 nt, Salmonella typhimurium LT2
auguaaagcgccauu

SEQ ID NO: 3803272 - RNA, 22 nt, Salmonella typhimurium LT2
auguaaagucggccauuuuuuu

SEQ ID NO: 3803273 - RNA, 16 nt, Salmonella typhimurium LT2
auguaacgccuuugcc

SEQ ID NO: 3803274 - RNA, 14 nt, Salmonella typhimurium LT2
auguaagaauaaca

SEQ ID NO: 3803275 - RNA, 18 nt, Salmonella typhimurium LT2
auguaaugcuugcugcuu

SEQ ID NO: 3803276 - RNA, 20 nt, Salmonella typhimurium LT2
auguacacgaaauagcgcag

SEQ ID NO: 3803277 - RNA, 18 nt, Salmonella typhimurium LT2
auguaccgcuacgcaggc

SEQ ID NO: 3803278 - RNA, 17 nt, Salmonella typhimurium LT2
auguaccugcguuaaac

SEQ ID NO: 3803279 - RNA, 19 nt, Salmonella typhimurium LT2
auuaaugucaugaagcuca

SEQ ID NO: 3803280 - RNA, 16 nt, Salmonella typhimurium LT2
auuaauucaugugaaa

SEQ ID NO: 3803281 - RNA, 22 nt, Salmonella typhimurium LT2
auuaauugauuacaaagggcaa

SEQ ID NO: 3803282 - RNA, 18 nt, Salmonella typhimurium LT2
auuaauuuauccaacagg

SEQ ID NO: 3803283 - RNA, 16 nt, Salmonella typhimurium LT2
auuacaaaaugugcaa

SEQ ID NO: 3803284 - RNA, 15 nt, Salmonella typhimurium LT2
auuacacaauaucaa

SEQ ID NO: 3803285 - RNA, 16 nt, Salmonella typhimurium LT2
auuacacaauaucaau

SEQ ID NO: 3803286 - RNA, 17 nt, Salmonella typhimurium LT2
auuacagauauccaccg

SEQ ID NO: 3803287 - RNA, 19 nt, Salmonella typhimurium LT2
auuacagcauguucaugcg

SEQ ID NO: 3803288 - RNA, 22 nt, Salmonella typhimurium LT2
auuacaggcaucuuccagcguc

SEQ ID NO: 3803289 - RNA, 15 nt, Salmonella typhimurium LT2
auuacaucaaaugaa

SEQ ID NO: 3803290 - RNA, 19 nt, Salmonella typhimurium LT2
auuacaucaaaugaacaca

SEQ ID NO: 3803291 - RNA, 12 nt, Salmonella typhimurium LT2
auuaccagcaau

SEQ ID NO: 3803292 - RNA, 12 nt, Salmonella typhimurium LT2
auuaccccagca

SEQ ID NO: 3803293 - RNA, 17 nt, Salmonella typhimurium LT2
auuaccccugguggggu

SEQ ID NO: 3803294 - RNA, 22 nt, Salmonella typhimurium LT2
auuacccucccuuucuucucaa

SEQ ID NO: 3803295 - RNA, 21 nt, Salmonella typhimurium LT2
auuaccgaugguuaaagguug

SEQ ID NO: 3803296 - RNA, 20 nt, Salmonella typhimurium LT2
auuaccgcucguuaacccaa

SEQ ID NO: 3803297 - RNA, 16 nt, Salmonella typhimurium LT2
auuaccggcugccgau

SEQ ID NO: 3803298 - RNA, 22 nt, Salmonella typhimurium LT2
auuaccgggauuuccauauuaa

SEQ ID NO: 3803299 - RNA, 14 nt, Salmonella typhimurium LT2
auuaccuaccagcg

SEQ ID NO: 3803300 - RNA, 21 nt, Salmonella typhimurium LT2
auuaccuucgcguaaugcaau

SEQ ID NO: 3803301 - RNA, 13 nt, Salmonella typhimurium LT2
auuaccuuuacau

SEQ ID NO: 3803302 - RNA, 18 nt, Salmonella typhimurium LT2
auuacgacccacaaugag

SEQ ID NO: 3803303 - RNA, 14 nt, Salmonella typhimurium LT2
auuacgacugcacc

SEQ ID NO: 3803304 - RNA, 22 nt, Salmonella typhimurium LT2
auuacgacugcacccaucuuua

SEQ ID NO: 3803305 - RNA, 16 nt, Salmonella typhimurium LT2
auuacgauugcgccau

SEQ ID NO: 3803306 - RNA, 23 nt, Salmonella typhimurium LT2
auuacgauugcgccaucuaaauu

SEQ ID NO: 3803307 - RNA, 22 nt, Salmonella typhimurium LT2
auuacgcacacuugcucccaga

SEQ ID NO: 3803308 - RNA, 23 nt, Salmonella typhimurium LT2
auuacgccaucagcauuuucaca

SEQ ID NO: 3803309 - RNA, 20 nt, Salmonella typhimurium LT2
auuacgcccauuaugccgca

SEQ ID NO: 3803310 - RNA, 17 nt, Salmonella typhimurium LT2
auuacgccugucgcgcc

SEQ ID NO: 3803311 - RNA, 15 nt, Salmonella typhimurium LT2
auuacggguaaugau

SEQ ID NO: 3803312 - RNA, 13 nt, Salmonella typhimurium LT2
auuacguacguca

SEQ ID NO: 3803313 - RNA, 21 nt, Salmonella typhimurium LT2
auuacguuggggauaaccaga

SEQ ID NO: 3803314 - RNA, 13 nt, Salmonella typhimurium LT2
auuacuauacccg

SEQ ID NO: 3803315 - RNA, 20 nt, Salmonella typhimurium LT2
auuacugcgugcuggcggcc

SEQ ID NO: 3803316 - RNA, 15 nt, Salmonella typhimurium LT2
auuacuuaugauaua

SEQ ID NO: 3803317 - RNA, 12 nt, Salmonella typhimurium LT2
auuagaauagcc

SEQ ID NO: 3803318 - RNA, 16 nt, Salmonella typhimurium LT2
auuagagacaugguaa

SEQ ID NO: 3803319 - RNA, 14 nt, Salmonella typhimurium LT2
auuagagccaauau

SEQ ID NO: 3803320 - RNA, 16 nt, Salmonella typhimurium LT2
auuagccagaggcuaa

SEQ ID NO: 3803321 - RNA, 19 nt, Salmonella typhimurium LT2
auuagccguugaguuugac

SEQ ID NO: 3803322 - RNA, 22 nt, Salmonella typhimurium LT2
auuagccuuccuggggaacaga

SEQ ID NO: 3803323 - RNA, 22 nt, Salmonella typhimurium LT2
auuagcguuuuuaucuuuuacg

SEQ ID NO: 3803324 - RNA, 13 nt, Salmonella typhimurium LT2
auuaggcuggguc

SEQ ID NO: 3803325 - RNA, 20 nt, Salmonella typhimurium LT2
auuaggcuuuucauucagcg

SEQ ID NO: 3803326 - RNA, 14 nt, Salmonella typhimurium LT2
auuagucugccauu

SEQ ID NO: 3803327 - RNA, 20 nt, Salmonella typhimurium LT2
auuagucugccauuuccuga

SEQ ID NO: 3803328 - RNA, 22 nt, Salmonella typhimurium LT2
auuauacuuauuuguaugacaa

SEQ ID NO: 3803329 - RNA, 19 nt, Salmonella typhimurium LT2
auuauacuugcugcuauga

SEQ ID NO: 3803330 - RNA, 21 nt, Salmonella typhimurium LT2
auuauauaacacgauuuuugu

SEQ ID NO: 3803331 - RNA, 21 nt, Salmonella typhimurium LT2
auuauauguuucuguauuuuc

SEQ ID NO: 3803332 - RNA, 18 nt, Salmonella typhimurium LT2
auuauauucguccuuuau

SEQ ID NO: 3803333 - RNA, 19 nt, Salmonella typhimurium LT2
auuaucaauggcuucaaug

SEQ ID NO: 3803334 - RNA, 11 nt, Salmonella typhimurium LT2
auuaucaccau

SEQ ID NO: 3803335 - RNA, 23 nt, Salmonella typhimurium LT2
auuaucuaccagccgauuuuucg

SEQ ID NO: 3803336 - RNA, 15 nt, Salmonella typhimurium LT2
auuaugaauaaccau

SEQ ID NO: 3803337 - RNA, 20 nt, Salmonella typhimurium LT2
auuaugaccaauaauaaucc

SEQ ID NO: 3803338 - RNA, 16 nt, Salmonella typhimurium LT2
auuaugccugucauca

SEQ ID NO: 3803339 - RNA, 21 nt, Salmonella typhimurium LT2
auuauggacgggauacggcga

SEQ ID NO: 3803340 - RNA, 15 nt, Salmonella typhimurium LT2
auuaugggcaaugau

SEQ ID NO: 3803341 - RNA, 15 nt, Salmonella typhimurium LT2
auuauguagcaacag

SEQ ID NO: 3803342 - RNA, 16 nt, Salmonella typhimurium LT2
auuauucaggccuccu

SEQ ID NO: 3803343 - RNA, 14 nt, Salmonella typhimurium LT2
auuauugcacauaa

SEQ ID NO: 3803344 - RNA, 22 nt, Salmonella typhimurium LT2
auuauugcguugcuuuauaaaa

SEQ ID NO: 3803345 - RNA, 22 nt, Salmonella typhimurium LT2
auuauugucuuuguugccuucg

SEQ ID NO: 3803346 - RNA, 14 nt, Salmonella typhimurium LT2
auuauuuacaguau

SEQ ID NO: 3803347 - RNA, 18 nt, Salmonella typhimurium LT2
auuauuuuagugaaaaaa

SEQ ID NO: 3803348 - RNA, 19 nt, Salmonella typhimurium LT2
auuauuuuagugaaaaaau

SEQ ID NO: 3803349 - RNA, 14 nt, Salmonella typhimurium LT2
auuauuuuuucuuu

SEQ ID NO: 3803350 - RNA, 22 nt, Salmonella typhimurium LT2
auuauuuuuucuuuaauuaaau

SEQ ID NO: 3803351 - RNA, 17 nt, Salmonella typhimurium LT2
auucaaaacgaucauug

SEQ ID NO: 3803352 - RNA, 21 nt, Salmonella typhimurium LT2
auucaaaccuucaagaaucaa

SEQ ID NO: 3803353 - RNA, 19 nt, Salmonella typhimurium LT2
auucaacacauuccauuuu

SEQ ID NO: 3803354 - RNA, 21 nt, Salmonella typhimurium LT2
auucaacaggggccuuuuuuu

SEQ ID NO: 3803355 - RNA, 22 nt, Salmonella typhimurium LT2
auucaacagggguuccggcaau

SEQ ID NO: 3803356 - RNA, 22 nt, Salmonella typhimurium LT2
auucaaccagccgaucagcgcc

SEQ ID NO: 3803357 - RNA, 23 nt, Salmonella typhimurium LT2
auucaaccagccgaucagcgcca

SEQ ID NO: 3803358 - RNA, 17 nt, Salmonella typhimurium LT2
auucaaccaguuaauuu

SEQ ID NO: 3803359 - RNA, 15 nt, Salmonella typhimurium LT2
auucaacgcccccuu

SEQ ID NO: 3803360 - RNA, 14 nt, Salmonella typhimurium LT2
auucaacguauuaa

SEQ ID NO: 3803361 - RNA, 20 nt, Salmonella typhimurium LT2
auucaagaacgguuuauccc

SEQ ID NO: 3803362 - RNA, 23 nt, Salmonella typhimurium LT2
auucaagaacgguuuauccccgc

SEQ ID NO: 3803363 - RNA, 16 nt, Salmonella typhimurium LT2
auucaagcuguuggau

SEQ ID NO: 3803364 - RNA, 11 nt, Salmonella typhimurium LT2
auucaaucacu

SEQ ID NO: 3803365 - RNA, 18 nt, Salmonella typhimurium LT2
auucaauuucccuuugcc

SEQ ID NO: 3803366 - RNA, 21 nt, Salmonella typhimurium LT2
auucacaccaaugucauauuu

SEQ ID NO: 3803367 - RNA, 22 nt, Salmonella typhimurium LT2
auucacaccuuuauauuuuucc

SEQ ID NO: 3803368 - RNA, 18 nt, Salmonella typhimurium LT2
auucacgacaugagauaa

SEQ ID NO: 3803369 - RNA, 16 nt, Salmonella typhimurium LT2
auucacucugaaaaau

SEQ ID NO: 3803370 - RNA, 20 nt, Salmonella typhimurium LT2
auucacucugaaaaauuuuc

SEQ ID NO: 3803371 - RNA, 22 nt, Salmonella typhimurium LT2
auucacuuucuugccacuggcc

SEQ ID NO: 3803372 - RNA, 12 nt, Salmonella typhimurium LT2
auucagcaaaug

SEQ ID NO: 3803373 - RNA, 17 nt, Salmonella typhimurium LT2
auucagcacccagcgaa

SEQ ID NO: 3803374 - RNA, 22 nt, Salmonella typhimurium LT2
auucagcacgcuuuggcaggcc

SEQ ID NO: 3803375 - RNA, 19 nt, Salmonella typhimurium LT2
auucagcgcuuagcggcac

SEQ ID NO: 3803376 - RNA, 20 nt, Salmonella typhimurium LT2
auucaggcaucguacgggca

SEQ ID NO: 3803377 - RNA, 14 nt, Salmonella typhimurium LT2
auucaguuugcaac

SEQ ID NO: 3803378 - RNA, 20 nt, Salmonella typhimurium LT2
auucauaaugguugugccag

SEQ ID NO: 3803379 - RNA, 16 nt, Salmonella typhimurium LT2
auucauaccuuuaagc

SEQ ID NO: 3803380 - RNA, 24 nt, Salmonella typhimurium LT2
auucauagagcgcguccagacguu

SEQ ID NO: 3803381 - RNA, 18 nt, Salmonella typhimurium LT2
auucauaugcgccaacug

SEQ ID NO: 3803382 - RNA, 15 nt, Salmonella typhimurium LT2
auucugcgccagcca

SEQ ID NO: 3803383 - RNA, 16 nt, Salmonella typhimurium LT2
auucugcgccagccag

SEQ ID NO: 3803384 - RNA, 12 nt, Salmonella typhimurium LT2
auucugcgguaa

SEQ ID NO: 3803385 - RNA, 18 nt, Salmonella typhimurium LT2
auucuggcgcagcuucug

SEQ ID NO: 3803386 - RNA, 20 nt, Salmonella typhimurium LT2
auucuggcgcagcuucugau

SEQ ID NO: 3803387 - RNA, 19 nt, Salmonella typhimurium LT2
auucugggcuuacuuucca

SEQ ID NO: 3803388 - RNA, 18 nt, Salmonella typhimurium LT2
auucugguaguaagucag

SEQ ID NO: 3803389 - RNA, 18 nt, Salmonella typhimurium LT2
auucuguuagcgcccucu

SEQ ID NO: 3803390 - RNA, 14 nt, Salmonella typhimurium LT2
auucuguuccuaau

SEQ ID NO: 3803391 - RNA, 15 nt, Salmonella typhimurium LT2
auucuguuuguuuuu

SEQ ID NO: 3803392 - RNA, 15 nt, Salmonella typhimurium LT2
auucuuaucauuuag

SEQ ID NO: 3803393 - RNA, 15 nt, Salmonella typhimurium LT2
auucuucgaaugucu

SEQ ID NO: 3803394 - RNA, 14 nt, Salmonella typhimurium LT2
auucuucuccucuu

SEQ ID NO: 3803395 - RNA, 15 nt, Salmonella typhimurium LT2
auucuucuccucuuc

SEQ ID NO: 3803396 - RNA, 15 nt, Salmonella typhimurium LT2
auucuucuuagaaua

SEQ ID NO: 3803397 - RNA, 12 nt, Salmonella typhimurium LT2
auucuugcgccg

SEQ ID NO: 3803398 - RNA, 13 nt, Salmonella typhimurium LT2
auucuuucgucac

SEQ ID NO: 3803399 - RNA, 19 nt, Salmonella typhimurium LT2
auucuuuguuuaaaaauuu

SEQ ID NO: 3803400 - RNA, 14 nt, Salmonella typhimurium LT2
auugaacauuuuuu

SEQ ID NO: 3803401 - RNA, 21 nt, Salmonella typhimurium LT2
auugaacauuuuuucagccug

SEQ ID NO: 3803402 - RNA, 21 nt, Salmonella typhimurium LT2
auugaacgcuggcggcaggcc

SEQ ID NO: 3803403 - RNA, 15 nt, Salmonella typhimurium LT2
auugaagcgauauuc

SEQ ID NO: 3803404 - RNA, 17 nt, Salmonella typhimurium LT2
auugaaguucuucccac

SEQ ID NO: 3803405 - RNA, 20 nt, Salmonella typhimurium LT2
auugaauuugacgacaugca

SEQ ID NO: 3803406 - RNA, 16 nt, Salmonella typhimurium LT2
auugaccagugcaaac

SEQ ID NO: 3803407 - RNA, 15 nt, Salmonella typhimurium LT2
auugaccccauauug

SEQ ID NO: 3803408 - RNA, 18 nt, Salmonella typhimurium LT2
auugacgggaaaucuccc

SEQ ID NO: 3803409 - RNA, 17 nt, Salmonella typhimurium LT2
auugacuggauuuuuga

SEQ ID NO: 3803410 - RNA, 17 nt, Salmonella typhimurium LT2
auugagcagucguucac

SEQ ID NO: 3803411 - RNA, 13 nt, Salmonella typhimurium LT2
auugagccacuca

SEQ ID NO: 3803412 - RNA, 15 nt, Salmonella typhimurium LT2
auugaggcuacccag

SEQ ID NO: 3803413 - RNA, 16 nt, Salmonella typhimurium LT2
auugaggcuacccaga

SEQ ID NO: 3803414 - RNA, 18 nt, Salmonella typhimurium LT2
auugaggcuacccagaca

SEQ ID NO: 3803415 - RNA, 20 nt, Salmonella typhimurium LT2
auugagguguuuccagugca

SEQ ID NO: 3803416 - RNA, 23 nt, Salmonella typhimurium LT2
auugagguguuuccagugcagcu

SEQ ID NO: 3803417 - RNA, 18 nt, Salmonella typhimurium LT2
auugaguggacaucgcca

SEQ ID NO: 3803418 - RNA, 16 nt, Salmonella typhimurium LT2
auugauaauaaccguc

SEQ ID NO: 3803419 - RNA, 20 nt, Salmonella typhimurium LT2
auugauauagaguccagcca

SEQ ID NO: 3803420 - RNA, 18 nt, Salmonella typhimurium LT2
auugauuacaaagggcaa

SEQ ID NO: 3803421 - RNA, 17 nt, Salmonella typhimurium LT2
auugauuggcaaacugc

SEQ ID NO: 3803422 - RNA, 13 nt, Salmonella typhimurium LT2
auugauuuuucug

SEQ ID NO: 3803423 - RNA, 15 nt, Salmonella typhimurium LT2
auugauuuuucuggu

SEQ ID NO: 3803424 - RNA, 17 nt, Salmonella typhimurium LT2
auugcaacgaucccuaa

SEQ ID NO: 3803425 - RNA, 22 nt, Salmonella typhimurium LT2
auugcaacgaucccuaauaaaa

SEQ ID NO: 3803426 - RNA, 20 nt, Salmonella typhimurium LT2
auugcaccugggagucgugc

SEQ ID NO: 3803427 - RNA, 17 nt, Salmonella typhimurium LT2
auugcagcgaccuggga

SEQ ID NO: 3803428 - RNA, 13 nt, Salmonella typhimurium LT2
auugcauccaacu

SEQ ID NO: 3803429 - RNA, 15 nt, Salmonella typhimurium LT2
auugccaugaugagc

SEQ ID NO: 3803430 - RNA, 17 nt, Salmonella typhimurium LT2
auugccaugaugagcgc

SEQ ID NO: 3803431 - RNA, 15 nt, Salmonella typhimurium LT2
auugcccaauguuuu

SEQ ID NO: 3803432 - RNA, 17 nt, Salmonella typhimurium LT2
auugcccaucgcgccau

SEQ ID NO: 3803433 - RNA, 16 nt, Salmonella typhimurium LT2
auugccccauguucag

SEQ ID NO: 3803434 - RNA, 23 nt, Salmonella typhimurium LT2
auugccccccagccauaauacaa

SEQ ID NO: 3803435 - RNA, 23 nt, Salmonella typhimurium LT2
auugcccuggauuagucugccau

SEQ ID NO: 3803436 - RNA, 15 nt, Salmonella typhimurium LT2
auugcccuuuuguuu

SEQ ID NO: 3803437 - RNA, 23 nt, Salmonella typhimurium LT2
auugcccuuuuguuuuugccccc

SEQ ID NO: 3803438 - RNA, 13 nt, Salmonella typhimurium LT2
auugccgaccauu

SEQ ID NO: 3803439 - RNA, 15 nt, Salmonella typhimurium LT2
auugccgcacauguu

SEQ ID NO: 3803440 - RNA, 19 nt, Salmonella typhimurium LT2
auugccgccuugguugccg

SEQ ID NO: 3803441 - RNA, 18 nt, Salmonella typhimurium LT2
auugccgucagcuccugc

SEQ ID NO: 3803442 - RNA, 21 nt, Salmonella typhimurium LT2
auugccguuguugucaauauc

SEQ ID NO: 3803443 - RNA, 23 nt, Salmonella typhimurium LT2
auugccugauggcgcuacgccug

SEQ ID NO: 3803444 - RNA, 17 nt, Salmonella typhimurium LT2
auugccuuucaauacuu

SEQ ID NO: 3803445 - RNA, 16 nt, Salmonella typhimurium LT2
auugcgaacaguuccg

SEQ ID NO: 3803446 - RNA, 16 nt, Salmonella typhimurium LT2
auugcgaauaaaacug

SEQ ID NO: 3803447 - RNA, 20 nt, Salmonella typhimurium LT2
auugcgacaagcucauuucc

SEQ ID NO: 3803448 - RNA, 15 nt, Salmonella typhimurium LT2
auugcgagaaaaaac

SEQ ID NO: 3803449 - RNA, 18 nt, Salmonella typhimurium LT2
auugcgauacagcguauc

SEQ ID NO: 3803450 - RNA, 16 nt, Salmonella typhimurium LT2
auugcgauaugcuguu

SEQ ID NO: 3803451 - RNA, 21 nt, Salmonella typhimurium LT2
auugcgaucuccuuuaaugaa

SEQ ID NO: 3803452 - RNA, 14 nt, Salmonella typhimurium LT2
auugcgccaccuua

SEQ ID NO: 3803453 - RNA, 16 nt, Salmonella typhimurium LT2
auugcgcgcuauguuc

SEQ ID NO: 3803454 - RNA, 20 nt, Salmonella typhimurium LT2
auugcggaucuucaccacgc

SEQ ID NO: 3803455 - RNA, 16 nt, Salmonella typhimurium LT2
auugcguaaugagcgu

SEQ ID NO: 3803456 - RNA, 21 nt, Salmonella typhimurium LT2
auugcguaucguaagccacug

SEQ ID NO: 3803457 - RNA, 22 nt, Salmonella typhimurium LT2
auugcguaucguaagccacugc

SEQ ID NO: 3803458 - RNA, 13 nt, Salmonella typhimurium LT2
auugcguugcuuu

SEQ ID NO: 3803459 - RNA, 17 nt, Salmonella typhimurium LT2
auugcucagguuauacu

SEQ ID NO: 3803460 - RNA, 17 nt, Salmonella typhimurium LT2
auugcugacgaaacauu

SEQ ID NO: 3803461 - RNA, 14 nt, Salmonella typhimurium LT2
auugcugagcugac

SEQ ID NO: 3803462 - RNA, 20 nt, Salmonella typhimurium LT2
auugcugcuauauaacauau

SEQ ID NO: 3803463 - RNA, 15 nt, Salmonella typhimurium LT2
auugcuggaaacgcg

SEQ ID NO: 3803464 - RNA, 22 nt, Salmonella typhimurium LT2
auugcuggccuagaugaaugac

SEQ ID NO: 3803465 - RNA, 22 nt, Salmonella typhimurium LT2
auugcuguguuuucagccaggc

SEQ ID NO: 3803466 - RNA, 22 nt, Salmonella typhimurium LT2
auugcuucguggcaaucagcaa

SEQ ID NO: 3803467 - RNA, 17 nt, Salmonella typhimurium LT2
auuggaaaaccccaucc

SEQ ID NO: 3803468 - RNA, 20 nt, Salmonella typhimurium LT2
auuggcaaaccccugcucgc

SEQ ID NO: 3803469 - RNA, 14 nt, Salmonella typhimurium LT2
auuggcaaacugcc

SEQ ID NO: 3803470 - RNA, 12 nt, Salmonella typhimurium LT2
auuggcaaugaa

SEQ ID NO: 3803471 - RNA, 14 nt, Salmonella typhimurium LT2
auuggcaucauaaa

SEQ ID NO: 3803472 - RNA, 15 nt, Salmonella typhimurium LT2
auuggcgagcaggaa

SEQ ID NO: 3803473 - RNA, 20 nt, Salmonella typhimurium LT2
auuggcgcgucaucaauauc

SEQ ID NO: 3803474 - RNA, 15 nt, Salmonella typhimurium LT2
auuggcguuuuauga

SEQ ID NO: 3803475 - RNA, 15 nt, Salmonella typhimurium LT2
auuggcuggccugcu

SEQ ID NO: 3803476 - RNA, 14 nt, Salmonella typhimurium LT2
auugguacaacgcc

SEQ ID NO: 3803477 - RNA, 15 nt, Salmonella typhimurium LT2
auugguagacgcacc

SEQ ID NO: 3803478 - RNA, 17 nt, Salmonella typhimurium LT2
auugguagacgcgcuag

SEQ ID NO: 3803479 - RNA, 14 nt, Salmonella typhimurium LT2
auuggucugauuca

SEQ ID NO: 3803480 - RNA, 20 nt, Salmonella typhimurium LT2
auuggucuggauugcagaga

SEQ ID NO: 3803481 - RNA, 15 nt, Salmonella typhimurium LT2
auuggugauauaaac

SEQ ID NO: 3803482 - RNA, 18 nt, Salmonella typhimurium LT2
auugguuaucaaaaaccu

SEQ ID NO: 3803483 - RNA, 11 nt, Salmonella typhimurium LT2
auugguugcuu

SEQ ID NO: 3803484 - RNA, 23 nt, Salmonella typhimurium LT2
auugguugcuucguccagaucca

SEQ ID NO: 3803485 - RNA, 13 nt, Salmonella typhimurium LT2
auuguagguuuuc

SEQ ID NO: 3803486 - RNA, 20 nt, Salmonella typhimurium LT2
auuucuguauaauuauuugu

SEQ ID NO: 3803487 - RNA, 13 nt, Salmonella typhimurium LT2
auuucuuaccaaa

SEQ ID NO: 3803488 - RNA, 14 nt, Salmonella typhimurium LT2
auuucuucauccca

SEQ ID NO: 3803489 - RNA, 17 nt, Salmonella typhimurium LT2
auuucuugcaauagcgc

SEQ ID NO: 3803490 - RNA, 20 nt, Salmonella typhimurium LT2
auuucuugcaucaggcagug

SEQ ID NO: 3803491 - RNA, 13 nt, Salmonella typhimurium LT2
auuucuugcgcca

SEQ ID NO: 3803492 - RNA, 14 nt, Salmonella typhimurium LT2
auuucuuuaugggc

SEQ ID NO: 3803493 - RNA, 16 nt, Salmonella typhimurium LT2
auuucuuuauucuggc

SEQ ID NO: 3803494 - RNA, 23 nt, Salmonella typhimurium LT2
auuugaaggacugauacagccaa

SEQ ID NO: 3803495 - RNA, 17 nt, Salmonella typhimurium LT2
auuugaugccuggcagu

SEQ ID NO: 3803496 - RNA, 13 nt, Salmonella typhimurium LT2
auuugauggcuaa

SEQ ID NO: 3803497 - RNA, 20 nt, Salmonella typhimurium LT2
auuugcaauucgaggagcgc

SEQ ID NO: 3803498 - RNA, 16 nt, Salmonella typhimurium LT2
auuugcagaaagauuu

SEQ ID NO: 3803499 - RNA, 12 nt, Salmonella typhimurium LT2
auuugcauuuuc

SEQ ID NO: 3803500 - RNA, 13 nt, Salmonella typhimurium LT2
auuugcccagcac

SEQ ID NO: 3803501 - RNA, 14 nt, Salmonella typhimurium LT2
auuugcccagccga

SEQ ID NO: 3803502 - RNA, 23 nt, Salmonella typhimurium LT2
auuugccugaacgguuuauaccg

SEQ ID NO: 3803503 - RNA, 16 nt, Salmonella typhimurium LT2
auuugccugccgcagc

SEQ ID NO: 3803504 - RNA, 18 nt, Salmonella typhimurium LT2
auuugcgcuuucagcgca

SEQ ID NO: 3803505 - RNA, 13 nt, Salmonella typhimurium LT2
auuugcggcgucg

SEQ ID NO: 3803506 - RNA, 22 nt, Salmonella typhimurium LT2
auuugcggcgucgccugguggc

SEQ ID NO: 3803507 - RNA, 15 nt, Salmonella typhimurium LT2
auuugcugcauuucu

SEQ ID NO: 3803508 - RNA, 15 nt, Salmonella typhimurium LT2
auuugcuguuaaaac

SEQ ID NO: 3803509 - RNA, 23 nt, Salmonella typhimurium LT2
auuugguuagggaucaucuucac

SEQ ID NO: 3803510 - RNA, 19 nt, Salmonella typhimurium LT2
auuuguacaaaaaauguga

SEQ ID NO: 3803511 - RNA, 19 nt, Salmonella typhimurium LT2
auuuguagcggcaacagca

SEQ ID NO: 3803512 - RNA, 17 nt, Salmonella typhimurium LT2
auuuguagcugcgccug

SEQ ID NO: 3803513 - RNA, 20 nt, Salmonella typhimurium LT2
auuuguauuaucccggccgc

SEQ ID NO: 3803514 - RNA, 21 nt, Salmonella typhimurium LT2
auuugucccuguuccaucucu

SEQ ID NO: 3803515 - RNA, 19 nt, Salmonella typhimurium LT2
auuugugauugcagauaau

SEQ ID NO: 3803516 - RNA, 14 nt, Salmonella typhimurium LT2
auuuguuaguccgc

SEQ ID NO: 3803517 - RNA, 14 nt, Salmonella typhimurium LT2
auuuguuccuggca

SEQ ID NO: 3803518 - RNA, 23 nt, Salmonella typhimurium LT2
auuuguucggcgcgauagcgaua

SEQ ID NO: 3803519 - RNA, 13 nt, Salmonella typhimurium LT2
auuuguuucaucg

SEQ ID NO: 3803520 - RNA, 13 nt, Salmonella typhimurium LT2
auuuuaacaucac

SEQ ID NO: 3803521 - RNA, 21 nt, Salmonella typhimurium LT2
auuuuacccgcgcaucccaca

SEQ ID NO: 3803522 - RNA, 13 nt, Salmonella typhimurium LT2
auuuuacuccaca

SEQ ID NO: 3803523 - RNA, 20 nt, Salmonella typhimurium LT2
auuuuacuccacauauugag

SEQ ID NO: 3803524 - RNA, 21 nt, Salmonella typhimurium LT2
auuuuacugccguauccaggg

SEQ ID NO: 3803525 - RNA, 14 nt, Salmonella typhimurium LT2
auuuuacuuucauu

SEQ ID NO: 3803526 - RNA, 18 nt, Salmonella typhimurium LT2
auuuuaggcacaucaaua

SEQ ID NO: 3803527 - RNA, 11 nt, Salmonella typhimurium LT2
auuuuaucacu

SEQ ID NO: 3803528 - RNA, 19 nt, Salmonella typhimurium LT2
auuuuauccaacagcgcaa

SEQ ID NO: 3803529 - RNA, 22 nt, Salmonella typhimurium LT2
auuuuaucgacacuauuuuuca

SEQ ID NO: 3803530 - RNA, 16 nt, Salmonella typhimurium LT2
auuuuaucuccauauc

SEQ ID NO: 3803531 - RNA, 13 nt, Salmonella typhimurium LT2
auuuucaccucca

SEQ ID NO: 3803532 - RNA, 14 nt, Salmonella typhimurium LT2
auuuucaccuggau

SEQ ID NO: 3803533 - RNA, 21 nt, Salmonella typhimurium LT2
auuuucagccauuuuuuauug

SEQ ID NO: 3803534 - RNA, 18 nt, Salmonella typhimurium LT2
auuuucauacuauuuccu

SEQ ID NO: 3803535 - RNA, 16 nt, Salmonella typhimurium LT2
auuuuccaggccgcca

SEQ ID NO: 3803536 - RNA, 16 nt, Salmonella typhimurium LT2
auuuuccguuaagcug

SEQ ID NO: 3803537 - RNA, 22 nt, Salmonella typhimurium LT2
auuuucgcuuuaauggcuuuca

SEQ ID NO: 3803538 - RNA, 15 nt, Salmonella typhimurium LT2
auuuucggcagcgcg

SEQ ID NO: 3803539 - RNA, 22 nt, Salmonella typhimurium LT2
auuuucggcugacgcgcuauca

SEQ ID NO: 3803540 - RNA, 21 nt, Salmonella typhimurium LT2
auuuucgucguuucuacaaua

SEQ ID NO: 3803541 - RNA, 18 nt, Salmonella typhimurium LT2
auuuucuaugugcgccag

SEQ ID NO: 3803542 - RNA, 14 nt, Salmonella typhimurium LT2
auuuucuucaucaa

SEQ ID NO: 3803543 - RNA, 13 nt, Salmonella typhimurium LT2
auuuugcauaaau

SEQ ID NO: 3803544 - RNA, 12 nt, Salmonella typhimurium LT2
auuuugcgccua

SEQ ID NO: 3803545 - RNA, 15 nt, Salmonella typhimurium LT2
auuuugcgguuuuaa

SEQ ID NO: 3803546 - RNA, 17 nt, Salmonella typhimurium LT2
auuuugcgguuuuaauu

SEQ ID NO: 3803547 - RNA, 13 nt, Salmonella typhimurium LT2
auuuugcuuuuuc

SEQ ID NO: 3803548 - RNA, 16 nt, Salmonella typhimurium LT2
auuuuggggaaaauac

SEQ ID NO: 3803549 - RNA, 17 nt, Salmonella typhimurium LT2
auuuuggggaaaauacc

SEQ ID NO: 3803550 - RNA, 23 nt, Salmonella typhimurium LT2
auuuuguaggccuaaaaauagcu

SEQ ID NO: 3803551 - RNA, 18 nt, Salmonella typhimurium LT2
auuuuguagguuccgaca

SEQ ID NO: 3803552 - RNA, 21 nt, Salmonella typhimurium LT2
auuuuguaguuguuuuaugug

SEQ ID NO: 3803553 - RNA, 24 nt, Salmonella typhimurium LT2
auuuugucaggccgcgugggacgu

SEQ ID NO: 3803554 - RNA, 13 nt, Salmonella typhimurium LT2
auuuuuaaaccaa

SEQ ID NO: 3803555 - RNA, 14 nt, Salmonella typhimurium LT2
auuuuuaaaccaac

SEQ ID NO: 3803556 - RNA, 22 nt, Salmonella typhimurium LT2
auuuuuaaugauguagucauca

SEQ ID NO: 3803557 - RNA, 20 nt, Salmonella typhimurium LT2
auuuuuaauguccagcagug

SEQ ID NO: 3803558 - RNA, 11 nt, Salmonella typhimurium LT2
auuuuuaggcg

SEQ ID NO: 3803559 - RNA, 13 nt, Salmonella typhimurium LT2
auuuuuauaaaau

SEQ ID NO: 3803560 - RNA, 13 nt, Salmonella typhimurium LT2
auuuuuauuaaaa

SEQ ID NO: 3803561 - RNA, 13 nt, Salmonella typhimurium LT2
auuuuucacaugc

SEQ ID NO: 3803562 - RNA, 18 nt, Salmonella typhimurium LT2
auuuuucagauagcgaac

SEQ ID NO: 3803563 - RNA, 12 nt, Salmonella typhimurium LT2
auuuuucagggu

SEQ ID NO: 3803564 - RNA, 16 nt, Salmonella typhimurium LT2
auuuuuccagccauuu

SEQ ID NO: 3803565 - RNA, 16 nt, Salmonella typhimurium LT2
auuuuucccaucaauc

SEQ ID NO: 3803566 - RNA, 15 nt, Salmonella typhimurium LT2
auuuuucccuggccg

SEQ ID NO: 3803567 - RNA, 18 nt, Salmonella typhimurium LT2
auuuuucccuggccggaa

SEQ ID NO: 3803568 - RNA, 20 nt, Salmonella typhimurium LT2
auuuuuccggcgucaaaaau

SEQ ID NO: 3803569 - RNA, 10 nt, Salmonella typhimurium LT2
auuuuuccuu

SEQ ID NO: 3803570 - RNA, 18 nt, Salmonella typhimurium LT2
auuuuucgccagguacau

SEQ ID NO: 3803571 - RNA, 14 nt, Salmonella typhimurium LT2
auuuuucugguaaa

SEQ ID NO: 3803572 - RNA, 16 nt, Salmonella typhimurium LT2
auuuuugaucucuuua

SEQ ID NO: 3803573 - RNA, 21 nt, Salmonella typhimurium LT2
auuuuuugacaacaaaaagau

SEQ ID NO: 3803574 - RNA, 14 nt, Salmonella typhimurium LT2
auuuuuuguaucca

SEQ ID NO: 3803575 - RNA, 19 nt, Salmonella typhimurium LT2
auuuuuuuaaugccggcgc

SEQ ID NO: 3803576 - RNA, 13 nt, Salmonella typhimurium LT2
auuuuuuuacauu

SEQ ID NO: 3803577 - RNA, 20 nt, Salmonella typhimurium LT2
auuuuuuuauauucgcucau

SEQ ID NO: 3803578 - RNA, 16 nt, Salmonella typhimurium LT2
auuuuuuuaucuucca

SEQ ID NO: 3803579 - RNA, 15 nt, Salmonella typhimurium LT2
auuuuuuucagccuu

SEQ ID NO: 3803580 - RNA, 12 nt, Salmonella typhimurium LT2
auuuuuuugccu

SEQ ID NO: 3803581 - RNA, 15 nt, Salmonella typhimurium LT2
auuuuuuuugcauga

SEQ ID NO: 3803582 - RNA, 19 nt, Salmonella typhimurium LT2
auuuuuuuugccugaaacg

SEQ ID NO: 3803583 - RNA, 13 nt, Salmonella typhimurium LT2
caaaaaaaaccag

SEQ ID NO: 3803584 - RNA, 16 nt, Salmonella typhimurium LT2
caaaaaaagaaaaaua

SEQ ID NO: 3803585 - RNA, 19 nt, Salmonella typhimurium LT2
caaaaaacgguauaaaaaa

SEQ ID NO: 3803586 - RNA, 23 nt, Salmonella typhimurium LT2
caaaaaagacagcaucuaauuaa

SEQ ID NO: 3803587 - RNA, 13 nt, Salmonella typhimurium LT2
caaaaaagagaag

SEQ ID NO: 3803588 - RNA, 11 nt, Salmonella typhimurium LT2
caaaaaagccc

SEQ ID NO: 3803589 - RNA, 13 nt, Salmonella typhimurium LT2
caaaaaagcugcg

SEQ ID NO: 3803590 - RNA, 16 nt, Salmonella typhimurium LT2
caaaaaaucagcaauc

SEQ ID NO: 3803591 - RNA, 20 nt, Salmonella typhimurium LT2
caaaccgauaaucaccagcc

SEQ ID NO: 3803592 - RNA, 22 nt, Salmonella typhimurium LT2
caaaccgauaaucaccagcccg

SEQ ID NO: 3803593 - RNA, 18 nt, Salmonella typhimurium LT2
caaaccgccgauggccca

SEQ ID NO: 3803594 - RNA, 21 nt, Salmonella typhimurium LT2
caaaccgguaaucccuucacg

SEQ ID NO: 3803595 - RNA, 19 nt, Salmonella typhimurium LT2
caaaccugagcauauaaau

SEQ ID NO: 3803596 - RNA, 15 nt, Salmonella typhimurium LT2
caaacgacacauaaa

SEQ ID NO: 3803597 - RNA, 15 nt, Salmonella typhimurium LT2
caaacgauaaaagcu

SEQ ID NO: 3803598 - RNA, 18 nt, Salmonella typhimurium LT2
caaacgauuucaucagcg

SEQ ID NO: 3803599 - RNA, 11 nt, Salmonella typhimurium LT2
caaacgccagc

SEQ ID NO: 3803600 - RNA, 23 nt, Salmonella typhimurium LT2
caaacgccggaugacacaucacc

SEQ ID NO: 3803601 - RNA, 18 nt, Salmonella typhimurium LT2
caaacgccugcaucaaca

SEQ ID NO: 3803602 - RNA, 19 nt, Salmonella typhimurium LT2
caaacgccugcaucaacag

SEQ ID NO: 3803603 - RNA, 15 nt, Salmonella typhimurium LT2
caaacgccugcuccg

SEQ ID NO: 3803604 - RNA, 16 nt, Salmonella typhimurium LT2
caaacggaauagcgcc

SEQ ID NO: 3803605 - RNA, 17 nt, Salmonella typhimurium LT2
caaacgucguaaaaccu

SEQ ID NO: 3803606 - RNA, 16 nt, Salmonella typhimurium LT2
caaacuauuuuuagcc

SEQ ID NO: 3803607 - RNA, 21 nt, Salmonella typhimurium LT2
caaacucaggagcuaaauauc

SEQ ID NO: 3803608 - RNA, 21 nt, Salmonella typhimurium LT2
caaacuccagcacguccugga

SEQ ID NO: 3803609 - RNA, 22 nt, Salmonella typhimurium LT2
caaacuccgcgcuggcaauaaa

SEQ ID NO: 3803610 - RNA, 19 nt, Salmonella typhimurium LT2
caaacugaaaaucaaauaa

SEQ ID NO: 3803611 - RNA, 23 nt, Salmonella typhimurium LT2
caaacugaacugcgcguauccgg

SEQ ID NO: 3803612 - RNA, 22 nt, Salmonella typhimurium LT2
caaacugauacuggauaaccgc

SEQ ID NO: 3803613 - RNA, 22 nt, Salmonella typhimurium LT2
caaacugcgcuagccgccgugu

SEQ ID NO: 3803614 - RNA, 15 nt, Salmonella typhimurium LT2
caaacuggccacagc

SEQ ID NO: 3803615 - RNA, 16 nt, Salmonella typhimurium LT2
caaacuggccacagca

SEQ ID NO: 3803616 - RNA, 20 nt, Salmonella typhimurium LT2
caaacuguguacgccaagcu

SEQ ID NO: 3803617 - RNA, 18 nt, Salmonella typhimurium LT2
caaacuucaucgccacgc

SEQ ID NO: 3803618 - RNA, 13 nt, Salmonella typhimurium LT2
caaacuuccacac

SEQ ID NO: 3803619 - RNA, 20 nt, Salmonella typhimurium LT2
caaagaaauugggcuuccac

SEQ ID NO: 3803620 - RNA, 16 nt, Salmonella typhimurium LT2
caaagaaggcauuuca

SEQ ID NO: 3803621 - RNA, 20 nt, Salmonella typhimurium LT2
caaagagugccagaaacauc

SEQ ID NO: 3803622 - RNA, 15 nt, Salmonella typhimurium LT2
caaagauaaacgaca

SEQ ID NO: 3803623 - RNA, 17 nt, Salmonella typhimurium LT2
caaagauaaucugaaua

SEQ ID NO: 3803624 - RNA, 15 nt, Salmonella typhimurium LT2
caaagaucucgguga

SEQ ID NO: 3803625 - RNA, 10 nt, Salmonella typhimurium LT2
caaagauuau

SEQ ID NO: 3803626 - RNA, 13 nt, Salmonella typhimurium LT2
caaagcaaaaaau

SEQ ID NO: 3803627 - RNA, 14 nt, Salmonella typhimurium LT2
caaagcaaucgcca

SEQ ID NO: 3803628 - RNA, 18 nt, Salmonella typhimurium LT2
caaagcaccauucuucaa

SEQ ID NO: 3803629 - RNA, 19 nt, Salmonella typhimurium LT2
caaagcaccauucuucaac

SEQ ID NO: 3803630 - RNA, 14 nt, Salmonella typhimurium LT2
caaagcccaccgcg

SEQ ID NO: 3803631 - RNA, 15 nt, Salmonella typhimurium LT2
caaagcccacgcccu

SEQ ID NO: 3803632 - RNA, 16 nt, Salmonella typhimurium LT2
caaagcccaucagcgc

SEQ ID NO: 3803633 - RNA, 20 nt, Salmonella typhimurium LT2
caaagccgccauccggccug

SEQ ID NO: 3803634 - RNA, 14 nt, Salmonella typhimurium LT2
caaagccggcgcca

SEQ ID NO: 3803635 - RNA, 17 nt, Salmonella typhimurium LT2
caaagccugcuggaaag

SEQ ID NO: 3803636 - RNA, 19 nt, Salmonella typhimurium LT2
caaagcgccauccggcaau

SEQ ID NO: 3803637 - RNA, 22 nt, Salmonella typhimurium LT2
caaagcgggcgacgauggggaa

SEQ ID NO: 3803638 - RNA, 23 nt, Salmonella typhimurium LT2
caaagcgggcgacgauggggaaa

SEQ ID NO: 3803639 - RNA, 16 nt, Salmonella typhimurium LT2
caaagcguaccgucug

SEQ ID NO: 3803640 - RNA, 24 nt, Salmonella typhimurium LT2
caaagcgucauguaaugcuugcug

SEQ ID NO: 3803641 - RNA, 16 nt, Salmonella typhimurium LT2
caaagcucaccugcuc

SEQ ID NO: 3803642 - RNA, 19 nt, Salmonella typhimurium LT2
caaaggaucauuggccaga

SEQ ID NO: 3803643 - RNA, 16 nt, Salmonella typhimurium LT2
caaaggcguaaaaagg

SEQ ID NO: 3803644 - RNA, 16 nt, Salmonella typhimurium LT2
caaagggagcagacug

SEQ ID NO: 3803645 - RNA, 22 nt, Salmonella typhimurium LT2
caaagguaaacgcgaccagcgc

SEQ ID NO: 3803646 - RNA, 16 nt, Salmonella typhimurium LT2
caaaguuaaucagcgc

SEQ ID NO: 3803647 - RNA, 19 nt, Salmonella typhimurium LT2
caaauaaaagccgccaugu

SEQ ID NO: 3803648 - RNA, 22 nt, Salmonella typhimurium LT2
caaauaaagcggucuuucaaca

SEQ ID NO: 3803649 - RNA, 17 nt, Salmonella typhimurium LT2
caaauaaauccaugaga

SEQ ID NO: 3803650 - RNA, 21 nt, Salmonella typhimurium LT2
caaauaaauccaugagaagaa

SEQ ID NO: 3803651 - RNA, 19 nt, Salmonella typhimurium LT2
caaauacagcaauaugacu

SEQ ID NO: 3803652 - RNA, 18 nt, Salmonella typhimurium LT2
caaauaccggacagacuu

SEQ ID NO: 3803653 - RNA, 17 nt, Salmonella typhimurium LT2
caaauacgcgcgccgcc

SEQ ID NO: 3803654 - RNA, 22 nt, Salmonella typhimurium LT2
caaauacguuguacuucauauu

SEQ ID NO: 3803655 - RNA, 19 nt, Salmonella typhimurium LT2
caaauagcguguguuuucc

SEQ ID NO: 3803656 - RNA, 19 nt, Salmonella typhimurium LT2
caaauagggcgcuugcgca

SEQ ID NO: 3803657 - RNA, 18 nt, Salmonella typhimurium LT2
caaauagggguucauaag

SEQ ID NO: 3803658 - RNA, 22 nt, Salmonella typhimurium LT2
caaauagguuuuaugcaucgcg

SEQ ID NO: 3803659 - RNA, 17 nt, Salmonella typhimurium LT2
caaauaguccagcagcc

SEQ ID NO: 3803660 - RNA, 22 nt, Salmonella typhimurium LT2
caaauauccuaccacgccgcua

SEQ ID NO: 3803661 - RNA, 17 nt, Salmonella typhimurium LT2
caaauaugauaugugua

SEQ ID NO: 3803662 - RNA, 14 nt, Salmonella typhimurium LT2
caaaucaaaaggca

SEQ ID NO: 3803663 - RNA, 13 nt, Salmonella typhimurium LT2
caaaucagcagga

SEQ ID NO: 3803664 - RNA, 13 nt, Salmonella typhimurium LT2
caaaucaucagca

SEQ ID NO: 3803665 - RNA, 18 nt, Salmonella typhimurium LT2
caaaucaucgccaugacc

SEQ ID NO: 3803666 - RNA, 17 nt, Salmonella typhimurium LT2
caaaucaugagcgcaau

SEQ ID NO: 3803667 - RNA, 19 nt, Salmonella typhimurium LT2
caaaucaugagcgcaauca

SEQ ID NO: 3803668 - RNA, 21 nt, Salmonella typhimurium LT2
caaauccacuggucgucugaa

SEQ ID NO: 3803669 - RNA, 15 nt, Salmonella typhimurium LT2
caaaucccggacaca

SEQ ID NO: 3803670 - RNA, 20 nt, Salmonella typhimurium LT2
caaaucccugaucggccaga

SEQ ID NO: 3803671 - RNA, 21 nt, Salmonella typhimurium LT2
caaauccgcauuucgcccucg

SEQ ID NO: 3803672 - RNA, 18 nt, Salmonella typhimurium LT2
caaaucgccaucagcgcg

SEQ ID NO: 3803673 - RNA, 20 nt, Salmonella typhimurium LT2
caaaucgccaucagcgcgaa

SEQ ID NO: 3803674 - RNA, 20 nt, Salmonella typhimurium LT2
caaaucgcccaucacaugua

SEQ ID NO: 3803675 - RNA, 22 nt, Salmonella typhimurium LT2
caaaucgucagccgccaguuca

SEQ ID NO: 3803676 - RNA, 20 nt, Salmonella typhimurium LT2
caaaucugccgggagcagau

SEQ ID NO: 3803677 - RNA, 22 nt, Salmonella typhimurium LT2
caaaucuggugauaaagcagac

SEQ ID NO: 3803678 - RNA, 19 nt, Salmonella typhimurium LT2
caaaucuguucuguccaug

SEQ ID NO: 3803679 - RNA, 15 nt, Salmonella typhimurium LT2
caaaugaacacaaaa

SEQ ID NO: 3803680 - RNA, 18 nt, Salmonella typhimurium LT2
caaaugaacacaaaaaac

SEQ ID NO: 3803681 - RNA, 15 nt, Salmonella typhimurium LT2
caaaugaccucaaga

SEQ ID NO: 3803682 - RNA, 15 nt, Salmonella typhimurium LT2
caaaugagaauagac

SEQ ID NO: 3803683 - RNA, 16 nt, Salmonella typhimurium LT2
caaaugagaauagacu

SEQ ID NO: 3803684 - RNA, 18 nt, Salmonella typhimurium LT2
caaaugauaauaugcuca

SEQ ID NO: 3803685 - RNA, 18 nt, Salmonella typhimurium LT2
caaaugauuuuuauaaaa

SEQ ID NO: 3803686 - RNA, 21 nt, Salmonella typhimurium LT2
caaaugcagcggaauucccac

SEQ ID NO: 3803687 - RNA, 21 nt, Salmonella typhimurium LT2
caaaugcugugucggauacca

SEQ ID NO: 3803688 - RNA, 22 nt, Salmonella typhimurium LT2
caaauggcguacuaaauaggcg

SEQ ID NO: 3803689 - RNA, 22 nt, Salmonella typhimurium LT2
caaaugggccggauagcgcugu

SEQ ID NO: 3803690 - RNA, 15 nt, Salmonella typhimurium LT2
caaauguuguuugaa

SEQ ID NO: 3803691 - RNA, 16 nt, Salmonella typhimurium LT2
caaauguuguuugaaa

SEQ ID NO: 3803692 - RNA, 17 nt, Salmonella typhimurium LT2
caaauuaucuguugaua

SEQ ID NO: 3803693 - RNA, 18 nt, Salmonella typhimurium LT2
caaauuaugauucaaucg

SEQ ID NO: 3803694 - RNA, 17 nt, Salmonella typhimurium LT2
caacgcucagaccgauc

SEQ ID NO: 3803695 - RNA, 13 nt, Salmonella typhimurium LT2
caacgcuccagca

SEQ ID NO: 3803696 - RNA, 14 nt, Salmonella typhimurium LT2
caacgcuccagcag

SEQ ID NO: 3803697 - RNA, 21 nt, Salmonella typhimurium LT2
caacgcugaauaucgucagua

SEQ ID NO: 3803698 - RNA, 15 nt, Salmonella typhimurium LT2
caacggcacacaggc

SEQ ID NO: 3803699 - RNA, 16 nt, Salmonella typhimurium LT2
caacggcgccauguug

SEQ ID NO: 3803700 - RNA, 18 nt, Salmonella typhimurium LT2
caacggcgccgugagcug

SEQ ID NO: 3803701 - RNA, 13 nt, Salmonella typhimurium LT2
caacggcgcggcg

SEQ ID NO: 3803702 - RNA, 23 nt, Salmonella typhimurium LT2
caacgggaaaaaauuacugccug

SEQ ID NO: 3803703 - RNA, 19 nt, Salmonella typhimurium LT2
caacgguaaaauggcucug

SEQ ID NO: 3803704 - RNA, 15 nt, Salmonella typhimurium LT2
caacgguacgacgcc

SEQ ID NO: 3803705 - RNA, 21 nt, Salmonella typhimurium LT2
caacggucuugccagcgagaa

SEQ ID NO: 3803706 - RNA, 22 nt, Salmonella typhimurium LT2
caacguaaugaucaugcugcac

SEQ ID NO: 3803707 - RNA, 19 nt, Salmonella typhimurium LT2
caacguaccggcaaccggu

SEQ ID NO: 3803708 - RNA, 23 nt, Salmonella typhimurium LT2
caacguaggccggguaaggcgaa

SEQ ID NO: 3803709 - RNA, 15 nt, Salmonella typhimurium LT2
caacgucaagacgcu

SEQ ID NO: 3803710 - RNA, 17 nt, Salmonella typhimurium LT2
caacgucaucaugaaaa

SEQ ID NO: 3803711 - RNA, 20 nt, Salmonella typhimurium LT2
caacgucauuaaaaccgcac

SEQ ID NO: 3803712 - RNA, 18 nt, Salmonella typhimurium LT2
caacguccaguucguucu

SEQ ID NO: 3803713 - RNA, 21 nt, Salmonella typhimurium LT2
caacgucgacagacgcaucuu

SEQ ID NO: 3803714 - RNA, 12 nt, Salmonella typhimurium LT2
caacgucgcgcc

SEQ ID NO: 3803715 - RNA, 17 nt, Salmonella typhimurium LT2
caacgucgcgcccugca

SEQ ID NO: 3803716 - RNA, 21 nt, Salmonella typhimurium LT2
caacguuguguccaggguguu

SEQ ID NO: 3803717 - RNA, 23 nt, Salmonella typhimurium LT2
caacguuuccggaaugagaugca

SEQ ID NO: 3803718 - RNA, 20 nt, Salmonella typhimurium LT2
caacguuucuuucaucagau

SEQ ID NO: 3803719 - RNA, 22 nt, Salmonella typhimurium LT2
caacguuucuuucaucagauca

SEQ ID NO: 3803720 - RNA, 13 nt, Salmonella typhimurium LT2
caacuccgccggc

SEQ ID NO: 3803721 - RNA, 17 nt, Salmonella typhimurium LT2
caacucuauuaaaauaa

SEQ ID NO: 3803722 - RNA, 19 nt, Salmonella typhimurium LT2
caacucuauuaaaauaaau

SEQ ID NO: 3803723 - RNA, 21 nt, Salmonella typhimurium LT2
caacucuauuaaaauaaauua

SEQ ID NO: 3803724 - RNA, 19 nt, Salmonella typhimurium LT2
caacucugugagcgucaua

SEQ ID NO: 3803725 - RNA, 21 nt, Salmonella typhimurium LT2
caacucuuuacccagcgggug

SEQ ID NO: 3803726 - RNA, 11 nt, Salmonella typhimurium LT2
caacugagcga

SEQ ID NO: 3803727 - RNA, 19 nt, Salmonella typhimurium LT2
caacugauuaaucugccga

SEQ ID NO: 3803728 - RNA, 17 nt, Salmonella typhimurium LT2
caacugccggggaagua

SEQ ID NO: 3803729 - RNA, 15 nt, Salmonella typhimurium LT2
caacugcuaguggau

SEQ ID NO: 3803730 - RNA, 16 nt, Salmonella typhimurium LT2
caacuggaaaagcgac

SEQ ID NO: 3803731 - RNA, 15 nt, Salmonella typhimurium LT2
caacuggcaauagcc

SEQ ID NO: 3803732 - RNA, 17 nt, Salmonella typhimurium LT2
caacuguaccugaucca

SEQ ID NO: 3803733 - RNA, 15 nt, Salmonella typhimurium LT2
caacuguauuuugaa

SEQ ID NO: 3803734 - RNA, 17 nt, Salmonella typhimurium LT2
caacuguucuucgcuuu

SEQ ID NO: 3803735 - RNA, 22 nt, Salmonella typhimurium LT2
caacuguuuuaccaaaucaaua

SEQ ID NO: 3803736 - RNA, 19 nt, Salmonella typhimurium LT2
caacuguuuuucacuaauc

SEQ ID NO: 3803737 - RNA, 10 nt, Salmonella typhimurium LT2
caacuucaug

SEQ ID NO: 3803738 - RNA, 23 nt, Salmonella typhimurium LT2
caacuuccagaacaucuaccgca

SEQ ID NO: 3803739 - RNA, 11 nt, Salmonella typhimurium LT2
caacuucuuca

SEQ ID NO: 3803740 - RNA, 19 nt, Salmonella typhimurium LT2
caacuugucuggagucaag

SEQ ID NO: 3803741 - RNA, 20 nt, Salmonella typhimurium LT2
caacuuuuacuuucaagaca

SEQ ID NO: 3803742 - RNA, 18 nt, Salmonella typhimurium LT2
caagaaaaucggccagcg

SEQ ID NO: 3803743 - RNA, 17 nt, Salmonella typhimurium LT2
caagaacgguuuauccc

SEQ ID NO: 3803744 - RNA, 21 nt, Salmonella typhimurium LT2
caagaacgguuuauccccgcu

SEQ ID NO: 3803745 - RNA, 23 nt, Salmonella typhimurium LT2
caagaagggauuaugcagacgcu

SEQ ID NO: 3803746 - RNA, 18 nt, Salmonella typhimurium LT2
caagaaguuccaccgucu

SEQ ID NO: 3803747 - RNA, 12 nt, Salmonella typhimurium LT2
caagaaucaaua

SEQ ID NO: 3803748 - RNA, 19 nt, Salmonella typhimurium LT2
caagaauuacaucaauaaa

SEQ ID NO: 3803749 - RNA, 16 nt, Salmonella typhimurium LT2
caagacacgcuuccag

SEQ ID NO: 3803750 - RNA, 17 nt, Salmonella typhimurium LT2
caagacccgaaccugcg

SEQ ID NO: 3803751 - RNA, 17 nt, Salmonella typhimurium LT2
caagacccgacaguaaa

SEQ ID NO: 3803752 - RNA, 23 nt, Salmonella typhimurium LT2
caagacccgacaguaaaacccaa

SEQ ID NO: 3803753 - RNA, 17 nt, Salmonella typhimurium LT2
caagaccgccuaacagc

SEQ ID NO: 3803754 - RNA, 18 nt, Salmonella typhimurium LT2
caagaccgccuaacagcg

SEQ ID NO: 3803755 - RNA, 21 nt, Salmonella typhimurium LT2
caagacgguuguuuuucagau

SEQ ID NO: 3803756 - RNA, 21 nt, Salmonella typhimurium LT2
caagagagcaacauaccgcag

SEQ ID NO: 3803757 - RNA, 15 nt, Salmonella typhimurium LT2
caagagauaucccau

SEQ ID NO: 3803758 - RNA, 20 nt, Salmonella typhimurium LT2
caagagauaucccaucgacu

SEQ ID NO: 3803759 - RNA, 14 nt, Salmonella typhimurium LT2
caagagcagcaacc

SEQ ID NO: 3803760 - RNA, 15 nt, Salmonella typhimurium LT2
caagagcagcaaccc

SEQ ID NO: 3803761 - RNA, 24 nt, Salmonella typhimurium LT2
caagagguaaugcccgauggcgcu

SEQ ID NO: 3803762 - RNA, 15 nt, Salmonella typhimurium LT2
caagagugaacacgu

SEQ ID NO: 3803763 - RNA, 19 nt, Salmonella typhimurium LT2
caagauaagaaguaaacag

SEQ ID NO: 3803764 - RNA, 18 nt, Salmonella typhimurium LT2
caagaucgcgcagcaggc

SEQ ID NO: 3803765 - RNA, 19 nt, Salmonella typhimurium LT2
caagcaacuguagaaugcu

SEQ ID NO: 3803766 - RNA, 17 nt, Salmonella typhimurium LT2
caagcaauaccagaaau

SEQ ID NO: 3803767 - RNA, 13 nt, Salmonella typhimurium LT2
caagcacaaaaag

SEQ ID NO: 3803768 - RNA, 21 nt, Salmonella typhimurium LT2
caagcaggcuaugcucccccc

SEQ ID NO: 3803769 - RNA, 23 nt, Salmonella typhimurium LT2
caagcaguaugcccccuccagcc

SEQ ID NO: 3803770 - RNA, 15 nt, Salmonella typhimurium LT2
caagcaguuccagca

SEQ ID NO: 3803771 - RNA, 12 nt, Salmonella typhimurium LT2
caagcgccagua

SEQ ID NO: 3803772 - RNA, 15 nt, Salmonella typhimurium LT2
caagcgccaguaaug

SEQ ID NO: 3803773 - RNA, 17 nt, Salmonella typhimurium LT2
caagcgccuguucaaca

SEQ ID NO: 3803774 - RNA, 17 nt, Salmonella typhimurium LT2
caagcgcggacagcaga

SEQ ID NO: 3803775 - RNA, 18 nt, Salmonella typhimurium LT2
caagcgcggacagcagaa

SEQ ID NO: 3803776 - RNA, 14 nt, Salmonella typhimurium LT2
caagcgcggcagca

SEQ ID NO: 3803777 - RNA, 13 nt, Salmonella typhimurium LT2
caagcgucagcau

SEQ ID NO: 3803778 - RNA, 17 nt, Salmonella typhimurium LT2
caagcguugaauuccau

SEQ ID NO: 3803779 - RNA, 17 nt, Salmonella typhimurium LT2
caagcucauuucccaau

SEQ ID NO: 3803780 - RNA, 18 nt, Salmonella typhimurium LT2
caagcugacggauacgcu

SEQ ID NO: 3803781 - RNA, 14 nt, Salmonella typhimurium LT2
caagcuggaauacc

SEQ ID NO: 3803782 - RNA, 15 nt, Salmonella typhimurium LT2
caagcugguaaaugc

SEQ ID NO: 3803783 - RNA, 19 nt, Salmonella typhimurium LT2
caagcugugccauauucuc

SEQ ID NO: 3803784 - RNA, 22 nt, Salmonella typhimurium LT2
caagcugugccauauucucugg

SEQ ID NO: 3803785 - RNA, 11 nt, Salmonella typhimurium LT2
caagcuuuacc

SEQ ID NO: 3803786 - RNA, 21 nt, Salmonella typhimurium LT2
caaggcaucuaucagagggga

SEQ ID NO: 3803787 - RNA, 21 nt, Salmonella typhimurium LT2
caaggcauuggacgggaucuc

SEQ ID NO: 3803788 - RNA, 19 nt, Salmonella typhimurium LT2
caaggcgcagaaccauacu

SEQ ID NO: 3803789 - RNA, 18 nt, Salmonella typhimurium LT2
caaggcgcuauccuggua

SEQ ID NO: 3803790 - RNA, 23 nt, Salmonella typhimurium LT2
caaggcgucgcuggucugacgga

SEQ ID NO: 3803791 - RNA, 16 nt, Salmonella typhimurium LT2
caaggcucaauacgca

SEQ ID NO: 3803792 - RNA, 21 nt, Salmonella typhimurium LT2
caagggaaggcgcccgggaga

SEQ ID NO: 3803793 - RNA, 12 nt, Salmonella typhimurium LT2
caagggcaaggg

SEQ ID NO: 3803794 - RNA, 14 nt, Salmonella typhimurium LT2
caagggcaagggca

SEQ ID NO: 3803795 - RNA, 20 nt, Salmonella typhimurium LT2
caagggucuuaacccauggc

SEQ ID NO: 3803796 - RNA, 22 nt, Salmonella typhimurium LT2
caagguggugcucuaaccaacu

SEQ ID NO: 3803797 - RNA, 16 nt, Salmonella typhimurium LT2
caaucgagaucagacu

SEQ ID NO: 3803798 - RNA, 12 nt, Salmonella typhimurium LT2
caaucgccaguu

SEQ ID NO: 3803799 - RNA, 16 nt, Salmonella typhimurium LT2
caaucgccccaggcca

SEQ ID NO: 3803800 - RNA, 13 nt, Salmonella typhimurium LT2
caaucgccugcaa

SEQ ID NO: 3803801 - RNA, 20 nt, Salmonella typhimurium LT2
caaucgccugccguaacgcc

SEQ ID NO: 3803802 - RNA, 16 nt, Salmonella typhimurium LT2
caaucgcgguaugcga

SEQ ID NO: 3803803 - RNA, 16 nt, Salmonella typhimurium LT2
caaucgcguuuuccag

SEQ ID NO: 3803804 - RNA, 20 nt, Salmonella typhimurium LT2
caaucgcuuccagcgccggu

SEQ ID NO: 3803805 - RNA, 12 nt, Salmonella typhimurium LT2
caaucggcgucu

SEQ ID NO: 3803806 - RNA, 21 nt, Salmonella typhimurium LT2
caaucggcgucuggagcgugc

SEQ ID NO: 3803807 - RNA, 17 nt, Salmonella typhimurium LT2
caaucgggaacagccac

SEQ ID NO: 3803808 - RNA, 13 nt, Salmonella typhimurium LT2
caaucguauggua

SEQ ID NO: 3803809 - RNA, 14 nt, Salmonella typhimurium LT2
caaucgucacuuca

SEQ ID NO: 3803810 - RNA, 13 nt, Salmonella typhimurium LT2
caaucuaagagcc

SEQ ID NO: 3803811 - RNA, 15 nt, Salmonella typhimurium LT2
caaucucaaugaugc

SEQ ID NO: 3803812 - RNA, 14 nt, Salmonella typhimurium LT2
caaucuccuccggc

SEQ ID NO: 3803813 - RNA, 20 nt, Salmonella typhimurium LT2
caaucucuggccaggcauug

SEQ ID NO: 3803814 - RNA, 20 nt, Salmonella typhimurium LT2
caaucucuuucggcgcgccc

SEQ ID NO: 3803815 - RNA, 14 nt, Salmonella typhimurium LT2
caaucuggugacga

SEQ ID NO: 3803816 - RNA, 21 nt, Salmonella typhimurium LT2
caaucuggugacgaugauaac

SEQ ID NO: 3803817 - RNA, 18 nt, Salmonella typhimurium LT2
caaucugguggcguuccu

SEQ ID NO: 3803818 - RNA, 20 nt, Salmonella typhimurium LT2
caaucugguggcguuccuua

SEQ ID NO: 3803819 - RNA, 16 nt, Salmonella typhimurium LT2
caaucuugauuacagu

SEQ ID NO: 3803820 - RNA, 18 nt, Salmonella typhimurium LT2
caaucuugauuacagucu

SEQ ID NO: 3803821 - RNA, 20 nt, Salmonella typhimurium LT2
caaugaagcauaaaaagacu

SEQ ID NO: 3803822 - RNA, 17 nt, Salmonella typhimurium LT2
caaugaccacaaauucu

SEQ ID NO: 3803823 - RNA, 18 nt, Salmonella typhimurium LT2
caaugaccgcaauuaaau

SEQ ID NO: 3803824 - RNA, 23 nt, Salmonella typhimurium LT2
caaugaccgcaauuaaaugaaug

SEQ ID NO: 3803825 - RNA, 19 nt, Salmonella typhimurium LT2
caaugagacaacggcgacc

SEQ ID NO: 3803826 - RNA, 18 nt, Salmonella typhimurium LT2
caaugauauagccuucaa

SEQ ID NO: 3803827 - RNA, 20 nt, Salmonella typhimurium LT2
caaugcaaacgacacauaaa

SEQ ID NO: 3803828 - RNA, 14 nt, Salmonella typhimurium LT2
caaugcaaagaaaa

SEQ ID NO: 3803829 - RNA, 15 nt, Salmonella typhimurium LT2
caaugcaaagaaaaa

SEQ ID NO: 3803830 - RNA, 15 nt, Salmonella typhimurium LT2
caaugccaccagcgc

SEQ ID NO: 3803831 - RNA, 15 nt, Salmonella typhimurium LT2
caaugcccacgccgu

SEQ ID NO: 3803832 - RNA, 14 nt, Salmonella typhimurium LT2
caaugcccuuaaau

SEQ ID NO: 3803833 - RNA, 15 nt, Salmonella typhimurium LT2
caaugcccuuaaauc

SEQ ID NO: 3803834 - RNA, 22 nt, Salmonella typhimurium LT2
caaugcccuuaaauccggccuc

SEQ ID NO: 3803835 - RNA, 19 nt, Salmonella typhimurium LT2
caaugccgccgagaacauu

SEQ ID NO: 3803836 - RNA, 20 nt, Salmonella typhimurium LT2
caaugccgcgagaaauacca

SEQ ID NO: 3803837 - RNA, 18 nt, Salmonella typhimurium LT2
caaugccuaacccuuuuc

SEQ ID NO: 3803838 - RNA, 18 nt, Salmonella typhimurium LT2
caaugcgacgcccaacca

SEQ ID NO: 3803839 - RNA, 18 nt, Salmonella typhimurium LT2
caaugcgcguaauuugcg

SEQ ID NO: 3803840 - RNA, 15 nt, Salmonella typhimurium LT2
caaugcgcuccagcu

SEQ ID NO: 3803841 - RNA, 14 nt, Salmonella typhimurium LT2
caaugcggaaacca

SEQ ID NO: 3803842 - RNA, 23 nt, Salmonella typhimurium LT2
caaugcggcgugcggcuguguuc

SEQ ID NO: 3803843 - RNA, 17 nt, Salmonella typhimurium LT2
caaugcugcuuugaugc

SEQ ID NO: 3803844 - RNA, 20 nt, Salmonella typhimurium LT2
caauggccccuggcugaaag

SEQ ID NO: 3803845 - RNA, 16 nt, Salmonella typhimurium LT2
caauggccgcagcgcc

SEQ ID NO: 3803846 - RNA, 20 nt, Salmonella typhimurium LT2
caauggcgacgaucagcgcc

SEQ ID NO: 3803847 - RNA, 18 nt, Salmonella typhimurium LT2
caauggcgucaaacagcu

SEQ ID NO: 3803848 - RNA, 19 nt, Salmonella typhimurium LT2
caauggcuucaaugaucca

SEQ ID NO: 3803849 - RNA, 13 nt, Salmonella typhimurium LT2
caauggucagcgc

SEQ ID NO: 3803850 - RNA, 22 nt, Salmonella typhimurium LT2
caaugguguuuuccagcguaau

SEQ ID NO: 3803851 - RNA, 23 nt, Salmonella typhimurium LT2
caauguaaaacgguaugaaacau

SEQ ID NO: 3803852 - RNA, 22 nt, Salmonella typhimurium LT2
caauguaacaccuguaacguca

SEQ ID NO: 3803853 - RNA, 17 nt, Salmonella typhimurium LT2
caauguauuuuacgcag

SEQ ID NO: 3803854 - RNA, 22 nt, Salmonella typhimurium LT2
caaugucuuuauccgccagcca

SEQ ID NO: 3803855 - RNA, 20 nt, Salmonella typhimurium LT2
caaugugguuaucguauaau

SEQ ID NO: 3803856 - RNA, 19 nt, Salmonella typhimurium LT2
caauguuaacuacuuuaca

SEQ ID NO: 3803857 - RNA, 14 nt, Salmonella typhimurium LT2
caauuaacaaauaa

SEQ ID NO: 3803858 - RNA, 12 nt, Salmonella typhimurium LT2
caauuaacauuu

SEQ ID NO: 3803859 - RNA, 14 nt, Salmonella typhimurium LT2
caauuaauauauuu

SEQ ID NO: 3803860 - RNA, 13 nt, Salmonella typhimurium LT2
caauuaauuuaua

SEQ ID NO: 3803861 - RNA, 19 nt, Salmonella typhimurium LT2
caauuacggacagaaaaaa

SEQ ID NO: 3803862 - RNA, 20 nt, Salmonella typhimurium LT2
caauuacggacagaaaaaau

SEQ ID NO: 3803863 - RNA, 21 nt, Salmonella typhimurium LT2
caauuacggacagaaaaaaua

SEQ ID NO: 3803864 - RNA, 12 nt, Salmonella typhimurium LT2
caauuacguugg

SEQ ID NO: 3803865 - RNA, 17 nt, Salmonella typhimurium LT2
caauuagcgacgcauac

SEQ ID NO: 3803866 - RNA, 23 nt, Salmonella typhimurium LT2
caauuauauucguccuuuaucag

SEQ ID NO: 3803867 - RNA, 14 nt, Salmonella typhimurium LT2
caauucaaucacuu

SEQ ID NO: 3803868 - RNA, 13 nt, Salmonella typhimurium LT2
caauuccacaggc

SEQ ID NO: 3803869 - RNA, 14 nt, Salmonella typhimurium LT2
caauuccacaggcg

SEQ ID NO: 3803870 - RNA, 14 nt, Salmonella typhimurium LT2
caauucccagaccc

SEQ ID NO: 3803871 - RNA, 15 nt, Salmonella typhimurium LT2
caauuccgcgccgcc

SEQ ID NO: 3803872 - RNA, 14 nt, Salmonella typhimurium LT2
caauuccugccaga

SEQ ID NO: 3803873 - RNA, 20 nt, Salmonella typhimurium LT2
caauucggaucgauaaaagc

SEQ ID NO: 3803874 - RNA, 22 nt, Salmonella typhimurium LT2
caauugacgggcggcuuccguu

SEQ ID NO: 3803875 - RNA, 14 nt, Salmonella typhimurium LT2
caauugcaggcagc

SEQ ID NO: 3803876 - RNA, 20 nt, Salmonella typhimurium LT2
caauuuaaaauccggcugcc

SEQ ID NO: 3803877 - RNA, 14 nt, Salmonella typhimurium LT2
caauuuaucagaca

SEQ ID NO: 3803878 - RNA, 15 nt, Salmonella typhimurium LT2
caauuucccccacuu

SEQ ID NO: 3803879 - RNA, 20 nt, Salmonella typhimurium LT2
caauuuccccugcgaacagc

SEQ ID NO: 3803880 - RNA, 20 nt, Salmonella typhimurium LT2
caauuuccgcugaaauagcc

SEQ ID NO: 3803881 - RNA, 14 nt, Salmonella typhimurium LT2
caauuuccucugcc

SEQ ID NO: 3803882 - RNA, 21 nt, Salmonella typhimurium LT2
caauuucucgcucgcccauca

SEQ ID NO: 3803883 - RNA, 21 nt, Salmonella typhimurium LT2
caauuucuggccccugagcaa

SEQ ID NO: 3803884 - RNA, 17 nt, Salmonella typhimurium LT2
caauuugcccagcgcug

SEQ ID NO: 3803885 - RNA, 21 nt, Salmonella typhimurium LT2
caauuugguuagggaucaucu

SEQ ID NO: 3803886 - RNA, 22 nt, Salmonella typhimurium LT2
caauuugguuagggaucaucuu

SEQ ID NO: 3803887 - RNA, 20 nt, Salmonella typhimurium LT2
caauuuuaauuuaauaauaa

SEQ ID NO: 3803888 - RNA, 21 nt, Salmonella typhimurium LT2
caauuuuaauuuaauaauaaa

SEQ ID NO: 3803889 - RNA, 19 nt, Salmonella typhimurium LT2
caauuuugauaagagaaaa

SEQ ID NO: 3803890 - RNA, 17 nt, Salmonella typhimurium LT2
caauuuuguuaaauccc

SEQ ID NO: 3803891 - RNA, 14 nt, Salmonella typhimurium LT2
cacaaaauauuacg

SEQ ID NO: 3803892 - RNA, 15 nt, Salmonella typhimurium LT2
cacaaacaauuuacg

SEQ ID NO: 3803893 - RNA, 21 nt, Salmonella typhimurium LT2
cacaaacaauuuacgcagccc

SEQ ID NO: 3803894 - RNA, 23 nt, Salmonella typhimurium LT2
cacaaacaauuuacgcagcccca

SEQ ID NO: 3803895 - RNA, 16 nt, Salmonella typhimurium LT2
cacaaacuccagacga

SEQ ID NO: 3803896 - RNA, 20 nt, Salmonella typhimurium LT2
cacaaacuccguuauauuuc

SEQ ID NO: 3803897 - RNA, 12 nt, Salmonella typhimurium LT2
cacaacccaaag

SEQ ID NO: 3803898 - RNA, 13 nt, Salmonella typhimurium LT2
cacaacccaaagg

SEQ ID NO: 3803899 - RNA, 15 nt, Salmonella typhimurium LT2
cacaacccaaaggcc

SEQ ID NO: 3803900 - RNA, 16 nt, Salmonella typhimurium LT2
cacaacccaaaggcca

SEQ ID NO: 3803901 - RNA, 14 nt, Salmonella typhimurium LT2
caccaaucaucacg

SEQ ID NO: 3803902 - RNA, 15 nt, Salmonella typhimurium LT2
caccaaucaucacgu

SEQ ID NO: 3803903 - RNA, 13 nt, Salmonella typhimurium LT2
caccacaaaggcg

SEQ ID NO: 3803904 - RNA, 14 nt, Salmonella typhimurium LT2
caccacaaaggcgc

SEQ ID NO: 3803905 - RNA, 14 nt, Salmonella typhimurium LT2
caccacaaagucgc

SEQ ID NO: 3803906 - RNA, 23 nt, Salmonella typhimurium LT2
caccacacgcuuauccagccacu

SEQ ID NO: 3803907 - RNA, 19 nt, Salmonella typhimurium LT2
caccacagucaucgcgcca

SEQ ID NO: 3803908 - RNA, 18 nt, Salmonella typhimurium LT2
caccacaguugcgacugg

SEQ ID NO: 3803909 - RNA, 22 nt, Salmonella typhimurium LT2
caccacauuuagcgcaguacgc

SEQ ID NO: 3803910 - RNA, 14 nt, Salmonella typhimurium LT2
caccaccaaaccgc

SEQ ID NO: 3803911 - RNA, 12 nt, Salmonella typhimurium LT2
caccaccagccc

SEQ ID NO: 3803912 - RNA, 16 nt, Salmonella typhimurium LT2
caccaccgcaggcagc

SEQ ID NO: 3803913 - RNA, 23 nt, Salmonella typhimurium LT2
caccaccggaugauucaguaaac

SEQ ID NO: 3803914 - RNA, 14 nt, Salmonella typhimurium LT2
caccaccuccugcu

SEQ ID NO: 3803915 - RNA, 19 nt, Salmonella typhimurium LT2
caccaccugcuguugcgga

SEQ ID NO: 3803916 - RNA, 13 nt, Salmonella typhimurium LT2
caccacgaaggaa

SEQ ID NO: 3803917 - RNA, 21 nt, Salmonella typhimurium LT2
caccacgaucuugucacaaua

SEQ ID NO: 3803918 - RNA, 13 nt, Salmonella typhimurium LT2
caccacgcacagu

SEQ ID NO: 3803919 - RNA, 19 nt, Salmonella typhimurium LT2
caccacgccuaaugaagcg

SEQ ID NO: 3803920 - RNA, 15 nt, Salmonella typhimurium LT2
caccacgccuuucac

SEQ ID NO: 3803921 - RNA, 16 nt, Salmonella typhimurium LT2
caccacgcgcacgccc

SEQ ID NO: 3803922 - RNA, 16 nt, Salmonella typhimurium LT2
caccacgguguacccc

SEQ ID NO: 3803923 - RNA, 22 nt, Salmonella typhimurium LT2
caccacguaacucggcagcgcg

SEQ ID NO: 3803924 - RNA, 14 nt, Salmonella typhimurium LT2
caccacgucauccg

SEQ ID NO: 3803925 - RNA, 17 nt, Salmonella typhimurium LT2
caccacuugauucugca

SEQ ID NO: 3803926 - RNA, 21 nt, Salmonella typhimurium LT2
caccagaauccacucggcgcu

SEQ ID NO: 3803927 - RNA, 23 nt, Salmonella typhimurium LT2
caccagaauccacucggcgcugu

SEQ ID NO: 3803928 - RNA, 11 nt, Salmonella typhimurium LT2
caccagaccga

SEQ ID NO: 3803929 - RNA, 12 nt, Salmonella typhimurium LT2
caccagacgcug

SEQ ID NO: 3803930 - RNA, 21 nt, Salmonella typhimurium LT2
caccagacgcuggcacuggca

SEQ ID NO: 3803931 - RNA, 13 nt, Salmonella typhimurium LT2
caccagcacagcc

SEQ ID NO: 3803932 - RNA, 16 nt, Salmonella typhimurium LT2
caccagcacagcccag

SEQ ID NO: 3803933 - RNA, 14 nt, Salmonella typhimurium LT2
caccagcaccgcca

SEQ ID NO: 3803934 - RNA, 15 nt, Salmonella typhimurium LT2
caccagcaccgccag

SEQ ID NO: 3803935 - RNA, 19 nt, Salmonella typhimurium LT2
caccagcaccgccagcgca

SEQ ID NO: 3803936 - RNA, 20 nt, Salmonella typhimurium LT2
caccagcacgcaggcauccg

SEQ ID NO: 3803937 - RNA, 14 nt, Salmonella typhimurium LT2
caccagcagcgcgg

SEQ ID NO: 3803938 - RNA, 17 nt, Salmonella typhimurium LT2
caccagccaggccgcca

SEQ ID NO: 3803939 - RNA, 15 nt, Salmonella typhimurium LT2
caccagccccagccc

SEQ ID NO: 3803940 - RNA, 21 nt, Salmonella typhimurium LT2
caccagcccggcgcacacccu

SEQ ID NO: 3803941 - RNA, 20 nt, Salmonella typhimurium LT2
caccagcccuggcugcccuu

SEQ ID NO: 3803942 - RNA, 14 nt, Salmonella typhimurium LT2
caccagccguucac

SEQ ID NO: 3803943 - RNA, 20 nt, Salmonella typhimurium LT2
caccagccguucaccagcca

SEQ ID NO: 3803944 - RNA, 16 nt, Salmonella typhimurium LT2
caccagcgauccagac

SEQ ID NO: 3803945 - RNA, 18 nt, Salmonella typhimurium LT2
caccagcgauccagaccg

SEQ ID NO: 3803946 - RNA, 15 nt, Salmonella typhimurium LT2
caccagcgcaguaaa

SEQ ID NO: 3803947 - RNA, 15 nt, Salmonella typhimurium LT2
caccagcgccagcga

SEQ ID NO: 3803948 - RNA, 17 nt, Salmonella typhimurium LT2
caccagcgccugcgcug

SEQ ID NO: 3803949 - RNA, 17 nt, Salmonella typhimurium LT2
caccagcgcgccgccgc

SEQ ID NO: 3803950 - RNA, 19 nt, Salmonella typhimurium LT2
caccagcucccgcgucacg

SEQ ID NO: 3803951 - RNA, 20 nt, Salmonella typhimurium LT2
caccagcugacgcagcagcu

SEQ ID NO: 3803952 - RNA, 20 nt, Salmonella typhimurium LT2
caccaggaagacuauccagc

SEQ ID NO: 3803953 - RNA, 20 nt, Salmonella typhimurium LT2
caccaggcguaagaucccag

SEQ ID NO: 3803954 - RNA, 18 nt, Salmonella typhimurium LT2
caccagguuaucgguaau

SEQ ID NO: 3803955 - RNA, 21 nt, Salmonella typhimurium LT2
caccaguacaauuuccugcca

SEQ ID NO: 3803956 - RNA, 15 nt, Salmonella typhimurium LT2
caccagucccuguuc

SEQ ID NO: 3803957 - RNA, 20 nt, Salmonella typhimurium LT2
caccagugaucggcuggaca

SEQ ID NO: 3803958 - RNA, 18 nt, Salmonella typhimurium LT2
caccaguucacgguaaua

SEQ ID NO: 3803959 - RNA, 15 nt, Salmonella typhimurium LT2
caccaguucacuccu

SEQ ID NO: 3803960 - RNA, 16 nt, Salmonella typhimurium LT2
caccaguucauauuug

SEQ ID NO: 3803961 - RNA, 22 nt, Salmonella typhimurium LT2
caccaguuuauccgccagccag

SEQ ID NO: 3803962 - RNA, 21 nt, Salmonella typhimurium LT2
gacgcgcaaaacucugagcau

SEQ ID NO: 3803963 - RNA, 14 nt, Salmonella typhimurium LT2
gacgcgcacccggc

SEQ ID NO: 3803964 - RNA, 14 nt, Salmonella typhimurium LT2
gacgcgcaggccgu

SEQ ID NO: 3803965 - RNA, 17 nt, Salmonella typhimurium LT2
gacgcgccacuuccagc

SEQ ID NO: 3803966 - RNA, 21 nt, Salmonella typhimurium LT2
gacgcgcgagaacugcugcau

SEQ ID NO: 3803967 - RNA, 18 nt, Salmonella typhimurium LT2
gacgcgcgauaucagcga

SEQ ID NO: 3803968 - RNA, 21 nt, Salmonella typhimurium LT2
gacgcgcgcgaaaagaaacug

SEQ ID NO: 3803969 - RNA, 15 nt, Salmonella typhimurium LT2
gacgcgcuagcuuca

SEQ ID NO: 3803970 - RNA, 19 nt, Salmonella typhimurium LT2
gacgcgcucaccuccgcca

SEQ ID NO: 3803971 - RNA, 16 nt, Salmonella typhimurium LT2
gacgcgcuccagcaac

SEQ ID NO: 3803972 - RNA, 15 nt, Salmonella typhimurium LT2
gacgcggacgccacc

SEQ ID NO: 3803973 - RNA, 22 nt, Salmonella typhimurium LT2
gacgcguaaccccugcccgcga

SEQ ID NO: 3803974 - RNA, 23 nt, Salmonella typhimurium LT2
gacgcguagcgucuuauccggcc

SEQ ID NO: 3803975 - RNA, 21 nt, Salmonella typhimurium LT2
gacgcguggcaucuuaucagg

SEQ ID NO: 3803976 - RNA, 19 nt, Salmonella typhimurium LT2
gacgcguguugccggacca

SEQ ID NO: 3803977 - RNA, 14 nt, Salmonella typhimurium LT2
gacgcguuaauauc

SEQ ID NO: 3803978 - RNA, 24 nt, Salmonella typhimurium LT2
gacgcguuaauauccuucagcguu

SEQ ID NO: 3803979 - RNA, 14 nt, Salmonella typhimurium LT2
gacgcguuccacuu

SEQ ID NO: 3803980 - RNA, 22 nt, Salmonella typhimurium LT2
gacgcuaaccucuauaguaaau

SEQ ID NO: 3803981 - RNA, 13 nt, Salmonella typhimurium LT2
gacgcuaacgcgc

SEQ ID NO: 3803982 - RNA, 14 nt, Salmonella typhimurium LT2
gacgcuaucguccu

SEQ ID NO: 3803983 - RNA, 19 nt, Salmonella typhimurium LT2
gacgcuauucaugccgacc

SEQ ID NO: 3803984 - RNA, 15 nt, Salmonella typhimurium LT2
gacgcuccagaaucu

SEQ ID NO: 3803985 - RNA, 16 nt, Salmonella typhimurium LT2
gacgcuccugaaucgc

SEQ ID NO: 3803986 - RNA, 18 nt, Salmonella typhimurium LT2
gacgcugaaccuuccauu

SEQ ID NO: 3803987 - RNA, 16 nt, Salmonella typhimurium LT2
gacgcugcaacucucc

SEQ ID NO: 3803988 - RNA, 22 nt, Salmonella typhimurium LT2
gacgcugccacaauggcaggca

SEQ ID NO: 3803989 - RNA, 19 nt, Salmonella typhimurium LT2
gacgcugcgcuuauccggc

SEQ ID NO: 3803990 - RNA, 20 nt, Salmonella typhimurium LT2
gacgcugcgcuuauccggcc

SEQ ID NO: 3803991 - RNA, 16 nt, Salmonella typhimurium LT2
gacgcuggcacuggca

SEQ ID NO: 3803992 - RNA, 12 nt, Salmonella typhimurium LT2
gacgcuggcgca

SEQ ID NO: 3803993 - RNA, 12 nt, Salmonella typhimurium LT2
gacgcugguugu

SEQ ID NO: 3803994 - RNA, 17 nt, Salmonella typhimurium LT2
gacgcuuaccgcgucuu

SEQ ID NO: 3803995 - RNA, 20 nt, Salmonella typhimurium LT2
gacgcuuaccgggccugcgu

SEQ ID NO: 3803996 - RNA, 15 nt, Salmonella typhimurium LT2
gacgcuucagagcag

SEQ ID NO: 3803997 - RNA, 18 nt, Salmonella typhimurium LT2
gacgcuucgcuuauccgg

SEQ ID NO: 3803998 - RNA, 19 nt, Salmonella typhimurium LT2
gacgcuugagcgccuuauc

SEQ ID NO: 3803999 - RNA, 14 nt, Salmonella typhimurium LT2
gacgcuuuuauccg

SEQ ID NO: 3804000 - RNA, 14 nt, Salmonella typhimurium LT2
gacggaaaccagau

SEQ ID NO: 3804001 - RNA, 20 nt, Salmonella typhimurium LT2
gacggacgcagaccaaaauc

SEQ ID NO: 3804002 - RNA, 22 nt, Salmonella typhimurium LT2
gacggacucgcgcagaaucagc

SEQ ID NO: 3804003 - RNA, 18 nt, Salmonella typhimurium LT2
gacggagaugaucguuuc

SEQ ID NO: 3804004 - RNA, 16 nt, Salmonella typhimurium LT2
gacggauucuuccucu

SEQ ID NO: 3804005 - RNA, 13 nt, Salmonella typhimurium LT2
gacggcagcgcca

SEQ ID NO: 3804006 - RNA, 20 nt, Salmonella typhimurium LT2
gacggcagcgccauccggca

SEQ ID NO: 3804007 - RNA, 16 nt, Salmonella typhimurium LT2
gacggcauaagccagc

SEQ ID NO: 3804008 - RNA, 12 nt, Salmonella typhimurium LT2
gacggccagcgc

SEQ ID NO: 3804009 - RNA, 17 nt, Salmonella typhimurium LT2
gacggccaguugcgcag

SEQ ID NO: 3804010 - RNA, 18 nt, Salmonella typhimurium LT2
gacggccugucuccgcag

SEQ ID NO: 3804011 - RNA, 23 nt, Salmonella typhimurium LT2
gacggcgaaucaauuuacgcacu

SEQ ID NO: 3804012 - RNA, 15 nt, Salmonella typhimurium LT2
gacggcgagcguucc

SEQ ID NO: 3804013 - RNA, 14 nt, Salmonella typhimurium LT2
gacggcggaccccu

SEQ ID NO: 3804014 - RNA, 15 nt, Salmonella typhimurium LT2
gacggcggccagcau

SEQ ID NO: 3804015 - RNA, 24 nt, Salmonella typhimurium LT2
gacggcgucaccaccgcaggcagc

SEQ ID NO: 3804016 - RNA, 15 nt, Salmonella typhimurium LT2
gacggcuaagcugau

SEQ ID NO: 3804017 - RNA, 18 nt, Salmonella typhimurium LT2
gacggcuaaguuaaccgg

SEQ ID NO: 3804018 - RNA, 16 nt, Salmonella typhimurium LT2
gacggcuccagcgcca

SEQ ID NO: 3804019 - RNA, 16 nt, Salmonella typhimurium LT2
gacggcugaauguucu

SEQ ID NO: 3804020 - RNA, 21 nt, Salmonella typhimurium LT2
gacggcugaccugaacgccua

SEQ ID NO: 3804021 - RNA, 22 nt, Salmonella typhimurium LT2
gacggcuucuucacgcagcgcc

SEQ ID NO: 3804022 - RNA, 14 nt, Salmonella typhimurium LT2
gacgggaucucgca

SEQ ID NO: 3804023 - RNA, 21 nt, Salmonella typhimurium LT2
gacgggauuaaaugacgcccu

SEQ ID NO: 3804024 - RNA, 12 nt, Salmonella typhimurium LT2
gacgggcuggcg

SEQ ID NO: 3804025 - RNA, 15 nt, Salmonella typhimurium LT2
gacggggcgcgugcg

SEQ ID NO: 3804026 - RNA, 23 nt, Salmonella typhimurium LT2
gacggugauguuggcccggacgc

SEQ ID NO: 3804027 - RNA, 23 nt, Salmonella typhimurium LT2
gacgguuuauccccgcuggcgcg

SEQ ID NO: 3804028 - RNA, 18 nt, Salmonella typhimurium LT2
gacguaaacgucggccuu

SEQ ID NO: 3804029 - RNA, 14 nt, Salmonella typhimurium LT2
gacguaaaucugaa

SEQ ID NO: 3804030 - RNA, 23 nt, Salmonella typhimurium LT2
gacguaacgguguuucaucuuca

SEQ ID NO: 3804031 - RNA, 21 nt, Salmonella typhimurium LT2
gacgucaacaccuccaguuca

SEQ ID NO: 3804032 - RNA, 18 nt, Salmonella typhimurium LT2
gacgucaacgguaaaaug

SEQ ID NO: 3804033 - RNA, 21 nt, Salmonella typhimurium LT2
gacgucacgaagauaugcccc

SEQ ID NO: 3804034 - RNA, 11 nt, Salmonella typhimurium LT2
gacguccagac

SEQ ID NO: 3804035 - RNA, 14 nt, Salmonella typhimurium LT2
gacguccaggccgu

SEQ ID NO: 3804036 - RNA, 15 nt, Salmonella typhimurium LT2
gacguccguuagcug

SEQ ID NO: 3804037 - RNA, 12 nt, Salmonella typhimurium LT2
gacguccugcaa

SEQ ID NO: 3804038 - RNA, 20 nt, Salmonella typhimurium LT2
gacgucgacgccuuucuuca

SEQ ID NO: 3804039 - RNA, 22 nt, Salmonella typhimurium LT2
gacgucgacgccuuucuucacg

SEQ ID NO: 3804040 - RNA, 14 nt, Salmonella typhimurium LT2
gacgucugucagaa

SEQ ID NO: 3804041 - RNA, 17 nt, Salmonella typhimurium LT2
gacgucuuucuuaacgc

SEQ ID NO: 3804042 - RNA, 13 nt, Salmonella typhimurium LT2
gacgugauaauaa

SEQ ID NO: 3804043 - RNA, 19 nt, Salmonella typhimurium LT2
gacgugcggcagggcgguc

SEQ ID NO: 3804044 - RNA, 12 nt, Salmonella typhimurium LT2
gacguggggguu

SEQ ID NO: 3804045 - RNA, 17 nt, Salmonella typhimurium LT2
gacguggggguucaagu

SEQ ID NO: 3804046 - RNA, 19 nt, Salmonella typhimurium LT2
gacguggggguucaagucc

SEQ ID NO: 3804047 - RNA, 21 nt, Salmonella typhimurium LT2
gacguuaacgcagcaucgcca

SEQ ID NO: 3804048 - RNA, 18 nt, Salmonella typhimurium LT2
gacguuaacgccgccauc

SEQ ID NO: 3804049 - RNA, 18 nt, Salmonella typhimurium LT2
gacguuacaucuccuggu

SEQ ID NO: 3804050 - RNA, 17 nt, Salmonella typhimurium LT2
gacguuaucgccgacaa

SEQ ID NO: 3804051 - RNA, 17 nt, Salmonella typhimurium LT2
gacguucaauucauaga

SEQ ID NO: 3804052 - RNA, 13 nt, Salmonella typhimurium LT2
gacguuccgcgac

SEQ ID NO: 3804053 - RNA, 18 nt, Salmonella typhimurium LT2
gacguugaaaaaacgggc

SEQ ID NO: 3804054 - RNA, 17 nt, Salmonella typhimurium LT2
gacguuuggcuuauccg

SEQ ID NO: 3804055 - RNA, 16 nt, Salmonella typhimurium LT2
gacuaaaagacgccau

SEQ ID NO: 3804056 - RNA, 15 nt, Salmonella typhimurium LT2
gacuaaccuugauuc

SEQ ID NO: 3804057 - RNA, 16 nt, Salmonella typhimurium LT2
gacuacauacgcgcau

SEQ ID NO: 3804058 - RNA, 15 nt, Salmonella typhimurium LT2
gacuacguucaucag

SEQ ID NO: 3804059 - RNA, 20 nt, Salmonella typhimurium LT2
gacuacucccgucgccuguu

SEQ ID NO: 3804060 - RNA, 16 nt, Salmonella typhimurium LT2
gacuagacagccucuc

SEQ ID NO: 3804061 - RNA, 17 nt, Salmonella typhimurium LT2
gacuaucagaaaaaauu

SEQ ID NO: 3804062 - RNA, 18 nt, Salmonella typhimurium LT2
gacuauccagccagggau

SEQ ID NO: 3804063 - RNA, 18 nt, Salmonella typhimurium LT2
gacuauccguccucuuuc

SEQ ID NO: 3804064 - RNA, 16 nt, Salmonella typhimurium LT2
gacuaucguuacccua

SEQ ID NO: 3804065 - RNA, 16 nt, Salmonella typhimurium LT2
gacuauuggaaucgcu

SEQ ID NO: 3804066 - RNA, 19 nt, Salmonella typhimurium LT2
gagagcguauccagcaccu

SEQ ID NO: 3804067 - RNA, 15 nt, Salmonella typhimurium LT2
gagagcgucaugaaa

SEQ ID NO: 3804068 - RNA, 19 nt, Salmonella typhimurium LT2
gagaggccaccagcgccag

SEQ ID NO: 3804069 - RNA, 19 nt, Salmonella typhimurium LT2
gagauaaccaucgcgcagc

SEQ ID NO: 3804070 - RNA, 14 nt, Salmonella typhimurium LT2
gagauaauuuauga

SEQ ID NO: 3804071 - RNA, 20 nt, Salmonella typhimurium LT2
gagauacugcgaucgccggc

SEQ ID NO: 3804072 - RNA, 18 nt, Salmonella typhimurium LT2
gagauauacaucugauua

SEQ ID NO: 3804073 - RNA, 18 nt, Salmonella typhimurium LT2
gagauaucccaucgacuu

SEQ ID NO: 3804074 - RNA, 17 nt, Salmonella typhimurium LT2
gagauauuuugucaggc

SEQ ID NO: 3804075 - RNA, 15 nt, Salmonella typhimurium LT2
gagaucagcaguugc

SEQ ID NO: 3804076 - RNA, 18 nt, Salmonella typhimurium LT2
gagaucgcuucaaucccc

SEQ ID NO: 3804077 - RNA, 13 nt, Salmonella typhimurium LT2
gagaucggcgcuc

SEQ ID NO: 3804078 - RNA, 20 nt, Salmonella typhimurium LT2
gagaucgguaauuuccacgc

SEQ ID NO: 3804079 - RNA, 21 nt, Salmonella typhimurium LT2
gagaucgguaauuuccacgcc

SEQ ID NO: 3804080 - RNA, 22 nt, Salmonella typhimurium LT2
gagaugaccgaguuccagucca

SEQ ID NO: 3804081 - RNA, 16 nt, Salmonella typhimurium LT2
gagaugucccaccgcc

SEQ ID NO: 3804082 - RNA, 20 nt, Salmonella typhimurium LT2
gagauguuuuaccaguacaa

SEQ ID NO: 3804083 - RNA, 19 nt, Salmonella typhimurium LT2
gagauuaacagcgcgacca

SEQ ID NO: 3804084 - RNA, 23 nt, Salmonella typhimurium LT2
gagauuaacagcgcgaccagcgu

SEQ ID NO: 3804085 - RNA, 16 nt, Salmonella typhimurium LT2
gagauugauaaucagc

SEQ ID NO: 3804086 - RNA, 20 nt, Salmonella typhimurium LT2
gagcaaaaccguagcuuugc

SEQ ID NO: 3804087 - RNA, 20 nt, Salmonella typhimurium LT2
gagcaaaccgacccaaaaau

SEQ ID NO: 3804088 - RNA, 13 nt, Salmonella typhimurium LT2
gagcaaaccgcaa

SEQ ID NO: 3804089 - RNA, 19 nt, Salmonella typhimurium LT2
gagcaaaggaucgcaacca

SEQ ID NO: 3804090 - RNA, 13 nt, Salmonella typhimurium LT2
gagcaacuggcaa

SEQ ID NO: 3804091 - RNA, 17 nt, Salmonella typhimurium LT2
gagcaaucaguucacgc

SEQ ID NO: 3804092 - RNA, 14 nt, Salmonella typhimurium LT2
gagcaaugggaagg

SEQ ID NO: 3804093 - RNA, 18 nt, Salmonella typhimurium LT2
gagcaaugggaaggaaaa

SEQ ID NO: 3804094 - RNA, 20 nt, Salmonella typhimurium LT2
gagcaaugggaaggaaaaua

SEQ ID NO: 3804095 - RNA, 13 nt, Salmonella typhimurium LT2
gagcacagcccau

SEQ ID NO: 3804096 - RNA, 16 nt, Salmonella typhimurium LT2
gagcacugcccaggac

SEQ ID NO: 3804097 - RNA, 17 nt, Salmonella typhimurium LT2
gagcacuucugacauuc

SEQ ID NO: 3804098 - RNA, 17 nt, Salmonella typhimurium LT2
gagcagaacaaguucuu

SEQ ID NO: 3804099 - RNA, 16 nt, Salmonella typhimurium LT2
gagcagcaacccugcc

SEQ ID NO: 3804100 - RNA, 22 nt, Salmonella typhimurium LT2
gagcagcaggacguugccgccc

SEQ ID NO: 3804101 - RNA, 16 nt, Salmonella typhimurium LT2
gagcagccuggcggcu

SEQ ID NO: 3804102 - RNA, 16 nt, Salmonella typhimurium LT2
gagcaggaaccacauc

SEQ ID NO: 3804103 - RNA, 21 nt, Salmonella typhimurium LT2
gagcaggccaaaaaagccgcu

SEQ ID NO: 3804104 - RNA, 19 nt, Salmonella typhimurium LT2
gagcagguaucguauccgg

SEQ ID NO: 3804105 - RNA, 16 nt, Salmonella typhimurium LT2
gagcaguacgccaaaa

SEQ ID NO: 3804106 - RNA, 19 nt, Salmonella typhimurium LT2
gagcagucguugcgccugu

SEQ ID NO: 3804107 - RNA, 20 nt, Salmonella typhimurium LT2
gagcagucguugcgccuguu

SEQ ID NO: 3804108 - RNA, 16 nt, Salmonella typhimurium LT2
gagcaguucagcagca

SEQ ID NO: 3804109 - RNA, 18 nt, Salmonella typhimurium LT2
gagcauacacauucaggc

SEQ ID NO: 3804110 - RNA, 23 nt, Salmonella typhimurium LT2
gagcauaucaacggucaggcugu

SEQ ID NO: 3804111 - RNA, 11 nt, Salmonella typhimurium LT2
gagcaucaaac

SEQ ID NO: 3804112 - RNA, 20 nt, Salmonella typhimurium LT2
gagcaucaucugccauuucu

SEQ ID NO: 3804113 - RNA, 20 nt, Salmonella typhimurium LT2
gagcaucuccagcgcauugc

SEQ ID NO: 3804114 - RNA, 12 nt, Salmonella typhimurium LT2
gagccaauaucc

SEQ ID NO: 3804115 - RNA, 15 nt, Salmonella typhimurium LT2
gagccaauauccgga

SEQ ID NO: 3804116 - RNA, 14 nt, Salmonella typhimurium LT2
gagccacuauccag

SEQ ID NO: 3804117 - RNA, 19 nt, Salmonella typhimurium LT2
gagccacuauccagucagc

SEQ ID NO: 3804118 - RNA, 22 nt, Salmonella typhimurium LT2
gagccacucacguucagcgcgg

SEQ ID NO: 3804119 - RNA, 23 nt, Salmonella typhimurium LT2
gagccacugcauuacucgccugc

SEQ ID NO: 3804120 - RNA, 18 nt, Salmonella typhimurium LT2
gagccagaugucgccaga

SEQ ID NO: 3804121 - RNA, 22 nt, Salmonella typhimurium LT2
gagccagccugaggaugauacu

SEQ ID NO: 3804122 - RNA, 23 nt, Salmonella typhimurium LT2
gagccaguguucccugcgcugga

SEQ ID NO: 3804123 - RNA, 21 nt, Salmonella typhimurium LT2
gagccaucggcaaacgccgcc

SEQ ID NO: 3804124 - RNA, 22 nt, Salmonella typhimurium LT2
gagccaucggcaaacgccgccu

SEQ ID NO: 3804125 - RNA, 15 nt, Salmonella typhimurium LT2
gagccauuaaugcag

SEQ ID NO: 3804126 - RNA, 17 nt, Salmonella typhimurium LT2
gagcccuccuccagcgc

SEQ ID NO: 3804127 - RNA, 17 nt, Salmonella typhimurium LT2
gagcccucuauccacac

SEQ ID NO: 3804128 - RNA, 21 nt, Salmonella typhimurium LT2
gagcccugugcgguauugaua

SEQ ID NO: 3804129 - RNA, 22 nt, Salmonella typhimurium LT2
gagccgauacgcgggccgcggc

SEQ ID NO: 3804130 - RNA, 23 nt, Salmonella typhimurium LT2
gagcgaacggcuuuccagcagcc

SEQ ID NO: 3804131 - RNA, 16 nt, Salmonella typhimurium LT2
gagcgaauccagcgcc

SEQ ID NO: 3804132 - RNA, 22 nt, Salmonella typhimurium LT2
gagcgacaaaucugccgggagc

SEQ ID NO: 3804133 - RNA, 16 nt, Salmonella typhimurium LT2
gagcgacgcccugccc

SEQ ID NO: 3804134 - RNA, 21 nt, Salmonella typhimurium LT2
gagcgacgguuuuauccccuu

SEQ ID NO: 3804135 - RNA, 20 nt, Salmonella typhimurium LT2
gagcgcaaaacgcugcuauu

SEQ ID NO: 3804136 - RNA, 22 nt, Salmonella typhimurium LT2
gagcgcagcgacuucaggcgcu

SEQ ID NO: 3804137 - RNA, 22 nt, Salmonella typhimurium LT2
gagcgcauacgcuguccaguca

SEQ ID NO: 3804138 - RNA, 13 nt, Salmonella typhimurium LT2
gagcgcauccggc

SEQ ID NO: 3804139 - RNA, 15 nt, Salmonella typhimurium LT2
gagcgcauccggcca

SEQ ID NO: 3804140 - RNA, 19 nt, Salmonella typhimurium LT2
gagcgcauccggccagcga

SEQ ID NO: 3804141 - RNA, 15 nt, Salmonella typhimurium LT2
gagcgccggcaaagc

SEQ ID NO: 3804142 - RNA, 16 nt, Salmonella typhimurium LT2
gagcgccguaccgcgu

SEQ ID NO: 3804143 - RNA, 14 nt, Salmonella typhimurium LT2
gagcgccguggaaa

SEQ ID NO: 3804144 - RNA, 20 nt, Salmonella typhimurium LT2
gagcgcgcaaucgggccugc

SEQ ID NO: 3804145 - RNA, 12 nt, Salmonella typhimurium LT2
gagcgcgcuggc

SEQ ID NO: 3804146 - RNA, 13 nt, Salmonella typhimurium LT2
gagcgcgcuggca

SEQ ID NO: 3804147 - RNA, 12 nt, Salmonella typhimurium LT2
gagcgcggcggc

SEQ ID NO: 3804148 - RNA, 15 nt, Salmonella typhimurium LT2
gagcgcgucagcgcc

SEQ ID NO: 3804149 - RNA, 16 nt, Salmonella typhimurium LT2
gagcgcgucagcgccu

SEQ ID NO: 3804150 - RNA, 19 nt, Salmonella typhimurium LT2
gagcggauaauccgccacu

SEQ ID NO: 3804151 - RNA, 21 nt, Salmonella typhimurium LT2
gagcggaucaaacuccgcgcu

SEQ ID NO: 3804152 - RNA, 14 nt, Salmonella typhimurium LT2
gagcggcacgccga

SEQ ID NO: 3804153 - RNA, 21 nt, Salmonella typhimurium LT2
gagcggcuacgccugauaagc

SEQ ID NO: 3804154 - RNA, 14 nt, Salmonella typhimurium LT2
gagcggcucaucca

SEQ ID NO: 3804155 - RNA, 16 nt, Salmonella typhimurium LT2
gagcggcucauccagc

SEQ ID NO: 3804156 - RNA, 14 nt, Salmonella typhimurium LT2
gagcgggccgucag

SEQ ID NO: 3804157 - RNA, 21 nt, Salmonella typhimurium LT2
gagcgguaagucaaccagccc

SEQ ID NO: 3804158 - RNA, 21 nt, Salmonella typhimurium LT2
gagcgguuuuuuuguggccug

SEQ ID NO: 3804159 - RNA, 13 nt, Salmonella typhimurium LT2
gagcguauccagc

SEQ ID NO: 3804160 - RNA, 16 nt, Salmonella typhimurium LT2
gagcgucaggccaucg

SEQ ID NO: 3804161 - RNA, 17 nt, Salmonella typhimurium LT2
gagcgucuacgccauca

SEQ ID NO: 3804162 - RNA, 17 nt, Salmonella typhimurium LT2
gagcgucucauccggca

SEQ ID NO: 3804163 - RNA, 21 nt, Salmonella typhimurium LT2
gagcgucuuuuauccccacua

SEQ ID NO: 3804164 - RNA, 19 nt, Salmonella typhimurium LT2
gagcgugaucgucuccugu

SEQ ID NO: 3804165 - RNA, 17 nt, Salmonella typhimurium LT2
gagcgugaucucauugg

SEQ ID NO: 3804166 - RNA, 18 nt, Salmonella typhimurium LT2
gagcgugaucucauugga

SEQ ID NO: 3804167 - RNA, 21 nt, Salmonella typhimurium LT2
gagcguuacgggaacagaauu

SEQ ID NO: 3804168 - RNA, 10 nt, Salmonella typhimurium LT2
gagcguucaa

SEQ ID NO: 3804169 - RNA, 23 nt, Salmonella typhimurium LT2
gauaaacgccccuucaucagcca

SEQ ID NO: 3804170 - RNA, 22 nt, Salmonella typhimurium LT2
gauaaacggcuuuaguucagca

SEQ ID NO: 3804171 - RNA, 15 nt, Salmonella typhimurium LT2
gauaaacucaaucag

SEQ ID NO: 3804172 - RNA, 20 nt, Salmonella typhimurium LT2
gauaaagaccggcacaaccg

SEQ ID NO: 3804173 - RNA, 16 nt, Salmonella typhimurium LT2
gauaaagagcaggcca

SEQ ID NO: 3804174 - RNA, 21 nt, Salmonella typhimurium LT2
gauaaagagcaggccaaaaaa

SEQ ID NO: 3804175 - RNA, 17 nt, Salmonella typhimurium LT2
gauaaagcacagcccca

SEQ ID NO: 3804176 - RNA, 13 nt, Salmonella typhimurium LT2
gauaaagcagcga

SEQ ID NO: 3804177 - RNA, 23 nt, Salmonella typhimurium LT2
gauaaagcccgucccuuccgcca

SEQ ID NO: 3804178 - RNA, 20 nt, Salmonella typhimurium LT2
gauaaagcgaccgaucauca

SEQ ID NO: 3804179 - RNA, 22 nt, Salmonella typhimurium LT2
gauaaagcgcucaugccacgcc

SEQ ID NO: 3804180 - RNA, 17 nt, Salmonella typhimurium LT2
gauaaagcugggucagg

SEQ ID NO: 3804181 - RNA, 18 nt, Salmonella typhimurium LT2
gauaaagguacuuucccc

SEQ ID NO: 3804182 - RNA, 17 nt, Salmonella typhimurium LT2
gauaaaguacuuucucc

SEQ ID NO: 3804183 - RNA, 18 nt, Salmonella typhimurium LT2
gauaaaguuaaacauacc

SEQ ID NO: 3804184 - RNA, 11 nt, Salmonella typhimurium LT2
gauaaauguuu

SEQ ID NO: 3804185 - RNA, 15 nt, Salmonella typhimurium LT2
gauaaauguuuaucu

SEQ ID NO: 3804186 - RNA, 11 nt, Salmonella typhimurium LT2
gauaacaauau

SEQ ID NO: 3804187 - RNA, 12 nt, Salmonella typhimurium LT2
gauaaccaauca

SEQ ID NO: 3804188 - RNA, 18 nt, Salmonella typhimurium LT2
gauaacccugaagcugca

SEQ ID NO: 3804189 - RNA, 14 nt, Salmonella typhimurium LT2
gauaaccgccgcca

SEQ ID NO: 3804190 - RNA, 16 nt, Salmonella typhimurium LT2
gauaaccuucuucguu

SEQ ID NO: 3804191 - RNA, 15 nt, Salmonella typhimurium LT2
gauaacgcaacaaca

SEQ ID NO: 3804192 - RNA, 22 nt, Salmonella typhimurium LT2
gauaacgcgauggccaaauaac

SEQ ID NO: 3804193 - RNA, 14 nt, Salmonella typhimurium LT2
gauaacgcggguua

SEQ ID NO: 3804194 - RNA, 15 nt, Salmonella typhimurium LT2
gauaacggaaagagg

SEQ ID NO: 3804195 - RNA, 13 nt, Salmonella typhimurium LT2
gauaacuaauggc

SEQ ID NO: 3804196 - RNA, 13 nt, Salmonella typhimurium LT2
gauaacucuucau

SEQ ID NO: 3804197 - RNA, 20 nt, Salmonella typhimurium LT2
gauaacugaagguuuuuccc

SEQ ID NO: 3804198 - RNA, 23 nt, Salmonella typhimurium LT2
gauaacugaagguuuuucccgga

SEQ ID NO: 3804199 - RNA, 17 nt, Salmonella typhimurium LT2
gauaagaccgguacgca

SEQ ID NO: 3804200 - RNA, 13 nt, Salmonella typhimurium LT2
gauaagagaaaau

SEQ ID NO: 3804201 - RNA, 15 nt, Salmonella typhimurium LT2
gauaagagaaaauac

SEQ ID NO: 3804202 - RNA, 20 nt, Salmonella typhimurium LT2
gauaagcaaagcgccauccg

SEQ ID NO: 3804203 - RNA, 19 nt, Salmonella typhimurium LT2
gauaagcaaagcgccaucg

SEQ ID NO: 3804204 - RNA, 16 nt, Salmonella typhimurium LT2
gauaagcaagcgccau

SEQ ID NO: 3804205 - RNA, 14 nt, Salmonella typhimurium LT2
gauaagcacaggcc

SEQ ID NO: 3804206 - RNA, 14 nt, Salmonella typhimurium LT2
gauaagcaccugca

SEQ ID NO: 3804207 - RNA, 21 nt, Salmonella typhimurium LT2
gauaagcaccugcauuuaucu

SEQ ID NO: 3804208 - RNA, 18 nt, Salmonella typhimurium LT2
gauaagcacuauuauauu

SEQ ID NO: 3804209 - RNA, 22 nt, Salmonella typhimurium LT2
gauaagcaggaaggaaaaucug

SEQ ID NO: 3804210 - RNA, 19 nt, Salmonella typhimurium LT2
gauaagcauaacguucuua

SEQ ID NO: 3804211 - RNA, 17 nt, Salmonella typhimurium LT2
gauaagccuccggauga

SEQ ID NO: 3804212 - RNA, 21 nt, Salmonella typhimurium LT2
gauaagccugcgcgccugcug

SEQ ID NO: 3804213 - RNA, 17 nt, Salmonella typhimurium LT2
gauaagcgaagcgccau

SEQ ID NO: 3804214 - RNA, 20 nt, Salmonella typhimurium LT2
gauaagcgaagcgccaucag

SEQ ID NO: 3804215 - RNA, 17 nt, Salmonella typhimurium LT2
gauaagcgcagcgccau

SEQ ID NO: 3804216 - RNA, 20 nt, Salmonella typhimurium LT2
gauaagcgcagcgccauccg

SEQ ID NO: 3804217 - RNA, 20 nt, Salmonella typhimurium LT2
gauaagcgcagcgccaucug

SEQ ID NO: 3804218 - RNA, 19 nt, Salmonella typhimurium LT2
gauaagcgccgcgccaucg

SEQ ID NO: 3804219 - RNA, 21 nt, Salmonella typhimurium LT2
gauaagcguaagcgccauccg

SEQ ID NO: 3804220 - RNA, 20 nt, Salmonella typhimurium LT2
gauaagcguagcgccaucag

SEQ ID NO: 3804221 - RNA, 16 nt, Salmonella typhimurium LT2
gauaagcgucagcgcc

SEQ ID NO: 3804222 - RNA, 21 nt, Salmonella typhimurium LT2
gauaagcgucagcgccauccg

SEQ ID NO: 3804223 - RNA, 15 nt, Salmonella typhimurium LT2
gauaagcgucagcgu

SEQ ID NO: 3804224 - RNA, 18 nt, Salmonella typhimurium LT2
gauaagcgucgccagcgu

SEQ ID NO: 3804225 - RNA, 20 nt, Salmonella typhimurium LT2
gauaagcgugagcgcauccg

SEQ ID NO: 3804226 - RNA, 19 nt, Salmonella typhimurium LT2
gauaagcgugcgucauccg

SEQ ID NO: 3804227 - RNA, 20 nt, Salmonella typhimurium LT2
gauaagcguuagcgccaccg

SEQ ID NO: 3804228 - RNA, 20 nt, Salmonella typhimurium LT2
gauaagcucugcgguaacaa

SEQ ID NO: 3804229 - RNA, 18 nt, Salmonella typhimurium LT2
gauaagcuuacgccaucg

SEQ ID NO: 3804230 - RNA, 22 nt, Salmonella typhimurium LT2
gauaaggcgcagccgccauccg

SEQ ID NO: 3804231 - RNA, 22 nt, Salmonella typhimurium LT2
gauaaggcgcuagccgcauccg

SEQ ID NO: 3804232 - RNA, 18 nt, Salmonella typhimurium LT2
gauaaggcgcuuguaaau

SEQ ID NO: 3804233 - RNA, 22 nt, Salmonella typhimurium LT2
gauaaggcggagccgccauccg

SEQ ID NO: 3804234 - RNA, 23 nt, Salmonella typhimurium LT2
gauaaggcggagccgccauccgg

SEQ ID NO: 3804235 - RNA, 18 nt, Salmonella typhimurium LT2
gauaaggcguuugcgccg

SEQ ID NO: 3804236 - RNA, 19 nt, Salmonella typhimurium LT2
gauaagguaaagccgccau

SEQ ID NO: 3804237 - RNA, 22 nt, Salmonella typhimurium LT2
gauaagguaaagccgccauccg

SEQ ID NO: 3804238 - RNA, 23 nt, Salmonella typhimurium LT2
gauaagguaacgcgaaaaaaaga

SEQ ID NO: 3804239 - RNA, 22 nt, Salmonella typhimurium LT2
gauaaggucgcuauccagcagu

SEQ ID NO: 3804240 - RNA, 22 nt, Salmonella typhimurium LT2
gauaagguguuuacgccgccau

SEQ ID NO: 3804241 - RNA, 15 nt, Salmonella typhimurium LT2
gauaagguugccaaa

SEQ ID NO: 3804242 - RNA, 18 nt, Salmonella typhimurium LT2
gauaagucaugagcuauu

SEQ ID NO: 3804243 - RNA, 14 nt, Salmonella typhimurium LT2
gauaagucgcguga

SEQ ID NO: 3804244 - RNA, 12 nt, Salmonella typhimurium LT2
gauaauaaaaua

SEQ ID NO: 3804245 - RNA, 13 nt, Salmonella typhimurium LT2
gauaauaaaauau

SEQ ID NO: 3804246 - RNA, 11 nt, Salmonella typhimurium LT2
gauaauaauga

SEQ ID NO: 3804247 - RNA, 18 nt, Salmonella typhimurium LT2
gauaauaguuagccugau

SEQ ID NO: 3804248 - RNA, 19 nt, Salmonella typhimurium LT2
gauaauauccccuaaauaa

SEQ ID NO: 3804249 - RNA, 18 nt, Salmonella typhimurium LT2
gauaauauccgacgccug

SEQ ID NO: 3804250 - RNA, 19 nt, Salmonella typhimurium LT2
gauaauauuaucagcaaua

SEQ ID NO: 3804251 - RNA, 22 nt, Salmonella typhimurium LT2
gauaaucaacggucuugccagc

SEQ ID NO: 3804252 - RNA, 11 nt, Salmonella typhimurium LT2
gauaaucagca

SEQ ID NO: 3804253 - RNA, 21 nt, Salmonella typhimurium LT2
gauaaucagcaagaugaccca

SEQ ID NO: 3804254 - RNA, 17 nt, Salmonella typhimurium LT2
gauaaucagcacgccac

SEQ ID NO: 3804255 - RNA, 17 nt, Salmonella typhimurium LT2
gauaaucauacagcgca

SEQ ID NO: 3804256 - RNA, 17 nt, Salmonella typhimurium LT2
gauaauccagacaaaca

SEQ ID NO: 3804257 - RNA, 18 nt, Salmonella typhimurium LT2
gauaaucgccgccagcuc

SEQ ID NO: 3804258 - RNA, 15 nt, Salmonella typhimurium LT2
gauaaugacauccag

SEQ ID NO: 3804259 - RNA, 19 nt, Salmonella typhimurium LT2
gauaaugcuuucgccagcc

SEQ ID NO: 3804260 - RNA, 20 nt, Salmonella typhimurium LT2
gauaauggcgccgauaacac

SEQ ID NO: 3804261 - RNA, 15 nt, Salmonella typhimurium LT2
gauaauuggcgguga

SEQ ID NO: 3804262 - RNA, 23 nt, Salmonella typhimurium LT2
gauaauuucacccguauucuuug

SEQ ID NO: 3804263 - RNA, 22 nt, Salmonella typhimurium LT2
gauaauuuucccaguucaucca

SEQ ID NO: 3804264 - RNA, 18 nt, Salmonella typhimurium LT2
gauacaaggcaaucugau

SEQ ID NO: 3804265 - RNA, 15 nt, Salmonella typhimurium LT2
gauacaccuucacau

SEQ ID NO: 3804266 - RNA, 18 nt, Salmonella typhimurium LT2
gauacagaaaaccggcaa

SEQ ID NO: 3804267 - RNA, 16 nt, Salmonella typhimurium LT2
gauacagcguaucggc

SEQ ID NO: 3804268 - RNA, 20 nt, Salmonella typhimurium LT2
gauacaggacugacugcugu

SEQ ID NO: 3804269 - RNA, 23 nt, Salmonella typhimurium LT2
gauacauauuucgaucggccagu

SEQ ID NO: 3804270 - RNA, 18 nt, Salmonella typhimurium LT2
gauacauggcuauuccac

SEQ ID NO: 3804271 - RNA, 21 nt, Salmonella typhimurium LT2
gauaccaaaaucggcuucucc

SEQ ID NO: 3804272 - RNA, 17 nt, Salmonella typhimurium LT2
gauauuuucaccuccac

SEQ ID NO: 3804273 - RNA, 15 nt, Salmonella typhimurium LT2
gauauuuucaggcac

SEQ ID NO: 3804274 - RNA, 23 nt, Salmonella typhimurium LT2
gaucaaccgguuugucauucgcc

SEQ ID NO: 3804275 - RNA, 18 nt, Salmonella typhimurium LT2
gaucaagcaauaccagaa

SEQ ID NO: 3804276 - RNA, 19 nt, Salmonella typhimurium LT2
gaucaagcaauaccagaaa

SEQ ID NO: 3804277 - RNA, 21 nt, Salmonella typhimurium LT2
gaucaagcccccgcaacauug

SEQ ID NO: 3804278 - RNA, 18 nt, Salmonella typhimurium LT2
gaucaauaaaauuaucca

SEQ ID NO: 3804279 - RNA, 22 nt, Salmonella typhimurium LT2
gaucacccacaucagcggcaca

SEQ ID NO: 3804280 - RNA, 15 nt, Salmonella typhimurium LT2
gaucaccucuuccag

SEQ ID NO: 3804281 - RNA, 19 nt, Salmonella typhimurium LT2
gaucaccucuuccagcguc

SEQ ID NO: 3804282 - RNA, 21 nt, Salmonella typhimurium LT2
gaucaccucuuccagcgucag

SEQ ID NO: 3804283 - RNA, 18 nt, Salmonella typhimurium LT2
gaucacgccguccagcac

SEQ ID NO: 3804284 - RNA, 14 nt, Salmonella typhimurium LT2
gaucacggugguga

SEQ ID NO: 3804285 - RNA, 21 nt, Salmonella typhimurium LT2
gaucacuuccgccaccacgcc

SEQ ID NO: 3804286 - RNA, 21 nt, Salmonella typhimurium LT2
gaucacuuuugggccgcgcag

SEQ ID NO: 3804287 - RNA, 21 nt, Salmonella typhimurium LT2
gaucagaccaucggccgcuau

SEQ ID NO: 3804288 - RNA, 19 nt, Salmonella typhimurium LT2
gaucagacuuuggauaaag

SEQ ID NO: 3804289 - RNA, 13 nt, Salmonella typhimurium LT2
gaucagccgcgac

SEQ ID NO: 3804290 - RNA, 11 nt, Salmonella typhimurium LT2
gaucagcgcca

SEQ ID NO: 3804291 - RNA, 15 nt, Salmonella typhimurium LT2
gaucagcgccacgca

SEQ ID NO: 3804292 - RNA, 18 nt, Salmonella typhimurium LT2
gaucagcgcgcuccagac

SEQ ID NO: 3804293 - RNA, 19 nt, Salmonella typhimurium LT2
gaucagcggcugcaaagca

SEQ ID NO: 3804294 - RNA, 18 nt, Salmonella typhimurium LT2
gaucaggaaaucuuccag

SEQ ID NO: 3804295 - RNA, 11 nt, Salmonella typhimurium LT2
gaucaggcgac

SEQ ID NO: 3804296 - RNA, 19 nt, Salmonella typhimurium LT2
gaucaggcgaccauccacc

SEQ ID NO: 3804297 - RNA, 17 nt, Salmonella typhimurium LT2
gaucaguggauaacgcg

SEQ ID NO: 3804298 - RNA, 14 nt, Salmonella typhimurium LT2
gaucaguuugccuu

SEQ ID NO: 3804299 - RNA, 19 nt, Salmonella typhimurium LT2
gaucaucacgaaauaacgc

SEQ ID NO: 3804300 - RNA, 22 nt, Salmonella typhimurium LT2
gaucauccggguuaaaccagcu

SEQ ID NO: 3804301 - RNA, 16 nt, Salmonella typhimurium LT2
gaucaucguaccaaua

SEQ ID NO: 3804302 - RNA, 15 nt, Salmonella typhimurium LT2
gaucaucuccgacgu

SEQ ID NO: 3804303 - RNA, 13 nt, Salmonella typhimurium LT2
gaucaucuucacu

SEQ ID NO: 3804304 - RNA, 20 nt, Salmonella typhimurium LT2
gaucaucuucacuucacaaa

SEQ ID NO: 3804305 - RNA, 23 nt, Salmonella typhimurium LT2
gaucaucuucacuucacaaacaa

SEQ ID NO: 3804306 - RNA, 12 nt, Salmonella typhimurium LT2
gaucaucuuuua

SEQ ID NO: 3804307 - RNA, 14 nt, Salmonella typhimurium LT2
gaucauggcucaga

SEQ ID NO: 3804308 - RNA, 19 nt, Salmonella typhimurium LT2
gaucauuaccugucgccca

SEQ ID NO: 3804309 - RNA, 14 nt, Salmonella typhimurium LT2
gaucauuggccaga

SEQ ID NO: 3804310 - RNA, 14 nt, Salmonella typhimurium LT2
gauccacacuggcg

SEQ ID NO: 3804311 - RNA, 12 nt, Salmonella typhimurium LT2
gauccagaaccg

SEQ ID NO: 3804312 - RNA, 23 nt, Salmonella typhimurium LT2
gauccagaccggcaugauggcga

SEQ ID NO: 3804313 - RNA, 16 nt, Salmonella typhimurium LT2
gauccagccccagcgc

SEQ ID NO: 3804314 - RNA, 21 nt, Salmonella typhimurium LT2
gauccagccccagcgccagcu

SEQ ID NO: 3804315 - RNA, 22 nt, Salmonella typhimurium LT2
gauccagccgcaguugccaggc

SEQ ID NO: 3804316 - RNA, 22 nt, Salmonella typhimurium LT2
gauccagcgauugacgguuugu

SEQ ID NO: 3804317 - RNA, 13 nt, Salmonella typhimurium LT2
gauccagcgggcc

SEQ ID NO: 3804318 - RNA, 13 nt, Salmonella typhimurium LT2
gauccagcucuuc

SEQ ID NO: 3804319 - RNA, 16 nt, Salmonella typhimurium LT2
gauccaggucuuccgc

SEQ ID NO: 3804320 - RNA, 11 nt, Salmonella typhimurium LT2
gaucccaccag

SEQ ID NO: 3804321 - RNA, 23 nt, Salmonella typhimurium LT2
gaucccagggcggcgucgccaga

SEQ ID NO: 3804322 - RNA, 16 nt, Salmonella typhimurium LT2
gaucccgaaaugguuc

SEQ ID NO: 3804323 - RNA, 15 nt, Salmonella typhimurium LT2
gaucccgccgaccag

SEQ ID NO: 3804324 - RNA, 18 nt, Salmonella typhimurium LT2
gaucccgggcgauaaacc

SEQ ID NO: 3804325 - RNA, 19 nt, Salmonella typhimurium LT2
gaucccuaauaaaauaacu

SEQ ID NO: 3804326 - RNA, 14 nt, Salmonella typhimurium LT2
gauccuccugcaga

SEQ ID NO: 3804327 - RNA, 15 nt, Salmonella typhimurium LT2
gauccugagaaauca

SEQ ID NO: 3804328 - RNA, 22 nt, Salmonella typhimurium LT2
gauccuggcguguccccaccaa

SEQ ID NO: 3804329 - RNA, 23 nt, Salmonella typhimurium LT2
gauccuggcguguccccaccaac

SEQ ID NO: 3804330 - RNA, 21 nt, Salmonella typhimurium LT2
gauccuguccugggccgccac

SEQ ID NO: 3804331 - RNA, 20 nt, Salmonella typhimurium LT2
gauccuguuucaccguagca

SEQ ID NO: 3804332 - RNA, 15 nt, Salmonella typhimurium LT2
gauccuucauucaga

SEQ ID NO: 3804333 - RNA, 21 nt, Salmonella typhimurium LT2
gaucgaacaauuaccgauggu

SEQ ID NO: 3804334 - RNA, 16 nt, Salmonella typhimurium LT2
gaucgaagauuccgcg

SEQ ID NO: 3804335 - RNA, 14 nt, Salmonella typhimurium LT2
gaucgaaucucccg

SEQ ID NO: 3804336 - RNA, 15 nt, Salmonella typhimurium LT2
gaucgacaaugauca

SEQ ID NO: 3804337 - RNA, 17 nt, Salmonella typhimurium LT2
gaucgacaaugaucaga

SEQ ID NO: 3804338 - RNA, 23 nt, Salmonella typhimurium LT2
gaucgacauaagaguccauucgg

SEQ ID NO: 3804339 - RNA, 22 nt, Salmonella typhimurium LT2
gaucgacgcugaugaaaaguau

SEQ ID NO: 3804340 - RNA, 20 nt, Salmonella typhimurium LT2
gaucgagccgucgccggccu

SEQ ID NO: 3804341 - RNA, 16 nt, Salmonella typhimurium LT2
gaucgaggucagcauu

SEQ ID NO: 3804342 - RNA, 14 nt, Salmonella typhimurium LT2
gaucgagucaggcg

SEQ ID NO: 3804343 - RNA, 20 nt, Salmonella typhimurium LT2
gaucgauauccgugcgcaau

SEQ ID NO: 3804344 - RNA, 20 nt, Salmonella typhimurium LT2
gaucgcaagauccugauauu

SEQ ID NO: 3804345 - RNA, 18 nt, Salmonella typhimurium LT2
gaucgcauaaauauccgg

SEQ ID NO: 3804346 - RNA, 20 nt, Salmonella typhimurium LT2
gaucgcauuuaaucgccugc

SEQ ID NO: 3804347 - RNA, 21 nt, Salmonella typhimurium LT2
gaucgccagcguuagcacauu

SEQ ID NO: 3804348 - RNA, 22 nt, Salmonella typhimurium LT2
gaucgccaucgacagcagcgcu

SEQ ID NO: 3804349 - RNA, 17 nt, Salmonella typhimurium LT2
gaucgccauucggauaa

SEQ ID NO: 3804350 - RNA, 20 nt, Salmonella typhimurium LT2
gaucgccgacgaccggcgca

SEQ ID NO: 3804351 - RNA, 14 nt, Salmonella typhimurium LT2
gaucgccgccgaau

SEQ ID NO: 3804352 - RNA, 10 nt, Salmonella typhimurium LT2
gaucgccugg

SEQ ID NO: 3804353 - RNA, 19 nt, Salmonella typhimurium LT2
gaucgcgaggcaacagaua

SEQ ID NO: 3804354 - RNA, 17 nt, Salmonella typhimurium LT2
gaucgcgauagcgcuga

SEQ ID NO: 3804355 - RNA, 14 nt, Salmonella typhimurium LT2
gaucgcgcagcagg

SEQ ID NO: 3804356 - RNA, 21 nt, Salmonella typhimurium LT2
gaucgcgcucccggccaauca

SEQ ID NO: 3804357 - RNA, 20 nt, Salmonella typhimurium LT2
gaucgcggcaaccguaucca

SEQ ID NO: 3804358 - RNA, 21 nt, Salmonella typhimurium LT2
gaucgcgugcauuaaaauaau

SEQ ID NO: 3804359 - RNA, 23 nt, Salmonella typhimurium LT2
gaucgcgugcauuaaaauaaugc

SEQ ID NO: 3804360 - RNA, 12 nt, Salmonella typhimurium LT2
gaucgcuuucca

SEQ ID NO: 3804361 - RNA, 22 nt, Salmonella typhimurium LT2
gaucgcuuucgcuuucucuucc

SEQ ID NO: 3804362 - RNA, 13 nt, Salmonella typhimurium LT2
gaucggccagcaa

SEQ ID NO: 3804363 - RNA, 14 nt, Salmonella typhimurium LT2
gaucggccauaucc

SEQ ID NO: 3804364 - RNA, 21 nt, Salmonella typhimurium LT2
gaucggcggcccacucaucca

SEQ ID NO: 3804365 - RNA, 21 nt, Salmonella typhimurium LT2
gaucggcuugagcaccacgcg

SEQ ID NO: 3804366 - RNA, 17 nt, Salmonella typhimurium LT2
gaucggcuuuaucuuua

SEQ ID NO: 3804367 - RNA, 15 nt, Salmonella typhimurium LT2
gaucgggcaauccau

SEQ ID NO: 3804368 - RNA, 19 nt, Salmonella typhimurium LT2
gaucgggcuuccagcguug

SEQ ID NO: 3804369 - RNA, 23 nt, Salmonella typhimurium LT2
gaucgguugcaggaagggcagca

SEQ ID NO: 3804370 - RNA, 18 nt, Salmonella typhimurium LT2
gaucguaaaaugaaaaac

SEQ ID NO: 3804371 - RNA, 22 nt, Salmonella typhimurium LT2
gaucguaaagcgcauccagcuc

SEQ ID NO: 3804372 - RNA, 15 nt, Salmonella typhimurium LT2
gaucguaugcagcca

SEQ ID NO: 3804373 - RNA, 21 nt, Salmonella typhimurium LT2
gaucguaugcagccaggccau

SEQ ID NO: 3804374 - RNA, 15 nt, Salmonella typhimurium LT2
gaucguaugcgccug

SEQ ID NO: 3804375 - RNA, 22 nt, Salmonella typhimurium LT2
gauggcggcugcgccuuauccg

SEQ ID NO: 3804376 - RNA, 12 nt, Salmonella typhimurium LT2
gauggcggcuuu

SEQ ID NO: 3804377 - RNA, 21 nt, Salmonella typhimurium LT2
gauggcguaauuaaccgcgcc

SEQ ID NO: 3804378 - RNA, 22 nt, Salmonella typhimurium LT2
gauggcgucugauugcgcccuc

SEQ ID NO: 3804379 - RNA, 17 nt, Salmonella typhimurium LT2
gauggcguuccagcauu

SEQ ID NO: 3804380 - RNA, 22 nt, Salmonella typhimurium LT2
gauggcguuccagcauuuccug

SEQ ID NO: 3804381 - RNA, 17 nt, Salmonella typhimurium LT2
gauggcuaauauccagc

SEQ ID NO: 3804382 - RNA, 20 nt, Salmonella typhimurium LT2
gauggcugcacccggagaga

SEQ ID NO: 3804383 - RNA, 17 nt, Salmonella typhimurium LT2
gauggcuuucuaccugc

SEQ ID NO: 3804384 - RNA, 20 nt, Salmonella typhimurium LT2
gaugggccgaguaauccgua

SEQ ID NO: 3804385 - RNA, 21 nt, Salmonella typhimurium LT2
gaugggccgaguaauccguag

SEQ ID NO: 3804386 - RNA, 18 nt, Salmonella typhimurium LT2
gaugggcgcacagcgcca

SEQ ID NO: 3804387 - RNA, 14 nt, Salmonella typhimurium LT2
gaugggcuucuuca

SEQ ID NO: 3804388 - RNA, 16 nt, Salmonella typhimurium LT2
gauggucaauaacagc

SEQ ID NO: 3804389 - RNA, 22 nt, Salmonella typhimurium LT2
gauggugcagccccggcggcgu

SEQ ID NO: 3804390 - RNA, 12 nt, Salmonella typhimurium LT2
gauggugcgagg

SEQ ID NO: 3804391 - RNA, 17 nt, Salmonella typhimurium LT2
gaugguggugcaagcac

SEQ ID NO: 3804392 - RNA, 21 nt, Salmonella typhimurium LT2
gaugguguuggcgaucagcgg

SEQ ID NO: 3804393 - RNA, 13 nt, Salmonella typhimurium LT2
gaugguugccaga

SEQ ID NO: 3804394 - RNA, 19 nt, Salmonella typhimurium LT2
gaugguugugugcguucgg

SEQ ID NO: 3804395 - RNA, 14 nt, Salmonella typhimurium LT2
gauguaaaaaugcu

SEQ ID NO: 3804396 - RNA, 20 nt, Salmonella typhimurium LT2
gauguccaggcgacaugaca

SEQ ID NO: 3804397 - RNA, 20 nt, Salmonella typhimurium LT2
gaugucccaucguaacgccg

SEQ ID NO: 3804398 - RNA, 14 nt, Salmonella typhimurium LT2
gaugucgccacgcc

SEQ ID NO: 3804399 - RNA, 18 nt, Salmonella typhimurium LT2
gaugugcuggggagcguu

SEQ ID NO: 3804400 - RNA, 17 nt, Salmonella typhimurium LT2
gauguguuugagcagcc

SEQ ID NO: 3804401 - RNA, 16 nt, Salmonella typhimurium LT2
gauguugcguauuuuu

SEQ ID NO: 3804402 - RNA, 23 nt, Salmonella typhimurium LT2
gauguuuugcggcuucagcgaca

SEQ ID NO: 3804403 - RNA, 20 nt, Salmonella typhimurium LT2
gauguuuuuaucaugcugac

SEQ ID NO: 3804404 - RNA, 13 nt, Salmonella typhimurium LT2
gauuaaccagcag

SEQ ID NO: 3804405 - RNA, 17 nt, Salmonella typhimurium LT2
gauuaagggacgguaaa

SEQ ID NO: 3804406 - RNA, 17 nt, Salmonella typhimurium LT2
gauuaauaaccaauaau

SEQ ID NO: 3804407 - RNA, 16 nt, Salmonella typhimurium LT2
gauuaauacguacuga

SEQ ID NO: 3804408 - RNA, 16 nt, Salmonella typhimurium LT2
gauuaaucgucauccc

SEQ ID NO: 3804409 - RNA, 18 nt, Salmonella typhimurium LT2
gauuaaugcuccaauaaa

SEQ ID NO: 3804410 - RNA, 12 nt, Salmonella typhimurium LT2
gauuaauuuaau

SEQ ID NO: 3804411 - RNA, 18 nt, Salmonella typhimurium LT2
gauuaccgggauuuccau

SEQ ID NO: 3804412 - RNA, 22 nt, Salmonella typhimurium LT2
gauuaccgggauuuccauauua

SEQ ID NO: 3804413 - RNA, 17 nt, Salmonella typhimurium LT2
gauuaccuaccagcgcg

SEQ ID NO: 3804414 - RNA, 16 nt, Salmonella typhimurium LT2
gauuacgacccacaau

SEQ ID NO: 3804415 - RNA, 18 nt, Salmonella typhimurium LT2
gauuacgacuuacgcagc

SEQ ID NO: 3804416 - RNA, 14 nt, Salmonella typhimurium LT2
gauuacgcgucuga

SEQ ID NO: 3804417 - RNA, 19 nt, Salmonella typhimurium LT2
gauuacgugcccggcguga

SEQ ID NO: 3804418 - RNA, 18 nt, Salmonella typhimurium LT2
gauuacucccuugccagc

SEQ ID NO: 3804419 - RNA, 22 nt, Salmonella typhimurium LT2
gauuacucgucaccgaauagcg

SEQ ID NO: 3804420 - RNA, 21 nt, Salmonella typhimurium LT2
gauuagcgacagcgcuauccg

SEQ ID NO: 3804421 - RNA, 16 nt, Salmonella typhimurium LT2
gauuagcucauacgcu

SEQ ID NO: 3804422 - RNA, 21 nt, Salmonella typhimurium LT2
gauuaggcaagcugguaaaug

SEQ ID NO: 3804423 - RNA, 23 nt, Salmonella typhimurium LT2
gauuaucagaaggcuugauacug

SEQ ID NO: 3804424 - RNA, 19 nt, Salmonella typhimurium LT2
gauuauuggucagcaggcg

SEQ ID NO: 3804425 - RNA, 17 nt, Salmonella typhimurium LT2
gauuauuugaucccguc

SEQ ID NO: 3804426 - RNA, 20 nt, Salmonella typhimurium LT2
gauuauuuuaucaucagcac

SEQ ID NO: 3804427 - RNA, 20 nt, Salmonella typhimurium LT2
gauuauuuuccaaccacggu

SEQ ID NO: 3804428 - RNA, 22 nt, Salmonella typhimurium LT2
gauucaacgcgugauccacagc

SEQ ID NO: 3804429 - RNA, 14 nt, Salmonella typhimurium LT2
gauucacuuucuug

SEQ ID NO: 3804430 - RNA, 23 nt, Salmonella typhimurium LT2
gauucacuuucuugccacuggcc

SEQ ID NO: 3804431 - RNA, 15 nt, Salmonella typhimurium LT2
gauucaggucaugca

SEQ ID NO: 3804432 - RNA, 19 nt, Salmonella typhimurium LT2
gauucaguucaucuuccac

SEQ ID NO: 3804433 - RNA, 17 nt, Salmonella typhimurium LT2
gauucaugaucuuuccu

SEQ ID NO: 3804434 - RNA, 23 nt, Salmonella typhimurium LT2
gauucaugguacucaacaucauu

SEQ ID NO: 3804435 - RNA, 13 nt, Salmonella typhimurium LT2
gauuccagagcga

SEQ ID NO: 3804436 - RNA, 15 nt, Salmonella typhimurium LT2
gauuccagauagcgc

SEQ ID NO: 3804437 - RNA, 23 nt, Salmonella typhimurium LT2
gauuccauuuuugcggauggcgc

SEQ ID NO: 3804438 - RNA, 13 nt, Salmonella typhimurium LT2
gauucgaaccugc

SEQ ID NO: 3804439 - RNA, 14 nt, Salmonella typhimurium LT2
gauucgaaccugcg

SEQ ID NO: 3804440 - RNA, 14 nt, Salmonella typhimurium LT2
gauucgcccacgga

SEQ ID NO: 3804441 - RNA, 16 nt, Salmonella typhimurium LT2
gauucgcccacggaug

SEQ ID NO: 3804442 - RNA, 22 nt, Salmonella typhimurium LT2
gauucguuucucuucggcggcc

SEQ ID NO: 3804443 - RNA, 18 nt, Salmonella typhimurium LT2
gauucuaacauaaugaau

SEQ ID NO: 3804444 - RNA, 15 nt, Salmonella typhimurium LT2
gauucuacucugcuc

SEQ ID NO: 3804445 - RNA, 13 nt, Salmonella typhimurium LT2
gauucuaucuguu

SEQ ID NO: 3804446 - RNA, 22 nt, Salmonella typhimurium LT2
gauucuaucuguuuuaauuccu

SEQ ID NO: 3804447 - RNA, 20 nt, Salmonella typhimurium LT2
gauucucuaacgucagcgcc

SEQ ID NO: 3804448 - RNA, 15 nt, Salmonella typhimurium LT2
gauucugccaguuca

SEQ ID NO: 3804449 - RNA, 13 nt, Salmonella typhimurium LT2
gauucuucugccu

SEQ ID NO: 3804450 - RNA, 13 nt, Salmonella typhimurium LT2
gauugaauaaugc

SEQ ID NO: 3804451 - RNA, 17 nt, Salmonella typhimurium LT2
gauugacagaauaaugc

SEQ ID NO: 3804452 - RNA, 16 nt, Salmonella typhimurium LT2
gauugacgguuugucu

SEQ ID NO: 3804453 - RNA, 17 nt, Salmonella typhimurium LT2
gauugauuuuguaaucu

SEQ ID NO: 3804454 - RNA, 18 nt, Salmonella typhimurium LT2
gauugcagagaaguguac

SEQ ID NO: 3804455 - RNA, 23 nt, Salmonella typhimurium LT2
gauugcagagaaguguacaaaca

SEQ ID NO: 3804456 - RNA, 12 nt, Salmonella typhimurium LT2
gauugccgauau

SEQ ID NO: 3804457 - RNA, 18 nt, Salmonella typhimurium LT2
gauugucuuaaauaugaa

SEQ ID NO: 3804458 - RNA, 16 nt, Salmonella typhimurium LT2
gauuuaagcuuaauuu

SEQ ID NO: 3804459 - RNA, 16 nt, Salmonella typhimurium LT2
gauuuagcggcagcca

SEQ ID NO: 3804460 - RNA, 12 nt, Salmonella typhimurium LT2
gauuuaugaaua

SEQ ID NO: 3804461 - RNA, 21 nt, Salmonella typhimurium LT2
gauuuauguaccgucaucgcc

SEQ ID NO: 3804462 - RNA, 19 nt, Salmonella typhimurium LT2
gauuuccagcgaauaauga

SEQ ID NO: 3804463 - RNA, 20 nt, Salmonella typhimurium LT2
gauuuccggcaccagaaucc

SEQ ID NO: 3804464 - RNA, 15 nt, Salmonella typhimurium LT2
gauuuccggcggcag

SEQ ID NO: 3804465 - RNA, 16 nt, Salmonella typhimurium LT2
gauuuccggcggcaga

SEQ ID NO: 3804466 - RNA, 19 nt, Salmonella typhimurium LT2
gauuuccggguucacauca

SEQ ID NO: 3804467 - RNA, 17 nt, Salmonella typhimurium LT2
gauuuccgguuccagcg

SEQ ID NO: 3804468 - RNA, 17 nt, Salmonella typhimurium LT2
gauuucguucuuucugc

SEQ ID NO: 3804469 - RNA, 15 nt, Salmonella typhimurium LT2
gauuucuuaauuccu

SEQ ID NO: 3804470 - RNA, 19 nt, Salmonella typhimurium LT2
gauuugcgaaucauguuuu

SEQ ID NO: 3804471 - RNA, 16 nt, Salmonella typhimurium LT2
gauuugcggcagaaau

SEQ ID NO: 3804472 - RNA, 17 nt, Salmonella typhimurium LT2
gauuugcugaaguucuc

SEQ ID NO: 3804473 - RNA, 16 nt, Salmonella typhimurium LT2
gauuuguuucaucgcc

SEQ ID NO: 3804474 - RNA, 21 nt, Salmonella typhimurium LT2
gauuuuaagcauccaggaagu

SEQ ID NO: 3804475 - RNA, 19 nt, Salmonella typhimurium LT2
gauuuuagcgcaucgcucc

SEQ ID NO: 3804476 - RNA, 20 nt, Salmonella typhimurium LT2
gauuuucccuucugaaauga

SEQ ID NO: 3804477 - RNA, 17 nt, Salmonella typhimurium LT2
gauuuuccguuaagcug

SEQ ID NO: 3804478 - RNA, 22 nt, Salmonella typhimurium LT2
gauuuugccuucaauuccugga

SEQ ID NO: 3804479 - RNA, 18 nt, Salmonella typhimurium LT2
gcaacccgacugccacca

SEQ ID NO: 3804480 - RNA, 15 nt, Salmonella typhimurium LT2
gcaacccgccgccau

SEQ ID NO: 3804481 - RNA, 15 nt, Salmonella typhimurium LT2
gcaacccgcuccaga

SEQ ID NO: 3804482 - RNA, 15 nt, Salmonella typhimurium LT2
gcaacccuuuuucaa

SEQ ID NO: 3804483 - RNA, 19 nt, Salmonella typhimurium LT2
gcaaccgacgggcgcuggu

SEQ ID NO: 3804484 - RNA, 14 nt, Salmonella typhimurium LT2
gcaaccgccugcac

SEQ ID NO: 3804485 - RNA, 18 nt, Salmonella typhimurium LT2
gcaaccgcuuugucagag

SEQ ID NO: 3804486 - RNA, 14 nt, Salmonella typhimurium LT2
gcaaccggcguggu

SEQ ID NO: 3804487 - RNA, 19 nt, Salmonella typhimurium LT2
gcaaccgguacucuuccag

SEQ ID NO: 3804488 - RNA, 17 nt, Salmonella typhimurium LT2
gcaaccuuaaacaucgc

SEQ ID NO: 3804489 - RNA, 19 nt, Salmonella typhimurium LT2
gcaacgaucccuaauaaaa

SEQ ID NO: 3804490 - RNA, 18 nt, Salmonella typhimurium LT2
gcaacgccguacuccagc

SEQ ID NO: 3804491 - RNA, 14 nt, Salmonella typhimurium LT2
gcaacgccuuccug

SEQ ID NO: 3804492 - RNA, 17 nt, Salmonella typhimurium LT2
gcaacgcgcauaccgcu

SEQ ID NO: 3804493 - RNA, 14 nt, Salmonella typhimurium LT2
gcaacgcgcaucaa

SEQ ID NO: 3804494 - RNA, 22 nt, Salmonella typhimurium LT2
gcaacgcuuuagugccgccauu

SEQ ID NO: 3804495 - RNA, 18 nt, Salmonella typhimurium LT2
gcaacggaaggaaauaac

SEQ ID NO: 3804496 - RNA, 19 nt, Salmonella typhimurium LT2
gcaacggccagcgcaggcu

SEQ ID NO: 3804497 - RNA, 16 nt, Salmonella typhimurium LT2
gcaacgggcaaugcca

SEQ ID NO: 3804498 - RNA, 18 nt, Salmonella typhimurium LT2
gcaacggguugcgaacuu

SEQ ID NO: 3804499 - RNA, 14 nt, Salmonella typhimurium LT2
gcaacgucaugacc

SEQ ID NO: 3804500 - RNA, 17 nt, Salmonella typhimurium LT2
gcaacguccgcagccga

SEQ ID NO: 3804501 - RNA, 18 nt, Salmonella typhimurium LT2
gcaacguguaggccuggu

SEQ ID NO: 3804502 - RNA, 20 nt, Salmonella typhimurium LT2
gcaacguuucuuucaucaga

SEQ ID NO: 3804503 - RNA, 23 nt, Salmonella typhimurium LT2
gcaacguuucuuucaucagauca

SEQ ID NO: 3804504 - RNA, 18 nt, Salmonella typhimurium LT2
gcaacguuuguaacagca

SEQ ID NO: 3804505 - RNA, 17 nt, Salmonella typhimurium LT2
gcaacucacgccauucc

SEQ ID NO: 3804506 - RNA, 22 nt, Salmonella typhimurium LT2
gcaacuccaguucccgacaggc

SEQ ID NO: 3804507 - RNA, 14 nt, Salmonella typhimurium LT2
gcaacugaccaucu

SEQ ID NO: 3804508 - RNA, 11 nt, Salmonella typhimurium LT2
gcaacugcgcc

SEQ ID NO: 3804509 - RNA, 13 nt, Salmonella typhimurium LT2
gcaacugcgccaa

SEQ ID NO: 3804510 - RNA, 15 nt, Salmonella typhimurium LT2
gcaacuggcaauagc

SEQ ID NO: 3804511 - RNA, 18 nt, Salmonella typhimurium LT2
gcaacuguugcgccagca

SEQ ID NO: 3804512 - RNA, 20 nt, Salmonella typhimurium LT2
gcaacuguugcgccagcacg

SEQ ID NO: 3804513 - RNA, 22 nt, Salmonella typhimurium LT2
gcaacuguuuuaccaaaucaau

SEQ ID NO: 3804514 - RNA, 17 nt, Salmonella typhimurium LT2
gcaacuucaccucaguc

SEQ ID NO: 3804515 - RNA, 13 nt, Salmonella typhimurium LT2
gcaagaaaaguuu

SEQ ID NO: 3804516 - RNA, 19 nt, Salmonella typhimurium LT2
gcaagaaccgcuuuuccug

SEQ ID NO: 3804517 - RNA, 22 nt, Salmonella typhimurium LT2
gcaagacacagcgucgcgcgau

SEQ ID NO: 3804518 - RNA, 21 nt, Salmonella typhimurium LT2
gcaagacccgaaccugcgaca

SEQ ID NO: 3804519 - RNA, 16 nt, Salmonella typhimurium LT2
gcaagacucgcgccuu

SEQ ID NO: 3804520 - RNA, 16 nt, Salmonella typhimurium LT2
gcaagauuaaccagca

SEQ ID NO: 3804521 - RNA, 20 nt, Salmonella typhimurium LT2
gcaagcauaaaaaacaucau

SEQ ID NO: 3804522 - RNA, 21 nt, Salmonella typhimurium LT2
gcaagcauaaaaaacaucaug

SEQ ID NO: 3804523 - RNA, 22 nt, Salmonella typhimurium LT2
gcaagcaucugauauaucuuca

SEQ ID NO: 3804524 - RNA, 14 nt, Salmonella typhimurium LT2
gcaagcgcgccaua

SEQ ID NO: 3804525 - RNA, 19 nt, Salmonella typhimurium LT2
gcaagcggcaaucgccuca

SEQ ID NO: 3804526 - RNA, 21 nt, Salmonella typhimurium LT2
gcaaggagacgcccgucacca

SEQ ID NO: 3804527 - RNA, 15 nt, Salmonella typhimurium LT2
gcaaggcaucaggcu

SEQ ID NO: 3804528 - RNA, 12 nt, Salmonella typhimurium LT2
gcaaggcgcggu

SEQ ID NO: 3804529 - RNA, 19 nt, Salmonella typhimurium LT2
gcaagggaaucucuucacg

SEQ ID NO: 3804530 - RNA, 16 nt, Salmonella typhimurium LT2
gcaaggguaugaauaa

SEQ ID NO: 3804531 - RNA, 14 nt, Salmonella typhimurium LT2
gcaaguauacuuau

SEQ ID NO: 3804532 - RNA, 20 nt, Salmonella typhimurium LT2
gcaaguaucgucagcagacu

SEQ ID NO: 3804533 - RNA, 13 nt, Salmonella typhimurium LT2
gcaaguaugaaaa

SEQ ID NO: 3804534 - RNA, 16 nt, Salmonella typhimurium LT2
gcaauaaaagcaacau

SEQ ID NO: 3804535 - RNA, 19 nt, Salmonella typhimurium LT2
gcaauaaaauauccuccac

SEQ ID NO: 3804536 - RNA, 18 nt, Salmonella typhimurium LT2
gcaauaaagcagggcggc

SEQ ID NO: 3804537 - RNA, 15 nt, Salmonella typhimurium LT2
gcaauaacgccgaua

SEQ ID NO: 3804538 - RNA, 13 nt, Salmonella typhimurium LT2
gcaauaauccgcu

SEQ ID NO: 3804539 - RNA, 19 nt, Salmonella typhimurium LT2
gcaauaauguuuacgccau

SEQ ID NO: 3804540 - RNA, 17 nt, Salmonella typhimurium LT2
gcaauaauuaggggcau

SEQ ID NO: 3804541 - RNA, 18 nt, Salmonella typhimurium LT2
gcaauacccagaacuucc

SEQ ID NO: 3804542 - RNA, 15 nt, Salmonella typhimurium LT2
gcaauagaguaauga

SEQ ID NO: 3804543 - RNA, 17 nt, Salmonella typhimurium LT2
gcaauagaguaaugaca

SEQ ID NO: 3804544 - RNA, 17 nt, Salmonella typhimurium LT2
gcaauagccaauaacgu

SEQ ID NO: 3804545 - RNA, 17 nt, Salmonella typhimurium LT2
gcaauaggauaacuuuu

SEQ ID NO: 3804546 - RNA, 13 nt, Salmonella typhimurium LT2
gcaauagucucca

SEQ ID NO: 3804547 - RNA, 19 nt, Salmonella typhimurium LT2
gcaauauaccgucagcacc

SEQ ID NO: 3804548 - RNA, 12 nt, Salmonella typhimurium LT2
gcaauaucagcc

SEQ ID NO: 3804549 - RNA, 15 nt, Salmonella typhimurium LT2
gcaauaucagccauu

SEQ ID NO: 3804550 - RNA, 16 nt, Salmonella typhimurium LT2
gcaauaucgaugccag

SEQ ID NO: 3804551 - RNA, 17 nt, Salmonella typhimurium LT2
gcaauaugaaaccgccc

SEQ ID NO: 3804552 - RNA, 19 nt, Salmonella typhimurium LT2
gcaauaugucuuaaacagc

SEQ ID NO: 3804553 - RNA, 24 nt, Salmonella typhimurium LT2
gcaauaugucuuaaacagcgauca

SEQ ID NO: 3804554 - RNA, 21 nt, Salmonella typhimurium LT2
gcaauauuaaugucaugcgcc

SEQ ID NO: 3804555 - RNA, 21 nt, Salmonella typhimurium LT2
gcaaucaaaugcguggcguau

SEQ ID NO: 3804556 - RNA, 13 nt, Salmonella typhimurium LT2
gcaaucagcauuu

SEQ ID NO: 3804557 - RNA, 21 nt, Salmonella typhimurium LT2
gcaaucaguacgcgcgcggcg

SEQ ID NO: 3804558 - RNA, 12 nt, Salmonella typhimurium LT2
gcaaucaucaga

SEQ ID NO: 3804559 - RNA, 17 nt, Salmonella typhimurium LT2
gcaaucccgaccagcgu

SEQ ID NO: 3804560 - RNA, 23 nt, Salmonella typhimurium LT2
gcaaucgacguugaucgccaucg

SEQ ID NO: 3804561 - RNA, 14 nt, Salmonella typhimurium LT2
gcaaucgagaucag

SEQ ID NO: 3804562 - RNA, 14 nt, Salmonella typhimurium LT2
gcaaucgccugcaa

SEQ ID NO: 3804563 - RNA, 21 nt, Salmonella typhimurium LT2
gcaaucgcugccuugagugac

SEQ ID NO: 3804564 - RNA, 13 nt, Salmonella typhimurium LT2
gcaaucgcuggcg

SEQ ID NO: 3804565 - RNA, 19 nt, Salmonella typhimurium LT2
gcaaucgggccugcuccgu

SEQ ID NO: 3804566 - RNA, 18 nt, Salmonella typhimurium LT2
gcaaucucuggccaggca

SEQ ID NO: 3804567 - RNA, 16 nt, Salmonella typhimurium LT2
gcaaucugaguauuua

SEQ ID NO: 3804568 - RNA, 19 nt, Salmonella typhimurium LT2
gcaaucugaguauuuacag

SEQ ID NO: 3804569 - RNA, 17 nt, Salmonella typhimurium LT2
gcaaucuuuagcaccuu

SEQ ID NO: 3804570 - RNA, 18 nt, Salmonella typhimurium LT2
gcaaugaagcaagugcug

SEQ ID NO: 3804571 - RNA, 20 nt, Salmonella typhimurium LT2
gcaaugaagcaagugcugga

SEQ ID NO: 3804572 - RNA, 17 nt, Salmonella typhimurium LT2
gcaaugacgguaagcau

SEQ ID NO: 3804573 - RNA, 14 nt, Salmonella typhimurium LT2
gcaaugagcggcca

SEQ ID NO: 3804574 - RNA, 18 nt, Salmonella typhimurium LT2
gcaaugauaacggcgcca

SEQ ID NO: 3804575 - RNA, 15 nt, Salmonella typhimurium LT2
gcaaugauaucggcc

SEQ ID NO: 3804576 - RNA, 12 nt, Salmonella typhimurium LT2
gcaaugauuuuu

SEQ ID NO: 3804577 - RNA, 12 nt, Salmonella typhimurium LT2
gcaaugccacca

SEQ ID NO: 3804578 - RNA, 15 nt, Salmonella typhimurium LT2
gcaaugccccgccgc

SEQ ID NO: 3804579 - RNA, 18 nt, Salmonella typhimurium LT2
gcaaugccuaccggcggc

SEQ ID NO: 3804580 - RNA, 17 nt, Salmonella typhimurium LT2
gcaaugccugaccaacg

SEQ ID NO: 3804581 - RNA, 22 nt, Salmonella typhimurium LT2
gcaaugcgcuccagcuucauca

SEQ ID NO: 3804582 - RNA, 20 nt, Salmonella typhimurium LT2
gcaaugcgcuuuuuuugccc

SEQ ID NO: 3804583 - RNA, 20 nt, Salmonella typhimurium LT2
gcaccgccaaacgcggucag

SEQ ID NO: 3804584 - RNA, 13 nt, Salmonella typhimurium LT2
gcaccgccagcgc

SEQ ID NO: 3804585 - RNA, 15 nt, Salmonella typhimurium LT2
gcaccgccagcgccg

SEQ ID NO: 3804586 - RNA, 16 nt, Salmonella typhimurium LT2
gcaccgcuaaaaaaca

SEQ ID NO: 3804587 - RNA, 20 nt, Salmonella typhimurium LT2
gcaccgcuucaauaagaaac

SEQ ID NO: 3804588 - RNA, 19 nt, Salmonella typhimurium LT2
gcaccguaucggcagucac

SEQ ID NO: 3804589 - RNA, 23 nt, Salmonella typhimurium LT2
gcaccguuauucgaugcggccag

SEQ ID NO: 3804590 - RNA, 18 nt, Salmonella typhimurium LT2
gcaccucaauaugaaauu

SEQ ID NO: 3804591 - RNA, 15 nt, Salmonella typhimurium LT2
gcaccugcucaggcu

SEQ ID NO: 3804592 - RNA, 17 nt, Salmonella typhimurium LT2
gcaccuggguauuccac

SEQ ID NO: 3804593 - RNA, 22 nt, Salmonella typhimurium LT2
gcaccuguaaccuuaaaaggcg

SEQ ID NO: 3804594 - RNA, 15 nt, Salmonella typhimurium LT2
gcaccuucaacagcu

SEQ ID NO: 3804595 - RNA, 20 nt, Salmonella typhimurium LT2
gcaccuucaacagcucgcca

SEQ ID NO: 3804596 - RNA, 22 nt, Salmonella typhimurium LT2
gcaccuucaacagcucgccaug

SEQ ID NO: 3804597 - RNA, 14 nt, Salmonella typhimurium LT2
gcaccuucaucauu

SEQ ID NO: 3804598 - RNA, 13 nt, Salmonella typhimurium LT2
gcacgaaauguag

SEQ ID NO: 3804599 - RNA, 17 nt, Salmonella typhimurium LT2
gcacgaacauaccggag

SEQ ID NO: 3804600 - RNA, 18 nt, Salmonella typhimurium LT2
gcacgaacauaccggagc

SEQ ID NO: 3804601 - RNA, 15 nt, Salmonella typhimurium LT2
gcacgacacaaaagc

SEQ ID NO: 3804602 - RNA, 17 nt, Salmonella typhimurium LT2
gcacgacacaaaagcau

SEQ ID NO: 3804603 - RNA, 17 nt, Salmonella typhimurium LT2
gcacgacagagaucagg

SEQ ID NO: 3804604 - RNA, 22 nt, Salmonella typhimurium LT2
gcacgacauucugcauggcgcu

SEQ ID NO: 3804605 - RNA, 16 nt, Salmonella typhimurium LT2
gcacgacggugcuaua

SEQ ID NO: 3804606 - RNA, 16 nt, Salmonella typhimurium LT2
gcacgagauccauuac

SEQ ID NO: 3804607 - RNA, 21 nt, Salmonella typhimurium LT2
gcacgaugcauaugcacagcg

SEQ ID NO: 3804608 - RNA, 16 nt, Salmonella typhimurium LT2
gcacgccacauugacc

SEQ ID NO: 3804609 - RNA, 12 nt, Salmonella typhimurium LT2
gcacgccagcgc

SEQ ID NO: 3804610 - RNA, 22 nt, Salmonella typhimurium LT2
gcacgccaucgccugauggcgc

SEQ ID NO: 3804611 - RNA, 18 nt, Salmonella typhimurium LT2
gcacgcccuucgucagga

SEQ ID NO: 3804612 - RNA, 18 nt, Salmonella typhimurium LT2
gcacgccgcgcucgcuca

SEQ ID NO: 3804613 - RNA, 16 nt, Salmonella typhimurium LT2
gcacgccugcauaaag

SEQ ID NO: 3804614 - RNA, 18 nt, Salmonella typhimurium LT2
gcacgcuauauuccagcc

SEQ ID NO: 3804615 - RNA, 12 nt, Salmonella typhimurium LT2
gcacgcugcgca

SEQ ID NO: 3804616 - RNA, 15 nt, Salmonella typhimurium LT2
gcacgcuggcaucaa

SEQ ID NO: 3804617 - RNA, 17 nt, Salmonella typhimurium LT2
gcacgcuuacccagcau

SEQ ID NO: 3804618 - RNA, 17 nt, Salmonella typhimurium LT2
gcacgcuuuggcaggcc

SEQ ID NO: 3804619 - RNA, 16 nt, Salmonella typhimurium LT2
gcacggaugcaucaug

SEQ ID NO: 3804620 - RNA, 16 nt, Salmonella typhimurium LT2
gcacggucaaucauca

SEQ ID NO: 3804621 - RNA, 17 nt, Salmonella typhimurium LT2
gcacggucaaucaucag

SEQ ID NO: 3804622 - RNA, 20 nt, Salmonella typhimurium LT2
gcacgucauuacgguauuua

SEQ ID NO: 3804623 - RNA, 14 nt, Salmonella typhimurium LT2
gcacguccuggaaa

SEQ ID NO: 3804624 - RNA, 21 nt, Salmonella typhimurium LT2
gcacguuaaagccgaccaucg

SEQ ID NO: 3804625 - RNA, 15 nt, Salmonella typhimurium LT2
gcacguugucccagg

SEQ ID NO: 3804626 - RNA, 18 nt, Salmonella typhimurium LT2
gcacguugucccaggcca

SEQ ID NO: 3804627 - RNA, 15 nt, Salmonella typhimurium LT2
gcacguuuuccaggu

SEQ ID NO: 3804628 - RNA, 16 nt, Salmonella typhimurium LT2
gcacuaacgauagagg

SEQ ID NO: 3804629 - RNA, 17 nt, Salmonella typhimurium LT2
gcacuacggugugccug

SEQ ID NO: 3804630 - RNA, 16 nt, Salmonella typhimurium LT2
gcacucaaccugugua

SEQ ID NO: 3804631 - RNA, 18 nt, Salmonella typhimurium LT2
gcacucgaagauacggau

SEQ ID NO: 3804632 - RNA, 16 nt, Salmonella typhimurium LT2
gcacucgcgacauggc

SEQ ID NO: 3804633 - RNA, 20 nt, Salmonella typhimurium LT2
gcacucucaaacuauuuuua

SEQ ID NO: 3804634 - RNA, 17 nt, Salmonella typhimurium LT2
gcacucuucuucgcguu

SEQ ID NO: 3804635 - RNA, 21 nt, Salmonella typhimurium LT2
gcacugacgucaacucgcggc

SEQ ID NO: 3804636 - RNA, 14 nt, Salmonella typhimurium LT2
gcacugacuuacag

SEQ ID NO: 3804637 - RNA, 17 nt, Salmonella typhimurium LT2
gcacugauagccgccag

SEQ ID NO: 3804638 - RNA, 15 nt, Salmonella typhimurium LT2
gcacugcgccuugcc

SEQ ID NO: 3804639 - RNA, 15 nt, Salmonella typhimurium LT2
gcacuguuugcugac

SEQ ID NO: 3804640 - RNA, 21 nt, Salmonella typhimurium LT2
gcacuuacucuacauucuguu

SEQ ID NO: 3804641 - RNA, 20 nt, Salmonella typhimurium LT2
gcacuucaaugucguuaucg

SEQ ID NO: 3804642 - RNA, 22 nt, Salmonella typhimurium LT2
gcacuucacgcuccuugagcgc

SEQ ID NO: 3804643 - RNA, 15 nt, Salmonella typhimurium LT2
gcacuuccagccacg

SEQ ID NO: 3804644 - RNA, 15 nt, Salmonella typhimurium LT2
gcacuucgauaaacg

SEQ ID NO: 3804645 - RNA, 22 nt, Salmonella typhimurium LT2
gcacuucgccgggauaaaacac

SEQ ID NO: 3804646 - RNA, 22 nt, Salmonella typhimurium LT2
gcacuugucggggaagggugag

SEQ ID NO: 3804647 - RNA, 18 nt, Salmonella typhimurium LT2
gcacuuuaagcggcagcu

SEQ ID NO: 3804648 - RNA, 16 nt, Salmonella typhimurium LT2
gcacuuucauugccgu

SEQ ID NO: 3804649 - RNA, 23 nt, Salmonella typhimurium LT2
gcacuuuccagccccuucgcugu

SEQ ID NO: 3804650 - RNA, 16 nt, Salmonella typhimurium LT2
gcagaaaaaucagcau

SEQ ID NO: 3804651 - RNA, 17 nt, Salmonella typhimurium LT2
gcagaaacuggcggcgc

SEQ ID NO: 3804652 - RNA, 18 nt, Salmonella typhimurium LT2
gcagaacaaacagaccgc

SEQ ID NO: 3804653 - RNA, 14 nt, Salmonella typhimurium LT2
gcagaacagcgacg

SEQ ID NO: 3804654 - RNA, 20 nt, Salmonella typhimurium LT2
gcagaagccggucaugccug

SEQ ID NO: 3804655 - RNA, 20 nt, Salmonella typhimurium LT2
gcagaagcgcggcucuggcg

SEQ ID NO: 3804656 - RNA, 22 nt, Salmonella typhimurium LT2
gcagacauauuuucaacggcau

SEQ ID NO: 3804657 - RNA, 19 nt, Salmonella typhimurium LT2
gcagacgaaaaugcgccuu

SEQ ID NO: 3804658 - RNA, 13 nt, Salmonella typhimurium LT2
gcagacgccgcgg

SEQ ID NO: 3804659 - RNA, 16 nt, Salmonella typhimurium LT2
gcagacggagaugauc

SEQ ID NO: 3804660 - RNA, 22 nt, Salmonella typhimurium LT2
gcagacggcugggcugaacgga

SEQ ID NO: 3804661 - RNA, 14 nt, Salmonella typhimurium LT2
gcagacgucaacac

SEQ ID NO: 3804662 - RNA, 20 nt, Salmonella typhimurium LT2
gcagacguuuaucggccagc

SEQ ID NO: 3804663 - RNA, 22 nt, Salmonella typhimurium LT2
gcagacucaacugcgggaagua

SEQ ID NO: 3804664 - RNA, 18 nt, Salmonella typhimurium LT2
gcagacucaguucgcgac

SEQ ID NO: 3804665 - RNA, 18 nt, Salmonella typhimurium LT2
gcagacugacgaaacacu

SEQ ID NO: 3804666 - RNA, 21 nt, Salmonella typhimurium LT2
gcagacugacgaaacacugau

SEQ ID NO: 3804667 - RNA, 14 nt, Salmonella typhimurium LT2
gcagacugcgccac

SEQ ID NO: 3804668 - RNA, 15 nt, Salmonella typhimurium LT2
gcagacuguaaaucu

SEQ ID NO: 3804669 - RNA, 15 nt, Salmonella typhimurium LT2
gcagacuuucugaca

SEQ ID NO: 3804670 - RNA, 20 nt, Salmonella typhimurium LT2
gcagagcgcgcucugccuuu

SEQ ID NO: 3804671 - RNA, 14 nt, Salmonella typhimurium LT2
gcagagcugacggg

SEQ ID NO: 3804672 - RNA, 15 nt, Salmonella typhimurium LT2
gcagaggucgccgcu

SEQ ID NO: 3804673 - RNA, 15 nt, Salmonella typhimurium LT2
gcagaguccagcggc

SEQ ID NO: 3804674 - RNA, 19 nt, Salmonella typhimurium LT2
gcagaguccagcggcagcu

SEQ ID NO: 3804675 - RNA, 16 nt, Salmonella typhimurium LT2
gcagagucgcagcggc

SEQ ID NO: 3804676 - RNA, 19 nt, Salmonella typhimurium LT2
gcagagucgcagcggcggu

SEQ ID NO: 3804677 - RNA, 14 nt, Salmonella typhimurium LT2
gcagaguuuaucuc

SEQ ID NO: 3804678 - RNA, 14 nt, Salmonella typhimurium LT2
gcagauagagcaua

SEQ ID NO: 3804679 - RNA, 23 nt, Salmonella typhimurium LT2
gcagauagagcgccugcaggcga

SEQ ID NO: 3804680 - RNA, 21 nt, Salmonella typhimurium LT2
gcagauagccugccagcacca

SEQ ID NO: 3804681 - RNA, 23 nt, Salmonella typhimurium LT2
gcagauaguucguuugcgcgagg

SEQ ID NO: 3804682 - RNA, 14 nt, Salmonella typhimurium LT2
gcagauaucuucca

SEQ ID NO: 3804683 - RNA, 21 nt, Salmonella typhimurium LT2
gcagauaucuuccagcgcguc

SEQ ID NO: 3804684 - RNA, 22 nt, Salmonella typhimurium LT2
gcagauaucuuccagcgcgucc

SEQ ID NO: 3804685 - RNA, 16 nt, Salmonella typhimurium LT2
gcagauccaucgccug

SEQ ID NO: 3804686 - RNA, 20 nt, Salmonella typhimurium LT2
gcagauccgcgauaucaauc

SEQ ID NO: 3804687 - RNA, 14 nt, Salmonella typhimurium LT2
gcaggaacagauac

SEQ ID NO: 3804688 - RNA, 15 nt, Salmonella typhimurium LT2
gcaggaacggcagga

SEQ ID NO: 3804689 - RNA, 14 nt, Salmonella typhimurium LT2
gcaggaaucguccg

SEQ ID NO: 3804690 - RNA, 15 nt, Salmonella typhimurium LT2
gcaggacagcgacau

SEQ ID NO: 3804691 - RNA, 12 nt, Salmonella typhimurium LT2
gcaggacccgag

SEQ ID NO: 3804692 - RNA, 18 nt, Salmonella typhimurium LT2
gcaggacuuaaaaacaaa

SEQ ID NO: 3804693 - RNA, 19 nt, Salmonella typhimurium LT2
gcaggagggagguucgccu

SEQ ID NO: 3804694 - RNA, 16 nt, Salmonella typhimurium LT2
gcaggaucaccggcag

SEQ ID NO: 3804695 - RNA, 18 nt, Salmonella typhimurium LT2
gcaggauccccaucccaa

SEQ ID NO: 3804696 - RNA, 21 nt, Salmonella typhimurium LT2
gcaggauucgaaccugcgacc

SEQ ID NO: 3804697 - RNA, 16 nt, Salmonella typhimurium LT2
gcaggcaaaaaagugu

SEQ ID NO: 3804698 - RNA, 21 nt, Salmonella typhimurium LT2
gcaggcaauauaccgucagca

SEQ ID NO: 3804699 - RNA, 18 nt, Salmonella typhimurium LT2
gcaggcauaaaaaagagg

SEQ ID NO: 3804700 - RNA, 17 nt, Salmonella typhimurium LT2
gcaggcaucgcgccgcc

SEQ ID NO: 3804701 - RNA, 18 nt, Salmonella typhimurium LT2
gcaggcauuaaaaaaacg

SEQ ID NO: 3804702 - RNA, 19 nt, Salmonella typhimurium LT2
gcaggccaaaaaaacgaag

SEQ ID NO: 3804703 - RNA, 17 nt, Salmonella typhimurium LT2
gcaggccaaaaaagccg

SEQ ID NO: 3804704 - RNA, 18 nt, Salmonella typhimurium LT2
gcaggcccgauaagcgcc

SEQ ID NO: 3804705 - RNA, 22 nt, Salmonella typhimurium LT2
gcaggcccgauaagcgccgcgc

SEQ ID NO: 3804706 - RNA, 19 nt, Salmonella typhimurium LT2
gcaggccuaacacaugcaa

SEQ ID NO: 3804707 - RNA, 18 nt, Salmonella typhimurium LT2
gcaggccuuucggcagcg

SEQ ID NO: 3804708 - RNA, 20 nt, Salmonella typhimurium LT2
gcaggcgaaaucaaaaggcg

SEQ ID NO: 3804709 - RNA, 17 nt, Salmonella typhimurium LT2
gcaggcgccgccauccg

SEQ ID NO: 3804710 - RNA, 16 nt, Salmonella typhimurium LT2
gcaggcggcuucgcau

SEQ ID NO: 3804711 - RNA, 19 nt, Salmonella typhimurium LT2
gcaggcgggugcgcagccc

SEQ ID NO: 3804712 - RNA, 20 nt, Salmonella typhimurium LT2
gcaggcgggugcgcagcccc

SEQ ID NO: 3804713 - RNA, 22 nt, Salmonella typhimurium LT2
gcaggcggugcgcagccacggc

SEQ ID NO: 3804714 - RNA, 19 nt, Salmonella typhimurium LT2
gcaggcgucauagccgcgc

SEQ ID NO: 3804715 - RNA, 20 nt, Salmonella typhimurium LT2
gcaggcgucauagccgcgcg

SEQ ID NO: 3804716 - RNA, 13 nt, Salmonella typhimurium LT2
gcaggcguuucaa

SEQ ID NO: 3804717 - RNA, 20 nt, Salmonella typhimurium LT2
gcaggcuaacgcgccccagg

SEQ ID NO: 3804718 - RNA, 15 nt, Salmonella typhimurium LT2
gcaggcuacgguacu

SEQ ID NO: 3804719 - RNA, 20 nt, Salmonella typhimurium LT2
gcaggcucucgguaguggca

SEQ ID NO: 3804720 - RNA, 20 nt, Salmonella typhimurium LT2
gcaggcuucacgcucacggu

SEQ ID NO: 3804721 - RNA, 20 nt, Salmonella typhimurium LT2
gcaggcuuccacgcacgccg

SEQ ID NO: 3804722 - RNA, 22 nt, Salmonella typhimurium LT2
gcaggcuuccacgcacgccggc

SEQ ID NO: 3804723 - RNA, 12 nt, Salmonella typhimurium LT2
gcaggcuuccag

SEQ ID NO: 3804724 - RNA, 15 nt, Salmonella typhimurium LT2
gcagggacuccugcg

SEQ ID NO: 3804725 - RNA, 21 nt, Salmonella typhimurium LT2
gcagggauauacaaauauccc

SEQ ID NO: 3804726 - RNA, 15 nt, Salmonella typhimurium LT2
gcagggcaauagcga

SEQ ID NO: 3804727 - RNA, 14 nt, Salmonella typhimurium LT2
gcagggccacaacg

SEQ ID NO: 3804728 - RNA, 17 nt, Salmonella typhimurium LT2
gcagggccgcguuaacg

SEQ ID NO: 3804729 - RNA, 18 nt, Salmonella typhimurium LT2
gcagggcgauauccagcg

SEQ ID NO: 3804730 - RNA, 20 nt, Salmonella typhimurium LT2
gcagggcgauauccagcgcc

SEQ ID NO: 3804731 - RNA, 21 nt, Salmonella typhimurium LT2
gcagggcgauauccagcgcca

SEQ ID NO: 3804732 - RNA, 20 nt, Salmonella typhimurium LT2
gcaggggcucuaaaaaggaa

SEQ ID NO: 3804733 - RNA, 18 nt, Salmonella typhimurium LT2
gcaggguauugccgagcg

SEQ ID NO: 3804734 - RNA, 19 nt, Salmonella typhimurium LT2
gcaggguauuugcgcccgc

SEQ ID NO: 3804735 - RNA, 20 nt, Salmonella typhimurium LT2
gcaggguauuugcgcccgcg

SEQ ID NO: 3804736 - RNA, 22 nt, Salmonella typhimurium LT2
gcagguaguaaccccaguagcc

SEQ ID NO: 3804737 - RNA, 18 nt, Salmonella typhimurium LT2
gcagguagucauauucac

SEQ ID NO: 3804738 - RNA, 14 nt, Salmonella typhimurium LT2
gcaggucgcguagu

SEQ ID NO: 3804739 - RNA, 14 nt, Salmonella typhimurium LT2
gcaggucggcccga

SEQ ID NO: 3804740 - RNA, 17 nt, Salmonella typhimurium LT2
gcaggugauggcggcuu

SEQ ID NO: 3804741 - RNA, 19 nt, Salmonella typhimurium LT2
gcaggugauggcggcuugg

SEQ ID NO: 3804742 - RNA, 16 nt, Salmonella typhimurium LT2
gcagguggaucugaau

SEQ ID NO: 3804743 - RNA, 16 nt, Salmonella typhimurium LT2
gcaggugguacaucaa

SEQ ID NO: 3804744 - RNA, 18 nt, Salmonella typhimurium LT2
gcagguugccgaugacuc

SEQ ID NO: 3804745 - RNA, 20 nt, Salmonella typhimurium LT2
gcagguugccgaugacuccc

SEQ ID NO: 3804746 - RNA, 15 nt, Salmonella typhimurium LT2
gcaguaaaaagaaag

SEQ ID NO: 3804747 - RNA, 17 nt, Salmonella typhimurium LT2
gcaguaacgccccacga

SEQ ID NO: 3804748 - RNA, 17 nt, Salmonella typhimurium LT2
gcaguaacuucagcauc

SEQ ID NO: 3804749 - RNA, 22 nt, Salmonella typhimurium LT2
gcaguaacuucagcaucaucuc

SEQ ID NO: 3804750 - RNA, 14 nt, Salmonella typhimurium LT2
gcaguaagccagcg

SEQ ID NO: 3804751 - RNA, 15 nt, Salmonella typhimurium LT2
gcaguaagccagcgg

SEQ ID NO: 3804752 - RNA, 23 nt, Salmonella typhimurium LT2
gcaguaauuucuugcgccagcgc

SEQ ID NO: 3804753 - RNA, 17 nt, Salmonella typhimurium LT2
gcaguacacgcaucggg

SEQ ID NO: 3804754 - RNA, 16 nt, Salmonella typhimurium LT2
gcaguacgccaaaaaa

SEQ ID NO: 3804755 - RNA, 14 nt, Salmonella typhimurium LT2
gcaguacgcgccau

SEQ ID NO: 3804756 - RNA, 21 nt, Salmonella typhimurium LT2
gcaguagccacgguaacagcu

SEQ ID NO: 3804757 - RNA, 21 nt, Salmonella typhimurium LT2
gcaguagugugguauucagcc

SEQ ID NO: 3804758 - RNA, 22 nt, Salmonella typhimurium LT2
gcaguagugugguauucagccc

SEQ ID NO: 3804759 - RNA, 17 nt, Salmonella typhimurium LT2
gcaguauugcaccagga

SEQ ID NO: 3804760 - RNA, 21 nt, Salmonella typhimurium LT2
gcagucacuuucagauuuuua

SEQ ID NO: 3804761 - RNA, 21 nt, Salmonella typhimurium LT2
gcagucagccuugaccgccug

SEQ ID NO: 3804762 - RNA, 13 nt, Salmonella typhimurium LT2
gcaguccaacaag

SEQ ID NO: 3804763 - RNA, 14 nt, Salmonella typhimurium LT2
gcaguccguccaga

SEQ ID NO: 3804764 - RNA, 18 nt, Salmonella typhimurium LT2
gcagucguucacgcgcuu

SEQ ID NO: 3804765 - RNA, 15 nt, Salmonella typhimurium LT2
gcagugacagaggaa

SEQ ID NO: 3804766 - RNA, 16 nt, Salmonella typhimurium LT2
gcagugaccagcauca

SEQ ID NO: 3804767 - RNA, 18 nt, Salmonella typhimurium LT2
gcagugauucguaguaag

SEQ ID NO: 3804768 - RNA, 12 nt, Salmonella typhimurium LT2
gcagugauuuua

SEQ ID NO: 3804769 - RNA, 16 nt, Salmonella typhimurium LT2
gcagugccgguugccu

SEQ ID NO: 3804770 - RNA, 17 nt, Salmonella typhimurium LT2
gcagugccgguugccug

SEQ ID NO: 3804771 - RNA, 18 nt, Salmonella typhimurium LT2
gcaguggcauguucccau

SEQ ID NO: 3804772 - RNA, 15 nt, Salmonella typhimurium LT2
gcaguggcucaguca

SEQ ID NO: 3804773 - RNA, 18 nt, Salmonella typhimurium LT2
gcaguguaucguugucgc

SEQ ID NO: 3804774 - RNA, 18 nt, Salmonella typhimurium LT2
gcaguucguacuccugca

SEQ ID NO: 3804775 - RNA, 14 nt, Salmonella typhimurium LT2
gcaguugaucguaa

SEQ ID NO: 3804776 - RNA, 14 nt, Salmonella typhimurium LT2
gcaguugcgcgucu

SEQ ID NO: 3804777 - RNA, 18 nt, Salmonella typhimurium LT2
gcaguugggcgcgcgacu

SEQ ID NO: 3804778 - RNA, 14 nt, Salmonella typhimurium LT2
gcaguuuaaagcca

SEQ ID NO: 3804779 - RNA, 17 nt, Salmonella typhimurium LT2
gcaguuuuccagcgccu

SEQ ID NO: 3804780 - RNA, 14 nt, Salmonella typhimurium LT2
gcauaaaaaagagg

SEQ ID NO: 3804781 - RNA, 19 nt, Salmonella typhimurium LT2
gcauaaaaaagauugcugu

SEQ ID NO: 3804782 - RNA, 14 nt, Salmonella typhimurium LT2
gcauaaaaaaugag

SEQ ID NO: 3804783 - RNA, 17 nt, Salmonella typhimurium LT2
gcauaaaaccgccgccc

SEQ ID NO: 3804784 - RNA, 19 nt, Salmonella typhimurium LT2
gcauaaaaccgccgcccau

SEQ ID NO: 3804785 - RNA, 23 nt, Salmonella typhimurium LT2
gcauaaacgccuuauccggccug

SEQ ID NO: 3804786 - RNA, 16 nt, Salmonella typhimurium LT2
gcauaaacgcggccau

SEQ ID NO: 3804787 - RNA, 15 nt, Salmonella typhimurium LT2
gcauaaagaacgugu

SEQ ID NO: 3804788 - RNA, 12 nt, Salmonella typhimurium LT2
gcauaaauaaua

SEQ ID NO: 3804789 - RNA, 15 nt, Salmonella typhimurium LT2
gcauaaaugcgauga

SEQ ID NO: 3804790 - RNA, 13 nt, Salmonella typhimurium LT2
gcauaacccgccg

SEQ ID NO: 3804791 - RNA, 15 nt, Salmonella typhimurium LT2
gcaugaauucaacgc

SEQ ID NO: 3804792 - RNA, 14 nt, Salmonella typhimurium LT2
gcaugaccauccac

SEQ ID NO: 3804793 - RNA, 14 nt, Salmonella typhimurium LT2
gcaugacccaggca

SEQ ID NO: 3804794 - RNA, 16 nt, Salmonella typhimurium LT2
gcaugacgcaggcgca

SEQ ID NO: 3804795 - RNA, 16 nt, Salmonella typhimurium LT2
gcaugagccagcccuc

SEQ ID NO: 3804796 - RNA, 18 nt, Salmonella typhimurium LT2
gcaugagguuaguaaugc

SEQ ID NO: 3804797 - RNA, 15 nt, Salmonella typhimurium LT2
gcaugaucggcuggg

SEQ ID NO: 3804798 - RNA, 13 nt, Salmonella typhimurium LT2
gcaugauggcgaa

SEQ ID NO: 3804799 - RNA, 21 nt, Salmonella typhimurium LT2
gcaugauggcgaacagcccca

SEQ ID NO: 3804800 - RNA, 16 nt, Salmonella typhimurium LT2
gcaugauggucgccag

SEQ ID NO: 3804801 - RNA, 12 nt, Salmonella typhimurium LT2
gcaugauuaaua

SEQ ID NO: 3804802 - RNA, 13 nt, Salmonella typhimurium LT2
gcaugauuacaga

SEQ ID NO: 3804803 - RNA, 20 nt, Salmonella typhimurium LT2
gcaugcccgccagcgggccg

SEQ ID NO: 3804804 - RNA, 22 nt, Salmonella typhimurium LT2
gcaugcgccccguuuccgcgac

SEQ ID NO: 3804805 - RNA, 15 nt, Salmonella typhimurium LT2
gcaugcguaaauuga

SEQ ID NO: 3804806 - RNA, 14 nt, Salmonella typhimurium LT2
gcauggaagaaaau

SEQ ID NO: 3804807 - RNA, 15 nt, Salmonella typhimurium LT2
gcauggagcaucagc

SEQ ID NO: 3804808 - RNA, 23 nt, Salmonella typhimurium LT2
gcauggcagauaaaccacgccgu

SEQ ID NO: 3804809 - RNA, 17 nt, Salmonella typhimurium LT2
gcauggcggucagcuuu

SEQ ID NO: 3804810 - RNA, 21 nt, Salmonella typhimurium LT2
gcaugggauacgccagcagac

SEQ ID NO: 3804811 - RNA, 14 nt, Salmonella typhimurium LT2
gcauggggagaccc

SEQ ID NO: 3804812 - RNA, 22 nt, Salmonella typhimurium LT2
gcauggggagaccccacacuac

SEQ ID NO: 3804813 - RNA, 23 nt, Salmonella typhimurium LT2
gcauggugacuccccacaauccc

SEQ ID NO: 3804814 - RNA, 21 nt, Salmonella typhimurium LT2
gcaugguguguucccgcgcca

SEQ ID NO: 3804815 - RNA, 21 nt, Salmonella typhimurium LT2
gcaugguuaacaauauugcgc

SEQ ID NO: 3804816 - RNA, 19 nt, Salmonella typhimurium LT2
gcauguccggcgacuccag

SEQ ID NO: 3804817 - RNA, 12 nt, Salmonella typhimurium LT2
gcaugugaguau

SEQ ID NO: 3804818 - RNA, 18 nt, Salmonella typhimurium LT2
gcauguucacaucgcuca

SEQ ID NO: 3804819 - RNA, 23 nt, Salmonella typhimurium LT2
gcauguuucuccugccagcgacg

SEQ ID NO: 3804820 - RNA, 15 nt, Salmonella typhimurium LT2
gcauuaaaaaaaaga

SEQ ID NO: 3804821 - RNA, 14 nt, Salmonella typhimurium LT2
gcauuaaaaugaug

SEQ ID NO: 3804822 - RNA, 19 nt, Salmonella typhimurium LT2
gcauuaaccugauccagga

SEQ ID NO: 3804823 - RNA, 15 nt, Salmonella typhimurium LT2
gcauuaacguccaua

SEQ ID NO: 3804824 - RNA, 13 nt, Salmonella typhimurium LT2
gcauuaauaucca

SEQ ID NO: 3804825 - RNA, 14 nt, Salmonella typhimurium LT2
gcauuaauggcgau

SEQ ID NO: 3804826 - RNA, 15 nt, Salmonella typhimurium LT2
gcauuaauuucuugc

SEQ ID NO: 3804827 - RNA, 14 nt, Salmonella typhimurium LT2
gcauuacgcuggcc

SEQ ID NO: 3804828 - RNA, 15 nt, Salmonella typhimurium LT2
gcauuauaagcgcca

SEQ ID NO: 3804829 - RNA, 22 nt, Salmonella typhimurium LT2
gcauuauguaauaacugacgau

SEQ ID NO: 3804830 - RNA, 15 nt, Salmonella typhimurium LT2
gcauuauucggcuuu

SEQ ID NO: 3804831 - RNA, 12 nt, Salmonella typhimurium LT2
gcauucacgccg

SEQ ID NO: 3804832 - RNA, 23 nt, Salmonella typhimurium LT2
gcauucagacauuuauuuggcaa

SEQ ID NO: 3804833 - RNA, 14 nt, Salmonella typhimurium LT2
gcauucagccagcu

SEQ ID NO: 3804834 - RNA, 15 nt, Salmonella typhimurium LT2
gcauucaguuugcaa

SEQ ID NO: 3804835 - RNA, 16 nt, Salmonella typhimurium LT2
gcauucaguuugcaac

SEQ ID NO: 3804836 - RNA, 21 nt, Salmonella typhimurium LT2
gcauucgcggcaagcggugua

SEQ ID NO: 3804837 - RNA, 14 nt, Salmonella typhimurium LT2
gcauucgcuccuca

SEQ ID NO: 3804838 - RNA, 16 nt, Salmonella typhimurium LT2
gcauucgcuccucagc

SEQ ID NO: 3804839 - RNA, 15 nt, Salmonella typhimurium LT2
gcauucugcaacugu

SEQ ID NO: 3804840 - RNA, 23 nt, Salmonella typhimurium LT2
gcauucuuugcuuuguaaagcgc

SEQ ID NO: 3804841 - RNA, 12 nt, Salmonella typhimurium LT2
gcauucuuuuag

SEQ ID NO: 3804842 - RNA, 13 nt, Salmonella typhimurium LT2
gcauugacgugcu

SEQ ID NO: 3804843 - RNA, 13 nt, Salmonella typhimurium LT2
gcauugcagcgca

SEQ ID NO: 3804844 - RNA, 21 nt, Salmonella typhimurium LT2
gcauugccaugaugagcgcca

SEQ ID NO: 3804845 - RNA, 21 nt, Salmonella typhimurium LT2
gcauugcccuucgcgcgauaa

SEQ ID NO: 3804846 - RNA, 13 nt, Salmonella typhimurium LT2
gcauugccggaaa

SEQ ID NO: 3804847 - RNA, 16 nt, Salmonella typhimurium LT2
gcauugccggaaacca

SEQ ID NO: 3804848 - RNA, 18 nt, Salmonella typhimurium LT2
gcauugggauggauaaau

SEQ ID NO: 3804849 - RNA, 23 nt, Salmonella typhimurium LT2
gcauugggccgauaaagcgaccg

SEQ ID NO: 3804850 - RNA, 15 nt, Salmonella typhimurium LT2
gcauugguaaauccg

SEQ ID NO: 3804851 - RNA, 22 nt, Salmonella typhimurium LT2
gcauugguggggcuaagugagc

SEQ ID NO: 3804852 - RNA, 19 nt, Salmonella typhimurium LT2
gcauuguuaauccagagcg

SEQ ID NO: 3804853 - RNA, 14 nt, Salmonella typhimurium LT2
gcauuuaggucuug

SEQ ID NO: 3804854 - RNA, 16 nt, Salmonella typhimurium LT2
gcauuucaaucgccac

SEQ ID NO: 3804855 - RNA, 16 nt, Salmonella typhimurium LT2
gcauuucccauccgcc

SEQ ID NO: 3804856 - RNA, 17 nt, Salmonella typhimurium LT2
gcauuucgccaguucca

SEQ ID NO: 3804857 - RNA, 12 nt, Salmonella typhimurium LT2
gcauuucuucaa

SEQ ID NO: 3804858 - RNA, 17 nt, Salmonella typhimurium LT2
gcauuuuaucuuuuguu

SEQ ID NO: 3804859 - RNA, 20 nt, Salmonella typhimurium LT2
gcauuuucgucugccggaaa

SEQ ID NO: 3804860 - RNA, 17 nt, Salmonella typhimurium LT2
gcauuuuuacucagcac

SEQ ID NO: 3804861 - RNA, 14 nt, Salmonella typhimurium LT2
gcauuuuuucuuca

SEQ ID NO: 3804862 - RNA, 17 nt, Salmonella typhimurium LT2
gccaaaaauaucgccgu

SEQ ID NO: 3804863 - RNA, 11 nt, Salmonella typhimurium LT2
gccaaaaaugg

SEQ ID NO: 3804864 - RNA, 19 nt, Salmonella typhimurium LT2
gccaaaacccaccagcagg

SEQ ID NO: 3804865 - RNA, 20 nt, Salmonella typhimurium LT2
gccaaaacccagaaucagca

SEQ ID NO: 3804866 - RNA, 22 nt, Salmonella typhimurium LT2
gccaaaacccuucgcaacaggu

SEQ ID NO: 3804867 - RNA, 23 nt, Salmonella typhimurium LT2
gccaaaagaaguggcaaucgaga

SEQ ID NO: 3804868 - RNA, 16 nt, Salmonella typhimurium LT2
gccaaaagaggcagca

SEQ ID NO: 3804869 - RNA, 17 nt, Salmonella typhimurium LT2
gccaaaagaggcagcaa

SEQ ID NO: 3804870 - RNA, 14 nt, Salmonella typhimurium LT2
gccaaacacccagc

SEQ ID NO: 3804871 - RNA, 21 nt, Salmonella typhimurium LT2
gccaaacacccagccccccua

SEQ ID NO: 3804872 - RNA, 14 nt, Salmonella typhimurium LT2
gccaaaccacugau

SEQ ID NO: 3804873 - RNA, 17 nt, Salmonella typhimurium LT2
gccaaaccagacccgcu

SEQ ID NO: 3804874 - RNA, 19 nt, Salmonella typhimurium LT2
gccaaacccgccacaggcc

SEQ ID NO: 3804875 - RNA, 16 nt, Salmonella typhimurium LT2
gccaaacgccgcaacc

SEQ ID NO: 3804876 - RNA, 17 nt, Salmonella typhimurium LT2
gccaaacuccaccugau

SEQ ID NO: 3804877 - RNA, 16 nt, Salmonella typhimurium LT2
gccaaacucuuccacc

SEQ ID NO: 3804878 - RNA, 21 nt, Salmonella typhimurium LT2
gccaaacucuuuuucaauaaa

SEQ ID NO: 3804879 - RNA, 20 nt, Salmonella typhimurium LT2
gccaaagaaacgcugaucua

SEQ ID NO: 3804880 - RNA, 17 nt, Salmonella typhimurium LT2
gccaaagggagcagacu

SEQ ID NO: 3804881 - RNA, 21 nt, Salmonella typhimurium LT2
gccaaagucauugcugccagu

SEQ ID NO: 3804882 - RNA, 22 nt, Salmonella typhimurium LT2
gccaaauacgucgcacggauca

SEQ ID NO: 3804883 - RNA, 14 nt, Salmonella typhimurium LT2
gccaaauagcgcca

SEQ ID NO: 3804884 - RNA, 19 nt, Salmonella typhimurium LT2
gccaaaucaugcccaacug

SEQ ID NO: 3804885 - RNA, 13 nt, Salmonella typhimurium LT2
gccaaauccggcu

SEQ ID NO: 3804886 - RNA, 18 nt, Salmonella typhimurium LT2
gccaaaucuguucugucc

SEQ ID NO: 3804887 - RNA, 21 nt, Salmonella typhimurium LT2
gccaaauuuucaaccacggau

SEQ ID NO: 3804888 - RNA, 23 nt, Salmonella typhimurium LT2
gccaacaaagaggcugcgcgaau

SEQ ID NO: 3804889 - RNA, 16 nt, Salmonella typhimurium LT2
gccaacagaagauccu

SEQ ID NO: 3804890 - RNA, 22 nt, Salmonella typhimurium LT2
gccaacagccgcccacaaccga

SEQ ID NO: 3804891 - RNA, 16 nt, Salmonella typhimurium LT2
gccaacaggucgauga

SEQ ID NO: 3804892 - RNA, 21 nt, Salmonella typhimurium LT2
gccaacaggucgaugauuuuc

SEQ ID NO: 3804893 - RNA, 19 nt, Salmonella typhimurium LT2
gccaacauagccacaggcu

SEQ ID NO: 3804894 - RNA, 16 nt, Salmonella typhimurium LT2
gccaacauagcggcaa

SEQ ID NO: 3804895 - RNA, 14 nt, Salmonella typhimurium LT2
gccagaggaaaucc

SEQ ID NO: 3804896 - RNA, 16 nt, Salmonella typhimurium LT2
gccagaggcggcgcca

SEQ ID NO: 3804897 - RNA, 20 nt, Salmonella typhimurium LT2
gccagaggcgguucugggca

SEQ ID NO: 3804898 - RNA, 14 nt, Salmonella typhimurium LT2
gccagauaaagcag

SEQ ID NO: 3804899 - RNA, 18 nt, Salmonella typhimurium LT2
gccagauaaagcagcgac

SEQ ID NO: 3804900 - RNA, 14 nt, Salmonella typhimurium LT2
gccagauaaaucag

SEQ ID NO: 3804901 - RNA, 15 nt, Salmonella typhimurium LT2
gccagauaaucgccg

SEQ ID NO: 3804902 - RNA, 21 nt, Salmonella typhimurium LT2
gccagauaguaaugcucaacu

SEQ ID NO: 3804903 - RNA, 21 nt, Salmonella typhimurium LT2
gccagaucgaacagcggcaga

SEQ ID NO: 3804904 - RNA, 17 nt, Salmonella typhimurium LT2
gccagaucgugccagau

SEQ ID NO: 3804905 - RNA, 17 nt, Salmonella typhimurium LT2
gccagaucucacaagau

SEQ ID NO: 3804906 - RNA, 20 nt, Salmonella typhimurium LT2
gccagaucucacaagauuca

SEQ ID NO: 3804907 - RNA, 19 nt, Salmonella typhimurium LT2
gccagaugaucagcauagc

SEQ ID NO: 3804908 - RNA, 18 nt, Salmonella typhimurium LT2
gccagauggauaaccugc

SEQ ID NO: 3804909 - RNA, 19 nt, Salmonella typhimurium LT2
gccagauggauaaccugcc

SEQ ID NO: 3804910 - RNA, 13 nt, Salmonella typhimurium LT2
gccagauggcugc

SEQ ID NO: 3804911 - RNA, 14 nt, Salmonella typhimurium LT2
gccagauguaggcc

SEQ ID NO: 3804912 - RNA, 20 nt, Salmonella typhimurium LT2
gccagauguaggccugauaa

SEQ ID NO: 3804913 - RNA, 17 nt, Salmonella typhimurium LT2
gccagauuaucggccag

SEQ ID NO: 3804914 - RNA, 14 nt, Salmonella typhimurium LT2
gccagauucaccac

SEQ ID NO: 3804915 - RNA, 23 nt, Salmonella typhimurium LT2
gccagauuuuccaggccgccagc

SEQ ID NO: 3804916 - RNA, 14 nt, Salmonella typhimurium LT2
gccagcaacagcgu

SEQ ID NO: 3804917 - RNA, 16 nt, Salmonella typhimurium LT2
gccagcaacccaccug

SEQ ID NO: 3804918 - RNA, 16 nt, Salmonella typhimurium LT2
gccagcaacgcgcuaa

SEQ ID NO: 3804919 - RNA, 20 nt, Salmonella typhimurium LT2
gccagcaaggcugccgccag

SEQ ID NO: 3804920 - RNA, 22 nt, Salmonella typhimurium LT2
gccagcaaugccgccgccaggu

SEQ ID NO: 3804921 - RNA, 15 nt, Salmonella typhimurium LT2
gccagcaccagcagc

SEQ ID NO: 3804922 - RNA, 15 nt, Salmonella typhimurium LT2
gccagcaccagcagu

SEQ ID NO: 3804923 - RNA, 16 nt, Salmonella typhimurium LT2
gccagcaccaggcucg

SEQ ID NO: 3804924 - RNA, 18 nt, Salmonella typhimurium LT2
gccagcagaagacggaaa

SEQ ID NO: 3804925 - RNA, 23 nt, Salmonella typhimurium LT2
gccagcagacaggugaacauuac

SEQ ID NO: 3804926 - RNA, 18 nt, Salmonella typhimurium LT2
gccagcagcgcaucaucc

SEQ ID NO: 3804927 - RNA, 22 nt, Salmonella typhimurium LT2
gccagcagcguuuugcgcguaa

SEQ ID NO: 3804928 - RNA, 19 nt, Salmonella typhimurium LT2
gccagcagcucaacggcag

SEQ ID NO: 3804929 - RNA, 22 nt, Salmonella typhimurium LT2
gccagcagguaucccaauaccg

SEQ ID NO: 3804930 - RNA, 17 nt, Salmonella typhimurium LT2
gccagcaguugcagcgu

SEQ ID NO: 3804931 - RNA, 15 nt, Salmonella typhimurium LT2
gccagcauacagcuu

SEQ ID NO: 3804932 - RNA, 21 nt, Salmonella typhimurium LT2
gccagcaucaugggcucauca

SEQ ID NO: 3804933 - RNA, 15 nt, Salmonella typhimurium LT2
gccagcaugauaaug

SEQ ID NO: 3804934 - RNA, 16 nt, Salmonella typhimurium LT2
gccagcauuuuuccac

SEQ ID NO: 3804935 - RNA, 14 nt, Salmonella typhimurium LT2
gccagccaaagcug

SEQ ID NO: 3804936 - RNA, 13 nt, Salmonella typhimurium LT2
gccagccagccgu

SEQ ID NO: 3804937 - RNA, 14 nt, Salmonella typhimurium LT2
gccagccagcgggc

SEQ ID NO: 3804938 - RNA, 19 nt, Salmonella typhimurium LT2
gccagccagucgccaggca

SEQ ID NO: 3804939 - RNA, 23 nt, Salmonella typhimurium LT2
gccagccauggcccaaaagguag

SEQ ID NO: 3804940 - RNA, 22 nt, Salmonella typhimurium LT2
gccagccauugcccggccuccg

SEQ ID NO: 3804941 - RNA, 20 nt, Salmonella typhimurium LT2
gccagccccaccguccacau

SEQ ID NO: 3804942 - RNA, 14 nt, Salmonella typhimurium LT2
gccagccccagccc

SEQ ID NO: 3804943 - RNA, 22 nt, Salmonella typhimurium LT2
gccagcccgacuaccggcacca

SEQ ID NO: 3804944 - RNA, 20 nt, Salmonella typhimurium LT2
gccagcccgaucaucuccug

SEQ ID NO: 3804945 - RNA, 23 nt, Salmonella typhimurium LT2
gccagcccgugaucggagaaaua

SEQ ID NO: 3804946 - RNA, 20 nt, Salmonella typhimurium LT2
gccagcccuaaggucacgcc

SEQ ID NO: 3804947 - RNA, 22 nt, Salmonella typhimurium LT2
gccagcccugcgaucaucauuc

SEQ ID NO: 3804948 - RNA, 15 nt, Salmonella typhimurium LT2
gccagcccuuccagc

SEQ ID NO: 3804949 - RNA, 22 nt, Salmonella typhimurium LT2
gccagccgacgcucuuccucaa

SEQ ID NO: 3804950 - RNA, 19 nt, Salmonella typhimurium LT2
gccagccgcagcucauaac

SEQ ID NO: 3804951 - RNA, 20 nt, Salmonella typhimurium LT2
gccagccgcgccaucuccuc

SEQ ID NO: 3804952 - RNA, 18 nt, Salmonella typhimurium LT2
gccagccggagagcagua

SEQ ID NO: 3804953 - RNA, 19 nt, Salmonella typhimurium LT2
gccagccggauacugcgcu

SEQ ID NO: 3804954 - RNA, 15 nt, Salmonella typhimurium LT2
gccagccugcgccag

SEQ ID NO: 3804955 - RNA, 12 nt, Salmonella typhimurium LT2
gccagccuuccc

SEQ ID NO: 3804956 - RNA, 17 nt, Salmonella typhimurium LT2
gccagcgacagguguua

SEQ ID NO: 3804957 - RNA, 14 nt, Salmonella typhimurium LT2
gccagcgagaaguc

SEQ ID NO: 3804958 - RNA, 23 nt, Salmonella typhimurium LT2
gccagcgagacuuuugccggaga

SEQ ID NO: 3804959 - RNA, 21 nt, Salmonella typhimurium LT2
gccagcgaugagcgccagcaa

SEQ ID NO: 3804960 - RNA, 17 nt, Salmonella typhimurium LT2
gccagcgcaacgcgcau

SEQ ID NO: 3804961 - RNA, 22 nt, Salmonella typhimurium LT2
gccagcgcagcguggccuuauc

SEQ ID NO: 3804962 - RNA, 14 nt, Salmonella typhimurium LT2
gccagcgcauccac

SEQ ID NO: 3804963 - RNA, 14 nt, Salmonella typhimurium LT2
gccagcgccagcgu

SEQ ID NO: 3804964 - RNA, 15 nt, Salmonella typhimurium LT2
gccagcgccaguacu

SEQ ID NO: 3804965 - RNA, 18 nt, Salmonella typhimurium LT2
gccagcgccggcgaauca

SEQ ID NO: 3804966 - RNA, 20 nt, Salmonella typhimurium LT2
gccagcgccggcgaaucacc

SEQ ID NO: 3804967 - RNA, 14 nt, Salmonella typhimurium LT2
gccagcgccuuagg

SEQ ID NO: 3804968 - RNA, 14 nt, Salmonella typhimurium LT2
gccagcgcgggcga

SEQ ID NO: 3804969 - RNA, 19 nt, Salmonella typhimurium LT2
gccagcgcguuuuccauuu

SEQ ID NO: 3804970 - RNA, 22 nt, Salmonella typhimurium LT2
gccagcgcguuuuccauuuuac

SEQ ID NO: 3804971 - RNA, 19 nt, Salmonella typhimurium LT2
gccagcgcugacaucaucc

SEQ ID NO: 3804972 - RNA, 18 nt, Salmonella typhimurium LT2
gccagcggaucgcgucca

SEQ ID NO: 3804973 - RNA, 15 nt, Salmonella typhimurium LT2
gccagcggcagcgcg

SEQ ID NO: 3804974 - RNA, 13 nt, Salmonella typhimurium LT2
gccagcgggcgga

SEQ ID NO: 3804975 - RNA, 14 nt, Salmonella typhimurium LT2
gccagcgggcugca

SEQ ID NO: 3804976 - RNA, 22 nt, Salmonella typhimurium LT2
gccagcgguugcggagaucauc

SEQ ID NO: 3804977 - RNA, 22 nt, Salmonella typhimurium LT2
gccagcgguuucauauggguaa

SEQ ID NO: 3804978 - RNA, 16 nt, Salmonella typhimurium LT2
gccagcgucgccaugc

SEQ ID NO: 3804979 - RNA, 18 nt, Salmonella typhimurium LT2
gccagcgucucagcaggc

SEQ ID NO: 3804980 - RNA, 20 nt, Salmonella typhimurium LT2
gccagcgucucagcaggcgg

SEQ ID NO: 3804981 - RNA, 16 nt, Salmonella typhimurium LT2
gccagcgugacccaga

SEQ ID NO: 3804982 - RNA, 18 nt, Salmonella typhimurium LT2
gccagcgugacccagaca

SEQ ID NO: 3804983 - RNA, 15 nt, Salmonella typhimurium LT2
gccagcguugcccau

SEQ ID NO: 3804984 - RNA, 16 nt, Salmonella typhimurium LT2
gccagcucaaaucgcg

SEQ ID NO: 3804985 - RNA, 20 nt, Salmonella typhimurium LT2
gccagcucaugcgcggcggg

SEQ ID NO: 3804986 - RNA, 20 nt, Salmonella typhimurium LT2
gccagcucgucggccagcgc

SEQ ID NO: 3804987 - RNA, 14 nt, Salmonella typhimurium LT2
gccagcucuuuucu

SEQ ID NO: 3804988 - RNA, 16 nt, Salmonella typhimurium LT2
gccagcucuuuucugg

SEQ ID NO: 3804989 - RNA, 23 nt, Salmonella typhimurium LT2
gccagcugaaacagaauaaacgg

SEQ ID NO: 3804990 - RNA, 14 nt, Salmonella typhimurium LT2
gccaggaacgguac

SEQ ID NO: 3804991 - RNA, 19 nt, Salmonella typhimurium LT2
gccaggaagucagcuuccu

SEQ ID NO: 3804992 - RNA, 15 nt, Salmonella typhimurium LT2
gccaggauaauaaug

SEQ ID NO: 3804993 - RNA, 16 nt, Salmonella typhimurium LT2
gccaggauaucgcccg

SEQ ID NO: 3804994 - RNA, 17 nt, Salmonella typhimurium LT2
gccaggauaucuuccac

SEQ ID NO: 3804995 - RNA, 17 nt, Salmonella typhimurium LT2
gccaggaucgccgcugc

SEQ ID NO: 3804996 - RNA, 17 nt, Salmonella typhimurium LT2
gccaggcaaccugucag

SEQ ID NO: 3804997 - RNA, 16 nt, Salmonella typhimurium LT2
gccaggcaaucagcag

SEQ ID NO: 3804998 - RNA, 13 nt, Salmonella typhimurium LT2
gccaggcacgccg

SEQ ID NO: 3804999 - RNA, 14 nt, Salmonella typhimurium LT2
gccaucguccagcc

SEQ ID NO: 3805000 - RNA, 15 nt, Salmonella typhimurium LT2
gccaucguccagcca

SEQ ID NO: 3805001 - RNA, 15 nt, Salmonella typhimurium LT2
gccaucucauucgcc

SEQ ID NO: 3805002 - RNA, 17 nt, Salmonella typhimurium LT2
gccaucuccaucauuuc

SEQ ID NO: 3805003 - RNA, 13 nt, Salmonella typhimurium LT2
gccaucuccugcg

SEQ ID NO: 3805004 - RNA, 14 nt, Salmonella typhimurium LT2
gccaucuuccaacu

SEQ ID NO: 3805005 - RNA, 18 nt, Salmonella typhimurium LT2
gccaucuuccagcaucag

SEQ ID NO: 3805006 - RNA, 15 nt, Salmonella typhimurium LT2
gccaucuuuuuucac

SEQ ID NO: 3805007 - RNA, 14 nt, Salmonella typhimurium LT2
gccaugaaaaaaac

SEQ ID NO: 3805008 - RNA, 18 nt, Salmonella typhimurium LT2
gccaugaacgacccgcgc

SEQ ID NO: 3805009 - RNA, 22 nt, Salmonella typhimurium LT2
gccaugaccauucgcacuccag

SEQ ID NO: 3805010 - RNA, 17 nt, Salmonella typhimurium LT2
gccaugagacgcguaaa

SEQ ID NO: 3805011 - RNA, 20 nt, Salmonella typhimurium LT2
gccaugagacgcguaaauca

SEQ ID NO: 3805012 - RNA, 13 nt, Salmonella typhimurium LT2
gccaugaucgccg

SEQ ID NO: 3805013 - RNA, 15 nt, Salmonella typhimurium LT2
gccaugaucgccgcc

SEQ ID NO: 3805014 - RNA, 16 nt, Salmonella typhimurium LT2
gccaugaucgccgcca

SEQ ID NO: 3805015 - RNA, 12 nt, Salmonella typhimurium LT2
gccaugauucau

SEQ ID NO: 3805016 - RNA, 15 nt, Salmonella typhimurium LT2
gccaugccagcaguu

SEQ ID NO: 3805017 - RNA, 18 nt, Salmonella typhimurium LT2
gccaugcccggcggcggc

SEQ ID NO: 3805018 - RNA, 18 nt, Salmonella typhimurium LT2
gccaugccugauggcgca

SEQ ID NO: 3805019 - RNA, 14 nt, Salmonella typhimurium LT2
gccaugcggcgcca

SEQ ID NO: 3805020 - RNA, 23 nt, Salmonella typhimurium LT2
gccaugcgggugacgcuggcgga

SEQ ID NO: 3805021 - RNA, 17 nt, Salmonella typhimurium LT2
gccaugcuuuccgggcc

SEQ ID NO: 3805022 - RNA, 14 nt, Salmonella typhimurium LT2
gccaugucuucacu

SEQ ID NO: 3805023 - RNA, 16 nt, Salmonella typhimurium LT2
gccaugucuucacucu

SEQ ID NO: 3805024 - RNA, 20 nt, Salmonella typhimurium LT2
gccauguuaauaccagcgcc

SEQ ID NO: 3805025 - RNA, 16 nt, Salmonella typhimurium LT2
gccauuaaugcaggca

SEQ ID NO: 3805026 - RNA, 20 nt, Salmonella typhimurium LT2
gccauuaaugcaggcagcac

SEQ ID NO: 3805027 - RNA, 20 nt, Salmonella typhimurium LT2
gccauuaauuucuuaccaaa

SEQ ID NO: 3805028 - RNA, 13 nt, Salmonella typhimurium LT2
gccauuauuuauu

SEQ ID NO: 3805029 - RNA, 15 nt, Salmonella typhimurium LT2
gccauuccagccggu

SEQ ID NO: 3805030 - RNA, 21 nt, Salmonella typhimurium LT2
gccauuccagccgguguuaac

SEQ ID NO: 3805031 - RNA, 12 nt, Salmonella typhimurium LT2
gccauuccagcg

SEQ ID NO: 3805032 - RNA, 16 nt, Salmonella typhimurium LT2
gccauuccccacgcca

SEQ ID NO: 3805033 - RNA, 17 nt, Salmonella typhimurium LT2
gccauuccgcagaagcc

SEQ ID NO: 3805034 - RNA, 15 nt, Salmonella typhimurium LT2
gccauucgaauucug

SEQ ID NO: 3805035 - RNA, 15 nt, Salmonella typhimurium LT2
gccauucgcuuccgc

SEQ ID NO: 3805036 - RNA, 17 nt, Salmonella typhimurium LT2
gccauugcguaaacgcu

SEQ ID NO: 3805037 - RNA, 15 nt, Salmonella typhimurium LT2
gccauugcugcuaua

SEQ ID NO: 3805038 - RNA, 19 nt, Salmonella typhimurium LT2
gccauugcugucgacaaua

SEQ ID NO: 3805039 - RNA, 15 nt, Salmonella typhimurium LT2
gccauuggcaaucag

SEQ ID NO: 3805040 - RNA, 22 nt, Salmonella typhimurium LT2
gccauuggcuauuuuuugcugg

SEQ ID NO: 3805041 - RNA, 20 nt, Salmonella typhimurium LT2
gccauuucgccuauuuucuc

SEQ ID NO: 3805042 - RNA, 16 nt, Salmonella typhimurium LT2
gccauuucugccugau

SEQ ID NO: 3805043 - RNA, 14 nt, Salmonella typhimurium LT2
gccauuucugcuca

SEQ ID NO: 3805044 - RNA, 19 nt, Salmonella typhimurium LT2
gccauuuuugcaucaucac

SEQ ID NO: 3805045 - RNA, 14 nt, Salmonella typhimurium LT2
gcccaaaucaauua

SEQ ID NO: 3805046 - RNA, 18 nt, Salmonella typhimurium LT2
gcccaacggaugcgccau

SEQ ID NO: 3805047 - RNA, 18 nt, Salmonella typhimurium LT2
gcccaacuguuaucauag

SEQ ID NO: 3805048 - RNA, 13 nt, Salmonella typhimurium LT2
gcccaauccggcu

SEQ ID NO: 3805049 - RNA, 19 nt, Salmonella typhimurium LT2
gcccaauguuuuaccggca

SEQ ID NO: 3805050 - RNA, 14 nt, Salmonella typhimurium LT2
gcccacaggcaggg

SEQ ID NO: 3805051 - RNA, 15 nt, Salmonella typhimurium LT2
gcccaccagucccug

SEQ ID NO: 3805052 - RNA, 22 nt, Salmonella typhimurium LT2
gcccaccggagcggcguccgcc

SEQ ID NO: 3805053 - RNA, 23 nt, Salmonella typhimurium LT2
gcccaccggagcggcguccgcca

SEQ ID NO: 3805054 - RNA, 15 nt, Salmonella typhimurium LT2
gcccaccuucgcgga

SEQ ID NO: 3805055 - RNA, 15 nt, Salmonella typhimurium LT2
gcccacgcccagagc

SEQ ID NO: 3805056 - RNA, 16 nt, Salmonella typhimurium LT2
gcccacgcuucccagc

SEQ ID NO: 3805057 - RNA, 19 nt, Salmonella typhimurium LT2
gcccacuuguaccaacugc

SEQ ID NO: 3805058 - RNA, 16 nt, Salmonella typhimurium LT2
gcccagcacgucgcgc

SEQ ID NO: 3805059 - RNA, 18 nt, Salmonella typhimurium LT2
gcccagcacuaacagcag

SEQ ID NO: 3805060 - RNA, 14 nt, Salmonella typhimurium LT2
gcccagcagcagaa

SEQ ID NO: 3805061 - RNA, 14 nt, Salmonella typhimurium LT2
gcccagcagggcca

SEQ ID NO: 3805062 - RNA, 14 nt, Salmonella typhimurium LT2
gcccagcccggaaa

SEQ ID NO: 3805063 - RNA, 16 nt, Salmonella typhimurium LT2
gcccagcccggaaaua

SEQ ID NO: 3805064 - RNA, 13 nt, Salmonella typhimurium LT2
gcccagccugccc

SEQ ID NO: 3805065 - RNA, 21 nt, Salmonella typhimurium LT2
gcccagcgcaaccugcgcccg

SEQ ID NO: 3805066 - RNA, 22 nt, Salmonella typhimurium LT2
gcccagcgcaaccugcgcccgc

SEQ ID NO: 3805067 - RNA, 13 nt, Salmonella typhimurium LT2
gcccagcgccgga

SEQ ID NO: 3805068 - RNA, 23 nt, Salmonella typhimurium LT2
gcccagcgccgugucaucauuac

SEQ ID NO: 3805069 - RNA, 18 nt, Salmonella typhimurium LT2
gcccagcgccuucuucac

SEQ ID NO: 3805070 - RNA, 23 nt, Salmonella typhimurium LT2
gcccagcgcgauacgcagaaccg

SEQ ID NO: 3805071 - RNA, 15 nt, Salmonella typhimurium LT2
gcccagcgcgguggc

SEQ ID NO: 3805072 - RNA, 18 nt, Salmonella typhimurium LT2
gcccagcgugccugccgc

SEQ ID NO: 3805073 - RNA, 19 nt, Salmonella typhimurium LT2
gcccagcgugccugccgca

SEQ ID NO: 3805074 - RNA, 15 nt, Salmonella typhimurium LT2
gcccagcuauuuuuc

SEQ ID NO: 3805075 - RNA, 14 nt, Salmonella typhimurium LT2
gcccagcucaucga

SEQ ID NO: 3805076 - RNA, 15 nt, Salmonella typhimurium LT2
gcccagcuugcccag

SEQ ID NO: 3805077 - RNA, 16 nt, Salmonella typhimurium LT2
gcccaggauacagccg

SEQ ID NO: 3805078 - RNA, 21 nt, Salmonella typhimurium LT2
gcccagggaaagaucaaacag

SEQ ID NO: 3805079 - RNA, 20 nt, Salmonella typhimurium LT2
gcccagguagaaucccacca

SEQ ID NO: 3805080 - RNA, 21 nt, Salmonella typhimurium LT2
gcccagguuagcagccacaca

SEQ ID NO: 3805081 - RNA, 13 nt, Salmonella typhimurium LT2
gcccagucacggc

SEQ ID NO: 3805082 - RNA, 21 nt, Salmonella typhimurium LT2
gcccauacacaccagcaggaa

SEQ ID NO: 3805083 - RNA, 19 nt, Salmonella typhimurium LT2
gcccauaccacaacagaau

SEQ ID NO: 3805084 - RNA, 16 nt, Salmonella typhimurium LT2
gcccauaccagcgcgg

SEQ ID NO: 3805085 - RNA, 17 nt, Salmonella typhimurium LT2
gcccauagcaaaguacu

SEQ ID NO: 3805086 - RNA, 16 nt, Salmonella typhimurium LT2
gcccaucaccgccagu

SEQ ID NO: 3805087 - RNA, 20 nt, Salmonella typhimurium LT2
gcccaucagcaucccaccgg

SEQ ID NO: 3805088 - RNA, 14 nt, Salmonella typhimurium LT2
gcccaucagcgcca

SEQ ID NO: 3805089 - RNA, 17 nt, Salmonella typhimurium LT2
gcccaucagcgccagcc

SEQ ID NO: 3805090 - RNA, 18 nt, Salmonella typhimurium LT2
gcccaucagcgccagccc

SEQ ID NO: 3805091 - RNA, 20 nt, Salmonella typhimurium LT2
gcccaucagcgccagcccug

SEQ ID NO: 3805092 - RNA, 17 nt, Salmonella typhimurium LT2
gcccaucaucaucggca

SEQ ID NO: 3805093 - RNA, 15 nt, Salmonella typhimurium LT2
gcccauccagcacag

SEQ ID NO: 3805094 - RNA, 14 nt, Salmonella typhimurium LT2
gcccaucgccacag

SEQ ID NO: 3805095 - RNA, 15 nt, Salmonella typhimurium LT2
gcccaucgccacagc

SEQ ID NO: 3805096 - RNA, 14 nt, Salmonella typhimurium LT2
gcccaucgccgccu

SEQ ID NO: 3805097 - RNA, 21 nt, Salmonella typhimurium LT2
gcccaucgcgccaugauucau

SEQ ID NO: 3805098 - RNA, 18 nt, Salmonella typhimurium LT2
gcccaugauggugaacag

SEQ ID NO: 3805099 - RNA, 15 nt, Salmonella typhimurium LT2
gcccaugccgcccag

SEQ ID NO: 3805100 - RNA, 20 nt, Salmonella typhimurium LT2
gcccauggcaggcagcacaa

SEQ ID NO: 3805101 - RNA, 18 nt, Salmonella typhimurium LT2
gcccauucaacgggcgau

SEQ ID NO: 3805102 - RNA, 14 nt, Salmonella typhimurium LT2
gcccauuccgccug

SEQ ID NO: 3805103 - RNA, 13 nt, Salmonella typhimurium LT2
gcccauuugcgag

SEQ ID NO: 3805104 - RNA, 19 nt, Salmonella typhimurium LT2
gcccgguggcgcuggcgcu

SEQ ID NO: 3805105 - RNA, 16 nt, Salmonella typhimurium LT2
gcccggugugccgcuu

SEQ ID NO: 3805106 - RNA, 21 nt, Salmonella typhimurium LT2
gcccgucaccauuaacaucag

SEQ ID NO: 3805107 - RNA, 12 nt, Salmonella typhimurium LT2
gcccgucagggg

SEQ ID NO: 3805108 - RNA, 15 nt, Salmonella typhimurium LT2
gcccguccgucagga

SEQ ID NO: 3805109 - RNA, 17 nt, Salmonella typhimurium LT2
gcccgucgcgaucacag

SEQ ID NO: 3805110 - RNA, 16 nt, Salmonella typhimurium LT2
gcccgugacgccaggc

SEQ ID NO: 3805111 - RNA, 19 nt, Salmonella typhimurium LT2
gcccgugaucggagaaaua

SEQ ID NO: 3805112 - RNA, 16 nt, Salmonella typhimurium LT2
gcccguuaugccaucu

SEQ ID NO: 3805113 - RNA, 13 nt, Salmonella typhimurium LT2
gcccguuccaggc

SEQ ID NO: 3805114 - RNA, 16 nt, Salmonella typhimurium LT2
gcccguugccuggcga

SEQ ID NO: 3805115 - RNA, 17 nt, Salmonella typhimurium LT2
gcccguugccuggcgac

SEQ ID NO: 3805116 - RNA, 14 nt, Salmonella typhimurium LT2
gcccguuguccgcc

SEQ ID NO: 3805117 - RNA, 18 nt, Salmonella typhimurium LT2
gcccuaaaaauagcacca

SEQ ID NO: 3805118 - RNA, 15 nt, Salmonella typhimurium LT2
gcccuauaacagcgc

SEQ ID NO: 3805119 - RNA, 14 nt, Salmonella typhimurium LT2
gcccuaucgcugcg

SEQ ID NO: 3805120 - RNA, 19 nt, Salmonella typhimurium LT2
gcccucaucggcaaacauc

SEQ ID NO: 3805121 - RNA, 18 nt, Salmonella typhimurium LT2
gcccuccagcuccgcgua

SEQ ID NO: 3805122 - RNA, 15 nt, Salmonella typhimurium LT2
gcccuccuccagcgc

SEQ ID NO: 3805123 - RNA, 15 nt, Salmonella typhimurium LT2
gcccucgcaaagcug

SEQ ID NO: 3805124 - RNA, 21 nt, Salmonella typhimurium LT2
gcccucgggucgaauuccagu

SEQ ID NO: 3805125 - RNA, 16 nt, Salmonella typhimurium LT2
gcccucgguacugcgg

SEQ ID NO: 3805126 - RNA, 13 nt, Salmonella typhimurium LT2
gcccucuauccac

SEQ ID NO: 3805127 - RNA, 17 nt, Salmonella typhimurium LT2
gcccucuuuaucaaaca

SEQ ID NO: 3805128 - RNA, 19 nt, Salmonella typhimurium LT2
gcccucuuuaucaaacaaa

SEQ ID NO: 3805129 - RNA, 16 nt, Salmonella typhimurium LT2
gcccugaagggcggcu

SEQ ID NO: 3805130 - RNA, 15 nt, Salmonella typhimurium LT2
gcccugaucccacag

SEQ ID NO: 3805131 - RNA, 23 nt, Salmonella typhimurium LT2
gcccugcaaaaguuugaccagca

SEQ ID NO: 3805132 - RNA, 13 nt, Salmonella typhimurium LT2
gcccugcaggcgg

SEQ ID NO: 3805133 - RNA, 20 nt, Salmonella typhimurium LT2
gcccugccaccagcguaccg

SEQ ID NO: 3805134 - RNA, 14 nt, Salmonella typhimurium LT2
gcccugcccgccag

SEQ ID NO: 3805135 - RNA, 18 nt, Salmonella typhimurium LT2
gcccugccggaaaaugcg

SEQ ID NO: 3805136 - RNA, 15 nt, Salmonella typhimurium LT2
gcccugcguuccgcu

SEQ ID NO: 3805137 - RNA, 16 nt, Salmonella typhimurium LT2
gcccugcucccacagc

SEQ ID NO: 3805138 - RNA, 16 nt, Salmonella typhimurium LT2
gcccugcuguuccagu

SEQ ID NO: 3805139 - RNA, 23 nt, Salmonella typhimurium LT2
gcccuggaggaacagcgccguca

SEQ ID NO: 3805140 - RNA, 17 nt, Salmonella typhimurium LT2
gcccuggguugcccaaa

SEQ ID NO: 3805141 - RNA, 17 nt, Salmonella typhimurium LT2
gcccuguccuccauggc

SEQ ID NO: 3805142 - RNA, 13 nt, Salmonella typhimurium LT2
gcccugugccgcu

SEQ ID NO: 3805143 - RNA, 22 nt, Salmonella typhimurium LT2
gcccuguggaaacuccagcggc

SEQ ID NO: 3805144 - RNA, 20 nt, Salmonella typhimurium LT2
gcccuguuuuuucgccgcgc

SEQ ID NO: 3805145 - RNA, 17 nt, Salmonella typhimurium LT2
gcccuuaaauccggccu

SEQ ID NO: 3805146 - RNA, 24 nt, Salmonella typhimurium LT2
gcccuucguuuuauuugaugccug

SEQ ID NO: 3805147 - RNA, 17 nt, Salmonella typhimurium LT2
gcccuucuccggucauc

SEQ ID NO: 3805148 - RNA, 22 nt, Salmonella typhimurium LT2
gcccuuucauuucugccugcuu

SEQ ID NO: 3805149 - RNA, 11 nt, Salmonella typhimurium LT2
gcccuuuuguu

SEQ ID NO: 3805150 - RNA, 13 nt, Salmonella typhimurium LT2
gccgaaacguaug

SEQ ID NO: 3805151 - RNA, 13 nt, Salmonella typhimurium LT2
gccgaaagugguu

SEQ ID NO: 3805152 - RNA, 12 nt, Salmonella typhimurium LT2
gccgaacagacg

SEQ ID NO: 3805153 - RNA, 13 nt, Salmonella typhimurium LT2
gccgaacaggcca

SEQ ID NO: 3805154 - RNA, 14 nt, Salmonella typhimurium LT2
gccgaacgcggcuu

SEQ ID NO: 3805155 - RNA, 21 nt, Salmonella typhimurium LT2
gccgaacuuacgcaguugauu

SEQ ID NO: 3805156 - RNA, 15 nt, Salmonella typhimurium LT2
gccgaagacuccccu

SEQ ID NO: 3805157 - RNA, 16 nt, Salmonella typhimurium LT2
gccgaagacuccccug

SEQ ID NO: 3805158 - RNA, 18 nt, Salmonella typhimurium LT2
gccgaagacuccccugca

SEQ ID NO: 3805159 - RNA, 14 nt, Salmonella typhimurium LT2
gccgaagccaacgc

SEQ ID NO: 3805160 - RNA, 20 nt, Salmonella typhimurium LT2
gccgaaguucauaaauguac

SEQ ID NO: 3805161 - RNA, 17 nt, Salmonella typhimurium LT2
gccgaaguucgcgccgc

SEQ ID NO: 3805162 - RNA, 21 nt, Salmonella typhimurium LT2
gccgaauaagcgacagcgcca

SEQ ID NO: 3805163 - RNA, 23 nt, Salmonella typhimurium LT2
gccgaauaagcgacagcgccauc

SEQ ID NO: 3805164 - RNA, 16 nt, Salmonella typhimurium LT2
gccgaaugacgggccu

SEQ ID NO: 3805165 - RNA, 14 nt, Salmonella typhimurium LT2
gccgaauggcggcu

SEQ ID NO: 3805166 - RNA, 21 nt, Salmonella typhimurium LT2
gccgacaaaugacgucagcaa

SEQ ID NO: 3805167 - RNA, 19 nt, Salmonella typhimurium LT2
gccgacauagcugaacaau

SEQ ID NO: 3805168 - RNA, 15 nt, Salmonella typhimurium LT2
gccgacauucccugc

SEQ ID NO: 3805169 - RNA, 19 nt, Salmonella typhimurium LT2
gccgaccaauugcaggcag

SEQ ID NO: 3805170 - RNA, 13 nt, Salmonella typhimurium LT2
gccgaccaccauc

SEQ ID NO: 3805171 - RNA, 17 nt, Salmonella typhimurium LT2
gccgaccaccauccggc

SEQ ID NO: 3805172 - RNA, 14 nt, Salmonella typhimurium LT2
gccgaccauccaga

SEQ ID NO: 3805173 - RNA, 19 nt, Salmonella typhimurium LT2
gccgacccccuccuuguaa

SEQ ID NO: 3805174 - RNA, 15 nt, Salmonella typhimurium LT2
gccgacgacaggcag

SEQ ID NO: 3805175 - RNA, 22 nt, Salmonella typhimurium LT2
gccgacgcauuucuccugauua

SEQ ID NO: 3805176 - RNA, 16 nt, Salmonella typhimurium LT2
gccgacguuaucgccg

SEQ ID NO: 3805177 - RNA, 19 nt, Salmonella typhimurium LT2
gccgacguuaucgccgaca

SEQ ID NO: 3805178 - RNA, 23 nt, Salmonella typhimurium LT2
gccgacuauuccgcaaacgccgu

SEQ ID NO: 3805179 - RNA, 19 nt, Salmonella typhimurium LT2
gccgagcagaucgcggcaa

SEQ ID NO: 3805180 - RNA, 20 nt, Salmonella typhimurium LT2
gccgagcagauuuuucgcca

SEQ ID NO: 3805181 - RNA, 14 nt, Salmonella typhimurium LT2
gccgagcaucgcuu

SEQ ID NO: 3805182 - RNA, 16 nt, Salmonella typhimurium LT2
gccgagcccgaggcga

SEQ ID NO: 3805183 - RNA, 16 nt, Salmonella typhimurium LT2
gccgaggcauccagaa

SEQ ID NO: 3805184 - RNA, 16 nt, Salmonella typhimurium LT2
gccgaggcauucagcc

SEQ ID NO: 3805185 - RNA, 19 nt, Salmonella typhimurium LT2
gccgaggguggcaccgcgc

SEQ ID NO: 3805186 - RNA, 21 nt, Salmonella typhimurium LT2
gccgaggugguaauuggccug

SEQ ID NO: 3805187 - RNA, 15 nt, Salmonella typhimurium LT2
gccgauaaucgcguc

SEQ ID NO: 3805188 - RNA, 16 nt, Salmonella typhimurium LT2
gccgauaaucgcgucu

SEQ ID NO: 3805189 - RNA, 14 nt, Salmonella typhimurium LT2
gccgauaccggcaa

SEQ ID NO: 3805190 - RNA, 15 nt, Salmonella typhimurium LT2
gccgauagaccuucg

SEQ ID NO: 3805191 - RNA, 18 nt, Salmonella typhimurium LT2
gccgauagcaucgcugau

SEQ ID NO: 3805192 - RNA, 16 nt, Salmonella typhimurium LT2
gccgauagcggcggcg

SEQ ID NO: 3805193 - RNA, 13 nt, Salmonella typhimurium LT2
gccgauaucaaua

SEQ ID NO: 3805194 - RNA, 19 nt, Salmonella typhimurium LT2
gccgauauggccguuuuca

SEQ ID NO: 3805195 - RNA, 16 nt, Salmonella typhimurium LT2
gccgauauugccuuca

SEQ ID NO: 3805196 - RNA, 16 nt, Salmonella typhimurium LT2
gccgaucaccagcgca

SEQ ID NO: 3805197 - RNA, 18 nt, Salmonella typhimurium LT2
gccgaucaccagcgcauc

SEQ ID NO: 3805198 - RNA, 17 nt, Salmonella typhimurium LT2
gccgaucaggccgcaga

SEQ ID NO: 3805199 - RNA, 12 nt, Salmonella typhimurium LT2
gccgaugacgcu

SEQ ID NO: 3805200 - RNA, 18 nt, Salmonella typhimurium LT2
gccgaugacucccagucc

SEQ ID NO: 3805201 - RNA, 21 nt, Salmonella typhimurium LT2
gccgaugaucccggcgccgcc

SEQ ID NO: 3805202 - RNA, 14 nt, Salmonella typhimurium LT2
gccgaugccgccga

SEQ ID NO: 3805203 - RNA, 19 nt, Salmonella typhimurium LT2
gccgaugcugaauagccag

SEQ ID NO: 3805204 - RNA, 21 nt, Salmonella typhimurium LT2
gccgauggccgacauugacca

SEQ ID NO: 3805205 - RNA, 17 nt, Salmonella typhimurium LT2
gccgauggucgcgccaa

SEQ ID NO: 3805206 - RNA, 19 nt, Salmonella typhimurium LT2
gccgauuuaccucucacca

SEQ ID NO: 3805207 - RNA, 14 nt, Salmonella typhimurium LT2
gccgauuuuucggc

SEQ ID NO: 3805208 - RNA, 16 nt, Salmonella typhimurium LT2
gccgcaaacgccugcu

SEQ ID NO: 3805209 - RNA, 17 nt, Salmonella typhimurium LT2
gccggaaacuggcguca

SEQ ID NO: 3805210 - RNA, 17 nt, Salmonella typhimurium LT2
gccggaaagaauaaucg

SEQ ID NO: 3805211 - RNA, 16 nt, Salmonella typhimurium LT2
gccggaaaucacccaa

SEQ ID NO: 3805212 - RNA, 15 nt, Salmonella typhimurium LT2
gccggaagcgcgaau

SEQ ID NO: 3805213 - RNA, 22 nt, Salmonella typhimurium LT2
gccggaaugcgaauaaucgccg

SEQ ID NO: 3805214 - RNA, 21 nt, Salmonella typhimurium LT2
gccggacagagugucuacacu

SEQ ID NO: 3805215 - RNA, 13 nt, Salmonella typhimurium LT2
gccggacagcagc

SEQ ID NO: 3805216 - RNA, 17 nt, Salmonella typhimurium LT2
gccggacaguucgccaa

SEQ ID NO: 3805217 - RNA, 20 nt, Salmonella typhimurium LT2
gccggacaguucgccaacgc

SEQ ID NO: 3805218 - RNA, 18 nt, Salmonella typhimurium LT2
gccggacggcgcagcgcg

SEQ ID NO: 3805219 - RNA, 15 nt, Salmonella typhimurium LT2
gccggacguugaaaa

SEQ ID NO: 3805220 - RNA, 21 nt, Salmonella typhimurium LT2
gccggagaaaaagaccgacau

SEQ ID NO: 3805221 - RNA, 18 nt, Salmonella typhimurium LT2
gccggagaccugucgccg

SEQ ID NO: 3805222 - RNA, 14 nt, Salmonella typhimurium LT2
gccggagaccuuuu

SEQ ID NO: 3805223 - RNA, 20 nt, Salmonella typhimurium LT2
gccggagagaugccgccagu

SEQ ID NO: 3805224 - RNA, 19 nt, Salmonella typhimurium LT2
gccggagagcaguacgcca

SEQ ID NO: 3805225 - RNA, 23 nt, Salmonella typhimurium LT2
gccggagagcauuuguagcggca

SEQ ID NO: 3805226 - RNA, 15 nt, Salmonella typhimurium LT2
gccggauaagacgcg

SEQ ID NO: 3805227 - RNA, 22 nt, Salmonella typhimurium LT2
gccggauaagacgcgcagcggc

SEQ ID NO: 3805228 - RNA, 15 nt, Salmonella typhimurium LT2
gccggauaagacgcu

SEQ ID NO: 3805229 - RNA, 21 nt, Salmonella typhimurium LT2
gccggauaagcguaagcgcca

SEQ ID NO: 3805230 - RNA, 16 nt, Salmonella typhimurium LT2
gccggauaagcguagc

SEQ ID NO: 3805231 - RNA, 19 nt, Salmonella typhimurium LT2
gccggauaagcguagcgca

SEQ ID NO: 3805232 - RNA, 21 nt, Salmonella typhimurium LT2
gccggauaagcguagcgccau

SEQ ID NO: 3805233 - RNA, 13 nt, Salmonella typhimurium LT2
gccggauaaggca

SEQ ID NO: 3805234 - RNA, 18 nt, Salmonella typhimurium LT2
gccggauaauaguuagcc

SEQ ID NO: 3805235 - RNA, 23 nt, Salmonella typhimurium LT2
gccggauaauuuauccaguaacg

SEQ ID NO: 3805236 - RNA, 23 nt, Salmonella typhimurium LT2
gccggauacgucacgucagcguc

SEQ ID NO: 3805237 - RNA, 19 nt, Salmonella typhimurium LT2
gccggauagcguagcgcca

SEQ ID NO: 3805238 - RNA, 19 nt, Salmonella typhimurium LT2
gccggauaucgcuauccgg

SEQ ID NO: 3805239 - RNA, 22 nt, Salmonella typhimurium LT2
gccggaugaggcgcagccgcca

SEQ ID NO: 3805240 - RNA, 13 nt, Salmonella typhimurium LT2
gccggauggcgcu

SEQ ID NO: 3805241 - RNA, 16 nt, Salmonella typhimurium LT2
gccggauggcggcuga

SEQ ID NO: 3805242 - RNA, 13 nt, Salmonella typhimurium LT2
gccggauggcggu

SEQ ID NO: 3805243 - RNA, 23 nt, Salmonella typhimurium LT2
gccggauggcgguacagcgagcu

SEQ ID NO: 3805244 - RNA, 20 nt, Salmonella typhimurium LT2
gccggauggcgguuggccua

SEQ ID NO: 3805245 - RNA, 18 nt, Salmonella typhimurium LT2
gccggaugugagcgcauc

SEQ ID NO: 3805246 - RNA, 22 nt, Salmonella typhimurium LT2
gccggaugugagcgcauccggc

SEQ ID NO: 3805247 - RNA, 14 nt, Salmonella typhimurium LT2
gccggauuagcgac

SEQ ID NO: 3805248 - RNA, 15 nt, Salmonella typhimurium LT2
gccggauuagcgaca

SEQ ID NO: 3805249 - RNA, 21 nt, Salmonella typhimurium LT2
gccggauuagcgacagcgcua

SEQ ID NO: 3805250 - RNA, 19 nt, Salmonella typhimurium LT2
gccggauuccagaauacga

SEQ ID NO: 3805251 - RNA, 16 nt, Salmonella typhimurium LT2
gccggcaggcagcgcc

SEQ ID NO: 3805252 - RNA, 17 nt, Salmonella typhimurium LT2
gccggcaggcagcgcca

SEQ ID NO: 3805253 - RNA, 13 nt, Salmonella typhimurium LT2
gccggcaucauuc

SEQ ID NO: 3805254 - RNA, 19 nt, Salmonella typhimurium LT2
gccggcaucauucugcagg

SEQ ID NO: 3805255 - RNA, 23 nt, Salmonella typhimurium LT2
gccggcaucauucugcaggcggg

SEQ ID NO: 3805256 - RNA, 14 nt, Salmonella typhimurium LT2
gccggccgcaguuu

SEQ ID NO: 3805257 - RNA, 14 nt, Salmonella typhimurium LT2
gccggcuucuuccg

SEQ ID NO: 3805258 - RNA, 16 nt, Salmonella typhimurium LT2
gccggcuucuuccggc

SEQ ID NO: 3805259 - RNA, 18 nt, Salmonella typhimurium LT2
gccgggaacugacagcag

SEQ ID NO: 3805260 - RNA, 20 nt, Salmonella typhimurium LT2
gccgggcaacacgaugaugu

SEQ ID NO: 3805261 - RNA, 17 nt, Salmonella typhimurium LT2
gccgggccugagcgcgc

SEQ ID NO: 3805262 - RNA, 20 nt, Salmonella typhimurium LT2
gccgggcgucacccgccggc

SEQ ID NO: 3805263 - RNA, 23 nt, Salmonella typhimurium LT2
gccgggcguuucacauuccggcg

SEQ ID NO: 3805264 - RNA, 21 nt, Salmonella typhimurium LT2
gccgggcuauccggcuguucg

SEQ ID NO: 3805265 - RNA, 14 nt, Salmonella typhimurium LT2
gccgggcuucacgg

SEQ ID NO: 3805266 - RNA, 16 nt, Salmonella typhimurium LT2
gccgggcuugagcccg

SEQ ID NO: 3805267 - RNA, 13 nt, Salmonella typhimurium LT2
gccggggcgcugg

SEQ ID NO: 3805268 - RNA, 14 nt, Salmonella typhimurium LT2
gccggggcgcuggc

SEQ ID NO: 3805269 - RNA, 22 nt, Salmonella typhimurium LT2
gccggggcucccacucuuccag

SEQ ID NO: 3805270 - RNA, 15 nt, Salmonella typhimurium LT2
gccggguaaacgcag

SEQ ID NO: 3805271 - RNA, 21 nt, Salmonella typhimurium LT2
gccggguaagcgcaagcgcca

SEQ ID NO: 3805272 - RNA, 14 nt, Salmonella typhimurium LT2
gccggguacugaau

SEQ ID NO: 3805273 - RNA, 22 nt, Salmonella typhimurium LT2
gccggguaggacauagccgcca

SEQ ID NO: 3805274 - RNA, 19 nt, Salmonella typhimurium LT2
gccggguauugugccccgc

SEQ ID NO: 3805275 - RNA, 21 nt, Salmonella typhimurium LT2
gccggguauugugccccgcgc

SEQ ID NO: 3805276 - RNA, 17 nt, Salmonella typhimurium LT2
gccggguuugccgugcg

SEQ ID NO: 3805277 - RNA, 21 nt, Salmonella typhimurium LT2
gccgguaaucgaucccgccgc

SEQ ID NO: 3805278 - RNA, 21 nt, Salmonella typhimurium LT2
gccgguacgcagcaggcagac

SEQ ID NO: 3805279 - RNA, 21 nt, Salmonella typhimurium LT2
gccgguacgggcagcggcuuc

SEQ ID NO: 3805280 - RNA, 19 nt, Salmonella typhimurium LT2
gccgguacuggagaccggc

SEQ ID NO: 3805281 - RNA, 17 nt, Salmonella typhimurium LT2
gccgguauccagcgcgu

SEQ ID NO: 3805282 - RNA, 15 nt, Salmonella typhimurium LT2
gccggucaugccauc

SEQ ID NO: 3805283 - RNA, 16 nt, Salmonella typhimurium LT2
gccggucgccagcaua

SEQ ID NO: 3805284 - RNA, 15 nt, Salmonella typhimurium LT2
gccggugaucccacc

SEQ ID NO: 3805285 - RNA, 17 nt, Salmonella typhimurium LT2
gccggugccauuccagc

SEQ ID NO: 3805286 - RNA, 13 nt, Salmonella typhimurium LT2
gccggugccgcaa

SEQ ID NO: 3805287 - RNA, 21 nt, Salmonella typhimurium LT2
gccggugccgcaaucgguuuc

SEQ ID NO: 3805288 - RNA, 23 nt, Salmonella typhimurium LT2
gccggugcgagaaaaagcaauaa

SEQ ID NO: 3805289 - RNA, 21 nt, Salmonella typhimurium LT2
gccgguguuuagccugauaca

SEQ ID NO: 3805290 - RNA, 17 nt, Salmonella typhimurium LT2
gccgguuagcgccgcgu

SEQ ID NO: 3805291 - RNA, 18 nt, Salmonella typhimurium LT2
gccgguuauaccgccauc

SEQ ID NO: 3805292 - RNA, 21 nt, Salmonella typhimurium LT2
gccgguucggccagucgcaga

SEQ ID NO: 3805293 - RNA, 22 nt, Salmonella typhimurium LT2
gccgguuuuagcguauccggca

SEQ ID NO: 3805294 - RNA, 19 nt, Salmonella typhimurium LT2
gccguaaacaggcaggccc

SEQ ID NO: 3805295 - RNA, 20 nt, Salmonella typhimurium LT2
gccguaacgaacgcggauca

SEQ ID NO: 3805296 - RNA, 12 nt, Salmonella typhimurium LT2
gccguagcagaa

SEQ ID NO: 3805297 - RNA, 19 nt, Salmonella typhimurium LT2
gccguagcgcgcuuccugc

SEQ ID NO: 3805298 - RNA, 13 nt, Salmonella typhimurium LT2
gccguaggagaua

SEQ ID NO: 3805299 - RNA, 16 nt, Salmonella typhimurium LT2
gccguauaauccagcu

SEQ ID NO: 3805300 - RNA, 20 nt, Salmonella typhimurium LT2
gccguaucagcaagcgccag

SEQ ID NO: 3805301 - RNA, 22 nt, Salmonella typhimurium LT2
gccguauuucacuuuugccggu

SEQ ID NO: 3805302 - RNA, 17 nt, Salmonella typhimurium LT2
gccgucaaugccgggca

SEQ ID NO: 3805303 - RNA, 19 nt, Salmonella typhimurium LT2
gccgucacaaagcccaccg

SEQ ID NO: 3805304 - RNA, 20 nt, Salmonella typhimurium LT2
gccgucagcuccugcgggcu

SEQ ID NO: 3805305 - RNA, 23 nt, Salmonella typhimurium LT2
gccgucaggucaugaucgauccg

SEQ ID NO: 3805306 - RNA, 23 nt, Salmonella typhimurium LT2
gccgucaucagcaagacucgcgc

SEQ ID NO: 3805307 - RNA, 15 nt, Salmonella typhimurium LT2
gccgucauccgcgua

SEQ ID NO: 3805308 - RNA, 19 nt, Salmonella typhimurium LT2
gccgucaucgcucaucagc

SEQ ID NO: 3805309 - RNA, 13 nt, Salmonella typhimurium LT2
gccguccagcacc

SEQ ID NO: 3805310 - RNA, 20 nt, Salmonella typhimurium LT2
gccguccgaucucguuaacg

SEQ ID NO: 3805311 - RNA, 12 nt, Salmonella typhimurium LT2
gccguccggcau

SEQ ID NO: 3805312 - RNA, 22 nt, Salmonella typhimurium LT2
gccugaaugcagaccucugcuu

SEQ ID NO: 3805313 - RNA, 16 nt, Salmonella typhimurium LT2
gccugacagcaaugag

SEQ ID NO: 3805314 - RNA, 17 nt, Salmonella typhimurium LT2
gccugacagcaaugagc

SEQ ID NO: 3805315 - RNA, 20 nt, Salmonella typhimurium LT2
gccugacgaaaaucauccag

SEQ ID NO: 3805316 - RNA, 21 nt, Salmonella typhimurium LT2
gccugacgaaaaucauccagu

SEQ ID NO: 3805317 - RNA, 15 nt, Salmonella typhimurium LT2
gccugacgccaccac

SEQ ID NO: 3805318 - RNA, 15 nt, Salmonella typhimurium LT2
gccugacugaagacg

SEQ ID NO: 3805319 - RNA, 18 nt, Salmonella typhimurium LT2
gccugagcgccagcgugc

SEQ ID NO: 3805320 - RNA, 12 nt, Salmonella typhimurium LT2
gccugagcuuuc

SEQ ID NO: 3805321 - RNA, 15 nt, Salmonella typhimurium LT2
gccugagguuucgcc

SEQ ID NO: 3805322 - RNA, 23 nt, Salmonella typhimurium LT2
gccugauaaaaaaacgccgccuu

SEQ ID NO: 3805323 - RNA, 15 nt, Salmonella typhimurium LT2
gccugauaaauaugc

SEQ ID NO: 3805324 - RNA, 19 nt, Salmonella typhimurium LT2
gccugauaagcgcagcgca

SEQ ID NO: 3805325 - RNA, 20 nt, Salmonella typhimurium LT2
gccugauaagcgcagcgcca

SEQ ID NO: 3805326 - RNA, 22 nt, Salmonella typhimurium LT2
gccugauaagcgcagcgccauc

SEQ ID NO: 3805327 - RNA, 19 nt, Salmonella typhimurium LT2
gccugauaagcuuucuguu

SEQ ID NO: 3805328 - RNA, 19 nt, Salmonella typhimurium LT2
gccugaucgauucucuucu

SEQ ID NO: 3805329 - RNA, 13 nt, Salmonella typhimurium LT2
gccugaucgccac

SEQ ID NO: 3805330 - RNA, 15 nt, Salmonella typhimurium LT2
gccugaucuuucugg

SEQ ID NO: 3805331 - RNA, 16 nt, Salmonella typhimurium LT2
gccugaucuuucuggu

SEQ ID NO: 3805332 - RNA, 17 nt, Salmonella typhimurium LT2
gccugaugacgcugcgc

SEQ ID NO: 3805333 - RNA, 22 nt, Salmonella typhimurium LT2
gccugaugcgcguuuagcgcca

SEQ ID NO: 3805334 - RNA, 23 nt, Salmonella typhimurium LT2
gccugauggcgacguuagcgcau

SEQ ID NO: 3805335 - RNA, 15 nt, Salmonella typhimurium LT2
gccugauggcgcagc

SEQ ID NO: 3805336 - RNA, 19 nt, Salmonella typhimurium LT2
gccugauggcgcagcgcca

SEQ ID NO: 3805337 - RNA, 23 nt, Salmonella typhimurium LT2
gccugauggcgcuacgcuuauca

SEQ ID NO: 3805338 - RNA, 19 nt, Salmonella typhimurium LT2
gccugauggcgcugcgcca

SEQ ID NO: 3805339 - RNA, 15 nt, Salmonella typhimurium LT2
gccugauggcgcuuc

SEQ ID NO: 3805340 - RNA, 14 nt, Salmonella typhimurium LT2
gccugauucauucc

SEQ ID NO: 3805341 - RNA, 17 nt, Salmonella typhimurium LT2
gccugauuucccaguug

SEQ ID NO: 3805342 - RNA, 13 nt, Salmonella typhimurium LT2
gccugauuucuga

SEQ ID NO: 3805343 - RNA, 20 nt, Salmonella typhimurium LT2
gccugcacaaaaagagcaau

SEQ ID NO: 3805344 - RNA, 12 nt, Salmonella typhimurium LT2
gccugcagaccc

SEQ ID NO: 3805345 - RNA, 13 nt, Salmonella typhimurium LT2
gccugcagaccca

SEQ ID NO: 3805346 - RNA, 19 nt, Salmonella typhimurium LT2
gccugcagauuauuucacu

SEQ ID NO: 3805347 - RNA, 16 nt, Salmonella typhimurium LT2
gccugcaggccggaua

SEQ ID NO: 3805348 - RNA, 19 nt, Salmonella typhimurium LT2
gccugcauaaacgcggcca

SEQ ID NO: 3805349 - RNA, 22 nt, Salmonella typhimurium LT2
gccugcauaaaggaguaacaga

SEQ ID NO: 3805350 - RNA, 16 nt, Salmonella typhimurium LT2
gccugcauacguuuca

SEQ ID NO: 3805351 - RNA, 21 nt, Salmonella typhimurium LT2
gccugcauacguuucaccagc

SEQ ID NO: 3805352 - RNA, 18 nt, Salmonella typhimurium LT2
gccugcaugucuucaugu

SEQ ID NO: 3805353 - RNA, 20 nt, Salmonella typhimurium LT2
gccugccagcaacccaccug

SEQ ID NO: 3805354 - RNA, 14 nt, Salmonella typhimurium LT2
gccugccagcacca

SEQ ID NO: 3805355 - RNA, 22 nt, Salmonella typhimurium LT2
gccugccagcaccagcagcgca

SEQ ID NO: 3805356 - RNA, 13 nt, Salmonella typhimurium LT2
gccugccauagca

SEQ ID NO: 3805357 - RNA, 17 nt, Salmonella typhimurium LT2
gccugccgcagcggcuc

SEQ ID NO: 3805358 - RNA, 16 nt, Salmonella typhimurium LT2
gccugccgcaucugac

SEQ ID NO: 3805359 - RNA, 23 nt, Salmonella typhimurium LT2
gccugccgccagcaguugcagcg

SEQ ID NO: 3805360 - RNA, 16 nt, Salmonella typhimurium LT2
gccugccgcgccgccg

SEQ ID NO: 3805361 - RNA, 17 nt, Salmonella typhimurium LT2
gccugccggauuuuuca

SEQ ID NO: 3805362 - RNA, 13 nt, Salmonella typhimurium LT2
gccugccgggccu

SEQ ID NO: 3805363 - RNA, 23 nt, Salmonella typhimurium LT2
gccugccguaaacaggcaggccc

SEQ ID NO: 3805364 - RNA, 15 nt, Salmonella typhimurium LT2
gccugccguccugau

SEQ ID NO: 3805365 - RNA, 22 nt, Salmonella typhimurium LT2
gccugccgucuuuuagcaucag

SEQ ID NO: 3805366 - RNA, 18 nt, Salmonella typhimurium LT2
gccugccugguaagcaga

SEQ ID NO: 3805367 - RNA, 18 nt, Salmonella typhimurium LT2
gccugcgaaugcaggccg

SEQ ID NO: 3805368 - RNA, 15 nt, Salmonella typhimurium LT2
gccugcgccagcgcc

SEQ ID NO: 3805369 - RNA, 16 nt, Salmonella typhimurium LT2
gccugcgccagcgccg

SEQ ID NO: 3805370 - RNA, 17 nt, Salmonella typhimurium LT2
gccugcgccuugacgau

SEQ ID NO: 3805371 - RNA, 21 nt, Salmonella typhimurium LT2
gccugcgcucauauacccugc

SEQ ID NO: 3805372 - RNA, 21 nt, Salmonella typhimurium LT2
gccugcgcuggaaucauccac

SEQ ID NO: 3805373 - RNA, 23 nt, Salmonella typhimurium LT2
gccugcgcuuugugcuccaccag

SEQ ID NO: 3805374 - RNA, 19 nt, Salmonella typhimurium LT2
gccugcggauuuuucgcca

SEQ ID NO: 3805375 - RNA, 20 nt, Salmonella typhimurium LT2
gccugcggauuuuucgccag

SEQ ID NO: 3805376 - RNA, 22 nt, Salmonella typhimurium LT2
gccugcggcgagguggcgaagc

SEQ ID NO: 3805377 - RNA, 15 nt, Salmonella typhimurium LT2
gccugcgucgcccca

SEQ ID NO: 3805378 - RNA, 14 nt, Salmonella typhimurium LT2
gccugcuccgggcg

SEQ ID NO: 3805379 - RNA, 18 nt, Salmonella typhimurium LT2
gccugcugcagacugccg

SEQ ID NO: 3805380 - RNA, 14 nt, Salmonella typhimurium LT2
gccugcugccugca

SEQ ID NO: 3805381 - RNA, 20 nt, Salmonella typhimurium LT2
gccugcugcgguaaggcagc

SEQ ID NO: 3805382 - RNA, 18 nt, Salmonella typhimurium LT2
gccuggagagcagcgcca

SEQ ID NO: 3805383 - RNA, 15 nt, Salmonella typhimurium LT2
gccuggcauuuuacu

SEQ ID NO: 3805384 - RNA, 16 nt, Salmonella typhimurium LT2
gccuggcgcuuuaaaa

SEQ ID NO: 3805385 - RNA, 17 nt, Salmonella typhimurium LT2
gccuggcggcuuccugu

SEQ ID NO: 3805386 - RNA, 21 nt, Salmonella typhimurium LT2
gccuggcgguaugaaagccau

SEQ ID NO: 3805387 - RNA, 16 nt, Salmonella typhimurium LT2
gccuggcugagaaaaa

SEQ ID NO: 3805388 - RNA, 20 nt, Salmonella typhimurium LT2
gccugggauagcgcugcgca

SEQ ID NO: 3805389 - RNA, 16 nt, Salmonella typhimurium LT2
gccugguaagcgcagc

SEQ ID NO: 3805390 - RNA, 20 nt, Salmonella typhimurium LT2
gccugguaagcgcagcgcca

SEQ ID NO: 3805391 - RNA, 17 nt, Salmonella typhimurium LT2
gccuguaaacagaugcu

SEQ ID NO: 3805392 - RNA, 14 nt, Salmonella typhimurium LT2
gccuguaaaccgcc

SEQ ID NO: 3805393 - RNA, 18 nt, Salmonella typhimurium LT2
gccuguaaugccgccugu

SEQ ID NO: 3805394 - RNA, 19 nt, Salmonella typhimurium LT2
gccuguaccgggcagacau

SEQ ID NO: 3805395 - RNA, 20 nt, Salmonella typhimurium LT2
gccuguacuugcgccgccau

SEQ ID NO: 3805396 - RNA, 12 nt, Salmonella typhimurium LT2
gccugucaggau

SEQ ID NO: 3805397 - RNA, 13 nt, Salmonella typhimurium LT2
gccugucgcgcca

SEQ ID NO: 3805398 - RNA, 16 nt, Salmonella typhimurium LT2
gccugucguacuccag

SEQ ID NO: 3805399 - RNA, 15 nt, Salmonella typhimurium LT2
gccugucuauuguuu

SEQ ID NO: 3805400 - RNA, 22 nt, Salmonella typhimurium LT2
gccugucuauuguuuagacaga

SEQ ID NO: 3805401 - RNA, 15 nt, Salmonella typhimurium LT2
gccugucuccgcagc

SEQ ID NO: 3805402 - RNA, 21 nt, Salmonella typhimurium LT2
gccugugacguuaacgcagca

SEQ ID NO: 3805403 - RNA, 21 nt, Salmonella typhimurium LT2
gccugugcuuucgccaccagc

SEQ ID NO: 3805404 - RNA, 18 nt, Salmonella typhimurium LT2
gccuguuagggcgcggcu

SEQ ID NO: 3805405 - RNA, 14 nt, Salmonella typhimurium LT2
gccuguucaucagg

SEQ ID NO: 3805406 - RNA, 18 nt, Salmonella typhimurium LT2
gccuguucuucaguaauu

SEQ ID NO: 3805407 - RNA, 16 nt, Salmonella typhimurium LT2
gccuguugacgcgcau

SEQ ID NO: 3805408 - RNA, 16 nt, Salmonella typhimurium LT2
gccuguuuacccuucg

SEQ ID NO: 3805409 - RNA, 14 nt, Salmonella typhimurium LT2
gccuguuuacggca

SEQ ID NO: 3805410 - RNA, 15 nt, Salmonella typhimurium LT2
gccuguuuauauucu

SEQ ID NO: 3805411 - RNA, 22 nt, Salmonella typhimurium LT2
gccuuaaaaagaacaagcugau

SEQ ID NO: 3805412 - RNA, 20 nt, Salmonella typhimurium LT2
gccuuaaccugguucaaaau

SEQ ID NO: 3805413 - RNA, 15 nt, Salmonella typhimurium LT2
gccuuacccggccua

SEQ ID NO: 3805414 - RNA, 19 nt, Salmonella typhimurium LT2
gccuuacccggccuacaca

SEQ ID NO: 3805415 - RNA, 16 nt, Salmonella typhimurium LT2
gccuuacggugcgugg

SEQ ID NO: 3805416 - RNA, 17 nt, Salmonella typhimurium LT2
gccuuauccagacgcug

SEQ ID NO: 3805417 - RNA, 13 nt, Salmonella typhimurium LT2
gccuuauccggcc

SEQ ID NO: 3805418 - RNA, 15 nt, Salmonella typhimurium LT2
gccuuauccggccua

SEQ ID NO: 3805419 - RNA, 22 nt, Salmonella typhimurium LT2
gccuuauccggccuacaacuca

SEQ ID NO: 3805420 - RNA, 19 nt, Salmonella typhimurium LT2
gccuuauccggccuacaag

SEQ ID NO: 3805421 - RNA, 14 nt, Salmonella typhimurium LT2
gccuuauucacagc

SEQ ID NO: 3805422 - RNA, 17 nt, Salmonella typhimurium LT2
gccuuauugugccgcgg

SEQ ID NO: 3805423 - RNA, 22 nt, Salmonella typhimurium LT2
gccuucagccugaaucagcauc

SEQ ID NO: 3805424 - RNA, 15 nt, Salmonella typhimurium LT2
gccuucaggcaucag

SEQ ID NO: 3805425 - RNA, 13 nt, Salmonella typhimurium LT2
gccuucagguuuu

SEQ ID NO: 3805426 - RNA, 18 nt, Salmonella typhimurium LT2
gccuucagucaacagugu

SEQ ID NO: 3805427 - RNA, 13 nt, Salmonella typhimurium LT2
gccuucauaauga

SEQ ID NO: 3805428 - RNA, 21 nt, Salmonella typhimurium LT2
gccuucauauuaaauuccggc

SEQ ID NO: 3805429 - RNA, 14 nt, Salmonella typhimurium LT2
gccuucauuaauuu

SEQ ID NO: 3805430 - RNA, 16 nt, Salmonella typhimurium LT2
gccuuccagaaauaaa

SEQ ID NO: 3805431 - RNA, 12 nt, Salmonella typhimurium LT2
gccuuccagcaa

SEQ ID NO: 3805432 - RNA, 15 nt, Salmonella typhimurium LT2
gccuuccaucgcauc

SEQ ID NO: 3805433 - RNA, 21 nt, Salmonella typhimurium LT2
gccuuccucgucggcaagaau

SEQ ID NO: 3805434 - RNA, 17 nt, Salmonella typhimurium LT2
gccuuccugcaggcgag

SEQ ID NO: 3805435 - RNA, 17 nt, Salmonella typhimurium LT2
gccuucgauuaacgcau

SEQ ID NO: 3805436 - RNA, 21 nt, Salmonella typhimurium LT2
gccuucgcauauuguaccugc

SEQ ID NO: 3805437 - RNA, 13 nt, Salmonella typhimurium LT2
gccuucgccuuca

SEQ ID NO: 3805438 - RNA, 15 nt, Salmonella typhimurium LT2
gccuucgccuucacg

SEQ ID NO: 3805439 - RNA, 20 nt, Salmonella typhimurium LT2
gccuucgcggugaucccagg

SEQ ID NO: 3805440 - RNA, 18 nt, Salmonella typhimurium LT2
gccuucguuauaaggccu

SEQ ID NO: 3805441 - RNA, 19 nt, Salmonella typhimurium LT2
gccuucuccgcucaugccu

SEQ ID NO: 3805442 - RNA, 15 nt, Salmonella typhimurium LT2
gccuucugcgcccgc

SEQ ID NO: 3805443 - RNA, 13 nt, Salmonella typhimurium LT2
gccuucuggccaa

SEQ ID NO: 3805444 - RNA, 13 nt, Salmonella typhimurium LT2
gccuucugugaua

SEQ ID NO: 3805445 - RNA, 18 nt, Salmonella typhimurium LT2
gccuucuucgcaaucucc

SEQ ID NO: 3805446 - RNA, 20 nt, Salmonella typhimurium LT2
gccuugauccuguaacgcau

SEQ ID NO: 3805447 - RNA, 22 nt, Salmonella typhimurium LT2
gccuugcccguauugaagcgau

SEQ ID NO: 3805448 - RNA, 14 nt, Salmonella typhimurium LT2
gccuugcggcgcca

SEQ ID NO: 3805449 - RNA, 21 nt, Salmonella typhimurium LT2
gccuugcuggccuguucaagu

SEQ ID NO: 3805450 - RNA, 15 nt, Salmonella typhimurium LT2
gccuugguugccgca

SEQ ID NO: 3805451 - RNA, 16 nt, Salmonella typhimurium LT2
gccuuguugcggauga

SEQ ID NO: 3805452 - RNA, 15 nt, Salmonella typhimurium LT2
gccuuuaagcugauu

SEQ ID NO: 3805453 - RNA, 14 nt, Salmonella typhimurium LT2
gccuuuaugcaguu

SEQ ID NO: 3805454 - RNA, 18 nt, Salmonella typhimurium LT2
gccuuuaugcaguuccgu

SEQ ID NO: 3805455 - RNA, 20 nt, Salmonella typhimurium LT2
gccuuuauucauuucaaugu

SEQ ID NO: 3805456 - RNA, 17 nt, Salmonella typhimurium LT2
gccuuucaccagcgccu

SEQ ID NO: 3805457 - RNA, 16 nt, Salmonella typhimurium LT2
gccuuucaccaucagc

SEQ ID NO: 3805458 - RNA, 12 nt, Salmonella typhimurium LT2
gccuuucaccca

SEQ ID NO: 3805459 - RNA, 17 nt, Salmonella typhimurium LT2
gccuuucagaugguuug

SEQ ID NO: 3805460 - RNA, 14 nt, Salmonella typhimurium LT2
gccuuucgcgcugc

SEQ ID NO: 3805461 - RNA, 23 nt, Salmonella typhimurium LT2
gccuuugucauccaccaggauaa

SEQ ID NO: 3805462 - RNA, 20 nt, Salmonella typhimurium LT2
gccuuugucgaaauugccgc

SEQ ID NO: 3805463 - RNA, 21 nt, Salmonella typhimurium LT2
gccuuuuaucaaugcacugac

SEQ ID NO: 3805464 - RNA, 21 nt, Salmonella typhimurium LT2
gccuuuucccccagcaucuua

SEQ ID NO: 3805465 - RNA, 21 nt, Salmonella typhimurium LT2
gccuuuucguacauguccaga

SEQ ID NO: 3805466 - RNA, 14 nt, Salmonella typhimurium LT2
gccuuuuggcagca

SEQ ID NO: 3805467 - RNA, 16 nt, Salmonella typhimurium LT2
gccuuuuucaacagca

SEQ ID NO: 3805468 - RNA, 17 nt, Salmonella typhimurium LT2
gccuuuuucaacagcac

SEQ ID NO: 3805469 - RNA, 22 nt, Salmonella typhimurium LT2
gccuuuuucaacagcacccagg

SEQ ID NO: 3805470 - RNA, 19 nt, Salmonella typhimurium LT2
gccuuuuucgcucuuauca

SEQ ID NO: 3805471 - RNA, 16 nt, Salmonella typhimurium LT2
gccuuuuugcagcgcg

SEQ ID NO: 3805472 - RNA, 20 nt, Salmonella typhimurium LT2
gccuuuuugcagcgcggcca

SEQ ID NO: 3805473 - RNA, 17 nt, Salmonella typhimurium LT2
gccuuuuuuaauccagg

SEQ ID NO: 3805474 - RNA, 13 nt, Salmonella typhimurium LT2
gcgaaaaagugau

SEQ ID NO: 3805475 - RNA, 18 nt, Salmonella typhimurium LT2
gcgaaaaaguucacgcuu

SEQ ID NO: 3805476 - RNA, 23 nt, Salmonella typhimurium LT2
gcgaaaacguugacuuaaaaagc

SEQ ID NO: 3805477 - RNA, 15 nt, Salmonella typhimurium LT2
gcgaaaagccggaau

SEQ ID NO: 3805478 - RNA, 12 nt, Salmonella typhimurium LT2
gcgaaaauaaac

SEQ ID NO: 3805479 - RNA, 22 nt, Salmonella typhimurium LT2
gcgaaaauaaaggugccgccgc

SEQ ID NO: 3805480 - RNA, 22 nt, Salmonella typhimurium LT2
gcgaaaauaccccagcgcgccg

SEQ ID NO: 3805481 - RNA, 14 nt, Salmonella typhimurium LT2
gcgaaaauccagua

SEQ ID NO: 3805482 - RNA, 18 nt, Salmonella typhimurium LT2
gcgaaacgccuuauccgg

SEQ ID NO: 3805483 - RNA, 20 nt, Salmonella typhimurium LT2
gcgaaagcacucggcgccuu

SEQ ID NO: 3805484 - RNA, 23 nt, Salmonella typhimurium LT2
gcgaaagcgaccggcacucaccu

SEQ ID NO: 3805485 - RNA, 21 nt, Salmonella typhimurium LT2
gcgaaaucaaagaccuccgcc

SEQ ID NO: 3805486 - RNA, 15 nt, Salmonella typhimurium LT2
gcgaaaucaccgaca

SEQ ID NO: 3805487 - RNA, 12 nt, Salmonella typhimurium LT2
gcgaacagcgcu

SEQ ID NO: 3805488 - RNA, 19 nt, Salmonella typhimurium LT2
gcgaacaggcucagcgcca

SEQ ID NO: 3805489 - RNA, 20 nt, Salmonella typhimurium LT2
gcgaacaguguaaacgccag

SEQ ID NO: 3805490 - RNA, 20 nt, Salmonella typhimurium LT2
gcgaacauuccgcccaggaa

SEQ ID NO: 3805491 - RNA, 17 nt, Salmonella typhimurium LT2
gcgaaccaccagccgau

SEQ ID NO: 3805492 - RNA, 21 nt, Salmonella typhimurium LT2
gcgaaccaucauuaauauaau

SEQ ID NO: 3805493 - RNA, 17 nt, Salmonella typhimurium LT2
gcgaaccggaccagcac

SEQ ID NO: 3805494 - RNA, 20 nt, Salmonella typhimurium LT2
gcgaaccggaccagcacaaa

SEQ ID NO: 3805495 - RNA, 21 nt, Salmonella typhimurium LT2
gcgaacgacucacgcgcgcuu

SEQ ID NO: 3805496 - RNA, 16 nt, Salmonella typhimurium LT2
gcgaacgccaggccaa

SEQ ID NO: 3805497 - RNA, 14 nt, Salmonella typhimurium LT2
gcgaacggauaaac

SEQ ID NO: 3805498 - RNA, 20 nt, Salmonella typhimurium LT2
gcgaacggcuuuccagcagc

SEQ ID NO: 3805499 - RNA, 20 nt, Salmonella typhimurium LT2
gcgaacguuacccggccagc

SEQ ID NO: 3805500 - RNA, 21 nt, Salmonella typhimurium LT2
gcgaacugguuauacaguuca

SEQ ID NO: 3805501 - RNA, 16 nt, Salmonella typhimurium LT2
gcgaacuugccggaac

SEQ ID NO: 3805502 - RNA, 20 nt, Salmonella typhimurium LT2
gcgaagauuaauccggucau

SEQ ID NO: 3805503 - RNA, 15 nt, Salmonella typhimurium LT2
gcgaagccgccaccc

SEQ ID NO: 3805504 - RNA, 18 nt, Salmonella typhimurium LT2
gcgaagcucagccaggcg

SEQ ID NO: 3805505 - RNA, 19 nt, Salmonella typhimurium LT2
gcgaagcucagccaggcgc

SEQ ID NO: 3805506 - RNA, 18 nt, Salmonella typhimurium LT2
gcgaagggccagagaaag

SEQ ID NO: 3805507 - RNA, 14 nt, Salmonella typhimurium LT2
gcgaauaaacacau

SEQ ID NO: 3805508 - RNA, 16 nt, Salmonella typhimurium LT2
gcgaauaacaucaucc

SEQ ID NO: 3805509 - RNA, 16 nt, Salmonella typhimurium LT2
gcgaauaaucccggcg

SEQ ID NO: 3805510 - RNA, 20 nt, Salmonella typhimurium LT2
gcgaauaaucccggcgccaa

SEQ ID NO: 3805511 - RNA, 14 nt, Salmonella typhimurium LT2
gcgaauaaucgccg

SEQ ID NO: 3805512 - RNA, 20 nt, Salmonella typhimurium LT2
gcgaauacuguuccaggcga

SEQ ID NO: 3805513 - RNA, 14 nt, Salmonella typhimurium LT2
gcgaauagcgccag

SEQ ID NO: 3805514 - RNA, 15 nt, Salmonella typhimurium LT2
gcgaauauacgcacc

SEQ ID NO: 3805515 - RNA, 23 nt, Salmonella typhimurium LT2
gcgaaucacauccgccagcgccu

SEQ ID NO: 3805516 - RNA, 17 nt, Salmonella typhimurium LT2
gcgaauccgacaugacg

SEQ ID NO: 3805517 - RNA, 23 nt, Salmonella typhimurium LT2
gcgaaucgccuguaccgggcaga

SEQ ID NO: 3805518 - RNA, 20 nt, Salmonella typhimurium LT2
gcgaaucucgugaucgccaa

SEQ ID NO: 3805519 - RNA, 17 nt, Salmonella typhimurium LT2
gcgaaugccguuaacgg

SEQ ID NO: 3805520 - RNA, 23 nt, Salmonella typhimurium LT2
gcgaucgcgauucgcccacggau

SEQ ID NO: 3805521 - RNA, 12 nt, Salmonella typhimurium LT2
gcgaucgcgcca

SEQ ID NO: 3805522 - RNA, 11 nt, Salmonella typhimurium LT2
gcgaucgcggc

SEQ ID NO: 3805523 - RNA, 13 nt, Salmonella typhimurium LT2
gcgaucgcuucca

SEQ ID NO: 3805524 - RNA, 21 nt, Salmonella typhimurium LT2
gcgaucgggauuccagugaca

SEQ ID NO: 3805525 - RNA, 23 nt, Salmonella typhimurium LT2
gcgaucgggauuccagugacaau

SEQ ID NO: 3805526 - RNA, 14 nt, Salmonella typhimurium LT2
gcgaucucuuuauc

SEQ ID NO: 3805527 - RNA, 14 nt, Salmonella typhimurium LT2
gcgaucugucgccg

SEQ ID NO: 3805528 - RNA, 23 nt, Salmonella typhimurium LT2
gcgaucuuuuguuuaccccaggc

SEQ ID NO: 3805529 - RNA, 17 nt, Salmonella typhimurium LT2
gcgaugaccaucaaaua

SEQ ID NO: 3805530 - RNA, 20 nt, Salmonella typhimurium LT2
gcgaugacggcgcguuaucg

SEQ ID NO: 3805531 - RNA, 22 nt, Salmonella typhimurium LT2
gcgaugacgucacgaagauaug

SEQ ID NO: 3805532 - RNA, 13 nt, Salmonella typhimurium LT2
gcgaugagcgcca

SEQ ID NO: 3805533 - RNA, 19 nt, Salmonella typhimurium LT2
gcgaugagcgugacgaccg

SEQ ID NO: 3805534 - RNA, 23 nt, Salmonella typhimurium LT2
gcgaugaguaaaauuuuuuucau

SEQ ID NO: 3805535 - RNA, 14 nt, Salmonella typhimurium LT2
gcgaugauaguguc

SEQ ID NO: 3805536 - RNA, 17 nt, Salmonella typhimurium LT2
gcgaugccaccagccua

SEQ ID NO: 3805537 - RNA, 19 nt, Salmonella typhimurium LT2
gcgaugccgacgcccgcuu

SEQ ID NO: 3805538 - RNA, 14 nt, Salmonella typhimurium LT2
gcgauggcagaccg

SEQ ID NO: 3805539 - RNA, 21 nt, Salmonella typhimurium LT2
gcgauggcagaccgauaauaa

SEQ ID NO: 3805540 - RNA, 18 nt, Salmonella typhimurium LT2
gcgaugguccccgguccu

SEQ ID NO: 3805541 - RNA, 23 nt, Salmonella typhimurium LT2
gcgauguauuuauccacgccgcu

SEQ ID NO: 3805542 - RNA, 22 nt, Salmonella typhimurium LT2
gcgauguuuacugcggcgcaac

SEQ ID NO: 3805543 - RNA, 22 nt, Salmonella typhimurium LT2
gcgauguuuuuaucaugcugac

SEQ ID NO: 3805544 - RNA, 16 nt, Salmonella typhimurium LT2
gcgauucaacaggaca

SEQ ID NO: 3805545 - RNA, 18 nt, Salmonella typhimurium LT2
gcgauucauaugcgccaa

SEQ ID NO: 3805546 - RNA, 16 nt, Salmonella typhimurium LT2
gcgauucgcccacgga

SEQ ID NO: 3805547 - RNA, 23 nt, Salmonella typhimurium LT2
gcgauugaucggaugaucgucaa

SEQ ID NO: 3805548 - RNA, 18 nt, Salmonella typhimurium LT2
gcgauuuauccaccgcca

SEQ ID NO: 3805549 - RNA, 14 nt, Salmonella typhimurium LT2
gcgauuuuuaggcc

SEQ ID NO: 3805550 - RNA, 13 nt, Salmonella typhimurium LT2
gcgcaaaagcgcg

SEQ ID NO: 3805551 - RNA, 16 nt, Salmonella typhimurium LT2
gcgcaaaagcgcgccc

SEQ ID NO: 3805552 - RNA, 21 nt, Salmonella typhimurium LT2
gcgcaaaaucgcaaacgccag

SEQ ID NO: 3805553 - RNA, 15 nt, Salmonella typhimurium LT2
gcgcaaacaacccgg

SEQ ID NO: 3805554 - RNA, 20 nt, Salmonella typhimurium LT2
gcgcaaacacggcugucggu

SEQ ID NO: 3805555 - RNA, 18 nt, Salmonella typhimurium LT2
gcgcaaacgcgugcuggu

SEQ ID NO: 3805556 - RNA, 22 nt, Salmonella typhimurium LT2
gcgcaaacuucgcauuuuuauc

SEQ ID NO: 3805557 - RNA, 18 nt, Salmonella typhimurium LT2
gcgcaaaucgccaucagc

SEQ ID NO: 3805558 - RNA, 18 nt, Salmonella typhimurium LT2
gcgcaaccgacgggcgcu

SEQ ID NO: 3805559 - RNA, 19 nt, Salmonella typhimurium LT2
gcgcaacgcuuaaucccuu

SEQ ID NO: 3805560 - RNA, 18 nt, Salmonella typhimurium LT2
gcgcaaggccguuaucca

SEQ ID NO: 3805561 - RNA, 21 nt, Salmonella typhimurium LT2
gcgcaauaaauucgaaauaaa

SEQ ID NO: 3805562 - RNA, 16 nt, Salmonella typhimurium LT2
gcgcaaucauuaccgg

SEQ ID NO: 3805563 - RNA, 14 nt, Salmonella typhimurium LT2
gcgcaaucgggccu

SEQ ID NO: 3805564 - RNA, 19 nt, Salmonella typhimurium LT2
gcgcaaucgggccugcucc

SEQ ID NO: 3805565 - RNA, 20 nt, Salmonella typhimurium LT2
gcgcaaucgggccugcuccg

SEQ ID NO: 3805566 - RNA, 20 nt, Salmonella typhimurium LT2
gcgcaaucugcucgacgcgc

SEQ ID NO: 3805567 - RNA, 12 nt, Salmonella typhimurium LT2
gcgcaauguuca

SEQ ID NO: 3805568 - RNA, 14 nt, Salmonella typhimurium LT2
gcgcaauuccagca

SEQ ID NO: 3805569 - RNA, 19 nt, Salmonella typhimurium LT2
gcgcacacaauagcaaucu

SEQ ID NO: 3805570 - RNA, 14 nt, Salmonella typhimurium LT2
gcgcacacgcccag

SEQ ID NO: 3805571 - RNA, 14 nt, Salmonella typhimurium LT2
gcgcacgcgcgcgc

SEQ ID NO: 3805572 - RNA, 17 nt, Salmonella typhimurium LT2
gcgcacggcgcguccuc

SEQ ID NO: 3805573 - RNA, 13 nt, Salmonella typhimurium LT2
gcgcacggucgcu

SEQ ID NO: 3805574 - RNA, 24 nt, Salmonella typhimurium LT2
gcgcacgucgguaaagcgcaccag

SEQ ID NO: 3805575 - RNA, 21 nt, Salmonella typhimurium LT2
gcgcagaaucacuucauccgg

SEQ ID NO: 3805576 - RNA, 19 nt, Salmonella typhimurium LT2
gcgcagaauucugagguga

SEQ ID NO: 3805577 - RNA, 18 nt, Salmonella typhimurium LT2
gcgcagacuugaaucugu

SEQ ID NO: 3805578 - RNA, 21 nt, Salmonella typhimurium LT2
gcgcagauauuuuccaucacg

SEQ ID NO: 3805579 - RNA, 22 nt, Salmonella typhimurium LT2
gcgcagccacggcgcacacgcc

SEQ ID NO: 3805580 - RNA, 16 nt, Salmonella typhimurium LT2
gcgcagccagcgcccc

SEQ ID NO: 3805581 - RNA, 12 nt, Salmonella typhimurium LT2
gcgcagcccaua

SEQ ID NO: 3805582 - RNA, 15 nt, Salmonella typhimurium LT2
gcgcagccccagcgc

SEQ ID NO: 3805583 - RNA, 17 nt, Salmonella typhimurium LT2
gcgcagccgcucaauaa

SEQ ID NO: 3805584 - RNA, 20 nt, Salmonella typhimurium LT2
gcgcagcgaaacugcgcgcc

SEQ ID NO: 3805585 - RNA, 22 nt, Salmonella typhimurium LT2
gcgcagcgaaacugcgcgccgg

SEQ ID NO: 3805586 - RNA, 16 nt, Salmonella typhimurium LT2
gcgcagcgcaucaggc

SEQ ID NO: 3805587 - RNA, 11 nt, Salmonella typhimurium LT2
gcgcagcgcca

SEQ ID NO: 3805588 - RNA, 18 nt, Salmonella typhimurium LT2
gcgcagcgccaucaggca

SEQ ID NO: 3805589 - RNA, 20 nt, Salmonella typhimurium LT2
gcgcagcgccaucaggcaau

SEQ ID NO: 3805590 - RNA, 19 nt, Salmonella typhimurium LT2
gcgcagcgccaucaggccc

SEQ ID NO: 3805591 - RNA, 19 nt, Salmonella typhimurium LT2
gcgcagcgccaucaggccu

SEQ ID NO: 3805592 - RNA, 18 nt, Salmonella typhimurium LT2
gcgcagcgccauccggca

SEQ ID NO: 3805593 - RNA, 15 nt, Salmonella typhimurium LT2
gcgcagcgcgcgacc

SEQ ID NO: 3805594 - RNA, 16 nt, Salmonella typhimurium LT2
gcgcagcgcgcggaug

SEQ ID NO: 3805595 - RNA, 21 nt, Salmonella typhimurium LT2
gcgcagcguggccuuauccag

SEQ ID NO: 3805596 - RNA, 15 nt, Salmonella typhimurium LT2
gcgcaggcgggggcg

SEQ ID NO: 3805597 - RNA, 18 nt, Salmonella typhimurium LT2
gcgcagggcgauauccag

SEQ ID NO: 3805598 - RNA, 14 nt, Salmonella typhimurium LT2
gcgcaggggcauuu

SEQ ID NO: 3805599 - RNA, 19 nt, Salmonella typhimurium LT2
gcgcaggggcauuuuccgg

SEQ ID NO: 3805600 - RNA, 21 nt, Salmonella typhimurium LT2
gcgcaggguuucgauauccag

SEQ ID NO: 3805601 - RNA, 20 nt, Salmonella typhimurium LT2
gcgcaguaaacuccucuucc

SEQ ID NO: 3805602 - RNA, 14 nt, Salmonella typhimurium LT2
gcgcagucacagau

SEQ ID NO: 3805603 - RNA, 22 nt, Salmonella typhimurium LT2
gcgcagucacagauccagacau

SEQ ID NO: 3805604 - RNA, 16 nt, Salmonella typhimurium LT2
gcgcagucagugaaaa

SEQ ID NO: 3805605 - RNA, 17 nt, Salmonella typhimurium LT2
gcgcagugaccagcauc

SEQ ID NO: 3805606 - RNA, 13 nt, Salmonella typhimurium LT2
gcgcaguggcggc

SEQ ID NO: 3805607 - RNA, 14 nt, Salmonella typhimurium LT2
gcgcaguggcggcu

SEQ ID NO: 3805608 - RNA, 19 nt, Salmonella typhimurium LT2
gcgcaguucgccaccagga

SEQ ID NO: 3805609 - RNA, 21 nt, Salmonella typhimurium LT2
gcgcaguuuacgcagcgccuu

SEQ ID NO: 3805610 - RNA, 23 nt, Salmonella typhimurium LT2
gcgcauaauccggaauaagaaua

SEQ ID NO: 3805611 - RNA, 18 nt, Salmonella typhimurium LT2
gcgcauacucauuaccgg

SEQ ID NO: 3805612 - RNA, 23 nt, Salmonella typhimurium LT2
gcgcauacucauuaccggcugcc

SEQ ID NO: 3805613 - RNA, 19 nt, Salmonella typhimurium LT2
gcgcauacugcgaugcgcu

SEQ ID NO: 3805614 - RNA, 15 nt, Salmonella typhimurium LT2
gcgcauaucuuacgg

SEQ ID NO: 3805615 - RNA, 11 nt, Salmonella typhimurium LT2
gcgcauccagc

SEQ ID NO: 3805616 - RNA, 17 nt, Salmonella typhimurium LT2
gcgcauccggccagcga

SEQ ID NO: 3805617 - RNA, 12 nt, Salmonella typhimurium LT2
gcgcauccggcg

SEQ ID NO: 3805618 - RNA, 18 nt, Salmonella typhimurium LT2
gcgcauccgguaaacgcu

SEQ ID NO: 3805619 - RNA, 23 nt, Salmonella typhimurium LT2
gcgcaucgcccugccagugaaag

SEQ ID NO: 3805620 - RNA, 20 nt, Salmonella typhimurium LT2
gcgcaucggucuccagcaac

SEQ ID NO: 3805621 - RNA, 12 nt, Salmonella typhimurium LT2
gcgcauggaaga

SEQ ID NO: 3805622 - RNA, 15 nt, Salmonella typhimurium LT2
gcgcauguaaccaaa

SEQ ID NO: 3805623 - RNA, 16 nt, Salmonella typhimurium LT2
gcgccgauaaucggcg

SEQ ID NO: 3805624 - RNA, 13 nt, Salmonella typhimurium LT2
gcgccgcagcgcc

SEQ ID NO: 3805625 - RNA, 14 nt, Salmonella typhimurium LT2
gcgccgcagcgccu

SEQ ID NO: 3805626 - RNA, 18 nt, Salmonella typhimurium LT2
gcgccgccaauauccauu

SEQ ID NO: 3805627 - RNA, 15 nt, Salmonella typhimurium LT2
gcgccgccagcgaca

SEQ ID NO: 3805628 - RNA, 11 nt, Salmonella typhimurium LT2
gcgccgccauc

SEQ ID NO: 3805629 - RNA, 14 nt, Salmonella typhimurium LT2
gcgccgccauccgg

SEQ ID NO: 3805630 - RNA, 17 nt, Salmonella typhimurium LT2
gcgccgccauccggcac

SEQ ID NO: 3805631 - RNA, 12 nt, Salmonella typhimurium LT2
gcgccgccgccu

SEQ ID NO: 3805632 - RNA, 23 nt, Salmonella typhimurium LT2
gcgccgccgggaucagcggcugc

SEQ ID NO: 3805633 - RNA, 21 nt, Salmonella typhimurium LT2
gcgccgccucgcgauccgcca

SEQ ID NO: 3805634 - RNA, 18 nt, Salmonella typhimurium LT2
gcgccgccugcuccgggc

SEQ ID NO: 3805635 - RNA, 13 nt, Salmonella typhimurium LT2
gcgccgcgcacgc

SEQ ID NO: 3805636 - RNA, 13 nt, Salmonella typhimurium LT2
gcgccgcgccacc

SEQ ID NO: 3805637 - RNA, 19 nt, Salmonella typhimurium LT2
gcgccgcgccaccgggccg

SEQ ID NO: 3805638 - RNA, 14 nt, Salmonella typhimurium LT2
gcgccgcgccgccc

SEQ ID NO: 3805639 - RNA, 15 nt, Salmonella typhimurium LT2
gcgccgcgggcuggu

SEQ ID NO: 3805640 - RNA, 18 nt, Salmonella typhimurium LT2
gcgccgcgggcugguagu

SEQ ID NO: 3805641 - RNA, 14 nt, Salmonella typhimurium LT2
gcgccgcggguauu

SEQ ID NO: 3805642 - RNA, 16 nt, Salmonella typhimurium LT2
gcgccgcuacucagcc

SEQ ID NO: 3805643 - RNA, 22 nt, Salmonella typhimurium LT2
gcgccgcucaucaccagcagca

SEQ ID NO: 3805644 - RNA, 16 nt, Salmonella typhimurium LT2
gcgccgcugagaaaaa

SEQ ID NO: 3805645 - RNA, 23 nt, Salmonella typhimurium LT2
gcgccgcuggcgaccagccugcc

SEQ ID NO: 3805646 - RNA, 11 nt, Salmonella typhimurium LT2
gcgccgcuucc

SEQ ID NO: 3805647 - RNA, 14 nt, Salmonella typhimurium LT2
gcgccgcuuccagg

SEQ ID NO: 3805648 - RNA, 15 nt, Salmonella typhimurium LT2
gcgccgcuuccggca

SEQ ID NO: 3805649 - RNA, 18 nt, Salmonella typhimurium LT2
gcgccgcuuccggcaggu

SEQ ID NO: 3805650 - RNA, 15 nt, Salmonella typhimurium LT2
gcgccggaacaggcu

SEQ ID NO: 3805651 - RNA, 14 nt, Salmonella typhimurium LT2
gcgccggacagcag

SEQ ID NO: 3805652 - RNA, 15 nt, Salmonella typhimurium LT2
gcgccggacagcagc

SEQ ID NO: 3805653 - RNA, 16 nt, Salmonella typhimurium LT2
gcgccggacgccacgc

SEQ ID NO: 3805654 - RNA, 17 nt, Salmonella typhimurium LT2
gcgccggacuccagcaa

SEQ ID NO: 3805655 - RNA, 23 nt, Salmonella typhimurium LT2
gcgccggacuccagcaacgccgc

SEQ ID NO: 3805656 - RNA, 18 nt, Salmonella typhimurium LT2
gcgccggaucgggcuucc

SEQ ID NO: 3805657 - RNA, 19 nt, Salmonella typhimurium LT2
gcgccggaucgggcuucca

SEQ ID NO: 3805658 - RNA, 21 nt, Salmonella typhimurium LT2
gcgccgggaaaaucagugaac

SEQ ID NO: 3805659 - RNA, 24 nt, Salmonella typhimurium LT2
gcgccggggaagcgacgacacggc

SEQ ID NO: 3805660 - RNA, 17 nt, Salmonella typhimurium LT2
gcgccggugaucccacc

SEQ ID NO: 3805661 - RNA, 13 nt, Salmonella typhimurium LT2
gcgccguaaacaa

SEQ ID NO: 3805662 - RNA, 19 nt, Salmonella typhimurium LT2
gcgccgucacccgcguauc

SEQ ID NO: 3805663 - RNA, 21 nt, Salmonella typhimurium LT2
gcgccgucacucccugcguca

SEQ ID NO: 3805664 - RNA, 13 nt, Salmonella typhimurium LT2
gcgccgucauccg

SEQ ID NO: 3805665 - RNA, 15 nt, Salmonella typhimurium LT2
gcgccguccauaaug

SEQ ID NO: 3805666 - RNA, 19 nt, Salmonella typhimurium LT2
gcgccgucuggagcgauga

SEQ ID NO: 3805667 - RNA, 17 nt, Salmonella typhimurium LT2
gcgccgugcccagcauc

SEQ ID NO: 3805668 - RNA, 18 nt, Salmonella typhimurium LT2
gcgccguggaaaagagcg

SEQ ID NO: 3805669 - RNA, 23 nt, Salmonella typhimurium LT2
gcgccgugucaucauuacaggcg

SEQ ID NO: 3805670 - RNA, 17 nt, Salmonella typhimurium LT2
gcgccguugaaaucggu

SEQ ID NO: 3805671 - RNA, 14 nt, Salmonella typhimurium LT2
gcgccuaccgccau

SEQ ID NO: 3805672 - RNA, 15 nt, Salmonella typhimurium LT2
gcgccuaccgccaua

SEQ ID NO: 3805673 - RNA, 15 nt, Salmonella typhimurium LT2
gcgccuagcgcgcgc

SEQ ID NO: 3805674 - RNA, 19 nt, Salmonella typhimurium LT2
gcgccuauguuaugcacaa

SEQ ID NO: 3805675 - RNA, 18 nt, Salmonella typhimurium LT2
gcgccuccacaaagcgcg

SEQ ID NO: 3805676 - RNA, 19 nt, Salmonella typhimurium LT2
gcgccuccacaaagcgcga

SEQ ID NO: 3805677 - RNA, 17 nt, Salmonella typhimurium LT2
gcgccuccccugccggc

SEQ ID NO: 3805678 - RNA, 15 nt, Salmonella typhimurium LT2
gcgccuccgcguagc

SEQ ID NO: 3805679 - RNA, 23 nt, Salmonella typhimurium LT2
gcgccuccgcguagcccagcgcc

SEQ ID NO: 3805680 - RNA, 15 nt, Salmonella typhimurium LT2
gcgccuccggccugc

SEQ ID NO: 3805681 - RNA, 16 nt, Salmonella typhimurium LT2
gcgccucgcugacgcc

SEQ ID NO: 3805682 - RNA, 17 nt, Salmonella typhimurium LT2
gcgccucgcugacgcca

SEQ ID NO: 3805683 - RNA, 18 nt, Salmonella typhimurium LT2
gcgccucgcugacgccag

SEQ ID NO: 3805684 - RNA, 14 nt, Salmonella typhimurium LT2
gcgccucggcgccc

SEQ ID NO: 3805685 - RNA, 19 nt, Salmonella typhimurium LT2
gcgccucgguggccuugua

SEQ ID NO: 3805686 - RNA, 11 nt, Salmonella typhimurium LT2
gcgccugaaua

SEQ ID NO: 3805687 - RNA, 16 nt, Salmonella typhimurium LT2
gcgccugacgcggacg

SEQ ID NO: 3805688 - RNA, 21 nt, Salmonella typhimurium LT2
gcgccugacgcggacgccacc

SEQ ID NO: 3805689 - RNA, 17 nt, Salmonella typhimurium LT2
gcgccugcauacucaca

SEQ ID NO: 3805690 - RNA, 20 nt, Salmonella typhimurium LT2
gcgccugcaugucuucaugu

SEQ ID NO: 3805691 - RNA, 18 nt, Salmonella typhimurium LT2
gcgccugcugccagccgc

SEQ ID NO: 3805692 - RNA, 21 nt, Salmonella typhimurium LT2
gcgccuggaucugcgcauuaa

SEQ ID NO: 3805693 - RNA, 17 nt, Salmonella typhimurium LT2
gcgccugggauaagcag

SEQ ID NO: 3805694 - RNA, 23 nt, Salmonella typhimurium LT2
gcgccugugcuuucgccaccagc

SEQ ID NO: 3805695 - RNA, 16 nt, Salmonella typhimurium LT2
gcgccuguuagggcgc

SEQ ID NO: 3805696 - RNA, 17 nt, Salmonella typhimurium LT2
gcgccuuaaaaagaaca

SEQ ID NO: 3805697 - RNA, 23 nt, Salmonella typhimurium LT2
gcgccuuacccggccuacacauc

SEQ ID NO: 3805698 - RNA, 16 nt, Salmonella typhimurium LT2
gcgccuuacguaccgg

SEQ ID NO: 3805699 - RNA, 13 nt, Salmonella typhimurium LT2
gcgccuuauccag

SEQ ID NO: 3805700 - RNA, 16 nt, Salmonella typhimurium LT2
gcgccuuauccggccu

SEQ ID NO: 3805701 - RNA, 17 nt, Salmonella typhimurium LT2
gcgccuucaggcaucag

SEQ ID NO: 3805702 - RNA, 21 nt, Salmonella typhimurium LT2
gcgccuucuucgcaaucuccg

SEQ ID NO: 3805703 - RNA, 14 nt, Salmonella typhimurium LT2
gcgccuugccccag

SEQ ID NO: 3805704 - RNA, 23 nt, Salmonella typhimurium LT2
gcgccuuuaauuccgccgggcaa

SEQ ID NO: 3805705 - RNA, 17 nt, Salmonella typhimurium LT2
gcgccuuucgcgcugca

SEQ ID NO: 3805706 - RNA, 23 nt, Salmonella typhimurium LT2
gcgcgaaaucaaagaccuccgcc

SEQ ID NO: 3805707 - RNA, 23 nt, Salmonella typhimurium LT2
gcgcgaacgccuuauccggccug

SEQ ID NO: 3805708 - RNA, 21 nt, Salmonella typhimurium LT2
gcgcgaauaaugcauccgcca

SEQ ID NO: 3805709 - RNA, 21 nt, Salmonella typhimurium LT2
gcgcgaaucgacaauccgcca

SEQ ID NO: 3805710 - RNA, 18 nt, Salmonella typhimurium LT2
gcgcgaauuugccccaga

SEQ ID NO: 3805711 - RNA, 23 nt, Salmonella typhimurium LT2
gcgcgaauuuuauuaagcaggcc

SEQ ID NO: 3805712 - RNA, 15 nt, Salmonella typhimurium LT2
gcgcgacaacaucgc

SEQ ID NO: 3805713 - RNA, 16 nt, Salmonella typhimurium LT2
gcgcgacgccaaaccc

SEQ ID NO: 3805714 - RNA, 18 nt, Salmonella typhimurium LT2
gcgcgacgguaaggcuau

SEQ ID NO: 3805715 - RNA, 17 nt, Salmonella typhimurium LT2
gcgcgacugcgcgcggu

SEQ ID NO: 3805716 - RNA, 15 nt, Salmonella typhimurium LT2
gcgcgauacgcagaa

SEQ ID NO: 3805717 - RNA, 21 nt, Salmonella typhimurium LT2
gcgcgaucgccccgaccagga

SEQ ID NO: 3805718 - RNA, 23 nt, Salmonella typhimurium LT2
gcgcgaugcgacucggugccgcu

SEQ ID NO: 3805719 - RNA, 13 nt, Salmonella typhimurium LT2
gcgcgauuuuuuc

SEQ ID NO: 3805720 - RNA, 19 nt, Salmonella typhimurium LT2
gcgcgccaauggccgcccc

SEQ ID NO: 3805721 - RNA, 16 nt, Salmonella typhimurium LT2
gcgcgccacgcaugga

SEQ ID NO: 3805722 - RNA, 13 nt, Salmonella typhimurium LT2
gcgcgccagcgcc

SEQ ID NO: 3805723 - RNA, 12 nt, Salmonella typhimurium LT2
gcgcgccagcgg

SEQ ID NO: 3805724 - RNA, 14 nt, Salmonella typhimurium LT2
gcgcgccagcucuu

SEQ ID NO: 3805725 - RNA, 15 nt, Salmonella typhimurium LT2
gcgcgccaguuuggu

SEQ ID NO: 3805726 - RNA, 13 nt, Salmonella typhimurium LT2
gcgcgccaugaga

SEQ ID NO: 3805727 - RNA, 22 nt, Salmonella typhimurium LT2
gcgcucuaucaccgcccgccgg

SEQ ID NO: 3805728 - RNA, 16 nt, Salmonella typhimurium LT2
gcgcucugccaguagc

SEQ ID NO: 3805729 - RNA, 15 nt, Salmonella typhimurium LT2
gcgcucuucgcucca

SEQ ID NO: 3805730 - RNA, 22 nt, Salmonella typhimurium LT2
gcgcucuuuuucuugucuccac

SEQ ID NO: 3805731 - RNA, 14 nt, Salmonella typhimurium LT2
gcgcugaagcccgc

SEQ ID NO: 3805732 - RNA, 15 nt, Salmonella typhimurium LT2
gcgcugaaucgcaau

SEQ ID NO: 3805733 - RNA, 14 nt, Salmonella typhimurium LT2
gcgcugacaucauc

SEQ ID NO: 3805734 - RNA, 19 nt, Salmonella typhimurium LT2
gcgcugacaucauccacgg

SEQ ID NO: 3805735 - RNA, 20 nt, Salmonella typhimurium LT2
gcgcugacaucauccacggc

SEQ ID NO: 3805736 - RNA, 22 nt, Salmonella typhimurium LT2
gcgcugccgucaaugccgggca

SEQ ID NO: 3805737 - RNA, 12 nt, Salmonella typhimurium LT2
gcgcugcgccau

SEQ ID NO: 3805738 - RNA, 14 nt, Salmonella typhimurium LT2
gcgcugcgccgcaa

SEQ ID NO: 3805739 - RNA, 21 nt, Salmonella typhimurium LT2
gcgcugcgcgauucgcccggc

SEQ ID NO: 3805740 - RNA, 13 nt, Salmonella typhimurium LT2
gcgcugcgcucuu

SEQ ID NO: 3805741 - RNA, 20 nt, Salmonella typhimurium LT2
gcgcugcgcuuaccaggccu

SEQ ID NO: 3805742 - RNA, 22 nt, Salmonella typhimurium LT2
gcgcugcgcuuaccgggccuac

SEQ ID NO: 3805743 - RNA, 16 nt, Salmonella typhimurium LT2
gcgcugcgcuuauccg

SEQ ID NO: 3805744 - RNA, 20 nt, Salmonella typhimurium LT2
gcgcugcgcuuauccggccu

SEQ ID NO: 3805745 - RNA, 16 nt, Salmonella typhimurium LT2
gcgcugcggcuacacg

SEQ ID NO: 3805746 - RNA, 21 nt, Salmonella typhimurium LT2
gcgcugcugcucaaaggcgcu

SEQ ID NO: 3805747 - RNA, 21 nt, Salmonella typhimurium LT2
gcgcugcuggagaccaccggc

SEQ ID NO: 3805748 - RNA, 20 nt, Salmonella typhimurium LT2
gcgcuggaaugcgcgcguga

SEQ ID NO: 3805749 - RNA, 14 nt, Salmonella typhimurium LT2
gcgcuggcagaucg

SEQ ID NO: 3805750 - RNA, 14 nt, Salmonella typhimurium LT2
gcgcuggcgagcga

SEQ ID NO: 3805751 - RNA, 15 nt, Salmonella typhimurium LT2
gcgcuggcgcgccug

SEQ ID NO: 3805752 - RNA, 20 nt, Salmonella typhimurium LT2
gcgcuggcgcggauuuccgg

SEQ ID NO: 3805753 - RNA, 17 nt, Salmonella typhimurium LT2
gcgcuggcgcuuaccgg

SEQ ID NO: 3805754 - RNA, 20 nt, Salmonella typhimurium LT2
gcgcuggggugcgccgcagc

SEQ ID NO: 3805755 - RNA, 17 nt, Salmonella typhimurium LT2
gcgcuggucagcagaaa

SEQ ID NO: 3805756 - RNA, 16 nt, Salmonella typhimurium LT2
gcgcuguacgccucuu

SEQ ID NO: 3805757 - RNA, 16 nt, Salmonella typhimurium LT2
gcgcuguauucgucca

SEQ ID NO: 3805758 - RNA, 15 nt, Salmonella typhimurium LT2
gcgcugucagcacaa

SEQ ID NO: 3805759 - RNA, 16 nt, Salmonella typhimurium LT2
gcgcugucgccacgca

SEQ ID NO: 3805760 - RNA, 19 nt, Salmonella typhimurium LT2
gcgcugucgccaucaccag

SEQ ID NO: 3805761 - RNA, 18 nt, Salmonella typhimurium LT2
gcgcugucgcuaauccgg

SEQ ID NO: 3805762 - RNA, 17 nt, Salmonella typhimurium LT2
gcgcugucgcuuaccgg

SEQ ID NO: 3805763 - RNA, 15 nt, Salmonella typhimurium LT2
gcgcugugcggcgug

SEQ ID NO: 3805764 - RNA, 15 nt, Salmonella typhimurium LT2
gcgcuguguccgccu

SEQ ID NO: 3805765 - RNA, 13 nt, Salmonella typhimurium LT2
gcgcuuacacaga

SEQ ID NO: 3805766 - RNA, 20 nt, Salmonella typhimurium LT2
gcgcuuaccaggccuacacg

SEQ ID NO: 3805767 - RNA, 19 nt, Salmonella typhimurium LT2
gcgcuuaccgggccuacag

SEQ ID NO: 3805768 - RNA, 22 nt, Salmonella typhimurium LT2
gcgcuuagccugcucgaucagc

SEQ ID NO: 3805769 - RNA, 23 nt, Salmonella typhimurium LT2
gcgcuuagcggcaccuuguccgg

SEQ ID NO: 3805770 - RNA, 13 nt, Salmonella typhimurium LT2
gcgcuuaucccag

SEQ ID NO: 3805771 - RNA, 14 nt, Salmonella typhimurium LT2
gcgcuuauccggcc

SEQ ID NO: 3805772 - RNA, 21 nt, Salmonella typhimurium LT2
gcgcuuauccggccuacagcu

SEQ ID NO: 3805773 - RNA, 20 nt, Salmonella typhimurium LT2
gcgcuuaucgggcagacugu

SEQ ID NO: 3805774 - RNA, 14 nt, Salmonella typhimurium LT2
gcgcuuccagcaug

SEQ ID NO: 3805775 - RNA, 16 nt, Salmonella typhimurium LT2
gcgcuucgccugccgg

SEQ ID NO: 3805776 - RNA, 17 nt, Salmonella typhimurium LT2
gcgcuucgcuuaucagg

SEQ ID NO: 3805777 - RNA, 20 nt, Salmonella typhimurium LT2
gcgcuucgcuuaucaggccu

SEQ ID NO: 3805778 - RNA, 16 nt, Salmonella typhimurium LT2
gcgcuucgcuuaucgg

SEQ ID NO: 3805779 - RNA, 20 nt, Salmonella typhimurium LT2
gcgcuucgcuuaucgggccu

SEQ ID NO: 3805780 - RNA, 18 nt, Salmonella typhimurium LT2
gcgcuucucccagccguc

SEQ ID NO: 3805781 - RNA, 22 nt, Salmonella typhimurium LT2
gcgcuugcauggcagccccggc

SEQ ID NO: 3805782 - RNA, 22 nt, Salmonella typhimurium LT2
gcgcuugccuuuacuguugccu

SEQ ID NO: 3805783 - RNA, 14 nt, Salmonella typhimurium LT2
gcgcuuuaaacaua

SEQ ID NO: 3805784 - RNA, 16 nt, Salmonella typhimurium LT2
gcgcuuuagggcuucc

SEQ ID NO: 3805785 - RNA, 17 nt, Salmonella typhimurium LT2
gcgcuuucaaucgucag

SEQ ID NO: 3805786 - RNA, 18 nt, Salmonella typhimurium LT2
gcgcuuucagcgcaugga

SEQ ID NO: 3805787 - RNA, 15 nt, Salmonella typhimurium LT2
gcgcuuucuucuuca

SEQ ID NO: 3805788 - RNA, 18 nt, Salmonella typhimurium LT2
gcgcuuugccgcugcugc

SEQ ID NO: 3805789 - RNA, 17 nt, Salmonella typhimurium LT2
gcgcuuugcuuauccgg

SEQ ID NO: 3805790 - RNA, 20 nt, Salmonella typhimurium LT2
gcgcuuugcuuauccggccu

SEQ ID NO: 3805791 - RNA, 19 nt, Salmonella typhimurium LT2
gcgcuuugggaacuagcga

SEQ ID NO: 3805792 - RNA, 20 nt, Salmonella typhimurium LT2
gcgcuuuggguuaaugccag

SEQ ID NO: 3805793 - RNA, 12 nt, Salmonella typhimurium LT2
gcgcuuuguuuc

SEQ ID NO: 3805794 - RNA, 16 nt, Salmonella typhimurium LT2
gcgcuuuuaaaauaaa

SEQ ID NO: 3805795 - RNA, 13 nt, Salmonella typhimurium LT2
gcggaaagccuuc

SEQ ID NO: 3805796 - RNA, 20 nt, Salmonella typhimurium LT2
gcggaaaggacguucuucuc

SEQ ID NO: 3805797 - RNA, 22 nt, Salmonella typhimurium LT2
gcggaaaggacuuaucaggccu

SEQ ID NO: 3805798 - RNA, 21 nt, Salmonella typhimurium LT2
gcggaacaucgcuuuuugcag

SEQ ID NO: 3805799 - RNA, 21 nt, Salmonella typhimurium LT2
gcggaacgucuuuuuccagca

SEQ ID NO: 3805800 - RNA, 15 nt, Salmonella typhimurium LT2
gcggaaguagagaac

SEQ ID NO: 3805801 - RNA, 19 nt, Salmonella typhimurium LT2
gcggaaguuaccgcgccag

SEQ ID NO: 3805802 - RNA, 19 nt, Salmonella typhimurium LT2
gcggaaucacgcauauccc

SEQ ID NO: 3805803 - RNA, 19 nt, Salmonella typhimurium LT2
gcggaaucgcuuccugggu

SEQ ID NO: 3805804 - RNA, 20 nt, Salmonella typhimurium LT2
gcggaaucgucacagacccc

SEQ ID NO: 3805805 - RNA, 19 nt, Salmonella typhimurium LT2
gcggaauggcgggcgcagg

SEQ ID NO: 3805806 - RNA, 19 nt, Salmonella typhimurium LT2
gcggaauugguagacgcgc

SEQ ID NO: 3805807 - RNA, 19 nt, Salmonella typhimurium LT2
gcggaauuuuauccugggu

SEQ ID NO: 3805808 - RNA, 16 nt, Salmonella typhimurium LT2
gcggacacccgcagcc

SEQ ID NO: 3805809 - RNA, 13 nt, Salmonella typhimurium LT2
gcggacgcagcuc

SEQ ID NO: 3805810 - RNA, 18 nt, Salmonella typhimurium LT2
gcggacggcaaccguccg

SEQ ID NO: 3805811 - RNA, 19 nt, Salmonella typhimurium LT2
gcggacguagcggcgccgg

SEQ ID NO: 3805812 - RNA, 20 nt, Salmonella typhimurium LT2
gcggacucgcuggacauuaa

SEQ ID NO: 3805813 - RNA, 17 nt, Salmonella typhimurium LT2
gcggagaagacgccgcc

SEQ ID NO: 3805814 - RNA, 15 nt, Salmonella typhimurium LT2
gcggagaguugaaac

SEQ ID NO: 3805815 - RNA, 16 nt, Salmonella typhimurium LT2
gcggagaucuccagau

SEQ ID NO: 3805816 - RNA, 13 nt, Salmonella typhimurium LT2
gcggaggggagga

SEQ ID NO: 3805817 - RNA, 19 nt, Salmonella typhimurium LT2
gcggagguuucuuuuucua

SEQ ID NO: 3805818 - RNA, 19 nt, Salmonella typhimurium LT2
gcggauacagcggcgcgcc

SEQ ID NO: 3805819 - RNA, 15 nt, Salmonella typhimurium LT2
gcggauaugcagcag

SEQ ID NO: 3805820 - RNA, 18 nt, Salmonella typhimurium LT2
gcggaucaaacuccgcgc

SEQ ID NO: 3805821 - RNA, 22 nt, Salmonella typhimurium LT2
gcggaucaaacuccgcgcuggc

SEQ ID NO: 3805822 - RNA, 15 nt, Salmonella typhimurium LT2
gcggaucggcgcaga

SEQ ID NO: 3805823 - RNA, 17 nt, Salmonella typhimurium LT2
gcggaugaucgccucuu

SEQ ID NO: 3805824 - RNA, 22 nt, Salmonella typhimurium LT2
gcggaugcgccauccaccaggc

SEQ ID NO: 3805825 - RNA, 15 nt, Salmonella typhimurium LT2
gcggaugcugcgcca

SEQ ID NO: 3805826 - RNA, 20 nt, Salmonella typhimurium LT2
gcggauguuaaugaauaauc

SEQ ID NO: 3805827 - RNA, 19 nt, Salmonella typhimurium LT2
gcggauugccauacacgcg

SEQ ID NO: 3805828 - RNA, 14 nt, Salmonella typhimurium LT2
gcggauuguugaca

SEQ ID NO: 3805829 - RNA, 20 nt, Salmonella typhimurium LT2
gcggauuuccgggcguacuu

SEQ ID NO: 3805830 - RNA, 15 nt, Salmonella typhimurium LT2
gcggauuuuucgcca

SEQ ID NO: 3805831 - RNA, 21 nt, Salmonella typhimurium LT2
gcgggcagcagcagcagcaga

SEQ ID NO: 3805832 - RNA, 21 nt, Salmonella typhimurium LT2
gcgggccgacaaaaauuucga

SEQ ID NO: 3805833 - RNA, 13 nt, Salmonella typhimurium LT2
gcgggccgcggcg

SEQ ID NO: 3805834 - RNA, 13 nt, Salmonella typhimurium LT2
gcgggccgucagg

SEQ ID NO: 3805835 - RNA, 20 nt, Salmonella typhimurium LT2
gcgggcgauagagaccgcuu

SEQ ID NO: 3805836 - RNA, 23 nt, Salmonella typhimurium LT2
gcgggcggccaaucagauauccc

SEQ ID NO: 3805837 - RNA, 19 nt, Salmonella typhimurium LT2
gcgggcguauagccaggca

SEQ ID NO: 3805838 - RNA, 13 nt, Salmonella typhimurium LT2
gcgggcuggcugg

SEQ ID NO: 3805839 - RNA, 14 nt, Salmonella typhimurium LT2
gcggggaacacaau

SEQ ID NO: 3805840 - RNA, 17 nt, Salmonella typhimurium LT2
gcggggauaaucagcag

SEQ ID NO: 3805841 - RNA, 12 nt, Salmonella typhimurium LT2
gcgggguaaaau

SEQ ID NO: 3805842 - RNA, 15 nt, Salmonella typhimurium LT2
gcgggguuugcagau

SEQ ID NO: 3805843 - RNA, 19 nt, Salmonella typhimurium LT2
gcggguaauccgacgcuuc

SEQ ID NO: 3805844 - RNA, 18 nt, Salmonella typhimurium LT2
gcggguaauuugcgccau

SEQ ID NO: 3805845 - RNA, 12 nt, Salmonella typhimurium LT2
gcgggucaggaa

SEQ ID NO: 3805846 - RNA, 18 nt, Salmonella typhimurium LT2
gcgggucaggaaacuggc

SEQ ID NO: 3805847 - RNA, 15 nt, Salmonella typhimurium LT2
gcggguccgcggagg

SEQ ID NO: 3805848 - RNA, 21 nt, Salmonella typhimurium LT2
gcgggugacgcuggcggagag

SEQ ID NO: 3805849 - RNA, 19 nt, Salmonella typhimurium LT2
gcgggugagcgcuaucagg

SEQ ID NO: 3805850 - RNA, 15 nt, Salmonella typhimurium LT2
gcgggugaugcgcca

SEQ ID NO: 3805851 - RNA, 16 nt, Salmonella typhimurium LT2
gcgggugaugcgccag

SEQ ID NO: 3805852 - RNA, 19 nt, Salmonella typhimurium LT2
gcgggugcgcagccccagc

SEQ ID NO: 3805853 - RNA, 14 nt, Salmonella typhimurium LT2
gcgggugcuccagc

SEQ ID NO: 3805854 - RNA, 20 nt, Salmonella typhimurium LT2
gcgggugugccucggcgacg

SEQ ID NO: 3805855 - RNA, 18 nt, Salmonella typhimurium LT2
gcggguucccccacucuu

SEQ ID NO: 3805856 - RNA, 13 nt, Salmonella typhimurium LT2
gcgguaaaaccgg

SEQ ID NO: 3805857 - RNA, 14 nt, Salmonella typhimurium LT2
gcgguaacaggcac

SEQ ID NO: 3805858 - RNA, 21 nt, Salmonella typhimurium LT2
gcgguaacguaacuggauucc

SEQ ID NO: 3805859 - RNA, 14 nt, Salmonella typhimurium LT2
gcgguaagcuguuc

SEQ ID NO: 3805860 - RNA, 16 nt, Salmonella typhimurium LT2
gcgguaaguacggcaa

SEQ ID NO: 3805861 - RNA, 18 nt, Salmonella typhimurium LT2
gcgguaauaacugacaga

SEQ ID NO: 3805862 - RNA, 16 nt, Salmonella typhimurium LT2
gcgguaaucgccgcga

SEQ ID NO: 3805863 - RNA, 21 nt, Salmonella typhimurium LT2
gcgguacagcgagcuauccgg

SEQ ID NO: 3805864 - RNA, 20 nt, Salmonella typhimurium LT2
gcgguacucuuuuuccgcga

SEQ ID NO: 3805865 - RNA, 19 nt, Salmonella typhimurium LT2
gcgguagcaucucacgcuc

SEQ ID NO: 3805866 - RNA, 14 nt, Salmonella typhimurium LT2
gcgguagccagcgc

SEQ ID NO: 3805867 - RNA, 12 nt, Salmonella typhimurium LT2
gcgguagcgaug

SEQ ID NO: 3805868 - RNA, 15 nt, Salmonella typhimurium LT2
gcgguagucacggag

SEQ ID NO: 3805869 - RNA, 16 nt, Salmonella typhimurium LT2
gcgguauaucacgcca

SEQ ID NO: 3805870 - RNA, 13 nt, Salmonella typhimurium LT2
gcgguaucaaugc

SEQ ID NO: 3805871 - RNA, 14 nt, Salmonella typhimurium LT2
gcgguauuauccgc

SEQ ID NO: 3805872 - RNA, 15 nt, Salmonella typhimurium LT2
gcggucaaacuugug

SEQ ID NO: 3805873 - RNA, 17 nt, Salmonella typhimurium LT2
gcggucaccuucggucc

SEQ ID NO: 3805874 - RNA, 22 nt, Salmonella typhimurium LT2
gcggucaccuucggucccaucg

SEQ ID NO: 3805875 - RNA, 16 nt, Salmonella typhimurium LT2
gcggucagaagucagc

SEQ ID NO: 3805876 - RNA, 22 nt, Salmonella typhimurium LT2
gcggucagccagcguaccagcg

SEQ ID NO: 3805877 - RNA, 14 nt, Salmonella typhimurium LT2
gcggucagcggcgc

SEQ ID NO: 3805878 - RNA, 12 nt, Salmonella typhimurium LT2
gcggucaggaau

SEQ ID NO: 3805879 - RNA, 23 nt, Salmonella typhimurium LT2
gcgguccaaagauaaacgacagc

SEQ ID NO: 3805880 - RNA, 14 nt, Salmonella typhimurium LT2
gcggucgccgcaug

SEQ ID NO: 3805881 - RNA, 21 nt, Salmonella typhimurium LT2
gcggucgguuuucuucggccu

SEQ ID NO: 3805882 - RNA, 18 nt, Salmonella typhimurium LT2
gcggucuuaucaaauuug

SEQ ID NO: 3805883 - RNA, 21 nt, Salmonella typhimurium LT2
gcggugaggggggauugacuc

SEQ ID NO: 3805884 - RNA, 20 nt, Salmonella typhimurium LT2
gcggugaucccaggccggca

SEQ ID NO: 3805885 - RNA, 20 nt, Salmonella typhimurium LT2
gcggugcuuggcauagccag

SEQ ID NO: 3805886 - RNA, 13 nt, Salmonella typhimurium LT2
gcgguggaagaga

SEQ ID NO: 3805887 - RNA, 13 nt, Salmonella typhimurium LT2
gcgguggauacgu

SEQ ID NO: 3805888 - RNA, 17 nt, Salmonella typhimurium LT2
gcgguggauggcuuccg

SEQ ID NO: 3805889 - RNA, 15 nt, Salmonella typhimurium LT2
gcgguggcgcacagu

SEQ ID NO: 3805890 - RNA, 21 nt, Salmonella typhimurium LT2
gcgguuauccgccagcgcaac

SEQ ID NO: 3805891 - RNA, 20 nt, Salmonella typhimurium LT2
gcgguuggccuacaagaucg

SEQ ID NO: 3805892 - RNA, 13 nt, Salmonella typhimurium LT2
gcgguuuacgcca

SEQ ID NO: 3805893 - RNA, 20 nt, Salmonella typhimurium LT2
gcgguuucaggccagacuga

SEQ ID NO: 3805894 - RNA, 18 nt, Salmonella typhimurium LT2
gcgguuuuauugucagaa

SEQ ID NO: 3805895 - RNA, 12 nt, Salmonella typhimurium LT2
gcguaaaaaaac

SEQ ID NO: 3805896 - RNA, 20 nt, Salmonella typhimurium LT2
gcguaaacacguuaucugac

SEQ ID NO: 3805897 - RNA, 16 nt, Salmonella typhimurium LT2
gcguaaagauuagaau

SEQ ID NO: 3805898 - RNA, 22 nt, Salmonella typhimurium LT2
gcguaacagcgcuaucaggaag

SEQ ID NO: 3805899 - RNA, 14 nt, Salmonella typhimurium LT2
gcguaacggcugac

SEQ ID NO: 3805900 - RNA, 12 nt, Salmonella typhimurium LT2
gcguaagcgcgu

SEQ ID NO: 3805901 - RNA, 19 nt, Salmonella typhimurium LT2
gcguaauaugggcacaacc

SEQ ID NO: 3805902 - RNA, 13 nt, Salmonella typhimurium LT2
gcguaauccagcu

SEQ ID NO: 3805903 - RNA, 14 nt, Salmonella typhimurium LT2
gcguaauccagcuu

SEQ ID NO: 3805904 - RNA, 21 nt, Salmonella typhimurium LT2
gcguaauccggccuggcgcag

SEQ ID NO: 3805905 - RNA, 17 nt, Salmonella typhimurium LT2
gcguaaugcgccaggca

SEQ ID NO: 3805906 - RNA, 19 nt, Salmonella typhimurium LT2
gcguaauggccaccagcac

SEQ ID NO: 3805907 - RNA, 18 nt, Salmonella typhimurium LT2
gcguaaugguguccacaa

SEQ ID NO: 3805908 - RNA, 15 nt, Salmonella typhimurium LT2
gcguaauucagcauu

SEQ ID NO: 3805909 - RNA, 23 nt, Salmonella typhimurium LT2
gcguacaaucgcguuuuccagca

SEQ ID NO: 3805910 - RNA, 18 nt, Salmonella typhimurium LT2
gcguacaauggcaggcau

SEQ ID NO: 3805911 - RNA, 21 nt, Salmonella typhimurium LT2
gcguacagaagguuauucgcc

SEQ ID NO: 3805912 - RNA, 23 nt, Salmonella typhimurium LT2
gcguacaggauguccaggcgaca

SEQ ID NO: 3805913 - RNA, 15 nt, Salmonella typhimurium LT2
gcguaccacgccgca

SEQ ID NO: 3805914 - RNA, 20 nt, Salmonella typhimurium LT2
gcguaccagaaacagcgcgc

SEQ ID NO: 3805915 - RNA, 14 nt, Salmonella typhimurium LT2
gcguaccagcgguc

SEQ ID NO: 3805916 - RNA, 15 nt, Salmonella typhimurium LT2
gcguaccgcgcgccc

SEQ ID NO: 3805917 - RNA, 21 nt, Salmonella typhimurium LT2
gcguaccgcuaucgccaaacu

SEQ ID NO: 3805918 - RNA, 13 nt, Salmonella typhimurium LT2
gcguacgggcaaa

SEQ ID NO: 3805919 - RNA, 13 nt, Salmonella typhimurium LT2
gcguagagagcgg

SEQ ID NO: 3805920 - RNA, 19 nt, Salmonella typhimurium LT2
gcguagccaaaagcgccac

SEQ ID NO: 3805921 - RNA, 16 nt, Salmonella typhimurium LT2
gcguagcguacugcag

SEQ ID NO: 3805922 - RNA, 20 nt, Salmonella typhimurium LT2
gcguagcuggucgccagcgc

SEQ ID NO: 3805923 - RNA, 16 nt, Salmonella typhimurium LT2
gcguauaacgccgccc

SEQ ID NO: 3805924 - RNA, 23 nt, Salmonella typhimurium LT2
gcguauagcgcuugucgcgcuau

SEQ ID NO: 3805925 - RNA, 23 nt, Salmonella typhimurium LT2
gcguaucauagcggcuaccgcgu

SEQ ID NO: 3805926 - RNA, 11 nt, Salmonella typhimurium LT2
gcguauccagu

SEQ ID NO: 3805927 - RNA, 21 nt, Salmonella typhimurium LT2
gcguaucucagcauguccgcc

SEQ ID NO: 3805928 - RNA, 18 nt, Salmonella typhimurium LT2
gcguaugacgcacacggc

SEQ ID NO: 3805929 - RNA, 13 nt, Salmonella typhimurium LT2
gcguaugcugaua

SEQ ID NO: 3805930 - RNA, 21 nt, Salmonella typhimurium LT2
gcguaugcuuucagcauguuu

SEQ ID NO: 3805931 - RNA, 14 nt, Salmonella typhimurium LT2
gcguauugguacaa

SEQ ID NO: 3805932 - RNA, 15 nt, Salmonella typhimurium LT2
gcgucaacguccagu

SEQ ID NO: 3805933 - RNA, 15 nt, Salmonella typhimurium LT2
gcgucaauuccgcgc

SEQ ID NO: 3805934 - RNA, 20 nt, Salmonella typhimurium LT2
gcgucaauuccgcgccgccc

SEQ ID NO: 3805935 - RNA, 21 nt, Salmonella typhimurium LT2
gcguuguuuuuucagaauuag

SEQ ID NO: 3805936 - RNA, 14 nt, Salmonella typhimurium LT2
gcguuuaagccccu

SEQ ID NO: 3805937 - RNA, 22 nt, Salmonella typhimurium LT2
gcguuuccccuuuaggcggcgc

SEQ ID NO: 3805938 - RNA, 23 nt, Salmonella typhimurium LT2
gcguuucccgcgcggaaggcgcc

SEQ ID NO: 3805939 - RNA, 14 nt, Salmonella typhimurium LT2
gcguuucgccgcca

SEQ ID NO: 3805940 - RNA, 20 nt, Salmonella typhimurium LT2
gcguuucguaauggccuaca

SEQ ID NO: 3805941 - RNA, 18 nt, Salmonella typhimurium LT2
gcguuucuagaugaugau

SEQ ID NO: 3805942 - RNA, 15 nt, Salmonella typhimurium LT2
gcguuugccgccuug

SEQ ID NO: 3805943 - RNA, 18 nt, Salmonella typhimurium LT2
gcguuuuacguacccgcu

SEQ ID NO: 3805944 - RNA, 19 nt, Salmonella typhimurium LT2
gcguuuuaucucuuuugcu

SEQ ID NO: 3805945 - RNA, 21 nt, Salmonella typhimurium LT2
gcguuuuaugaucgacaauga

SEQ ID NO: 3805946 - RNA, 13 nt, Salmonella typhimurium LT2
gcguuuuccagcu

SEQ ID NO: 3805947 - RNA, 16 nt, Salmonella typhimurium LT2
gcguuuucucauucuc

SEQ ID NO: 3805948 - RNA, 18 nt, Salmonella typhimurium LT2
gcguuuuuucaucggcag

SEQ ID NO: 3805949 - RNA, 21 nt, Salmonella typhimurium LT2
gcuaaaacacccgcaaacuaa

SEQ ID NO: 3805950 - RNA, 17 nt, Salmonella typhimurium LT2
gcuaaaacagauaacga

SEQ ID NO: 3805951 - RNA, 20 nt, Salmonella typhimurium LT2
gcuaaacaauuugcccagcg

SEQ ID NO: 3805952 - RNA, 14 nt, Salmonella typhimurium LT2
gcuaaacagcaaau

SEQ ID NO: 3805953 - RNA, 14 nt, Salmonella typhimurium LT2
gcuaaacaucgucu

SEQ ID NO: 3805954 - RNA, 19 nt, Salmonella typhimurium LT2
gcuaaaccacaugaccagc

SEQ ID NO: 3805955 - RNA, 22 nt, Salmonella typhimurium LT2
gcuaaaccacucguucccgcgc

SEQ ID NO: 3805956 - RNA, 16 nt, Salmonella typhimurium LT2
gcuaaaccggcggaau

SEQ ID NO: 3805957 - RNA, 18 nt, Salmonella typhimurium LT2
gcuaaagccuaccaccuc

SEQ ID NO: 3805958 - RNA, 23 nt, Salmonella typhimurium LT2
gcuaaagcgacuuauccggccua

SEQ ID NO: 3805959 - RNA, 16 nt, Salmonella typhimurium LT2
gcuaaauuaaaaauaa

SEQ ID NO: 3805960 - RNA, 14 nt, Salmonella typhimurium LT2
gcuaaccagcgagc

SEQ ID NO: 3805961 - RNA, 21 nt, Salmonella typhimurium LT2
gcuaaccagcgagcuacaggu

SEQ ID NO: 3805962 - RNA, 20 nt, Salmonella typhimurium LT2
gcuaacgcgcacccggcuua

SEQ ID NO: 3805963 - RNA, 16 nt, Salmonella typhimurium LT2
gcuaacgcgccccagg

SEQ ID NO: 3805964 - RNA, 17 nt, Salmonella typhimurium LT2
gcuaacgcgccccaggu

SEQ ID NO: 3805965 - RNA, 13 nt, Salmonella typhimurium LT2
gcuaacgcgucuu

SEQ ID NO: 3805966 - RNA, 14 nt, Salmonella typhimurium LT2
gcuaacgcgucuua

SEQ ID NO: 3805967 - RNA, 23 nt, Salmonella typhimurium LT2
gcuaacgcgucuuaucuggccua

SEQ ID NO: 3805968 - RNA, 17 nt, Salmonella typhimurium LT2
gcuaacgggcugaccgc

SEQ ID NO: 3805969 - RNA, 22 nt, Salmonella typhimurium LT2
gcuaacguccgccgucaggcua

SEQ ID NO: 3805970 - RNA, 17 nt, Salmonella typhimurium LT2
gcuaagcaacaguucac

SEQ ID NO: 3805971 - RNA, 22 nt, Salmonella typhimurium LT2
gcuaagcguuacggaaaaaaua

SEQ ID NO: 3805972 - RNA, 18 nt, Salmonella typhimurium LT2
gcuaagggcaccagcaac

SEQ ID NO: 3805973 - RNA, 17 nt, Salmonella typhimurium LT2
gcuaaucaggaagaaag

SEQ ID NO: 3805974 - RNA, 19 nt, Salmonella typhimurium LT2
gcuaaucaggaagaaagac

SEQ ID NO: 3805975 - RNA, 16 nt, Salmonella typhimurium LT2
gcuaaugaagacgaag

SEQ ID NO: 3805976 - RNA, 14 nt, Salmonella typhimurium LT2
gcuaaugauuaucu

SEQ ID NO: 3805977 - RNA, 18 nt, Salmonella typhimurium LT2
gcuaaugauuaucuuuuu

SEQ ID NO: 3805978 - RNA, 20 nt, Salmonella typhimurium LT2
gcuaaugcuuauccggccua

SEQ ID NO: 3805979 - RNA, 16 nt, Salmonella typhimurium LT2
gcuaauggcuuauugg

SEQ ID NO: 3805980 - RNA, 18 nt, Salmonella typhimurium LT2
gcuaauuuccccccagac

SEQ ID NO: 3805981 - RNA, 21 nt, Salmonella typhimurium LT2
gcuacaaccagcgcggccaga

SEQ ID NO: 3805982 - RNA, 18 nt, Salmonella typhimurium LT2
gcuacaggugccacgcuu

SEQ ID NO: 3805983 - RNA, 18 nt, Salmonella typhimurium LT2
gcuaccagcgcggcgcca

SEQ ID NO: 3805984 - RNA, 21 nt, Salmonella typhimurium LT2
gcuaccagcgcggcgccagua

SEQ ID NO: 3805985 - RNA, 23 nt, Salmonella typhimurium LT2
gcuaccagcgcggcgccaguacu

SEQ ID NO: 3805986 - RNA, 17 nt, Salmonella typhimurium LT2
gcuaccaggcaaagcuc

SEQ ID NO: 3805987 - RNA, 12 nt, Salmonella typhimurium LT2
gcuacccagaca

SEQ ID NO: 3805988 - RNA, 13 nt, Salmonella typhimurium LT2
gcuacccaugacg

SEQ ID NO: 3805989 - RNA, 18 nt, Salmonella typhimurium LT2
gcuaccgucuccauguca

SEQ ID NO: 3805990 - RNA, 22 nt, Salmonella typhimurium LT2
gcuacgaacgcgaaggccagca

SEQ ID NO: 3805991 - RNA, 14 nt, Salmonella typhimurium LT2
gcuacgcagcggcg

SEQ ID NO: 3805992 - RNA, 17 nt, Salmonella typhimurium LT2
gcuacgcuuaucaggcc

SEQ ID NO: 3805993 - RNA, 14 nt, Salmonella typhimurium LT2
gcuacggcucccuc

SEQ ID NO: 3805994 - RNA, 18 nt, Salmonella typhimurium LT2
gcuacgguacugcccacc

SEQ ID NO: 3805995 - RNA, 19 nt, Salmonella typhimurium LT2
gcuacguuuaucuggcuua

SEQ ID NO: 3805996 - RNA, 14 nt, Salmonella typhimurium LT2
gcuacucagcguca

SEQ ID NO: 3805997 - RNA, 17 nt, Salmonella typhimurium LT2
gcuacugccgccaucgc

SEQ ID NO: 3805998 - RNA, 23 nt, Salmonella typhimurium LT2
gcuagcugugguugcccgcaggc

SEQ ID NO: 3805999 - RNA, 17 nt, Salmonella typhimurium LT2
gcuagugccgccaggca

SEQ ID NO: 3806000 - RNA, 19 nt, Salmonella typhimurium LT2
gcuauaacguuuaauguca

SEQ ID NO: 3806001 - RNA, 19 nt, Salmonella typhimurium LT2
gcuauaaucacagggguca

SEQ ID NO: 3806002 - RNA, 20 nt, Salmonella typhimurium LT2
gcuauacaguaaaacgccaa

SEQ ID NO: 3806003 - RNA, 19 nt, Salmonella typhimurium LT2
gcuauaugaaccuuguaac

SEQ ID NO: 3806004 - RNA, 18 nt, Salmonella typhimurium LT2
gcuauauuuugugcaacc

SEQ ID NO: 3806005 - RNA, 22 nt, Salmonella typhimurium LT2
gcuaucaacgccuccaggcuac

SEQ ID NO: 3806006 - RNA, 15 nt, Salmonella typhimurium LT2
gcuaucaccucugcg

SEQ ID NO: 3806007 - RNA, 17 nt, Salmonella typhimurium LT2
gcuaucagacugaucgc

SEQ ID NO: 3806008 - RNA, 14 nt, Salmonella typhimurium LT2
gcuaucagccgcca

SEQ ID NO: 3806009 - RNA, 14 nt, Salmonella typhimurium LT2
gcuauccaucgccg

SEQ ID NO: 3806010 - RNA, 20 nt, Salmonella typhimurium LT2
gcuauccaucgccgcgccgu

SEQ ID NO: 3806011 - RNA, 14 nt, Salmonella typhimurium LT2
gcuaucccaggcgg

SEQ ID NO: 3806012 - RNA, 20 nt, Salmonella typhimurium LT2
gcuaucccaggcggagaaau

SEQ ID NO: 3806013 - RNA, 14 nt, Salmonella typhimurium LT2
gcuauccggcaaca

SEQ ID NO: 3806014 - RNA, 19 nt, Salmonella typhimurium LT2
gcuauccggcaacaugaca

SEQ ID NO: 3806015 - RNA, 18 nt, Salmonella typhimurium LT2
gcuaucgaccaccgggcg

SEQ ID NO: 3806016 - RNA, 23 nt, Salmonella typhimurium LT2
gcuaucgcccaaauaguccagca

SEQ ID NO: 3806017 - RNA, 23 nt, Salmonella typhimurium LT2
gcuaucgccuccagacuggcgac

SEQ ID NO: 3806018 - RNA, 15 nt, Salmonella typhimurium LT2
gcuaucgucgcgcaa

SEQ ID NO: 3806019 - RNA, 18 nt, Salmonella typhimurium LT2
gcuaucucuuccagcguc

SEQ ID NO: 3806020 - RNA, 22 nt, Salmonella typhimurium LT2
gcuaucugacagccaaacugcu

SEQ ID NO: 3806021 - RNA, 18 nt, Salmonella typhimurium LT2
gcuaucugcuccgccagc

SEQ ID NO: 3806022 - RNA, 22 nt, Salmonella typhimurium LT2
gcuaucuucaauacgaaaacca

SEQ ID NO: 3806023 - RNA, 13 nt, Salmonella typhimurium LT2
gcuaucuuugcug

SEQ ID NO: 3806024 - RNA, 13 nt, Salmonella typhimurium LT2
gcuaugcgccagu

SEQ ID NO: 3806025 - RNA, 16 nt, Salmonella typhimurium LT2
gcuaugcgcuccagga

SEQ ID NO: 3806026 - RNA, 14 nt, Salmonella typhimurium LT2
gcuaugcucccccc

SEQ ID NO: 3806027 - RNA, 18 nt, Salmonella typhimurium LT2
gcuaugcucccccccuuc

SEQ ID NO: 3806028 - RNA, 13 nt, Salmonella typhimurium LT2
gcuaugcugauca

SEQ ID NO: 3806029 - RNA, 21 nt, Salmonella typhimurium LT2
gcuaugcugaucaucuggccu

SEQ ID NO: 3806030 - RNA, 17 nt, Salmonella typhimurium LT2
gcuauggcaacaaagcc

SEQ ID NO: 3806031 - RNA, 17 nt, Salmonella typhimurium LT2
gcuauguaagagcguuu

SEQ ID NO: 3806032 - RNA, 21 nt, Salmonella typhimurium LT2
gcuauguagcgcugaagcccg

SEQ ID NO: 3806033 - RNA, 14 nt, Salmonella typhimurium LT2
gcuauuaccaguaa

SEQ ID NO: 3806034 - RNA, 18 nt, Salmonella typhimurium LT2
gcuauuaccccgcggcau

SEQ ID NO: 3806035 - RNA, 12 nt, Salmonella typhimurium LT2
gcuauuagccaa

SEQ ID NO: 3806036 - RNA, 19 nt, Salmonella typhimurium LT2
gcuauucuucgaucgccug

SEQ ID NO: 3806037 - RNA, 22 nt, Salmonella typhimurium LT2
gcucaaaaaagaguaaaguuau

SEQ ID NO: 3806038 - RNA, 19 nt, Salmonella typhimurium LT2
gcuccguccacgcgagcug

SEQ ID NO: 3806039 - RNA, 13 nt, Salmonella typhimurium LT2
gcuccugccagau

SEQ ID NO: 3806040 - RNA, 15 nt, Salmonella typhimurium LT2
gcuccugccagauuu

SEQ ID NO: 3806041 - RNA, 22 nt, Salmonella typhimurium LT2
gcuccugcgguacggccagcgc

SEQ ID NO: 3806042 - RNA, 12 nt, Salmonella typhimurium LT2
gcuccuucgaug

SEQ ID NO: 3806043 - RNA, 16 nt, Salmonella typhimurium LT2
gcuccuugagcgccug

SEQ ID NO: 3806044 - RNA, 18 nt, Salmonella typhimurium LT2
gcuccuugauugcaagaa

SEQ ID NO: 3806045 - RNA, 14 nt, Salmonella typhimurium LT2
gcucgaaucgccau

SEQ ID NO: 3806046 - RNA, 21 nt, Salmonella typhimurium LT2
gcucgagggugguauccucga

SEQ ID NO: 3806047 - RNA, 19 nt, Salmonella typhimurium LT2
gcucgaucccgacccauac

SEQ ID NO: 3806048 - RNA, 21 nt, Salmonella typhimurium LT2
gcucgcacugauagccgccag

SEQ ID NO: 3806049 - RNA, 13 nt, Salmonella typhimurium LT2
gcucgccagcgca

SEQ ID NO: 3806050 - RNA, 22 nt, Salmonella typhimurium LT2
gcucgccagcgcagucagugaa

SEQ ID NO: 3806051 - RNA, 22 nt, Salmonella typhimurium LT2
gcucgccaguaucggcaggacu

SEQ ID NO: 3806052 - RNA, 16 nt, Salmonella typhimurium LT2
gcucgcccaucacuac

SEQ ID NO: 3806053 - RNA, 18 nt, Salmonella typhimurium LT2
gcucgcccgcagcaaaaa

SEQ ID NO: 3806054 - RNA, 17 nt, Salmonella typhimurium LT2
gcucgcccuucgggccg

SEQ ID NO: 3806055 - RNA, 19 nt, Salmonella typhimurium LT2
gcucgccugugcccgcggu

SEQ ID NO: 3806056 - RNA, 15 nt, Salmonella typhimurium LT2
gcucgcgccacgcag

SEQ ID NO: 3806057 - RNA, 22 nt, Salmonella typhimurium LT2
gcucgcgcuguucgcuuaaccg

SEQ ID NO: 3806058 - RNA, 11 nt, Salmonella typhimurium LT2
gcucgcggcgg

SEQ ID NO: 3806059 - RNA, 12 nt, Salmonella typhimurium LT2
gcucgcggcgga

SEQ ID NO: 3806060 - RNA, 11 nt, Salmonella typhimurium LT2
gcucgcguaac

SEQ ID NO: 3806061 - RNA, 17 nt, Salmonella typhimurium LT2
gcucgcguaacagcggu

SEQ ID NO: 3806062 - RNA, 22 nt, Salmonella typhimurium LT2
gcucgcuggugccaaucuccag

SEQ ID NO: 3806063 - RNA, 16 nt, Salmonella typhimurium LT2
gcucgcuguucgccag

SEQ ID NO: 3806064 - RNA, 17 nt, Salmonella typhimurium LT2
gcucgcuguucgccaga

SEQ ID NO: 3806065 - RNA, 19 nt, Salmonella typhimurium LT2
gcucgcuuaaugaggccac

SEQ ID NO: 3806066 - RNA, 23 nt, Salmonella typhimurium LT2
gcucgcuuaaugaggccaccagu

SEQ ID NO: 3806067 - RNA, 16 nt, Salmonella typhimurium LT2
gcucgcuuaucuggcc

SEQ ID NO: 3806068 - RNA, 15 nt, Salmonella typhimurium LT2
gcucgcuuuccauua

SEQ ID NO: 3806069 - RNA, 15 nt, Salmonella typhimurium LT2
gcucgcuuugccgcc

SEQ ID NO: 3806070 - RNA, 19 nt, Salmonella typhimurium LT2
gcucggccagauaacgcgc

SEQ ID NO: 3806071 - RNA, 15 nt, Salmonella typhimurium LT2
gcucggcgucauccc

SEQ ID NO: 3806072 - RNA, 22 nt, Salmonella typhimurium LT2
gcucggcuaucgccacuacgcc

SEQ ID NO: 3806073 - RNA, 14 nt, Salmonella typhimurium LT2
gcucguacacgcgc

SEQ ID NO: 3806074 - RNA, 21 nt, Salmonella typhimurium LT2
gcucguagcguuuaaagacca

SEQ ID NO: 3806075 - RNA, 16 nt, Salmonella typhimurium LT2
gcucgucccgcagcau

SEQ ID NO: 3806076 - RNA, 17 nt, Salmonella typhimurium LT2
gcucgugauugauucgc

SEQ ID NO: 3806077 - RNA, 18 nt, Salmonella typhimurium LT2
gcucguuaaauccuccca

SEQ ID NO: 3806078 - RNA, 18 nt, Salmonella typhimurium LT2
gcucguuguuuaauacgc

SEQ ID NO: 3806079 - RNA, 22 nt, Salmonella typhimurium LT2
gcucuacguugaccucaucacc

SEQ ID NO: 3806080 - RNA, 20 nt, Salmonella typhimurium LT2
gcucuaucaccgcccgccgg

SEQ ID NO: 3806081 - RNA, 13 nt, Salmonella typhimurium LT2
gcucucccagcug

SEQ ID NO: 3806082 - RNA, 23 nt, Salmonella typhimurium LT2
gcucuccccacacugaauuacug

SEQ ID NO: 3806083 - RNA, 21 nt, Salmonella typhimurium LT2
gcucucgccacgcuccaucau

SEQ ID NO: 3806084 - RNA, 20 nt, Salmonella typhimurium LT2
gcucucgugccaguaacguu

SEQ ID NO: 3806085 - RNA, 19 nt, Salmonella typhimurium LT2
gcucucuuucaccagcgcc

SEQ ID NO: 3806086 - RNA, 16 nt, Salmonella typhimurium LT2
gcucucuuuuggcgac

SEQ ID NO: 3806087 - RNA, 22 nt, Salmonella typhimurium LT2
gcucucuuuuggcgacagacgc

SEQ ID NO: 3806088 - RNA, 14 nt, Salmonella typhimurium LT2
gcucugcaauuucu

SEQ ID NO: 3806089 - RNA, 19 nt, Salmonella typhimurium LT2
gcucugcaauuucugcugg

SEQ ID NO: 3806090 - RNA, 19 nt, Salmonella typhimurium LT2
gcucugccgguuggccggc

SEQ ID NO: 3806091 - RNA, 18 nt, Salmonella typhimurium LT2
gcucuguccgcaaagaca

SEQ ID NO: 3806092 - RNA, 21 nt, Salmonella typhimurium LT2
gcucuucgccgguaaaaaucc

SEQ ID NO: 3806093 - RNA, 17 nt, Salmonella typhimurium LT2
gcucuucgccguuaucg

SEQ ID NO: 3806094 - RNA, 12 nt, Salmonella typhimurium LT2
gcucuucgcucc

SEQ ID NO: 3806095 - RNA, 16 nt, Salmonella typhimurium LT2
gcucuucgcuccaguc

SEQ ID NO: 3806096 - RNA, 16 nt, Salmonella typhimurium LT2
gcucuuuacauaaugu

SEQ ID NO: 3806097 - RNA, 18 nt, Salmonella typhimurium LT2
gcucuuuuucuugucucc

SEQ ID NO: 3806098 - RNA, 22 nt, Salmonella typhimurium LT2
gcugaaacagaauaaacggcag

SEQ ID NO: 3806099 - RNA, 15 nt, Salmonella typhimurium LT2
gcugaaauagccccg

SEQ ID NO: 3806100 - RNA, 11 nt, Salmonella typhimurium LT2
gcugaaccacc

SEQ ID NO: 3806101 - RNA, 15 nt, Salmonella typhimurium LT2
gcugaaccacccuga

SEQ ID NO: 3806102 - RNA, 22 nt, Salmonella typhimurium LT2
gcugaaccacccugaaaaguua

SEQ ID NO: 3806103 - RNA, 15 nt, Salmonella typhimurium LT2
gcugaacgcggugac

SEQ ID NO: 3806104 - RNA, 16 nt, Salmonella typhimurium LT2
gcugaacgcggugacu

SEQ ID NO: 3806105 - RNA, 12 nt, Salmonella typhimurium LT2
gcugaagacugg

SEQ ID NO: 3806106 - RNA, 16 nt, Salmonella typhimurium LT2
gcugaagacuggcaag

SEQ ID NO: 3806107 - RNA, 15 nt, Salmonella typhimurium LT2
gcugaagugcggaua

SEQ ID NO: 3806108 - RNA, 17 nt, Salmonella typhimurium LT2
gcugaauaccugcccca

SEQ ID NO: 3806109 - RNA, 16 nt, Salmonella typhimurium LT2
gcugaaugaagccuua

SEQ ID NO: 3806110 - RNA, 20 nt, Salmonella typhimurium LT2
gcugaaugaagccuuagcgg

SEQ ID NO: 3806111 - RNA, 12 nt, Salmonella typhimurium LT2
gcugaauguucu

SEQ ID NO: 3806112 - RNA, 16 nt, Salmonella typhimurium LT2
gcugacaaucagcaca

SEQ ID NO: 3806113 - RNA, 16 nt, Salmonella typhimurium LT2
gcugacaaucugcugg

SEQ ID NO: 3806114 - RNA, 15 nt, Salmonella typhimurium LT2
gcugacaucauccac

SEQ ID NO: 3806115 - RNA, 17 nt, Salmonella typhimurium LT2
gcugaccuuaauccagc

SEQ ID NO: 3806116 - RNA, 16 nt, Salmonella typhimurium LT2
gcugacgacauucagc

SEQ ID NO: 3806117 - RNA, 19 nt, Salmonella typhimurium LT2
gcugacgacauucagcaca

SEQ ID NO: 3806118 - RNA, 21 nt, Salmonella typhimurium LT2
gcugacgacauucagcacaug

SEQ ID NO: 3806119 - RNA, 14 nt, Salmonella typhimurium LT2
gcugacgaccccag

SEQ ID NO: 3806120 - RNA, 21 nt, Salmonella typhimurium LT2
gcugacgauacucagccccag

SEQ ID NO: 3806121 - RNA, 22 nt, Salmonella typhimurium LT2
gcugacgauacucagccccagg

SEQ ID NO: 3806122 - RNA, 16 nt, Salmonella typhimurium LT2
gcugacgcagcagcuc

SEQ ID NO: 3806123 - RNA, 15 nt, Salmonella typhimurium LT2
gcugacgccaggcca

SEQ ID NO: 3806124 - RNA, 15 nt, Salmonella typhimurium LT2
gcugacgcccaucag

SEQ ID NO: 3806125 - RNA, 16 nt, Salmonella typhimurium LT2
gcugacgcccaucagc

SEQ ID NO: 3806126 - RNA, 16 nt, Salmonella typhimurium LT2
gcugacgcgaucgccg

SEQ ID NO: 3806127 - RNA, 16 nt, Salmonella typhimurium LT2
gcugacgcgccuggau

SEQ ID NO: 3806128 - RNA, 14 nt, Salmonella typhimurium LT2
gcugacggcgcgau

SEQ ID NO: 3806129 - RNA, 15 nt, Salmonella typhimurium LT2
gcugacggcgcgauc

SEQ ID NO: 3806130 - RNA, 12 nt, Salmonella typhimurium LT2
gcugacugccgu

SEQ ID NO: 3806131 - RNA, 17 nt, Salmonella typhimurium LT2
gcugacugguuuguugc

SEQ ID NO: 3806132 - RNA, 12 nt, Salmonella typhimurium LT2
gcugagaaaaag

SEQ ID NO: 3806133 - RNA, 23 nt, Salmonella typhimurium LT2
gcugagaauugacgauaucaucu

SEQ ID NO: 3806134 - RNA, 14 nt, Salmonella typhimurium LT2
gcugagcagccagc

SEQ ID NO: 3806135 - RNA, 15 nt, Salmonella typhimurium LT2
gcugagcagccagcc

SEQ ID NO: 3806136 - RNA, 17 nt, Salmonella typhimurium LT2
gcugagcagccagccca

SEQ ID NO: 3806137 - RNA, 22 nt, Salmonella typhimurium LT2
gcugagccuucaccguaucgcc

SEQ ID NO: 3806138 - RNA, 18 nt, Salmonella typhimurium LT2
gcugaggauggcgcggca

SEQ ID NO: 3806139 - RNA, 13 nt, Salmonella typhimurium LT2
gcugaggccgcuc

SEQ ID NO: 3806140 - RNA, 13 nt, Salmonella typhimurium LT2
gcugaggccugca

SEQ ID NO: 3806141 - RNA, 19 nt, Salmonella typhimurium LT2
gcugaguuuagccagcagc

SEQ ID NO: 3806142 - RNA, 16 nt, Salmonella typhimurium LT2
gcuggcgcagccgcuu

SEQ ID NO: 3806143 - RNA, 18 nt, Salmonella typhimurium LT2
gcuggcgcggggaacaca

SEQ ID NO: 3806144 - RNA, 19 nt, Salmonella typhimurium LT2
gcuggcgcggggaacacuc

SEQ ID NO: 3806145 - RNA, 21 nt, Salmonella typhimurium LT2
gcuggcgcgucacaacagccg

SEQ ID NO: 3806146 - RNA, 18 nt, Salmonella typhimurium LT2
gcuggcgcugacgacacu

SEQ ID NO: 3806147 - RNA, 14 nt, Salmonella typhimurium LT2
gcuggcggccccuc

SEQ ID NO: 3806148 - RNA, 19 nt, Salmonella typhimurium LT2
gcuggcgggguucgggcag

SEQ ID NO: 3806149 - RNA, 21 nt, Salmonella typhimurium LT2
gcuggcgguggauggcuuccg

SEQ ID NO: 3806150 - RNA, 19 nt, Salmonella typhimurium LT2
gcuggcgguuuuugugggu

SEQ ID NO: 3806151 - RNA, 21 nt, Salmonella typhimurium LT2
gcuggcguacaguuucgccgu

SEQ ID NO: 3806152 - RNA, 13 nt, Salmonella typhimurium LT2
gcuggcguccagc

SEQ ID NO: 3806153 - RNA, 19 nt, Salmonella typhimurium LT2
gcuggcgucgccaaagcag

SEQ ID NO: 3806154 - RNA, 16 nt, Salmonella typhimurium LT2
gcuggcgugaaccggu

SEQ ID NO: 3806155 - RNA, 22 nt, Salmonella typhimurium LT2
gcuggcgugacguguggcgcug

SEQ ID NO: 3806156 - RNA, 14 nt, Salmonella typhimurium LT2
gcuggcucuugcug

SEQ ID NO: 3806157 - RNA, 19 nt, Salmonella typhimurium LT2
gcuggcucuugcuguagcu

SEQ ID NO: 3806158 - RNA, 16 nt, Salmonella typhimurium LT2
gcuggcugccgccauu

SEQ ID NO: 3806159 - RNA, 14 nt, Salmonella typhimurium LT2
gcuggcuuaacuca

SEQ ID NO: 3806160 - RNA, 22 nt, Salmonella typhimurium LT2
gcugggcuuuauccugaccgcu

SEQ ID NO: 3806161 - RNA, 15 nt, Salmonella typhimurium LT2
gcuggggcuggcggc

SEQ ID NO: 3806162 - RNA, 16 nt, Salmonella typhimurium LT2
gcuggggcuggcggcg

SEQ ID NO: 3806163 - RNA, 20 nt, Salmonella typhimurium LT2
gcuggguugauaccggagga

SEQ ID NO: 3806164 - RNA, 21 nt, Salmonella typhimurium LT2
gcuggucagcaacgccuccag

SEQ ID NO: 3806165 - RNA, 20 nt, Salmonella typhimurium LT2
gcuggucagcagaaacuggc

SEQ ID NO: 3806166 - RNA, 21 nt, Salmonella typhimurium LT2
gcuggucagcgcaaucugcuc

SEQ ID NO: 3806167 - RNA, 16 nt, Salmonella typhimurium LT2
gcuggucagcgcgcca

SEQ ID NO: 3806168 - RNA, 13 nt, Salmonella typhimurium LT2
gcuggucgagaua

SEQ ID NO: 3806169 - RNA, 15 nt, Salmonella typhimurium LT2
gcuggucgccagcgc

SEQ ID NO: 3806170 - RNA, 16 nt, Salmonella typhimurium LT2
gcuggucgccagcgcc

SEQ ID NO: 3806171 - RNA, 21 nt, Salmonella typhimurium LT2
gcuggucgccgcccaucgggc

SEQ ID NO: 3806172 - RNA, 20 nt, Salmonella typhimurium LT2
gcuggucggaucggcgguuu

SEQ ID NO: 3806173 - RNA, 15 nt, Salmonella typhimurium LT2
gcuggugaucuggcc

SEQ ID NO: 3806174 - RNA, 13 nt, Salmonella typhimurium LT2
gcugguuccccgu

SEQ ID NO: 3806175 - RNA, 16 nt, Salmonella typhimurium LT2
gcugguugccuuccug

SEQ ID NO: 3806176 - RNA, 17 nt, Salmonella typhimurium LT2
gcugguugccuuccuga

SEQ ID NO: 3806177 - RNA, 15 nt, Salmonella typhimurium LT2
gcuguaaaccggccc

SEQ ID NO: 3806178 - RNA, 18 nt, Salmonella typhimurium LT2
gcuguaaaucugauaauc

SEQ ID NO: 3806179 - RNA, 23 nt, Salmonella typhimurium LT2
gcuguaaauguuguuccagagug

SEQ ID NO: 3806180 - RNA, 23 nt, Salmonella typhimurium LT2
gcuguaaccuacgccaagcaccu

SEQ ID NO: 3806181 - RNA, 18 nt, Salmonella typhimurium LT2
gcuguaauagauaugaaa

SEQ ID NO: 3806182 - RNA, 15 nt, Salmonella typhimurium LT2
gcuguagccagccug

SEQ ID NO: 3806183 - RNA, 21 nt, Salmonella typhimurium LT2
gcuguagcguuucgcgcgcgc

SEQ ID NO: 3806184 - RNA, 17 nt, Salmonella typhimurium LT2
gcuguagcugcccggau

SEQ ID NO: 3806185 - RNA, 21 nt, Salmonella typhimurium LT2
gcugucagcacaauccauagg

SEQ ID NO: 3806186 - RNA, 16 nt, Salmonella typhimurium LT2
gcugucaucaaugagc

SEQ ID NO: 3806187 - RNA, 12 nt, Salmonella typhimurium LT2
gcugucccagag

SEQ ID NO: 3806188 - RNA, 14 nt, Salmonella typhimurium LT2
gcugucccagaguu

SEQ ID NO: 3806189 - RNA, 20 nt, Salmonella typhimurium LT2
gcuguccgcccaacaccagc

SEQ ID NO: 3806190 - RNA, 20 nt, Salmonella typhimurium LT2
gcugucgacaauaaauugcg

SEQ ID NO: 3806191 - RNA, 17 nt, Salmonella typhimurium LT2
gcugucgauuuccggcg

SEQ ID NO: 3806192 - RNA, 17 nt, Salmonella typhimurium LT2
gcugucgccaccuugua

SEQ ID NO: 3806193 - RNA, 12 nt, Salmonella typhimurium LT2
gcugucgccaga

SEQ ID NO: 3806194 - RNA, 17 nt, Salmonella typhimurium LT2
gcugucgccaucaccag

SEQ ID NO: 3806195 - RNA, 14 nt, Salmonella typhimurium LT2
gcugucgccccuuu

SEQ ID NO: 3806196 - RNA, 16 nt, Salmonella typhimurium LT2
gcugucgccgcuguuu

SEQ ID NO: 3806197 - RNA, 20 nt, Salmonella typhimurium LT2
gcugucgcgaaagcacucgg

SEQ ID NO: 3806198 - RNA, 19 nt, Salmonella typhimurium LT2
gcugucgcucacgauaacg

SEQ ID NO: 3806199 - RNA, 16 nt, Salmonella typhimurium LT2
gcugucgcuuauucgg

SEQ ID NO: 3806200 - RNA, 18 nt, Salmonella typhimurium LT2
gcugucggcguuguuaug

SEQ ID NO: 3806201 - RNA, 14 nt, Salmonella typhimurium LT2
gcugucggucagga

SEQ ID NO: 3806202 - RNA, 19 nt, Salmonella typhimurium LT2
gcugucgguuaacaccagu

SEQ ID NO: 3806203 - RNA, 19 nt, Salmonella typhimurium LT2
gcugugauacuggcggcga

SEQ ID NO: 3806204 - RNA, 16 nt, Salmonella typhimurium LT2
gcuguguccaggucau

SEQ ID NO: 3806205 - RNA, 15 nt, Salmonella typhimurium LT2
gcuguguccgccaug

SEQ ID NO: 3806206 - RNA, 14 nt, Salmonella typhimurium LT2
gcuguuaaaaccgg

SEQ ID NO: 3806207 - RNA, 15 nt, Salmonella typhimurium LT2
gcuguuaaaaccggc

SEQ ID NO: 3806208 - RNA, 19 nt, Salmonella typhimurium LT2
gcuguuaaaaccggcugcc

SEQ ID NO: 3806209 - RNA, 18 nt, Salmonella typhimurium LT2
gcuguuaccggacagcac

SEQ ID NO: 3806210 - RNA, 23 nt, Salmonella typhimurium LT2
gcuguuacgcggucuuuuaaaag

SEQ ID NO: 3806211 - RNA, 12 nt, Salmonella typhimurium LT2
gcuguucaccac

SEQ ID NO: 3806212 - RNA, 23 nt, Salmonella typhimurium LT2
gcuguuuuucaucaucauccaga

SEQ ID NO: 3806213 - RNA, 14 nt, Salmonella typhimurium LT2
gcuuaaaaaauccu

SEQ ID NO: 3806214 - RNA, 16 nt, Salmonella typhimurium LT2
gcuuaaccgggaucgg

SEQ ID NO: 3806215 - RNA, 20 nt, Salmonella typhimurium LT2
gcuuaacgccaguuccgcca

SEQ ID NO: 3806216 - RNA, 19 nt, Salmonella typhimurium LT2
gcuuaacggcccaggcauc

SEQ ID NO: 3806217 - RNA, 19 nt, Salmonella typhimurium LT2
gcuuaagccagccaaagcu

SEQ ID NO: 3806218 - RNA, 21 nt, Salmonella typhimurium LT2
gcuuaauacgcagaucuuuuu

SEQ ID NO: 3806219 - RNA, 20 nt, Salmonella typhimurium LT2
gcuuaauccgugaauguccu

SEQ ID NO: 3806220 - RNA, 16 nt, Salmonella typhimurium LT2
gcuuaaucgagagcgg

SEQ ID NO: 3806221 - RNA, 23 nt, Salmonella typhimurium LT2
gcuuacauuucaggcaaaaaaaa

SEQ ID NO: 3806222 - RNA, 13 nt, Salmonella typhimurium LT2
gcuuaccagaccg

SEQ ID NO: 3806223 - RNA, 14 nt, Salmonella typhimurium LT2
gcuuaccaggccua

SEQ ID NO: 3806224 - RNA, 19 nt, Salmonella typhimurium LT2
gcuuaccaggccuacacgu

SEQ ID NO: 3806225 - RNA, 22 nt, Salmonella typhimurium LT2
gcuuaccgggucuggucaggua

SEQ ID NO: 3806226 - RNA, 23 nt, Salmonella typhimurium LT2
gcuuaccuuguucuuccauugcu

SEQ ID NO: 3806227 - RNA, 22 nt, Salmonella typhimurium LT2
gcuuacgaacugcggcuuuuuc

SEQ ID NO: 3806228 - RNA, 17 nt, Salmonella typhimurium LT2
gcuuacgcggcgcgcuc

SEQ ID NO: 3806229 - RNA, 16 nt, Salmonella typhimurium LT2
gcuuacggccaugggu

SEQ ID NO: 3806230 - RNA, 20 nt, Salmonella typhimurium LT2
gcuuacucagccagauaccg

SEQ ID NO: 3806231 - RNA, 21 nt, Salmonella typhimurium LT2
gcuuacuuuccaaaauccagg

SEQ ID NO: 3806232 - RNA, 21 nt, Salmonella typhimurium LT2
gcuuagggucagugauaacgc

SEQ ID NO: 3806233 - RNA, 15 nt, Salmonella typhimurium LT2
gcuuaguaggcuggc

SEQ ID NO: 3806234 - RNA, 20 nt, Salmonella typhimurium LT2
gcuuaucacguagccagagc

SEQ ID NO: 3806235 - RNA, 14 nt, Salmonella typhimurium LT2
gcuuaucaggccua

SEQ ID NO: 3806236 - RNA, 16 nt, Salmonella typhimurium LT2
gcuuaucaggccuaca

SEQ ID NO: 3806237 - RNA, 21 nt, Salmonella typhimurium LT2
gcuuaucaggccuacgugcuc

SEQ ID NO: 3806238 - RNA, 12 nt, Salmonella typhimurium LT2
gcuuauccagcc

SEQ ID NO: 3806239 - RNA, 14 nt, Salmonella typhimurium LT2
gcuuauccggccua

SEQ ID NO: 3806240 - RNA, 16 nt, Salmonella typhimurium LT2
gcuuauccggccuaca

SEQ ID NO: 3806241 - RNA, 18 nt, Salmonella typhimurium LT2
gcuuauccggccuacagc

SEQ ID NO: 3806242 - RNA, 20 nt, Salmonella typhimurium LT2
gcuuauccggccuacgauuu

SEQ ID NO: 3806243 - RNA, 17 nt, Salmonella typhimurium LT2
gcuuauccggccugcac

SEQ ID NO: 3806244 - RNA, 17 nt, Salmonella typhimurium LT2
gcuuaucgggcaacuga

SEQ ID NO: 3806245 - RNA, 18 nt, Salmonella typhimurium LT2
gcuuaucugaccaugcca

SEQ ID NO: 3806246 - RNA, 21 nt, Salmonella typhimurium LT2
gcuuuauauaaaaaaugguuu

SEQ ID NO: 3806247 - RNA, 18 nt, Salmonella typhimurium LT2
gcuuuaucuggucugcau

SEQ ID NO: 3806248 - RNA, 22 nt, Salmonella typhimurium LT2
gcuuuauucugucgccaccacu

SEQ ID NO: 3806249 - RNA, 19 nt, Salmonella typhimurium LT2
gcuuuauuuuuaauugcug

SEQ ID NO: 3806250 - RNA, 17 nt, Salmonella typhimurium LT2
gcuuucagauuagccag

SEQ ID NO: 3806251 - RNA, 17 nt, Salmonella typhimurium LT2
gcuuucagcuuuuugga

SEQ ID NO: 3806252 - RNA, 21 nt, Salmonella typhimurium LT2
gcuuucagcuuuuuggaaaug

SEQ ID NO: 3806253 - RNA, 22 nt, Salmonella typhimurium LT2
gcuuucaucauaucuucccgau

SEQ ID NO: 3806254 - RNA, 21 nt, Salmonella typhimurium LT2
gcuuucaucguauaaauuuuu

SEQ ID NO: 3806255 - RNA, 20 nt, Salmonella typhimurium LT2
gcuuucauuacgcuuccugc

SEQ ID NO: 3806256 - RNA, 17 nt, Salmonella typhimurium LT2
gcuuuccagccaugcca

SEQ ID NO: 3806257 - RNA, 18 nt, Salmonella typhimurium LT2
gcuuuccaggccagcgac

SEQ ID NO: 3806258 - RNA, 13 nt, Salmonella typhimurium LT2
gcuuuccgccaug

SEQ ID NO: 3806259 - RNA, 16 nt, Salmonella typhimurium LT2
gcuuuccgccaugaaa

SEQ ID NO: 3806260 - RNA, 21 nt, Salmonella typhimurium LT2
gcuuuccgccaugaaaaaaac

SEQ ID NO: 3806261 - RNA, 14 nt, Salmonella typhimurium LT2
gcuuuccgccgccg

SEQ ID NO: 3806262 - RNA, 19 nt, Salmonella typhimurium LT2
gcuuuccguuaccucaaaa

SEQ ID NO: 3806263 - RNA, 17 nt, Salmonella typhimurium LT2
gcuuucgcaacauccga

SEQ ID NO: 3806264 - RNA, 14 nt, Salmonella typhimurium LT2
gcuuucggaucaau

SEQ ID NO: 3806265 - RNA, 15 nt, Salmonella typhimurium LT2
gcuuucucuuccgcu

SEQ ID NO: 3806266 - RNA, 20 nt, Salmonella typhimurium LT2
gcuuucugaauuucacgcuu

SEQ ID NO: 3806267 - RNA, 14 nt, Salmonella typhimurium LT2
gcuuucuucguuag

SEQ ID NO: 3806268 - RNA, 13 nt, Salmonella typhimurium LT2
gcuuucuucuuca

SEQ ID NO: 3806269 - RNA, 14 nt, Salmonella typhimurium LT2
gcuuucuucuucac

SEQ ID NO: 3806270 - RNA, 23 nt, Salmonella typhimurium LT2
gcuuucuuuuagcgcuucuccca

SEQ ID NO: 3806271 - RNA, 17 nt, Salmonella typhimurium LT2
gcuuugaaucucuuccc

SEQ ID NO: 3806272 - RNA, 16 nt, Salmonella typhimurium LT2
gcuuugagcagcgcca

SEQ ID NO: 3806273 - RNA, 17 nt, Salmonella typhimurium LT2
gcuuugagcagcgccau

SEQ ID NO: 3806274 - RNA, 23 nt, Salmonella typhimurium LT2
gcuuugauuacugagaugacgcc

SEQ ID NO: 3806275 - RNA, 15 nt, Salmonella typhimurium LT2
gcuuugcaacagggc

SEQ ID NO: 3806276 - RNA, 16 nt, Salmonella typhimurium LT2
gcuuugcgccggcagu

SEQ ID NO: 3806277 - RNA, 17 nt, Salmonella typhimurium LT2
gcuuugcguaaaaaaac

SEQ ID NO: 3806278 - RNA, 22 nt, Salmonella typhimurium LT2
gcuuugcguaaaaaaacaucau

SEQ ID NO: 3806279 - RNA, 18 nt, Salmonella typhimurium LT2
gcuuugcuuauccggccu

SEQ ID NO: 3806280 - RNA, 18 nt, Salmonella typhimurium LT2
gcuuuggcaaacggcgcc

SEQ ID NO: 3806281 - RNA, 20 nt, Salmonella typhimurium LT2
gcuuugggaacuagcgaauc

SEQ ID NO: 3806282 - RNA, 18 nt, Salmonella typhimurium LT2
gcuuuguaaaacauucaa

SEQ ID NO: 3806283 - RNA, 15 nt, Salmonella typhimurium LT2
gcuuuguaaagcgcc

SEQ ID NO: 3806284 - RNA, 18 nt, Salmonella typhimurium LT2
gcuuuguuuugacgcugg

SEQ ID NO: 3806285 - RNA, 12 nt, Salmonella typhimurium LT2
gcuuuuaaaaua

SEQ ID NO: 3806286 - RNA, 17 nt, Salmonella typhimurium LT2
gcuuuuacagggcggca

SEQ ID NO: 3806287 - RNA, 23 nt, Salmonella typhimurium LT2
gcuuuuacagggcggcaggauga

SEQ ID NO: 3806288 - RNA, 18 nt, Salmonella typhimurium LT2
gcuuuuacgccauuggca

SEQ ID NO: 3806289 - RNA, 21 nt, Salmonella typhimurium LT2
gcuuuuaguuguacaaacugu

SEQ ID NO: 3806290 - RNA, 22 nt, Salmonella typhimurium LT2
gcuuuuaucugggucaggaacu

SEQ ID NO: 3806291 - RNA, 15 nt, Salmonella typhimurium LT2
gcuuuucagcccagg

SEQ ID NO: 3806292 - RNA, 19 nt, Salmonella typhimurium LT2
gcuuuuccguuagcuggcu

SEQ ID NO: 3806293 - RNA, 14 nt, Salmonella typhimurium LT2
gcuuuuccuuccag

SEQ ID NO: 3806294 - RNA, 19 nt, Salmonella typhimurium LT2
gcuuuugaauaaucccgca

SEQ ID NO: 3806295 - RNA, 22 nt, Salmonella typhimurium LT2
gcuuuugccgcgcccagcgccg

SEQ ID NO: 3806296 - RNA, 15 nt, Salmonella typhimurium LT2
gcuuuugguuccuuc

SEQ ID NO: 3806297 - RNA, 20 nt, Salmonella typhimurium LT2
gcuuuugguuuuucaaccac

SEQ ID NO: 3806298 - RNA, 16 nt, Salmonella typhimurium LT2
gcuuuuuacaaaguga

SEQ ID NO: 3806299 - RNA, 22 nt, Salmonella typhimurium LT2
gcuuuuucauucugcuuaccag

SEQ ID NO: 3806300 - RNA, 13 nt, Salmonella typhimurium LT2
gcuuuuugcgcca

SEQ ID NO: 3806301 - RNA, 19 nt, Salmonella typhimurium LT2
gcuuuuuucucugcuuucg

SEQ ID NO: 3806302 - RNA, 22 nt, Salmonella typhimurium LT2
gcuuuuuucucugcuuucggug

SEQ ID NO: 3806303 - RNA, 20 nt, Salmonella typhimurium LT2
ggaaaaaauacugauaaaaa

SEQ ID NO: 3806304 - RNA, 15 nt, Salmonella typhimurium LT2
ggaaaaagccgccgu

SEQ ID NO: 3806305 - RNA, 13 nt, Salmonella typhimurium LT2
ggaaaaauaagag

SEQ ID NO: 3806306 - RNA, 22 nt, Salmonella typhimurium LT2
ggaaaaauaguggcuggcgucc

SEQ ID NO: 3806307 - RNA, 13 nt, Salmonella typhimurium LT2
ggaaaacagcgcc

SEQ ID NO: 3806308 - RNA, 20 nt, Salmonella typhimurium LT2
ggaaaacgcaucugggcuga

SEQ ID NO: 3806309 - RNA, 22 nt, Salmonella typhimurium LT2
ggaaaauaaugccucauuaaaa

SEQ ID NO: 3806310 - RNA, 14 nt, Salmonella typhimurium LT2
ggaaaauuccugga

SEQ ID NO: 3806311 - RNA, 22 nt, Salmonella typhimurium LT2
ggaaacaguuuaguugccguuu

SEQ ID NO: 3806312 - RNA, 21 nt, Salmonella typhimurium LT2
ggaaacauaaggguaagcaau

SEQ ID NO: 3806313 - RNA, 20 nt, Salmonella typhimurium LT2
ggaaaccagauaccccgcca

SEQ ID NO: 3806314 - RNA, 19 nt, Salmonella typhimurium LT2
ggaaaccaguucgcgcgug

SEQ ID NO: 3806315 - RNA, 16 nt, Salmonella typhimurium LT2
ggaaacccgcucgccc

SEQ ID NO: 3806316 - RNA, 22 nt, Salmonella typhimurium LT2
ggaaacccgcucgcccgcagca

SEQ ID NO: 3806317 - RNA, 20 nt, Salmonella typhimurium LT2
ggaaaccgcucgaaagguua

SEQ ID NO: 3806318 - RNA, 18 nt, Salmonella typhimurium LT2
ggaaaccuguucccggca

SEQ ID NO: 3806319 - RNA, 23 nt, Salmonella typhimurium LT2
ggaaaccuuucuucucuucuuca

SEQ ID NO: 3806320 - RNA, 14 nt, Salmonella typhimurium LT2
ggaaacgccaggca

SEQ ID NO: 3806321 - RNA, 14 nt, Salmonella typhimurium LT2
ggaaacgcugcgcc

SEQ ID NO: 3806322 - RNA, 23 nt, Salmonella typhimurium LT2
ggaaacgcugcgccuggucuucc

SEQ ID NO: 3806323 - RNA, 21 nt, Salmonella typhimurium LT2
ggaaacggcucgguuuauccc

SEQ ID NO: 3806324 - RNA, 14 nt, Salmonella typhimurium LT2
ggaaacuuaucauu

SEQ ID NO: 3806325 - RNA, 17 nt, Salmonella typhimurium LT2
ggaaagaacacaggcag

SEQ ID NO: 3806326 - RNA, 15 nt, Salmonella typhimurium LT2
ggaaagacggcagcg

SEQ ID NO: 3806327 - RNA, 14 nt, Salmonella typhimurium LT2
ggaaagccccuacc

SEQ ID NO: 3806328 - RNA, 13 nt, Salmonella typhimurium LT2
ggaaaggcagaga

SEQ ID NO: 3806329 - RNA, 14 nt, Salmonella typhimurium LT2
ggaaagggacgaug

SEQ ID NO: 3806330 - RNA, 17 nt, Salmonella typhimurium LT2
ggaaagugaaggccaga

SEQ ID NO: 3806331 - RNA, 22 nt, Salmonella typhimurium LT2
ggaaauaaagguuucgauacag

SEQ ID NO: 3806332 - RNA, 20 nt, Salmonella typhimurium LT2
ggaaaucaaaccaccccagg

SEQ ID NO: 3806333 - RNA, 23 nt, Salmonella typhimurium LT2
ggaaaucaaaccaccccagguua

SEQ ID NO: 3806334 - RNA, 24 nt, Salmonella typhimurium LT2
ggaaaucaauuccgguugcccauu

SEQ ID NO: 3806335 - RNA, 23 nt, Salmonella typhimurium LT2
ggaacaaaccgacuuucaaaucg

SEQ ID NO: 3806336 - RNA, 21 nt, Salmonella typhimurium LT2
ggaacaacgcaacacaggccg

SEQ ID NO: 3806337 - RNA, 16 nt, Salmonella typhimurium LT2
ggaacaacucucccaa

SEQ ID NO: 3806338 - RNA, 13 nt, Salmonella typhimurium LT2
ggaacagaagcgc

SEQ ID NO: 3806339 - RNA, 15 nt, Salmonella typhimurium LT2
ggaacagcgccguca

SEQ ID NO: 3806340 - RNA, 19 nt, Salmonella typhimurium LT2
ggaacagcggagcgaagaa

SEQ ID NO: 3806341 - RNA, 16 nt, Salmonella typhimurium LT2
ggaacaggccaaaccc

SEQ ID NO: 3806342 - RNA, 15 nt, Salmonella typhimurium LT2
ggaacagggccgcau

SEQ ID NO: 3806343 - RNA, 16 nt, Salmonella typhimurium LT2
ggaaccaaaugcccag

SEQ ID NO: 3806344 - RNA, 13 nt, Salmonella typhimurium LT2
ggaacccagcaaa

SEQ ID NO: 3806345 - RNA, 14 nt, Salmonella typhimurium LT2
ggaacccaggcacc

SEQ ID NO: 3806346 - RNA, 14 nt, Salmonella typhimurium LT2
ggaacgagccgaua

SEQ ID NO: 3806347 - RNA, 10 nt, Salmonella typhimurium LT2
ggaacgcugu

SEQ ID NO: 3806348 - RNA, 18 nt, Salmonella typhimurium LT2
ggaacucugcuuuuauuu

SEQ ID NO: 3806349 - RNA, 19 nt, Salmonella typhimurium LT2
ggagucaaguuagcccccg

SEQ ID NO: 3806350 - RNA, 15 nt, Salmonella typhimurium LT2
ggagucauugcuaug

SEQ ID NO: 3806351 - RNA, 19 nt, Salmonella typhimurium LT2
ggaguccagcaacugcgcg

SEQ ID NO: 3806352 - RNA, 21 nt, Salmonella typhimurium LT2
ggagucgccgguuguccacug

SEQ ID NO: 3806353 - RNA, 17 nt, Salmonella typhimurium LT2
ggagucuaaaaauaauu

SEQ ID NO: 3806354 - RNA, 22 nt, Salmonella typhimurium LT2
ggagucuaaaacgaacaggccg

SEQ ID NO: 3806355 - RNA, 19 nt, Salmonella typhimurium LT2
ggagugaguccccaggagc

SEQ ID NO: 3806356 - RNA, 16 nt, Salmonella typhimurium LT2
ggaguggcgaaauugg

SEQ ID NO: 3806357 - RNA, 12 nt, Salmonella typhimurium LT2
ggauaaaacaga

SEQ ID NO: 3806358 - RNA, 13 nt, Salmonella typhimurium LT2
ggauaaagaccgg

SEQ ID NO: 3806359 - RNA, 14 nt, Salmonella typhimurium LT2
ggauaaagaccggc

SEQ ID NO: 3806360 - RNA, 23 nt, Salmonella typhimurium LT2
ggauaaagccaauggugcucagc

SEQ ID NO: 3806361 - RNA, 15 nt, Salmonella typhimurium LT2
ggauaaaggccggga

SEQ ID NO: 3806362 - RNA, 22 nt, Salmonella typhimurium LT2
ggauaaauagugacgccgccau

SEQ ID NO: 3806363 - RNA, 15 nt, Salmonella typhimurium LT2
ggauaaaucaucauc

SEQ ID NO: 3806364 - RNA, 17 nt, Salmonella typhimurium LT2
ggauaaauuaaaugugc

SEQ ID NO: 3806365 - RNA, 23 nt, Salmonella typhimurium LT2
ggauaacgcucuuaccgcuaaaa

SEQ ID NO: 3806366 - RNA, 18 nt, Salmonella typhimurium LT2
ggauaagcaaagcgccau

SEQ ID NO: 3806367 - RNA, 19 nt, Salmonella typhimurium LT2
ggauaagcauuagcgccau

SEQ ID NO: 3806368 - RNA, 18 nt, Salmonella typhimurium LT2
ggauaagcgcagcgccau

SEQ ID NO: 3806369 - RNA, 20 nt, Salmonella typhimurium LT2
ggauaaggcgcuagccgcau

SEQ ID NO: 3806370 - RNA, 20 nt, Salmonella typhimurium LT2
ggauaaggcguaaccgccau

SEQ ID NO: 3806371 - RNA, 23 nt, Salmonella typhimurium LT2
ggauaaggcguucacgccgccau

SEQ ID NO: 3806372 - RNA, 22 nt, Salmonella typhimurium LT2
ggauaaggcguuucgccgccau

SEQ ID NO: 3806373 - RNA, 23 nt, Salmonella typhimurium LT2
ggauaaggugcuugcgccgccau

SEQ ID NO: 3806374 - RNA, 23 nt, Salmonella typhimurium LT2
ggauaagguguuuacgccgccau

SEQ ID NO: 3806375 - RNA, 12 nt, Salmonella typhimurium LT2
ggauacagcgcc

SEQ ID NO: 3806376 - RNA, 16 nt, Salmonella typhimurium LT2
ggauaccacgccaaua

SEQ ID NO: 3806377 - RNA, 17 nt, Salmonella typhimurium LT2
ggauaccguccaccagc

SEQ ID NO: 3806378 - RNA, 22 nt, Salmonella typhimurium LT2
ggauagagaucuuccgccacca

SEQ ID NO: 3806379 - RNA, 16 nt, Salmonella typhimurium LT2
ggauagaguuaaaagg

SEQ ID NO: 3806380 - RNA, 17 nt, Salmonella typhimurium LT2
ggauagcguagcgccau

SEQ ID NO: 3806381 - RNA, 19 nt, Salmonella typhimurium LT2
ggauagcguagcgccaucc

SEQ ID NO: 3806382 - RNA, 12 nt, Salmonella typhimurium LT2
ggauagucuuca

SEQ ID NO: 3806383 - RNA, 13 nt, Salmonella typhimurium LT2
ggauagucuucaa

SEQ ID NO: 3806384 - RNA, 20 nt, Salmonella typhimurium LT2
ggauagugauauagcgccau

SEQ ID NO: 3806385 - RNA, 16 nt, Salmonella typhimurium LT2
ggauauacuucaucag

SEQ ID NO: 3806386 - RNA, 23 nt, Salmonella typhimurium LT2
ggauauccugcucgccugugccc

SEQ ID NO: 3806387 - RNA, 13 nt, Salmonella typhimurium LT2
ggauauucauugc

SEQ ID NO: 3806388 - RNA, 14 nt, Salmonella typhimurium LT2
ggaucaagcccccg

SEQ ID NO: 3806389 - RNA, 13 nt, Salmonella typhimurium LT2
ggaucagcggcug

SEQ ID NO: 3806390 - RNA, 23 nt, Salmonella typhimurium LT2
ggaucaggcgcuugcgccgccau

SEQ ID NO: 3806391 - RNA, 13 nt, Salmonella typhimurium LT2
ggaucaucuuuua

SEQ ID NO: 3806392 - RNA, 16 nt, Salmonella typhimurium LT2
ggaucaugguugaaaa

SEQ ID NO: 3806393 - RNA, 13 nt, Salmonella typhimurium LT2
ggaucccccuggc

SEQ ID NO: 3806394 - RNA, 20 nt, Salmonella typhimurium LT2
ggaucccgaauaucgcgagc

SEQ ID NO: 3806395 - RNA, 21 nt, Salmonella typhimurium LT2
ggaucgccagaucgaacagcg

SEQ ID NO: 3806396 - RNA, 12 nt, Salmonella typhimurium LT2
ggaucgccauca

SEQ ID NO: 3806397 - RNA, 12 nt, Salmonella typhimurium LT2
ggaucgccaucg

SEQ ID NO: 3806398 - RNA, 15 nt, Salmonella typhimurium LT2
ggaucgccaucgaca

SEQ ID NO: 3806399 - RNA, 13 nt, Salmonella typhimurium LT2
ggaucgccaugcu

SEQ ID NO: 3806400 - RNA, 21 nt, Salmonella typhimurium LT2
ggaucggucugacgcauaaug

SEQ ID NO: 3806401 - RNA, 16 nt, Salmonella typhimurium LT2
ggaucgucggucagau

SEQ ID NO: 3806402 - RNA, 22 nt, Salmonella typhimurium LT2
ggaucgucucugagaucaaaca

SEQ ID NO: 3806403 - RNA, 13 nt, Salmonella typhimurium LT2
ggaucucaccacu

SEQ ID NO: 3806404 - RNA, 15 nt, Salmonella typhimurium LT2
ggaugaaacgacaca

SEQ ID NO: 3806405 - RNA, 23 nt, Salmonella typhimurium LT2
ggaugacggcgaacggggagaca

SEQ ID NO: 3806406 - RNA, 22 nt, Salmonella typhimurium LT2
ggaugaggaucgcgugcauuaa

SEQ ID NO: 3806407 - RNA, 20 nt, Salmonella typhimurium LT2
ggaugaggcgcagccgccau

SEQ ID NO: 3806408 - RNA, 12 nt, Salmonella typhimurium LT2
ggaugaucguca

SEQ ID NO: 3806409 - RNA, 15 nt, Salmonella typhimurium LT2
ggaugccaaccaccg

SEQ ID NO: 3806410 - RNA, 15 nt, Salmonella typhimurium LT2
ggaugcgauguaaaa

SEQ ID NO: 3806411 - RNA, 17 nt, Salmonella typhimurium LT2
ggaugcgcaaucaccca

SEQ ID NO: 3806412 - RNA, 13 nt, Salmonella typhimurium LT2
ggaugcgccaucc

SEQ ID NO: 3806413 - RNA, 14 nt, Salmonella typhimurium LT2
ggaugcgcuaucga

SEQ ID NO: 3806414 - RNA, 22 nt, Salmonella typhimurium LT2
ggaugcugccugccugaagcgc

SEQ ID NO: 3806415 - RNA, 13 nt, Salmonella typhimurium LT2
ggauggcaaaaac

SEQ ID NO: 3806416 - RNA, 18 nt, Salmonella typhimurium LT2
ggauggcaaaaacagccg

SEQ ID NO: 3806417 - RNA, 17 nt, Salmonella typhimurium LT2
ggauggcaguacagggc

SEQ ID NO: 3806418 - RNA, 15 nt, Salmonella typhimurium LT2
ggauggccucugcca

SEQ ID NO: 3806419 - RNA, 11 nt, Salmonella typhimurium LT2
ggauggcggcu

SEQ ID NO: 3806420 - RNA, 22 nt, Salmonella typhimurium LT2
ggauguaccgcuacgcaggcca

SEQ ID NO: 3806421 - RNA, 14 nt, Salmonella typhimurium LT2
ggauguacucaucc

SEQ ID NO: 3806422 - RNA, 16 nt, Salmonella typhimurium LT2
ggauguggugcggcuu

SEQ ID NO: 3806423 - RNA, 12 nt, Salmonella typhimurium LT2
ggauuaucagaa

SEQ ID NO: 3806424 - RNA, 19 nt, Salmonella typhimurium LT2
ggauucgccagcgugcuua

SEQ ID NO: 3806425 - RNA, 14 nt, Salmonella typhimurium LT2
ggauucggcaacac

SEQ ID NO: 3806426 - RNA, 21 nt, Salmonella typhimurium LT2
ggauucucuaacgucagcgcc

SEQ ID NO: 3806427 - RNA, 22 nt, Salmonella typhimurium LT2
ggauucucuaacgucagcgcca

SEQ ID NO: 3806428 - RNA, 20 nt, Salmonella typhimurium LT2
ggauugggcagacuuucuga

SEQ ID NO: 3806429 - RNA, 11 nt, Salmonella typhimurium LT2
ggauugucuua

SEQ ID NO: 3806430 - RNA, 17 nt, Salmonella typhimurium LT2
ggauuuaaaccgccccg

SEQ ID NO: 3806431 - RNA, 11 nt, Salmonella typhimurium LT2
ggauuuuaaau

SEQ ID NO: 3806432 - RNA, 17 nt, Salmonella typhimurium LT2
ggauuuuaaauugguua

SEQ ID NO: 3806433 - RNA, 20 nt, Salmonella typhimurium LT2
ggauuuuccguuaagcugga

SEQ ID NO: 3806434 - RNA, 22 nt, Salmonella typhimurium LT2
ggcaaaaacggcgcuuuuaaaa

SEQ ID NO: 3806435 - RNA, 23 nt, Salmonella typhimurium LT2
ggcaaaaagcauaugcgguccgu

SEQ ID NO: 3806436 - RNA, 13 nt, Salmonella typhimurium LT2
ggcaaaaugccag

SEQ ID NO: 3806437 - RNA, 20 nt, Salmonella typhimurium LT2
ggcaaaaugcgucggcacca

SEQ ID NO: 3806438 - RNA, 22 nt, Salmonella typhimurium LT2
ggcaaaaugcgucggcaccauu

SEQ ID NO: 3806439 - RNA, 16 nt, Salmonella typhimurium LT2
ggcaaaauggcgaugc

SEQ ID NO: 3806440 - RNA, 19 nt, Salmonella typhimurium LT2
ggcaaaauggguucuggcg

SEQ ID NO: 3806441 - RNA, 21 nt, Salmonella typhimurium LT2
ggcaaacacaaaaugcccuuc

SEQ ID NO: 3806442 - RNA, 12 nt, Salmonella typhimurium LT2
ggcaaaccagca

SEQ ID NO: 3806443 - RNA, 17 nt, Salmonella typhimurium LT2
ggcaaacggcgccagcu

SEQ ID NO: 3806444 - RNA, 12 nt, Salmonella typhimurium LT2
ggcaaagcaggu

SEQ ID NO: 3806445 - RNA, 15 nt, Salmonella typhimurium LT2
ggcaaagcaggugag

SEQ ID NO: 3806446 - RNA, 22 nt, Salmonella typhimurium LT2
ggcaaagcucaacgcaggcugg

SEQ ID NO: 3806447 - RNA, 16 nt, Salmonella typhimurium LT2
ggcaaaggaaugcuuu

SEQ ID NO: 3806448 - RNA, 19 nt, Salmonella typhimurium LT2
ggcaaauaauaccacgaug

SEQ ID NO: 3806449 - RNA, 11 nt, Salmonella typhimurium LT2
ggcaaauagcg

SEQ ID NO: 3806450 - RNA, 22 nt, Salmonella typhimurium LT2
ggcaaauagcguguguuuuccu

SEQ ID NO: 3806451 - RNA, 23 nt, Salmonella typhimurium LT2
ggcaacaaaacuaccgcgccagc

SEQ ID NO: 3806452 - RNA, 23 nt, Salmonella typhimurium LT2
ggcaacaaacauaagcaaauccu

SEQ ID NO: 3806453 - RNA, 13 nt, Salmonella typhimurium LT2
ggcaucacgccgg

SEQ ID NO: 3806454 - RNA, 15 nt, Salmonella typhimurium LT2
ggcaucagauuuagg

SEQ ID NO: 3806455 - RNA, 17 nt, Salmonella typhimurium LT2
ggcaucagccgccaucc

SEQ ID NO: 3806456 - RNA, 18 nt, Salmonella typhimurium LT2
ggcauccgugaccugcug

SEQ ID NO: 3806457 - RNA, 18 nt, Salmonella typhimurium LT2
ggcaucgcccguuuuacc

SEQ ID NO: 3806458 - RNA, 20 nt, Salmonella typhimurium LT2
ggcaucgcccguuuuaccgg

SEQ ID NO: 3806459 - RNA, 15 nt, Salmonella typhimurium LT2
ggcaucggcagcguc

SEQ ID NO: 3806460 - RNA, 18 nt, Salmonella typhimurium LT2
ggcaucggcagcgucagg

SEQ ID NO: 3806461 - RNA, 18 nt, Salmonella typhimurium LT2
ggcaucguagucaggcag

SEQ ID NO: 3806462 - RNA, 17 nt, Salmonella typhimurium LT2
ggcaucucuggcggcgu

SEQ ID NO: 3806463 - RNA, 18 nt, Salmonella typhimurium LT2
ggcaucugaacacgccga

SEQ ID NO: 3806464 - RNA, 14 nt, Salmonella typhimurium LT2
ggcaucuuaaacca

SEQ ID NO: 3806465 - RNA, 21 nt, Salmonella typhimurium LT2
ggcaucuuaaaccaggcuuag

SEQ ID NO: 3806466 - RNA, 18 nt, Salmonella typhimurium LT2
ggcaucuuaucaggccua

SEQ ID NO: 3806467 - RNA, 15 nt, Salmonella typhimurium LT2
ggcaugaagaaaaua

SEQ ID NO: 3806468 - RNA, 20 nt, Salmonella typhimurium LT2
ggcaugaagcagcaggcagg

SEQ ID NO: 3806469 - RNA, 19 nt, Salmonella typhimurium LT2
ggcaugcagcucaagcgcc

SEQ ID NO: 3806470 - RNA, 22 nt, Salmonella typhimurium LT2
ggcaugcguugaaaaccugcaa

SEQ ID NO: 3806471 - RNA, 18 nt, Salmonella typhimurium LT2
ggcauggcguuauggcaa

SEQ ID NO: 3806472 - RNA, 17 nt, Salmonella typhimurium LT2
ggcauuaauauccagug

SEQ ID NO: 3806473 - RNA, 17 nt, Salmonella typhimurium LT2
ggcauucaguuucuucg

SEQ ID NO: 3806474 - RNA, 23 nt, Salmonella typhimurium LT2
ggcauucaguuucuucggcuuca

SEQ ID NO: 3806475 - RNA, 18 nt, Salmonella typhimurium LT2
ggcauucuuuuagcgcuc

SEQ ID NO: 3806476 - RNA, 17 nt, Salmonella typhimurium LT2
ggcauugauaaagcgcu

SEQ ID NO: 3806477 - RNA, 14 nt, Salmonella typhimurium LT2
ggcauugcagcgcg

SEQ ID NO: 3806478 - RNA, 17 nt, Salmonella typhimurium LT2
ggcauuggcguuaccgg

SEQ ID NO: 3806479 - RNA, 17 nt, Salmonella typhimurium LT2
ggcauuucaaucgccac

SEQ ID NO: 3806480 - RNA, 22 nt, Salmonella typhimurium LT2
ggcauuucaccgccaauaacgg

SEQ ID NO: 3806481 - RNA, 21 nt, Salmonella typhimurium LT2
ggccaaaaaagccgcucgcca

SEQ ID NO: 3806482 - RNA, 20 nt, Salmonella typhimurium LT2
ggccaaaacccaccagcagg

SEQ ID NO: 3806483 - RNA, 23 nt, Salmonella typhimurium LT2
ggccaaaacccaccagcagggca

SEQ ID NO: 3806484 - RNA, 14 nt, Salmonella typhimurium LT2
ggccaaacagcggc

SEQ ID NO: 3806485 - RNA, 20 nt, Salmonella typhimurium LT2
ggccaaacccugcgccacaa

SEQ ID NO: 3806486 - RNA, 15 nt, Salmonella typhimurium LT2
ggccaacuuauccga

SEQ ID NO: 3806487 - RNA, 16 nt, Salmonella typhimurium LT2
ggccaacuuauccgac

SEQ ID NO: 3806488 - RNA, 14 nt, Salmonella typhimurium LT2
ggccaagcagcgcc

SEQ ID NO: 3806489 - RNA, 16 nt, Salmonella typhimurium LT2
ggccaagcagcgccac

SEQ ID NO: 3806490 - RNA, 13 nt, Salmonella typhimurium LT2
ggccaaucaaccg

SEQ ID NO: 3806491 - RNA, 22 nt, Salmonella typhimurium LT2
ggccaaugccgccuuuaucgac

SEQ ID NO: 3806492 - RNA, 22 nt, Salmonella typhimurium LT2
ggccaauggcucaacuccgccg

SEQ ID NO: 3806493 - RNA, 20 nt, Salmonella typhimurium LT2
ggccaauguacguaaaacca

SEQ ID NO: 3806494 - RNA, 17 nt, Salmonella typhimurium LT2
ggccacaauugccagca

SEQ ID NO: 3806495 - RNA, 18 nt, Salmonella typhimurium LT2
ggccacagcgccagacac

SEQ ID NO: 3806496 - RNA, 12 nt, Salmonella typhimurium LT2
ggccaccagcac

SEQ ID NO: 3806497 - RNA, 14 nt, Salmonella typhimurium LT2
ggccaccagcacaa

SEQ ID NO: 3806498 - RNA, 23 nt, Salmonella typhimurium LT2
ggccacgaauuugucccuguucc

SEQ ID NO: 3806499 - RNA, 21 nt, Salmonella typhimurium LT2
ggccacggauuuaauccacca

SEQ ID NO: 3806500 - RNA, 14 nt, Salmonella typhimurium LT2
ggccacggcuguaa

SEQ ID NO: 3806501 - RNA, 16 nt, Salmonella typhimurium LT2
ggccacucuccagcau

SEQ ID NO: 3806502 - RNA, 17 nt, Salmonella typhimurium LT2
ggccacucuccagcauc

SEQ ID NO: 3806503 - RNA, 17 nt, Salmonella typhimurium LT2
ggccacugcuggcccag

SEQ ID NO: 3806504 - RNA, 20 nt, Salmonella typhimurium LT2
ggccagaaguagcagagaaa

SEQ ID NO: 3806505 - RNA, 22 nt, Salmonella typhimurium LT2
ggccagagcaagcucuguucaa

SEQ ID NO: 3806506 - RNA, 18 nt, Salmonella typhimurium LT2
ggccagaugaucagcaua

SEQ ID NO: 3806507 - RNA, 15 nt, Salmonella typhimurium LT2
ggccagaugcggcga

SEQ ID NO: 3806508 - RNA, 14 nt, Salmonella typhimurium LT2
ggccagauggcaaa

SEQ ID NO: 3806509 - RNA, 15 nt, Salmonella typhimurium LT2
ggccagauggcaaac

SEQ ID NO: 3806510 - RNA, 14 nt, Salmonella typhimurium LT2
ggccagcagcgcau

SEQ ID NO: 3806511 - RNA, 17 nt, Salmonella typhimurium LT2
ggccagcaguuccacca

SEQ ID NO: 3806512 - RNA, 21 nt, Salmonella typhimurium LT2
ggccagccgacgcucuuccuc

SEQ ID NO: 3806513 - RNA, 12 nt, Salmonella typhimurium LT2
ggccagcgacac

SEQ ID NO: 3806514 - RNA, 15 nt, Salmonella typhimurium LT2
ggccagcgacacgcc

SEQ ID NO: 3806515 - RNA, 11 nt, Salmonella typhimurium LT2
ggccagcgacu

SEQ ID NO: 3806516 - RNA, 15 nt, Salmonella typhimurium LT2
ggccagcgccggcga

SEQ ID NO: 3806517 - RNA, 14 nt, Salmonella typhimurium LT2
ggccagcgcgcggc

SEQ ID NO: 3806518 - RNA, 16 nt, Salmonella typhimurium LT2
ggccagcgcgcguggg

SEQ ID NO: 3806519 - RNA, 17 nt, Salmonella typhimurium LT2
ggccagcguaccugcgg

SEQ ID NO: 3806520 - RNA, 21 nt, Salmonella typhimurium LT2
ggccaggaauaaaggucacau

SEQ ID NO: 3806521 - RNA, 16 nt, Salmonella typhimurium LT2
ggccaggcauugauaa

SEQ ID NO: 3806522 - RNA, 21 nt, Salmonella typhimurium LT2
ggccaggcgugauugagcaga

SEQ ID NO: 3806523 - RNA, 17 nt, Salmonella typhimurium LT2
ggccaguagcgggggcc

SEQ ID NO: 3806524 - RNA, 15 nt, Salmonella typhimurium LT2
ggccaguauuggccu

SEQ ID NO: 3806525 - RNA, 19 nt, Salmonella typhimurium LT2
ggccagugccaaguaacac

SEQ ID NO: 3806526 - RNA, 22 nt, Salmonella typhimurium LT2
ggccaguugcuucauaucgcca

SEQ ID NO: 3806527 - RNA, 17 nt, Salmonella typhimurium LT2
ggccaguuguucuuuca

SEQ ID NO: 3806528 - RNA, 18 nt, Salmonella typhimurium LT2
ggccaguuguucuuucac

SEQ ID NO: 3806529 - RNA, 19 nt, Salmonella typhimurium LT2
ggccaguuuccugacccgc

SEQ ID NO: 3806530 - RNA, 21 nt, Salmonella typhimurium LT2
ggccauaauacgcuugcgcca

SEQ ID NO: 3806531 - RNA, 18 nt, Salmonella typhimurium LT2
ggccaucucaauaaucuc

SEQ ID NO: 3806532 - RNA, 21 nt, Salmonella typhimurium LT2
ggccaucuuccagcaucagca

SEQ ID NO: 3806533 - RNA, 18 nt, Salmonella typhimurium LT2
ggccaugaucgccgccau

SEQ ID NO: 3806534 - RNA, 17 nt, Salmonella typhimurium LT2
ggccaugcgcaagcgcc

SEQ ID NO: 3806535 - RNA, 15 nt, Salmonella typhimurium LT2
ggccaugcuuuugca

SEQ ID NO: 3806536 - RNA, 19 nt, Salmonella typhimurium LT2
ggccauuaagcuucgugag

SEQ ID NO: 3806537 - RNA, 17 nt, Salmonella typhimurium LT2
ggccauugaagucccuu

SEQ ID NO: 3806538 - RNA, 20 nt, Salmonella typhimurium LT2
ggccauuugcggaauaugag

SEQ ID NO: 3806539 - RNA, 23 nt, Salmonella typhimurium LT2
ggcccacguaagugggaucaggu

SEQ ID NO: 3806540 - RNA, 17 nt, Salmonella typhimurium LT2
ggcccacucauccagca

SEQ ID NO: 3806541 - RNA, 18 nt, Salmonella typhimurium LT2
ggcccagcgacagccagu

SEQ ID NO: 3806542 - RNA, 17 nt, Salmonella typhimurium LT2
ggcccagcguacugcca

SEQ ID NO: 3806543 - RNA, 16 nt, Salmonella typhimurium LT2
ggcccaggcaucgacg

SEQ ID NO: 3806544 - RNA, 16 nt, Salmonella typhimurium LT2
ggcccaugaucaggcg

SEQ ID NO: 3806545 - RNA, 15 nt, Salmonella typhimurium LT2
ggccccaauuugcug

SEQ ID NO: 3806546 - RNA, 22 nt, Salmonella typhimurium LT2
ggcccgauaagcaaagcgccau

SEQ ID NO: 3806547 - RNA, 16 nt, Salmonella typhimurium LT2
ggcccgauaagcgcug

SEQ ID NO: 3806548 - RNA, 11 nt, Salmonella typhimurium LT2
ggcccgccagc

SEQ ID NO: 3806549 - RNA, 14 nt, Salmonella typhimurium LT2
ggcccgcggcgacg

SEQ ID NO: 3806550 - RNA, 15 nt, Salmonella typhimurium LT2
ggcccguagggugag

SEQ ID NO: 3806551 - RNA, 21 nt, Salmonella typhimurium LT2
ggcccguagggugaggaguga

SEQ ID NO: 3806552 - RNA, 17 nt, Salmonella typhimurium LT2
ggcccguggcccaggcc

SEQ ID NO: 3806553 - RNA, 15 nt, Salmonella typhimurium LT2
ggcccguugccuggc

SEQ ID NO: 3806554 - RNA, 14 nt, Salmonella typhimurium LT2
ggccgaaaccgcuc

SEQ ID NO: 3806555 - RNA, 14 nt, Salmonella typhimurium LT2
ggccgacagacgcc

SEQ ID NO: 3806556 - RNA, 17 nt, Salmonella typhimurium LT2
ggccgacaggcggcagc

SEQ ID NO: 3806557 - RNA, 18 nt, Salmonella typhimurium LT2
ggcgcugcuggcagcgcu

SEQ ID NO: 3806558 - RNA, 20 nt, Salmonella typhimurium LT2
ggcgcugcuggcagcgcuga

SEQ ID NO: 3806559 - RNA, 18 nt, Salmonella typhimurium LT2
ggcgcuggcgcuuaccgg

SEQ ID NO: 3806560 - RNA, 22 nt, Salmonella typhimurium LT2
ggcgcuggggugcgccgcagcg

SEQ ID NO: 3806561 - RNA, 15 nt, Salmonella typhimurium LT2
ggcgcuucgcuuauc

SEQ ID NO: 3806562 - RNA, 15 nt, Salmonella typhimurium LT2
ggcgcuucggcgcca

SEQ ID NO: 3806563 - RNA, 14 nt, Salmonella typhimurium LT2
ggcgcuugcuuauc

SEQ ID NO: 3806564 - RNA, 17 nt, Salmonella typhimurium LT2
ggcgcuuugcuuauccg

SEQ ID NO: 3806565 - RNA, 17 nt, Salmonella typhimurium LT2
ggcgcuuuguuacucuu

SEQ ID NO: 3806566 - RNA, 18 nt, Salmonella typhimurium LT2
ggcggaaaugcggguccu

SEQ ID NO: 3806567 - RNA, 19 nt, Salmonella typhimurium LT2
ggcggacaacgcuccagca

SEQ ID NO: 3806568 - RNA, 20 nt, Salmonella typhimurium LT2
ggcggacaacgcuccagcag

SEQ ID NO: 3806569 - RNA, 13 nt, Salmonella typhimurium LT2
ggcggacagcggc

SEQ ID NO: 3806570 - RNA, 20 nt, Salmonella typhimurium LT2
ggcggagccaaaagaagugg

SEQ ID NO: 3806571 - RNA, 20 nt, Salmonella typhimurium LT2
ggcggagccgccauccggca

SEQ ID NO: 3806572 - RNA, 18 nt, Salmonella typhimurium LT2
ggcggcaaaaacgccggu

SEQ ID NO: 3806573 - RNA, 18 nt, Salmonella typhimurium LT2
ggcggcagcuuacugugc

SEQ ID NO: 3806574 - RNA, 22 nt, Salmonella typhimurium LT2
ggcggcaguggacuaugcucca

SEQ ID NO: 3806575 - RNA, 20 nt, Salmonella typhimurium LT2
ggcggcauaaacgccuuauc

SEQ ID NO: 3806576 - RNA, 16 nt, Salmonella typhimurium LT2
ggcggccaaucagaua

SEQ ID NO: 3806577 - RNA, 13 nt, Salmonella typhimurium LT2
ggcggccagcauu

SEQ ID NO: 3806578 - RNA, 18 nt, Salmonella typhimurium LT2
ggcggcccacucauccag

SEQ ID NO: 3806579 - RNA, 20 nt, Salmonella typhimurium LT2
ggcggcgacuggcuaaacaa

SEQ ID NO: 3806580 - RNA, 20 nt, Salmonella typhimurium LT2
ggcggcgcgaacgccuuauc

SEQ ID NO: 3806581 - RNA, 21 nt, Salmonella typhimurium LT2
ggcggcgcgcucuacguugac

SEQ ID NO: 3806582 - RNA, 20 nt, Salmonella typhimurium LT2
ggcggcguaaacaccuuauc

SEQ ID NO: 3806583 - RNA, 23 nt, Salmonella typhimurium LT2
ggcggcguaaacacguuaucuga

SEQ ID NO: 3806584 - RNA, 20 nt, Salmonella typhimurium LT2
ggcggcgugaacgccuuauc

SEQ ID NO: 3806585 - RNA, 20 nt, Salmonella typhimurium LT2
ggcggcgugaacgucuuauc

SEQ ID NO: 3806586 - RNA, 23 nt, Salmonella typhimurium LT2
ggcggcgugaacgucuuauccgg

SEQ ID NO: 3806587 - RNA, 20 nt, Salmonella typhimurium LT2
ggcggcgugaccgccuuauc

SEQ ID NO: 3806588 - RNA, 14 nt, Salmonella typhimurium LT2
ggcggcgugcgccc

SEQ ID NO: 3806589 - RNA, 13 nt, Salmonella typhimurium LT2
ggcggcguuaacg

SEQ ID NO: 3806590 - RNA, 19 nt, Salmonella typhimurium LT2
ggcggcguuuauacgugug

SEQ ID NO: 3806591 - RNA, 20 nt, Salmonella typhimurium LT2
ggcggcuaccucuuauccgg

SEQ ID NO: 3806592 - RNA, 20 nt, Salmonella typhimurium LT2
ggcggcuacgccuuacccgg

SEQ ID NO: 3806593 - RNA, 13 nt, Salmonella typhimurium LT2
ggcggcuagcgca

SEQ ID NO: 3806594 - RNA, 14 nt, Salmonella typhimurium LT2
ggcggcucagggca

SEQ ID NO: 3806595 - RNA, 19 nt, Salmonella typhimurium LT2
ggcggcugcgccuuauccg

SEQ ID NO: 3806596 - RNA, 20 nt, Salmonella typhimurium LT2
ggcggcugcgccuuauccgg

SEQ ID NO: 3806597 - RNA, 14 nt, Salmonella typhimurium LT2
ggcggcuuggcugu

SEQ ID NO: 3806598 - RNA, 15 nt, Salmonella typhimurium LT2
ggcggcuuuacccgg

SEQ ID NO: 3806599 - RNA, 20 nt, Salmonella typhimurium LT2
ggcgggcgauagagaccgcu

SEQ ID NO: 3806600 - RNA, 17 nt, Salmonella typhimurium LT2
ggcggggucaaaaaagg

SEQ ID NO: 3806601 - RNA, 18 nt, Salmonella typhimurium LT2
ggcgggugcgcagcccca

SEQ ID NO: 3806602 - RNA, 14 nt, Salmonella typhimurium LT2
ggcgguaugaaagc

SEQ ID NO: 3806603 - RNA, 14 nt, Salmonella typhimurium LT2
ggcgguauuauccg

SEQ ID NO: 3806604 - RNA, 20 nt, Salmonella typhimurium LT2
ggcggucgacaugcgcaugu

SEQ ID NO: 3806605 - RNA, 19 nt, Salmonella typhimurium LT2
ggcggucuggauuuggcug

SEQ ID NO: 3806606 - RNA, 20 nt, Salmonella typhimurium LT2
ggcggugcgcagccacggcg

SEQ ID NO: 3806607 - RNA, 18 nt, Salmonella typhimurium LT2
ggcgguuauccgccagcg

SEQ ID NO: 3806608 - RNA, 12 nt, Salmonella typhimurium LT2
ggcgguucgcca

SEQ ID NO: 3806609 - RNA, 13 nt, Salmonella typhimurium LT2
ggcgguuuauccg

SEQ ID NO: 3806610 - RNA, 14 nt, Salmonella typhimurium LT2
ggcgguuuauccgg

SEQ ID NO: 3806611 - RNA, 18 nt, Salmonella typhimurium LT2
ggcgguuugacggcugca

SEQ ID NO: 3806612 - RNA, 22 nt, Salmonella typhimurium LT2
ggcgguuuuuuuauccauuuca

SEQ ID NO: 3806613 - RNA, 21 nt, Salmonella typhimurium LT2
ggcguaaaagcgauaaagaca

SEQ ID NO: 3806614 - RNA, 14 nt, Salmonella typhimurium LT2
ggcguaaaucaggc

SEQ ID NO: 3806615 - RNA, 15 nt, Salmonella typhimurium LT2
ggcguaaaucaggcc

SEQ ID NO: 3806616 - RNA, 17 nt, Salmonella typhimurium LT2
ggcguaaaugugcgcca

SEQ ID NO: 3806617 - RNA, 21 nt, Salmonella typhimurium LT2
ggcguaaccgccauccggcga

SEQ ID NO: 3806618 - RNA, 23 nt, Salmonella typhimurium LT2
ggcguaacggcugacgcccauca

SEQ ID NO: 3806619 - RNA, 15 nt, Salmonella typhimurium LT2
ggcguaagaucccag

SEQ ID NO: 3806620 - RNA, 16 nt, Salmonella typhimurium LT2
ggcguaagaucgcgag

SEQ ID NO: 3806621 - RNA, 15 nt, Salmonella typhimurium LT2
ggcguaauccagcuu

SEQ ID NO: 3806622 - RNA, 18 nt, Salmonella typhimurium LT2
ggcguaauuaaccgcgcc

SEQ ID NO: 3806623 - RNA, 13 nt, Salmonella typhimurium LT2
ggcguaccaucag

SEQ ID NO: 3806624 - RNA, 17 nt, Salmonella typhimurium LT2
ggcguacuaaauaggcg

SEQ ID NO: 3806625 - RNA, 21 nt, Salmonella typhimurium LT2
ggcguacuaaauaggcggcau

SEQ ID NO: 3806626 - RNA, 13 nt, Salmonella typhimurium LT2
ggcguagccgccg

SEQ ID NO: 3806627 - RNA, 17 nt, Salmonella typhimurium LT2
ggcguagccgccgagcg

SEQ ID NO: 3806628 - RNA, 19 nt, Salmonella typhimurium LT2
ggcguagucagcgacgcga

SEQ ID NO: 3806629 - RNA, 17 nt, Salmonella typhimurium LT2
ggcguauagccaggcag

SEQ ID NO: 3806630 - RNA, 13 nt, Salmonella typhimurium LT2
ggcguauagcgcu

SEQ ID NO: 3806631 - RNA, 18 nt, Salmonella typhimurium LT2
ggcguauuccauacagaa

SEQ ID NO: 3806632 - RNA, 14 nt, Salmonella typhimurium LT2
ggcguauuuaugug

SEQ ID NO: 3806633 - RNA, 17 nt, Salmonella typhimurium LT2
ggcgucaaacagcuuaa

SEQ ID NO: 3806634 - RNA, 15 nt, Salmonella typhimurium LT2
ggcgucaaugaucag

SEQ ID NO: 3806635 - RNA, 20 nt, Salmonella typhimurium LT2
ggcgucaccaccgcaggcag

SEQ ID NO: 3806636 - RNA, 22 nt, Salmonella typhimurium LT2
ggcgucaccaccgcaggcagcg

SEQ ID NO: 3806637 - RNA, 20 nt, Salmonella typhimurium LT2
ggcgucacccgccggcagua

SEQ ID NO: 3806638 - RNA, 20 nt, Salmonella typhimurium LT2
ggcgucagccgccaucaggc

SEQ ID NO: 3806639 - RNA, 13 nt, Salmonella typhimurium LT2
ggcgucaggccgg

SEQ ID NO: 3806640 - RNA, 22 nt, Salmonella typhimurium LT2
ggcgucauagccgcgcgucagc

SEQ ID NO: 3806641 - RNA, 14 nt, Salmonella typhimurium LT2
ggcgucauccggcg

SEQ ID NO: 3806642 - RNA, 23 nt, Salmonella typhimurium LT2
ggcgucccuuucccuuccagcga

SEQ ID NO: 3806643 - RNA, 16 nt, Salmonella typhimurium LT2
ggcguccugcccgcca

SEQ ID NO: 3806644 - RNA, 16 nt, Salmonella typhimurium LT2
ggcgucgccugugccg

SEQ ID NO: 3806645 - RNA, 21 nt, Salmonella typhimurium LT2
ggcgucgcuggucugacggau

SEQ ID NO: 3806646 - RNA, 21 nt, Salmonella typhimurium LT2
ggcgucucgcacucgccgcca

SEQ ID NO: 3806647 - RNA, 15 nt, Salmonella typhimurium LT2
ggcgugaaccgguaa

SEQ ID NO: 3806648 - RNA, 13 nt, Salmonella typhimurium LT2
ggcgugacgcgcc

SEQ ID NO: 3806649 - RNA, 21 nt, Salmonella typhimurium LT2
ggcgugguggauauccagcau

SEQ ID NO: 3806650 - RNA, 22 nt, Salmonella typhimurium LT2
ggcgugguggauauccagcaua

SEQ ID NO: 3806651 - RNA, 17 nt, Salmonella typhimurium LT2
ggcgugucgccggggcg

SEQ ID NO: 3806652 - RNA, 19 nt, Salmonella typhimurium LT2
ggcguguugaaguccucua

SEQ ID NO: 3806653 - RNA, 20 nt, Salmonella typhimurium LT2
ggcguguuguaaaacgcgcc

SEQ ID NO: 3806654 - RNA, 23 nt, Salmonella typhimurium LT2
ggcguuacuccgcgauagagcgc

SEQ ID NO: 3806655 - RNA, 17 nt, Salmonella typhimurium LT2
ggcguuaucuugacaug

SEQ ID NO: 3806656 - RNA, 13 nt, Salmonella typhimurium LT2
ggcguucaacacc

SEQ ID NO: 3806657 - RNA, 18 nt, Salmonella typhimurium LT2
ggcguucgcccugcgcca

SEQ ID NO: 3806658 - RNA, 19 nt, Salmonella typhimurium LT2
ggcguucugcgccauuucc

SEQ ID NO: 3806659 - RNA, 19 nt, Salmonella typhimurium LT2
ggcguuucguuuagcgccu

SEQ ID NO: 3806660 - RNA, 23 nt, Salmonella typhimurium LT2
gggacguuucgauaaccaccagc

SEQ ID NO: 3806661 - RNA, 12 nt, Salmonella typhimurium LT2
gggacuggauga

SEQ ID NO: 3806662 - RNA, 13 nt, Salmonella typhimurium LT2
gggagcagacugu

SEQ ID NO: 3806663 - RNA, 21 nt, Salmonella typhimurium LT2
gggaggcaggcaacaugacca

SEQ ID NO: 3806664 - RNA, 23 nt, Salmonella typhimurium LT2
gggaguaguguaauaccacugcc

SEQ ID NO: 3806665 - RNA, 21 nt, Salmonella typhimurium LT2
gggaguaugcggucaaaagcu

SEQ ID NO: 3806666 - RNA, 17 nt, Salmonella typhimurium LT2
gggauaaucagcagcga

SEQ ID NO: 3806667 - RNA, 13 nt, Salmonella typhimurium LT2
gggauauaaaauu

SEQ ID NO: 3806668 - RNA, 22 nt, Salmonella typhimurium LT2
gggauaucgcuggccuccagca

SEQ ID NO: 3806669 - RNA, 16 nt, Salmonella typhimurium LT2
gggaucagcggcugca

SEQ ID NO: 3806670 - RNA, 22 nt, Salmonella typhimurium LT2
gggcaaaaacggcgcuuuuaaa

SEQ ID NO: 3806671 - RNA, 19 nt, Salmonella typhimurium LT2
gggcaaacagcacuacagc

SEQ ID NO: 3806672 - RNA, 19 nt, Salmonella typhimurium LT2
gggcaacggccagcgcagg

SEQ ID NO: 3806673 - RNA, 20 nt, Salmonella typhimurium LT2
gggcaacggccagcgcaggc

SEQ ID NO: 3806674 - RNA, 19 nt, Salmonella typhimurium LT2
gggcaacgggccggguucg

SEQ ID NO: 3806675 - RNA, 14 nt, Salmonella typhimurium LT2
gggcaagcgaagcg

SEQ ID NO: 3806676 - RNA, 18 nt, Salmonella typhimurium LT2
gggcaagggcaagggcaa

SEQ ID NO: 3806677 - RNA, 20 nt, Salmonella typhimurium LT2
gggcaauaaagcggaugacg

SEQ ID NO: 3806678 - RNA, 14 nt, Salmonella typhimurium LT2
gggcaauccauuaa

SEQ ID NO: 3806679 - RNA, 23 nt, Salmonella typhimurium LT2
gggcacgcugaccacgccgccgc

SEQ ID NO: 3806680 - RNA, 12 nt, Salmonella typhimurium LT2
gggcagaaacgu

SEQ ID NO: 3806681 - RNA, 20 nt, Salmonella typhimurium LT2
gggcagaaacguaccugaga

SEQ ID NO: 3806682 - RNA, 20 nt, Salmonella typhimurium LT2
gggcagacauuugcgcacgg

SEQ ID NO: 3806683 - RNA, 14 nt, Salmonella typhimurium LT2
gggcagacuuucug

SEQ ID NO: 3806684 - RNA, 13 nt, Salmonella typhimurium LT2
gggcagagccgga

SEQ ID NO: 3806685 - RNA, 12 nt, Salmonella typhimurium LT2
gggcaggcgugu

SEQ ID NO: 3806686 - RNA, 22 nt, Salmonella typhimurium LT2
gggcaguaaauuaaacagcugu

SEQ ID NO: 3806687 - RNA, 17 nt, Salmonella typhimurium LT2
gggcauaaaaaagccga

SEQ ID NO: 3806688 - RNA, 16 nt, Salmonella typhimurium LT2
gggcauaaaugguacu

SEQ ID NO: 3806689 - RNA, 21 nt, Salmonella typhimurium LT2
gggcauauucuggcggcgggu

SEQ ID NO: 3806690 - RNA, 15 nt, Salmonella typhimurium LT2
gggcaucaccggauc

SEQ ID NO: 3806691 - RNA, 14 nt, Salmonella typhimurium LT2
gggcaucauaagag

SEQ ID NO: 3806692 - RNA, 12 nt, Salmonella typhimurium LT2
gggcauccgccg

SEQ ID NO: 3806693 - RNA, 15 nt, Salmonella typhimurium LT2
gggcauccgccgccg

SEQ ID NO: 3806694 - RNA, 16 nt, Salmonella typhimurium LT2
gggccacucuccagca

SEQ ID NO: 3806695 - RNA, 17 nt, Salmonella typhimurium LT2
gggccacucuccagcau

SEQ ID NO: 3806696 - RNA, 13 nt, Salmonella typhimurium LT2
gggccagcgccag

SEQ ID NO: 3806697 - RNA, 24 nt, Salmonella typhimurium LT2
gggccaguuuccugacccgcucgu

SEQ ID NO: 3806698 - RNA, 17 nt, Salmonella typhimurium LT2
gggcccguggcccaggc

SEQ ID NO: 3806699 - RNA, 23 nt, Salmonella typhimurium LT2
gggcccguggcccaggcccgggu

SEQ ID NO: 3806700 - RNA, 13 nt, Salmonella typhimurium LT2
gggccgaaaccgc

SEQ ID NO: 3806701 - RNA, 16 nt, Salmonella typhimurium LT2
gggccgacagacgcca

SEQ ID NO: 3806702 - RNA, 21 nt, Salmonella typhimurium LT2
gggccgacguaacuaucuguu

SEQ ID NO: 3806703 - RNA, 13 nt, Salmonella typhimurium LT2
gggccgccgccau

SEQ ID NO: 3806704 - RNA, 13 nt, Salmonella typhimurium LT2
gggccugauaagc

SEQ ID NO: 3806705 - RNA, 18 nt, Salmonella typhimurium LT2
gggccugauaagcacagg

SEQ ID NO: 3806706 - RNA, 20 nt, Salmonella typhimurium LT2
gggccuuuuuaaugacuuuu

SEQ ID NO: 3806707 - RNA, 12 nt, Salmonella typhimurium LT2
gggcgaaaacgc

SEQ ID NO: 3806708 - RNA, 22 nt, Salmonella typhimurium LT2
gggcgaaucuggauagucaggc

SEQ ID NO: 3806709 - RNA, 15 nt, Salmonella typhimurium LT2
gggcgacacgcgcgc

SEQ ID NO: 3806710 - RNA, 16 nt, Salmonella typhimurium LT2
gggcgaccgucgggcc

SEQ ID NO: 3806711 - RNA, 23 nt, Salmonella typhimurium LT2
gggcgagauguuuuaccaguaca

SEQ ID NO: 3806712 - RNA, 13 nt, Salmonella typhimurium LT2
gggcgauaaacca

SEQ ID NO: 3806713 - RNA, 15 nt, Salmonella typhimurium LT2
gggcgauaaaccagc

SEQ ID NO: 3806714 - RNA, 23 nt, Salmonella typhimurium LT2
gggcgauaaaccagccccacggu

SEQ ID NO: 3806715 - RNA, 13 nt, Salmonella typhimurium LT2
gggcgaucagcag

SEQ ID NO: 3806716 - RNA, 13 nt, Salmonella typhimurium LT2
gggcgaugcgcga

SEQ ID NO: 3806717 - RNA, 15 nt, Salmonella typhimurium LT2
gggcgcacagcgcca

SEQ ID NO: 3806718 - RNA, 21 nt, Salmonella typhimurium LT2
gggcgcggcugguaagagagc

SEQ ID NO: 3806719 - RNA, 21 nt, Salmonella typhimurium LT2
gggcggaaaacauucgcccgu

SEQ ID NO: 3806720 - RNA, 20 nt, Salmonella typhimurium LT2
gggcgggauaauacguacgg

SEQ ID NO: 3806721 - RNA, 16 nt, Salmonella typhimurium LT2
gggcgguacagcaucc

SEQ ID NO: 3806722 - RNA, 17 nt, Salmonella typhimurium LT2
gggcguaaauauaacgc

SEQ ID NO: 3806723 - RNA, 15 nt, Salmonella typhimurium LT2
gggcguccacuuucu

SEQ ID NO: 3806724 - RNA, 12 nt, Salmonella typhimurium LT2
gggcguccugcc

SEQ ID NO: 3806725 - RNA, 15 nt, Salmonella typhimurium LT2
gggcgugacgcgcca

SEQ ID NO: 3806726 - RNA, 13 nt, Salmonella typhimurium LT2
gggcgugucccug

SEQ ID NO: 3806727 - RNA, 19 nt, Salmonella typhimurium LT2
gggcguuucagcuuccagu

SEQ ID NO: 3806728 - RNA, 19 nt, Salmonella typhimurium LT2
gggcuaaaugcccacggcg

SEQ ID NO: 3806729 - RNA, 12 nt, Salmonella typhimurium LT2
gggcuauaggcc

SEQ ID NO: 3806730 - RNA, 15 nt, Salmonella typhimurium LT2
gggcuauuugcagau

SEQ ID NO: 3806731 - RNA, 22 nt, Salmonella typhimurium LT2
gggcuccauagggcagggugcc

SEQ ID NO: 3806732 - RNA, 16 nt, Salmonella typhimurium LT2
gggcuguuauucagca

SEQ ID NO: 3806733 - RNA, 15 nt, Salmonella typhimurium LT2
gggcuuaaugcgcac

SEQ ID NO: 3806734 - RNA, 14 nt, Salmonella typhimurium LT2
gggcuugagcccgg

SEQ ID NO: 3806735 - RNA, 23 nt, Salmonella typhimurium LT2
gggcuuuugagucgcauccagug

SEQ ID NO: 3806736 - RNA, 16 nt, Salmonella typhimurium LT2
ggggaaacccacgacc

SEQ ID NO: 3806737 - RNA, 19 nt, Salmonella typhimurium LT2
ggggaaacccacgaccagu

SEQ ID NO: 3806738 - RNA, 17 nt, Salmonella typhimurium LT2
ggggaagcgacgacacg

SEQ ID NO: 3806739 - RNA, 18 nt, Salmonella typhimurium LT2
ggggaagggugagaaccu

SEQ ID NO: 3806740 - RNA, 16 nt, Salmonella typhimurium LT2
ggggauaaccagaaaa

SEQ ID NO: 3806741 - RNA, 20 nt, Salmonella typhimurium LT2
ggggaucaagcccccgcaac

SEQ ID NO: 3806742 - RNA, 11 nt, Salmonella typhimurium LT2
ggggauuucau

SEQ ID NO: 3806743 - RNA, 14 nt, Salmonella typhimurium LT2
ggggcauuuuccgg

SEQ ID NO: 3806744 - RNA, 13 nt, Salmonella typhimurium LT2
ggggccagcgcca

SEQ ID NO: 3806745 - RNA, 14 nt, Salmonella typhimurium LT2
ggggcgacagcccc

SEQ ID NO: 3806746 - RNA, 18 nt, Salmonella typhimurium LT2
ggggcuaauuucccccca

SEQ ID NO: 3806747 - RNA, 19 nt, Salmonella typhimurium LT2
gggggaaaugagaaaagga

SEQ ID NO: 3806748 - RNA, 21 nt, Salmonella typhimurium LT2
gggggaaaugagaaaaggaag

SEQ ID NO: 3806749 - RNA, 17 nt, Salmonella typhimurium LT2
gggggaggcaggcaaca

SEQ ID NO: 3806750 - RNA, 20 nt, Salmonella typhimurium LT2
gggggccugauggcgcugcg

SEQ ID NO: 3806751 - RNA, 17 nt, Salmonella typhimurium LT2
gggggcgaucagcaggu

SEQ ID NO: 3806752 - RNA, 23 nt, Salmonella typhimurium LT2
ggggguucaaguccccccccucg

SEQ ID NO: 3806753 - RNA, 19 nt, Salmonella typhimurium LT2
ggggucggcgcuaaugugg

SEQ ID NO: 3806754 - RNA, 16 nt, Salmonella typhimurium LT2
gggguucagaccagaa

SEQ ID NO: 3806755 - RNA, 21 nt, Salmonella typhimurium LT2
gggguuuguccugcagcgcca

SEQ ID NO: 3806756 - RNA, 22 nt, Salmonella typhimurium LT2
gggguuuucucuuuccagcgac

SEQ ID NO: 3806757 - RNA, 21 nt, Salmonella typhimurium LT2
gggguuuuugccggaccugcg

SEQ ID NO: 3806758 - RNA, 21 nt, Salmonella typhimurium LT2
ggguaaaugcgcgcggcugcc

SEQ ID NO: 3806759 - RNA, 11 nt, Salmonella typhimurium LT2
ggguaauacug

SEQ ID NO: 3806760 - RNA, 22 nt, Salmonella typhimurium LT2
ggguaaugaucagcaaaauagu

SEQ ID NO: 3806761 - RNA, 16 nt, Salmonella typhimurium LT2
ggguauagagcaaucu

SEQ ID NO: 3806762 - RNA, 23 nt, Salmonella typhimurium LT2
ggguaucccgacgcacgagaucc

SEQ ID NO: 3806763 - RNA, 14 nt, Salmonella typhimurium LT2
ggguauggcgccaa

SEQ ID NO: 3806764 - RNA, 12 nt, Salmonella typhimurium LT2
ggucaugcggau

SEQ ID NO: 3806765 - RNA, 19 nt, Salmonella typhimurium LT2
ggucauucauugucuuuuu

SEQ ID NO: 3806766 - RNA, 15 nt, Salmonella typhimurium LT2
ggucauuuuacugcg

SEQ ID NO: 3806767 - RNA, 21 nt, Salmonella typhimurium LT2
gguccggcgcuaaccagcgcu

SEQ ID NO: 3806768 - RNA, 21 nt, Salmonella typhimurium LT2
ggucgacaugcgcaugugagu

SEQ ID NO: 3806769 - RNA, 17 nt, Salmonella typhimurium LT2
ggucgaccaccugcugu

SEQ ID NO: 3806770 - RNA, 13 nt, Salmonella typhimurium LT2
ggucgacgccuua

SEQ ID NO: 3806771 - RNA, 21 nt, Salmonella typhimurium LT2
ggucgcguccggggccagcgc

SEQ ID NO: 3806772 - RNA, 16 nt, Salmonella typhimurium LT2
ggucgcuauccagcag

SEQ ID NO: 3806773 - RNA, 16 nt, Salmonella typhimurium LT2
ggucggcuacgacagg

SEQ ID NO: 3806774 - RNA, 16 nt, Salmonella typhimurium LT2
ggucgggcaggcuucc

SEQ ID NO: 3806775 - RNA, 13 nt, Salmonella typhimurium LT2
ggucguaaacacg

SEQ ID NO: 3806776 - RNA, 20 nt, Salmonella typhimurium LT2
ggucguacuaaagagcgccu

SEQ ID NO: 3806777 - RNA, 13 nt, Salmonella typhimurium LT2
ggucgucaucggc

SEQ ID NO: 3806778 - RNA, 11 nt, Salmonella typhimurium LT2
ggucguccagu

SEQ ID NO: 3806779 - RNA, 19 nt, Salmonella typhimurium LT2
ggucuccagcaaaaaaugc

SEQ ID NO: 3806780 - RNA, 20 nt, Salmonella typhimurium LT2
ggucucuucaugcauaaccg

SEQ ID NO: 3806781 - RNA, 19 nt, Salmonella typhimurium LT2
ggucugcaugccgcaggcc

SEQ ID NO: 3806782 - RNA, 18 nt, Salmonella typhimurium LT2
ggucuucuuucagguucc

SEQ ID NO: 3806783 - RNA, 20 nt, Salmonella typhimurium LT2
ggugaaaaugaaaaauccgc

SEQ ID NO: 3806784 - RNA, 20 nt, Salmonella typhimurium LT2
ggugaaccaaagcaaaaaau

SEQ ID NO: 3806785 - RNA, 12 nt, Salmonella typhimurium LT2
ggugaagacgcu

SEQ ID NO: 3806786 - RNA, 22 nt, Salmonella typhimurium LT2
ggugaauaccagcggcaaacag

SEQ ID NO: 3806787 - RNA, 14 nt, Salmonella typhimurium LT2
ggugaauuugcugc

SEQ ID NO: 3806788 - RNA, 14 nt, Salmonella typhimurium LT2
ggugacaucgccaa

SEQ ID NO: 3806789 - RNA, 23 nt, Salmonella typhimurium LT2
ggugacgagggaaggggauuuuc

SEQ ID NO: 3806790 - RNA, 21 nt, Salmonella typhimurium LT2
ggugacgauacggcccagacc

SEQ ID NO: 3806791 - RNA, 17 nt, Salmonella typhimurium LT2
ggugacggaaaccagca

SEQ ID NO: 3806792 - RNA, 16 nt, Salmonella typhimurium LT2
ggugacugucgagaug

SEQ ID NO: 3806793 - RNA, 13 nt, Salmonella typhimurium LT2
ggugauagcgcgc

SEQ ID NO: 3806794 - RNA, 22 nt, Salmonella typhimurium LT2
ggugauauuuuagccaucccgg

SEQ ID NO: 3806795 - RNA, 15 nt, Salmonella typhimurium LT2
ggugauccuccugca

SEQ ID NO: 3806796 - RNA, 23 nt, Salmonella typhimurium LT2
ggugaucuggccaauuuuucaca

SEQ ID NO: 3806797 - RNA, 19 nt, Salmonella typhimurium LT2
ggugaugaaggucggcuga

SEQ ID NO: 3806798 - RNA, 16 nt, Salmonella typhimurium LT2
ggugauuaacagcgcc

SEQ ID NO: 3806799 - RNA, 17 nt, Salmonella typhimurium LT2
ggugauuaacagcgcca

SEQ ID NO: 3806800 - RNA, 14 nt, Salmonella typhimurium LT2
ggugauuuccagaa

SEQ ID NO: 3806801 - RNA, 23 nt, Salmonella typhimurium LT2
ggugauuucgcccgcauucgcgg

SEQ ID NO: 3806802 - RNA, 15 nt, Salmonella typhimurium LT2
ggugcaaaacguuug

SEQ ID NO: 3806803 - RNA, 23 nt, Salmonella typhimurium LT2
ggugcaagcaccuuauccggccu

SEQ ID NO: 3806804 - RNA, 16 nt, Salmonella typhimurium LT2
ggugcacgaacugcug

SEQ ID NO: 3806805 - RNA, 11 nt, Salmonella typhimurium LT2
ggugcagucgc

SEQ ID NO: 3806806 - RNA, 24 nt, Salmonella typhimurium LT2
ggugcaugcggagauggcgaagga

SEQ ID NO: 3806807 - RNA, 18 nt, Salmonella typhimurium LT2
ggugccaaucuccagcau

SEQ ID NO: 3806808 - RNA, 17 nt, Salmonella typhimurium LT2
ggugccauuccagccgg

SEQ ID NO: 3806809 - RNA, 17 nt, Salmonella typhimurium LT2
ggugcccgcaaaaccuu

SEQ ID NO: 3806810 - RNA, 17 nt, Salmonella typhimurium LT2
ggugccgaaaucaucaa

SEQ ID NO: 3806811 - RNA, 21 nt, Salmonella typhimurium LT2
ggugcgccccagcaugagcca

SEQ ID NO: 3806812 - RNA, 20 nt, Salmonella typhimurium LT2
ggugcgccgcagcgccugcg

SEQ ID NO: 3806813 - RNA, 17 nt, Salmonella typhimurium LT2
ggugcguccgguagaga

SEQ ID NO: 3806814 - RNA, 18 nt, Salmonella typhimurium LT2
ggugcguggcgcugggcc

SEQ ID NO: 3806815 - RNA, 15 nt, Salmonella typhimurium LT2
ggugcucaaucagaa

SEQ ID NO: 3806816 - RNA, 21 nt, Salmonella typhimurium LT2
ggugcuccagcccgaaaggac

SEQ ID NO: 3806817 - RNA, 18 nt, Salmonella typhimurium LT2
ggugcuuagcuggccaau

SEQ ID NO: 3806818 - RNA, 18 nt, Salmonella typhimurium LT2
gguggaucccccuggccc

SEQ ID NO: 3806819 - RNA, 17 nt, Salmonella typhimurium LT2
gguggcgccgcgccacc

SEQ ID NO: 3806820 - RNA, 18 nt, Salmonella typhimurium LT2
gguggcggaauugguaga

SEQ ID NO: 3806821 - RNA, 23 nt, Salmonella typhimurium LT2
ggugggcgguauccuccugccag

SEQ ID NO: 3806822 - RNA, 22 nt, Salmonella typhimurium LT2
gguggggauaucuucgaugaga

SEQ ID NO: 3806823 - RNA, 19 nt, Salmonella typhimurium LT2
gguggggcuaagugagcau

SEQ ID NO: 3806824 - RNA, 15 nt, Salmonella typhimurium LT2
ggugggugaugacgg

SEQ ID NO: 3806825 - RNA, 16 nt, Salmonella typhimurium LT2
ggugggugaugacggg

SEQ ID NO: 3806826 - RNA, 20 nt, Salmonella typhimurium LT2
gguggucaucgcggccagca

SEQ ID NO: 3806827 - RNA, 21 nt, Salmonella typhimurium LT2
gguggugcucuaaccaacuga

SEQ ID NO: 3806828 - RNA, 16 nt, Salmonella typhimurium LT2
ggugguuucccugacc

SEQ ID NO: 3806829 - RNA, 13 nt, Salmonella typhimurium LT2
gguguacagcgcg

SEQ ID NO: 3806830 - RNA, 14 nt, Salmonella typhimurium LT2
gguguaccccgccu

SEQ ID NO: 3806831 - RNA, 14 nt, Salmonella typhimurium LT2
ggugucagauccuu

SEQ ID NO: 3806832 - RNA, 18 nt, Salmonella typhimurium LT2
ggugucaucuucuuccgg

SEQ ID NO: 3806833 - RNA, 20 nt, Salmonella typhimurium LT2
ggugugccgcuugccaguac

SEQ ID NO: 3806834 - RNA, 15 nt, Salmonella typhimurium LT2
ggugugccugcgcuu

SEQ ID NO: 3806835 - RNA, 18 nt, Salmonella typhimurium LT2
gguguuuacgccgccauc

SEQ ID NO: 3806836 - RNA, 21 nt, Salmonella typhimurium LT2
gguuaacauaugggcaaaaac

SEQ ID NO: 3806837 - RNA, 20 nt, Salmonella typhimurium LT2
gguuaacccacaacgcacca

SEQ ID NO: 3806838 - RNA, 19 nt, Salmonella typhimurium LT2
gguuaacccgguuuauccc

SEQ ID NO: 3806839 - RNA, 15 nt, Salmonella typhimurium LT2
gguuaacgucagauu

SEQ ID NO: 3806840 - RNA, 12 nt, Salmonella typhimurium LT2
gguuaacucuuu

SEQ ID NO: 3806841 - RNA, 17 nt, Salmonella typhimurium LT2
gguuaagauacauauca

SEQ ID NO: 3806842 - RNA, 13 nt, Salmonella typhimurium LT2
gguuaauggcagc

SEQ ID NO: 3806843 - RNA, 15 nt, Salmonella typhimurium LT2
gguuacaacccgacc

SEQ ID NO: 3806844 - RNA, 23 nt, Salmonella typhimurium LT2
gguuaccaaacccuuuggcaaaa

SEQ ID NO: 3806845 - RNA, 14 nt, Salmonella typhimurium LT2
gguuacucuuccac

SEQ ID NO: 3806846 - RNA, 19 nt, Salmonella typhimurium LT2
gguuagccagugggcguca

SEQ ID NO: 3806847 - RNA, 22 nt, Salmonella typhimurium LT2
gguuauaaacccccuggccgga

SEQ ID NO: 3806848 - RNA, 16 nt, Salmonella typhimurium LT2
gguuauaccgccaucc

SEQ ID NO: 3806849 - RNA, 14 nt, Salmonella typhimurium LT2
gguuauccagcagg

SEQ ID NO: 3806850 - RNA, 19 nt, Salmonella typhimurium LT2
gguucaacgcgcugcagcu

SEQ ID NO: 3806851 - RNA, 13 nt, Salmonella typhimurium LT2
gguucaagucccc

SEQ ID NO: 3806852 - RNA, 15 nt, Salmonella typhimurium LT2
gguucaagucccccc

SEQ ID NO: 3806853 - RNA, 19 nt, Salmonella typhimurium LT2
gguucaaguccccccccuc

SEQ ID NO: 3806854 - RNA, 22 nt, Salmonella typhimurium LT2
gguucaccagcgcgccgccgcc

SEQ ID NO: 3806855 - RNA, 13 nt, Salmonella typhimurium LT2
gguuccaggcacu

SEQ ID NO: 3806856 - RNA, 23 nt, Salmonella typhimurium LT2
gguucccgagcggccaaagggag

SEQ ID NO: 3806857 - RNA, 19 nt, Salmonella typhimurium LT2
gguucccgccgccaucgcc

SEQ ID NO: 3806858 - RNA, 12 nt, Salmonella typhimurium LT2
gguucgccuucc

SEQ ID NO: 3806859 - RNA, 19 nt, Salmonella typhimurium LT2
gguucgcgaagugucuucc

SEQ ID NO: 3806860 - RNA, 12 nt, Salmonella typhimurium LT2
gguucugcucaa

SEQ ID NO: 3806861 - RNA, 20 nt, Salmonella typhimurium LT2
gguucuuguguugaaauacu

SEQ ID NO: 3806862 - RNA, 20 nt, Salmonella typhimurium LT2
gguugaaggucugacaacua

SEQ ID NO: 3806863 - RNA, 23 nt, Salmonella typhimurium LT2
gguugcaugauuaggcuggguca

SEQ ID NO: 3806864 - RNA, 15 nt, Salmonella typhimurium LT2
gguugcccggcgcca

SEQ ID NO: 3806865 - RNA, 17 nt, Salmonella typhimurium LT2
gguugcgaauaaacaca

SEQ ID NO: 3806866 - RNA, 23 nt, Salmonella typhimurium LT2
gguugucaaauuugcugccaucg

SEQ ID NO: 3806867 - RNA, 18 nt, Salmonella typhimurium LT2
gguuuacguagcagcgcg

SEQ ID NO: 3806868 - RNA, 12 nt, Salmonella typhimurium LT2
guaauaaagaag

SEQ ID NO: 3806869 - RNA, 13 nt, Salmonella typhimurium LT2
guaauaaagaagg

SEQ ID NO: 3806870 - RNA, 14 nt, Salmonella typhimurium LT2
guaauaaagcguag

SEQ ID NO: 3806871 - RNA, 15 nt, Salmonella typhimurium LT2
guaauaaagcguagc

SEQ ID NO: 3806872 - RNA, 22 nt, Salmonella typhimurium LT2
guaauacgcgucugucgaaacu

SEQ ID NO: 3806873 - RNA, 18 nt, Salmonella typhimurium LT2
guaauacggagcaaaaaa

SEQ ID NO: 3806874 - RNA, 23 nt, Salmonella typhimurium LT2
guaauagaguuuauguaccaguu

SEQ ID NO: 3806875 - RNA, 18 nt, Salmonella typhimurium LT2
guaauauaaucuaccauu

SEQ ID NO: 3806876 - RNA, 21 nt, Salmonella typhimurium LT2
guaauaucgcggguuuuauca

SEQ ID NO: 3806877 - RNA, 15 nt, Salmonella typhimurium LT2
guaauaugggcacaa

SEQ ID NO: 3806878 - RNA, 12 nt, Salmonella typhimurium LT2
guaauauuaaaa

SEQ ID NO: 3806879 - RNA, 22 nt, Salmonella typhimurium LT2
guaaucacgucauuaaagcgcu

SEQ ID NO: 3806880 - RNA, 21 nt, Salmonella typhimurium LT2
guaaucauuucauuaaucagu

SEQ ID NO: 3806881 - RNA, 22 nt, Salmonella typhimurium LT2
guaauccacauccaaccgcuga

SEQ ID NO: 3806882 - RNA, 14 nt, Salmonella typhimurium LT2
guaauccagcuuca

SEQ ID NO: 3806883 - RNA, 18 nt, Salmonella typhimurium LT2
guaaucccggucgcgcca

SEQ ID NO: 3806884 - RNA, 13 nt, Salmonella typhimurium LT2
guaaucgccguau

SEQ ID NO: 3806885 - RNA, 11 nt, Salmonella typhimurium LT2
guaaucgcggu

SEQ ID NO: 3806886 - RNA, 17 nt, Salmonella typhimurium LT2
guaaucucccacccgcg

SEQ ID NO: 3806887 - RNA, 16 nt, Salmonella typhimurium LT2
guaaucuuuucauauu

SEQ ID NO: 3806888 - RNA, 15 nt, Salmonella typhimurium LT2
guaaugcgccaggca

SEQ ID NO: 3806889 - RNA, 17 nt, Salmonella typhimurium LT2
guaaugcgccaggcagc

SEQ ID NO: 3806890 - RNA, 16 nt, Salmonella typhimurium LT2
guaaugcucaacucug

SEQ ID NO: 3806891 - RNA, 15 nt, Salmonella typhimurium LT2
guaaugcuugcugcu

SEQ ID NO: 3806892 - RNA, 13 nt, Salmonella typhimurium LT2
guaauggccuaca

SEQ ID NO: 3806893 - RNA, 17 nt, Salmonella typhimurium LT2
guaauggccuacacacu

SEQ ID NO: 3806894 - RNA, 17 nt, Salmonella typhimurium LT2
guaaugguauugcgaua

SEQ ID NO: 3806895 - RNA, 18 nt, Salmonella typhimurium LT2
guaaugucuggugcagca

SEQ ID NO: 3806896 - RNA, 19 nt, Salmonella typhimurium LT2
guaauguucaggguuagcg

SEQ ID NO: 3806897 - RNA, 17 nt, Salmonella typhimurium LT2
guaauguuuacuccauu

SEQ ID NO: 3806898 - RNA, 18 nt, Salmonella typhimurium LT2
guaauucucccaaauuuu

SEQ ID NO: 3806899 - RNA, 17 nt, Salmonella typhimurium LT2
guaauugacgcgucagg

SEQ ID NO: 3806900 - RNA, 18 nt, Salmonella typhimurium LT2
guaauugaggauugccgc

SEQ ID NO: 3806901 - RNA, 19 nt, Salmonella typhimurium LT2
guaauugaggauugccgcc

SEQ ID NO: 3806902 - RNA, 18 nt, Salmonella typhimurium LT2
guaauuucgcuggcggcc

SEQ ID NO: 3806903 - RNA, 19 nt, Salmonella typhimurium LT2
guaauuugaacauauccgc

SEQ ID NO: 3806904 - RNA, 10 nt, Salmonella typhimurium LT2
guaauuugcg

SEQ ID NO: 3806905 - RNA, 11 nt, Salmonella typhimurium LT2
guaauuuucac

SEQ ID NO: 3806906 - RNA, 19 nt, Salmonella typhimurium LT2
guaauuuugauauaaccgu

SEQ ID NO: 3806907 - RNA, 17 nt, Salmonella typhimurium LT2
guaauuuuucucccagc

SEQ ID NO: 3806908 - RNA, 13 nt, Salmonella typhimurium LT2
guacaaaaaaugu

SEQ ID NO: 3806909 - RNA, 20 nt, Salmonella typhimurium LT2
guacaaacaaauaaauccau

SEQ ID NO: 3806910 - RNA, 22 nt, Salmonella typhimurium LT2
guacaaacacgucuuugcugcc

SEQ ID NO: 3806911 - RNA, 12 nt, Salmonella typhimurium LT2
guacaaacgcac

SEQ ID NO: 3806912 - RNA, 23 nt, Salmonella typhimurium LT2
guacaaauguaguaccaggcaga

SEQ ID NO: 3806913 - RNA, 19 nt, Salmonella typhimurium LT2
guacaagggccgccgccau

SEQ ID NO: 3806914 - RNA, 17 nt, Salmonella typhimurium LT2
guacaaucgcguuuucc

SEQ ID NO: 3806915 - RNA, 23 nt, Salmonella typhimurium LT2
guacaaugcaaagaaaaacagga

SEQ ID NO: 3806916 - RNA, 22 nt, Salmonella typhimurium LT2
guacacaaucgcauaaccggcg

SEQ ID NO: 3806917 - RNA, 18 nt, Salmonella typhimurium LT2
guacacaauugccauggu

SEQ ID NO: 3806918 - RNA, 19 nt, Salmonella typhimurium LT2
guacaccugcaacuccugg

SEQ ID NO: 3806919 - RNA, 15 nt, Salmonella typhimurium LT2
guacacgaaauagcg

SEQ ID NO: 3806920 - RNA, 14 nt, Salmonella typhimurium LT2
guacacgcaucggg

SEQ ID NO: 3806921 - RNA, 12 nt, Salmonella typhimurium LT2
guacagaugcug

SEQ ID NO: 3806922 - RNA, 17 nt, Salmonella typhimurium LT2
guacagcaauaaaagga

SEQ ID NO: 3806923 - RNA, 17 nt, Salmonella typhimurium LT2
guacagccgggcauaug

SEQ ID NO: 3806924 - RNA, 20 nt, Salmonella typhimurium LT2
guacagcuugcuggccgcgu

SEQ ID NO: 3806925 - RNA, 16 nt, Salmonella typhimurium LT2
guacaggccgccgccu

SEQ ID NO: 3806926 - RNA, 16 nt, Salmonella typhimurium LT2
guacauaacagcagca

SEQ ID NO: 3806927 - RNA, 14 nt, Salmonella typhimurium LT2
guacauaacaucuc

SEQ ID NO: 3806928 - RNA, 23 nt, Salmonella typhimurium LT2
guacauauccaguugaccguuag

SEQ ID NO: 3806929 - RNA, 21 nt, Salmonella typhimurium LT2
guacaucaaaucagacgcuuc

SEQ ID NO: 3806930 - RNA, 16 nt, Salmonella typhimurium LT2
guacaucgcgcugacc

SEQ ID NO: 3806931 - RNA, 14 nt, Salmonella typhimurium LT2
guacauguccagau

SEQ ID NO: 3806932 - RNA, 12 nt, Salmonella typhimurium LT2
guaccaaacagc

SEQ ID NO: 3806933 - RNA, 12 nt, Salmonella typhimurium LT2
guaccaacugcu

SEQ ID NO: 3806934 - RNA, 14 nt, Salmonella typhimurium LT2
guaccaauacccag

SEQ ID NO: 3806935 - RNA, 15 nt, Salmonella typhimurium LT2
guaccaauacccagc

SEQ ID NO: 3806936 - RNA, 16 nt, Salmonella typhimurium LT2
guaccaauacccagcg

SEQ ID NO: 3806937 - RNA, 18 nt, Salmonella typhimurium LT2
guaccacgccgcacacag

SEQ ID NO: 3806938 - RNA, 20 nt, Salmonella typhimurium LT2
guaccagaacucguugccag

SEQ ID NO: 3806939 - RNA, 17 nt, Salmonella typhimurium LT2
guaccagcaacgccagc

SEQ ID NO: 3806940 - RNA, 16 nt, Salmonella typhimurium LT2
guaccagcgcccgagc

SEQ ID NO: 3806941 - RNA, 14 nt, Salmonella typhimurium LT2
guaccagcgcgaac

SEQ ID NO: 3806942 - RNA, 17 nt, Salmonella typhimurium LT2
guaccauaccggugcgc

SEQ ID NO: 3806943 - RNA, 22 nt, Salmonella typhimurium LT2
guaccauaccggugcgccccag

SEQ ID NO: 3806944 - RNA, 17 nt, Salmonella typhimurium LT2
guaccauugagcucucu

SEQ ID NO: 3806945 - RNA, 16 nt, Salmonella typhimurium LT2
guaccauugcccauuc

SEQ ID NO: 3806946 - RNA, 14 nt, Salmonella typhimurium LT2
guaccgaacagcca

SEQ ID NO: 3806947 - RNA, 18 nt, Salmonella typhimurium LT2
guaccgaacagccaggcu

SEQ ID NO: 3806948 - RNA, 20 nt, Salmonella typhimurium LT2
guaccgacgccauuccccag

SEQ ID NO: 3806949 - RNA, 23 nt, Salmonella typhimurium LT2
guaccgauuguuuggugcugaaa

SEQ ID NO: 3806950 - RNA, 16 nt, Salmonella typhimurium LT2
guaccgccgccgggcc

SEQ ID NO: 3806951 - RNA, 17 nt, Salmonella typhimurium LT2
guaccgcuacgcaggcc

SEQ ID NO: 3806952 - RNA, 15 nt, Salmonella typhimurium LT2
guaccggauuuagcg

SEQ ID NO: 3806953 - RNA, 12 nt, Salmonella typhimurium LT2
guaccggcaggu

SEQ ID NO: 3806954 - RNA, 17 nt, Salmonella typhimurium LT2
guaccggcgcucagcca

SEQ ID NO: 3806955 - RNA, 20 nt, Salmonella typhimurium LT2
guaccgucacuucuucgcga

SEQ ID NO: 3806956 - RNA, 17 nt, Salmonella typhimurium LT2
guaccgucuggcgaggc

SEQ ID NO: 3806957 - RNA, 16 nt, Salmonella typhimurium LT2
guaccguugccgccga

SEQ ID NO: 3806958 - RNA, 19 nt, Salmonella typhimurium LT2
guaccguuuuccagaccga

SEQ ID NO: 3806959 - RNA, 15 nt, Salmonella typhimurium LT2
guaccucgcauacuu

SEQ ID NO: 3806960 - RNA, 20 nt, Salmonella typhimurium LT2
guaccugcggcaauggcuca

SEQ ID NO: 3806961 - RNA, 16 nt, Salmonella typhimurium LT2
guaccugcguuaaacg

SEQ ID NO: 3806962 - RNA, 15 nt, Salmonella typhimurium LT2
guacgcaagcguaag

SEQ ID NO: 3806963 - RNA, 17 nt, Salmonella typhimurium LT2
guacgcaggcggcuggc

SEQ ID NO: 3806964 - RNA, 22 nt, Salmonella typhimurium LT2
guacgccaaaucuguucugucc

SEQ ID NO: 3806965 - RNA, 21 nt, Salmonella typhimurium LT2
guacgcccgugacgccaggca

SEQ ID NO: 3806966 - RNA, 22 nt, Salmonella typhimurium LT2
guacgcgcgucguauaugccaa

SEQ ID NO: 3806967 - RNA, 20 nt, Salmonella typhimurium LT2
guacgcgucugaaugacgcc

SEQ ID NO: 3806968 - RNA, 22 nt, Salmonella typhimurium LT2
guacggauagccauuucugccu

SEQ ID NO: 3806969 - RNA, 20 nt, Salmonella typhimurium LT2
guacggaugggguaucgcca

SEQ ID NO: 3806970 - RNA, 18 nt, Salmonella typhimurium LT2
guacggccaccaggccug

SEQ ID NO: 3806971 - RNA, 23 nt, Salmonella typhimurium LT2
guacggcuuucuuucuccagcgu

SEQ ID NO: 3806972 - RNA, 14 nt, Salmonella typhimurium LT2
guauccgccaccau

SEQ ID NO: 3806973 - RNA, 19 nt, Salmonella typhimurium LT2
guauccggccugcagggaa

SEQ ID NO: 3806974 - RNA, 15 nt, Salmonella typhimurium LT2
guauccguacuuucu

SEQ ID NO: 3806975 - RNA, 14 nt, Salmonella typhimurium LT2
guauccuuccagcc

SEQ ID NO: 3806976 - RNA, 15 nt, Salmonella typhimurium LT2
guaucgacgcagaca

SEQ ID NO: 3806977 - RNA, 17 nt, Salmonella typhimurium LT2
guaucgauacagacgcc

SEQ ID NO: 3806978 - RNA, 22 nt, Salmonella typhimurium LT2
guaucugguggaaaagaaaaca

SEQ ID NO: 3806979 - RNA, 22 nt, Salmonella typhimurium LT2
guaucugucacuuaaguaaaga

SEQ ID NO: 3806980 - RNA, 21 nt, Salmonella typhimurium LT2
guaugacaaauaaaauaagca

SEQ ID NO: 3806981 - RNA, 18 nt, Salmonella typhimurium LT2
guaugacgcacacggcgu

SEQ ID NO: 3806982 - RNA, 23 nt, Salmonella typhimurium LT2
guaugacgcuugagcgccuuauc

SEQ ID NO: 3806983 - RNA, 14 nt, Salmonella typhimurium LT2
guaugcagccaggc

SEQ ID NO: 3806984 - RNA, 13 nt, Salmonella typhimurium LT2
guaugccuuccag

SEQ ID NO: 3806985 - RNA, 16 nt, Salmonella typhimurium LT2
guaugcgcaaaucaaa

SEQ ID NO: 3806986 - RNA, 21 nt, Salmonella typhimurium LT2
guaugcggggguguugcaaua

SEQ ID NO: 3806987 - RNA, 16 nt, Salmonella typhimurium LT2
guaugcggucaaaagc

SEQ ID NO: 3806988 - RNA, 16 nt, Salmonella typhimurium LT2
guauguauugcauuuu

SEQ ID NO: 3806989 - RNA, 23 nt, Salmonella typhimurium LT2
guauguauuuuauccaggagagc

SEQ ID NO: 3806990 - RNA, 17 nt, Salmonella typhimurium LT2
guauguuaacgccgauu

SEQ ID NO: 3806991 - RNA, 17 nt, Salmonella typhimurium LT2
guauuaacgcuuugcca

SEQ ID NO: 3806992 - RNA, 20 nt, Salmonella typhimurium LT2
guauuaagccuuuuuaaaua

SEQ ID NO: 3806993 - RNA, 22 nt, Salmonella typhimurium LT2
guauuaagccuuuuuaaauauu

SEQ ID NO: 3806994 - RNA, 21 nt, Salmonella typhimurium LT2
guauuacacuacuucuucagu

SEQ ID NO: 3806995 - RNA, 12 nt, Salmonella typhimurium LT2
guauuaccaaua

SEQ ID NO: 3806996 - RNA, 16 nt, Salmonella typhimurium LT2
guauuaucaaugguua

SEQ ID NO: 3806997 - RNA, 15 nt, Salmonella typhimurium LT2
guauuccaucaaaag

SEQ ID NO: 3806998 - RNA, 13 nt, Salmonella typhimurium LT2
guauucuaacuga

SEQ ID NO: 3806999 - RNA, 20 nt, Salmonella typhimurium LT2
guauucugcgccagccagcu

SEQ ID NO: 3807000 - RNA, 15 nt, Salmonella typhimurium LT2
guauugacaacaaau

SEQ ID NO: 3807001 - RNA, 19 nt, Salmonella typhimurium LT2
guauugacaacaaauccaa

SEQ ID NO: 3807002 - RNA, 16 nt, Salmonella typhimurium LT2
guauugacgccgacau

SEQ ID NO: 3807003 - RNA, 14 nt, Salmonella typhimurium LT2
guauugagcagcgg

SEQ ID NO: 3807004 - RNA, 17 nt, Salmonella typhimurium LT2
guauugagcgaaacagg

SEQ ID NO: 3807005 - RNA, 14 nt, Salmonella typhimurium LT2
guauugguauuuug

SEQ ID NO: 3807006 - RNA, 13 nt, Salmonella typhimurium LT2
guauuuauccagc

SEQ ID NO: 3807007 - RNA, 17 nt, Salmonella typhimurium LT2
guauuucacuuuugccg

SEQ ID NO: 3807008 - RNA, 19 nt, Salmonella typhimurium LT2
guauuucccuucccagccc

SEQ ID NO: 3807009 - RNA, 17 nt, Salmonella typhimurium LT2
guauuucugaaaaaccg

SEQ ID NO: 3807010 - RNA, 11 nt, Salmonella typhimurium LT2
guauuuucuau

SEQ ID NO: 3807011 - RNA, 16 nt, Salmonella typhimurium LT2
guauuuucuaucgcau

SEQ ID NO: 3807012 - RNA, 21 nt, Salmonella typhimurium LT2
guauuuuuuuacacaauucug

SEQ ID NO: 3807013 - RNA, 13 nt, Salmonella typhimurium LT2
gucaaaaaaggac

SEQ ID NO: 3807014 - RNA, 20 nt, Salmonella typhimurium LT2
gucaaaaccaaacagcgaca

SEQ ID NO: 3807015 - RNA, 14 nt, Salmonella typhimurium LT2
gucaaaacgcccau

SEQ ID NO: 3807016 - RNA, 14 nt, Salmonella typhimurium LT2
gucaaaacuuauuu

SEQ ID NO: 3807017 - RNA, 12 nt, Salmonella typhimurium LT2
gucaaaagcugc

SEQ ID NO: 3807018 - RNA, 13 nt, Salmonella typhimurium LT2
gucaaaaugauca

SEQ ID NO: 3807019 - RNA, 23 nt, Salmonella typhimurium LT2
gucaaaauuaaucgccagcagcg

SEQ ID NO: 3807020 - RNA, 17 nt, Salmonella typhimurium LT2
gucaaacacgaccagcg

SEQ ID NO: 3807021 - RNA, 19 nt, Salmonella typhimurium LT2
gucaaacaguucagacacc

SEQ ID NO: 3807022 - RNA, 16 nt, Salmonella typhimurium LT2
gucaaacuuuuauaaa

SEQ ID NO: 3807023 - RNA, 18 nt, Salmonella typhimurium LT2
gucaaauccaccgccagc

SEQ ID NO: 3807024 - RNA, 17 nt, Salmonella typhimurium LT2
gucaacacgcagaccca

SEQ ID NO: 3807025 - RNA, 22 nt, Salmonella typhimurium LT2
gucaacauagcuauauuuagcc

SEQ ID NO: 3807026 - RNA, 22 nt, Salmonella typhimurium LT2
gucaacccuauugccacaauau

SEQ ID NO: 3807027 - RNA, 16 nt, Salmonella typhimurium LT2
gucaacgccaagcgcg

SEQ ID NO: 3807028 - RNA, 21 nt, Salmonella typhimurium LT2
gucaacguccaguucguucug

SEQ ID NO: 3807029 - RNA, 22 nt, Salmonella typhimurium LT2
gucaacguccaguucguucugc

SEQ ID NO: 3807030 - RNA, 17 nt, Salmonella typhimurium LT2
gucaacugcucuaccaa

SEQ ID NO: 3807031 - RNA, 14 nt, Salmonella typhimurium LT2
gucaagguggugcu

SEQ ID NO: 3807032 - RNA, 22 nt, Salmonella typhimurium LT2
gucaauaaccgccgauuuaucg

SEQ ID NO: 3807033 - RNA, 14 nt, Salmonella typhimurium LT2
gucaauaucgacgg

SEQ ID NO: 3807034 - RNA, 16 nt, Salmonella typhimurium LT2
gucaauauuaaugcug

SEQ ID NO: 3807035 - RNA, 23 nt, Salmonella typhimurium LT2
gucaaugacuuuuuugccaauau

SEQ ID NO: 3807036 - RNA, 16 nt, Salmonella typhimurium LT2
gucaaugaucagcuug

SEQ ID NO: 3807037 - RNA, 17 nt, Salmonella typhimurium LT2
gucaaugccgggcagac

SEQ ID NO: 3807038 - RNA, 14 nt, Salmonella typhimurium LT2
gucaauuuccucga

SEQ ID NO: 3807039 - RNA, 18 nt, Salmonella typhimurium LT2
gucacaaagcccaccgcg

SEQ ID NO: 3807040 - RNA, 12 nt, Salmonella typhimurium LT2
gucacaacagcc

SEQ ID NO: 3807041 - RNA, 15 nt, Salmonella typhimurium LT2
gucacagaauacccu

SEQ ID NO: 3807042 - RNA, 20 nt, Salmonella typhimurium LT2
gucacagguucgaaucccgu

SEQ ID NO: 3807043 - RNA, 15 nt, Salmonella typhimurium LT2
gucacauacuucugu

SEQ ID NO: 3807044 - RNA, 14 nt, Salmonella typhimurium LT2
gucacauccagaca

SEQ ID NO: 3807045 - RNA, 13 nt, Salmonella typhimurium LT2
gucaccagcagca

SEQ ID NO: 3807046 - RNA, 16 nt, Salmonella typhimurium LT2
gucaccagcagcacaa

SEQ ID NO: 3807047 - RNA, 23 nt, Salmonella typhimurium LT2
gucaccauuaacaucagaaaaaa

SEQ ID NO: 3807048 - RNA, 16 nt, Salmonella typhimurium LT2
gucaccgccagugcau

SEQ ID NO: 3807049 - RNA, 22 nt, Salmonella typhimurium LT2
gucaccggaauggucgcgccag

SEQ ID NO: 3807050 - RNA, 13 nt, Salmonella typhimurium LT2
gucacgaaguucc

SEQ ID NO: 3807051 - RNA, 19 nt, Salmonella typhimurium LT2
gucacgacggcgaccagca

SEQ ID NO: 3807052 - RNA, 22 nt, Salmonella typhimurium LT2
gucacgacggcgaccagcaaaa

SEQ ID NO: 3807053 - RNA, 18 nt, Salmonella typhimurium LT2
gucacgauguucaacguc

SEQ ID NO: 3807054 - RNA, 15 nt, Salmonella typhimurium LT2
gucacgcaggggguc

SEQ ID NO: 3807055 - RNA, 14 nt, Salmonella typhimurium LT2
gucacggaucuucu

SEQ ID NO: 3807056 - RNA, 19 nt, Salmonella typhimurium LT2
gucacgguuuauccccgcu

SEQ ID NO: 3807057 - RNA, 14 nt, Salmonella typhimurium LT2
gucacuaacuccag

SEQ ID NO: 3807058 - RNA, 17 nt, Salmonella typhimurium LT2
gucacuaacuccagcau

SEQ ID NO: 3807059 - RNA, 21 nt, Salmonella typhimurium LT2
gucacucacauucauugccgc

SEQ ID NO: 3807060 - RNA, 18 nt, Salmonella typhimurium LT2
gucacuccggcugcacca

SEQ ID NO: 3807061 - RNA, 13 nt, Salmonella typhimurium LT2
gucacuggcggcg

SEQ ID NO: 3807062 - RNA, 15 nt, Salmonella typhimurium LT2
gucacugucagcauc

SEQ ID NO: 3807063 - RNA, 16 nt, Salmonella typhimurium LT2
gucacugucagcauca

SEQ ID NO: 3807064 - RNA, 23 nt, Salmonella typhimurium LT2
gucacuucaaccuuuaucuguug

SEQ ID NO: 3807065 - RNA, 18 nt, Salmonella typhimurium LT2
gucagacaccagcccugg

SEQ ID NO: 3807066 - RNA, 17 nt, Salmonella typhimurium LT2
gucagaccggcaaucaa

SEQ ID NO: 3807067 - RNA, 17 nt, Salmonella typhimurium LT2
gucagauccuucauuca

SEQ ID NO: 3807068 - RNA, 22 nt, Salmonella typhimurium LT2
gucagauuuucauuuagcgccu

SEQ ID NO: 3807069 - RNA, 15 nt, Salmonella typhimurium LT2
gucagcaccaguaca

SEQ ID NO: 3807070 - RNA, 16 nt, Salmonella typhimurium LT2
gucagcauuucaucca

SEQ ID NO: 3807071 - RNA, 16 nt, Salmonella typhimurium LT2
gucagcggagaguuga

SEQ ID NO: 3807072 - RNA, 21 nt, Salmonella typhimurium LT2
gucagcgggguucggaccaga

SEQ ID NO: 3807073 - RNA, 17 nt, Salmonella typhimurium LT2
gucagcgucaucggcuc

SEQ ID NO: 3807074 - RNA, 17 nt, Salmonella typhimurium LT2
gucagcgucgcuaccag

SEQ ID NO: 3807075 - RNA, 13 nt, Salmonella typhimurium LT2
gucagcuuccugu

SEQ ID NO: 3807076 - RNA, 15 nt, Salmonella typhimurium LT2
gucccugauguaguu

SEQ ID NO: 3807077 - RNA, 17 nt, Salmonella typhimurium LT2
gucccuuccgccaccag

SEQ ID NO: 3807078 - RNA, 18 nt, Salmonella typhimurium LT2
guccgaauaacucugcuc

SEQ ID NO: 3807079 - RNA, 20 nt, Salmonella typhimurium LT2
guccgaauaacucugcucuu

SEQ ID NO: 3807080 - RNA, 18 nt, Salmonella typhimurium LT2
guccgauagcauuauugc

SEQ ID NO: 3807081 - RNA, 15 nt, Salmonella typhimurium LT2
guccgcacgccugca

SEQ ID NO: 3807082 - RNA, 12 nt, Salmonella typhimurium LT2
guccgccagcgu

SEQ ID NO: 3807083 - RNA, 17 nt, Salmonella typhimurium LT2
guccgccuaccagcaca

SEQ ID NO: 3807084 - RNA, 18 nt, Salmonella typhimurium LT2
guccgcuggcguccagcc

SEQ ID NO: 3807085 - RNA, 15 nt, Salmonella typhimurium LT2
guccggaagacagcu

SEQ ID NO: 3807086 - RNA, 20 nt, Salmonella typhimurium LT2
guccggcauccaaccgaaca

SEQ ID NO: 3807087 - RNA, 20 nt, Salmonella typhimurium LT2
guccggcaucgugauaaacg

SEQ ID NO: 3807088 - RNA, 19 nt, Salmonella typhimurium LT2
guccggcgaauuucaucag

SEQ ID NO: 3807089 - RNA, 17 nt, Salmonella typhimurium LT2
guccggcgcuaaccagc

SEQ ID NO: 3807090 - RNA, 14 nt, Salmonella typhimurium LT2
guccggcggcagcc

SEQ ID NO: 3807091 - RNA, 15 nt, Salmonella typhimurium LT2
guccggcugaagcgg

SEQ ID NO: 3807092 - RNA, 13 nt, Salmonella typhimurium LT2
guccggggccagc

SEQ ID NO: 3807093 - RNA, 15 nt, Salmonella typhimurium LT2
guccgguaucggcaa

SEQ ID NO: 3807094 - RNA, 14 nt, Salmonella typhimurium LT2
guccgguguccauc

SEQ ID NO: 3807095 - RNA, 14 nt, Salmonella typhimurium LT2
guccguggcacggu

SEQ ID NO: 3807096 - RNA, 20 nt, Salmonella typhimurium LT2
guccguuaccccuuuuucaa

SEQ ID NO: 3807097 - RNA, 20 nt, Salmonella typhimurium LT2
guccguuuucaacgccgcgc

SEQ ID NO: 3807098 - RNA, 21 nt, Salmonella typhimurium LT2
guccucacacugauggcagac

SEQ ID NO: 3807099 - RNA, 18 nt, Salmonella typhimurium LT2
guccuccggcugaagccc

SEQ ID NO: 3807100 - RNA, 19 nt, Salmonella typhimurium LT2
guccuccggcugaagcccc

SEQ ID NO: 3807101 - RNA, 22 nt, Salmonella typhimurium LT2
guccucuauuuuuuuauauucg

SEQ ID NO: 3807102 - RNA, 13 nt, Salmonella typhimurium LT2
guccucuggcccg

SEQ ID NO: 3807103 - RNA, 14 nt, Salmonella typhimurium LT2
guccugaauuucac

SEQ ID NO: 3807104 - RNA, 23 nt, Salmonella typhimurium LT2
guccugauagccguaaauaauca

SEQ ID NO: 3807105 - RNA, 14 nt, Salmonella typhimurium LT2
guccugauccggcu

SEQ ID NO: 3807106 - RNA, 16 nt, Salmonella typhimurium LT2
guccugccccugccag

SEQ ID NO: 3807107 - RNA, 22 nt, Salmonella typhimurium LT2
guccuggaaagaaggcuugguu

SEQ ID NO: 3807108 - RNA, 15 nt, Salmonella typhimurium LT2
guccugggcugccag

SEQ ID NO: 3807109 - RNA, 19 nt, Salmonella typhimurium LT2
guccugggcugccagggca

SEQ ID NO: 3807110 - RNA, 17 nt, Salmonella typhimurium LT2
guccuguaacaacuguu

SEQ ID NO: 3807111 - RNA, 19 nt, Salmonella typhimurium LT2
guccuuacggacguggggg

SEQ ID NO: 3807112 - RNA, 17 nt, Salmonella typhimurium LT2
guccuugcgaagaccgc

SEQ ID NO: 3807113 - RNA, 14 nt, Salmonella typhimurium LT2
gucgaacgguaaca

SEQ ID NO: 3807114 - RNA, 22 nt, Salmonella typhimurium LT2
gucgaacugaauggucggcugc

SEQ ID NO: 3807115 - RNA, 20 nt, Salmonella typhimurium LT2
gucgaacuuacggcgcgcca

SEQ ID NO: 3807116 - RNA, 14 nt, Salmonella typhimurium LT2
gucgaagcuuuuca

SEQ ID NO: 3807117 - RNA, 18 nt, Salmonella typhimurium LT2
gucgacaaagccgcagcg

SEQ ID NO: 3807118 - RNA, 17 nt, Salmonella typhimurium LT2
gucgacagcccgccagc

SEQ ID NO: 3807119 - RNA, 14 nt, Salmonella typhimurium LT2
gucgaccauacgca

SEQ ID NO: 3807120 - RNA, 17 nt, Salmonella typhimurium LT2
gucgaccgguccacuug

SEQ ID NO: 3807121 - RNA, 19 nt, Salmonella typhimurium LT2
gucgacguugccaggcgac

SEQ ID NO: 3807122 - RNA, 15 nt, Salmonella typhimurium LT2
gucgacugguaggcc

SEQ ID NO: 3807123 - RNA, 18 nt, Salmonella typhimurium LT2
gucgacugguaggccuga

SEQ ID NO: 3807124 - RNA, 19 nt, Salmonella typhimurium LT2
gucgagaaaccgcucgccg

SEQ ID NO: 3807125 - RNA, 21 nt, Salmonella typhimurium LT2
gucgagaaaccgcucgccgcc

SEQ ID NO: 3807126 - RNA, 14 nt, Salmonella typhimurium LT2
gucgagcagcagga

SEQ ID NO: 3807127 - RNA, 15 nt, Salmonella typhimurium LT2
gucgagcgcggaggg

SEQ ID NO: 3807128 - RNA, 18 nt, Salmonella typhimurium LT2
gucgagcucaguccagcc

SEQ ID NO: 3807129 - RNA, 16 nt, Salmonella typhimurium LT2
gucgaggaucaucucc

SEQ ID NO: 3807130 - RNA, 15 nt, Salmonella typhimurium LT2
gucgagguuauaaac

SEQ ID NO: 3807131 - RNA, 17 nt, Salmonella typhimurium LT2
gucgauaaaauccucua

SEQ ID NO: 3807132 - RNA, 16 nt, Salmonella typhimurium LT2
gucgauaaaucgccac

SEQ ID NO: 3807133 - RNA, 22 nt, Salmonella typhimurium LT2
gucgauaauauccagcacgccu

SEQ ID NO: 3807134 - RNA, 20 nt, Salmonella typhimurium LT2
gucgauaaucauacagcgca

SEQ ID NO: 3807135 - RNA, 15 nt, Salmonella typhimurium LT2
gucgaucucggccac

SEQ ID NO: 3807136 - RNA, 20 nt, Salmonella typhimurium LT2
gucgaugugaauccaggcca

SEQ ID NO: 3807137 - RNA, 17 nt, Salmonella typhimurium LT2
gucgauuucgcaggccc

SEQ ID NO: 3807138 - RNA, 18 nt, Salmonella typhimurium LT2
gucgcaaucuggcgcaau

SEQ ID NO: 3807139 - RNA, 21 nt, Salmonella typhimurium LT2
gucgcacuucgcguuagccgg

SEQ ID NO: 3807140 - RNA, 20 nt, Salmonella typhimurium LT2
gucgcagcggcggucugcgc

SEQ ID NO: 3807141 - RNA, 23 nt, Salmonella typhimurium LT2
gucgcagcggcggucugcgccug

SEQ ID NO: 3807142 - RNA, 15 nt, Salmonella typhimurium LT2
gucgcagcggcugcg

SEQ ID NO: 3807143 - RNA, 13 nt, Salmonella typhimurium LT2
gucgcauccggcu

SEQ ID NO: 3807144 - RNA, 19 nt, Salmonella typhimurium LT2
gucgccaccaugcugguug

SEQ ID NO: 3807145 - RNA, 13 nt, Salmonella typhimurium LT2
gucgccaccugcg

SEQ ID NO: 3807146 - RNA, 17 nt, Salmonella typhimurium LT2
gucgccaccugcguggu

SEQ ID NO: 3807147 - RNA, 15 nt, Salmonella typhimurium LT2
gucgccagcgccgga

SEQ ID NO: 3807148 - RNA, 12 nt, Salmonella typhimurium LT2
gucgccaggcaa

SEQ ID NO: 3807149 - RNA, 21 nt, Salmonella typhimurium LT2
gucgccauauccaagccccuc

SEQ ID NO: 3807150 - RNA, 12 nt, Salmonella typhimurium LT2
gucgccaucagg

SEQ ID NO: 3807151 - RNA, 21 nt, Salmonella typhimurium LT2
gucgccaucaggcgauggcgc

SEQ ID NO: 3807152 - RNA, 14 nt, Salmonella typhimurium LT2
gucgccauccggcg

SEQ ID NO: 3807153 - RNA, 13 nt, Salmonella typhimurium LT2
gucgccauccuga

SEQ ID NO: 3807154 - RNA, 23 nt, Salmonella typhimurium LT2
gucgccaugaccugggcgccaga

SEQ ID NO: 3807155 - RNA, 17 nt, Salmonella typhimurium LT2
gucgccccaaucgccag

SEQ ID NO: 3807156 - RNA, 13 nt, Salmonella typhimurium LT2
gucgcccguccgc

SEQ ID NO: 3807157 - RNA, 15 nt, Salmonella typhimurium LT2
gucgccgcccaucgg

SEQ ID NO: 3807158 - RNA, 22 nt, Salmonella typhimurium LT2
gucgccgcgcccagcagcagaa

SEQ ID NO: 3807159 - RNA, 12 nt, Salmonella typhimurium LT2
gucgccggccug

SEQ ID NO: 3807160 - RNA, 16 nt, Salmonella typhimurium LT2
gucgccggggcgcugg

SEQ ID NO: 3807161 - RNA, 18 nt, Salmonella typhimurium LT2
gucgccggggcgcuggcg

SEQ ID NO: 3807162 - RNA, 16 nt, Salmonella typhimurium LT2
gucgccugcugcugga

SEQ ID NO: 3807163 - RNA, 18 nt, Salmonella typhimurium LT2
gucgccuuccugcaggcg

SEQ ID NO: 3807164 - RNA, 10 nt, Salmonella typhimurium LT2
gucgccuucg

SEQ ID NO: 3807165 - RNA, 16 nt, Salmonella typhimurium LT2
gucgcgacguccgcca

SEQ ID NO: 3807166 - RNA, 23 nt, Salmonella typhimurium LT2
gucgcgauaucugaacgcgggcg

SEQ ID NO: 3807167 - RNA, 15 nt, Salmonella typhimurium LT2
gucgcgaucgcgcca

SEQ ID NO: 3807168 - RNA, 16 nt, Salmonella typhimurium LT2
gucgcgaucgcgccag

SEQ ID NO: 3807169 - RNA, 20 nt, Salmonella typhimurium LT2
gucgcgaucgcgccagccuu

SEQ ID NO: 3807170 - RNA, 22 nt, Salmonella typhimurium LT2
gucgcgccaaaagaggcagcaa

SEQ ID NO: 3807171 - RNA, 13 nt, Salmonella typhimurium LT2
gucgcgccagcga

SEQ ID NO: 3807172 - RNA, 16 nt, Salmonella typhimurium LT2
gucgcgcgccgccugc

SEQ ID NO: 3807173 - RNA, 12 nt, Salmonella typhimurium LT2
gucgcgcuuacg

SEQ ID NO: 3807174 - RNA, 15 nt, Salmonella typhimurium LT2
gucgcggaacgcccu

SEQ ID NO: 3807175 - RNA, 15 nt, Salmonella typhimurium LT2
gucgcggcuuucagc

SEQ ID NO: 3807176 - RNA, 21 nt, Salmonella typhimurium LT2
gucgcgggcgcuaaaccggcg

SEQ ID NO: 3807177 - RNA, 14 nt, Salmonella typhimurium LT2
gucgcguagcgaug

SEQ ID NO: 3807178 - RNA, 21 nt, Salmonella typhimurium LT2
gucgcguaugguucagguauu

SEQ ID NO: 3807179 - RNA, 20 nt, Salmonella typhimurium LT2
gucgcguccggggccagcgc

SEQ ID NO: 3807180 - RNA, 16 nt, Salmonella typhimurium LT2
gugaaccaaagcaaaa

SEQ ID NO: 3807181 - RNA, 18 nt, Salmonella typhimurium LT2
gugaaccaaagcaaaaaa

SEQ ID NO: 3807182 - RNA, 13 nt, Salmonella typhimurium LT2
gugaaccgguaaa

SEQ ID NO: 3807183 - RNA, 14 nt, Salmonella typhimurium LT2
gugaaccgguaaag

SEQ ID NO: 3807184 - RNA, 16 nt, Salmonella typhimurium LT2
gugaaccgucgccucc

SEQ ID NO: 3807185 - RNA, 15 nt, Salmonella typhimurium LT2
gugaaccuccuguga

SEQ ID NO: 3807186 - RNA, 17 nt, Salmonella typhimurium LT2
gugaacgccuccauuuu

SEQ ID NO: 3807187 - RNA, 21 nt, Salmonella typhimurium LT2
gugaagauuauucucgcacuu

SEQ ID NO: 3807188 - RNA, 20 nt, Salmonella typhimurium LT2
gugaagcgacgaauaauccu

SEQ ID NO: 3807189 - RNA, 12 nt, Salmonella typhimurium LT2
gugaaggcaaaa

SEQ ID NO: 3807190 - RNA, 17 nt, Salmonella typhimurium LT2
gugaaggcaaaacacca

SEQ ID NO: 3807191 - RNA, 13 nt, Salmonella typhimurium LT2
gugaauaaauccu

SEQ ID NO: 3807192 - RNA, 18 nt, Salmonella typhimurium LT2
gugaauauauuggcagga

SEQ ID NO: 3807193 - RNA, 19 nt, Salmonella typhimurium LT2
gugaaucgacggcaauauu

SEQ ID NO: 3807194 - RNA, 16 nt, Salmonella typhimurium LT2
gugaauguccccugac

SEQ ID NO: 3807195 - RNA, 20 nt, Salmonella typhimurium LT2
gugaauuaugaccaauguua

SEQ ID NO: 3807196 - RNA, 14 nt, Salmonella typhimurium LT2
gugacacacuugau

SEQ ID NO: 3807197 - RNA, 15 nt, Salmonella typhimurium LT2
gugacagcaacaucu

SEQ ID NO: 3807198 - RNA, 22 nt, Salmonella typhimurium LT2
gugaccaaaccugcgcaucguu

SEQ ID NO: 3807199 - RNA, 14 nt, Salmonella typhimurium LT2
gugaccccggccuc

SEQ ID NO: 3807200 - RNA, 20 nt, Salmonella typhimurium LT2
gugaccccggccucgcccgc

SEQ ID NO: 3807201 - RNA, 13 nt, Salmonella typhimurium LT2
gugaccgccuucg

SEQ ID NO: 3807202 - RNA, 12 nt, Salmonella typhimurium LT2
gugaccugcuga

SEQ ID NO: 3807203 - RNA, 23 nt, Salmonella typhimurium LT2
gugacgucaagaucgcgcagcag

SEQ ID NO: 3807204 - RNA, 17 nt, Salmonella typhimurium LT2
gugacgucauacggagu

SEQ ID NO: 3807205 - RNA, 15 nt, Salmonella typhimurium LT2
gugacguucaucauu

SEQ ID NO: 3807206 - RNA, 18 nt, Salmonella typhimurium LT2
gugacuaauagccaaaag

SEQ ID NO: 3807207 - RNA, 13 nt, Salmonella typhimurium LT2
gugacuucgcagc

SEQ ID NO: 3807208 - RNA, 15 nt, Salmonella typhimurium LT2
gugagcccuccucca

SEQ ID NO: 3807209 - RNA, 23 nt, Salmonella typhimurium LT2
gugagcccuccuccagcgcgucc

SEQ ID NO: 3807210 - RNA, 14 nt, Salmonella typhimurium LT2
gugagcucuuucug

SEQ ID NO: 3807211 - RNA, 21 nt, Salmonella typhimurium LT2
gugagggcaaaguuccagguu

SEQ ID NO: 3807212 - RNA, 18 nt, Salmonella typhimurium LT2
gugaggggggauugacuc

SEQ ID NO: 3807213 - RNA, 14 nt, Salmonella typhimurium LT2
gugaguaaauaaaa

SEQ ID NO: 3807214 - RNA, 19 nt, Salmonella typhimurium LT2
gugaguguuacucuuccuc

SEQ ID NO: 3807215 - RNA, 19 nt, Salmonella typhimurium LT2
gugauaaagcacagcccca

SEQ ID NO: 3807216 - RNA, 11 nt, Salmonella typhimurium LT2
gugauaacgcg

SEQ ID NO: 3807217 - RNA, 17 nt, Salmonella typhimurium LT2
gugauacucugcgcugc

SEQ ID NO: 3807218 - RNA, 12 nt, Salmonella typhimurium LT2
gugauauagcaa

SEQ ID NO: 3807219 - RNA, 14 nt, Salmonella typhimurium LT2
gugauauagcgcca

SEQ ID NO: 3807220 - RNA, 17 nt, Salmonella typhimurium LT2
gugauccaccaccagca

SEQ ID NO: 3807221 - RNA, 13 nt, Salmonella typhimurium LT2
gugauccuccugc

SEQ ID NO: 3807222 - RNA, 23 nt, Salmonella typhimurium LT2
gugaucgaggcgcuggcgagcga

SEQ ID NO: 3807223 - RNA, 18 nt, Salmonella typhimurium LT2
gugaucggagaaauagac

SEQ ID NO: 3807224 - RNA, 13 nt, Salmonella typhimurium LT2
gugaucuccucgc

SEQ ID NO: 3807225 - RNA, 15 nt, Salmonella typhimurium LT2
gugaugacuaaauca

SEQ ID NO: 3807226 - RNA, 14 nt, Salmonella typhimurium LT2
gugaugcaucagaa

SEQ ID NO: 3807227 - RNA, 12 nt, Salmonella typhimurium LT2
gugaugcgccag

SEQ ID NO: 3807228 - RNA, 22 nt, Salmonella typhimurium LT2
gugaugcggacgcugacgccag

SEQ ID NO: 3807229 - RNA, 15 nt, Salmonella typhimurium LT2
gugauggguauuaga

SEQ ID NO: 3807230 - RNA, 16 nt, Salmonella typhimurium LT2
gugauggguauuagaa

SEQ ID NO: 3807231 - RNA, 17 nt, Salmonella typhimurium LT2
gugauggguauuagaau

SEQ ID NO: 3807232 - RNA, 13 nt, Salmonella typhimurium LT2
gugaugugccggu

SEQ ID NO: 3807233 - RNA, 16 nt, Salmonella typhimurium LT2
gugauuaacagcgcca

SEQ ID NO: 3807234 - RNA, 12 nt, Salmonella typhimurium LT2
gugauuacaaaa

SEQ ID NO: 3807235 - RNA, 14 nt, Salmonella typhimurium LT2
gugauugaaguucu

SEQ ID NO: 3807236 - RNA, 18 nt, Salmonella typhimurium LT2
gugcaaacgauaaaagcu

SEQ ID NO: 3807237 - RNA, 14 nt, Salmonella typhimurium LT2
gugcaacagagagc

SEQ ID NO: 3807238 - RNA, 18 nt, Salmonella typhimurium LT2
gugcaacaguugcgucuu

SEQ ID NO: 3807239 - RNA, 15 nt, Salmonella typhimurium LT2
gugcaaccgccugca

SEQ ID NO: 3807240 - RNA, 12 nt, Salmonella typhimurium LT2
gugcaagcaccu

SEQ ID NO: 3807241 - RNA, 17 nt, Salmonella typhimurium LT2
gugcaauauuaauguca

SEQ ID NO: 3807242 - RNA, 21 nt, Salmonella typhimurium LT2
gugcaauccugucgucaccag

SEQ ID NO: 3807243 - RNA, 23 nt, Salmonella typhimurium LT2
gugcaauccugucgucaccagca

SEQ ID NO: 3807244 - RNA, 13 nt, Salmonella typhimurium LT2
gugcacugccuga

SEQ ID NO: 3807245 - RNA, 17 nt, Salmonella typhimurium LT2
gugcagcaagcggcugu

SEQ ID NO: 3807246 - RNA, 20 nt, Salmonella typhimurium LT2
gugcaggauuuguaucacaa

SEQ ID NO: 3807247 - RNA, 20 nt, Salmonella typhimurium LT2
gugcaucaggaaauccugga

SEQ ID NO: 3807248 - RNA, 22 nt, Salmonella typhimurium LT2
gugcaugggauacgccagcaga

SEQ ID NO: 3807249 - RNA, 11 nt, Salmonella typhimurium LT2
gugcauggugu

SEQ ID NO: 3807250 - RNA, 20 nt, Salmonella typhimurium LT2
gugcauucccugaaacaggu

SEQ ID NO: 3807251 - RNA, 12 nt, Salmonella typhimurium LT2
gugccaccagcc

SEQ ID NO: 3807252 - RNA, 17 nt, Salmonella typhimurium LT2
gugccaccagccggagc

SEQ ID NO: 3807253 - RNA, 22 nt, Salmonella typhimurium LT2
gugccacgcuuuuuaccggcga

SEQ ID NO: 3807254 - RNA, 17 nt, Salmonella typhimurium LT2
gugccacuccgccagua

SEQ ID NO: 3807255 - RNA, 22 nt, Salmonella typhimurium LT2
gugccagaaacaagaagcacga

SEQ ID NO: 3807256 - RNA, 13 nt, Salmonella typhimurium LT2
gugccagaaacau

SEQ ID NO: 3807257 - RNA, 17 nt, Salmonella typhimurium LT2
gugccagggcggaagca

SEQ ID NO: 3807258 - RNA, 19 nt, Salmonella typhimurium LT2
gugccaguaacucaucgcc

SEQ ID NO: 3807259 - RNA, 11 nt, Salmonella typhimurium LT2
gugccauauuc

SEQ ID NO: 3807260 - RNA, 14 nt, Salmonella typhimurium LT2
gugccauuccagcc

SEQ ID NO: 3807261 - RNA, 18 nt, Salmonella typhimurium LT2
gugcccgcgguuugacug

SEQ ID NO: 3807262 - RNA, 14 nt, Salmonella typhimurium LT2
gugcccguuuuaca

SEQ ID NO: 3807263 - RNA, 14 nt, Salmonella typhimurium LT2
gugccgauaucaau

SEQ ID NO: 3807264 - RNA, 11 nt, Salmonella typhimurium LT2
gugccgccaga

SEQ ID NO: 3807265 - RNA, 13 nt, Salmonella typhimurium LT2
gugccgccagauc

SEQ ID NO: 3807266 - RNA, 13 nt, Salmonella typhimurium LT2
gugccgcgcuggu

SEQ ID NO: 3807267 - RNA, 23 nt, Salmonella typhimurium LT2
gugccggaaagacggcagcgcca

SEQ ID NO: 3807268 - RNA, 14 nt, Salmonella typhimurium LT2
gugccggauggcgu

SEQ ID NO: 3807269 - RNA, 16 nt, Salmonella typhimurium LT2
gugccggcgauaaccc

SEQ ID NO: 3807270 - RNA, 23 nt, Salmonella typhimurium LT2
gugccgugagcacguaggccaga

SEQ ID NO: 3807271 - RNA, 16 nt, Salmonella typhimurium LT2
gugccguguaaggcaa

SEQ ID NO: 3807272 - RNA, 21 nt, Salmonella typhimurium LT2
gugccguuaaucgauaagcca

SEQ ID NO: 3807273 - RNA, 14 nt, Salmonella typhimurium LT2
gugccugccgcaga

SEQ ID NO: 3807274 - RNA, 22 nt, Salmonella typhimurium LT2
gugccugccgcagaagcgacau

SEQ ID NO: 3807275 - RNA, 14 nt, Salmonella typhimurium LT2
gugccugccgccuc

SEQ ID NO: 3807276 - RNA, 14 nt, Salmonella typhimurium LT2
gugccuuccgcaau

SEQ ID NO: 3807277 - RNA, 13 nt, Salmonella typhimurium LT2
gugcgagaaaaag

SEQ ID NO: 3807278 - RNA, 14 nt, Salmonella typhimurium LT2
gugcgcaagaaaag

SEQ ID NO: 3807279 - RNA, 18 nt, Salmonella typhimurium LT2
gugcgcagccccagcgcc

SEQ ID NO: 3807280 - RNA, 18 nt, Salmonella typhimurium LT2
gugcgccagccuuauccc

SEQ ID NO: 3807281 - RNA, 22 nt, Salmonella typhimurium LT2
gugcgccagccuuaucccaucc

SEQ ID NO: 3807282 - RNA, 21 nt, Salmonella typhimurium LT2
gugcgccccagcaugagccag

SEQ ID NO: 3807283 - RNA, 13 nt, Salmonella typhimurium LT2
gugcgccccaggu

SEQ ID NO: 3807284 - RNA, 15 nt, Salmonella typhimurium LT2
gugcgccgcagcgcc

SEQ ID NO: 3807285 - RNA, 21 nt, Salmonella typhimurium LT2
gugcgccgcgagugcaggauc

SEQ ID NO: 3807286 - RNA, 20 nt, Salmonella typhimurium LT2
gugcgccguccugcaaggca

SEQ ID NO: 3807287 - RNA, 23 nt, Salmonella typhimurium LT2
gugcgcguagcgaugagaaauag

SEQ ID NO: 3807288 - RNA, 17 nt, Salmonella typhimurium LT2
gugcgcugugacaggcg

SEQ ID NO: 3807289 - RNA, 13 nt, Salmonella typhimurium LT2
gugcggcuuaucg

SEQ ID NO: 3807290 - RNA, 18 nt, Salmonella typhimurium LT2
gugcggguucauccgcga

SEQ ID NO: 3807291 - RNA, 18 nt, Salmonella typhimurium LT2
gugcgguauaucacgcca

SEQ ID NO: 3807292 - RNA, 14 nt, Salmonella typhimurium LT2
gugcguccgguaga

SEQ ID NO: 3807293 - RNA, 14 nt, Salmonella typhimurium LT2
gugcguucggauaa

SEQ ID NO: 3807294 - RNA, 13 nt, Salmonella typhimurium LT2
gugcguucuucca

SEQ ID NO: 3807295 - RNA, 17 nt, Salmonella typhimurium LT2
gugcuacgccugccugc

SEQ ID NO: 3807296 - RNA, 22 nt, Salmonella typhimurium LT2
gugcucaaccacgauaaccaga

SEQ ID NO: 3807297 - RNA, 16 nt, Salmonella typhimurium LT2
gugcucagccccuggg

SEQ ID NO: 3807298 - RNA, 22 nt, Salmonella typhimurium LT2
gugcucauccaacugcgccuga

SEQ ID NO: 3807299 - RNA, 14 nt, Salmonella typhimurium LT2
gugcuccguccugu

SEQ ID NO: 3807300 - RNA, 14 nt, Salmonella typhimurium LT2
gugcuggcggccgu

SEQ ID NO: 3807301 - RNA, 23 nt, Salmonella typhimurium LT2
gugcuugcgccgccauccggcaa

SEQ ID NO: 3807302 - RNA, 17 nt, Salmonella typhimurium LT2
gugcuugcguuucuaga

SEQ ID NO: 3807303 - RNA, 20 nt, Salmonella typhimurium LT2
guggaaaacagcauaauaaa

SEQ ID NO: 3807304 - RNA, 17 nt, Salmonella typhimurium LT2
guggaaacuccagcggc

SEQ ID NO: 3807305 - RNA, 19 nt, Salmonella typhimurium LT2
guggaacaacucucccaac

SEQ ID NO: 3807306 - RNA, 15 nt, Salmonella typhimurium LT2
guggagucuaaaaau

SEQ ID NO: 3807307 - RNA, 19 nt, Salmonella typhimurium LT2
guggaucucgucgccggug

SEQ ID NO: 3807308 - RNA, 21 nt, Salmonella typhimurium LT2
guggaucugaaucuugcgcag

SEQ ID NO: 3807309 - RNA, 14 nt, Salmonella typhimurium LT2
guggcaaaauccaa

SEQ ID NO: 3807310 - RNA, 14 nt, Salmonella typhimurium LT2
guggcaaucgacgu

SEQ ID NO: 3807311 - RNA, 14 nt, Salmonella typhimurium LT2
guggcaucuuauca

SEQ ID NO: 3807312 - RNA, 15 nt, Salmonella typhimurium LT2
guggcaucuuaucag

SEQ ID NO: 3807313 - RNA, 22 nt, Salmonella typhimurium LT2
guggcaugaaaauaugaugcua

SEQ ID NO: 3807314 - RNA, 15 nt, Salmonella typhimurium LT2
guggcauuucucgca

SEQ ID NO: 3807315 - RNA, 21 nt, Salmonella typhimurium LT2
guggccagcaugcccgccagc

SEQ ID NO: 3807316 - RNA, 16 nt, Salmonella typhimurium LT2
guggcccagcgcggug

SEQ ID NO: 3807317 - RNA, 18 nt, Salmonella typhimurium LT2
guggcccagcgcgguggc

SEQ ID NO: 3807318 - RNA, 19 nt, Salmonella typhimurium LT2
guggcccgcacugccgagu

SEQ ID NO: 3807319 - RNA, 23 nt, Salmonella typhimurium LT2
guggccgauauggccguuuucau

SEQ ID NO: 3807320 - RNA, 21 nt, Salmonella typhimurium LT2
guggcgaaauugguagacgca

SEQ ID NO: 3807321 - RNA, 22 nt, Salmonella typhimurium LT2
guggcgaacaggcucagcgcca

SEQ ID NO: 3807322 - RNA, 20 nt, Salmonella typhimurium LT2
guggcgacaaaagccagaua

SEQ ID NO: 3807323 - RNA, 22 nt, Salmonella typhimurium LT2
guggcgacgccuauucucgccg

SEQ ID NO: 3807324 - RNA, 21 nt, Salmonella typhimurium LT2
guggcgagccggaagucauua

SEQ ID NO: 3807325 - RNA, 20 nt, Salmonella typhimurium LT2
guggcgcaguuuacgcagcg

SEQ ID NO: 3807326 - RNA, 23 nt, Salmonella typhimurium LT2
guggcgcaguuuacgcagcgccu

SEQ ID NO: 3807327 - RNA, 19 nt, Salmonella typhimurium LT2
guggcgcggacgcuuaccg

SEQ ID NO: 3807328 - RNA, 13 nt, Salmonella typhimurium LT2
guggcgcuccagc

SEQ ID NO: 3807329 - RNA, 16 nt, Salmonella typhimurium LT2
guggcgcuccagccgu

SEQ ID NO: 3807330 - RNA, 19 nt, Salmonella typhimurium LT2
guggcgcugcgcuuaccag

SEQ ID NO: 3807331 - RNA, 23 nt, Salmonella typhimurium LT2
guggcgcugcgcuuaccgggccu

SEQ ID NO: 3807332 - RNA, 14 nt, Salmonella typhimurium LT2
guggcggcaaaaaa

SEQ ID NO: 3807333 - RNA, 15 nt, Salmonella typhimurium LT2
guggcguaaacgcca

SEQ ID NO: 3807334 - RNA, 14 nt, Salmonella typhimurium LT2
guggcgucggcugu

SEQ ID NO: 3807335 - RNA, 16 nt, Salmonella typhimurium LT2
guggcuaacgggcuga

SEQ ID NO: 3807336 - RNA, 17 nt, Salmonella typhimurium LT2
guggcugaagagcgacu

SEQ ID NO: 3807337 - RNA, 21 nt, Salmonella typhimurium LT2
gugggacguuuggcuuauccg

SEQ ID NO: 3807338 - RNA, 20 nt, Salmonella typhimurium LT2
gugggaucgacucauccagc

SEQ ID NO: 3807339 - RNA, 17 nt, Salmonella typhimurium LT2
gugggcgugucgccggg

SEQ ID NO: 3807340 - RNA, 18 nt, Salmonella typhimurium LT2
guggggauaucuucgaug

SEQ ID NO: 3807341 - RNA, 13 nt, Salmonella typhimurium LT2
guggguuccagcg

SEQ ID NO: 3807342 - RNA, 22 nt, Salmonella typhimurium LT2
gugguaaagaagccgccgccau

SEQ ID NO: 3807343 - RNA, 20 nt, Salmonella typhimurium LT2
gugguagugauucuuuucaa

SEQ ID NO: 3807344 - RNA, 21 nt, Salmonella typhimurium LT2
gugguaucucgucgccagggc

SEQ ID NO: 3807345 - RNA, 22 nt, Salmonella typhimurium LT2
guggucauauugucgcgcccgu

SEQ ID NO: 3807346 - RNA, 14 nt, Salmonella typhimurium LT2
guggucgcggcuca

SEQ ID NO: 3807347 - RNA, 21 nt, Salmonella typhimurium LT2
guggucgcggcucaccagcug

SEQ ID NO: 3807348 - RNA, 15 nt, Salmonella typhimurium LT2
guggugaauaucgag

SEQ ID NO: 3807349 - RNA, 23 nt, Salmonella typhimurium LT2
guggugcaagcaccuuauccggc

SEQ ID NO: 3807350 - RNA, 20 nt, Salmonella typhimurium LT2
gugguggauauccagcauaa

SEQ ID NO: 3807351 - RNA, 24 nt, Salmonella typhimurium LT2
gugguguuaacgaaguauucgaug

SEQ ID NO: 3807352 - RNA, 15 nt, Salmonella typhimurium LT2
gugguucuggcggcg

SEQ ID NO: 3807353 - RNA, 16 nt, Salmonella typhimurium LT2
gugguuuccggcagcu

SEQ ID NO: 3807354 - RNA, 14 nt, Salmonella typhimurium LT2
guguaaaagccagc

SEQ ID NO: 3807355 - RNA, 16 nt, Salmonella typhimurium LT2
guguaaaagccagcaa

SEQ ID NO: 3807356 - RNA, 12 nt, Salmonella typhimurium LT2
guguaaaugacg

SEQ ID NO: 3807357 - RNA, 21 nt, Salmonella typhimurium LT2
guguacacaauugccaugguu

SEQ ID NO: 3807358 - RNA, 12 nt, Salmonella typhimurium LT2
guguacauccag

SEQ ID NO: 3807359 - RNA, 21 nt, Salmonella typhimurium LT2
guguagcgagccaucggcaaa

SEQ ID NO: 3807360 - RNA, 17 nt, Salmonella typhimurium LT2
guguauccauagucagc

SEQ ID NO: 3807361 - RNA, 13 nt, Salmonella typhimurium LT2
gugucaaagcgcc

SEQ ID NO: 3807362 - RNA, 19 nt, Salmonella typhimurium LT2
gugucaaauuguacuuuuu

SEQ ID NO: 3807363 - RNA, 20 nt, Salmonella typhimurium LT2
gugucagacaccgggcuauu

SEQ ID NO: 3807364 - RNA, 20 nt, Salmonella typhimurium LT2
gugucauagucggcgccaaa

SEQ ID NO: 3807365 - RNA, 23 nt, Salmonella typhimurium LT2
gugucaucaaauuaucuguugau

SEQ ID NO: 3807366 - RNA, 21 nt, Salmonella typhimurium LT2
guguccaggucaucaccucca

SEQ ID NO: 3807367 - RNA, 16 nt, Salmonella typhimurium LT2
guguccccugcaggaa

SEQ ID NO: 3807368 - RNA, 19 nt, Salmonella typhimurium LT2
guguccggguucagcgaca

SEQ ID NO: 3807369 - RNA, 14 nt, Salmonella typhimurium LT2
guguccucugcugc

SEQ ID NO: 3807370 - RNA, 12 nt, Salmonella typhimurium LT2
gugucgauaacc

SEQ ID NO: 3807371 - RNA, 20 nt, Salmonella typhimurium LT2
gugucgccggggcgcuggcg

SEQ ID NO: 3807372 - RNA, 15 nt, Salmonella typhimurium LT2
gugucgggccaggcu

SEQ ID NO: 3807373 - RNA, 14 nt, Salmonella typhimurium LT2
gugucguaguggca

SEQ ID NO: 3807374 - RNA, 19 nt, Salmonella typhimurium LT2
gugucguuucauccugaca

SEQ ID NO: 3807375 - RNA, 16 nt, Salmonella typhimurium LT2
gugucugcuucgucug

SEQ ID NO: 3807376 - RNA, 18 nt, Salmonella typhimurium LT2
gugucuuuuacgccagga

SEQ ID NO: 3807377 - RNA, 16 nt, Salmonella typhimurium LT2
gugugcagccaguuag

SEQ ID NO: 3807378 - RNA, 19 nt, Salmonella typhimurium LT2
guguggucgucagccguga

SEQ ID NO: 3807379 - RNA, 15 nt, Salmonella typhimurium LT2
guguucacaauugug

SEQ ID NO: 3807380 - RNA, 14 nt, Salmonella typhimurium LT2
guguucguaaagca

SEQ ID NO: 3807381 - RNA, 13 nt, Salmonella typhimurium LT2
guguugcucaaaa

SEQ ID NO: 3807382 - RNA, 22 nt, Salmonella typhimurium LT2
guguuggaugaaccauaucaaa

SEQ ID NO: 3807383 - RNA, 19 nt, Salmonella typhimurium LT2
guguugguacacagcacaa

SEQ ID NO: 3807384 - RNA, 19 nt, Salmonella typhimurium LT2
guguuucaucucaucaaug

SEQ ID NO: 3807385 - RNA, 18 nt, Salmonella typhimurium LT2
guuaaaacggaucagccu

SEQ ID NO: 3807386 - RNA, 17 nt, Salmonella typhimurium LT2
guuaaagccgaccaucg

SEQ ID NO: 3807387 - RNA, 14 nt, Salmonella typhimurium LT2
guuaaagccgaugg

SEQ ID NO: 3807388 - RNA, 17 nt, Salmonella typhimurium LT2
guucagguuggcgacau

SEQ ID NO: 3807389 - RNA, 16 nt, Salmonella typhimurium LT2
guucaguaugaucaug

SEQ ID NO: 3807390 - RNA, 14 nt, Salmonella typhimurium LT2
guucaguucuuccc

SEQ ID NO: 3807391 - RNA, 12 nt, Salmonella typhimurium LT2
guucaguuucaa

SEQ ID NO: 3807392 - RNA, 16 nt, Salmonella typhimurium LT2
guucauaagucaucca

SEQ ID NO: 3807393 - RNA, 15 nt, Salmonella typhimurium LT2
guucauaccggauau

SEQ ID NO: 3807394 - RNA, 22 nt, Salmonella typhimurium LT2
guucaucaggcaauaaacauca

SEQ ID NO: 3807395 - RNA, 19 nt, Salmonella typhimurium LT2
guucaucaggccugcaaac

SEQ ID NO: 3807396 - RNA, 21 nt, Salmonella typhimurium LT2
guucaucaggccugcaaaccu

SEQ ID NO: 3807397 - RNA, 17 nt, Salmonella typhimurium LT2
guucaucauuuucccac

SEQ ID NO: 3807398 - RNA, 12 nt, Salmonella typhimurium LT2
guucauccagca

SEQ ID NO: 3807399 - RNA, 22 nt, Salmonella typhimurium LT2
guucaucccacuccaucgccug

SEQ ID NO: 3807400 - RNA, 18 nt, Salmonella typhimurium LT2
guucaugaaccacgcuaa

SEQ ID NO: 3807401 - RNA, 22 nt, Salmonella typhimurium LT2
guucaugccgacgauuugcgcu

SEQ ID NO: 3807402 - RNA, 17 nt, Salmonella typhimurium LT2
guucaugcgacugccca

SEQ ID NO: 3807403 - RNA, 14 nt, Salmonella typhimurium LT2
guucauggcaaaag

SEQ ID NO: 3807404 - RNA, 22 nt, Salmonella typhimurium LT2
guucauggguuagauauaguuu

SEQ ID NO: 3807405 - RNA, 20 nt, Salmonella typhimurium LT2
guucauucccgccaauaacc

SEQ ID NO: 3807406 - RNA, 21 nt, Salmonella typhimurium LT2
guucauuucaggcaaaggaau

SEQ ID NO: 3807407 - RNA, 20 nt, Salmonella typhimurium LT2
guuccaacagcgacgccaga

SEQ ID NO: 3807408 - RNA, 14 nt, Salmonella typhimurium LT2
guuccaaucucuuu

SEQ ID NO: 3807409 - RNA, 20 nt, Salmonella typhimurium LT2
guuccaccgucuaucgugga

SEQ ID NO: 3807410 - RNA, 17 nt, Salmonella typhimurium LT2
guuccagaggcauuauu

SEQ ID NO: 3807411 - RNA, 12 nt, Salmonella typhimurium LT2
guuccagcagcu

SEQ ID NO: 3807412 - RNA, 16 nt, Salmonella typhimurium LT2
guuccagccgccaggc

SEQ ID NO: 3807413 - RNA, 14 nt, Salmonella typhimurium LT2
guuccagcgccacg

SEQ ID NO: 3807414 - RNA, 23 nt, Salmonella typhimurium LT2
guuccauauccagcgcaggcaac

SEQ ID NO: 3807415 - RNA, 18 nt, Salmonella typhimurium LT2
guuccauuccagaacgaa

SEQ ID NO: 3807416 - RNA, 23 nt, Salmonella typhimurium LT2
guucccagcgggaacaucacgga

SEQ ID NO: 3807417 - RNA, 16 nt, Salmonella typhimurium LT2
guucccgacggcaggc

SEQ ID NO: 3807418 - RNA, 15 nt, Salmonella typhimurium LT2
guucccgagcggcca

SEQ ID NO: 3807419 - RNA, 14 nt, Salmonella typhimurium LT2
guuccgaaauaaau

SEQ ID NO: 3807420 - RNA, 16 nt, Salmonella typhimurium LT2
guuccgacaauaaaaa

SEQ ID NO: 3807421 - RNA, 16 nt, Salmonella typhimurium LT2
guuccgccagauacaa

SEQ ID NO: 3807422 - RNA, 23 nt, Salmonella typhimurium LT2
guuccgcgacaaugauuugcaac

SEQ ID NO: 3807423 - RNA, 14 nt, Salmonella typhimurium LT2
guuccguaagcgcc

SEQ ID NO: 3807424 - RNA, 20 nt, Salmonella typhimurium LT2
guuccguggugggcgcgacu

SEQ ID NO: 3807425 - RNA, 21 nt, Salmonella typhimurium LT2
guuccguuaguguuggccuga

SEQ ID NO: 3807426 - RNA, 21 nt, Salmonella typhimurium LT2
guuccugcgggaacagauaaa

SEQ ID NO: 3807427 - RNA, 22 nt, Salmonella typhimurium LT2
guuccugcgggaacagauaaau

SEQ ID NO: 3807428 - RNA, 16 nt, Salmonella typhimurium LT2
guuccugcuggcaaaa

SEQ ID NO: 3807429 - RNA, 19 nt, Salmonella typhimurium LT2
guuccuggcaaagcgucau

SEQ ID NO: 3807430 - RNA, 18 nt, Salmonella typhimurium LT2
guuccuucuuccagaccg

SEQ ID NO: 3807431 - RNA, 20 nt, Salmonella typhimurium LT2
guucgaauccagguacccca

SEQ ID NO: 3807432 - RNA, 15 nt, Salmonella typhimurium LT2
guucgaauccuuccc

SEQ ID NO: 3807433 - RNA, 13 nt, Salmonella typhimurium LT2
guucgcaacauuc

SEQ ID NO: 3807434 - RNA, 12 nt, Salmonella typhimurium LT2
guucgccacggu

SEQ ID NO: 3807435 - RNA, 14 nt, Salmonella typhimurium LT2
guucgccauccaga

SEQ ID NO: 3807436 - RNA, 17 nt, Salmonella typhimurium LT2
guucgcgcaguucaucc

SEQ ID NO: 3807437 - RNA, 15 nt, Salmonella typhimurium LT2
guucgcgcauaccuu

SEQ ID NO: 3807438 - RNA, 18 nt, Salmonella typhimurium LT2
guucgcgccgcggucgca

SEQ ID NO: 3807439 - RNA, 16 nt, Salmonella typhimurium LT2
guucgcggaacggcga

SEQ ID NO: 3807440 - RNA, 21 nt, Salmonella typhimurium LT2
guucgcgggucgguuucaguu

SEQ ID NO: 3807441 - RNA, 16 nt, Salmonella typhimurium LT2
guucgcuuauuccucc

SEQ ID NO: 3807442 - RNA, 23 nt, Salmonella typhimurium LT2
guucgcuuucauacgacgacggu

SEQ ID NO: 3807443 - RNA, 15 nt, Salmonella typhimurium LT2
guucguacuccugca

SEQ ID NO: 3807444 - RNA, 21 nt, Salmonella typhimurium LT2
guucgucccugcaacgccugc

SEQ ID NO: 3807445 - RNA, 22 nt, Salmonella typhimurium LT2
guucguucaacguaaagcuggc

SEQ ID NO: 3807446 - RNA, 18 nt, Salmonella typhimurium LT2
guucucccaccgcgcaca

SEQ ID NO: 3807447 - RNA, 20 nt, Salmonella typhimurium LT2
guucuccgucaacaccugca

SEQ ID NO: 3807448 - RNA, 14 nt, Salmonella typhimurium LT2
guucucuccaguuc

SEQ ID NO: 3807449 - RNA, 13 nt, Salmonella typhimurium LT2
guucugacgcgac

SEQ ID NO: 3807450 - RNA, 19 nt, Salmonella typhimurium LT2
guucugauacucguagcca

SEQ ID NO: 3807451 - RNA, 19 nt, Salmonella typhimurium LT2
guucugcgccauuuccagc

SEQ ID NO: 3807452 - RNA, 20 nt, Salmonella typhimurium LT2
guucugcgucgcgcauggca

SEQ ID NO: 3807453 - RNA, 19 nt, Salmonella typhimurium LT2
guucuuacggacguggggg

SEQ ID NO: 3807454 - RNA, 14 nt, Salmonella typhimurium LT2
guucuuccagcguc

SEQ ID NO: 3807455 - RNA, 23 nt, Salmonella typhimurium LT2
guucuucgaccguuaccguacua

SEQ ID NO: 3807456 - RNA, 13 nt, Salmonella typhimurium LT2
guucuuucaccau

SEQ ID NO: 3807457 - RNA, 19 nt, Salmonella typhimurium LT2
guucuuucgccagaaccgc

SEQ ID NO: 3807458 - RNA, 18 nt, Salmonella typhimurium LT2
guucuuugauuagcucau

SEQ ID NO: 3807459 - RNA, 16 nt, Salmonella typhimurium LT2
guucuuuuuaaaacac

SEQ ID NO: 3807460 - RNA, 14 nt, Salmonella typhimurium LT2
guugaaaaccugca

SEQ ID NO: 3807461 - RNA, 14 nt, Salmonella typhimurium LT2
guugaaagccccgg

SEQ ID NO: 3807462 - RNA, 22 nt, Salmonella typhimurium LT2
guugaacauuucaucuaucugc

SEQ ID NO: 3807463 - RNA, 21 nt, Salmonella typhimurium LT2
guugaaguucucaucgcuauu

SEQ ID NO: 3807464 - RNA, 15 nt, Salmonella typhimurium LT2
guugaauuacccguc

SEQ ID NO: 3807465 - RNA, 17 nt, Salmonella typhimurium LT2
guugacaccacggcaau

SEQ ID NO: 3807466 - RNA, 18 nt, Salmonella typhimurium LT2
guugacaucgcacgccuu

SEQ ID NO: 3807467 - RNA, 19 nt, Salmonella typhimurium LT2
guugaccagguugccagcg

SEQ ID NO: 3807468 - RNA, 18 nt, Salmonella typhimurium LT2
guugacugcgcuccgacu

SEQ ID NO: 3807469 - RNA, 17 nt, Salmonella typhimurium LT2
guugacuuaaaaagcgg

SEQ ID NO: 3807470 - RNA, 17 nt, Salmonella typhimurium LT2
guugagcaaugggaagg

SEQ ID NO: 3807471 - RNA, 18 nt, Salmonella typhimurium LT2
guugagcaaugggaagga

SEQ ID NO: 3807472 - RNA, 22 nt, Salmonella typhimurium LT2
guugagcaaugggaaggaaaau

SEQ ID NO: 3807473 - RNA, 17 nt, Salmonella typhimurium LT2
guugagcgcuugcugcg

SEQ ID NO: 3807474 - RNA, 23 nt, Salmonella typhimurium LT2
guugagcguuacgggaacagaau

SEQ ID NO: 3807475 - RNA, 20 nt, Salmonella typhimurium LT2
guugauaaaacacucuuuuu

SEQ ID NO: 3807476 - RNA, 13 nt, Salmonella typhimurium LT2
guugauaauauua

SEQ ID NO: 3807477 - RNA, 23 nt, Salmonella typhimurium LT2
guugauacagaaaaccggcaaau

SEQ ID NO: 3807478 - RNA, 17 nt, Salmonella typhimurium LT2
guugaucguaaaaugaa

SEQ ID NO: 3807479 - RNA, 13 nt, Salmonella typhimurium LT2
guugcaacuccag

SEQ ID NO: 3807480 - RNA, 15 nt, Salmonella typhimurium LT2
guugcauacggucaa

SEQ ID NO: 3807481 - RNA, 20 nt, Salmonella typhimurium LT2
guugcaucuuaucaggccga

SEQ ID NO: 3807482 - RNA, 16 nt, Salmonella typhimurium LT2
guugccagcggccagg

SEQ ID NO: 3807483 - RNA, 20 nt, Salmonella typhimurium LT2
guugcccaguacggcgcgaa

SEQ ID NO: 3807484 - RNA, 17 nt, Salmonella typhimurium LT2
guugccgaugacuccca

SEQ ID NO: 3807485 - RNA, 12 nt, Salmonella typhimurium LT2
guugccgcccgu

SEQ ID NO: 3807486 - RNA, 20 nt, Salmonella typhimurium LT2
guugccgcccguuuuuucca

SEQ ID NO: 3807487 - RNA, 22 nt, Salmonella typhimurium LT2
guugccgcccguuuuuuccagu

SEQ ID NO: 3807488 - RNA, 20 nt, Salmonella typhimurium LT2
guugccugcgucauccccag

SEQ ID NO: 3807489 - RNA, 13 nt, Salmonella typhimurium LT2
guugccuuccuga

SEQ ID NO: 3807490 - RNA, 17 nt, Salmonella typhimurium LT2
guugccuuugucaucca

SEQ ID NO: 3807491 - RNA, 23 nt, Salmonella typhimurium LT2
guugcgaacuugccggaacgcga

SEQ ID NO: 3807492 - RNA, 17 nt, Salmonella typhimurium LT2
guuucuucaggccagcc

SEQ ID NO: 3807493 - RNA, 13 nt, Salmonella typhimurium LT2
guuucuucaucaa

SEQ ID NO: 3807494 - RNA, 13 nt, Salmonella typhimurium LT2
guuucuucugucc

SEQ ID NO: 3807495 - RNA, 14 nt, Salmonella typhimurium LT2
guuucuuucaucag

SEQ ID NO: 3807496 - RNA, 13 nt, Salmonella typhimurium LT2
guuugaccagcaa

SEQ ID NO: 3807497 - RNA, 17 nt, Salmonella typhimurium LT2
guuugacgaaaucgcau

SEQ ID NO: 3807498 - RNA, 21 nt, Salmonella typhimurium LT2
guuugaggaaaccuuucuucu

SEQ ID NO: 3807499 - RNA, 18 nt, Salmonella typhimurium LT2
guuugauaaacugcgcca

SEQ ID NO: 3807500 - RNA, 22 nt, Salmonella typhimurium LT2
guuugaucuuuuucagcaccuu

SEQ ID NO: 3807501 - RNA, 23 nt, Salmonella typhimurium LT2
guuugcauaggccccgguggcgg

SEQ ID NO: 3807502 - RNA, 18 nt, Salmonella typhimurium LT2
guuugccagcaccagcag

SEQ ID NO: 3807503 - RNA, 19 nt, Salmonella typhimurium LT2
guuugccccauuguucuuu

SEQ ID NO: 3807504 - RNA, 21 nt, Salmonella typhimurium LT2
guuugccgcauacaucgcaga

SEQ ID NO: 3807505 - RNA, 13 nt, Salmonella typhimurium LT2
guuugccgggcau

SEQ ID NO: 3807506 - RNA, 18 nt, Salmonella typhimurium LT2
guuugcggauuggauaaa

SEQ ID NO: 3807507 - RNA, 18 nt, Salmonella typhimurium LT2
guuugcugacaaucugcu

SEQ ID NO: 3807508 - RNA, 16 nt, Salmonella typhimurium LT2
guuugcugagcagcca

SEQ ID NO: 3807509 - RNA, 13 nt, Salmonella typhimurium LT2
guuugcugcacca

SEQ ID NO: 3807510 - RNA, 14 nt, Salmonella typhimurium LT2
guuugucauccaga

SEQ ID NO: 3807511 - RNA, 23 nt, Salmonella typhimurium LT2
guuuguuguagccaggcgaugaa

SEQ ID NO: 3807512 - RNA, 14 nt, Salmonella typhimurium LT2
guuuuaaaaauaac

SEQ ID NO: 3807513 - RNA, 13 nt, Salmonella typhimurium LT2
guuuuaauuccug

SEQ ID NO: 3807514 - RNA, 17 nt, Salmonella typhimurium LT2
guuuuacaccagcuuuu

SEQ ID NO: 3807515 - RNA, 19 nt, Salmonella typhimurium LT2
guuuuaccaguacaauuuc

SEQ ID NO: 3807516 - RNA, 17 nt, Salmonella typhimurium LT2
guuuuauccccuucagg

SEQ ID NO: 3807517 - RNA, 19 nt, Salmonella typhimurium LT2
guuuucaaagacgguuuca

SEQ ID NO: 3807518 - RNA, 21 nt, Salmonella typhimurium LT2
guuuucaggaaggagcaaaca

SEQ ID NO: 3807519 - RNA, 22 nt, Salmonella typhimurium LT2
guuuucaggaaggagcaaacag

SEQ ID NO: 3807520 - RNA, 16 nt, Salmonella typhimurium LT2
guuuucucauccagcu

SEQ ID NO: 3807521 - RNA, 23 nt, Salmonella typhimurium LT2
guuuugaaaucuugcugucggac

SEQ ID NO: 3807522 - RNA, 21 nt, Salmonella typhimurium LT2
guuuugaucgaaucucccgau

SEQ ID NO: 3807523 - RNA, 14 nt, Salmonella typhimurium LT2
guuuugcagcgcca

SEQ ID NO: 3807524 - RNA, 14 nt, Salmonella typhimurium LT2
guuuugcccauuuc

SEQ ID NO: 3807525 - RNA, 15 nt, Salmonella typhimurium LT2
guuuuggcagcgccc

SEQ ID NO: 3807526 - RNA, 18 nt, Salmonella typhimurium LT2
guuuuggguaaauaccag

SEQ ID NO: 3807527 - RNA, 15 nt, Salmonella typhimurium LT2
guuuuuauuuuucuu

SEQ ID NO: 3807528 - RNA, 14 nt, Salmonella typhimurium LT2
guuuuucaucauca

SEQ ID NO: 3807529 - RNA, 13 nt, Salmonella typhimurium LT2
guuuuucccggau

SEQ ID NO: 3807530 - RNA, 16 nt, Salmonella typhimurium LT2
guuuuucgaaaauuuc

SEQ ID NO: 3807531 - RNA, 14 nt, Salmonella typhimurium LT2
guuuuucucaucaa

SEQ ID NO: 3807532 - RNA, 18 nt, Salmonella typhimurium LT2
guuuuugcgccauugccg

SEQ ID NO: 3807533 - RNA, 22 nt, Salmonella typhimurium LT2
guuuuuggaaacuaugcaaaac

SEQ ID NO: 3807534 - RNA, 22 nt, Salmonella typhimurium LT2
guuuuuuaaccguucuuccugg

SEQ ID NO: 3807535 - RNA, 14 nt, Salmonella typhimurium LT2
guuuuuucguucca

SEQ ID NO: 3807536 - RNA, 16 nt, Salmonella typhimurium LT2
guuuuuuuaugcguuu

SEQ ID NO: 3807537 - RNA, 13 nt, Salmonella typhimurium LT2
uaaaaaaacauca

SEQ ID NO: 3807538 - RNA, 19 nt, Salmonella typhimurium LT2
uaaaaaaauaaaaaaggca

SEQ ID NO: 3807539 - RNA, 23 nt, Salmonella typhimurium LT2
uaaaaaacaacucuauuaaaaua

SEQ ID NO: 3807540 - RNA, 16 nt, Salmonella typhimurium LT2
uaaaaaacaagauuaa

SEQ ID NO: 3807541 - RNA, 18 nt, Salmonella typhimurium LT2
uaaaaaacaccugucugu

SEQ ID NO: 3807542 - RNA, 11 nt, Salmonella typhimurium LT2
uaaaaaacagg

SEQ ID NO: 3807543 - RNA, 16 nt, Salmonella typhimurium LT2
uaaaaaacaggcgcag

SEQ ID NO: 3807544 - RNA, 20 nt, Salmonella typhimurium LT2
uaaaaaaggcagaagaaucu

SEQ ID NO: 3807545 - RNA, 23 nt, Salmonella typhimurium LT2
uaaaaaaggcagaagaaucugcc

SEQ ID NO: 3807546 - RNA, 17 nt, Salmonella typhimurium LT2
uaaaaaauccugcacuu

SEQ ID NO: 3807547 - RNA, 12 nt, Salmonella typhimurium LT2
uaaaaaaugaga

SEQ ID NO: 3807548 - RNA, 13 nt, Salmonella typhimurium LT2
uaaaaacagcgca

SEQ ID NO: 3807549 - RNA, 20 nt, Salmonella typhimurium LT2
uaaaaaccauuuauaaaaua

SEQ ID NO: 3807550 - RNA, 15 nt, Salmonella typhimurium LT2
uaaaaacgccaauca

SEQ ID NO: 3807551 - RNA, 15 nt, Salmonella typhimurium LT2
uaaaaagagaaaaaa

SEQ ID NO: 3807552 - RNA, 18 nt, Salmonella typhimurium LT2
uaaaaagcacaucaggaa

SEQ ID NO: 3807553 - RNA, 19 nt, Salmonella typhimurium LT2
uaaaaagcacaucaggaaa

SEQ ID NO: 3807554 - RNA, 16 nt, Salmonella typhimurium LT2
uaaaaagcugcauaau

SEQ ID NO: 3807555 - RNA, 10 nt, Salmonella typhimurium LT2
uaaaaaggaa

SEQ ID NO: 3807556 - RNA, 11 nt, Salmonella typhimurium LT2
uaaaaaggaaa

SEQ ID NO: 3807557 - RNA, 21 nt, Salmonella typhimurium LT2
uaaaaagggggagucgguacu

SEQ ID NO: 3807558 - RNA, 21 nt, Salmonella typhimurium LT2
uaaaaaggugagcgcaaugcu

SEQ ID NO: 3807559 - RNA, 11 nt, Salmonella typhimurium LT2
uaaaaauaacg

SEQ ID NO: 3807560 - RNA, 16 nt, Salmonella typhimurium LT2
uaaaaauaauugauaa

SEQ ID NO: 3807561 - RNA, 18 nt, Salmonella typhimurium LT2
uaaaaauaucugaauaac

SEQ ID NO: 3807562 - RNA, 19 nt, Salmonella typhimurium LT2
uaaaaauaucugaauaacc

SEQ ID NO: 3807563 - RNA, 22 nt, Salmonella typhimurium LT2
uaaaaaugauaagcacuauuau

SEQ ID NO: 3807564 - RNA, 22 nt, Salmonella typhimurium LT2
uaaaacaaaaaaacggccucaa

SEQ ID NO: 3807565 - RNA, 21 nt, Salmonella typhimurium LT2
uaaaacaagucagcguuacug

SEQ ID NO: 3807566 - RNA, 20 nt, Salmonella typhimurium LT2
uaaaacaccacaaagucgcc

SEQ ID NO: 3807567 - RNA, 20 nt, Salmonella typhimurium LT2
uaaaacagccugucgccguc

SEQ ID NO: 3807568 - RNA, 13 nt, Salmonella typhimurium LT2
uaaaacccaauaa

SEQ ID NO: 3807569 - RNA, 15 nt, Salmonella typhimurium LT2
uaaaaccgaucgccu

SEQ ID NO: 3807570 - RNA, 20 nt, Salmonella typhimurium LT2
uaaaaccuaacgccugcaua

SEQ ID NO: 3807571 - RNA, 17 nt, Salmonella typhimurium LT2
uaaaacgauauugccuu

SEQ ID NO: 3807572 - RNA, 16 nt, Salmonella typhimurium LT2
uaaaacggcucaucag

SEQ ID NO: 3807573 - RNA, 18 nt, Salmonella typhimurium LT2
uaaaacgguaugaaacau

SEQ ID NO: 3807574 - RNA, 16 nt, Salmonella typhimurium LT2
uaaaagacgaagccga

SEQ ID NO: 3807575 - RNA, 21 nt, Salmonella typhimurium LT2
uaaaagcaauguaagaauaac

SEQ ID NO: 3807576 - RNA, 17 nt, Salmonella typhimurium LT2
uaaaagcccuuaucgcc

SEQ ID NO: 3807577 - RNA, 22 nt, Salmonella typhimurium LT2
uaaaagcccuuaucgccccagc

SEQ ID NO: 3807578 - RNA, 18 nt, Salmonella typhimurium LT2
uaaaaguaaauaagaaaa

SEQ ID NO: 3807579 - RNA, 19 nt, Salmonella typhimurium LT2
uaaaaguaaauaagaaaau

SEQ ID NO: 3807580 - RNA, 22 nt, Salmonella typhimurium LT2
uaaaaguacaaugcaaagaaaa

SEQ ID NO: 3807581 - RNA, 15 nt, Salmonella typhimurium LT2
uaaaauaaauuaauu

SEQ ID NO: 3807582 - RNA, 15 nt, Salmonella typhimurium LT2
uaaaauaacuauaau

SEQ ID NO: 3807583 - RNA, 20 nt, Salmonella typhimurium LT2
uaaaauaagcaauuacuauu

SEQ ID NO: 3807584 - RNA, 21 nt, Salmonella typhimurium LT2
uaaaauacgcucaauauacuu

SEQ ID NO: 3807585 - RNA, 11 nt, Salmonella typhimurium LT2
uaaaaucgcgu

SEQ ID NO: 3807586 - RNA, 20 nt, Salmonella typhimurium LT2
uaaaaucggggucuuccagc

SEQ ID NO: 3807587 - RNA, 23 nt, Salmonella typhimurium LT2
uaaaaucggggucuuccagcaga

SEQ ID NO: 3807588 - RNA, 22 nt, Salmonella typhimurium LT2
uaaaaucggguggccuaacgcc

SEQ ID NO: 3807589 - RNA, 10 nt, Salmonella typhimurium LT2
uaaaaugacc

SEQ ID NO: 3807590 - RNA, 13 nt, Salmonella typhimurium LT2
uaaaauggacauu

SEQ ID NO: 3807591 - RNA, 19 nt, Salmonella typhimurium LT2
uaaaauuguaauaauuuaa

SEQ ID NO: 3807592 - RNA, 20 nt, Salmonella typhimurium LT2
uaaaauuguaauaauuuaaa

SEQ ID NO: 3807593 - RNA, 22 nt, Salmonella typhimurium LT2
uaaaauuguaauaauuuaaaau

SEQ ID NO: 3807594 - RNA, 20 nt, Salmonella typhimurium LT2
uaaaauuuugcauaaauaau

SEQ ID NO: 3807595 - RNA, 20 nt, Salmonella typhimurium LT2
uaaacaauuugcccagcgcu

SEQ ID NO: 3807596 - RNA, 20 nt, Salmonella typhimurium LT2
uaaaugcuccccgccgcaca

SEQ ID NO: 3807597 - RNA, 20 nt, Salmonella typhimurium LT2
uaaaugcugaugacguccag

SEQ ID NO: 3807598 - RNA, 23 nt, Salmonella typhimurium LT2
uaaaugguacuuuucauccacag

SEQ ID NO: 3807599 - RNA, 17 nt, Salmonella typhimurium LT2
uaaauguuugcuuuagc

SEQ ID NO: 3807600 - RNA, 20 nt, Salmonella typhimurium LT2
uaaauuaaacagcuguaaau

SEQ ID NO: 3807601 - RNA, 14 nt, Salmonella typhimurium LT2
uaaauuacuuauga

SEQ ID NO: 3807602 - RNA, 21 nt, Salmonella typhimurium LT2
uaaauuauuuaagcucuucuu

SEQ ID NO: 3807603 - RNA, 14 nt, Salmonella typhimurium LT2
uaaauucauauuua

SEQ ID NO: 3807604 - RNA, 19 nt, Salmonella typhimurium LT2
uaaauucauauuuaaauau

SEQ ID NO: 3807605 - RNA, 18 nt, Salmonella typhimurium LT2
uaaauugcggcaugaucu

SEQ ID NO: 3807606 - RNA, 23 nt, Salmonella typhimurium LT2
uaaauuguuugguuuugaaaauc

SEQ ID NO: 3807607 - RNA, 20 nt, Salmonella typhimurium LT2
uaaauuuaacucguccuguu

SEQ ID NO: 3807608 - RNA, 22 nt, Salmonella typhimurium LT2
uaaauuucaacccgaucgccau

SEQ ID NO: 3807609 - RNA, 17 nt, Salmonella typhimurium LT2
uaaauuuccgcagccag

SEQ ID NO: 3807610 - RNA, 18 nt, Salmonella typhimurium LT2
uaaauuuccgcagccaga

SEQ ID NO: 3807611 - RNA, 21 nt, Salmonella typhimurium LT2
uaaauuuccucuugucaggca

SEQ ID NO: 3807612 - RNA, 11 nt, Salmonella typhimurium LT2
uaaauuuucau

SEQ ID NO: 3807613 - RNA, 13 nt, Salmonella typhimurium LT2
uaaauuuucauua

SEQ ID NO: 3807614 - RNA, 17 nt, Salmonella typhimurium LT2
uaaauuuucgcucaaca

SEQ ID NO: 3807615 - RNA, 15 nt, Salmonella typhimurium LT2
uaaauuuuuuaacag

SEQ ID NO: 3807616 - RNA, 22 nt, Salmonella typhimurium LT2
uaacaaaaugagauugauaauc

SEQ ID NO: 3807617 - RNA, 16 nt, Salmonella typhimurium LT2
uaacaacuguuuuuca

SEQ ID NO: 3807618 - RNA, 17 nt, Salmonella typhimurium LT2
uaacaacuguuuuucac

SEQ ID NO: 3807619 - RNA, 20 nt, Salmonella typhimurium LT2
uaacaauccuaccguaacgu

SEQ ID NO: 3807620 - RNA, 21 nt, Salmonella typhimurium LT2
uaacaaugucgaaacaacaca

SEQ ID NO: 3807621 - RNA, 15 nt, Salmonella typhimurium LT2
uaacacaaaaucccu

SEQ ID NO: 3807622 - RNA, 21 nt, Salmonella typhimurium LT2
uaacacaauacuucaaaugau

SEQ ID NO: 3807623 - RNA, 19 nt, Salmonella typhimurium LT2
uaacacacaguugccuucg

SEQ ID NO: 3807624 - RNA, 13 nt, Salmonella typhimurium LT2
uaacacaugcaag

SEQ ID NO: 3807625 - RNA, 22 nt, Salmonella typhimurium LT2
uaacaccacgaaggaaacgcca

SEQ ID NO: 3807626 - RNA, 21 nt, Salmonella typhimurium LT2
uaacaccgcggcgcucgccag

SEQ ID NO: 3807627 - RNA, 20 nt, Salmonella typhimurium LT2
uaacaccuuuaucaauagau

SEQ ID NO: 3807628 - RNA, 22 nt, Salmonella typhimurium LT2
uaacaccuuuuccucuucuugc

SEQ ID NO: 3807629 - RNA, 16 nt, Salmonella typhimurium LT2
uaacacggcuggcaau

SEQ ID NO: 3807630 - RNA, 16 nt, Salmonella typhimurium LT2
uaacacgguuuccggc

SEQ ID NO: 3807631 - RNA, 17 nt, Salmonella typhimurium LT2
uaacagaauaagccagg

SEQ ID NO: 3807632 - RNA, 19 nt, Salmonella typhimurium LT2
uaacagacgcaucuuuuuc

SEQ ID NO: 3807633 - RNA, 22 nt, Salmonella typhimurium LT2
uaacagacgcaucuuuuucccg

SEQ ID NO: 3807634 - RNA, 19 nt, Salmonella typhimurium LT2
uaacagauaguuaauaaug

SEQ ID NO: 3807635 - RNA, 13 nt, Salmonella typhimurium LT2
uaacagccagcga

SEQ ID NO: 3807636 - RNA, 19 nt, Salmonella typhimurium LT2
uaacagccgcggaccuuuu

SEQ ID NO: 3807637 - RNA, 16 nt, Salmonella typhimurium LT2
uaacagcgcgaccagc

SEQ ID NO: 3807638 - RNA, 21 nt, Salmonella typhimurium LT2
uaacagcgcgaccaggaaacc

SEQ ID NO: 3807639 - RNA, 19 nt, Salmonella typhimurium LT2
uaacagcgcuaucaggaag

SEQ ID NO: 3807640 - RNA, 18 nt, Salmonella typhimurium LT2
uaacagcuugaucaucag

SEQ ID NO: 3807641 - RNA, 19 nt, Salmonella typhimurium LT2
uaacagcuugaucaucagg

SEQ ID NO: 3807642 - RNA, 14 nt, Salmonella typhimurium LT2
uaacaggaacgccg

SEQ ID NO: 3807643 - RNA, 16 nt, Salmonella typhimurium LT2
uaacaggaagcggcug

SEQ ID NO: 3807644 - RNA, 18 nt, Salmonella typhimurium LT2
uaacaggcaccagcguau

SEQ ID NO: 3807645 - RNA, 17 nt, Salmonella typhimurium LT2
uaacaguggguugacgu

SEQ ID NO: 3807646 - RNA, 19 nt, Salmonella typhimurium LT2
uaacaguuggcuugccagc

SEQ ID NO: 3807647 - RNA, 14 nt, Salmonella typhimurium LT2
uaacauacaaaaag

SEQ ID NO: 3807648 - RNA, 21 nt, Salmonella typhimurium LT2
uaacaucaccuuucauuuuau

SEQ ID NO: 3807649 - RNA, 14 nt, Salmonella typhimurium LT2
uaaccaaagcacca

SEQ ID NO: 3807650 - RNA, 16 nt, Salmonella typhimurium LT2
uaaccaaagcaccauu

SEQ ID NO: 3807651 - RNA, 18 nt, Salmonella typhimurium LT2
uaaccaacaggaggaucg

SEQ ID NO: 3807652 - RNA, 22 nt, Salmonella typhimurium LT2
uaaccaacaggaggaucgccgc

SEQ ID NO: 3807653 - RNA, 11 nt, Salmonella typhimurium LT2
uaaccaacuga

SEQ ID NO: 3807654 - RNA, 17 nt, Salmonella typhimurium LT2
uaaccaauuaaauuauu

SEQ ID NO: 3807655 - RNA, 22 nt, Salmonella typhimurium LT2
uaaccaccgcugcgugcgcgcc

SEQ ID NO: 3807656 - RNA, 23 nt, Salmonella typhimurium LT2
uaaccaccggcgcgccagcgcau

SEQ ID NO: 3807657 - RNA, 17 nt, Salmonella typhimurium LT2
uaaccacgauaaagaca

SEQ ID NO: 3807658 - RNA, 16 nt, Salmonella typhimurium LT2
uaaccagaucggcuau

SEQ ID NO: 3807659 - RNA, 20 nt, Salmonella typhimurium LT2
uaaccagcgagcuacaggug

SEQ ID NO: 3807660 - RNA, 18 nt, Salmonella typhimurium LT2
uaaccagcgcgccgccaa

SEQ ID NO: 3807661 - RNA, 13 nt, Salmonella typhimurium LT2
uaaccaggccaga

SEQ ID NO: 3807662 - RNA, 23 nt, Salmonella typhimurium LT2
uaaccauaucaguuaugacagac

SEQ ID NO: 3807663 - RNA, 16 nt, Salmonella typhimurium LT2
uaacccgauacccuga

SEQ ID NO: 3807664 - RNA, 20 nt, Salmonella typhimurium LT2
uaacccguccauauucaguu

SEQ ID NO: 3807665 - RNA, 20 nt, Salmonella typhimurium LT2
uaacccguugccgaacgcgg

SEQ ID NO: 3807666 - RNA, 13 nt, Salmonella typhimurium LT2
uaacccuccugcc

SEQ ID NO: 3807667 - RNA, 19 nt, Salmonella typhimurium LT2
uaaccgauaacgcggcccg

SEQ ID NO: 3807668 - RNA, 16 nt, Salmonella typhimurium LT2
uaaccgccuccgacaa

SEQ ID NO: 3807669 - RNA, 17 nt, Salmonella typhimurium LT2
uaaccgcgaucgaugug

SEQ ID NO: 3807670 - RNA, 22 nt, Salmonella typhimurium LT2
uaaccggacgauuuaagcuuaa

SEQ ID NO: 3807671 - RNA, 16 nt, Salmonella typhimurium LT2
uaaccggaucggccau

SEQ ID NO: 3807672 - RNA, 19 nt, Salmonella typhimurium LT2
uaaccggcaaccaacgccc

SEQ ID NO: 3807673 - RNA, 14 nt, Salmonella typhimurium LT2
uaaccggcaacuuu

SEQ ID NO: 3807674 - RNA, 22 nt, Salmonella typhimurium LT2
uaaccggcggcgucuggcgaaa

SEQ ID NO: 3807675 - RNA, 19 nt, Salmonella typhimurium LT2
uaaccguaacgcuccugga

SEQ ID NO: 3807676 - RNA, 22 nt, Salmonella typhimurium LT2
uaaccgucuggcugccaucggc

SEQ ID NO: 3807677 - RNA, 17 nt, Salmonella typhimurium LT2
uaaccguggcggcagug

SEQ ID NO: 3807678 - RNA, 21 nt, Salmonella typhimurium LT2
uaaccguucaucuaucgccag

SEQ ID NO: 3807679 - RNA, 15 nt, Salmonella typhimurium LT2
uaaccguucuuccug

SEQ ID NO: 3807680 - RNA, 16 nt, Salmonella typhimurium LT2
uaaccguucuuccugg

SEQ ID NO: 3807681 - RNA, 20 nt, Salmonella typhimurium LT2
uaaccucaaugauuuccgca

SEQ ID NO: 3807682 - RNA, 17 nt, Salmonella typhimurium LT2
uaaccucuauaguaaau

SEQ ID NO: 3807683 - RNA, 18 nt, Salmonella typhimurium LT2
uaaccucuauaguaaauu

SEQ ID NO: 3807684 - RNA, 23 nt, Salmonella typhimurium LT2
uaaccuucuaccccgugauucac

SEQ ID NO: 3807685 - RNA, 16 nt, Salmonella typhimurium LT2
uaacgaaauguuuucu

SEQ ID NO: 3807686 - RNA, 20 nt, Salmonella typhimurium LT2
uaacgauacccaccagcgug

SEQ ID NO: 3807687 - RNA, 14 nt, Salmonella typhimurium LT2
uaacgcacuaccag

SEQ ID NO: 3807688 - RNA, 23 nt, Salmonella typhimurium LT2
uaacgcacuggucgggcaggcuu

SEQ ID NO: 3807689 - RNA, 17 nt, Salmonella typhimurium LT2
uaacgcagcaucgccau

SEQ ID NO: 3807690 - RNA, 15 nt, Salmonella typhimurium LT2
uaacgcaggcgauag

SEQ ID NO: 3807691 - RNA, 23 nt, Salmonella typhimurium LT2
uaacgcaggcgauagccccagua

SEQ ID NO: 3807692 - RNA, 18 nt, Salmonella typhimurium LT2
uaacgcauacauucuguu

SEQ ID NO: 3807693 - RNA, 15 nt, Salmonella typhimurium LT2
uaacgccgauuaaug

SEQ ID NO: 3807694 - RNA, 18 nt, Salmonella typhimurium LT2
uaacgccgauuaaugcuc

SEQ ID NO: 3807695 - RNA, 17 nt, Salmonella typhimurium LT2
uaacgcgcuggucagca

SEQ ID NO: 3807696 - RNA, 17 nt, Salmonella typhimurium LT2
uaacgcgcuuuuuucgu

SEQ ID NO: 3807697 - RNA, 19 nt, Salmonella typhimurium LT2
uaacgcgggcguaauacau

SEQ ID NO: 3807698 - RNA, 22 nt, Salmonella typhimurium LT2
uaacgcggguuuuuacuuucca

SEQ ID NO: 3807699 - RNA, 16 nt, Salmonella typhimurium LT2
uaaggcuggcacguuc

SEQ ID NO: 3807700 - RNA, 14 nt, Salmonella typhimurium LT2
uaagggccuucauu

SEQ ID NO: 3807701 - RNA, 22 nt, Salmonella typhimurium LT2
uaaggggcaggcgucaaaacag

SEQ ID NO: 3807702 - RNA, 18 nt, Salmonella typhimurium LT2
uaagggugaaagggugcg

SEQ ID NO: 3807703 - RNA, 19 nt, Salmonella typhimurium LT2
uaagguauccuaaugccac

SEQ ID NO: 3807704 - RNA, 19 nt, Salmonella typhimurium LT2
uaaggucgcuauccagcag

SEQ ID NO: 3807705 - RNA, 21 nt, Salmonella typhimurium LT2
uaaggucgcuauccagcagua

SEQ ID NO: 3807706 - RNA, 17 nt, Salmonella typhimurium LT2
uaagguugccugccaga

SEQ ID NO: 3807707 - RNA, 22 nt, Salmonella typhimurium LT2
uaaguaaagauuuuuauuaaaa

SEQ ID NO: 3807708 - RNA, 23 nt, Salmonella typhimurium LT2
uaaguaaagauuuuuauuaaaau

SEQ ID NO: 3807709 - RNA, 14 nt, Salmonella typhimurium LT2
uaaguaaguugauc

SEQ ID NO: 3807710 - RNA, 16 nt, Salmonella typhimurium LT2
uaaguauacggaagcg

SEQ ID NO: 3807711 - RNA, 14 nt, Salmonella typhimurium LT2
uaagucauccagac

SEQ ID NO: 3807712 - RNA, 19 nt, Salmonella typhimurium LT2
uaagucgccgcagcuccau

SEQ ID NO: 3807713 - RNA, 20 nt, Salmonella typhimurium LT2
uaagucuccuguuuacaggc

SEQ ID NO: 3807714 - RNA, 22 nt, Salmonella typhimurium LT2
uaaguguagcgccgccugacug

SEQ ID NO: 3807715 - RNA, 21 nt, Salmonella typhimurium LT2
uaaguuacuaaaaguaaauaa

SEQ ID NO: 3807716 - RNA, 16 nt, Salmonella typhimurium LT2
uaaguucgcaacauga

SEQ ID NO: 3807717 - RNA, 16 nt, Salmonella typhimurium LT2
uaaguugaaaggaaag

SEQ ID NO: 3807718 - RNA, 14 nt, Salmonella typhimurium LT2
uaaguugaccacac

SEQ ID NO: 3807719 - RNA, 19 nt, Salmonella typhimurium LT2
uaaguuuaugguaaucaca

SEQ ID NO: 3807720 - RNA, 15 nt, Salmonella typhimurium LT2
uaauaaaaaacaacu

SEQ ID NO: 3807721 - RNA, 13 nt, Salmonella typhimurium LT2
uaauaaaaauacc

SEQ ID NO: 3807722 - RNA, 13 nt, Salmonella typhimurium LT2
uaauaaaauaacu

SEQ ID NO: 3807723 - RNA, 16 nt, Salmonella typhimurium LT2
uaauaaaauauuauuu

SEQ ID NO: 3807724 - RNA, 15 nt, Salmonella typhimurium LT2
uaauaaauuuucauu

SEQ ID NO: 3807725 - RNA, 20 nt, Salmonella typhimurium LT2
uaauaaauuuucauuauaaa

SEQ ID NO: 3807726 - RNA, 13 nt, Salmonella typhimurium LT2
uaauaacacaaua

SEQ ID NO: 3807727 - RNA, 14 nt, Salmonella typhimurium LT2
uaauaaccagcccc

SEQ ID NO: 3807728 - RNA, 21 nt, Salmonella typhimurium LT2
uaauaacggcgacaggcacaa

SEQ ID NO: 3807729 - RNA, 18 nt, Salmonella typhimurium LT2
uaauaacugacagacuca

SEQ ID NO: 3807730 - RNA, 13 nt, Salmonella typhimurium LT2
uaauaauaaauuu

SEQ ID NO: 3807731 - RNA, 13 nt, Salmonella typhimurium LT2
uaauaauauccuu

SEQ ID NO: 3807732 - RNA, 12 nt, Salmonella typhimurium LT2
uaauaauuaaca

SEQ ID NO: 3807733 - RNA, 22 nt, Salmonella typhimurium LT2
uaauaauugagcgcaaaacgcu

SEQ ID NO: 3807734 - RNA, 19 nt, Salmonella typhimurium LT2
uaauaauuggcauccagca

SEQ ID NO: 3807735 - RNA, 13 nt, Salmonella typhimurium LT2
uaauaauuuaaaa

SEQ ID NO: 3807736 - RNA, 18 nt, Salmonella typhimurium LT2
uaauacacaauacgccga

SEQ ID NO: 3807737 - RNA, 12 nt, Salmonella typhimurium LT2
uaauacaggcca

SEQ ID NO: 3807738 - RNA, 18 nt, Salmonella typhimurium LT2
uaauacaucuuccuccug

SEQ ID NO: 3807739 - RNA, 18 nt, Salmonella typhimurium LT2
uaauaccgagaaugccga

SEQ ID NO: 3807740 - RNA, 21 nt, Salmonella typhimurium LT2
uaauaccgugcaggacagaca

SEQ ID NO: 3807741 - RNA, 17 nt, Salmonella typhimurium LT2
uaauacgacucaauaca

SEQ ID NO: 3807742 - RNA, 15 nt, Salmonella typhimurium LT2
uaauacgcuugcgcc

SEQ ID NO: 3807743 - RNA, 20 nt, Salmonella typhimurium LT2
uaauacgcuugcgccagcau

SEQ ID NO: 3807744 - RNA, 18 nt, Salmonella typhimurium LT2
uaauacggagcaaaaaac

SEQ ID NO: 3807745 - RNA, 19 nt, Salmonella typhimurium LT2
uaauacguaaaccgcucac

SEQ ID NO: 3807746 - RNA, 20 nt, Salmonella typhimurium LT2
uaauacguacugaaauaacu

SEQ ID NO: 3807747 - RNA, 13 nt, Salmonella typhimurium LT2
uaauacugccgca

SEQ ID NO: 3807748 - RNA, 14 nt, Salmonella typhimurium LT2
uaauagguugcgcc

SEQ ID NO: 3807749 - RNA, 16 nt, Salmonella typhimurium LT2
uaauaguuagccugau

SEQ ID NO: 3807750 - RNA, 17 nt, Salmonella typhimurium LT2
uaauauaaccaauuuaa

SEQ ID NO: 3807751 - RNA, 24 nt, Salmonella typhimurium LT2
uaauauauuuauauauagagcagc

SEQ ID NO: 3807752 - RNA, 18 nt, Salmonella typhimurium LT2
uaauaucaacccucccug

SEQ ID NO: 3807753 - RNA, 13 nt, Salmonella typhimurium LT2
uaauaucauccgg

SEQ ID NO: 3807754 - RNA, 20 nt, Salmonella typhimurium LT2
uaauaucgcgcucuuccgcc

SEQ ID NO: 3807755 - RNA, 18 nt, Salmonella typhimurium LT2
uaauaugccagcucaaau

SEQ ID NO: 3807756 - RNA, 16 nt, Salmonella typhimurium LT2
uaauauuaagcagcuu

SEQ ID NO: 3807757 - RNA, 13 nt, Salmonella typhimurium LT2
uaauauuaucagc

SEQ ID NO: 3807758 - RNA, 15 nt, Salmonella typhimurium LT2
uaauauuaucagcaa

SEQ ID NO: 3807759 - RNA, 19 nt, Salmonella typhimurium LT2
uaauauucauaucguaaau

SEQ ID NO: 3807760 - RNA, 23 nt, Salmonella typhimurium LT2
uaaucaaugcgacgcccaaccag

SEQ ID NO: 3807761 - RNA, 20 nt, Salmonella typhimurium LT2
uaaucacacaagucaccguu

SEQ ID NO: 3807762 - RNA, 15 nt, Salmonella typhimurium LT2
uaaucaccaccucaa

SEQ ID NO: 3807763 - RNA, 12 nt, Salmonella typhimurium LT2
uaaucaccagcc

SEQ ID NO: 3807764 - RNA, 15 nt, Salmonella typhimurium LT2
uaaucaccauggcgc

SEQ ID NO: 3807765 - RNA, 19 nt, Salmonella typhimurium LT2
uaaucacuaacuagccaua

SEQ ID NO: 3807766 - RNA, 16 nt, Salmonella typhimurium LT2
uaaucagcaucaccua

SEQ ID NO: 3807767 - RNA, 16 nt, Salmonella typhimurium LT2
uaaucaggacaucaaa

SEQ ID NO: 3807768 - RNA, 16 nt, Salmonella typhimurium LT2
uaaucaggagggcugc

SEQ ID NO: 3807769 - RNA, 16 nt, Salmonella typhimurium LT2
uaaucaguucaggaac

SEQ ID NO: 3807770 - RNA, 18 nt, Salmonella typhimurium LT2
uaaucaguucaggaacau

SEQ ID NO: 3807771 - RNA, 19 nt, Salmonella typhimurium LT2
uaaucaguucaggaacauc

SEQ ID NO: 3807772 - RNA, 19 nt, Salmonella typhimurium LT2
uaaucaucacgcuauggcc

SEQ ID NO: 3807773 - RNA, 11 nt, Salmonella typhimurium LT2
uaaucaucaua

SEQ ID NO: 3807774 - RNA, 22 nt, Salmonella typhimurium LT2
uaaucaugaacgcuaucggcau

SEQ ID NO: 3807775 - RNA, 12 nt, Salmonella typhimurium LT2
uaauccacaacg

SEQ ID NO: 3807776 - RNA, 16 nt, Salmonella typhimurium LT2
uaaucccgcauauuuu

SEQ ID NO: 3807777 - RNA, 23 nt, Salmonella typhimurium LT2
uaaucccgcggcggacagcggca

SEQ ID NO: 3807778 - RNA, 11 nt, Salmonella typhimurium LT2
uaaucccuugc

SEQ ID NO: 3807779 - RNA, 18 nt, Salmonella typhimurium LT2
uaauccgcugcaacuccc

SEQ ID NO: 3807780 - RNA, 22 nt, Salmonella typhimurium LT2
uaauccggcgaggcgauaaucu

SEQ ID NO: 3807781 - RNA, 17 nt, Salmonella typhimurium LT2
uaauccggucauccagc

SEQ ID NO: 3807782 - RNA, 20 nt, Salmonella typhimurium LT2
uaauccuuguccauguaaac

SEQ ID NO: 3807783 - RNA, 17 nt, Salmonella typhimurium LT2
uaaucgaaucgccucaa

SEQ ID NO: 3807784 - RNA, 14 nt, Salmonella typhimurium LT2
uaaucgcacggcuu

SEQ ID NO: 3807785 - RNA, 21 nt, Salmonella typhimurium LT2
uaaucgccauugcaauaccgg

SEQ ID NO: 3807786 - RNA, 15 nt, Salmonella typhimurium LT2
uaaucgcgagaaaau

SEQ ID NO: 3807787 - RNA, 18 nt, Salmonella typhimurium LT2
uaaucgcgagaaaauaga

SEQ ID NO: 3807788 - RNA, 21 nt, Salmonella typhimurium LT2
uaaucgcgauacugccgccca

SEQ ID NO: 3807789 - RNA, 15 nt, Salmonella typhimurium LT2
uaaucgcuucaauca

SEQ ID NO: 3807790 - RNA, 23 nt, Salmonella typhimurium LT2
uaaucggcggcgcgaccauaaug

SEQ ID NO: 3807791 - RNA, 19 nt, Salmonella typhimurium LT2
uaaucggcguggggcaggc

SEQ ID NO: 3807792 - RNA, 19 nt, Salmonella typhimurium LT2
uaaucgucccacaugaacu

SEQ ID NO: 3807793 - RNA, 16 nt, Salmonella typhimurium LT2
uaaucguguaaucuuu

SEQ ID NO: 3807794 - RNA, 13 nt, Salmonella typhimurium LT2
uaaucuacaaacg

SEQ ID NO: 3807795 - RNA, 12 nt, Salmonella typhimurium LT2
uaaucugaaaga

SEQ ID NO: 3807796 - RNA, 20 nt, Salmonella typhimurium LT2
uaaucuugagucgggccugc

SEQ ID NO: 3807797 - RNA, 15 nt, Salmonella typhimurium LT2
uaaucuugcgauagc

SEQ ID NO: 3807798 - RNA, 13 nt, Salmonella typhimurium LT2
uaaugaaccacac

SEQ ID NO: 3807799 - RNA, 19 nt, Salmonella typhimurium LT2
uaaugaagacguugaauau

SEQ ID NO: 3807800 - RNA, 15 nt, Salmonella typhimurium LT2
uaaugaauaaucucg

SEQ ID NO: 3807801 - RNA, 16 nt, Salmonella typhimurium LT2
uaaugacaaaaauuaa

SEQ ID NO: 3807802 - RNA, 16 nt, Salmonella typhimurium LT2
uaaugacauagugcaa

SEQ ID NO: 3807803 - RNA, 17 nt, Salmonella typhimurium LT2
uacacugauaccccagc

SEQ ID NO: 3807804 - RNA, 17 nt, Salmonella typhimurium LT2
uacacuucagccagacg

SEQ ID NO: 3807805 - RNA, 17 nt, Salmonella typhimurium LT2
uacagaaaaccggcaaa

SEQ ID NO: 3807806 - RNA, 21 nt, Salmonella typhimurium LT2
uacagaauccggcgcucauca

SEQ ID NO: 3807807 - RNA, 12 nt, Salmonella typhimurium LT2
uacagacaucau

SEQ ID NO: 3807808 - RNA, 22 nt, Salmonella typhimurium LT2
uacagacaucaucgaacgccgc

SEQ ID NO: 3807809 - RNA, 17 nt, Salmonella typhimurium LT2
uacagacgccaacgcgc

SEQ ID NO: 3807810 - RNA, 24 nt, Salmonella typhimurium LT2
uacagaugcugucuuagugaaaua

SEQ ID NO: 3807811 - RNA, 20 nt, Salmonella typhimurium LT2
uacagcaacgggacggcggc

SEQ ID NO: 3807812 - RNA, 17 nt, Salmonella typhimurium LT2
uacagcaauaaaaggaa

SEQ ID NO: 3807813 - RNA, 14 nt, Salmonella typhimurium LT2
uacagccaaaaaua

SEQ ID NO: 3807814 - RNA, 17 nt, Salmonella typhimurium LT2
uacagccaaaucagcag

SEQ ID NO: 3807815 - RNA, 21 nt, Salmonella typhimurium LT2
uacagccaaaucagcaggaca

SEQ ID NO: 3807816 - RNA, 20 nt, Salmonella typhimurium LT2
uacagcccgccagcaccagg

SEQ ID NO: 3807817 - RNA, 14 nt, Salmonella typhimurium LT2
uacagccgaagcca

SEQ ID NO: 3807818 - RNA, 21 nt, Salmonella typhimurium LT2
uacagccgacuauuccgcaaa

SEQ ID NO: 3807819 - RNA, 20 nt, Salmonella typhimurium LT2
uacagccuuguuuaccgcaa

SEQ ID NO: 3807820 - RNA, 19 nt, Salmonella typhimurium LT2
uacagccuuuugagcagca

SEQ ID NO: 3807821 - RNA, 15 nt, Salmonella typhimurium LT2
uacagcgcagcccau

SEQ ID NO: 3807822 - RNA, 14 nt, Salmonella typhimurium LT2
uacagcguaucggc

SEQ ID NO: 3807823 - RNA, 18 nt, Salmonella typhimurium LT2
uacagcucgucgucgcgg

SEQ ID NO: 3807824 - RNA, 16 nt, Salmonella typhimurium LT2
uacaggacauuugggg

SEQ ID NO: 3807825 - RNA, 13 nt, Salmonella typhimurium LT2
uacaggauacggc

SEQ ID NO: 3807826 - RNA, 23 nt, Salmonella typhimurium LT2
uacaggcaaucggccagguauug

SEQ ID NO: 3807827 - RNA, 17 nt, Salmonella typhimurium LT2
uacaggcaucuuccagc

SEQ ID NO: 3807828 - RNA, 17 nt, Salmonella typhimurium LT2
uacaggccgauauauug

SEQ ID NO: 3807829 - RNA, 15 nt, Salmonella typhimurium LT2
uacaggcguguggca

SEQ ID NO: 3807830 - RNA, 18 nt, Salmonella typhimurium LT2
uacaggcuuaacacccgg

SEQ ID NO: 3807831 - RNA, 20 nt, Salmonella typhimurium LT2
uacagggaauaugcugaucu

SEQ ID NO: 3807832 - RNA, 15 nt, Salmonella typhimurium LT2
uacagggcggcagga

SEQ ID NO: 3807833 - RNA, 12 nt, Salmonella typhimurium LT2
uacaggugcagg

SEQ ID NO: 3807834 - RNA, 17 nt, Salmonella typhimurium LT2
uacagguugugcaucuc

SEQ ID NO: 3807835 - RNA, 13 nt, Salmonella typhimurium LT2
uacaguuuaucug

SEQ ID NO: 3807836 - RNA, 15 nt, Salmonella typhimurium LT2
uacaguuuaucugcg

SEQ ID NO: 3807837 - RNA, 16 nt, Salmonella typhimurium LT2
uacaguuugucaucag

SEQ ID NO: 3807838 - RNA, 13 nt, Salmonella typhimurium LT2
uacauacugcuuu

SEQ ID NO: 3807839 - RNA, 19 nt, Salmonella typhimurium LT2
uacauagcaggccauaaug

SEQ ID NO: 3807840 - RNA, 15 nt, Salmonella typhimurium LT2
uacaucaauaaacau

SEQ ID NO: 3807841 - RNA, 15 nt, Salmonella typhimurium LT2
uacaucagaguaauu

SEQ ID NO: 3807842 - RNA, 14 nt, Salmonella typhimurium LT2
uacauccagcuaua

SEQ ID NO: 3807843 - RNA, 21 nt, Salmonella typhimurium LT2
uacauccaggaggcaaaaugc

SEQ ID NO: 3807844 - RNA, 18 nt, Salmonella typhimurium LT2
uacauccaucacuccuua

SEQ ID NO: 3807845 - RNA, 16 nt, Salmonella typhimurium LT2
uacauccggcaggcau

SEQ ID NO: 3807846 - RNA, 15 nt, Salmonella typhimurium LT2
uacaucgccacuacc

SEQ ID NO: 3807847 - RNA, 14 nt, Salmonella typhimurium LT2
uacaucgcgcuuaa

SEQ ID NO: 3807848 - RNA, 17 nt, Salmonella typhimurium LT2
uacaucguaaagcacca

SEQ ID NO: 3807849 - RNA, 14 nt, Salmonella typhimurium LT2
uacaucgucugcuu

SEQ ID NO: 3807850 - RNA, 20 nt, Salmonella typhimurium LT2
uacaucuuauuucaccggac

SEQ ID NO: 3807851 - RNA, 20 nt, Salmonella typhimurium LT2
uacauuaaugucaugaagcu

SEQ ID NO: 3807852 - RNA, 17 nt, Salmonella typhimurium LT2
uacauuauugcacauaa

SEQ ID NO: 3807853 - RNA, 22 nt, Salmonella typhimurium LT2
uacauuuuguauucgcagggcu

SEQ ID NO: 3807854 - RNA, 14 nt, Salmonella typhimurium LT2
uaccaaacagcaga

SEQ ID NO: 3807855 - RNA, 19 nt, Salmonella typhimurium LT2
uaccaaacccuuuggcaaa

SEQ ID NO: 3807856 - RNA, 19 nt, Salmonella typhimurium LT2
uaccaaagcccgcaaacag

SEQ ID NO: 3807857 - RNA, 17 nt, Salmonella typhimurium LT2
uaccaaagucaucaauu

SEQ ID NO: 3807858 - RNA, 14 nt, Salmonella typhimurium LT2
uaccaacugagcua

SEQ ID NO: 3807859 - RNA, 16 nt, Salmonella typhimurium LT2
uaccaagucucaagag

SEQ ID NO: 3807860 - RNA, 18 nt, Salmonella typhimurium LT2
uaccaauacccagcgcca

SEQ ID NO: 3807861 - RNA, 17 nt, Salmonella typhimurium LT2
uaccaauucccagaccc

SEQ ID NO: 3807862 - RNA, 19 nt, Salmonella typhimurium LT2
uaccaauuuucucgccgau

SEQ ID NO: 3807863 - RNA, 21 nt, Salmonella typhimurium LT2
uaccaauuuucucgccgauag

SEQ ID NO: 3807864 - RNA, 17 nt, Salmonella typhimurium LT2
uaccacaacaagaauau

SEQ ID NO: 3807865 - RNA, 20 nt, Salmonella typhimurium LT2
uaccacaacaagaauauauu

SEQ ID NO: 3807866 - RNA, 18 nt, Salmonella typhimurium LT2
uaccacagaaaucgccgg

SEQ ID NO: 3807867 - RNA, 14 nt, Salmonella typhimurium LT2
uaccaccacgccuu

SEQ ID NO: 3807868 - RNA, 13 nt, Salmonella typhimurium LT2
uaccacgccgcac

SEQ ID NO: 3807869 - RNA, 18 nt, Salmonella typhimurium LT2
uaccacgccgcacacagc

SEQ ID NO: 3807870 - RNA, 23 nt, Salmonella typhimurium LT2
uaccacuaacagugcgcguagcg

SEQ ID NO: 3807871 - RNA, 17 nt, Salmonella typhimurium LT2
uaccacugguuaaugcc

SEQ ID NO: 3807872 - RNA, 18 nt, Salmonella typhimurium LT2
uaccagaacucguugcca

SEQ ID NO: 3807873 - RNA, 15 nt, Salmonella typhimurium LT2
uaccagcaacgccag

SEQ ID NO: 3807874 - RNA, 15 nt, Salmonella typhimurium LT2
uaccagcaacugacc

SEQ ID NO: 3807875 - RNA, 15 nt, Salmonella typhimurium LT2
uaccagcaucgcguu

SEQ ID NO: 3807876 - RNA, 20 nt, Salmonella typhimurium LT2
uaccagccaacaguauagaa

SEQ ID NO: 3807877 - RNA, 22 nt, Salmonella typhimurium LT2
uaccagccgagugcuuauguag

SEQ ID NO: 3807878 - RNA, 23 nt, Salmonella typhimurium LT2
uaccagccuucggacugcuggua

SEQ ID NO: 3807879 - RNA, 17 nt, Salmonella typhimurium LT2
uaccagcgucaucggau

SEQ ID NO: 3807880 - RNA, 22 nt, Salmonella typhimurium LT2
uaccaggcauaauggaacugcc

SEQ ID NO: 3807881 - RNA, 23 nt, Salmonella typhimurium LT2
uaccaggcauaauggaacugccu

SEQ ID NO: 3807882 - RNA, 23 nt, Salmonella typhimurium LT2
uaccaggcggcuuuuucaucauc

SEQ ID NO: 3807883 - RNA, 21 nt, Salmonella typhimurium LT2
uaccaggcgguaugauacagu

SEQ ID NO: 3807884 - RNA, 19 nt, Salmonella typhimurium LT2
uaccaucggcgcuacggcg

SEQ ID NO: 3807885 - RNA, 13 nt, Salmonella typhimurium LT2
uacccaaaauaau

SEQ ID NO: 3807886 - RNA, 14 nt, Salmonella typhimurium LT2
uacccaacagcaga

SEQ ID NO: 3807887 - RNA, 21 nt, Salmonella typhimurium LT2
uacccaacagcagacagccga

SEQ ID NO: 3807888 - RNA, 19 nt, Salmonella typhimurium LT2
uacccacuucuuccagcgu

SEQ ID NO: 3807889 - RNA, 21 nt, Salmonella typhimurium LT2
uacccagcgccaacgccacug

SEQ ID NO: 3807890 - RNA, 22 nt, Salmonella typhimurium LT2
uacccagcgccaacgccacugc

SEQ ID NO: 3807891 - RNA, 15 nt, Salmonella typhimurium LT2
uacccagcucagcuu

SEQ ID NO: 3807892 - RNA, 23 nt, Salmonella typhimurium LT2
uacccagcuuucucacuugcaga

SEQ ID NO: 3807893 - RNA, 20 nt, Salmonella typhimurium LT2
uacccaggcgucgaacuccu

SEQ ID NO: 3807894 - RNA, 20 nt, Salmonella typhimurium LT2
uacccauuucuucuucaagc

SEQ ID NO: 3807895 - RNA, 13 nt, Salmonella typhimurium LT2
uaccccagcaucu

SEQ ID NO: 3807896 - RNA, 13 nt, Salmonella typhimurium LT2
uaccccagcgcgc

SEQ ID NO: 3807897 - RNA, 23 nt, Salmonella typhimurium LT2
uaccccagcgcgccgcagcgccg

SEQ ID NO: 3807898 - RNA, 20 nt, Salmonella typhimurium LT2
uaccccaucauugacuucaa

SEQ ID NO: 3807899 - RNA, 22 nt, Salmonella typhimurium LT2
uaccccgcagcgaaaauccagu

SEQ ID NO: 3807900 - RNA, 21 nt, Salmonella typhimurium LT2
uaccccucuuucacagcuccu

SEQ ID NO: 3807901 - RNA, 21 nt, Salmonella typhimurium LT2
uacccgacagcggcgcagaca

SEQ ID NO: 3807902 - RNA, 14 nt, Salmonella typhimurium LT2
uacccgcacgcuuu

SEQ ID NO: 3807903 - RNA, 21 nt, Salmonella typhimurium LT2
uacccgcacgcuuucuucguu

SEQ ID NO: 3807904 - RNA, 19 nt, Salmonella typhimurium LT2
uacccgcgcaucccacacc

SEQ ID NO: 3807905 - RNA, 21 nt, Salmonella typhimurium LT2
uacccgcgcaucccacaccac

SEQ ID NO: 3807906 - RNA, 13 nt, Salmonella typhimurium LT2
uacgccgccgccc

SEQ ID NO: 3807907 - RNA, 24 nt, Salmonella typhimurium LT2
uacgccuaaauuuaacucguccug

SEQ ID NO: 3807908 - RNA, 15 nt, Salmonella typhimurium LT2
uacgccuuacccggc

SEQ ID NO: 3807909 - RNA, 20 nt, Salmonella typhimurium LT2
uacgccuuacccggccuaca

SEQ ID NO: 3807910 - RNA, 18 nt, Salmonella typhimurium LT2
uacgcgacgcauugccau

SEQ ID NO: 3807911 - RNA, 13 nt, Salmonella typhimurium LT2
uacgcgacgugcu

SEQ ID NO: 3807912 - RNA, 21 nt, Salmonella typhimurium LT2
uacgcgaugagauaauaaaug

SEQ ID NO: 3807913 - RNA, 18 nt, Salmonella typhimurium LT2
uacgcgccacgccauugc

SEQ ID NO: 3807914 - RNA, 16 nt, Salmonella typhimurium LT2
uacgcgcgcggcguca

SEQ ID NO: 3807915 - RNA, 17 nt, Salmonella typhimurium LT2
uacgcgcugcaaauacu

SEQ ID NO: 3807916 - RNA, 23 nt, Salmonella typhimurium LT2
uacgcggccaaaacccaccagca

SEQ ID NO: 3807917 - RNA, 16 nt, Salmonella typhimurium LT2
uacgcggcguaccgcg

SEQ ID NO: 3807918 - RNA, 20 nt, Salmonella typhimurium LT2
uacgcgggcucguugcgucg

SEQ ID NO: 3807919 - RNA, 22 nt, Salmonella typhimurium LT2
uacgcggucuuuuaaaagaccu

SEQ ID NO: 3807920 - RNA, 20 nt, Salmonella typhimurium LT2
uacgcggugcgccguaaaca

SEQ ID NO: 3807921 - RNA, 22 nt, Salmonella typhimurium LT2
uacgcggugcgccguaaacaau

SEQ ID NO: 3807922 - RNA, 17 nt, Salmonella typhimurium LT2
uacgcgucaaagcacau

SEQ ID NO: 3807923 - RNA, 15 nt, Salmonella typhimurium LT2
uacgcgucaauuacc

SEQ ID NO: 3807924 - RNA, 20 nt, Salmonella typhimurium LT2
uacgcgucugucgaaacugg

SEQ ID NO: 3807925 - RNA, 18 nt, Salmonella typhimurium LT2
uacgcguuucacaaccuc

SEQ ID NO: 3807926 - RNA, 15 nt, Salmonella typhimurium LT2
uacgcuauuuaaaaa

SEQ ID NO: 3807927 - RNA, 16 nt, Salmonella typhimurium LT2
uacgcuauuuaaaaac

SEQ ID NO: 3807928 - RNA, 18 nt, Salmonella typhimurium LT2
uacgcucauaaaaaagaa

SEQ ID NO: 3807929 - RNA, 19 nt, Salmonella typhimurium LT2
uacgcuccugcgguacggc

SEQ ID NO: 3807930 - RNA, 21 nt, Salmonella typhimurium LT2
uacgcucuugacguguuucau

SEQ ID NO: 3807931 - RNA, 18 nt, Salmonella typhimurium LT2
uacgcuuaauggcgucaa

SEQ ID NO: 3807932 - RNA, 19 nt, Salmonella typhimurium LT2
uacgcuuaucaggccuacc

SEQ ID NO: 3807933 - RNA, 21 nt, Salmonella typhimurium LT2
uacgcuuaucccagccgcgau

SEQ ID NO: 3807934 - RNA, 16 nt, Salmonella typhimurium LT2
uacgcuuccugccgug

SEQ ID NO: 3807935 - RNA, 21 nt, Salmonella typhimurium LT2
uacgcuucggcuccagcgccu

SEQ ID NO: 3807936 - RNA, 15 nt, Salmonella typhimurium LT2
uacggaaaaaauacu

SEQ ID NO: 3807937 - RNA, 12 nt, Salmonella typhimurium LT2
uacggaaaaaug

SEQ ID NO: 3807938 - RNA, 16 nt, Salmonella typhimurium LT2
uacggacagaaaaaau

SEQ ID NO: 3807939 - RNA, 23 nt, Salmonella typhimurium LT2
uacggacguggggguucaagucc

SEQ ID NO: 3807940 - RNA, 16 nt, Salmonella typhimurium LT2
uacggagcaaaaaacg

SEQ ID NO: 3807941 - RNA, 23 nt, Salmonella typhimurium LT2
uacggagcaaaaaacgagaacac

SEQ ID NO: 3807942 - RNA, 13 nt, Salmonella typhimurium LT2
uacggcaaaaaua

SEQ ID NO: 3807943 - RNA, 11 nt, Salmonella typhimurium LT2
uacggcaggcc

SEQ ID NO: 3807944 - RNA, 14 nt, Salmonella typhimurium LT2
uacggcaucggaac

SEQ ID NO: 3807945 - RNA, 13 nt, Salmonella typhimurium LT2
uacggcgcgccac

SEQ ID NO: 3807946 - RNA, 16 nt, Salmonella typhimurium LT2
uacggcgcgccaccau

SEQ ID NO: 3807947 - RNA, 16 nt, Salmonella typhimurium LT2
uacggcuccagcacau

SEQ ID NO: 3807948 - RNA, 21 nt, Salmonella typhimurium LT2
uacgggaauuccaguccuuuc

SEQ ID NO: 3807949 - RNA, 22 nt, Salmonella typhimurium LT2
uacgggagagcguauccagcac

SEQ ID NO: 3807950 - RNA, 15 nt, Salmonella typhimurium LT2
uacgggcagcggcuu

SEQ ID NO: 3807951 - RNA, 18 nt, Salmonella typhimurium LT2
uacgggcaugaagaaaau

SEQ ID NO: 3807952 - RNA, 16 nt, Salmonella typhimurium LT2
uacgggucugaauagc

SEQ ID NO: 3807953 - RNA, 21 nt, Salmonella typhimurium LT2
uacgguccguuuucgccccca

SEQ ID NO: 3807954 - RNA, 19 nt, Salmonella typhimurium LT2
uacggucgacaccagcgau

SEQ ID NO: 3807955 - RNA, 14 nt, Salmonella typhimurium LT2
uacgguuagcgaac

SEQ ID NO: 3807956 - RNA, 21 nt, Salmonella typhimurium LT2
uacguaacugcgguaaauaau

SEQ ID NO: 3807957 - RNA, 16 nt, Salmonella typhimurium LT2
uacguacugaaauaac

SEQ ID NO: 3807958 - RNA, 18 nt, Salmonella typhimurium LT2
uacguccaccguuacgcc

SEQ ID NO: 3807959 - RNA, 12 nt, Salmonella typhimurium LT2
uacguccauccg

SEQ ID NO: 3807960 - RNA, 22 nt, Salmonella typhimurium LT2
uacgucgccgucuggggaaacc

SEQ ID NO: 3807961 - RNA, 16 nt, Salmonella typhimurium LT2
uacgugaaacugauag

SEQ ID NO: 3807962 - RNA, 22 nt, Salmonella typhimurium LT2
uacgugaaauaacguuaacgcc

SEQ ID NO: 3807963 - RNA, 22 nt, Salmonella typhimurium LT2
uacguucaacgggaaaaaauua

SEQ ID NO: 3807964 - RNA, 14 nt, Salmonella typhimurium LT2
uacguugcggcgcg

SEQ ID NO: 3807965 - RNA, 23 nt, Salmonella typhimurium LT2
uacguuggagaggaauuguccac

SEQ ID NO: 3807966 - RNA, 19 nt, Salmonella typhimurium LT2
uacguuuaucuggcuuaca

SEQ ID NO: 3807967 - RNA, 18 nt, Salmonella typhimurium LT2
uacuauaacgcgcugcug

SEQ ID NO: 3807968 - RNA, 16 nt, Salmonella typhimurium LT2
uacuauagauauuaaa

SEQ ID NO: 3807969 - RNA, 21 nt, Salmonella typhimurium LT2
uacucaaaccugcgccgcgau

SEQ ID NO: 3807970 - RNA, 14 nt, Salmonella typhimurium LT2
uacucaacaucauu

SEQ ID NO: 3807971 - RNA, 16 nt, Salmonella typhimurium LT2
uacucacauucauaaa

SEQ ID NO: 3807972 - RNA, 20 nt, Salmonella typhimurium LT2
uacucacauucauaaaagau

SEQ ID NO: 3807973 - RNA, 13 nt, Salmonella typhimurium LT2
uacucagcgucau

SEQ ID NO: 3807974 - RNA, 15 nt, Salmonella typhimurium LT2
uacucagggcgaaaa

SEQ ID NO: 3807975 - RNA, 23 nt, Salmonella typhimurium LT2
uacucauccauuuccguuuucag

SEQ ID NO: 3807976 - RNA, 21 nt, Salmonella typhimurium LT2
uacuccagcccaucagucccc

SEQ ID NO: 3807977 - RNA, 18 nt, Salmonella typhimurium LT2
uacuccauucccagcucu

SEQ ID NO: 3807978 - RNA, 16 nt, Salmonella typhimurium LT2
uacuccgacggcgagc

SEQ ID NO: 3807979 - RNA, 16 nt, Salmonella typhimurium LT2
uacuccugcaacagaa

SEQ ID NO: 3807980 - RNA, 18 nt, Salmonella typhimurium LT2
uacuccugcaucguuuug

SEQ ID NO: 3807981 - RNA, 20 nt, Salmonella typhimurium LT2
uacucgacgcacuccagaug

SEQ ID NO: 3807982 - RNA, 22 nt, Salmonella typhimurium LT2
uacucgccaauauccccagccc

SEQ ID NO: 3807983 - RNA, 17 nt, Salmonella typhimurium LT2
uacucugcucgccagua

SEQ ID NO: 3807984 - RNA, 16 nt, Salmonella typhimurium LT2
uacucugcuuuuucac

SEQ ID NO: 3807985 - RNA, 13 nt, Salmonella typhimurium LT2
uacucuucacccu

SEQ ID NO: 3807986 - RNA, 12 nt, Salmonella typhimurium LT2
uacucuuccucc

SEQ ID NO: 3807987 - RNA, 19 nt, Salmonella typhimurium LT2
uacucuuggagagcaucau

SEQ ID NO: 3807988 - RNA, 13 nt, Salmonella typhimurium LT2
uacucuuuuuccg

SEQ ID NO: 3807989 - RNA, 18 nt, Salmonella typhimurium LT2
uacugaacuauaggaaaa

SEQ ID NO: 3807990 - RNA, 19 nt, Salmonella typhimurium LT2
uacugaauaacagcaccau

SEQ ID NO: 3807991 - RNA, 16 nt, Salmonella typhimurium LT2
uacugaauaccuucuu

SEQ ID NO: 3807992 - RNA, 19 nt, Salmonella typhimurium LT2
uacugaauauuccuuucuu

SEQ ID NO: 3807993 - RNA, 20 nt, Salmonella typhimurium LT2
uacugaccaagcgucagcau

SEQ ID NO: 3807994 - RNA, 16 nt, Salmonella typhimurium LT2
uacugaccggcccguu

SEQ ID NO: 3807995 - RNA, 14 nt, Salmonella typhimurium LT2
uacugacuuaauaa

SEQ ID NO: 3807996 - RNA, 14 nt, Salmonella typhimurium LT2
uacugauaagcaua

SEQ ID NO: 3807997 - RNA, 16 nt, Salmonella typhimurium LT2
uacugcaacgccagau

SEQ ID NO: 3807998 - RNA, 19 nt, Salmonella typhimurium LT2
uacugccaaccaucaacuc

SEQ ID NO: 3807999 - RNA, 22 nt, Salmonella typhimurium LT2
uacugccgcccaucgccacagc

SEQ ID NO: 3808000 - RNA, 19 nt, Salmonella typhimurium LT2
uacugcgaucgccggcaau

SEQ ID NO: 3808001 - RNA, 20 nt, Salmonella typhimurium LT2
uacugcgcccgcaagcugca

SEQ ID NO: 3808002 - RNA, 17 nt, Salmonella typhimurium LT2
uacugcguccggcgaau

SEQ ID NO: 3808003 - RNA, 23 nt, Salmonella typhimurium LT2
uacugcucauaacccuccugccu

SEQ ID NO: 3808004 - RNA, 18 nt, Salmonella typhimurium LT2
uacugcuguccgccagca

SEQ ID NO: 3808005 - RNA, 20 nt, Salmonella typhimurium LT2
uacugcuuagcucaucagcc

SEQ ID NO: 3808006 - RNA, 17 nt, Salmonella typhimurium LT2
uacugcuuuaauaccgg

SEQ ID NO: 3808007 - RNA, 23 nt, Salmonella typhimurium LT2
uacugggucgcguuuaccgccgc

SEQ ID NO: 3808008 - RNA, 19 nt, Salmonella typhimurium LT2
uacuuaacacccguagccc

SEQ ID NO: 3808009 - RNA, 13 nt, Salmonella typhimurium LT2
uagccuuuuucgc

SEQ ID NO: 3808010 - RNA, 15 nt, Salmonella typhimurium LT2
uagcgaaacaguugg

SEQ ID NO: 3808011 - RNA, 14 nt, Salmonella typhimurium LT2
uagcgaaacugccu

SEQ ID NO: 3808012 - RNA, 16 nt, Salmonella typhimurium LT2
uagcgaaauguucguc

SEQ ID NO: 3808013 - RNA, 14 nt, Salmonella typhimurium LT2
uagcgacauacaua

SEQ ID NO: 3808014 - RNA, 16 nt, Salmonella typhimurium LT2
uagcgaccgcgguaac

SEQ ID NO: 3808015 - RNA, 20 nt, Salmonella typhimurium LT2
uagcgagaaggcuuuuccau

SEQ ID NO: 3808016 - RNA, 13 nt, Salmonella typhimurium LT2
uagcgauacugac

SEQ ID NO: 3808017 - RNA, 15 nt, Salmonella typhimurium LT2
uagcgaucagcgcca

SEQ ID NO: 3808018 - RNA, 18 nt, Salmonella typhimurium LT2
uagcgcaaauauccuacc

SEQ ID NO: 3808019 - RNA, 19 nt, Salmonella typhimurium LT2
uagcgcaggggggaaauga

SEQ ID NO: 3808020 - RNA, 19 nt, Salmonella typhimurium LT2
uagcgcaguaauuucuugc

SEQ ID NO: 3808021 - RNA, 20 nt, Salmonella typhimurium LT2
uagcgcagucaagcuugccg

SEQ ID NO: 3808022 - RNA, 14 nt, Salmonella typhimurium LT2
uagcgccacgcgau

SEQ ID NO: 3808023 - RNA, 22 nt, Salmonella typhimurium LT2
uagcgccagacagauaacacca

SEQ ID NO: 3808024 - RNA, 14 nt, Salmonella typhimurium LT2
uagcgccagcagca

SEQ ID NO: 3808025 - RNA, 16 nt, Salmonella typhimurium LT2
uagcgccagcagcaua

SEQ ID NO: 3808026 - RNA, 14 nt, Salmonella typhimurium LT2
uagcgccaucagac

SEQ ID NO: 3808027 - RNA, 14 nt, Salmonella typhimurium LT2
uagcgccuacgggc

SEQ ID NO: 3808028 - RNA, 22 nt, Salmonella typhimurium LT2
uagcgccuccccuaaucgagga

SEQ ID NO: 3808029 - RNA, 12 nt, Salmonella typhimurium LT2
uagcgccugcuc

SEQ ID NO: 3808030 - RNA, 21 nt, Salmonella typhimurium LT2
uagcgccuuguuuucaucugc

SEQ ID NO: 3808031 - RNA, 21 nt, Salmonella typhimurium LT2
uagcgcgcgcuaauuuucagg

SEQ ID NO: 3808032 - RNA, 12 nt, Salmonella typhimurium LT2
uagcgcgcugcu

SEQ ID NO: 3808033 - RNA, 15 nt, Salmonella typhimurium LT2
uagcgcgcuuccugc

SEQ ID NO: 3808034 - RNA, 16 nt, Salmonella typhimurium LT2
uagcgcgcuuccugcc

SEQ ID NO: 3808035 - RNA, 16 nt, Salmonella typhimurium LT2
uagcgcggcagcgcgc

SEQ ID NO: 3808036 - RNA, 20 nt, Salmonella typhimurium LT2
uagcgcguuaccgcucaaac

SEQ ID NO: 3808037 - RNA, 19 nt, Salmonella typhimurium LT2
uagcgcugaagcccgcgau

SEQ ID NO: 3808038 - RNA, 17 nt, Salmonella typhimurium LT2
uagcgcugagcguagau

SEQ ID NO: 3808039 - RNA, 21 nt, Salmonella typhimurium LT2
uagcgcugagcguagauauac

SEQ ID NO: 3808040 - RNA, 17 nt, Salmonella typhimurium LT2
uagcgcuuuccaguccc

SEQ ID NO: 3808041 - RNA, 15 nt, Salmonella typhimurium LT2
uagcgcuuuuuccag

SEQ ID NO: 3808042 - RNA, 13 nt, Salmonella typhimurium LT2
uagcggcagcacg

SEQ ID NO: 3808043 - RNA, 21 nt, Salmonella typhimurium LT2
uagcggcagccaugcuauuca

SEQ ID NO: 3808044 - RNA, 21 nt, Salmonella typhimurium LT2
uagcggcguuuauauaaaaau

SEQ ID NO: 3808045 - RNA, 20 nt, Salmonella typhimurium LT2
uagcggcuaaucaccaccuc

SEQ ID NO: 3808046 - RNA, 15 nt, Salmonella typhimurium LT2
uagcggcucaggaag

SEQ ID NO: 3808047 - RNA, 18 nt, Salmonella typhimurium LT2
uagcgggcaaugccacca

SEQ ID NO: 3808048 - RNA, 21 nt, Salmonella typhimurium LT2
uagcgggcuguuuuccagcgg

SEQ ID NO: 3808049 - RNA, 20 nt, Salmonella typhimurium LT2
uagcguauccggcaagucag

SEQ ID NO: 3808050 - RNA, 18 nt, Salmonella typhimurium LT2
uagcgucaacgcuuuuau

SEQ ID NO: 3808051 - RNA, 13 nt, Salmonella typhimurium LT2
uagcgugacggca

SEQ ID NO: 3808052 - RNA, 17 nt, Salmonella typhimurium LT2
uagcgugccgacguuca

SEQ ID NO: 3808053 - RNA, 16 nt, Salmonella typhimurium LT2
uagcguguguuuuccu

SEQ ID NO: 3808054 - RNA, 18 nt, Salmonella typhimurium LT2
uagcguucauucccgcca

SEQ ID NO: 3808055 - RNA, 13 nt, Salmonella typhimurium LT2
uagcguugauaug

SEQ ID NO: 3808056 - RNA, 13 nt, Salmonella typhimurium LT2
uagcguuuuccag

SEQ ID NO: 3808057 - RNA, 15 nt, Salmonella typhimurium LT2
uagcuaaauuaaaaa

SEQ ID NO: 3808058 - RNA, 16 nt, Salmonella typhimurium LT2
uagcuaaauuaaaaau

SEQ ID NO: 3808059 - RNA, 22 nt, Salmonella typhimurium LT2
uagcuaaauuaaaaauaaucag

SEQ ID NO: 3808060 - RNA, 15 nt, Salmonella typhimurium LT2
uagcuaaugauuauc

SEQ ID NO: 3808061 - RNA, 20 nt, Salmonella typhimurium LT2
uagcucaguugguuagagca

SEQ ID NO: 3808062 - RNA, 14 nt, Salmonella typhimurium LT2
uagcugcccggaua

SEQ ID NO: 3808063 - RNA, 21 nt, Salmonella typhimurium LT2
uagcugcggcuauauaaaauc

SEQ ID NO: 3808064 - RNA, 17 nt, Salmonella typhimurium LT2
uagcugcggcucgccaa

SEQ ID NO: 3808065 - RNA, 19 nt, Salmonella typhimurium LT2
uagcuggcaagaccgauag

SEQ ID NO: 3808066 - RNA, 13 nt, Salmonella typhimurium LT2
uagcuggcagggg

SEQ ID NO: 3808067 - RNA, 21 nt, Salmonella typhimurium LT2
uagcuguaccagaucgccugc

SEQ ID NO: 3808068 - RNA, 23 nt, Salmonella typhimurium LT2
uagcugucccagcgucaacugcg

SEQ ID NO: 3808069 - RNA, 15 nt, Salmonella typhimurium LT2
uagcuuaaaaaaucc

SEQ ID NO: 3808070 - RNA, 16 nt, Salmonella typhimurium LT2
uagcuuugccacuggc

SEQ ID NO: 3808071 - RNA, 19 nt, Salmonella typhimurium LT2
uaggaguaaauaauuuugu

SEQ ID NO: 3808072 - RNA, 17 nt, Salmonella typhimurium LT2
uaggauaacuuuuacca

SEQ ID NO: 3808073 - RNA, 18 nt, Salmonella typhimurium LT2
uaggauauccugcucgcc

SEQ ID NO: 3808074 - RNA, 17 nt, Salmonella typhimurium LT2
uaggaucaaccaccuuc

SEQ ID NO: 3808075 - RNA, 17 nt, Salmonella typhimurium LT2
uaggcaacaauuucuac

SEQ ID NO: 3808076 - RNA, 15 nt, Salmonella typhimurium LT2
uaggcacuuuccaga

SEQ ID NO: 3808077 - RNA, 15 nt, Salmonella typhimurium LT2
uaggcaggaaaucca

SEQ ID NO: 3808078 - RNA, 21 nt, Salmonella typhimurium LT2
uaggccagccgacgcucuucc

SEQ ID NO: 3808079 - RNA, 12 nt, Salmonella typhimurium LT2
uaggccggauaa

SEQ ID NO: 3808080 - RNA, 20 nt, Salmonella typhimurium LT2
uaggccggauaagcauuagc

SEQ ID NO: 3808081 - RNA, 19 nt, Salmonella typhimurium LT2
uaggccggauaagcgcagc

SEQ ID NO: 3808082 - RNA, 20 nt, Salmonella typhimurium LT2
uaggccggauaagcgugagc

SEQ ID NO: 3808083 - RNA, 17 nt, Salmonella typhimurium LT2
uaggccggauaagcguu

SEQ ID NO: 3808084 - RNA, 17 nt, Salmonella typhimurium LT2
uaggccggauaaggcgu

SEQ ID NO: 3808085 - RNA, 20 nt, Salmonella typhimurium LT2
uaggccggauaaggcguaac

SEQ ID NO: 3808086 - RNA, 16 nt, Salmonella typhimurium LT2
uaggccggauaaggug

SEQ ID NO: 3808087 - RNA, 13 nt, Salmonella typhimurium LT2
uaggccugauaag

SEQ ID NO: 3808088 - RNA, 19 nt, Salmonella typhimurium LT2
uaggccugauaagcgcagc

SEQ ID NO: 3808089 - RNA, 18 nt, Salmonella typhimurium LT2
uaggccugauaagcguag

SEQ ID NO: 3808090 - RNA, 18 nt, Salmonella typhimurium LT2
uaggccugguaagcguag

SEQ ID NO: 3808091 - RNA, 14 nt, Salmonella typhimurium LT2
uaggcgacaggcgu

SEQ ID NO: 3808092 - RNA, 14 nt, Salmonella typhimurium LT2
uaggcgccaagcac

SEQ ID NO: 3808093 - RNA, 17 nt, Salmonella typhimurium LT2
uaggcgccgccgacaau

SEQ ID NO: 3808094 - RNA, 22 nt, Salmonella typhimurium LT2
uaggcguaaagauuagaauagc

SEQ ID NO: 3808095 - RNA, 20 nt, Salmonella typhimurium LT2
uaggcucaauaugccaggca

SEQ ID NO: 3808096 - RNA, 21 nt, Salmonella typhimurium LT2
uaggcugaauacguauuggaa

SEQ ID NO: 3808097 - RNA, 17 nt, Salmonella typhimurium LT2
uaggcuuuugguucaaa

SEQ ID NO: 3808098 - RNA, 18 nt, Salmonella typhimurium LT2
uagggcgcggcugguaag

SEQ ID NO: 3808099 - RNA, 16 nt, Salmonella typhimurium LT2
uagggggcuaccggag

SEQ ID NO: 3808100 - RNA, 21 nt, Salmonella typhimurium LT2
uagguaagauauuuuguuuua

SEQ ID NO: 3808101 - RNA, 20 nt, Salmonella typhimurium LT2
uaggucagguaagcgcuagc

SEQ ID NO: 3808102 - RNA, 22 nt, Salmonella typhimurium LT2
uagguucgguaugccuuccaga

SEQ ID NO: 3808103 - RNA, 18 nt, Salmonella typhimurium LT2
uagguucugcgaggugau

SEQ ID NO: 3808104 - RNA, 16 nt, Salmonella typhimurium LT2
uagguugcgccaacgu

SEQ ID NO: 3808105 - RNA, 22 nt, Salmonella typhimurium LT2
uaguaaacggcgcugaaaggca

SEQ ID NO: 3808106 - RNA, 17 nt, Salmonella typhimurium LT2
uaguaauaaagcguagc

SEQ ID NO: 3808107 - RNA, 18 nt, Salmonella typhimurium LT2
uaguaauaaagcguagcc

SEQ ID NO: 3808108 - RNA, 15 nt, Salmonella typhimurium LT2
uaguaauauuaaaag

SEQ ID NO: 3808109 - RNA, 15 nt, Salmonella typhimurium LT2
uaguaaugcaugguc

SEQ ID NO: 3808110 - RNA, 15 nt, Salmonella typhimurium LT2
uaguaaugcgcgaau

SEQ ID NO: 3808111 - RNA, 16 nt, Salmonella typhimurium LT2
uaguaguuauaaaucc

SEQ ID NO: 3808112 - RNA, 14 nt, Salmonella typhimurium LT2
uaguaucauauuuu

SEQ ID NO: 3808113 - RNA, 22 nt, Salmonella typhimurium LT2
uaucaaacugaaaaucaaauaa

SEQ ID NO: 3808114 - RNA, 17 nt, Salmonella typhimurium LT2
uaucaacgggaacuuuc

SEQ ID NO: 3808115 - RNA, 19 nt, Salmonella typhimurium LT2
uaucaagaaaacugccagg

SEQ ID NO: 3808116 - RNA, 12 nt, Salmonella typhimurium LT2
uaucaagccuac

SEQ ID NO: 3808117 - RNA, 15 nt, Salmonella typhimurium LT2
uaucaauaaccgcca

SEQ ID NO: 3808118 - RNA, 17 nt, Salmonella typhimurium LT2
uaucaaucauauaaucu

SEQ ID NO: 3808119 - RNA, 18 nt, Salmonella typhimurium LT2
uaucaaugccgcgagaaa

SEQ ID NO: 3808120 - RNA, 15 nt, Salmonella typhimurium LT2
uaucaaugcgcguaa

SEQ ID NO: 3808121 - RNA, 17 nt, Salmonella typhimurium LT2
uaucacagaugacagag

SEQ ID NO: 3808122 - RNA, 16 nt, Salmonella typhimurium LT2
uaucaccccagguuga

SEQ ID NO: 3808123 - RNA, 24 nt, Salmonella typhimurium LT2
uaucacccugaauuucaauaaucc

SEQ ID NO: 3808124 - RNA, 15 nt, Salmonella typhimurium LT2
uaucagacaaucugu

SEQ ID NO: 3808125 - RNA, 16 nt, Salmonella typhimurium LT2
uaucagaccugccuga

SEQ ID NO: 3808126 - RNA, 21 nt, Salmonella typhimurium LT2
uaucagaugugguauuuucua

SEQ ID NO: 3808127 - RNA, 19 nt, Salmonella typhimurium LT2
uaucagccauuaaccagau

SEQ ID NO: 3808128 - RNA, 16 nt, Salmonella typhimurium LT2
uaucagccgccaguaa

SEQ ID NO: 3808129 - RNA, 18 nt, Salmonella typhimurium LT2
uaucagcgcguuuuccau

SEQ ID NO: 3808130 - RNA, 23 nt, Salmonella typhimurium LT2
uaucaggauaauuucacccguau

SEQ ID NO: 3808131 - RNA, 20 nt, Salmonella typhimurium LT2
uaucaggaucaaaaucgcgc

SEQ ID NO: 3808132 - RNA, 21 nt, Salmonella typhimurium LT2
uaucaggcaauacgcugccgg

SEQ ID NO: 3808133 - RNA, 20 nt, Salmonella typhimurium LT2
uaucaggccgacaaaugacg

SEQ ID NO: 3808134 - RNA, 15 nt, Salmonella typhimurium LT2
uaucaggccuacgac

SEQ ID NO: 3808135 - RNA, 23 nt, Salmonella typhimurium LT2
uaucaggcugagcgacgguuuua

SEQ ID NO: 3808136 - RNA, 23 nt, Salmonella typhimurium LT2
uaucaguccccacauuacgccca

SEQ ID NO: 3808137 - RNA, 17 nt, Salmonella typhimurium LT2
uaucaguuaugacagac

SEQ ID NO: 3808138 - RNA, 14 nt, Salmonella typhimurium LT2
uaucauauuuucuu

SEQ ID NO: 3808139 - RNA, 20 nt, Salmonella typhimurium LT2
uaucaucuugcuuaagccag

SEQ ID NO: 3808140 - RNA, 13 nt, Salmonella typhimurium LT2
uaucauuauguca

SEQ ID NO: 3808141 - RNA, 18 nt, Salmonella typhimurium LT2
uaucauuuugauucaguu

SEQ ID NO: 3808142 - RNA, 13 nt, Salmonella typhimurium LT2
uauccaauaauaa

SEQ ID NO: 3808143 - RNA, 17 nt, Salmonella typhimurium LT2
uauccaauaauaagaau

SEQ ID NO: 3808144 - RNA, 18 nt, Salmonella typhimurium LT2
uauccaauaauaagaauu

SEQ ID NO: 3808145 - RNA, 18 nt, Salmonella typhimurium LT2
uauccacgcagacgccgc

SEQ ID NO: 3808146 - RNA, 19 nt, Salmonella typhimurium LT2
uauccagaccuauugccuu

SEQ ID NO: 3808147 - RNA, 16 nt, Salmonella typhimurium LT2
uauccagcaccucauc

SEQ ID NO: 3808148 - RNA, 18 nt, Salmonella typhimurium LT2
uauccagccacguugucg

SEQ ID NO: 3808149 - RNA, 23 nt, Salmonella typhimurium LT2
uauccagcgccaggauaucuucc

SEQ ID NO: 3808150 - RNA, 20 nt, Salmonella typhimurium LT2
uauccagcgcguaaauaccu

SEQ ID NO: 3808151 - RNA, 23 nt, Salmonella typhimurium LT2
uauccagucgccaggagacaaua

SEQ ID NO: 3808152 - RNA, 17 nt, Salmonella typhimurium LT2
uauccaguuuuuuacuu

SEQ ID NO: 3808153 - RNA, 16 nt, Salmonella typhimurium LT2
uauccauugaaacggu

SEQ ID NO: 3808154 - RNA, 18 nt, Salmonella typhimurium LT2
uauccccagucuuccugc

SEQ ID NO: 3808155 - RNA, 17 nt, Salmonella typhimurium LT2
uauccccgucauacuuc

SEQ ID NO: 3808156 - RNA, 24 nt, Salmonella typhimurium LT2
uaucccgccacuguccugacggcg

SEQ ID NO: 3808157 - RNA, 18 nt, Salmonella typhimurium LT2
uaucccguggugcguugc

SEQ ID NO: 3808158 - RNA, 14 nt, Salmonella typhimurium LT2
uaucccuauucuga

SEQ ID NO: 3808159 - RNA, 15 nt, Salmonella typhimurium LT2
uaucccuuucaaaaa

SEQ ID NO: 3808160 - RNA, 19 nt, Salmonella typhimurium LT2
uauccgacugaccagaccg

SEQ ID NO: 3808161 - RNA, 15 nt, Salmonella typhimurium LT2
uauccgccagccagc

SEQ ID NO: 3808162 - RNA, 14 nt, Salmonella typhimurium LT2
uauccgccgcaaac

SEQ ID NO: 3808163 - RNA, 18 nt, Salmonella typhimurium LT2
uauccggcaaaagaggcu

SEQ ID NO: 3808164 - RNA, 15 nt, Salmonella typhimurium LT2
uauccggcaacauga

SEQ ID NO: 3808165 - RNA, 13 nt, Salmonella typhimurium LT2
uauccggccuaca

SEQ ID NO: 3808166 - RNA, 19 nt, Salmonella typhimurium LT2
uauccggccugcaggcaac

SEQ ID NO: 3808167 - RNA, 17 nt, Salmonella typhimurium LT2
uauccggcggcaaaggc

SEQ ID NO: 3808168 - RNA, 21 nt, Salmonella typhimurium LT2
uauccgugcgcaauuccagca

SEQ ID NO: 3808169 - RNA, 15 nt, Salmonella typhimurium LT2
uauccuaaaucugcc

SEQ ID NO: 3808170 - RNA, 19 nt, Salmonella typhimurium LT2
uauccuaaaucugccauca

SEQ ID NO: 3808171 - RNA, 15 nt, Salmonella typhimurium LT2
uauccuauuggcgca

SEQ ID NO: 3808172 - RNA, 21 nt, Salmonella typhimurium LT2
uauccucgcauccuccaucca

SEQ ID NO: 3808173 - RNA, 18 nt, Salmonella typhimurium LT2
uauccucuuuucgaacgc

SEQ ID NO: 3808174 - RNA, 15 nt, Salmonella typhimurium LT2
uauccugaaggacaa

SEQ ID NO: 3808175 - RNA, 12 nt, Salmonella typhimurium LT2
uauccuggccug

SEQ ID NO: 3808176 - RNA, 18 nt, Salmonella typhimurium LT2
uaucgaacucauagcgcc

SEQ ID NO: 3808177 - RNA, 14 nt, Salmonella typhimurium LT2
uaucgacacuauuu

SEQ ID NO: 3808178 - RNA, 18 nt, Salmonella typhimurium LT2
uaucgacacuauuuuuca

SEQ ID NO: 3808179 - RNA, 21 nt, Salmonella typhimurium LT2
uaucgacacuauuuuucaggg

SEQ ID NO: 3808180 - RNA, 23 nt, Salmonella typhimurium LT2
uaucgacguuguucgcuucuucu

SEQ ID NO: 3808181 - RNA, 21 nt, Salmonella typhimurium LT2
uaucgacucucccggcgccca

SEQ ID NO: 3808182 - RNA, 13 nt, Salmonella typhimurium LT2
uaucgauaaucaa

SEQ ID NO: 3808183 - RNA, 14 nt, Salmonella typhimurium LT2
uaucgaugcuuauu

SEQ ID NO: 3808184 - RNA, 13 nt, Salmonella typhimurium LT2
uaucgcaauauac

SEQ ID NO: 3808185 - RNA, 14 nt, Salmonella typhimurium LT2
uaucgccaaaccag

SEQ ID NO: 3808186 - RNA, 20 nt, Salmonella typhimurium LT2
uaucgccagcagggucagga

SEQ ID NO: 3808187 - RNA, 17 nt, Salmonella typhimurium LT2
uaucgccauauacgcca

SEQ ID NO: 3808188 - RNA, 16 nt, Salmonella typhimurium LT2
uaucgccaucaacgcc

SEQ ID NO: 3808189 - RNA, 15 nt, Salmonella typhimurium LT2
uaucgccgaucacaa

SEQ ID NO: 3808190 - RNA, 17 nt, Salmonella typhimurium LT2
uaucgcgagcaauuucc

SEQ ID NO: 3808191 - RNA, 23 nt, Salmonella typhimurium LT2
uaucgcgccgccaauauccauuu

SEQ ID NO: 3808192 - RNA, 20 nt, Salmonella typhimurium LT2
uaucgcgccggacagcagca

SEQ ID NO: 3808193 - RNA, 23 nt, Salmonella typhimurium LT2
uaucgcgcucuuccgccagcgcc

SEQ ID NO: 3808194 - RNA, 11 nt, Salmonella typhimurium LT2
uaucgcggcag

SEQ ID NO: 3808195 - RNA, 19 nt, Salmonella typhimurium LT2
uaucgcuaauucucccugc

SEQ ID NO: 3808196 - RNA, 22 nt, Salmonella typhimurium LT2
uaucggcacaucaugccagccg

SEQ ID NO: 3808197 - RNA, 13 nt, Salmonella typhimurium LT2
uaucggccagcgc

SEQ ID NO: 3808198 - RNA, 18 nt, Salmonella typhimurium LT2
uaucggccggaugccagu

SEQ ID NO: 3808199 - RNA, 20 nt, Salmonella typhimurium LT2
uaucggcggaaauucgcgcc

SEQ ID NO: 3808200 - RNA, 20 nt, Salmonella typhimurium LT2
uaucgggcccguugccuggc

SEQ ID NO: 3808201 - RNA, 21 nt, Salmonella typhimurium LT2
uaucgguaguguuaucgccga

SEQ ID NO: 3808202 - RNA, 14 nt, Salmonella typhimurium LT2
uaucguauccgguc

SEQ ID NO: 3808203 - RNA, 24 nt, Salmonella typhimurium LT2
uaucguggcgggcgucaauuuccu

SEQ ID NO: 3808204 - RNA, 18 nt, Salmonella typhimurium LT2
uaucguugcgcgcaauca

SEQ ID NO: 3808205 - RNA, 21 nt, Salmonella typhimurium LT2
uaucguuuuauuucugcccca

SEQ ID NO: 3808206 - RNA, 21 nt, Salmonella typhimurium LT2
uaucuaccagccgauuuuucg

SEQ ID NO: 3808207 - RNA, 20 nt, Salmonella typhimurium LT2
uaucuaugguaauuuaaagu

SEQ ID NO: 3808208 - RNA, 15 nt, Salmonella typhimurium LT2
uaucucucuggcgca

SEQ ID NO: 3808209 - RNA, 17 nt, Salmonella typhimurium LT2
uaucugaccaugccagc

SEQ ID NO: 3808210 - RNA, 23 nt, Salmonella typhimurium LT2
uaucugcauugccgggcugaccg

SEQ ID NO: 3808211 - RNA, 15 nt, Salmonella typhimurium LT2
uaucugcccuuucuu

SEQ ID NO: 3808212 - RNA, 16 nt, Salmonella typhimurium LT2
uaucugcgccgccaaa

SEQ ID NO: 3808213 - RNA, 12 nt, Salmonella typhimurium LT2
uaucugcugcug

SEQ ID NO: 3808214 - RNA, 20 nt, Salmonella typhimurium LT2
uaucuguauaaauaaaauug

SEQ ID NO: 3808215 - RNA, 12 nt, Salmonella typhimurium LT2
uaucuuauaaau

SEQ ID NO: 3808216 - RNA, 11 nt, Salmonella typhimurium LT2
uauucuucucc

SEQ ID NO: 3808217 - RNA, 17 nt, Salmonella typhimurium LT2
uauugaacauuuuuuca

SEQ ID NO: 3808218 - RNA, 17 nt, Salmonella typhimurium LT2
uauugacgcuuucuucc

SEQ ID NO: 3808219 - RNA, 20 nt, Salmonella typhimurium LT2
uauugagaaaauuacgccca

SEQ ID NO: 3808220 - RNA, 15 nt, Salmonella typhimurium LT2
uauugagaauaaacu

SEQ ID NO: 3808221 - RNA, 17 nt, Salmonella typhimurium LT2
uauugagcgaaacaggu

SEQ ID NO: 3808222 - RNA, 17 nt, Salmonella typhimurium LT2
uauugccacaauaucau

SEQ ID NO: 3808223 - RNA, 20 nt, Salmonella typhimurium LT2
uauugccacaauaucaucgu

SEQ ID NO: 3808224 - RNA, 17 nt, Salmonella typhimurium LT2
uauugccugaagaacau

SEQ ID NO: 3808225 - RNA, 15 nt, Salmonella typhimurium LT2
uauugccuuauucac

SEQ ID NO: 3808226 - RNA, 21 nt, Salmonella typhimurium LT2
uauugcgaauaaaacugccau

SEQ ID NO: 3808227 - RNA, 22 nt, Salmonella typhimurium LT2
uauugcuucguggcaaucagca

SEQ ID NO: 3808228 - RNA, 20 nt, Salmonella typhimurium LT2
uauugcuuucaauuuccgca

SEQ ID NO: 3808229 - RNA, 17 nt, Salmonella typhimurium LT2
uauuggcccccaucgcc

SEQ ID NO: 3808230 - RNA, 21 nt, Salmonella typhimurium LT2
uauuggcgcagccuuuuucuc

SEQ ID NO: 3808231 - RNA, 15 nt, Salmonella typhimurium LT2
uauuguaccugccgc

SEQ ID NO: 3808232 - RNA, 13 nt, Salmonella typhimurium LT2
uauugucaugcua

SEQ ID NO: 3808233 - RNA, 14 nt, Salmonella typhimurium LT2
uauugugagaaaag

SEQ ID NO: 3808234 - RNA, 22 nt, Salmonella typhimurium LT2
uauugugccgcggcuucaucac

SEQ ID NO: 3808235 - RNA, 17 nt, Salmonella typhimurium LT2
uauuguuuagacagaca

SEQ ID NO: 3808236 - RNA, 16 nt, Salmonella typhimurium LT2
uauuuaacuuaaauaa

SEQ ID NO: 3808237 - RNA, 15 nt, Salmonella typhimurium LT2
uauuuaagcucuucu

SEQ ID NO: 3808238 - RNA, 15 nt, Salmonella typhimurium LT2
uauuuaauacaucag

SEQ ID NO: 3808239 - RNA, 20 nt, Salmonella typhimurium LT2
uauuuagccguucaugcacu

SEQ ID NO: 3808240 - RNA, 20 nt, Salmonella typhimurium LT2
uauuucacuucgauaacauc

SEQ ID NO: 3808241 - RNA, 13 nt, Salmonella typhimurium LT2
uauuucagacuua

SEQ ID NO: 3808242 - RNA, 13 nt, Salmonella typhimurium LT2
uauuucaguacag

SEQ ID NO: 3808243 - RNA, 17 nt, Salmonella typhimurium LT2
uauuucaucuauuauuu

SEQ ID NO: 3808244 - RNA, 17 nt, Salmonella typhimurium LT2
uauuuccaccuucucuu

SEQ ID NO: 3808245 - RNA, 17 nt, Salmonella typhimurium LT2
uauuuccauuuuucaga

SEQ ID NO: 3808246 - RNA, 19 nt, Salmonella typhimurium LT2
uauuuccuuccgaaucaau

SEQ ID NO: 3808247 - RNA, 22 nt, Salmonella typhimurium LT2
uauuucgacaagaagauuucuu

SEQ ID NO: 3808248 - RNA, 18 nt, Salmonella typhimurium LT2
uauuucgacuuucuucgg

SEQ ID NO: 3808249 - RNA, 21 nt, Salmonella typhimurium LT2
uauuucugucagcguuuuuca

SEQ ID NO: 3808250 - RNA, 13 nt, Salmonella typhimurium LT2
uauuugcauuuuc

SEQ ID NO: 3808251 - RNA, 13 nt, Salmonella typhimurium LT2
uauuugcccuguu

SEQ ID NO: 3808252 - RNA, 11 nt, Salmonella typhimurium LT2
uauuuguuccu

SEQ ID NO: 3808253 - RNA, 22 nt, Salmonella typhimurium LT2
uauuuguuugccgcgauagaaa

SEQ ID NO: 3808254 - RNA, 15 nt, Salmonella typhimurium LT2
uauuuuaaauuccca

SEQ ID NO: 3808255 - RNA, 16 nt, Salmonella typhimurium LT2
uauuuuagcuucuuca

SEQ ID NO: 3808256 - RNA, 20 nt, Salmonella typhimurium LT2
uauuuuauaaaacuacaaca

SEQ ID NO: 3808257 - RNA, 14 nt, Salmonella typhimurium LT2
uauuuuccaguagu

SEQ ID NO: 3808258 - RNA, 18 nt, Salmonella typhimurium LT2
uauuuucuugcuacauau

SEQ ID NO: 3808259 - RNA, 24 nt, Salmonella typhimurium LT2
uauuuuggcauuucgcauugucau

SEQ ID NO: 3808260 - RNA, 21 nt, Salmonella typhimurium LT2
uauuuuguaggccuaaaaaua

SEQ ID NO: 3808261 - RNA, 16 nt, Salmonella typhimurium LT2
uauuuuuauuuuagcu

SEQ ID NO: 3808262 - RNA, 19 nt, Salmonella typhimurium LT2
uauuuuucuauuccgcuca

SEQ ID NO: 3808263 - RNA, 13 nt, Salmonella typhimurium LT2
uauuuuuucgcac

SEQ ID NO: 3808264 - RNA, 13 nt, Salmonella typhimurium LT2
ucaaaaaagagaa

SEQ ID NO: 3808265 - RNA, 16 nt, Salmonella typhimurium LT2
ucaaaaauaaaaaaac

SEQ ID NO: 3808266 - RNA, 11 nt, Salmonella typhimurium LT2
ucaaaacaggu

SEQ ID NO: 3808267 - RNA, 14 nt, Salmonella typhimurium LT2
ucaaaacgacauaa

SEQ ID NO: 3808268 - RNA, 21 nt, Salmonella typhimurium LT2
ucaaaacuggaaacgcaucca

SEQ ID NO: 3808269 - RNA, 18 nt, Salmonella typhimurium LT2
ucaaaagauugauuuauu

SEQ ID NO: 3808270 - RNA, 16 nt, Salmonella typhimurium LT2
ucaaaagcguguagca

SEQ ID NO: 3808271 - RNA, 16 nt, Salmonella typhimurium LT2
ucaaaaggugagaaaa

SEQ ID NO: 3808272 - RNA, 14 nt, Salmonella typhimurium LT2
ucaaaaguaucaac

SEQ ID NO: 3808273 - RNA, 16 nt, Salmonella typhimurium LT2
ucaaaauauaacuucu

SEQ ID NO: 3808274 - RNA, 11 nt, Salmonella typhimurium LT2
ucaaaaucaaa

SEQ ID NO: 3808275 - RNA, 15 nt, Salmonella typhimurium LT2
ucaaaaucgcgcccc

SEQ ID NO: 3808276 - RNA, 18 nt, Salmonella typhimurium LT2
ucaaaaugcaccggcguu

SEQ ID NO: 3808277 - RNA, 19 nt, Salmonella typhimurium LT2
ucaaaaugcccgcauugcg

SEQ ID NO: 3808278 - RNA, 15 nt, Salmonella typhimurium LT2
ucaaaauuaaucgcc

SEQ ID NO: 3808279 - RNA, 22 nt, Salmonella typhimurium LT2
ucaaaauuaaucgccagcagcg

SEQ ID NO: 3808280 - RNA, 16 nt, Salmonella typhimurium LT2
ucaaaauuaccuuuac

SEQ ID NO: 3808281 - RNA, 22 nt, Salmonella typhimurium LT2
ucaaaauuaccuuuacaugaaa

SEQ ID NO: 3808282 - RNA, 20 nt, Salmonella typhimurium LT2
ucaaacacaaauuucgagca

SEQ ID NO: 3808283 - RNA, 16 nt, Salmonella typhimurium LT2
ucaaacacgaccagcg

SEQ ID NO: 3808284 - RNA, 22 nt, Salmonella typhimurium LT2
ucaaacagcuggcggaagacac

SEQ ID NO: 3808285 - RNA, 13 nt, Salmonella typhimurium LT2
ucaaaccacgcug

SEQ ID NO: 3808286 - RNA, 18 nt, Salmonella typhimurium LT2
ucaaaccaguuuuucauu

SEQ ID NO: 3808287 - RNA, 14 nt, Salmonella typhimurium LT2
ucaaacccuuccgc

SEQ ID NO: 3808288 - RNA, 14 nt, Salmonella typhimurium LT2
ucaaacgccugcau

SEQ ID NO: 3808289 - RNA, 17 nt, Salmonella typhimurium LT2
ucaaacgccugcaucaa

SEQ ID NO: 3808290 - RNA, 22 nt, Salmonella typhimurium LT2
ucaaacgccugcaucaacaggc

SEQ ID NO: 3808291 - RNA, 22 nt, Salmonella typhimurium LT2
ucaaacgcgccgcugcguaccg

SEQ ID NO: 3808292 - RNA, 19 nt, Salmonella typhimurium LT2
ucaaacggccugcgcugga

SEQ ID NO: 3808293 - RNA, 16 nt, Salmonella typhimurium LT2
ucaaacuccgcgcugg

SEQ ID NO: 3808294 - RNA, 23 nt, Salmonella typhimurium LT2
ucaaacucgcugccgacuuggcu

SEQ ID NO: 3808295 - RNA, 15 nt, Salmonella typhimurium LT2
ucaaacuuuuaaauu

SEQ ID NO: 3808296 - RNA, 18 nt, Salmonella typhimurium LT2
ucaaacuuuuaaauugaa

SEQ ID NO: 3808297 - RNA, 20 nt, Salmonella typhimurium LT2
ucaaacuuuuaaauugaaga

SEQ ID NO: 3808298 - RNA, 20 nt, Salmonella typhimurium LT2
ucaaacuuuuauaaauauag

SEQ ID NO: 3808299 - RNA, 22 nt, Salmonella typhimurium LT2
ucaaagaacagggggcgcauca

SEQ ID NO: 3808300 - RNA, 15 nt, Salmonella typhimurium LT2
ucaaagaucucggug

SEQ ID NO: 3808301 - RNA, 22 nt, Salmonella typhimurium LT2
ucaaauaagacauggaguucca

SEQ ID NO: 3808302 - RNA, 17 nt, Salmonella typhimurium LT2
ucaaauaccuuuucauu

SEQ ID NO: 3808303 - RNA, 22 nt, Salmonella typhimurium LT2
ucaaaucagacgcuucauuggu

SEQ ID NO: 3808304 - RNA, 17 nt, Salmonella typhimurium LT2
ucaaauccaacucaguu

SEQ ID NO: 3808305 - RNA, 15 nt, Salmonella typhimurium LT2
ucaaauccaccgcca

SEQ ID NO: 3808306 - RNA, 12 nt, Salmonella typhimurium LT2
ucaaauccagcu

SEQ ID NO: 3808307 - RNA, 21 nt, Salmonella typhimurium LT2
ucaaauccuggaagacuucac

SEQ ID NO: 3808308 - RNA, 15 nt, Salmonella typhimurium LT2
ucaaaucgcggcgcu

SEQ ID NO: 3808309 - RNA, 14 nt, Salmonella typhimurium LT2
ucaaaugagaauag

SEQ ID NO: 3808310 - RNA, 14 nt, Salmonella typhimurium LT2
ucaaauuugcccag

SEQ ID NO: 3808311 - RNA, 16 nt, Salmonella typhimurium LT2
ucaaauuugcccagca

SEQ ID NO: 3808312 - RNA, 13 nt, Salmonella typhimurium LT2
ucaacaaaguuaa

SEQ ID NO: 3808313 - RNA, 14 nt, Salmonella typhimurium LT2
ucaacaaucguuaa

SEQ ID NO: 3808314 - RNA, 17 nt, Salmonella typhimurium LT2
ucaacaaugcuuucacc

SEQ ID NO: 3808315 - RNA, 14 nt, Salmonella typhimurium LT2
ucaacaaugucgcc

SEQ ID NO: 3808316 - RNA, 15 nt, Salmonella typhimurium LT2
ucaacaccagcagcg

SEQ ID NO: 3808317 - RNA, 18 nt, Salmonella typhimurium LT2
ucaacacuuagaacgcgg

SEQ ID NO: 3808318 - RNA, 21 nt, Salmonella typhimurium LT2
ucaacacuuagaacgcggaag

SEQ ID NO: 3808319 - RNA, 18 nt, Salmonella typhimurium LT2
ucaacagcgcggcaggcc

SEQ ID NO: 3808320 - RNA, 14 nt, Salmonella typhimurium LT2
ucaauuccacaggc

SEQ ID NO: 3808321 - RNA, 17 nt, Salmonella typhimurium LT2
ucaauuccuggaacugg

SEQ ID NO: 3808322 - RNA, 14 nt, Salmonella typhimurium LT2
ucaauucuuuaauu

SEQ ID NO: 3808323 - RNA, 12 nt, Salmonella typhimurium LT2
ucaauugagcgg

SEQ ID NO: 3808324 - RNA, 17 nt, Salmonella typhimurium LT2
ucaauugccgucagcuc

SEQ ID NO: 3808325 - RNA, 12 nt, Salmonella typhimurium LT2
ucaauuuccagu

SEQ ID NO: 3808326 - RNA, 18 nt, Salmonella typhimurium LT2
ucaauuucucuuuuauua

SEQ ID NO: 3808327 - RNA, 16 nt, Salmonella typhimurium LT2
ucaauuugcaauucga

SEQ ID NO: 3808328 - RNA, 14 nt, Salmonella typhimurium LT2
ucaauuugccggaa

SEQ ID NO: 3808329 - RNA, 17 nt, Salmonella typhimurium LT2
ucaauuuuaauuuaaua

SEQ ID NO: 3808330 - RNA, 18 nt, Salmonella typhimurium LT2
ucaauuuuaauuuaauaa

SEQ ID NO: 3808331 - RNA, 21 nt, Salmonella typhimurium LT2
ucaauuuuaauuuaauaauaa

SEQ ID NO: 3808332 - RNA, 13 nt, Salmonella typhimurium LT2
ucacaaaaucauu

SEQ ID NO: 3808333 - RNA, 15 nt, Salmonella typhimurium LT2
ucacaaacaauuucc

SEQ ID NO: 3808334 - RNA, 22 nt, Salmonella typhimurium LT2
ucacaaacaauuucccccacuu

SEQ ID NO: 3808335 - RNA, 18 nt, Salmonella typhimurium LT2
ucacaaacggcgguuuuu

SEQ ID NO: 3808336 - RNA, 12 nt, Salmonella typhimurium LT2
ucacaaagccca

SEQ ID NO: 3808337 - RNA, 18 nt, Salmonella typhimurium LT2
ucacaaccuccacgccca

SEQ ID NO: 3808338 - RNA, 16 nt, Salmonella typhimurium LT2
ucacaacgucaucccg

SEQ ID NO: 3808339 - RNA, 16 nt, Salmonella typhimurium LT2
ucacaacugaagcaua

SEQ ID NO: 3808340 - RNA, 21 nt, Salmonella typhimurium LT2
ucacaauaucgagaugaccgu

SEQ ID NO: 3808341 - RNA, 12 nt, Salmonella typhimurium LT2
ucacaaugucau

SEQ ID NO: 3808342 - RNA, 15 nt, Salmonella typhimurium LT2
ucacaaugucaucaa

SEQ ID NO: 3808343 - RNA, 18 nt, Salmonella typhimurium LT2
ucacacaagucaccguuu

SEQ ID NO: 3808344 - RNA, 23 nt, Salmonella typhimurium LT2
ucacacaagucaccguuuuucau

SEQ ID NO: 3808345 - RNA, 15 nt, Salmonella typhimurium LT2
ucacaccauauccaa

SEQ ID NO: 3808346 - RNA, 12 nt, Salmonella typhimurium LT2
ucacacccagcg

SEQ ID NO: 3808347 - RNA, 16 nt, Salmonella typhimurium LT2
ucacacugacaauaaa

SEQ ID NO: 3808348 - RNA, 21 nt, Salmonella typhimurium LT2
ucacacugcgccgccagcgac

SEQ ID NO: 3808349 - RNA, 14 nt, Salmonella typhimurium LT2
ucacagaugacaga

SEQ ID NO: 3808350 - RNA, 19 nt, Salmonella typhimurium LT2
ucacagaugacagagucca

SEQ ID NO: 3808351 - RNA, 19 nt, Salmonella typhimurium LT2
ucacagccacacugcugug

SEQ ID NO: 3808352 - RNA, 19 nt, Salmonella typhimurium LT2
ucacaggcuucgacaaaca

SEQ ID NO: 3808353 - RNA, 21 nt, Salmonella typhimurium LT2
ucacauacaaagagaaaauga

SEQ ID NO: 3808354 - RNA, 17 nt, Salmonella typhimurium LT2
ucacauacagcacuucc

SEQ ID NO: 3808355 - RNA, 18 nt, Salmonella typhimurium LT2
ucacauauucaauaauau

SEQ ID NO: 3808356 - RNA, 13 nt, Salmonella typhimurium LT2
ucacauccagccc

SEQ ID NO: 3808357 - RNA, 13 nt, Salmonella typhimurium LT2
ucacaucccagca

SEQ ID NO: 3808358 - RNA, 15 nt, Salmonella typhimurium LT2
ucacaucgcccugau

SEQ ID NO: 3808359 - RNA, 19 nt, Salmonella typhimurium LT2
ucacaucgccggagaucag

SEQ ID NO: 3808360 - RNA, 22 nt, Salmonella typhimurium LT2
ucacaucgccggagaucagcag

SEQ ID NO: 3808361 - RNA, 20 nt, Salmonella typhimurium LT2
ucacaucguaaaucagcgug

SEQ ID NO: 3808362 - RNA, 20 nt, Salmonella typhimurium LT2
ucacaugcggaagcaaaaua

SEQ ID NO: 3808363 - RNA, 13 nt, Salmonella typhimurium LT2
ucacauggcgaau

SEQ ID NO: 3808364 - RNA, 20 nt, Salmonella typhimurium LT2
ucacauggcgaauaucacua

SEQ ID NO: 3808365 - RNA, 14 nt, Salmonella typhimurium LT2
ucacaugugcgcua

SEQ ID NO: 3808366 - RNA, 21 nt, Salmonella typhimurium LT2
ucacauuggcaaaccccugcu

SEQ ID NO: 3808367 - RNA, 14 nt, Salmonella typhimurium LT2
ucaccacaaaggcg

SEQ ID NO: 3808368 - RNA, 19 nt, Salmonella typhimurium LT2
ucaccacgcgcacgcccau

SEQ ID NO: 3808369 - RNA, 15 nt, Salmonella typhimurium LT2
ucaccacuguauucc

SEQ ID NO: 3808370 - RNA, 19 nt, Salmonella typhimurium LT2
ucaccagaaugagcggaac

SEQ ID NO: 3808371 - RNA, 23 nt, Salmonella typhimurium LT2
ucaccagagcaucaauggugaau

SEQ ID NO: 3808372 - RNA, 12 nt, Salmonella typhimurium LT2
ucaccagcaccg

SEQ ID NO: 3808373 - RNA, 19 nt, Salmonella typhimurium LT2
ucaccagcaccgccagcgc

SEQ ID NO: 3808374 - RNA, 19 nt, Salmonella typhimurium LT2
ucaccagcagcacaaaaau

SEQ ID NO: 3808375 - RNA, 13 nt, Salmonella typhimurium LT2
ucaccagcagcau

SEQ ID NO: 3808376 - RNA, 14 nt, Salmonella typhimurium LT2
ucaccagccgaucg

SEQ ID NO: 3808377 - RNA, 12 nt, Salmonella typhimurium LT2
ucaccagcgcgc

SEQ ID NO: 3808378 - RNA, 18 nt, Salmonella typhimurium LT2
ucaccagcugacgcagca

SEQ ID NO: 3808379 - RNA, 21 nt, Salmonella typhimurium LT2
ucaccagcugacgcagcagcu

SEQ ID NO: 3808380 - RNA, 12 nt, Salmonella typhimurium LT2
ucaccaggaugc

SEQ ID NO: 3808381 - RNA, 21 nt, Salmonella typhimurium LT2
ucaccaucagcgucagcacca

SEQ ID NO: 3808382 - RNA, 15 nt, Salmonella typhimurium LT2
ucaccaucccaugau

SEQ ID NO: 3808383 - RNA, 16 nt, Salmonella typhimurium LT2
ucaccaucccaugaug

SEQ ID NO: 3808384 - RNA, 22 nt, Salmonella typhimurium LT2
ucaccaucugcgcacguuuauu

SEQ ID NO: 3808385 - RNA, 17 nt, Salmonella typhimurium LT2
ucaccauuaacaucaga

SEQ ID NO: 3808386 - RNA, 15 nt, Salmonella typhimurium LT2
ucaccauucccagcg

SEQ ID NO: 3808387 - RNA, 16 nt, Salmonella typhimurium LT2
ucaccauucccagcgc

SEQ ID NO: 3808388 - RNA, 22 nt, Salmonella typhimurium LT2
ucacccagaugcgaaucuucau

SEQ ID NO: 3808389 - RNA, 14 nt, Salmonella typhimurium LT2
ucacccccagcuga

SEQ ID NO: 3808390 - RNA, 16 nt, Salmonella typhimurium LT2
ucacccccagcugacu

SEQ ID NO: 3808391 - RNA, 14 nt, Salmonella typhimurium LT2
ucacccgccggcag

SEQ ID NO: 3808392 - RNA, 19 nt, Salmonella typhimurium LT2
ucacccggauacgcggcac

SEQ ID NO: 3808393 - RNA, 14 nt, Salmonella typhimurium LT2
ucacccugaauuuc

SEQ ID NO: 3808394 - RNA, 16 nt, Salmonella typhimurium LT2
ucacccugaauuucaa

SEQ ID NO: 3808395 - RNA, 20 nt, Salmonella typhimurium LT2
ucacccugaauuucaauaau

SEQ ID NO: 3808396 - RNA, 15 nt, Salmonella typhimurium LT2
ucaccgacagcaccg

SEQ ID NO: 3808397 - RNA, 21 nt, Salmonella typhimurium LT2
ucaccgcauagauauaaacgc

SEQ ID NO: 3808398 - RNA, 19 nt, Salmonella typhimurium LT2
ucaccgccagugcauagca

SEQ ID NO: 3808399 - RNA, 21 nt, Salmonella typhimurium LT2
ucaccgcggcaaccagcccau

SEQ ID NO: 3808400 - RNA, 16 nt, Salmonella typhimurium LT2
ucaccggcacccaguu

SEQ ID NO: 3808401 - RNA, 15 nt, Salmonella typhimurium LT2
ucaccggcgugcgcu

SEQ ID NO: 3808402 - RNA, 18 nt, Salmonella typhimurium LT2
ucaccguaauauaaucua

SEQ ID NO: 3808403 - RNA, 21 nt, Salmonella typhimurium LT2
ucaccguauuagcaaaucuuc

SEQ ID NO: 3808404 - RNA, 18 nt, Salmonella typhimurium LT2
ucaccguccgccaggccc

SEQ ID NO: 3808405 - RNA, 18 nt, Salmonella typhimurium LT2
ucaccguggcaaaaucca

SEQ ID NO: 3808406 - RNA, 21 nt, Salmonella typhimurium LT2
ucaccgugguuaccgccagau

SEQ ID NO: 3808407 - RNA, 19 nt, Salmonella typhimurium LT2
ucaccguuuaaaaacauca

SEQ ID NO: 3808408 - RNA, 21 nt, Salmonella typhimurium LT2
ucaccguuuaaaaacaucauu

SEQ ID NO: 3808409 - RNA, 18 nt, Salmonella typhimurium LT2
ucaccucacuccagaccu

SEQ ID NO: 3808410 - RNA, 11 nt, Salmonella typhimurium LT2
ucaccuccacg

SEQ ID NO: 3808411 - RNA, 18 nt, Salmonella typhimurium LT2
ucaccuccagcacgcgcu

SEQ ID NO: 3808412 - RNA, 18 nt, Salmonella typhimurium LT2
ucaccuccgccaccagcg

SEQ ID NO: 3808413 - RNA, 19 nt, Salmonella typhimurium LT2
ucaccucuaccggggcgcu

SEQ ID NO: 3808414 - RNA, 16 nt, Salmonella typhimurium LT2
ucaccucuuccccggu

SEQ ID NO: 3808415 - RNA, 14 nt, Salmonella typhimurium LT2
ucaccugauagcgg

SEQ ID NO: 3808416 - RNA, 18 nt, Salmonella typhimurium LT2
ucaccugauuaccuacca

SEQ ID NO: 3808417 - RNA, 23 nt, Salmonella typhimurium LT2
ucaccugccguaccguugccgcc

SEQ ID NO: 3808418 - RNA, 17 nt, Salmonella typhimurium LT2
ucaccugucgcuaacgc

SEQ ID NO: 3808419 - RNA, 22 nt, Salmonella typhimurium LT2
ucaccuucggucccaucgcgcc

SEQ ID NO: 3808420 - RNA, 21 nt, Salmonella typhimurium LT2
ucaccuucggugaaaucacga

SEQ ID NO: 3808421 - RNA, 15 nt, Salmonella typhimurium LT2
ucaccuuucauuuua

SEQ ID NO: 3808422 - RNA, 21 nt, Salmonella typhimurium LT2
ucacgaacgaguacguaaugc

SEQ ID NO: 3808423 - RNA, 15 nt, Salmonella typhimurium LT2
ucacgaagucuggcu

SEQ ID NO: 3808424 - RNA, 17 nt, Salmonella typhimurium LT2
ucagcaauuucucgccc

SEQ ID NO: 3808425 - RNA, 20 nt, Salmonella typhimurium LT2
ucagcacaaagugcgcuguc

SEQ ID NO: 3808426 - RNA, 11 nt, Salmonella typhimurium LT2
ucagcacaauc

SEQ ID NO: 3808427 - RNA, 20 nt, Salmonella typhimurium LT2
ucagcaccucaucgcuaccu

SEQ ID NO: 3808428 - RNA, 19 nt, Salmonella typhimurium LT2
ucagcaccuuugaacgucg

SEQ ID NO: 3808429 - RNA, 13 nt, Salmonella typhimurium LT2
ucagcagaacaaa

SEQ ID NO: 3808430 - RNA, 17 nt, Salmonella typhimurium LT2
ucagcagaggaaaacgu

SEQ ID NO: 3808431 - RNA, 21 nt, Salmonella typhimurium LT2
ucagcagcaccgguuuuuccg

SEQ ID NO: 3808432 - RNA, 21 nt, Salmonella typhimurium LT2
ucagcagcagcguaauggcca

SEQ ID NO: 3808433 - RNA, 17 nt, Salmonella typhimurium LT2
ucagcauaaagccucuc

SEQ ID NO: 3808434 - RNA, 15 nt, Salmonella typhimurium LT2
ucagcauacugcguu

SEQ ID NO: 3808435 - RNA, 16 nt, Salmonella typhimurium LT2
ucagcauauccagcgc

SEQ ID NO: 3808436 - RNA, 18 nt, Salmonella typhimurium LT2
ucagcauauccagcgccu

SEQ ID NO: 3808437 - RNA, 19 nt, Salmonella typhimurium LT2
ucagcauccgcaagacacg

SEQ ID NO: 3808438 - RNA, 17 nt, Salmonella typhimurium LT2
ucagcaucgcauuaacg

SEQ ID NO: 3808439 - RNA, 12 nt, Salmonella typhimurium LT2
ucagcauggugu

SEQ ID NO: 3808440 - RNA, 13 nt, Salmonella typhimurium LT2
ucagcauuaauac

SEQ ID NO: 3808441 - RNA, 20 nt, Salmonella typhimurium LT2
ucagcauuucauccauuaaa

SEQ ID NO: 3808442 - RNA, 16 nt, Salmonella typhimurium LT2
ucagccacgacgcuca

SEQ ID NO: 3808443 - RNA, 16 nt, Salmonella typhimurium LT2
ucagccacuucuucca

SEQ ID NO: 3808444 - RNA, 16 nt, Salmonella typhimurium LT2
ucagccagcagcucaa

SEQ ID NO: 3808445 - RNA, 12 nt, Salmonella typhimurium LT2
ucagccagcgau

SEQ ID NO: 3808446 - RNA, 15 nt, Salmonella typhimurium LT2
ucagccagcgaucag

SEQ ID NO: 3808447 - RNA, 20 nt, Salmonella typhimurium LT2
ucagccaggcggcaauaucc

SEQ ID NO: 3808448 - RNA, 20 nt, Salmonella typhimurium LT2
ucagccaggguuuaaucgcc

SEQ ID NO: 3808449 - RNA, 21 nt, Salmonella typhimurium LT2
ucagccaggguuuaaucgccg

SEQ ID NO: 3808450 - RNA, 15 nt, Salmonella typhimurium LT2
ucagcccuacaaagg

SEQ ID NO: 3808451 - RNA, 23 nt, Salmonella typhimurium LT2
ucagcccuugucgacugcggaac

SEQ ID NO: 3808452 - RNA, 19 nt, Salmonella typhimurium LT2
ucagccgccaucaggcaug

SEQ ID NO: 3808453 - RNA, 18 nt, Salmonella typhimurium LT2
ucagccguauggcguacg

SEQ ID NO: 3808454 - RNA, 16 nt, Salmonella typhimurium LT2
ucagccugaaagauua

SEQ ID NO: 3808455 - RNA, 22 nt, Salmonella typhimurium LT2
ucagccugaaagauuauuuuau

SEQ ID NO: 3808456 - RNA, 16 nt, Salmonella typhimurium LT2
ucagccugaaucagca

SEQ ID NO: 3808457 - RNA, 20 nt, Salmonella typhimurium LT2
ucagcgaccgucguguuacc

SEQ ID NO: 3808458 - RNA, 18 nt, Salmonella typhimurium LT2
ucagcgaguuccaccaua

SEQ ID NO: 3808459 - RNA, 18 nt, Salmonella typhimurium LT2
ucagcgaucugucgccgc

SEQ ID NO: 3808460 - RNA, 16 nt, Salmonella typhimurium LT2
ucagcgauugcgccag

SEQ ID NO: 3808461 - RNA, 17 nt, Salmonella typhimurium LT2
ucagcgcagugaccagc

SEQ ID NO: 3808462 - RNA, 21 nt, Salmonella typhimurium LT2
ucagcgccauccggcuuucuu

SEQ ID NO: 3808463 - RNA, 19 nt, Salmonella typhimurium LT2
ucagcgcgagcgugaucuc

SEQ ID NO: 3808464 - RNA, 12 nt, Salmonella typhimurium LT2
ucagcgcgcucc

SEQ ID NO: 3808465 - RNA, 10 nt, Salmonella typhimurium LT2
ucagcgcggc

SEQ ID NO: 3808466 - RNA, 19 nt, Salmonella typhimurium LT2
ucagcgcggcagccggaac

SEQ ID NO: 3808467 - RNA, 19 nt, Salmonella typhimurium LT2
ucagcgcguuuuccaucau

SEQ ID NO: 3808468 - RNA, 18 nt, Salmonella typhimurium LT2
ucagcgcuaccagcgcgg

SEQ ID NO: 3808469 - RNA, 22 nt, Salmonella typhimurium LT2
ucagcguaaaacuuuucugcgu

SEQ ID NO: 3808470 - RNA, 20 nt, Salmonella typhimurium LT2
ucagcgugaugcgauccagc

SEQ ID NO: 3808471 - RNA, 23 nt, Salmonella typhimurium LT2
ucagcgugggcagccguuucuuc

SEQ ID NO: 3808472 - RNA, 21 nt, Salmonella typhimurium LT2
ucagcguguuucaucucauca

SEQ ID NO: 3808473 - RNA, 22 nt, Salmonella typhimurium LT2
ucagcuccucgcgaaucucaau

SEQ ID NO: 3808474 - RNA, 19 nt, Salmonella typhimurium LT2
ucagcugaacagucccacc

SEQ ID NO: 3808475 - RNA, 15 nt, Salmonella typhimurium LT2
ucagcuugucgguaa

SEQ ID NO: 3808476 - RNA, 21 nt, Salmonella typhimurium LT2
ucaggaaaaagggaauaauac

SEQ ID NO: 3808477 - RNA, 18 nt, Salmonella typhimurium LT2
ucaggaaaacgcuuucca

SEQ ID NO: 3808478 - RNA, 15 nt, Salmonella typhimurium LT2
ucaggaaagagaaaa

SEQ ID NO: 3808479 - RNA, 13 nt, Salmonella typhimurium LT2
ucaggaaaugaac

SEQ ID NO: 3808480 - RNA, 15 nt, Salmonella typhimurium LT2
ucaggaaaugaacca

SEQ ID NO: 3808481 - RNA, 16 nt, Salmonella typhimurium LT2
ucaggaaaugaaccag

SEQ ID NO: 3808482 - RNA, 21 nt, Salmonella typhimurium LT2
ucaggaaauucucagaaacaa

SEQ ID NO: 3808483 - RNA, 14 nt, Salmonella typhimurium LT2
ucaggaagaaagac

SEQ ID NO: 3808484 - RNA, 20 nt, Salmonella typhimurium LT2
ucaggaagaacacgccgccu

SEQ ID NO: 3808485 - RNA, 14 nt, Salmonella typhimurium LT2
ucaggaaggagcaa

SEQ ID NO: 3808486 - RNA, 17 nt, Salmonella typhimurium LT2
ucaggaaggagcaaaca

SEQ ID NO: 3808487 - RNA, 19 nt, Salmonella typhimurium LT2
ucaggacaucaaaggcaga

SEQ ID NO: 3808488 - RNA, 20 nt, Salmonella typhimurium LT2
ucaggacggcauaagccagc

SEQ ID NO: 3808489 - RNA, 23 nt, Salmonella typhimurium LT2
ucaggacggcauaagccagcccu

SEQ ID NO: 3808490 - RNA, 22 nt, Salmonella typhimurium LT2
ucaggaggccugaauaaugacc

SEQ ID NO: 3808491 - RNA, 21 nt, Salmonella typhimurium LT2
ucaggagggcugcccgccguu

SEQ ID NO: 3808492 - RNA, 14 nt, Salmonella typhimurium LT2
ucaggauauucgcc

SEQ ID NO: 3808493 - RNA, 19 nt, Salmonella typhimurium LT2
ucaggaugggcuucuucac

SEQ ID NO: 3808494 - RNA, 16 nt, Salmonella typhimurium LT2
ucaggcaaaaaaaacc

SEQ ID NO: 3808495 - RNA, 14 nt, Salmonella typhimurium LT2
ucaggcaaaaauaa

SEQ ID NO: 3808496 - RNA, 23 nt, Salmonella typhimurium LT2
ucaggcaaaaaucgucaucagau

SEQ ID NO: 3808497 - RNA, 14 nt, Salmonella typhimurium LT2
ucaggcaacccgga

SEQ ID NO: 3808498 - RNA, 17 nt, Salmonella typhimurium LT2
ucaggcaauaaacauca

SEQ ID NO: 3808499 - RNA, 20 nt, Salmonella typhimurium LT2
ucaggcaauaaacaucagcc

SEQ ID NO: 3808500 - RNA, 15 nt, Salmonella typhimurium LT2
ucaggcaauacgcug

SEQ ID NO: 3808501 - RNA, 14 nt, Salmonella typhimurium LT2
ucaggcaaugucug

SEQ ID NO: 3808502 - RNA, 18 nt, Salmonella typhimurium LT2
ucaggcacaaaaaacaaa

SEQ ID NO: 3808503 - RNA, 12 nt, Salmonella typhimurium LT2
ucaggcacaaug

SEQ ID NO: 3808504 - RNA, 23 nt, Salmonella typhimurium LT2
ucaggcacagaagcgccugucua

SEQ ID NO: 3808505 - RNA, 16 nt, Salmonella typhimurium LT2
ucaggcacgugcauaa

SEQ ID NO: 3808506 - RNA, 14 nt, Salmonella typhimurium LT2
ucaggcagaaauaa

SEQ ID NO: 3808507 - RNA, 19 nt, Salmonella typhimurium LT2
ucaggcaucagauaaacag

SEQ ID NO: 3808508 - RNA, 13 nt, Salmonella typhimurium LT2
ucaggcaugccaa

SEQ ID NO: 3808509 - RNA, 18 nt, Salmonella typhimurium LT2
ucaggcaugccaaaccag

SEQ ID NO: 3808510 - RNA, 13 nt, Salmonella typhimurium LT2
ucaggcauguugc

SEQ ID NO: 3808511 - RNA, 21 nt, Salmonella typhimurium LT2
ucaggcauguugcgcaaucac

SEQ ID NO: 3808512 - RNA, 22 nt, Salmonella typhimurium LT2
ucaggccagacugagcaaacuc

SEQ ID NO: 3808513 - RNA, 15 nt, Salmonella typhimurium LT2
ucaggccagccugau

SEQ ID NO: 3808514 - RNA, 20 nt, Salmonella typhimurium LT2
ucaggccaggguugcguucg

SEQ ID NO: 3808515 - RNA, 21 nt, Salmonella typhimurium LT2
ucaggccgccgcacaggcgac

SEQ ID NO: 3808516 - RNA, 16 nt, Salmonella typhimurium LT2
ucaggccuacaguuuc

SEQ ID NO: 3808517 - RNA, 22 nt, Salmonella typhimurium LT2
ucaggccuacgacagcgcuggc

SEQ ID NO: 3808518 - RNA, 19 nt, Salmonella typhimurium LT2
ucaggcgauagccguccau

SEQ ID NO: 3808519 - RNA, 17 nt, Salmonella typhimurium LT2
ucaggcgcgauggaguc

SEQ ID NO: 3808520 - RNA, 21 nt, Salmonella typhimurium LT2
ucaggcucgucgccuuccagc

SEQ ID NO: 3808521 - RNA, 22 nt, Salmonella typhimurium LT2
ucaggcucgucgccuuccagcg

SEQ ID NO: 3808522 - RNA, 14 nt, Salmonella typhimurium LT2
ucaggcuugucgcg

SEQ ID NO: 3808523 - RNA, 12 nt, Salmonella typhimurium LT2
ucaggcuuucca

SEQ ID NO: 3808524 - RNA, 14 nt, Salmonella typhimurium LT2
ucagggccaucuca

SEQ ID NO: 3808525 - RNA, 19 nt, Salmonella typhimurium LT2
ucagggcgaaaaugaucac

SEQ ID NO: 3808526 - RNA, 21 nt, Salmonella typhimurium LT2
ucagggcgacgaaucagcgau

SEQ ID NO: 3808527 - RNA, 18 nt, Salmonella typhimurium LT2
ucagggcguagacgacca

SEQ ID NO: 3808528 - RNA, 18 nt, Salmonella typhimurium LT2
ucaucaucggcacagcca

SEQ ID NO: 3808529 - RNA, 21 nt, Salmonella typhimurium LT2
ucaucaucucugucgaccauc

SEQ ID NO: 3808530 - RNA, 12 nt, Salmonella typhimurium LT2
ucaucaucuguu

SEQ ID NO: 3808531 - RNA, 21 nt, Salmonella typhimurium LT2
ucaucaugaaaaacaguaccg

SEQ ID NO: 3808532 - RNA, 17 nt, Salmonella typhimurium LT2
ucaucauuaccuacgcg

SEQ ID NO: 3808533 - RNA, 17 nt, Salmonella typhimurium LT2
ucaucauuaccuuuucc

SEQ ID NO: 3808534 - RNA, 20 nt, Salmonella typhimurium LT2
ucaucauuauauagucaaug

SEQ ID NO: 3808535 - RNA, 14 nt, Salmonella typhimurium LT2
ucaucauuuuccca

SEQ ID NO: 3808536 - RNA, 15 nt, Salmonella typhimurium LT2
ucauccacagaacgg

SEQ ID NO: 3808537 - RNA, 14 nt, Salmonella typhimurium LT2
ucauccagaaaaug

SEQ ID NO: 3808538 - RNA, 16 nt, Salmonella typhimurium LT2
ucauccagcaaaauaa

SEQ ID NO: 3808539 - RNA, 24 nt, Salmonella typhimurium LT2
ucauccagcgagccuuccaucgca

SEQ ID NO: 3808540 - RNA, 13 nt, Salmonella typhimurium LT2
ucauccagcgcgc

SEQ ID NO: 3808541 - RNA, 11 nt, Salmonella typhimurium LT2
ucauccagcgg

SEQ ID NO: 3808542 - RNA, 17 nt, Salmonella typhimurium LT2
ucaucccacgucgccuu

SEQ ID NO: 3808543 - RNA, 16 nt, Salmonella typhimurium LT2
ucaucccagucaucgu

SEQ ID NO: 3808544 - RNA, 22 nt, Salmonella typhimurium LT2
ucaucccagucgucaucccagu

SEQ ID NO: 3808545 - RNA, 15 nt, Salmonella typhimurium LT2
ucauccccaacauca

SEQ ID NO: 3808546 - RNA, 17 nt, Salmonella typhimurium LT2
ucaucccgcugugaucc

SEQ ID NO: 3808547 - RNA, 22 nt, Salmonella typhimurium LT2
ucaucccggcuuaaauuuuuaa

SEQ ID NO: 3808548 - RNA, 23 nt, Salmonella typhimurium LT2
ucaucccgguuucccgcgugaac

SEQ ID NO: 3808549 - RNA, 18 nt, Salmonella typhimurium LT2
ucauccgcccgacaucaa

SEQ ID NO: 3808550 - RNA, 13 nt, Salmonella typhimurium LT2
ucauccgcguaau

SEQ ID NO: 3808551 - RNA, 19 nt, Salmonella typhimurium LT2
ucauccggguuaaaccagc

SEQ ID NO: 3808552 - RNA, 14 nt, Salmonella typhimurium LT2
ucauccgucuggcg

SEQ ID NO: 3808553 - RNA, 16 nt, Salmonella typhimurium LT2
ucaucgaaccgggugc

SEQ ID NO: 3808554 - RNA, 21 nt, Salmonella typhimurium LT2
ucaucgaaggcaucuucagac

SEQ ID NO: 3808555 - RNA, 22 nt, Salmonella typhimurium LT2
ucaucgauacgaccgccgacaa

SEQ ID NO: 3808556 - RNA, 16 nt, Salmonella typhimurium LT2
ucaucgcaaauucugu

SEQ ID NO: 3808557 - RNA, 14 nt, Salmonella typhimurium LT2
ucaucgcauccagg

SEQ ID NO: 3808558 - RNA, 17 nt, Salmonella typhimurium LT2
ucaucgccaagcggcaa

SEQ ID NO: 3808559 - RNA, 22 nt, Salmonella typhimurium LT2
ucaucgccacaugcggcaggcu

SEQ ID NO: 3808560 - RNA, 13 nt, Salmonella typhimurium LT2
ucaucgccagccc

SEQ ID NO: 3808561 - RNA, 18 nt, Salmonella typhimurium LT2
ucaucgccuuaacucuua

SEQ ID NO: 3808562 - RNA, 18 nt, Salmonella typhimurium LT2
ucaucgcucaucagcuuc

SEQ ID NO: 3808563 - RNA, 17 nt, Salmonella typhimurium LT2
ucaucgcuugcccagca

SEQ ID NO: 3808564 - RNA, 16 nt, Salmonella typhimurium LT2
ucaucggccaccacau

SEQ ID NO: 3808565 - RNA, 18 nt, Salmonella typhimurium LT2
ucaucggucaguuugccc

SEQ ID NO: 3808566 - RNA, 20 nt, Salmonella typhimurium LT2
ucaucggucaguuugcccca

SEQ ID NO: 3808567 - RNA, 18 nt, Salmonella typhimurium LT2
ucaucgguguucacaauu

SEQ ID NO: 3808568 - RNA, 17 nt, Salmonella typhimurium LT2
ucaucgguuacuccuua

SEQ ID NO: 3808569 - RNA, 23 nt, Salmonella typhimurium LT2
ucaucguaccaauacccagcgcc

SEQ ID NO: 3808570 - RNA, 20 nt, Salmonella typhimurium LT2
ucaucgucauuaaugccuaa

SEQ ID NO: 3808571 - RNA, 13 nt, Salmonella typhimurium LT2
ucaucuacacgca

SEQ ID NO: 3808572 - RNA, 22 nt, Salmonella typhimurium LT2
ucaucuauagccugcuggguac

SEQ ID NO: 3808573 - RNA, 16 nt, Salmonella typhimurium LT2
ucaucucaagccccau

SEQ ID NO: 3808574 - RNA, 13 nt, Salmonella typhimurium LT2
ucaucugacugcg

SEQ ID NO: 3808575 - RNA, 11 nt, Salmonella typhimurium LT2
ucaucugcuuc

SEQ ID NO: 3808576 - RNA, 19 nt, Salmonella typhimurium LT2
ucaucugguuuugcguaau

SEQ ID NO: 3808577 - RNA, 22 nt, Salmonella typhimurium LT2
ucaucuguagcuucugucccag

SEQ ID NO: 3808578 - RNA, 14 nt, Salmonella typhimurium LT2
ucaucuucaucacu

SEQ ID NO: 3808579 - RNA, 14 nt, Salmonella typhimurium LT2
ucaucuuuuaaaau

SEQ ID NO: 3808580 - RNA, 21 nt, Salmonella typhimurium LT2
ucaugaaaaacaguaccggca

SEQ ID NO: 3808581 - RNA, 23 nt, Salmonella typhimurium LT2
ucaugaaucgcgcgcgccaguca

SEQ ID NO: 3808582 - RNA, 18 nt, Salmonella typhimurium LT2
ucaugaccgguuuuucgc

SEQ ID NO: 3808583 - RNA, 17 nt, Salmonella typhimurium LT2
ucaugauacccagcguc

SEQ ID NO: 3808584 - RNA, 14 nt, Salmonella typhimurium LT2
ucaugaucuuuccu

SEQ ID NO: 3808585 - RNA, 19 nt, Salmonella typhimurium LT2
ucaugaucuuuccuuuuuc

SEQ ID NO: 3808586 - RNA, 20 nt, Salmonella typhimurium LT2
ucaugaucuuuccuuuuuca

SEQ ID NO: 3808587 - RNA, 23 nt, Salmonella typhimurium LT2
ucaugaucuuuccuuuuucaggc

SEQ ID NO: 3808588 - RNA, 22 nt, Salmonella typhimurium LT2
ucaugaugaucuucagcccguu

SEQ ID NO: 3808589 - RNA, 21 nt, Salmonella typhimurium LT2
ucaugcaacuucaccucaguc

SEQ ID NO: 3808590 - RNA, 22 nt, Salmonella typhimurium LT2
ucaugccugccagcauuaaccc

SEQ ID NO: 3808591 - RNA, 22 nt, Salmonella typhimurium LT2
ucaugccuucuuugccuuuuuc

SEQ ID NO: 3808592 - RNA, 13 nt, Salmonella typhimurium LT2
ucaugcggcggug

SEQ ID NO: 3808593 - RNA, 15 nt, Salmonella typhimurium LT2
ucaugcgggagcuug

SEQ ID NO: 3808594 - RNA, 16 nt, Salmonella typhimurium LT2
ucaugcugcaccgcau

SEQ ID NO: 3808595 - RNA, 22 nt, Salmonella typhimurium LT2
ucaugcuggcgaugaguaaaau

SEQ ID NO: 3808596 - RNA, 23 nt, Salmonella typhimurium LT2
ucaugcuguauaaacucagcaau

SEQ ID NO: 3808597 - RNA, 16 nt, Salmonella typhimurium LT2
ucaugcuuaucgccaa

SEQ ID NO: 3808598 - RNA, 20 nt, Salmonella typhimurium LT2
ucaugcuuaucgccaaacca

SEQ ID NO: 3808599 - RNA, 16 nt, Salmonella typhimurium LT2
ucauggaacuuaucca

SEQ ID NO: 3808600 - RNA, 18 nt, Salmonella typhimurium LT2
ucauggaagguauucauc

SEQ ID NO: 3808601 - RNA, 14 nt, Salmonella typhimurium LT2
ucauggcgaacucu

SEQ ID NO: 3808602 - RNA, 21 nt, Salmonella typhimurium LT2
ucauggcgcgacauggcgaaa

SEQ ID NO: 3808603 - RNA, 18 nt, Salmonella typhimurium LT2
ucauggcguucgccgcau

SEQ ID NO: 3808604 - RNA, 16 nt, Salmonella typhimurium LT2
ucauggcuauuuugau

SEQ ID NO: 3808605 - RNA, 20 nt, Salmonella typhimurium LT2
ucauggcucagauugaacgc

SEQ ID NO: 3808606 - RNA, 21 nt, Salmonella typhimurium LT2
ucauggcuuuuacccuucaug

SEQ ID NO: 3808607 - RNA, 16 nt, Salmonella typhimurium LT2
ucaugggcucaucaaa

SEQ ID NO: 3808608 - RNA, 18 nt, Salmonella typhimurium LT2
ucaugguacucaacauca

SEQ ID NO: 3808609 - RNA, 17 nt, Salmonella typhimurium LT2
ucaugguagucaaauuc

SEQ ID NO: 3808610 - RNA, 19 nt, Salmonella typhimurium LT2
ucaugguagucaaauucca

SEQ ID NO: 3808611 - RNA, 17 nt, Salmonella typhimurium LT2
ucaugguguauaaauaa

SEQ ID NO: 3808612 - RNA, 13 nt, Salmonella typhimurium LT2
ucaugguugaaaa

SEQ ID NO: 3808613 - RNA, 22 nt, Salmonella typhimurium LT2
ucaugguugaaaaaagccgaug

SEQ ID NO: 3808614 - RNA, 13 nt, Salmonella typhimurium LT2
ucauuaaaaaacc

SEQ ID NO: 3808615 - RNA, 12 nt, Salmonella typhimurium LT2
ucauuaaaaugc

SEQ ID NO: 3808616 - RNA, 22 nt, Salmonella typhimurium LT2
ucauuaacgacaacuucuaauu

SEQ ID NO: 3808617 - RNA, 18 nt, Salmonella typhimurium LT2
ucauuaacguaggccgga

SEQ ID NO: 3808618 - RNA, 13 nt, Salmonella typhimurium LT2
ucauuaauauaau

SEQ ID NO: 3808619 - RNA, 22 nt, Salmonella typhimurium LT2
ucauuaaucaguucaggaacau

SEQ ID NO: 3808620 - RNA, 21 nt, Salmonella typhimurium LT2
ucauuaauuauacugucgcuc

SEQ ID NO: 3808621 - RNA, 19 nt, Salmonella typhimurium LT2
ucauuacgaaguuuaauuc

SEQ ID NO: 3808622 - RNA, 19 nt, Salmonella typhimurium LT2
ucauuacgccugucgcgcc

SEQ ID NO: 3808623 - RNA, 15 nt, Salmonella typhimurium LT2
ucauuacugggucgc

SEQ ID NO: 3808624 - RNA, 19 nt, Salmonella typhimurium LT2
ucauuauucaggccuccug

SEQ ID NO: 3808625 - RNA, 16 nt, Salmonella typhimurium LT2
ucauucaccaccggau

SEQ ID NO: 3808626 - RNA, 17 nt, Salmonella typhimurium LT2
ucauucagaucaaaaau

SEQ ID NO: 3808627 - RNA, 21 nt, Salmonella typhimurium LT2
ucauucgagaugcauaaaaaa

SEQ ID NO: 3808628 - RNA, 22 nt, Salmonella typhimurium LT2
ucauucgccucaaaacgggcag

SEQ ID NO: 3808629 - RNA, 20 nt, Salmonella typhimurium LT2
ucauucgggucaaugccguc

SEQ ID NO: 3808630 - RNA, 20 nt, Salmonella typhimurium LT2
ucauucgguuaggaauagca

SEQ ID NO: 3808631 - RNA, 16 nt, Salmonella typhimurium LT2
uccagcaaugauuuua

SEQ ID NO: 3808632 - RNA, 23 nt, Salmonella typhimurium LT2
uccagcaauucguugacgcuauc

SEQ ID NO: 3808633 - RNA, 22 nt, Salmonella typhimurium LT2
uccagcaccgcgaccaguucac

SEQ ID NO: 3808634 - RNA, 19 nt, Salmonella typhimurium LT2
uccagcacgagugccagcc

SEQ ID NO: 3808635 - RNA, 22 nt, Salmonella typhimurium LT2
uccagcacgauauccagcaccu

SEQ ID NO: 3808636 - RNA, 22 nt, Salmonella typhimurium LT2
uccagcagaaucuguuucaguu

SEQ ID NO: 3808637 - RNA, 13 nt, Salmonella typhimurium LT2
uccagcagcgcau

SEQ ID NO: 3808638 - RNA, 13 nt, Salmonella typhimurium LT2
uccagcagggcgu

SEQ ID NO: 3808639 - RNA, 18 nt, Salmonella typhimurium LT2
uccagcagguggaucuga

SEQ ID NO: 3808640 - RNA, 22 nt, Salmonella typhimurium LT2
uccagcauaaugugaugcagac

SEQ ID NO: 3808641 - RNA, 17 nt, Salmonella typhimurium LT2
uccagcauuucgacguc

SEQ ID NO: 3808642 - RNA, 12 nt, Salmonella typhimurium LT2
uccagccagcgc

SEQ ID NO: 3808643 - RNA, 19 nt, Salmonella typhimurium LT2
uccagccagcgccagcguu

SEQ ID NO: 3808644 - RNA, 14 nt, Salmonella typhimurium LT2
uccagccccuucgc

SEQ ID NO: 3808645 - RNA, 18 nt, Salmonella typhimurium LT2
uccagccccuucgcuguc

SEQ ID NO: 3808646 - RNA, 22 nt, Salmonella typhimurium LT2
uccagcccggcggauaaaucau

SEQ ID NO: 3808647 - RNA, 21 nt, Salmonella typhimurium LT2
uccagcccguucugugcgccg

SEQ ID NO: 3808648 - RNA, 19 nt, Salmonella typhimurium LT2
uccagcgaauccgugcgca

SEQ ID NO: 3808649 - RNA, 13 nt, Salmonella typhimurium LT2
uccagcgcaugga

SEQ ID NO: 3808650 - RNA, 22 nt, Salmonella typhimurium LT2
uccagcgcauggaagaaaauau

SEQ ID NO: 3808651 - RNA, 16 nt, Salmonella typhimurium LT2
uccagcgccugcugca

SEQ ID NO: 3808652 - RNA, 12 nt, Salmonella typhimurium LT2
uccagcgcgaaa

SEQ ID NO: 3808653 - RNA, 22 nt, Salmonella typhimurium LT2
uccagcgcguccuuauaaugcu

SEQ ID NO: 3808654 - RNA, 19 nt, Salmonella typhimurium LT2
uccagcgcgucggccggca

SEQ ID NO: 3808655 - RNA, 20 nt, Salmonella typhimurium LT2
uccagcggcaggauccccau

SEQ ID NO: 3808656 - RNA, 22 nt, Salmonella typhimurium LT2
uccagcggccaguguacauagc

SEQ ID NO: 3808657 - RNA, 18 nt, Salmonella typhimurium LT2
uccagcgguagccagcgc

SEQ ID NO: 3808658 - RNA, 20 nt, Salmonella typhimurium LT2
uccagcgguagccagcgcag

SEQ ID NO: 3808659 - RNA, 15 nt, Salmonella typhimurium LT2
uccagcguacugcgg

SEQ ID NO: 3808660 - RNA, 15 nt, Salmonella typhimurium LT2
uccagcgucgggccg

SEQ ID NO: 3808661 - RNA, 16 nt, Salmonella typhimurium LT2
uccagcgucgggccgc

SEQ ID NO: 3808662 - RNA, 14 nt, Salmonella typhimurium LT2
uccagcgugcagau

SEQ ID NO: 3808663 - RNA, 18 nt, Salmonella typhimurium LT2
uccagcucagggucccca

SEQ ID NO: 3808664 - RNA, 19 nt, Salmonella typhimurium LT2
uccagcuccagccgcugcc

SEQ ID NO: 3808665 - RNA, 23 nt, Salmonella typhimurium LT2
uccagcucgucgaagcuuuucac

SEQ ID NO: 3808666 - RNA, 20 nt, Salmonella typhimurium LT2
uccagcucuuugguccauaa

SEQ ID NO: 3808667 - RNA, 19 nt, Salmonella typhimurium LT2
uccagcugcgacagcgaac

SEQ ID NO: 3808668 - RNA, 22 nt, Salmonella typhimurium LT2
uccagcuggguuuugucgguaa

SEQ ID NO: 3808669 - RNA, 23 nt, Salmonella typhimurium LT2
uccagcugguauaggccaggcua

SEQ ID NO: 3808670 - RNA, 22 nt, Salmonella typhimurium LT2
uccaggaacaggcccgccagac

SEQ ID NO: 3808671 - RNA, 16 nt, Salmonella typhimurium LT2
uccaggagagcaccuu

SEQ ID NO: 3808672 - RNA, 15 nt, Salmonella typhimurium LT2
uccaggcacucaacc

SEQ ID NO: 3808673 - RNA, 18 nt, Salmonella typhimurium LT2
uccaggcacucaaccugu

SEQ ID NO: 3808674 - RNA, 20 nt, Salmonella typhimurium LT2
uccaggcccggugucagaca

SEQ ID NO: 3808675 - RNA, 19 nt, Salmonella typhimurium LT2
uccaggccgucggcgccag

SEQ ID NO: 3808676 - RNA, 13 nt, Salmonella typhimurium LT2
uccaggcgcugcu

SEQ ID NO: 3808677 - RNA, 24 nt, Salmonella typhimurium LT2
uccaggcucgauaaucaucacgcu

SEQ ID NO: 3808678 - RNA, 21 nt, Salmonella typhimurium LT2
uccaggguuuaaucacgccau

SEQ ID NO: 3808679 - RNA, 17 nt, Salmonella typhimurium LT2
uccagguaacauacaaa

SEQ ID NO: 3808680 - RNA, 21 nt, Salmonella typhimurium LT2
uccaggucaucaccuccagca

SEQ ID NO: 3808681 - RNA, 22 nt, Salmonella typhimurium LT2
uccaguaauucccggcaggcgu

SEQ ID NO: 3808682 - RNA, 15 nt, Salmonella typhimurium LT2
uccaguaauuuuucc

SEQ ID NO: 3808683 - RNA, 17 nt, Salmonella typhimurium LT2
uccaguacaagcaggcu

SEQ ID NO: 3808684 - RNA, 19 nt, Salmonella typhimurium LT2
uccaguacuuucuuuugau

SEQ ID NO: 3808685 - RNA, 14 nt, Salmonella typhimurium LT2
uccaguagcagcga

SEQ ID NO: 3808686 - RNA, 18 nt, Salmonella typhimurium LT2
uccaguaguuccuggaga

SEQ ID NO: 3808687 - RNA, 22 nt, Salmonella typhimurium LT2
uccaguaguuccuggagaacga

SEQ ID NO: 3808688 - RNA, 19 nt, Salmonella typhimurium LT2
uccagucaaaaugucagua

SEQ ID NO: 3808689 - RNA, 14 nt, Salmonella typhimurium LT2
uccagucagcguua

SEQ ID NO: 3808690 - RNA, 16 nt, Salmonella typhimurium LT2
uccagucaggcucaau

SEQ ID NO: 3808691 - RNA, 12 nt, Salmonella typhimurium LT2
uccagucccuga

SEQ ID NO: 3808692 - RNA, 19 nt, Salmonella typhimurium LT2
uccagucgcguaugguuca

SEQ ID NO: 3808693 - RNA, 15 nt, Salmonella typhimurium LT2
uccagugacaaugua

SEQ ID NO: 3808694 - RNA, 15 nt, Salmonella typhimurium LT2
uccagugccgccaga

SEQ ID NO: 3808695 - RNA, 11 nt, Salmonella typhimurium LT2
uccagugguga

SEQ ID NO: 3808696 - RNA, 18 nt, Salmonella typhimurium LT2
uccaguguuguucucuga

SEQ ID NO: 3808697 - RNA, 14 nt, Salmonella typhimurium LT2
uccaguucauaagu

SEQ ID NO: 3808698 - RNA, 18 nt, Salmonella typhimurium LT2
uccaguucauaagucauc

SEQ ID NO: 3808699 - RNA, 21 nt, Salmonella typhimurium LT2
uccaguucauaagucauccag

SEQ ID NO: 3808700 - RNA, 22 nt, Salmonella typhimurium LT2
uccaguucaucuacacgcacuu

SEQ ID NO: 3808701 - RNA, 20 nt, Salmonella typhimurium LT2
uccaguugaugaugccagga

SEQ ID NO: 3808702 - RNA, 17 nt, Salmonella typhimurium LT2
uccaguugcccucuuua

SEQ ID NO: 3808703 - RNA, 15 nt, Salmonella typhimurium LT2
uccaguugcggcauc

SEQ ID NO: 3808704 - RNA, 18 nt, Salmonella typhimurium LT2
uccaguugcuuaccuugu

SEQ ID NO: 3808705 - RNA, 13 nt, Salmonella typhimurium LT2
uccaguuuuuucc

SEQ ID NO: 3808706 - RNA, 17 nt, Salmonella typhimurium LT2
uccaguuuuuuccagcg

SEQ ID NO: 3808707 - RNA, 12 nt, Salmonella typhimurium LT2
uccauaaaauga

SEQ ID NO: 3808708 - RNA, 23 nt, Salmonella typhimurium LT2
uccauaaacuggcgcacaggccu

SEQ ID NO: 3808709 - RNA, 13 nt, Salmonella typhimurium LT2
uccauacauccau

SEQ ID NO: 3808710 - RNA, 22 nt, Salmonella typhimurium LT2
uccauaccggacuccaggcaac

SEQ ID NO: 3808711 - RNA, 18 nt, Salmonella typhimurium LT2
uccauaccguuucaacug

SEQ ID NO: 3808712 - RNA, 19 nt, Salmonella typhimurium LT2
uccauauaacagaauaagc

SEQ ID NO: 3808713 - RNA, 14 nt, Salmonella typhimurium LT2
uccauauccagcgc

SEQ ID NO: 3808714 - RNA, 14 nt, Salmonella typhimurium LT2
uccaucaaaagcuu

SEQ ID NO: 3808715 - RNA, 20 nt, Salmonella typhimurium LT2
uccaucaaaagcuuuucgcu

SEQ ID NO: 3808716 - RNA, 22 nt, Salmonella typhimurium LT2
uccaucacgguuuacgcgcaau

SEQ ID NO: 3808717 - RNA, 13 nt, Salmonella typhimurium LT2
uccaucacuccuu

SEQ ID NO: 3808718 - RNA, 15 nt, Salmonella typhimurium LT2
uccaucagaucauca

SEQ ID NO: 3808719 - RNA, 16 nt, Salmonella typhimurium LT2
uccaucagaucgaucu

SEQ ID NO: 3808720 - RNA, 14 nt, Salmonella typhimurium LT2
uccaucagccaggc

SEQ ID NO: 3808721 - RNA, 16 nt, Salmonella typhimurium LT2
uccaucagccaggguu

SEQ ID NO: 3808722 - RNA, 17 nt, Salmonella typhimurium LT2
uccaucagcgcuuugau

SEQ ID NO: 3808723 - RNA, 14 nt, Salmonella typhimurium LT2
uccaucgaauaaag

SEQ ID NO: 3808724 - RNA, 15 nt, Salmonella typhimurium LT2
uccaucgguucucug

SEQ ID NO: 3808725 - RNA, 21 nt, Salmonella typhimurium LT2
uccaucgguucucugccauca

SEQ ID NO: 3808726 - RNA, 17 nt, Salmonella typhimurium LT2
uccaugagaagaaaaag

SEQ ID NO: 3808727 - RNA, 17 nt, Salmonella typhimurium LT2
uccaugccuuuggccug

SEQ ID NO: 3808728 - RNA, 22 nt, Salmonella typhimurium LT2
uccaugcgauacguaggccuga

SEQ ID NO: 3808729 - RNA, 20 nt, Salmonella typhimurium LT2
uccauggcaaaauucguauu

SEQ ID NO: 3808730 - RNA, 15 nt, Salmonella typhimurium LT2
uccauguaaacucca

SEQ ID NO: 3808731 - RNA, 16 nt, Salmonella typhimurium LT2
uccaugucuugcuauc

SEQ ID NO: 3808732 - RNA, 19 nt, Salmonella typhimurium LT2
uccauuacucucauguuca

SEQ ID NO: 3808733 - RNA, 16 nt, Salmonella typhimurium LT2
uccauuagcgccugau

SEQ ID NO: 3808734 - RNA, 17 nt, Salmonella typhimurium LT2
ucccguaaaagaagaaa

SEQ ID NO: 3808735 - RNA, 16 nt, Salmonella typhimurium LT2
ucccguagcgucaaca

SEQ ID NO: 3808736 - RNA, 16 nt, Salmonella typhimurium LT2
ucccgucauuacgcgc

SEQ ID NO: 3808737 - RNA, 13 nt, Salmonella typhimurium LT2
ucccguuucagug

SEQ ID NO: 3808738 - RNA, 17 nt, Salmonella typhimurium LT2
ucccuaagccggcaggc

SEQ ID NO: 3808739 - RNA, 21 nt, Salmonella typhimurium LT2
ucccuaagccggcaggcagcg

SEQ ID NO: 3808740 - RNA, 13 nt, Salmonella typhimurium LT2
ucccuaauaaaau

SEQ ID NO: 3808741 - RNA, 17 nt, Salmonella typhimurium LT2
ucccucauauuuguauc

SEQ ID NO: 3808742 - RNA, 12 nt, Salmonella typhimurium LT2
ucccucaucaau

SEQ ID NO: 3808743 - RNA, 17 nt, Salmonella typhimurium LT2
ucccucaucaauacguu

SEQ ID NO: 3808744 - RNA, 14 nt, Salmonella typhimurium LT2
ucccucgaaguauu

SEQ ID NO: 3808745 - RNA, 14 nt, Salmonella typhimurium LT2
ucccucgaaugcug

SEQ ID NO: 3808746 - RNA, 12 nt, Salmonella typhimurium LT2
ucccucgccccg

SEQ ID NO: 3808747 - RNA, 14 nt, Salmonella typhimurium LT2
ucccucguguacca

SEQ ID NO: 3808748 - RNA, 11 nt, Salmonella typhimurium LT2
ucccucuccag

SEQ ID NO: 3808749 - RNA, 14 nt, Salmonella typhimurium LT2
ucccucuuaauuuu

SEQ ID NO: 3808750 - RNA, 22 nt, Salmonella typhimurium LT2
ucccugacaauacugaacgccg

SEQ ID NO: 3808751 - RNA, 19 nt, Salmonella typhimurium LT2
ucccugaucggccagauag

SEQ ID NO: 3808752 - RNA, 23 nt, Salmonella typhimurium LT2
ucccuggccggaauacguaauac

SEQ ID NO: 3808753 - RNA, 16 nt, Salmonella typhimurium LT2
ucccugggccucgccc

SEQ ID NO: 3808754 - RNA, 13 nt, Salmonella typhimurium LT2
ucccuguucgcca

SEQ ID NO: 3808755 - RNA, 17 nt, Salmonella typhimurium LT2
ucccuuccgccaccagg

SEQ ID NO: 3808756 - RNA, 18 nt, Salmonella typhimurium LT2
ucccuuccgccaccaggu

SEQ ID NO: 3808757 - RNA, 20 nt, Salmonella typhimurium LT2
ucccuuccgccaccagguuc

SEQ ID NO: 3808758 - RNA, 18 nt, Salmonella typhimurium LT2
ucccuucgaucaugccuu

SEQ ID NO: 3808759 - RNA, 18 nt, Salmonella typhimurium LT2
ucccuuugacaaccugcc

SEQ ID NO: 3808760 - RNA, 21 nt, Salmonella typhimurium LT2
ucccuuugccccauagucaga

SEQ ID NO: 3808761 - RNA, 22 nt, Salmonella typhimurium LT2
ucccuuugguggaguuuucaua

SEQ ID NO: 3808762 - RNA, 19 nt, Salmonella typhimurium LT2
uccgaaaugaccaccgcau

SEQ ID NO: 3808763 - RNA, 21 nt, Salmonella typhimurium LT2
uccgaauacggacauuuauuu

SEQ ID NO: 3808764 - RNA, 18 nt, Salmonella typhimurium LT2
uccgacaugacgccgcag

SEQ ID NO: 3808765 - RNA, 23 nt, Salmonella typhimurium LT2
uccgacgcguuucacaucgccca

SEQ ID NO: 3808766 - RNA, 22 nt, Salmonella typhimurium LT2
uccgauuucguucuuucugcca

SEQ ID NO: 3808767 - RNA, 13 nt, Salmonella typhimurium LT2
uccgcaaacgccg

SEQ ID NO: 3808768 - RNA, 22 nt, Salmonella typhimurium LT2
uccgcaaagacaacgaccagug

SEQ ID NO: 3808769 - RNA, 19 nt, Salmonella typhimurium LT2
uccgcaaagcccaucagcg

SEQ ID NO: 3808770 - RNA, 23 nt, Salmonella typhimurium LT2
uccgcaaagcccaucagcgccag

SEQ ID NO: 3808771 - RNA, 22 nt, Salmonella typhimurium LT2
uccgcaagacacgcuuccagau

SEQ ID NO: 3808772 - RNA, 17 nt, Salmonella typhimurium LT2
uccgcaagaguaaucgu

SEQ ID NO: 3808773 - RNA, 15 nt, Salmonella typhimurium LT2
uccgcaaucgcugcc

SEQ ID NO: 3808774 - RNA, 16 nt, Salmonella typhimurium LT2
uccgcaauuaauuuau

SEQ ID NO: 3808775 - RNA, 16 nt, Salmonella typhimurium LT2
uccgcaauuuccugau

SEQ ID NO: 3808776 - RNA, 17 nt, Salmonella typhimurium LT2
uccgcacauaaucaccg

SEQ ID NO: 3808777 - RNA, 14 nt, Salmonella typhimurium LT2
uccgcacgcgcgcc

SEQ ID NO: 3808778 - RNA, 17 nt, Salmonella typhimurium LT2
uccgcacgcgcgcccau

SEQ ID NO: 3808779 - RNA, 20 nt, Salmonella typhimurium LT2
uccgcagccagaaucagccg

SEQ ID NO: 3808780 - RNA, 16 nt, Salmonella typhimurium LT2
uccgcagccgacgcau

SEQ ID NO: 3808781 - RNA, 17 nt, Salmonella typhimurium LT2
uccgcagccgacgcauu

SEQ ID NO: 3808782 - RNA, 21 nt, Salmonella typhimurium LT2
uccgcaggcgacgugacggug

SEQ ID NO: 3808783 - RNA, 23 nt, Salmonella typhimurium LT2
uccgcaucguuaucauuaucgcc

SEQ ID NO: 3808784 - RNA, 22 nt, Salmonella typhimurium LT2
uccgcaucguucaacucgcuaa

SEQ ID NO: 3808785 - RNA, 13 nt, Salmonella typhimurium LT2
uccgcauuucgcc

SEQ ID NO: 3808786 - RNA, 13 nt, Salmonella typhimurium LT2
uccgccaccagcg

SEQ ID NO: 3808787 - RNA, 12 nt, Salmonella typhimurium LT2
uccgccacggcu

SEQ ID NO: 3808788 - RNA, 19 nt, Salmonella typhimurium LT2
uccgccagacucagccagg

SEQ ID NO: 3808789 - RNA, 19 nt, Salmonella typhimurium LT2
uccgccagauacaaaucuc

SEQ ID NO: 3808790 - RNA, 15 nt, Salmonella typhimurium LT2
uccgccagcaacacu

SEQ ID NO: 3808791 - RNA, 16 nt, Salmonella typhimurium LT2
uccgccaggcccauga

SEQ ID NO: 3808792 - RNA, 20 nt, Salmonella typhimurium LT2
uccgccauaaacgguuucag

SEQ ID NO: 3808793 - RNA, 20 nt, Salmonella typhimurium LT2
uccgccauaacggcugucca

SEQ ID NO: 3808794 - RNA, 14 nt, Salmonella typhimurium LT2
uccgccauaucccc

SEQ ID NO: 3808795 - RNA, 22 nt, Salmonella typhimurium LT2
uccgccaugaaaaaaacgcauu

SEQ ID NO: 3808796 - RNA, 18 nt, Salmonella typhimurium LT2
uccgcccaggaacaugac

SEQ ID NO: 3808797 - RNA, 19 nt, Salmonella typhimurium LT2
uccgcccgccucaaaccag

SEQ ID NO: 3808798 - RNA, 19 nt, Salmonella typhimurium LT2
uccgcccgcgcucccgccc

SEQ ID NO: 3808799 - RNA, 15 nt, Salmonella typhimurium LT2
uccgccgcaaacugg

SEQ ID NO: 3808800 - RNA, 15 nt, Salmonella typhimurium LT2
uccgccgccagccau

SEQ ID NO: 3808801 - RNA, 13 nt, Salmonella typhimurium LT2
uccgccgccgcaa

SEQ ID NO: 3808802 - RNA, 13 nt, Salmonella typhimurium LT2
uccgccgccuucu

SEQ ID NO: 3808803 - RNA, 23 nt, Salmonella typhimurium LT2
uccgccgggauaauauugccauu

SEQ ID NO: 3808804 - RNA, 15 nt, Salmonella typhimurium LT2
uccgccgucgucacc

SEQ ID NO: 3808805 - RNA, 21 nt, Salmonella typhimurium LT2
uccgccugauaaaacgcaggc

SEQ ID NO: 3808806 - RNA, 21 nt, Salmonella typhimurium LT2
uccgccugaucuuucugguaa

SEQ ID NO: 3808807 - RNA, 16 nt, Salmonella typhimurium LT2
uccgccuggaacccag

SEQ ID NO: 3808808 - RNA, 17 nt, Salmonella typhimurium LT2
uccgccuggaacccagg

SEQ ID NO: 3808809 - RNA, 18 nt, Salmonella typhimurium LT2
uccgccuggaacccaggc

SEQ ID NO: 3808810 - RNA, 15 nt, Salmonella typhimurium LT2
uccgcgacguacugg

SEQ ID NO: 3808811 - RNA, 21 nt, Salmonella typhimurium LT2
uccgcgacguacuggaacagu

SEQ ID NO: 3808812 - RNA, 17 nt, Salmonella typhimurium LT2
uccgcgagcagccagau

SEQ ID NO: 3808813 - RNA, 23 nt, Salmonella typhimurium LT2
uccgcgauggucuucuuucaggu

SEQ ID NO: 3808814 - RNA, 18 nt, Salmonella typhimurium LT2
uccgcgcaaauacugaaa

SEQ ID NO: 3808815 - RNA, 15 nt, Salmonella typhimurium LT2
uccgcgcauccugca

SEQ ID NO: 3808816 - RNA, 23 nt, Salmonella typhimurium LT2
uccgcgcgcuuuuuuggcguaga

SEQ ID NO: 3808817 - RNA, 20 nt, Salmonella typhimurium LT2
uccgcgcugaugguuucggc

SEQ ID NO: 3808818 - RNA, 19 nt, Salmonella typhimurium LT2
uccgcgcuuucuggcgcag

SEQ ID NO: 3808819 - RNA, 18 nt, Salmonella typhimurium LT2
uccgcguaaucgcgaaua

SEQ ID NO: 3808820 - RNA, 22 nt, Salmonella typhimurium LT2
uccgcguaaugguguccacaag

SEQ ID NO: 3808821 - RNA, 22 nt, Salmonella typhimurium LT2
uccgcgugaugggcgaucgccg

SEQ ID NO: 3808822 - RNA, 16 nt, Salmonella typhimurium LT2
uccgcguggacgcguu

SEQ ID NO: 3808823 - RNA, 23 nt, Salmonella typhimurium LT2
uccgcguuagcaaguccgggcug

SEQ ID NO: 3808824 - RNA, 14 nt, Salmonella typhimurium LT2
uccgcguuuaucgc

SEQ ID NO: 3808825 - RNA, 16 nt, Salmonella typhimurium LT2
uccgcuauuaccagua

SEQ ID NO: 3808826 - RNA, 16 nt, Salmonella typhimurium LT2
uccgcugacacgcgca

SEQ ID NO: 3808827 - RNA, 22 nt, Salmonella typhimurium LT2
uccgcuuacucguuuugccgau

SEQ ID NO: 3808828 - RNA, 18 nt, Salmonella typhimurium LT2
uccgcuucaccuuucgcc

SEQ ID NO: 3808829 - RNA, 15 nt, Salmonella typhimurium LT2
uccggaagacagcuu

SEQ ID NO: 3808830 - RNA, 17 nt, Salmonella typhimurium LT2
uccggacugauagucau

SEQ ID NO: 3808831 - RNA, 15 nt, Salmonella typhimurium LT2
uccggaucaucuuuu

SEQ ID NO: 3808832 - RNA, 16 nt, Salmonella typhimurium LT2
uccggaugacgccgcu

SEQ ID NO: 3808833 - RNA, 23 nt, Salmonella typhimurium LT2
uccggaugcgacuccaggaacag

SEQ ID NO: 3808834 - RNA, 18 nt, Salmonella typhimurium LT2
uccggauggcguuccagc

SEQ ID NO: 3808835 - RNA, 23 nt, Salmonella typhimurium LT2
uccggcaacugccggggaaguac

SEQ ID NO: 3808836 - RNA, 19 nt, Salmonella typhimurium LT2
uccggcaagggucuuaacc

SEQ ID NO: 3808837 - RNA, 16 nt, Salmonella typhimurium LT2
uccugaauagcaggca

SEQ ID NO: 3808838 - RNA, 22 nt, Salmonella typhimurium LT2
uccugaauagcaggcaaaaaag

SEQ ID NO: 3808839 - RNA, 16 nt, Salmonella typhimurium LT2
uccugaaucaccagcc

SEQ ID NO: 3808840 - RNA, 16 nt, Salmonella typhimurium LT2
uccugaauugucccca

SEQ ID NO: 3808841 - RNA, 15 nt, Salmonella typhimurium LT2
uccugaauuucacgc

SEQ ID NO: 3808842 - RNA, 23 nt, Salmonella typhimurium LT2
uccugaccuuguagcacaaucug

SEQ ID NO: 3808843 - RNA, 20 nt, Salmonella typhimurium LT2
uccugacguggcggaaaauc

SEQ ID NO: 3808844 - RNA, 12 nt, Salmonella typhimurium LT2
uccugauaaccu

SEQ ID NO: 3808845 - RNA, 21 nt, Salmonella typhimurium LT2
uccugauagccguaaauaauc

SEQ ID NO: 3808846 - RNA, 17 nt, Salmonella typhimurium LT2
uccugaucaaggcgcag

SEQ ID NO: 3808847 - RNA, 13 nt, Salmonella typhimurium LT2
uccugauccggcu

SEQ ID NO: 3808848 - RNA, 20 nt, Salmonella typhimurium LT2
uccugauuaaguuuuuuuaa

SEQ ID NO: 3808849 - RNA, 14 nt, Salmonella typhimurium LT2
uccugcaaaaggaa

SEQ ID NO: 3808850 - RNA, 16 nt, Salmonella typhimurium LT2
uccugcaacagaagag

SEQ ID NO: 3808851 - RNA, 18 nt, Salmonella typhimurium LT2
uccugcaauccgacaaga

SEQ ID NO: 3808852 - RNA, 17 nt, Salmonella typhimurium LT2
uccugcacuuccagcca

SEQ ID NO: 3808853 - RNA, 13 nt, Salmonella typhimurium LT2
uccugcagcgcca

SEQ ID NO: 3808854 - RNA, 20 nt, Salmonella typhimurium LT2
uccugcaggcgagugcuacc

SEQ ID NO: 3808855 - RNA, 23 nt, Salmonella typhimurium LT2
uccugcaggguaauuagccccug

SEQ ID NO: 3808856 - RNA, 20 nt, Salmonella typhimurium LT2
uccugcaucgacauccgauu

SEQ ID NO: 3808857 - RNA, 16 nt, Salmonella typhimurium LT2
uccugccaaauaaucc

SEQ ID NO: 3808858 - RNA, 11 nt, Salmonella typhimurium LT2
uccugccagac

SEQ ID NO: 3808859 - RNA, 15 nt, Salmonella typhimurium LT2
uccugccagacccca

SEQ ID NO: 3808860 - RNA, 20 nt, Salmonella typhimurium LT2
uccugcccgccacccuccgg

SEQ ID NO: 3808861 - RNA, 16 nt, Salmonella typhimurium LT2
uccugccgacaggcag

SEQ ID NO: 3808862 - RNA, 13 nt, Salmonella typhimurium LT2
uccugccgccgca

SEQ ID NO: 3808863 - RNA, 14 nt, Salmonella typhimurium LT2
uccugccgccgcac

SEQ ID NO: 3808864 - RNA, 22 nt, Salmonella typhimurium LT2
uccugccgccgcaccacugcug

SEQ ID NO: 3808865 - RNA, 17 nt, Salmonella typhimurium LT2
uccugcgccagcaccau

SEQ ID NO: 3808866 - RNA, 19 nt, Salmonella typhimurium LT2
uccugcgcugucaccagca

SEQ ID NO: 3808867 - RNA, 22 nt, Salmonella typhimurium LT2
uccugcgcuuuuugcuucgcca

SEQ ID NO: 3808868 - RNA, 15 nt, Salmonella typhimurium LT2
uccugcggaacgcgg

SEQ ID NO: 3808869 - RNA, 21 nt, Salmonella typhimurium LT2
uccugcggcauuagcaugggc

SEQ ID NO: 3808870 - RNA, 20 nt, Salmonella typhimurium LT2
uccugcgggcuuagggucag

SEQ ID NO: 3808871 - RNA, 14 nt, Salmonella typhimurium LT2
uccugcuccugcgg

SEQ ID NO: 3808872 - RNA, 21 nt, Salmonella typhimurium LT2
uccuggcaaagcgucauguaa

SEQ ID NO: 3808873 - RNA, 16 nt, Salmonella typhimurium LT2
uccuggcgugucccca

SEQ ID NO: 3808874 - RNA, 22 nt, Salmonella typhimurium LT2
uccuggcugucggcagaaccug

SEQ ID NO: 3808875 - RNA, 16 nt, Salmonella typhimurium LT2
uccuggcuuaccugcu

SEQ ID NO: 3808876 - RNA, 12 nt, Salmonella typhimurium LT2
uccuggcuucaa

SEQ ID NO: 3808877 - RNA, 15 nt, Salmonella typhimurium LT2
uccuggcuugccaga

SEQ ID NO: 3808878 - RNA, 16 nt, Salmonella typhimurium LT2
uccugggauaccggaa

SEQ ID NO: 3808879 - RNA, 21 nt, Salmonella typhimurium LT2
uccugggcaaaauagcccggc

SEQ ID NO: 3808880 - RNA, 15 nt, Salmonella typhimurium LT2
uccugguaggggaaa

SEQ ID NO: 3808881 - RNA, 22 nt, Salmonella typhimurium LT2
uccuguaacaacuguuuuucac

SEQ ID NO: 3808882 - RNA, 18 nt, Salmonella typhimurium LT2
uccuguagguucgguaug

SEQ ID NO: 3808883 - RNA, 16 nt, Salmonella typhimurium LT2
uccugugaaguaaaaa

SEQ ID NO: 3808884 - RNA, 17 nt, Salmonella typhimurium LT2
uccuguucauccacaga

SEQ ID NO: 3808885 - RNA, 12 nt, Salmonella typhimurium LT2
uccuguuccuga

SEQ ID NO: 3808886 - RNA, 16 nt, Salmonella typhimurium LT2
uccuguucguucaaau

SEQ ID NO: 3808887 - RNA, 20 nt, Salmonella typhimurium LT2
uccuguuuaagcccggccuu

SEQ ID NO: 3808888 - RNA, 13 nt, Salmonella typhimurium LT2
uccuuaaucagcu

SEQ ID NO: 3808889 - RNA, 22 nt, Salmonella typhimurium LT2
uccuuaugaccgagucuacauc

SEQ ID NO: 3808890 - RNA, 17 nt, Salmonella typhimurium LT2
uccuuauuuaauacauc

SEQ ID NO: 3808891 - RNA, 20 nt, Salmonella typhimurium LT2
uccuuauuuaauacaucaga

SEQ ID NO: 3808892 - RNA, 22 nt, Salmonella typhimurium LT2
uccuuauuuacgguuggccagc

SEQ ID NO: 3808893 - RNA, 18 nt, Salmonella typhimurium LT2
uccuucagcguuugcgcc

SEQ ID NO: 3808894 - RNA, 18 nt, Salmonella typhimurium LT2
uccuucagcuucacgaag

SEQ ID NO: 3808895 - RNA, 17 nt, Salmonella typhimurium LT2
uccuuccagcccguucu

SEQ ID NO: 3808896 - RNA, 15 nt, Salmonella typhimurium LT2
uccuucccccaccac

SEQ ID NO: 3808897 - RNA, 23 nt, Salmonella typhimurium LT2
uccuuccgaaucaauuccuacaa

SEQ ID NO: 3808898 - RNA, 13 nt, Salmonella typhimurium LT2
uccuuccgccgca

SEQ ID NO: 3808899 - RNA, 16 nt, Salmonella typhimurium LT2
uccuuccgcuuuaagc

SEQ ID NO: 3808900 - RNA, 20 nt, Salmonella typhimurium LT2
uccuuccggcuuuaacccug

SEQ ID NO: 3808901 - RNA, 15 nt, Salmonella typhimurium LT2
uccuuccuccaccac

SEQ ID NO: 3808902 - RNA, 18 nt, Salmonella typhimurium LT2
uccuucuuccauucccac

SEQ ID NO: 3808903 - RNA, 11 nt, Salmonella typhimurium LT2
uccuucuuccg

SEQ ID NO: 3808904 - RNA, 22 nt, Salmonella typhimurium LT2
uccuugcagccagaacucaucu

SEQ ID NO: 3808905 - RNA, 20 nt, Salmonella typhimurium LT2
uccuugccagugaaaaaaag

SEQ ID NO: 3808906 - RNA, 21 nt, Salmonella typhimurium LT2
uccuugcuucgauggccucau

SEQ ID NO: 3808907 - RNA, 15 nt, Salmonella typhimurium LT2
uccuuuaucugcccu

SEQ ID NO: 3808908 - RNA, 18 nt, Salmonella typhimurium LT2
uccuuucgagaagcccag

SEQ ID NO: 3808909 - RNA, 15 nt, Salmonella typhimurium LT2
uccuuugccuuucuu

SEQ ID NO: 3808910 - RNA, 21 nt, Salmonella typhimurium LT2
uccuuuuaccggcgaagucgc

SEQ ID NO: 3808911 - RNA, 13 nt, Salmonella typhimurium LT2
ucgaaaaucacug

SEQ ID NO: 3808912 - RNA, 22 nt, Salmonella typhimurium LT2
ucgaaacguucgcaucccagga

SEQ ID NO: 3808913 - RNA, 20 nt, Salmonella typhimurium LT2
ucgaaacuggcauugugagc

SEQ ID NO: 3808914 - RNA, 16 nt, Salmonella typhimurium LT2
ucgaaauaaagaaagu

SEQ ID NO: 3808915 - RNA, 15 nt, Salmonella typhimurium LT2
ucgaacagcggcaga

SEQ ID NO: 3808916 - RNA, 22 nt, Salmonella typhimurium LT2
ucgaaccaacgacccccaccau

SEQ ID NO: 3808917 - RNA, 17 nt, Salmonella typhimurium LT2
ucgaacgccgacaucac

SEQ ID NO: 3808918 - RNA, 11 nt, Salmonella typhimurium LT2
ucgaacgccgc

SEQ ID NO: 3808919 - RNA, 17 nt, Salmonella typhimurium LT2
ucgaacgguaacaggaa

SEQ ID NO: 3808920 - RNA, 20 nt, Salmonella typhimurium LT2
ucgaagaauuccaccuuacc

SEQ ID NO: 3808921 - RNA, 13 nt, Salmonella typhimurium LT2
ucgaagcuuuuca

SEQ ID NO: 3808922 - RNA, 20 nt, Salmonella typhimurium LT2
ucgaagugcgaaauuuaaua

SEQ ID NO: 3808923 - RNA, 21 nt, Salmonella typhimurium LT2
ucgaauaaagacaaugcugcu

SEQ ID NO: 3808924 - RNA, 12 nt, Salmonella typhimurium LT2
ucgaauucugau

SEQ ID NO: 3808925 - RNA, 16 nt, Salmonella typhimurium LT2
ucgacaaacaccgagc

SEQ ID NO: 3808926 - RNA, 14 nt, Salmonella typhimurium LT2
ucgacaaaggcaag

SEQ ID NO: 3808927 - RNA, 18 nt, Salmonella typhimurium LT2
ucgacaagcggguggucu

SEQ ID NO: 3808928 - RNA, 16 nt, Salmonella typhimurium LT2
ucgacaagcuaauccc

SEQ ID NO: 3808929 - RNA, 17 nt, Salmonella typhimurium LT2
ucgacaauguccgccag

SEQ ID NO: 3808930 - RNA, 22 nt, Salmonella typhimurium LT2
ucgacaccagcgauaaacgcca

SEQ ID NO: 3808931 - RNA, 18 nt, Salmonella typhimurium LT2
ucgacagauuggucagca

SEQ ID NO: 3808932 - RNA, 19 nt, Salmonella typhimurium LT2
ucgacagcccgccagcaua

SEQ ID NO: 3808933 - RNA, 21 nt, Salmonella typhimurium LT2
ucgacauauugauagagcaaa

SEQ ID NO: 3808934 - RNA, 21 nt, Salmonella typhimurium LT2
ucgacaugcgcaugugaguau

SEQ ID NO: 3808935 - RNA, 15 nt, Salmonella typhimurium LT2
ucgacaugggcggga

SEQ ID NO: 3808936 - RNA, 22 nt, Salmonella typhimurium LT2
ucgacauuaacgaugccuuaug

SEQ ID NO: 3808937 - RNA, 14 nt, Salmonella typhimurium LT2
ucgacccccaccau

SEQ ID NO: 3808938 - RNA, 18 nt, Salmonella typhimurium LT2
ucgacccccaccauguca

SEQ ID NO: 3808939 - RNA, 19 nt, Salmonella typhimurium LT2
ucgacccccaccaugucaa

SEQ ID NO: 3808940 - RNA, 22 nt, Salmonella typhimurium LT2
ucgacccccaccaugucaaggu

SEQ ID NO: 3808941 - RNA, 23 nt, Salmonella typhimurium LT2
ucgccacccggcuuuuuuauugc

SEQ ID NO: 3808942 - RNA, 18 nt, Salmonella typhimurium LT2
ucgccaccgcauuuucag

SEQ ID NO: 3808943 - RNA, 19 nt, Salmonella typhimurium LT2
ucgccaccgcuacaaucca

SEQ ID NO: 3808944 - RNA, 14 nt, Salmonella typhimurium LT2
ucgccaccggcaca

SEQ ID NO: 3808945 - RNA, 19 nt, Salmonella typhimurium LT2
ucgccacgccaauaguuaa

SEQ ID NO: 3808946 - RNA, 12 nt, Salmonella typhimurium LT2
ucgccacggcca

SEQ ID NO: 3808947 - RNA, 18 nt, Salmonella typhimurium LT2
ucgccagaccgaaaagcc

SEQ ID NO: 3808948 - RNA, 16 nt, Salmonella typhimurium LT2
ucgccagcaacgccca

SEQ ID NO: 3808949 - RNA, 16 nt, Salmonella typhimurium LT2
ucgccagcagcgcgau

SEQ ID NO: 3808950 - RNA, 22 nt, Salmonella typhimurium LT2
ucgccagcauacgucugcgcug

SEQ ID NO: 3808951 - RNA, 15 nt, Salmonella typhimurium LT2
ucgccagccccagcc

SEQ ID NO: 3808952 - RNA, 16 nt, Salmonella typhimurium LT2
ucgccagccccagccc

SEQ ID NO: 3808953 - RNA, 15 nt, Salmonella typhimurium LT2
ucgccagcccgacua

SEQ ID NO: 3808954 - RNA, 18 nt, Salmonella typhimurium LT2
ucgccagcccgaucaucu

SEQ ID NO: 3808955 - RNA, 19 nt, Salmonella typhimurium LT2
ucgccagccgcagcucaua

SEQ ID NO: 3808956 - RNA, 17 nt, Salmonella typhimurium LT2
ucgccagcgcagucagu

SEQ ID NO: 3808957 - RNA, 20 nt, Salmonella typhimurium LT2
ucgccagcggaucgcgucca

SEQ ID NO: 3808958 - RNA, 18 nt, Salmonella typhimurium LT2
ucgccagcggcagcgcgg

SEQ ID NO: 3808959 - RNA, 15 nt, Salmonella typhimurium LT2
ucgccagcguuagca

SEQ ID NO: 3808960 - RNA, 10 nt, Salmonella typhimurium LT2
ucgccaggcc

SEQ ID NO: 3808961 - RNA, 13 nt, Salmonella typhimurium LT2
ucgccaguugcag

SEQ ID NO: 3808962 - RNA, 16 nt, Salmonella typhimurium LT2
ucgccauaaagcugua

SEQ ID NO: 3808963 - RNA, 20 nt, Salmonella typhimurium LT2
ucgccauaaagcuguaccug

SEQ ID NO: 3808964 - RNA, 16 nt, Salmonella typhimurium LT2
ucgccauacaucgcgu

SEQ ID NO: 3808965 - RNA, 13 nt, Salmonella typhimurium LT2
ucgccaucaccag

SEQ ID NO: 3808966 - RNA, 17 nt, Salmonella typhimurium LT2
ucgccauccaccaggac

SEQ ID NO: 3808967 - RNA, 18 nt, Salmonella typhimurium LT2
ucgccaucgacagcagcg

SEQ ID NO: 3808968 - RNA, 15 nt, Salmonella typhimurium LT2
ucgccaugaccacaa

SEQ ID NO: 3808969 - RNA, 18 nt, Salmonella typhimurium LT2
ucgccauuccaagaauga

SEQ ID NO: 3808970 - RNA, 19 nt, Salmonella typhimurium LT2
ucgccauugcaauaccggc

SEQ ID NO: 3808971 - RNA, 23 nt, Salmonella typhimurium LT2
ucgcccaaauaguccagcagcca

SEQ ID NO: 3808972 - RNA, 19 nt, Salmonella typhimurium LT2
ucgcccaaaugcucugcaa

SEQ ID NO: 3808973 - RNA, 22 nt, Salmonella typhimurium LT2
ucgcccaccgcauagacgugcg

SEQ ID NO: 3808974 - RNA, 15 nt, Salmonella typhimurium LT2
ucgcccacgcccaga

SEQ ID NO: 3808975 - RNA, 13 nt, Salmonella typhimurium LT2
ucgcccaggcgau

SEQ ID NO: 3808976 - RNA, 21 nt, Salmonella typhimurium LT2
ucgcccagguuguaucauguu

SEQ ID NO: 3808977 - RNA, 17 nt, Salmonella typhimurium LT2
ucgccccgaccaggaug

SEQ ID NO: 3808978 - RNA, 13 nt, Salmonella typhimurium LT2
ucgcccgccagau

SEQ ID NO: 3808979 - RNA, 14 nt, Salmonella typhimurium LT2
ucgcccgcgaugau

SEQ ID NO: 3808980 - RNA, 15 nt, Salmonella typhimurium LT2
ucgcccgcucgcgau

SEQ ID NO: 3808981 - RNA, 14 nt, Salmonella typhimurium LT2
ucgcccggaaaugg

SEQ ID NO: 3808982 - RNA, 16 nt, Salmonella typhimurium LT2
ucgcccggaucgcggc

SEQ ID NO: 3808983 - RNA, 23 nt, Salmonella typhimurium LT2
ucgcccguucugaccaguugcag

SEQ ID NO: 3808984 - RNA, 14 nt, Salmonella typhimurium LT2
ucgcccguuuuacc

SEQ ID NO: 3808985 - RNA, 14 nt, Salmonella typhimurium LT2
ucgcccugccagcu

SEQ ID NO: 3808986 - RNA, 14 nt, Salmonella typhimurium LT2
ucgcccugcgccag

SEQ ID NO: 3808987 - RNA, 18 nt, Salmonella typhimurium LT2
ucgcccugcgccagacgc

SEQ ID NO: 3808988 - RNA, 19 nt, Salmonella typhimurium LT2
ucgcccuguauacaggccu

SEQ ID NO: 3808989 - RNA, 13 nt, Salmonella typhimurium LT2
ucgccgcaucggc

SEQ ID NO: 3808990 - RNA, 18 nt, Salmonella typhimurium LT2
ucgccgcccaaccagccc

SEQ ID NO: 3808991 - RNA, 22 nt, Salmonella typhimurium LT2
ucgccgccgccagguuauccag

SEQ ID NO: 3808992 - RNA, 22 nt, Salmonella typhimurium LT2
ucgccgccgccgcgacugcuuc

SEQ ID NO: 3808993 - RNA, 12 nt, Salmonella typhimurium LT2
ucgccgcgacag

SEQ ID NO: 3808994 - RNA, 13 nt, Salmonella typhimurium LT2
ucgccgcggcgca

SEQ ID NO: 3808995 - RNA, 20 nt, Salmonella typhimurium LT2
ucgccgcggugauccuccug

SEQ ID NO: 3808996 - RNA, 21 nt, Salmonella typhimurium LT2
ucgccggagccgccuggccug

SEQ ID NO: 3808997 - RNA, 17 nt, Salmonella typhimurium LT2
ucgccgggauaaaacac

SEQ ID NO: 3808998 - RNA, 16 nt, Salmonella typhimurium LT2
ucgccgguagccagcc

SEQ ID NO: 3808999 - RNA, 15 nt, Salmonella typhimurium LT2
ucgccgguuggcaug

SEQ ID NO: 3809000 - RNA, 23 nt, Salmonella typhimurium LT2
ucgccguaaaacaacagcggcgu

SEQ ID NO: 3809001 - RNA, 16 nt, Salmonella typhimurium LT2
ucgccguaaaauucac

SEQ ID NO: 3809002 - RNA, 19 nt, Salmonella typhimurium LT2
ucgccguaacgaacgcgga

SEQ ID NO: 3809003 - RNA, 18 nt, Salmonella typhimurium LT2
ucgccgucagugagcccu

SEQ ID NO: 3809004 - RNA, 14 nt, Salmonella typhimurium LT2
ucgccguccauuuc

SEQ ID NO: 3809005 - RNA, 13 nt, Salmonella typhimurium LT2
ucgccguuaugca

SEQ ID NO: 3809006 - RNA, 17 nt, Salmonella typhimurium LT2
ucgccguuccauuccag

SEQ ID NO: 3809007 - RNA, 17 nt, Salmonella typhimurium LT2
ucgccguugauuuucag

SEQ ID NO: 3809008 - RNA, 19 nt, Salmonella typhimurium LT2
ucgccuaagcguucaucag

SEQ ID NO: 3809009 - RNA, 14 nt, Salmonella typhimurium LT2
ucgccuccagcgau

SEQ ID NO: 3809010 - RNA, 16 nt, Salmonella typhimurium LT2
ucgccuccagcgauag

SEQ ID NO: 3809011 - RNA, 22 nt, Salmonella typhimurium LT2
ucgccugauauaaucgaaucgc

SEQ ID NO: 3809012 - RNA, 18 nt, Salmonella typhimurium LT2
ucgccugcgucgccccaa

SEQ ID NO: 3809013 - RNA, 23 nt, Salmonella typhimurium LT2
ucgccuggugcgggucaaaagcg

SEQ ID NO: 3809014 - RNA, 17 nt, Salmonella typhimurium LT2
ucgccuguaccgggcag

SEQ ID NO: 3809015 - RNA, 18 nt, Salmonella typhimurium LT2
ucgccuguccggccugua

SEQ ID NO: 3809016 - RNA, 14 nt, Salmonella typhimurium LT2
ucgccuucacgcau

SEQ ID NO: 3809017 - RNA, 13 nt, Salmonella typhimurium LT2
ucgccuucauccg

SEQ ID NO: 3809018 - RNA, 19 nt, Salmonella typhimurium LT2
ucgccuuccgcaccgccag

SEQ ID NO: 3809019 - RNA, 18 nt, Salmonella typhimurium LT2
ucgccuucgccggcaaca

SEQ ID NO: 3809020 - RNA, 20 nt, Salmonella typhimurium LT2
ucgccuucgccggcaacagg

SEQ ID NO: 3809021 - RNA, 17 nt, Salmonella typhimurium LT2
ucgccuucuucaucuuc

SEQ ID NO: 3809022 - RNA, 15 nt, Salmonella typhimurium LT2
ucgccuuucacgcgu

SEQ ID NO: 3809023 - RNA, 16 nt, Salmonella typhimurium LT2
ucgccuuucacgcguu

SEQ ID NO: 3809024 - RNA, 19 nt, Salmonella typhimurium LT2
ucgccuuuuagcgcguuac

SEQ ID NO: 3809025 - RNA, 20 nt, Salmonella typhimurium LT2
ucgcgaauagugcagaaagg

SEQ ID NO: 3809026 - RNA, 13 nt, Salmonella typhimurium LT2
ucgcgaauuucaa

SEQ ID NO: 3809027 - RNA, 21 nt, Salmonella typhimurium LT2
ucgcgacggaccggcagcguc

SEQ ID NO: 3809028 - RNA, 20 nt, Salmonella typhimurium LT2
ucgcgagaaaauagaggaaa

SEQ ID NO: 3809029 - RNA, 13 nt, Salmonella typhimurium LT2
ucgcgauaacguu

SEQ ID NO: 3809030 - RNA, 14 nt, Salmonella typhimurium LT2
ucgcgauaaucaac

SEQ ID NO: 3809031 - RNA, 20 nt, Salmonella typhimurium LT2
ucgcgauaaucaacucuccu

SEQ ID NO: 3809032 - RNA, 19 nt, Salmonella typhimurium LT2
ucgcgauacugccgcccau

SEQ ID NO: 3809033 - RNA, 17 nt, Salmonella typhimurium LT2
ucgcgaucacagacaga

SEQ ID NO: 3809034 - RNA, 18 nt, Salmonella typhimurium LT2
ucgcgauccugaaaugcc

SEQ ID NO: 3809035 - RNA, 13 nt, Salmonella typhimurium LT2
ucgcgauuuagcg

SEQ ID NO: 3809036 - RNA, 15 nt, Salmonella typhimurium LT2
ucgcgcaccauaaua

SEQ ID NO: 3809037 - RNA, 20 nt, Salmonella typhimurium LT2
ucgcgcagauagagcgccug

SEQ ID NO: 3809038 - RNA, 13 nt, Salmonella typhimurium LT2
ucgcgcagccagc

SEQ ID NO: 3809039 - RNA, 18 nt, Salmonella typhimurium LT2
ucgcgcagccagcgcccc

SEQ ID NO: 3809040 - RNA, 17 nt, Salmonella typhimurium LT2
ucgcgcauggcagggcg

SEQ ID NO: 3809041 - RNA, 18 nt, Salmonella typhimurium LT2
ucgcgccaaaagaggcag

SEQ ID NO: 3809042 - RNA, 20 nt, Salmonella typhimurium LT2
ucgcgccaaaagaggcagca

SEQ ID NO: 3809043 - RNA, 15 nt, Salmonella typhimurium LT2
ucgcgccacgcagau

SEQ ID NO: 3809044 - RNA, 19 nt, Salmonella typhimurium LT2
ucgcgcccuccuccagcgu

SEQ ID NO: 3809045 - RNA, 20 nt, Salmonella typhimurium LT2
ucggcacacuacgcagcggu

SEQ ID NO: 3809046 - RNA, 17 nt, Salmonella typhimurium LT2
ucggcaccaucuaaauc

SEQ ID NO: 3809047 - RNA, 19 nt, Salmonella typhimurium LT2
ucggcaccauucccacgca

SEQ ID NO: 3809048 - RNA, 19 nt, Salmonella typhimurium LT2
ucggcagauuaccggcaau

SEQ ID NO: 3809049 - RNA, 12 nt, Salmonella typhimurium LT2
ucggcagcgcga

SEQ ID NO: 3809050 - RNA, 20 nt, Salmonella typhimurium LT2
ucggcaggacuuaaaaacaa

SEQ ID NO: 3809051 - RNA, 22 nt, Salmonella typhimurium LT2
ucggcaggccggagcugauacg

SEQ ID NO: 3809052 - RNA, 16 nt, Salmonella typhimurium LT2
ucggcagucacuuuca

SEQ ID NO: 3809053 - RNA, 21 nt, Salmonella typhimurium LT2
ucggcauacaccgccagcguc

SEQ ID NO: 3809054 - RNA, 23 nt, Salmonella typhimurium LT2
ucggcauacaccgccagcgucug

SEQ ID NO: 3809055 - RNA, 22 nt, Salmonella typhimurium LT2
ucggcauaggcuauugccucac

SEQ ID NO: 3809056 - RNA, 16 nt, Salmonella typhimurium LT2
ucggcaugccacuggg

SEQ ID NO: 3809057 - RNA, 21 nt, Salmonella typhimurium LT2
ucggccacgcuaaagucagca

SEQ ID NO: 3809058 - RNA, 17 nt, Salmonella typhimurium LT2
ucggccagcaagcggcg

SEQ ID NO: 3809059 - RNA, 14 nt, Salmonella typhimurium LT2
ucggccagcgccag

SEQ ID NO: 3809060 - RNA, 17 nt, Salmonella typhimurium LT2
ucggccaugggcgcguu

SEQ ID NO: 3809061 - RNA, 14 nt, Salmonella typhimurium LT2
ucggccauuuuuuu

SEQ ID NO: 3809062 - RNA, 21 nt, Salmonella typhimurium LT2
ucggccugcguuaacggcuuc

SEQ ID NO: 3809063 - RNA, 17 nt, Salmonella typhimurium LT2
ucggcgacgucccggca

SEQ ID NO: 3809064 - RNA, 20 nt, Salmonella typhimurium LT2
ucggcgacuggaacaggcca

SEQ ID NO: 3809065 - RNA, 17 nt, Salmonella typhimurium LT2
ucggcgagguacugcau

SEQ ID NO: 3809066 - RNA, 13 nt, Salmonella typhimurium LT2
ucggcgauaaacc

SEQ ID NO: 3809067 - RNA, 23 nt, Salmonella typhimurium LT2
ucggcgaugugccuguaaauguu

SEQ ID NO: 3809068 - RNA, 17 nt, Salmonella typhimurium LT2
ucggcgccagccacaag

SEQ ID NO: 3809069 - RNA, 12 nt, Salmonella typhimurium LT2
ucggcgcgcugg

SEQ ID NO: 3809070 - RNA, 13 nt, Salmonella typhimurium LT2
ucggcgcgcuggc

SEQ ID NO: 3809071 - RNA, 12 nt, Salmonella typhimurium LT2
ucggcgcggaaa

SEQ ID NO: 3809072 - RNA, 14 nt, Salmonella typhimurium LT2
ucggcgcggggaac

SEQ ID NO: 3809073 - RNA, 21 nt, Salmonella typhimurium LT2
ucggcgcgucgugaucgaacu

SEQ ID NO: 3809074 - RNA, 14 nt, Salmonella typhimurium LT2
ucggcgucaucccg

SEQ ID NO: 3809075 - RNA, 16 nt, Salmonella typhimurium LT2
ucggcgucgcggcaau

SEQ ID NO: 3809076 - RNA, 16 nt, Salmonella typhimurium LT2
ucggcgugccagcguc

SEQ ID NO: 3809077 - RNA, 14 nt, Salmonella typhimurium LT2
ucggcguguuucau

SEQ ID NO: 3809078 - RNA, 17 nt, Salmonella typhimurium LT2
ucggcguugcccaucgc

SEQ ID NO: 3809079 - RNA, 14 nt, Salmonella typhimurium LT2
ucggcuaaggcgau

SEQ ID NO: 3809080 - RNA, 21 nt, Salmonella typhimurium LT2
ucggcucagacaguagcggcg

SEQ ID NO: 3809081 - RNA, 15 nt, Salmonella typhimurium LT2
ucggcucauccagca

SEQ ID NO: 3809082 - RNA, 20 nt, Salmonella typhimurium LT2
ucggcuguacuuuaaccgga

SEQ ID NO: 3809083 - RNA, 14 nt, Salmonella typhimurium LT2
ucggcuucaucaca

SEQ ID NO: 3809084 - RNA, 20 nt, Salmonella typhimurium LT2
ucggcuugcuucaucugguu

SEQ ID NO: 3809085 - RNA, 23 nt, Salmonella typhimurium LT2
ucggcuuuguaucagcauuuaca

SEQ ID NO: 3809086 - RNA, 14 nt, Salmonella typhimurium LT2
ucgggaacgcuguc

SEQ ID NO: 3809087 - RNA, 21 nt, Salmonella typhimurium LT2
ucgggaaucaucgaggccacc

SEQ ID NO: 3809088 - RNA, 19 nt, Salmonella typhimurium LT2
ucgggaugguuaaauucau

SEQ ID NO: 3809089 - RNA, 20 nt, Salmonella typhimurium LT2
ucgggaugguuaaauucaua

SEQ ID NO: 3809090 - RNA, 16 nt, Salmonella typhimurium LT2
ucgggauuccagugac

SEQ ID NO: 3809091 - RNA, 23 nt, Salmonella typhimurium LT2
ucgggcaggcuuccacgcacgcc

SEQ ID NO: 3809092 - RNA, 18 nt, Salmonella typhimurium LT2
ucggggauucgccagcgu

SEQ ID NO: 3809093 - RNA, 16 nt, Salmonella typhimurium LT2
ucggggucuuccagca

SEQ ID NO: 3809094 - RNA, 18 nt, Salmonella typhimurium LT2
ucgggucauuuugccgau

SEQ ID NO: 3809095 - RNA, 22 nt, Salmonella typhimurium LT2
ucgggugacgagggaaggggau

SEQ ID NO: 3809096 - RNA, 23 nt, Salmonella typhimurium LT2
ucgggugagacgcagccucucuu

SEQ ID NO: 3809097 - RNA, 21 nt, Salmonella typhimurium LT2
ucggguucacuuuaccaggca

SEQ ID NO: 3809098 - RNA, 13 nt, Salmonella typhimurium LT2
ucggguuuuccug

SEQ ID NO: 3809099 - RNA, 19 nt, Salmonella typhimurium LT2
ucgguaaaaaugcaauguc

SEQ ID NO: 3809100 - RNA, 16 nt, Salmonella typhimurium LT2
ucgguacggcgcugcu

SEQ ID NO: 3809101 - RNA, 23 nt, Salmonella typhimurium LT2
ucgguacuucacaauaagaaauu

SEQ ID NO: 3809102 - RNA, 18 nt, Salmonella typhimurium LT2
ucgguagaaugaauguag

SEQ ID NO: 3809103 - RNA, 22 nt, Salmonella typhimurium LT2
ucgguagcuguaccagaucgcc

SEQ ID NO: 3809104 - RNA, 21 nt, Salmonella typhimurium LT2
ucgguauaacuggucaucccc

SEQ ID NO: 3809105 - RNA, 13 nt, Salmonella typhimurium LT2
ucggucaccugac

SEQ ID NO: 3809106 - RNA, 15 nt, Salmonella typhimurium LT2
ucggucaguuugccc

SEQ ID NO: 3809107 - RNA, 20 nt, Salmonella typhimurium LT2
ucggucauaaccggccgaug

SEQ ID NO: 3809108 - RNA, 18 nt, Salmonella typhimurium LT2
ucggucccaucgcgccau

SEQ ID NO: 3809109 - RNA, 18 nt, Salmonella typhimurium LT2
ucggugaaaaugaaaaau

SEQ ID NO: 3809110 - RNA, 19 nt, Salmonella typhimurium LT2
ucggugacggaaaccagca

SEQ ID NO: 3809111 - RNA, 14 nt, Salmonella typhimurium LT2
ucggugauuuccag

SEQ ID NO: 3809112 - RNA, 23 nt, Salmonella typhimurium LT2
ucggugcgguuacguccggcauu

SEQ ID NO: 3809113 - RNA, 22 nt, Salmonella typhimurium LT2
ucggugguuuuaacccccagca

SEQ ID NO: 3809114 - RNA, 11 nt, Salmonella typhimurium LT2
ucgguucugcg

SEQ ID NO: 3809115 - RNA, 12 nt, Salmonella typhimurium LT2
ucgguugaacca

SEQ ID NO: 3809116 - RNA, 16 nt, Salmonella typhimurium LT2
ucgguuuauccccgcu

SEQ ID NO: 3809117 - RNA, 21 nt, Salmonella typhimurium LT2
ucgguuuauccccgcuggcgc

SEQ ID NO: 3809118 - RNA, 20 nt, Salmonella typhimurium LT2
ucguaaaucaauuuuaauuu

SEQ ID NO: 3809119 - RNA, 17 nt, Salmonella typhimurium LT2
ucguaacaccuuacgca

SEQ ID NO: 3809120 - RNA, 21 nt, Salmonella typhimurium LT2
ucguacacgcgcccgccgcca

SEQ ID NO: 3809121 - RNA, 17 nt, Salmonella typhimurium LT2
ucguacauguccagauc

SEQ ID NO: 3809122 - RNA, 14 nt, Salmonella typhimurium LT2
ucguacuccugcau

SEQ ID NO: 3809123 - RNA, 22 nt, Salmonella typhimurium LT2
ucguacugcuuuaauaccggau

SEQ ID NO: 3809124 - RNA, 18 nt, Salmonella typhimurium LT2
ucguagccgaccaccauc

SEQ ID NO: 3809125 - RNA, 14 nt, Salmonella typhimurium LT2
ucguaggccagcgc

SEQ ID NO: 3809126 - RNA, 15 nt, Salmonella typhimurium LT2
ucguauccccagucu

SEQ ID NO: 3809127 - RNA, 16 nt, Salmonella typhimurium LT2
ucguaugcagccaggc

SEQ ID NO: 3809128 - RNA, 21 nt, Salmonella typhimurium LT2
ucgucaaaaccaaacagcgac

SEQ ID NO: 3809129 - RNA, 16 nt, Salmonella typhimurium LT2
ucgucaaacaguucag

SEQ ID NO: 3809130 - RNA, 21 nt, Salmonella typhimurium LT2
ucgucaaacaguucagacacc

SEQ ID NO: 3809131 - RNA, 19 nt, Salmonella typhimurium LT2
ucgucaaagaucucgguga

SEQ ID NO: 3809132 - RNA, 22 nt, Salmonella typhimurium LT2
ucgucacaauaugguuauccag

SEQ ID NO: 3809133 - RNA, 12 nt, Salmonella typhimurium LT2
ucgucaccagca

SEQ ID NO: 3809134 - RNA, 23 nt, Salmonella typhimurium LT2
ucgucaccuguagggucgccgcg

SEQ ID NO: 3809135 - RNA, 18 nt, Salmonella typhimurium LT2
ucgucacgcgcaaagcug

SEQ ID NO: 3809136 - RNA, 14 nt, Salmonella typhimurium LT2
ucgucagcaccguc

SEQ ID NO: 3809137 - RNA, 17 nt, Salmonella typhimurium LT2
ucgucagcacuucccac

SEQ ID NO: 3809138 - RNA, 16 nt, Salmonella typhimurium LT2
ucgucagccgccaguu

SEQ ID NO: 3809139 - RNA, 12 nt, Salmonella typhimurium LT2
ucgucaguucca

SEQ ID NO: 3809140 - RNA, 21 nt, Salmonella typhimurium LT2
ucgucauagcguugauaugcu

SEQ ID NO: 3809141 - RNA, 14 nt, Salmonella typhimurium LT2
ucgucauagugagc

SEQ ID NO: 3809142 - RNA, 23 nt, Salmonella typhimurium LT2
ucgucauagugagcgacuucaaa

SEQ ID NO: 3809143 - RNA, 15 nt, Salmonella typhimurium LT2
ucgucauccauccac

SEQ ID NO: 3809144 - RNA, 18 nt, Salmonella typhimurium LT2
ucgucaugcucgcuuucc

SEQ ID NO: 3809145 - RNA, 21 nt, Salmonella typhimurium LT2
ucgucaugcucgcuuuccauu

SEQ ID NO: 3809146 - RNA, 12 nt, Salmonella typhimurium LT2
ucguccugcaau

SEQ ID NO: 3809147 - RNA, 15 nt, Salmonella typhimurium LT2
ucguccugcgcgacg

SEQ ID NO: 3809148 - RNA, 15 nt, Salmonella typhimurium LT2
ucuccaccgccuggc

SEQ ID NO: 3809149 - RNA, 17 nt, Salmonella typhimurium LT2
ucuccaugccagaagag

SEQ ID NO: 3809150 - RNA, 22 nt, Salmonella typhimurium LT2
ucuccaugucacuggcggcggu

SEQ ID NO: 3809151 - RNA, 13 nt, Salmonella typhimurium LT2
ucucccaacuguu

SEQ ID NO: 3809152 - RNA, 17 nt, Salmonella typhimurium LT2
ucucccagaugaaaaau

SEQ ID NO: 3809153 - RNA, 18 nt, Salmonella typhimurium LT2
ucucccagccgggcagga

SEQ ID NO: 3809154 - RNA, 17 nt, Salmonella typhimurium LT2
ucucccagccgucaugc

SEQ ID NO: 3809155 - RNA, 13 nt, Salmonella typhimurium LT2
ucucccgaacugu

SEQ ID NO: 3809156 - RNA, 20 nt, Salmonella typhimurium LT2
ucucccgauuguauaaauua

SEQ ID NO: 3809157 - RNA, 21 nt, Salmonella typhimurium LT2
ucucccgccucgucaugcucg

SEQ ID NO: 3809158 - RNA, 13 nt, Salmonella typhimurium LT2
ucucccgggccgc

SEQ ID NO: 3809159 - RNA, 13 nt, Salmonella typhimurium LT2
ucucccuggcagu

SEQ ID NO: 3809160 - RNA, 17 nt, Salmonella typhimurium LT2
ucuccgacguuaacugc

SEQ ID NO: 3809161 - RNA, 15 nt, Salmonella typhimurium LT2
ucuccgcaauuaauu

SEQ ID NO: 3809162 - RNA, 20 nt, Salmonella typhimurium LT2
ucuccggcgcugcgcucuuu

SEQ ID NO: 3809163 - RNA, 21 nt, Salmonella typhimurium LT2
ucuccgggaaaaacguaucca

SEQ ID NO: 3809164 - RNA, 20 nt, Salmonella typhimurium LT2
ucuccgggauagcaaucucg

SEQ ID NO: 3809165 - RNA, 22 nt, Salmonella typhimurium LT2
ucuccuacaccaccagcccggc

SEQ ID NO: 3809166 - RNA, 22 nt, Salmonella typhimurium LT2
ucuccucacgcccugaagggcg

SEQ ID NO: 3809167 - RNA, 16 nt, Salmonella typhimurium LT2
ucuccucgaugcgccg

SEQ ID NO: 3809168 - RNA, 17 nt, Salmonella typhimurium LT2
ucuccucugaaaaauau

SEQ ID NO: 3809169 - RNA, 17 nt, Salmonella typhimurium LT2
ucuccugaacgcccggc

SEQ ID NO: 3809170 - RNA, 16 nt, Salmonella typhimurium LT2
ucuccugacugccgcc

SEQ ID NO: 3809171 - RNA, 23 nt, Salmonella typhimurium LT2
ucuccugauuaauccgcggauag

SEQ ID NO: 3809172 - RNA, 14 nt, Salmonella typhimurium LT2
ucuccugccagcga

SEQ ID NO: 3809173 - RNA, 21 nt, Salmonella typhimurium LT2
ucuccugcgauagcugcugac

SEQ ID NO: 3809174 - RNA, 15 nt, Salmonella typhimurium LT2
ucuccugcgccagcc

SEQ ID NO: 3809175 - RNA, 21 nt, Salmonella typhimurium LT2
ucuccuguaaugaggcaaauc

SEQ ID NO: 3809176 - RNA, 16 nt, Salmonella typhimurium LT2
ucucgaaacaauagcu

SEQ ID NO: 3809177 - RNA, 13 nt, Salmonella typhimurium LT2
ucucgacauacuc

SEQ ID NO: 3809178 - RNA, 18 nt, Salmonella typhimurium LT2
ucucgauccguccaggau

SEQ ID NO: 3809179 - RNA, 23 nt, Salmonella typhimurium LT2
ucucgaugauaaaggucaucaca

SEQ ID NO: 3809180 - RNA, 16 nt, Salmonella typhimurium LT2
ucucgauuucacgaua

SEQ ID NO: 3809181 - RNA, 19 nt, Salmonella typhimurium LT2
ucucgcaagauuccagaua

SEQ ID NO: 3809182 - RNA, 18 nt, Salmonella typhimurium LT2
ucucgcacaccagauucc

SEQ ID NO: 3809183 - RNA, 13 nt, Salmonella typhimurium LT2
ucucgcacaucau

SEQ ID NO: 3809184 - RNA, 12 nt, Salmonella typhimurium LT2
ucucgcaggcca

SEQ ID NO: 3809185 - RNA, 17 nt, Salmonella typhimurium LT2
ucucgccaaaccacacc

SEQ ID NO: 3809186 - RNA, 15 nt, Salmonella typhimurium LT2
ucucgcccgccagau

SEQ ID NO: 3809187 - RNA, 21 nt, Salmonella typhimurium LT2
ucucgcuauauacccccugca

SEQ ID NO: 3809188 - RNA, 14 nt, Salmonella typhimurium LT2
ucucgcucgcccgc

SEQ ID NO: 3809189 - RNA, 20 nt, Salmonella typhimurium LT2
ucucgucugcugaaaugccu

SEQ ID NO: 3809190 - RNA, 14 nt, Salmonella typhimurium LT2
ucucuacgccggcg

SEQ ID NO: 3809191 - RNA, 20 nt, Salmonella typhimurium LT2
ucucuaugguggcugaagag

SEQ ID NO: 3809192 - RNA, 13 nt, Salmonella typhimurium LT2
ucucuccaguucu

SEQ ID NO: 3809193 - RNA, 13 nt, Salmonella typhimurium LT2
ucucuccaguuug

SEQ ID NO: 3809194 - RNA, 15 nt, Salmonella typhimurium LT2
ucucugagaucaaac

SEQ ID NO: 3809195 - RNA, 15 nt, Salmonella typhimurium LT2
ucucugccaucaucc

SEQ ID NO: 3809196 - RNA, 22 nt, Salmonella typhimurium LT2
ucucuggcgccgccagccagga

SEQ ID NO: 3809197 - RNA, 13 nt, Salmonella typhimurium LT2
ucucugucacugg

SEQ ID NO: 3809198 - RNA, 22 nt, Salmonella typhimurium LT2
ucucugugucugacgcuuauca

SEQ ID NO: 3809199 - RNA, 20 nt, Salmonella typhimurium LT2
ucucuuccaggauacacaug

SEQ ID NO: 3809200 - RNA, 17 nt, Salmonella typhimurium LT2
ucucuucgacaucuuca

SEQ ID NO: 3809201 - RNA, 19 nt, Salmonella typhimurium LT2
ucucuucgucauacucucu

SEQ ID NO: 3809202 - RNA, 21 nt, Salmonella typhimurium LT2
ucucuucguguaacgcauaca

SEQ ID NO: 3809203 - RNA, 15 nt, Salmonella typhimurium LT2
ucucuugugcuucca

SEQ ID NO: 3809204 - RNA, 21 nt, Salmonella typhimurium LT2
ucucuuucaccagcgccagaa

SEQ ID NO: 3809205 - RNA, 15 nt, Salmonella typhimurium LT2
ucucuuuccagcgac

SEQ ID NO: 3809206 - RNA, 15 nt, Salmonella typhimurium LT2
ucucuuuggccagua

SEQ ID NO: 3809207 - RNA, 13 nt, Salmonella typhimurium LT2
ucucuuuugcggc

SEQ ID NO: 3809208 - RNA, 22 nt, Salmonella typhimurium LT2
ucucuuuuuuugcuuccgccuu

SEQ ID NO: 3809209 - RNA, 15 nt, Salmonella typhimurium LT2
ucugaaaaauaugug

SEQ ID NO: 3809210 - RNA, 19 nt, Salmonella typhimurium LT2
ucugaaaaggggauaacaa

SEQ ID NO: 3809211 - RNA, 22 nt, Salmonella typhimurium LT2
ucugaaaggcgucagccgccau

SEQ ID NO: 3809212 - RNA, 22 nt, Salmonella typhimurium LT2
ucugaauuuccugcgcuuuuug

SEQ ID NO: 3809213 - RNA, 18 nt, Salmonella typhimurium LT2
ucugacaacuauugcugc

SEQ ID NO: 3809214 - RNA, 13 nt, Salmonella typhimurium LT2
ucugacagccaaa

SEQ ID NO: 3809215 - RNA, 17 nt, Salmonella typhimurium LT2
ucugacaggucggcguu

SEQ ID NO: 3809216 - RNA, 11 nt, Salmonella typhimurium LT2
ucugaccaguu

SEQ ID NO: 3809217 - RNA, 23 nt, Salmonella typhimurium LT2
ucugacgaggcuacucuucgcug

SEQ ID NO: 3809218 - RNA, 13 nt, Salmonella typhimurium LT2
ucugacggccugu

SEQ ID NO: 3809219 - RNA, 14 nt, Salmonella typhimurium LT2
ucugagaucaaaca

SEQ ID NO: 3809220 - RNA, 16 nt, Salmonella typhimurium LT2
ucugagcgcaaacauc

SEQ ID NO: 3809221 - RNA, 24 nt, Salmonella typhimurium LT2
ucugauaacgcaggcgauagcccc

SEQ ID NO: 3809222 - RNA, 12 nt, Salmonella typhimurium LT2
ucugauaagucc

SEQ ID NO: 3809223 - RNA, 20 nt, Salmonella typhimurium LT2
ucugauagcuaaccagcgag

SEQ ID NO: 3809224 - RNA, 21 nt, Salmonella typhimurium LT2
ucugauagggacacauuucuu

SEQ ID NO: 3809225 - RNA, 12 nt, Salmonella typhimurium LT2
ucugauccagcg

SEQ ID NO: 3809226 - RNA, 19 nt, Salmonella typhimurium LT2
ucugaugccugaaggcgcu

SEQ ID NO: 3809227 - RNA, 15 nt, Salmonella typhimurium LT2
ucugcacauacgcca

SEQ ID NO: 3809228 - RNA, 14 nt, Salmonella typhimurium LT2
ucugcaggucacga

SEQ ID NO: 3809229 - RNA, 20 nt, Salmonella typhimurium LT2
ucugcaugccgcaggccgga

SEQ ID NO: 3809230 - RNA, 20 nt, Salmonella typhimurium LT2
ucugcauggcgcuaaacauc

SEQ ID NO: 3809231 - RNA, 14 nt, Salmonella typhimurium LT2
ucugccauuucugc

SEQ ID NO: 3809232 - RNA, 16 nt, Salmonella typhimurium LT2
ucugccauuucugcuc

SEQ ID NO: 3809233 - RNA, 18 nt, Salmonella typhimurium LT2
ucugcccauuucagcauu

SEQ ID NO: 3809234 - RNA, 22 nt, Salmonella typhimurium LT2
ucugccccaaccguuuugcaau

SEQ ID NO: 3809235 - RNA, 16 nt, Salmonella typhimurium LT2
ucugcccuggcucuac

SEQ ID NO: 3809236 - RNA, 14 nt, Salmonella typhimurium LT2
ucugccgacgcgau

SEQ ID NO: 3809237 - RNA, 17 nt, Salmonella typhimurium LT2
ucugccgguucggcauc

SEQ ID NO: 3809238 - RNA, 14 nt, Salmonella typhimurium LT2
ucugccugcagacc

SEQ ID NO: 3809239 - RNA, 15 nt, Salmonella typhimurium LT2
ucugccugcagaccc

SEQ ID NO: 3809240 - RNA, 14 nt, Salmonella typhimurium LT2
ucugccuuuuuuaa

SEQ ID NO: 3809241 - RNA, 13 nt, Salmonella typhimurium LT2
ucugcgccaccag

SEQ ID NO: 3809242 - RNA, 14 nt, Salmonella typhimurium LT2
ucugcgccaccagc

SEQ ID NO: 3809243 - RNA, 12 nt, Salmonella typhimurium LT2
ucugcgcguaaa

SEQ ID NO: 3809244 - RNA, 19 nt, Salmonella typhimurium LT2
ucugcgcuguugauagcgg

SEQ ID NO: 3809245 - RNA, 21 nt, Salmonella typhimurium LT2
ucugcguccugcuuaugaaac

SEQ ID NO: 3809246 - RNA, 14 nt, Salmonella typhimurium LT2
ucugcgucuucuuc

SEQ ID NO: 3809247 - RNA, 14 nt, Salmonella typhimurium LT2
ucugcuccggcgua

SEQ ID NO: 3809248 - RNA, 16 nt, Salmonella typhimurium LT2
ucugcugacauuccuu

SEQ ID NO: 3809249 - RNA, 19 nt, Salmonella typhimurium LT2
ucugcugccucaucaauuc

SEQ ID NO: 3809250 - RNA, 15 nt, Salmonella typhimurium LT2
ucugcugcgggaaaa

SEQ ID NO: 3809251 - RNA, 18 nt, Salmonella typhimurium LT2
ucugcuuauucuuuucaa

SEQ ID NO: 3809252 - RNA, 13 nt, Salmonella typhimurium LT2
ucuucuaccaccu

SEQ ID NO: 3809253 - RNA, 17 nt, Salmonella typhimurium LT2
ucuucugccuuuuuuaa

SEQ ID NO: 3809254 - RNA, 22 nt, Salmonella typhimurium LT2
ucuucuuagaauagcaucaauu

SEQ ID NO: 3809255 - RNA, 19 nt, Salmonella typhimurium LT2
ucuucuucgcguuuuucga

SEQ ID NO: 3809256 - RNA, 19 nt, Salmonella typhimurium LT2
ucuucuucgcucucgccac

SEQ ID NO: 3809257 - RNA, 13 nt, Salmonella typhimurium LT2
ucuucuucucaau

SEQ ID NO: 3809258 - RNA, 13 nt, Salmonella typhimurium LT2
ucuucuuuaaccg

SEQ ID NO: 3809259 - RNA, 15 nt, Salmonella typhimurium LT2
ucuucuuucaucaua

SEQ ID NO: 3809260 - RNA, 15 nt, Salmonella typhimurium LT2
ucuucuuuuccugau

SEQ ID NO: 3809261 - RNA, 12 nt, Salmonella typhimurium LT2
ucuugaguuggc

SEQ ID NO: 3809262 - RNA, 15 nt, Salmonella typhimurium LT2
ucuugauaucaucau

SEQ ID NO: 3809263 - RNA, 12 nt, Salmonella typhimurium LT2
ucuugcacaaua

SEQ ID NO: 3809264 - RNA, 18 nt, Salmonella typhimurium LT2
ucuugcaggcaggucucc

SEQ ID NO: 3809265 - RNA, 13 nt, Salmonella typhimurium LT2
ucuugccacuggc

SEQ ID NO: 3809266 - RNA, 14 nt, Salmonella typhimurium LT2
ucuugccacuggcc

SEQ ID NO: 3809267 - RNA, 15 nt, Salmonella typhimurium LT2
ucuugccacuggccu

SEQ ID NO: 3809268 - RNA, 14 nt, Salmonella typhimurium LT2
ucuugcucacggcg

SEQ ID NO: 3809269 - RNA, 15 nt, Salmonella typhimurium LT2
ucuuggagagcauca

SEQ ID NO: 3809270 - RNA, 19 nt, Salmonella typhimurium LT2
ucuuggagagcaucaucug

SEQ ID NO: 3809271 - RNA, 14 nt, Salmonella typhimurium LT2
ucuuguaggcccga

SEQ ID NO: 3809272 - RNA, 15 nt, Salmonella typhimurium LT2
ucuugucaggcaaaa

SEQ ID NO: 3809273 - RNA, 21 nt, Salmonella typhimurium LT2
ucuugugcuuccagcuccauc

SEQ ID NO: 3809274 - RNA, 19 nt, Salmonella typhimurium LT2
ucuuguuuucuacucuuca

SEQ ID NO: 3809275 - RNA, 13 nt, Salmonella typhimurium LT2
ucuuuaaacuuuu

SEQ ID NO: 3809276 - RNA, 14 nt, Salmonella typhimurium LT2
ucuuuaaauuucag

SEQ ID NO: 3809277 - RNA, 13 nt, Salmonella typhimurium LT2
ucuuuaacaccuu

SEQ ID NO: 3809278 - RNA, 14 nt, Salmonella typhimurium LT2
ucuuuacacucgcg

SEQ ID NO: 3809279 - RNA, 15 nt, Salmonella typhimurium LT2
ucuuuaccaaugugc

SEQ ID NO: 3809280 - RNA, 16 nt, Salmonella typhimurium LT2
ucuuuacgcagcaaga

SEQ ID NO: 3809281 - RNA, 17 nt, Salmonella typhimurium LT2
ucuuuagauaauuucgc

SEQ ID NO: 3809282 - RNA, 21 nt, Salmonella typhimurium LT2
ucuuuagcgcuaauuccuguc

SEQ ID NO: 3809283 - RNA, 12 nt, Salmonella typhimurium LT2
ucuuuaucaaac

SEQ ID NO: 3809284 - RNA, 13 nt, Salmonella typhimurium LT2
ucuuuaugcguca

SEQ ID NO: 3809285 - RNA, 14 nt, Salmonella typhimurium LT2
ucuuucaacuuccg

SEQ ID NO: 3809286 - RNA, 17 nt, Salmonella typhimurium LT2
ucuuucaauaauggcgc

SEQ ID NO: 3809287 - RNA, 12 nt, Salmonella typhimurium LT2
ucuuucaauccu

SEQ ID NO: 3809288 - RNA, 13 nt, Salmonella typhimurium LT2
ucuuucaucaaac

SEQ ID NO: 3809289 - RNA, 14 nt, Salmonella typhimurium LT2
ucuuucauuuuacc

SEQ ID NO: 3809290 - RNA, 15 nt, Salmonella typhimurium LT2
ucuuuccauuucagc

SEQ ID NO: 3809291 - RNA, 22 nt, Salmonella typhimurium LT2
ucuuucccggcaauuaccgcca

SEQ ID NO: 3809292 - RNA, 22 nt, Salmonella typhimurium LT2
ucuuucccggcguaauccagcu

SEQ ID NO: 3809293 - RNA, 12 nt, Salmonella typhimurium LT2
ucuuuccuuuuu

SEQ ID NO: 3809294 - RNA, 21 nt, Salmonella typhimurium LT2
ucuuucugaaacggaucaaaa

SEQ ID NO: 3809295 - RNA, 19 nt, Salmonella typhimurium LT2
ucuuucuggaacugucccg

SEQ ID NO: 3809296 - RNA, 12 nt, Salmonella typhimurium LT2
ucuuugaauaac

SEQ ID NO: 3809297 - RNA, 20 nt, Salmonella typhimurium LT2
ucuuugaccagcgacgauga

SEQ ID NO: 3809298 - RNA, 18 nt, Salmonella typhimurium LT2
ucuuugcugccaucuucc

SEQ ID NO: 3809299 - RNA, 14 nt, Salmonella typhimurium LT2
ucuuugcugccguc

SEQ ID NO: 3809300 - RNA, 15 nt, Salmonella typhimurium LT2
ucuuuggacggcauc

SEQ ID NO: 3809301 - RNA, 22 nt, Salmonella typhimurium LT2
ucuuuggccaguaucgcgccgc

SEQ ID NO: 3809302 - RNA, 18 nt, Salmonella typhimurium LT2
ucuuuuacgaucgccacc

SEQ ID NO: 3809303 - RNA, 20 nt, Salmonella typhimurium LT2
ucuuuuauuauuacaggagu

SEQ ID NO: 3809304 - RNA, 16 nt, Salmonella typhimurium LT2
ucuuuugcgccuucca

SEQ ID NO: 3809305 - RNA, 17 nt, Salmonella typhimurium LT2
ucuuuuguuuuucucuu

SEQ ID NO: 3809306 - RNA, 15 nt, Salmonella typhimurium LT2
ucuuuuuauuuuaua

SEQ ID NO: 3809307 - RNA, 22 nt, Salmonella typhimurium LT2
ugaaaaacgguauuuccauuuu

SEQ ID NO: 3809308 - RNA, 17 nt, Salmonella typhimurium LT2
ugaaaaccauaauaaug

SEQ ID NO: 3809309 - RNA, 13 nt, Salmonella typhimurium LT2
ugaaaaccuaaau

SEQ ID NO: 3809310 - RNA, 16 nt, Salmonella typhimurium LT2
ugaaaaccugcaaaaa

SEQ ID NO: 3809311 - RNA, 12 nt, Salmonella typhimurium LT2
ugaaaaggaaaa

SEQ ID NO: 3809312 - RNA, 18 nt, Salmonella typhimurium LT2
ugaaaaucgacuggugau

SEQ ID NO: 3809313 - RNA, 21 nt, Salmonella typhimurium LT2
ugaaaaucgacuggugauuuu

SEQ ID NO: 3809314 - RNA, 21 nt, Salmonella typhimurium LT2
ugaaaaugcguccagaggauc

SEQ ID NO: 3809315 - RNA, 19 nt, Salmonella typhimurium LT2
ugaaacccgccaccgccag

SEQ ID NO: 3809316 - RNA, 19 nt, Salmonella typhimurium LT2
ugaaaccgaauccuuugga

SEQ ID NO: 3809317 - RNA, 23 nt, Salmonella typhimurium LT2
ugaaaccgaauccuuuggauuca

SEQ ID NO: 3809318 - RNA, 15 nt, Salmonella typhimurium LT2
ugaaaccgccggaug

SEQ ID NO: 3809319 - RNA, 22 nt, Salmonella typhimurium LT2
ugaaaccggcgcgccuuccagc

SEQ ID NO: 3809320 - RNA, 18 nt, Salmonella typhimurium LT2
ugaaacgaaaacugggca

SEQ ID NO: 3809321 - RNA, 18 nt, Salmonella typhimurium LT2
ugaaacugaaucaauagc

SEQ ID NO: 3809322 - RNA, 22 nt, Salmonella typhimurium LT2
ugaaagaccuaaaccacguccc

SEQ ID NO: 3809323 - RNA, 18 nt, Salmonella typhimurium LT2
ugaaagaguacgccgaua

SEQ ID NO: 3809324 - RNA, 20 nt, Salmonella typhimurium LT2
ugaaagauuauuuuaucauc

SEQ ID NO: 3809325 - RNA, 23 nt, Salmonella typhimurium LT2
ugaaagccaucgcuaaguugaac

SEQ ID NO: 3809326 - RNA, 19 nt, Salmonella typhimurium LT2
ugaaagcucggcgggguuu

SEQ ID NO: 3809327 - RNA, 14 nt, Salmonella typhimurium LT2
ugaaaggcauuucu

SEQ ID NO: 3809328 - RNA, 22 nt, Salmonella typhimurium LT2
ugaaaguaagcuauuucuguau

SEQ ID NO: 3809329 - RNA, 21 nt, Salmonella typhimurium LT2
ugaaagucuucccgcaaacug

SEQ ID NO: 3809330 - RNA, 17 nt, Salmonella typhimurium LT2
ugaaauaaacguaccga

SEQ ID NO: 3809331 - RNA, 19 nt, Salmonella typhimurium LT2
ugaaauaaucguguaaucu

SEQ ID NO: 3809332 - RNA, 20 nt, Salmonella typhimurium LT2
ugaaauaaucguguaaucuu

SEQ ID NO: 3809333 - RNA, 21 nt, Salmonella typhimurium LT2
ugaaauacccgccgauaaacg

SEQ ID NO: 3809334 - RNA, 14 nt, Salmonella typhimurium LT2
ugaaaucgguaauc

SEQ ID NO: 3809335 - RNA, 22 nt, Salmonella typhimurium LT2
ugaaaucgucagacggcuccag

SEQ ID NO: 3809336 - RNA, 22 nt, Salmonella typhimurium LT2
ugaaaucgucgccaacaccgau

SEQ ID NO: 3809337 - RNA, 15 nt, Salmonella typhimurium LT2
ugaaaucuugcuguc

SEQ ID NO: 3809338 - RNA, 17 nt, Salmonella typhimurium LT2
ugaaauggcaugagcag

SEQ ID NO: 3809339 - RNA, 18 nt, Salmonella typhimurium LT2
ugaaauucuaugccaagc

SEQ ID NO: 3809340 - RNA, 20 nt, Salmonella typhimurium LT2
ugaaauuuccuccgccgaua

SEQ ID NO: 3809341 - RNA, 17 nt, Salmonella typhimurium LT2
ugaacaauaugucgauu

SEQ ID NO: 3809342 - RNA, 14 nt, Salmonella typhimurium LT2
ugaacacccugccc

SEQ ID NO: 3809343 - RNA, 16 nt, Salmonella typhimurium LT2
ugaacacgccgacuca

SEQ ID NO: 3809344 - RNA, 11 nt, Salmonella typhimurium LT2
ugaacaggcag

SEQ ID NO: 3809345 - RNA, 18 nt, Salmonella typhimurium LT2
ugaacauacguuuaaagc

SEQ ID NO: 3809346 - RNA, 13 nt, Salmonella typhimurium LT2
ugaacauuuuuuc

SEQ ID NO: 3809347 - RNA, 15 nt, Salmonella typhimurium LT2
ugaacauuuuuucag

SEQ ID NO: 3809348 - RNA, 15 nt, Salmonella typhimurium LT2
ugaaccaagauaaga

SEQ ID NO: 3809349 - RNA, 22 nt, Salmonella typhimurium LT2
ugaaccacggagagacaguuca

SEQ ID NO: 3809350 - RNA, 21 nt, Salmonella typhimurium LT2
ugaaccagcggcaccagcacg

SEQ ID NO: 3809351 - RNA, 20 nt, Salmonella typhimurium LT2
ugaaccgaaauccaccagcg

SEQ ID NO: 3809352 - RNA, 18 nt, Salmonella typhimurium LT2
ugaaccuguuaucaggau

SEQ ID NO: 3809353 - RNA, 19 nt, Salmonella typhimurium LT2
ugaaccuguuaucaggaua

SEQ ID NO: 3809354 - RNA, 16 nt, Salmonella typhimurium LT2
ugaacgccaggccguu

SEQ ID NO: 3809355 - RNA, 14 nt, Salmonella typhimurium LT2
ugaacgccggaacc

SEQ ID NO: 3809356 - RNA, 15 nt, Salmonella typhimurium LT2
ugacagccaccagcg

SEQ ID NO: 3809357 - RNA, 15 nt, Salmonella typhimurium LT2
ugacagcgcgcgaau

SEQ ID NO: 3809358 - RNA, 21 nt, Salmonella typhimurium LT2
ugacaggggguugcucuuucu

SEQ ID NO: 3809359 - RNA, 17 nt, Salmonella typhimurium LT2
ugacagugaagugugaa

SEQ ID NO: 3809360 - RNA, 15 nt, Salmonella typhimurium LT2
ugacauccauaauac

SEQ ID NO: 3809361 - RNA, 17 nt, Salmonella typhimurium LT2
ugacauccauaauacga

SEQ ID NO: 3809362 - RNA, 17 nt, Salmonella typhimurium LT2
ugacauccggauccaga

SEQ ID NO: 3809363 - RNA, 16 nt, Salmonella typhimurium LT2
ugacauuaauucaguc

SEQ ID NO: 3809364 - RNA, 17 nt, Salmonella typhimurium LT2
ugacauuaauucagucc

SEQ ID NO: 3809365 - RNA, 18 nt, Salmonella typhimurium LT2
ugacauucccauugagca

SEQ ID NO: 3809366 - RNA, 19 nt, Salmonella typhimurium LT2
ugacauucccauugagcag

SEQ ID NO: 3809367 - RNA, 20 nt, Salmonella typhimurium LT2
ugacauugucauaaggacua

SEQ ID NO: 3809368 - RNA, 22 nt, Salmonella typhimurium LT2
ugacauuuaaggcgcggccuca

SEQ ID NO: 3809369 - RNA, 13 nt, Salmonella typhimurium LT2
ugaccaccgcauc

SEQ ID NO: 3809370 - RNA, 18 nt, Salmonella typhimurium LT2
ugaccacgacgaccgcca

SEQ ID NO: 3809371 - RNA, 18 nt, Salmonella typhimurium LT2
ugaccacgccgccgcguc

SEQ ID NO: 3809372 - RNA, 18 nt, Salmonella typhimurium LT2
ugaccacgguuaucuggc

SEQ ID NO: 3809373 - RNA, 16 nt, Salmonella typhimurium LT2
ugaccagcaucgccgg

SEQ ID NO: 3809374 - RNA, 13 nt, Salmonella typhimurium LT2
ugaccagcgacgg

SEQ ID NO: 3809375 - RNA, 12 nt, Salmonella typhimurium LT2
ugaccagcgccg

SEQ ID NO: 3809376 - RNA, 21 nt, Salmonella typhimurium LT2
ugaccagcuucucaguaugaa

SEQ ID NO: 3809377 - RNA, 22 nt, Salmonella typhimurium LT2
ugaccaguuguuccgcgcugau

SEQ ID NO: 3809378 - RNA, 15 nt, Salmonella typhimurium LT2
ugaccaucaaauaau

SEQ ID NO: 3809379 - RNA, 17 nt, Salmonella typhimurium LT2
ugaccauucgcacucca

SEQ ID NO: 3809380 - RNA, 13 nt, Salmonella typhimurium LT2
ugacccagacaaa

SEQ ID NO: 3809381 - RNA, 13 nt, Salmonella typhimurium LT2
ugacccagcgcga

SEQ ID NO: 3809382 - RNA, 18 nt, Salmonella typhimurium LT2
ugacccagucgggaaacu

SEQ ID NO: 3809383 - RNA, 14 nt, Salmonella typhimurium LT2
ugaccccauacgcg

SEQ ID NO: 3809384 - RNA, 20 nt, Salmonella typhimurium LT2
ugacccgccagugcuuuuaa

SEQ ID NO: 3809385 - RNA, 23 nt, Salmonella typhimurium LT2
ugaccgccgucauagcaggagau

SEQ ID NO: 3809386 - RNA, 19 nt, Salmonella typhimurium LT2
ugaccgcuucgccuucgcc

SEQ ID NO: 3809387 - RNA, 17 nt, Salmonella typhimurium LT2
ugaccggaaaaggcgac

SEQ ID NO: 3809388 - RNA, 17 nt, Salmonella typhimurium LT2
ugaccggcuauccaugc

SEQ ID NO: 3809389 - RNA, 19 nt, Salmonella typhimurium LT2
ugaccgguaagcccauggc

SEQ ID NO: 3809390 - RNA, 14 nt, Salmonella typhimurium LT2
ugaccgucauccac

SEQ ID NO: 3809391 - RNA, 14 nt, Salmonella typhimurium LT2
ugaccguccccagc

SEQ ID NO: 3809392 - RNA, 22 nt, Salmonella typhimurium LT2
ugaccguuaguaaucggaucaa

SEQ ID NO: 3809393 - RNA, 22 nt, Salmonella typhimurium LT2
ugaccguugauucagcgucuga

SEQ ID NO: 3809394 - RNA, 12 nt, Salmonella typhimurium LT2
ugaccguugcca

SEQ ID NO: 3809395 - RNA, 13 nt, Salmonella typhimurium LT2
ugaccucaucacc

SEQ ID NO: 3809396 - RNA, 13 nt, Salmonella typhimurium LT2
ugaccucauccau

SEQ ID NO: 3809397 - RNA, 13 nt, Salmonella typhimurium LT2
ugaccugaacgcc

SEQ ID NO: 3809398 - RNA, 17 nt, Salmonella typhimurium LT2
ugaccugaauccagacu

SEQ ID NO: 3809399 - RNA, 17 nt, Salmonella typhimurium LT2
ugaccugggcgccagag

SEQ ID NO: 3809400 - RNA, 16 nt, Salmonella typhimurium LT2
ugaccuuaauccagcc

SEQ ID NO: 3809401 - RNA, 18 nt, Salmonella typhimurium LT2
ugaccuucaccugaauau

SEQ ID NO: 3809402 - RNA, 14 nt, Salmonella typhimurium LT2
ugacgaaaaucauc

SEQ ID NO: 3809403 - RNA, 20 nt, Salmonella typhimurium LT2
ugacgaagccuuucaguugu

SEQ ID NO: 3809404 - RNA, 15 nt, Salmonella typhimurium LT2
ugacgaccgcggccu

SEQ ID NO: 3809405 - RNA, 15 nt, Salmonella typhimurium LT2
ugacgacuaaaaaaa

SEQ ID NO: 3809406 - RNA, 17 nt, Salmonella typhimurium LT2
ugacgacuaccgccgau

SEQ ID NO: 3809407 - RNA, 21 nt, Salmonella typhimurium LT2
ugacgacuuuaucaauacuga

SEQ ID NO: 3809408 - RNA, 21 nt, Salmonella typhimurium LT2
ugacgagcgacgaggcauggc

SEQ ID NO: 3809409 - RNA, 19 nt, Salmonella typhimurium LT2
ugacgauacgucauaucau

SEQ ID NO: 3809410 - RNA, 18 nt, Salmonella typhimurium LT2
ugacgauaucaucuugcu

SEQ ID NO: 3809411 - RNA, 15 nt, Salmonella typhimurium LT2
ugacgauaugcugcc

SEQ ID NO: 3809412 - RNA, 18 nt, Salmonella typhimurium LT2
ugacgaucguggcgauag

SEQ ID NO: 3809413 - RNA, 18 nt, Salmonella typhimurium LT2
ugacgcaaacugccaggc

SEQ ID NO: 3809414 - RNA, 22 nt, Salmonella typhimurium LT2
ugacgcagacgucaacaccucc

SEQ ID NO: 3809415 - RNA, 16 nt, Salmonella typhimurium LT2
ugacgcagcagcuccc

SEQ ID NO: 3809416 - RNA, 18 nt, Salmonella typhimurium LT2
ugacgcagcagcuccccg

SEQ ID NO: 3809417 - RNA, 16 nt, Salmonella typhimurium LT2
ugacgcagcaucucaa

SEQ ID NO: 3809418 - RNA, 21 nt, Salmonella typhimurium LT2
ugacgcaguaauacgccgccg

SEQ ID NO: 3809419 - RNA, 20 nt, Salmonella typhimurium LT2
ugacgccgcagccugauggc

SEQ ID NO: 3809420 - RNA, 19 nt, Salmonella typhimurium LT2
ugacgccggguaaacgcag

SEQ ID NO: 3809421 - RNA, 18 nt, Salmonella typhimurium LT2
ugacgcgcauacucauua

SEQ ID NO: 3809422 - RNA, 22 nt, Salmonella typhimurium LT2
ugacgcguuaauauccuucagc

SEQ ID NO: 3809423 - RNA, 12 nt, Salmonella typhimurium LT2
ugacgcuauugu

SEQ ID NO: 3809424 - RNA, 16 nt, Salmonella typhimurium LT2
ugacgcuccugaaucg

SEQ ID NO: 3809425 - RNA, 16 nt, Salmonella typhimurium LT2
ugacgcucuccuccaa

SEQ ID NO: 3809426 - RNA, 18 nt, Salmonella typhimurium LT2
ugacgcuucgcuuauccg

SEQ ID NO: 3809427 - RNA, 17 nt, Salmonella typhimurium LT2
ugacgcuuuugugcccg

SEQ ID NO: 3809428 - RNA, 14 nt, Salmonella typhimurium LT2
ugacggaaaccagc

SEQ ID NO: 3809429 - RNA, 16 nt, Salmonella typhimurium LT2
ugacggauuugacuuc

SEQ ID NO: 3809430 - RNA, 21 nt, Salmonella typhimurium LT2
ugacggcaaagcccacgcccu

SEQ ID NO: 3809431 - RNA, 22 nt, Salmonella typhimurium LT2
ugacggcgcuuuaaacauauaa

SEQ ID NO: 3809432 - RNA, 22 nt, Salmonella typhimurium LT2
ugacggcuacuccggcgcggcg

SEQ ID NO: 3809433 - RNA, 22 nt, Salmonella typhimurium LT2
ugacgggaaaucucccuggcag

SEQ ID NO: 3809434 - RNA, 20 nt, Salmonella typhimurium LT2
ugacgggggcgaucagcagg

SEQ ID NO: 3809435 - RNA, 15 nt, Salmonella typhimurium LT2
ugacguaaauucuga

SEQ ID NO: 3809436 - RNA, 13 nt, Salmonella typhimurium LT2
ugacguaauugcc

SEQ ID NO: 3809437 - RNA, 24 nt, Salmonella typhimurium LT2
ugacguaggaggagaugaccgagu

SEQ ID NO: 3809438 - RNA, 20 nt, Salmonella typhimurium LT2
ugacgucacugucagcauca

SEQ ID NO: 3809439 - RNA, 13 nt, Salmonella typhimurium LT2
ugacguccaggcc

SEQ ID NO: 3809440 - RNA, 22 nt, Salmonella typhimurium LT2
ugacgucgguaaucacgucauu

SEQ ID NO: 3809441 - RNA, 14 nt, Salmonella typhimurium LT2
ugacgugagagaaa

SEQ ID NO: 3809442 - RNA, 19 nt, Salmonella typhimurium LT2
ugacguguuucauaauaug

SEQ ID NO: 3809443 - RNA, 22 nt, Salmonella typhimurium LT2
ugacguucaucauuuucccacu

SEQ ID NO: 3809444 - RNA, 13 nt, Salmonella typhimurium LT2
ugacguuuuccuc

SEQ ID NO: 3809445 - RNA, 15 nt, Salmonella typhimurium LT2
ugacguuuuccucgu

SEQ ID NO: 3809446 - RNA, 15 nt, Salmonella typhimurium LT2
ugacuaaaagacgcc

SEQ ID NO: 3809447 - RNA, 12 nt, Salmonella typhimurium LT2
ugacuaaaucag

SEQ ID NO: 3809448 - RNA, 13 nt, Salmonella typhimurium LT2
ugacuaaaucagc

SEQ ID NO: 3809449 - RNA, 15 nt, Salmonella typhimurium LT2
ugacuaaaucagcau

SEQ ID NO: 3809450 - RNA, 16 nt, Salmonella typhimurium LT2
ugacuacucccgucgc

SEQ ID NO: 3809451 - RNA, 14 nt, Salmonella typhimurium LT2
ugacuaguccugau

SEQ ID NO: 3809452 - RNA, 15 nt, Salmonella typhimurium LT2
ugacuaguccugaua

SEQ ID NO: 3809453 - RNA, 15 nt, Salmonella typhimurium LT2
ugacuauccacagcg

SEQ ID NO: 3809454 - RNA, 14 nt, Salmonella typhimurium LT2
ugacuaucuuuaug

SEQ ID NO: 3809455 - RNA, 20 nt, Salmonella typhimurium LT2
ugacucaaaaagaggaaagc

SEQ ID NO: 3809456 - RNA, 15 nt, Salmonella typhimurium LT2
ugacucaccagcacg

SEQ ID NO: 3809457 - RNA, 21 nt, Salmonella typhimurium LT2
ugacucaccagcacgcaggca

SEQ ID NO: 3809458 - RNA, 18 nt, Salmonella typhimurium LT2
ugacucagcggccauuga

SEQ ID NO: 3809459 - RNA, 20 nt, Salmonella typhimurium LT2
ugacucauuucaacauaucc

SEQ ID NO: 3809460 - RNA, 13 nt, Salmonella typhimurium LT2
ugauaagcgcagc

SEQ ID NO: 3809461 - RNA, 20 nt, Salmonella typhimurium LT2
ugauaagcgcagcgccauca

SEQ ID NO: 3809462 - RNA, 21 nt, Salmonella typhimurium LT2
ugauaagcguagcgccaucag

SEQ ID NO: 3809463 - RNA, 12 nt, Salmonella typhimurium LT2
ugauaauacugc

SEQ ID NO: 3809464 - RNA, 22 nt, Salmonella typhimurium LT2
ugauaauaugcucaacuuccag

SEQ ID NO: 3809465 - RNA, 21 nt, Salmonella typhimurium LT2
ugauaauauuaucagcaauaa

SEQ ID NO: 3809466 - RNA, 18 nt, Salmonella typhimurium LT2
ugauaaucagcacgccac

SEQ ID NO: 3809467 - RNA, 19 nt, Salmonella typhimurium LT2
ugauaauuagagacauggu

SEQ ID NO: 3809468 - RNA, 23 nt, Salmonella typhimurium LT2
ugauaauuggcggugaggcugac

SEQ ID NO: 3809469 - RNA, 18 nt, Salmonella typhimurium LT2
ugauacagaaaaccggca

SEQ ID NO: 3809470 - RNA, 22 nt, Salmonella typhimurium LT2
ugauacagaaaaccggcaaaua

SEQ ID NO: 3809471 - RNA, 15 nt, Salmonella typhimurium LT2
ugauaccccagcgau

SEQ ID NO: 3809472 - RNA, 13 nt, Salmonella typhimurium LT2
ugauacccugaau

SEQ ID NO: 3809473 - RNA, 14 nt, Salmonella typhimurium LT2
ugauacccugaauc

SEQ ID NO: 3809474 - RNA, 16 nt, Salmonella typhimurium LT2
ugauaccuaaacgcgu

SEQ ID NO: 3809475 - RNA, 20 nt, Salmonella typhimurium LT2
ugauaccuuuaaccucuuuu

SEQ ID NO: 3809476 - RNA, 15 nt, Salmonella typhimurium LT2
ugauacgccuggaua

SEQ ID NO: 3809477 - RNA, 19 nt, Salmonella typhimurium LT2
ugauacgcggcugaugcag

SEQ ID NO: 3809478 - RNA, 19 nt, Salmonella typhimurium LT2
ugauacgggaagucauuag

SEQ ID NO: 3809479 - RNA, 15 nt, Salmonella typhimurium LT2
ugauacuccaucuga

SEQ ID NO: 3809480 - RNA, 16 nt, Salmonella typhimurium LT2
ugauagacguaaugau

SEQ ID NO: 3809481 - RNA, 23 nt, Salmonella typhimurium LT2
ugauagagguuaccgggcuaaac

SEQ ID NO: 3809482 - RNA, 21 nt, Salmonella typhimurium LT2
ugauagcccguuaugccaucu

SEQ ID NO: 3809483 - RNA, 17 nt, Salmonella typhimurium LT2
ugauagccguucuccag

SEQ ID NO: 3809484 - RNA, 18 nt, Salmonella typhimurium LT2
ugauagccguucuccagc

SEQ ID NO: 3809485 - RNA, 15 nt, Salmonella typhimurium LT2
ugauagggaaggcuu

SEQ ID NO: 3809486 - RNA, 18 nt, Salmonella typhimurium LT2
ugauagggcgccuguuua

SEQ ID NO: 3809487 - RNA, 13 nt, Salmonella typhimurium LT2
ugauaguccauca

SEQ ID NO: 3809488 - RNA, 17 nt, Salmonella typhimurium LT2
ugauaguccaucaccuc

SEQ ID NO: 3809489 - RNA, 21 nt, Salmonella typhimurium LT2
ugauagucguuauaauccuga

SEQ ID NO: 3809490 - RNA, 20 nt, Salmonella typhimurium LT2
ugauaguuuaaauccagcgc

SEQ ID NO: 3809491 - RNA, 18 nt, Salmonella typhimurium LT2
ugauauacgaagcgccau

SEQ ID NO: 3809492 - RNA, 21 nt, Salmonella typhimurium LT2
ugauauacgaagcgccauccg

SEQ ID NO: 3809493 - RNA, 20 nt, Salmonella typhimurium LT2
ugauauagccuucaauaagu

SEQ ID NO: 3809494 - RNA, 21 nt, Salmonella typhimurium LT2
ugauaucggccggaugccagu

SEQ ID NO: 3809495 - RNA, 20 nt, Salmonella typhimurium LT2
ugauaucuaugguaauuuaa

SEQ ID NO: 3809496 - RNA, 15 nt, Salmonella typhimurium LT2
ugauaugcaguucau

SEQ ID NO: 3809497 - RNA, 20 nt, Salmonella typhimurium LT2
ugauaugcaguucaucaucc

SEQ ID NO: 3809498 - RNA, 19 nt, Salmonella typhimurium LT2
ugauaugcucgacaauaaa

SEQ ID NO: 3809499 - RNA, 21 nt, Salmonella typhimurium LT2
ugauauuagaaagcugcacca

SEQ ID NO: 3809500 - RNA, 18 nt, Salmonella typhimurium LT2
ugauauugcauaggggca

SEQ ID NO: 3809501 - RNA, 22 nt, Salmonella typhimurium LT2
ugauauugcguaagcagcugcu

SEQ ID NO: 3809502 - RNA, 20 nt, Salmonella typhimurium LT2
ugaucaacgccgcgccauca

SEQ ID NO: 3809503 - RNA, 12 nt, Salmonella typhimurium LT2
ugaucaaucaac

SEQ ID NO: 3809504 - RNA, 18 nt, Salmonella typhimurium LT2
ugaucaaucaacucuuua

SEQ ID NO: 3809505 - RNA, 22 nt, Salmonella typhimurium LT2
ugaucacuuuugggccgcgcag

SEQ ID NO: 3809506 - RNA, 23 nt, Salmonella typhimurium LT2
ugaucagaacucacauauucaau

SEQ ID NO: 3809507 - RNA, 22 nt, Salmonella typhimurium LT2
ugaucagacgcacaaucgccgu

SEQ ID NO: 3809508 - RNA, 23 nt, Salmonella typhimurium LT2
ugaucagacgcacaaucgccgug

SEQ ID NO: 3809509 - RNA, 18 nt, Salmonella typhimurium LT2
ugaucagcacgcggaaca

SEQ ID NO: 3809510 - RNA, 15 nt, Salmonella typhimurium LT2
ugaucaguuugccuu

SEQ ID NO: 3809511 - RNA, 23 nt, Salmonella typhimurium LT2
ugaucaguuugccuuuauucauu

SEQ ID NO: 3809512 - RNA, 21 nt, Salmonella typhimurium LT2
ugaucauaaauucgcagcguu

SEQ ID NO: 3809513 - RNA, 22 nt, Salmonella typhimurium LT2
ugaucauaaauucgcagcguuc

SEQ ID NO: 3809514 - RNA, 19 nt, Salmonella typhimurium LT2
ugaucaugcugcaccgcau

SEQ ID NO: 3809515 - RNA, 17 nt, Salmonella typhimurium LT2
ugaucccacagcggaug

SEQ ID NO: 3809516 - RNA, 16 nt, Salmonella typhimurium LT2
ugaucccaggccggca

SEQ ID NO: 3809517 - RNA, 22 nt, Salmonella typhimurium LT2
ugaucccgccgaccagauaucc

SEQ ID NO: 3809518 - RNA, 17 nt, Salmonella typhimurium LT2
ugauccuccugcagacu

SEQ ID NO: 3809519 - RNA, 14 nt, Salmonella typhimurium LT2
ugaucgaaaaugcg

SEQ ID NO: 3809520 - RNA, 15 nt, Salmonella typhimurium LT2
ugaucgagaucgcca

SEQ ID NO: 3809521 - RNA, 17 nt, Salmonella typhimurium LT2
ugaucgauccgcaucag

SEQ ID NO: 3809522 - RNA, 17 nt, Salmonella typhimurium LT2
ugaucgccgccaucggc

SEQ ID NO: 3809523 - RNA, 14 nt, Salmonella typhimurium LT2
ugaucgccucuucg

SEQ ID NO: 3809524 - RNA, 19 nt, Salmonella typhimurium LT2
ugaucgcugagcgccauca

SEQ ID NO: 3809525 - RNA, 16 nt, Salmonella typhimurium LT2
ugaucgcuugccacua

SEQ ID NO: 3809526 - RNA, 15 nt, Salmonella typhimurium LT2
ugaucguaugcagcc

SEQ ID NO: 3809527 - RNA, 22 nt, Salmonella typhimurium LT2
ugaucguuggaaagcugcugcu

SEQ ID NO: 3809528 - RNA, 22 nt, Salmonella typhimurium LT2
ugaucguuuccagcaucgacca

SEQ ID NO: 3809529 - RNA, 23 nt, Salmonella typhimurium LT2
ugaucguuuuuguccauaaaaug

SEQ ID NO: 3809530 - RNA, 13 nt, Salmonella typhimurium LT2
ugaucuaaaaauu

SEQ ID NO: 3809531 - RNA, 18 nt, Salmonella typhimurium LT2
ugaucuauccaauaauaa

SEQ ID NO: 3809532 - RNA, 20 nt, Salmonella typhimurium LT2
ugaucuauccaauaauaaga

SEQ ID NO: 3809533 - RNA, 22 nt, Salmonella typhimurium LT2
ugaucuccucgccguaaaauuc

SEQ ID NO: 3809534 - RNA, 15 nt, Salmonella typhimurium LT2
ugaucugaagcguau

SEQ ID NO: 3809535 - RNA, 13 nt, Salmonella typhimurium LT2
ugaucuggccaau

SEQ ID NO: 3809536 - RNA, 19 nt, Salmonella typhimurium LT2
ugaucuggccaauuuuuca

SEQ ID NO: 3809537 - RNA, 20 nt, Salmonella typhimurium LT2
ugaucuggccaauuuuucac

SEQ ID NO: 3809538 - RNA, 13 nt, Salmonella typhimurium LT2
ugaucuuuauaaa

SEQ ID NO: 3809539 - RNA, 19 nt, Salmonella typhimurium LT2
ugaucuuucaacguuuuau

SEQ ID NO: 3809540 - RNA, 22 nt, Salmonella typhimurium LT2
ugaugaaaaguauauaucccgc

SEQ ID NO: 3809541 - RNA, 17 nt, Salmonella typhimurium LT2
ugaugaacaggcguggg

SEQ ID NO: 3809542 - RNA, 18 nt, Salmonella typhimurium LT2
ugaugacaaagccggaua

SEQ ID NO: 3809543 - RNA, 13 nt, Salmonella typhimurium LT2
ugaugacgcgcag

SEQ ID NO: 3809544 - RNA, 20 nt, Salmonella typhimurium LT2
ugaugacgcgcaggccguca

SEQ ID NO: 3809545 - RNA, 13 nt, Salmonella typhimurium LT2
ugaugagaggcga

SEQ ID NO: 3809546 - RNA, 16 nt, Salmonella typhimurium LT2
ugaugaggcguaagcg

SEQ ID NO: 3809547 - RNA, 13 nt, Salmonella typhimurium LT2
ugaugauaaauug

SEQ ID NO: 3809548 - RNA, 21 nt, Salmonella typhimurium LT2
ugaugaucgcgauagcgcuga

SEQ ID NO: 3809549 - RNA, 13 nt, Salmonella typhimurium LT2
ugaugaucuucag

SEQ ID NO: 3809550 - RNA, 17 nt, Salmonella typhimurium LT2
ugaugaugaagcuacag

SEQ ID NO: 3809551 - RNA, 16 nt, Salmonella typhimurium LT2
ugaugauuuaugaaua

SEQ ID NO: 3809552 - RNA, 23 nt, Salmonella typhimurium LT2
ugaugcaacaggccgcgaaagcg

SEQ ID NO: 3809553 - RNA, 17 nt, Salmonella typhimurium LT2
ugaugcaggcaauauac

SEQ ID NO: 3809554 - RNA, 13 nt, Salmonella typhimurium LT2
ugaugccacaggc

SEQ ID NO: 3809555 - RNA, 22 nt, Salmonella typhimurium LT2
ugaugccccagaacaacgggaa

SEQ ID NO: 3809556 - RNA, 15 nt, Salmonella typhimurium LT2
ugaugccgucgacgc

SEQ ID NO: 3809557 - RNA, 20 nt, Salmonella typhimurium LT2
ugaugccguuuucauccauu

SEQ ID NO: 3809558 - RNA, 18 nt, Salmonella typhimurium LT2
ugaugcguauccagcgcg

SEQ ID NO: 3809559 - RNA, 23 nt, Salmonella typhimurium LT2
ugaugcguuguaccguuuuccag

SEQ ID NO: 3809560 - RNA, 16 nt, Salmonella typhimurium LT2
ugaugcuuuuuacauu

SEQ ID NO: 3809561 - RNA, 20 nt, Salmonella typhimurium LT2
ugauggcagaccguggccgu

SEQ ID NO: 3809562 - RNA, 17 nt, Salmonella typhimurium LT2
ugauggcgaacagcccc

SEQ ID NO: 3809563 - RNA, 11 nt, Salmonella typhimurium LT2
ugcagcagcgu

SEQ ID NO: 3809564 - RNA, 17 nt, Salmonella typhimurium LT2
ugcagcagcuucgccag

SEQ ID NO: 3809565 - RNA, 14 nt, Salmonella typhimurium LT2
ugcagccaggccau

SEQ ID NO: 3809566 - RNA, 18 nt, Salmonella typhimurium LT2
ugcagccccggcggcguu

SEQ ID NO: 3809567 - RNA, 18 nt, Salmonella typhimurium LT2
ugcagccuggagagcagc

SEQ ID NO: 3809568 - RNA, 22 nt, Salmonella typhimurium LT2
ugcagccuggagagcagcgcca

SEQ ID NO: 3809569 - RNA, 13 nt, Salmonella typhimurium LT2
ugcagcgcagcgg

SEQ ID NO: 3809570 - RNA, 14 nt, Salmonella typhimurium LT2
ugcagcgccaucca

SEQ ID NO: 3809571 - RNA, 16 nt, Salmonella typhimurium LT2
ugcagcgccgccugua

SEQ ID NO: 3809572 - RNA, 21 nt, Salmonella typhimurium LT2
ugcagcgccuggcgguaugaa

SEQ ID NO: 3809573 - RNA, 19 nt, Salmonella typhimurium LT2
ugcagcgcguccaauagcc

SEQ ID NO: 3809574 - RNA, 18 nt, Salmonella typhimurium LT2
ugcagcggaauucccaca

SEQ ID NO: 3809575 - RNA, 14 nt, Salmonella typhimurium LT2
ugcagcguuuccag

SEQ ID NO: 3809576 - RNA, 14 nt, Salmonella typhimurium LT2
ugcagcucaagcgc

SEQ ID NO: 3809577 - RNA, 16 nt, Salmonella typhimurium LT2
ugcagcucgcacugau

SEQ ID NO: 3809578 - RNA, 18 nt, Salmonella typhimurium LT2
ugcaggccaagcagcgcc

SEQ ID NO: 3809579 - RNA, 14 nt, Salmonella typhimurium LT2
ugcaggccggauaa

SEQ ID NO: 3809580 - RNA, 18 nt, Salmonella typhimurium LT2
ugcaggccggauaagccg

SEQ ID NO: 3809581 - RNA, 19 nt, Salmonella typhimurium LT2
ugcaggcgggugcgcagcc

SEQ ID NO: 3809582 - RNA, 18 nt, Salmonella typhimurium LT2
ugcagggaacacggcaug

SEQ ID NO: 3809583 - RNA, 21 nt, Salmonella typhimurium LT2
ugcagggaacacggcaugaag

SEQ ID NO: 3809584 - RNA, 18 nt, Salmonella typhimurium LT2
ugcagggaauaagcaccc

SEQ ID NO: 3809585 - RNA, 16 nt, Salmonella typhimurium LT2
ugcaguaagugagucc

SEQ ID NO: 3809586 - RNA, 15 nt, Salmonella typhimurium LT2
ugcagugcacugccu

SEQ ID NO: 3809587 - RNA, 17 nt, Salmonella typhimurium LT2
ugcagugcacugccuga

SEQ ID NO: 3809588 - RNA, 18 nt, Salmonella typhimurium LT2
ugcagugcacugccugau

SEQ ID NO: 3809589 - RNA, 22 nt, Salmonella typhimurium LT2
ugcaguucaucauccugcaggg

SEQ ID NO: 3809590 - RNA, 23 nt, Salmonella typhimurium LT2
ugcaguuccgcaauccuggcuuc

SEQ ID NO: 3809591 - RNA, 19 nt, Salmonella typhimurium LT2
ugcaguuccguugcaauau

SEQ ID NO: 3809592 - RNA, 19 nt, Salmonella typhimurium LT2
ugcaguucguacuccugca

SEQ ID NO: 3809593 - RNA, 14 nt, Salmonella typhimurium LT2
ugcauaaaaaaacg

SEQ ID NO: 3809594 - RNA, 22 nt, Salmonella typhimurium LT2
ugcauaaaacugaguucgccau

SEQ ID NO: 3809595 - RNA, 20 nt, Salmonella typhimurium LT2
ugcauaaagauugguaucug

SEQ ID NO: 3809596 - RNA, 20 nt, Salmonella typhimurium LT2
ugcauaaagcgguuuucaaa

SEQ ID NO: 3809597 - RNA, 23 nt, Salmonella typhimurium LT2
ugcauaaaggaguaacagauagu

SEQ ID NO: 3809598 - RNA, 12 nt, Salmonella typhimurium LT2
ugcauaauggug

SEQ ID NO: 3809599 - RNA, 19 nt, Salmonella typhimurium LT2
ugcauacguuucaccagca

SEQ ID NO: 3809600 - RNA, 20 nt, Salmonella typhimurium LT2
ugcauacguuucaccagcac

SEQ ID NO: 3809601 - RNA, 19 nt, Salmonella typhimurium LT2
ugcauacucacauucauaa

SEQ ID NO: 3809602 - RNA, 22 nt, Salmonella typhimurium LT2
ugcauacucacauucauaaaag

SEQ ID NO: 3809603 - RNA, 22 nt, Salmonella typhimurium LT2
ugcauauacguugcggcgcguu

SEQ ID NO: 3809604 - RNA, 16 nt, Salmonella typhimurium LT2
ugcauauuguauuggu

SEQ ID NO: 3809605 - RNA, 23 nt, Salmonella typhimurium LT2
ugcaucagaacaaacuuauccca

SEQ ID NO: 3809606 - RNA, 23 nt, Salmonella typhimurium LT2
ugcaucgccaguuugucaugcgu

SEQ ID NO: 3809607 - RNA, 15 nt, Salmonella typhimurium LT2
ugcaucucuuccagg

SEQ ID NO: 3809608 - RNA, 22 nt, Salmonella typhimurium LT2
ugcaucucuuccaggauacaca

SEQ ID NO: 3809609 - RNA, 15 nt, Salmonella typhimurium LT2
ugcaucuugaaugau

SEQ ID NO: 3809610 - RNA, 20 nt, Salmonella typhimurium LT2
ugcaucuugaaugauuuugu

SEQ ID NO: 3809611 - RNA, 13 nt, Salmonella typhimurium LT2
ugcaugacgcagg

SEQ ID NO: 3809612 - RNA, 15 nt, Salmonella typhimurium LT2
ugcaugauuaauacg

SEQ ID NO: 3809613 - RNA, 17 nt, Salmonella typhimurium LT2
ugcauggcagauaaacc

SEQ ID NO: 3809614 - RNA, 23 nt, Salmonella typhimurium LT2
ugcauggccggucuuaugcugcc

SEQ ID NO: 3809615 - RNA, 13 nt, Salmonella typhimurium LT2
ugcauucgcuccu

SEQ ID NO: 3809616 - RNA, 16 nt, Salmonella typhimurium LT2
ugcauucugcaacugu

SEQ ID NO: 3809617 - RNA, 15 nt, Salmonella typhimurium LT2
ugcauugcuuuuagu

SEQ ID NO: 3809618 - RNA, 16 nt, Salmonella typhimurium LT2
ugccaaaaaaucagca

SEQ ID NO: 3809619 - RNA, 21 nt, Salmonella typhimurium LT2
ugccaaacaucgcucgcgcca

SEQ ID NO: 3809620 - RNA, 20 nt, Salmonella typhimurium LT2
ugccaaagcgggcaauauaa

SEQ ID NO: 3809621 - RNA, 19 nt, Salmonella typhimurium LT2
ugccaaaucaugagcgcaa

SEQ ID NO: 3809622 - RNA, 14 nt, Salmonella typhimurium LT2
ugccaaccaccgcg

SEQ ID NO: 3809623 - RNA, 21 nt, Salmonella typhimurium LT2
ugccaagcguaguacguucca

SEQ ID NO: 3809624 - RNA, 17 nt, Salmonella typhimurium LT2
ugccaaguaacacggcg

SEQ ID NO: 3809625 - RNA, 16 nt, Salmonella typhimurium LT2
ugccaaguaauaaaga

SEQ ID NO: 3809626 - RNA, 23 nt, Salmonella typhimurium LT2
ugccaauauauugcuccaucauc

SEQ ID NO: 3809627 - RNA, 15 nt, Salmonella typhimurium LT2
ugccaaucuccagca

SEQ ID NO: 3809628 - RNA, 14 nt, Salmonella typhimurium LT2
ugccacaaccgccc

SEQ ID NO: 3809629 - RNA, 22 nt, Salmonella typhimurium LT2
ugccacaaccgcccccaacuga

SEQ ID NO: 3809630 - RNA, 15 nt, Salmonella typhimurium LT2
ugccacaauuugcag

SEQ ID NO: 3809631 - RNA, 13 nt, Salmonella typhimurium LT2
ugccaccagccua

SEQ ID NO: 3809632 - RNA, 20 nt, Salmonella typhimurium LT2
ugccaccagccuaaaaacag

SEQ ID NO: 3809633 - RNA, 14 nt, Salmonella typhimurium LT2
ugccaccagcgcca

SEQ ID NO: 3809634 - RNA, 17 nt, Salmonella typhimurium LT2
ugccacgagccuucugg

SEQ ID NO: 3809635 - RNA, 22 nt, Salmonella typhimurium LT2
ugccacgucacgcaacaggccg

SEQ ID NO: 3809636 - RNA, 13 nt, Salmonella typhimurium LT2
ugccacuccgcca

SEQ ID NO: 3809637 - RNA, 16 nt, Salmonella typhimurium LT2
ugccacucgauuccca

SEQ ID NO: 3809638 - RNA, 13 nt, Salmonella typhimurium LT2
ugccacugccacg

SEQ ID NO: 3809639 - RNA, 20 nt, Salmonella typhimurium LT2
ugccacuggguuucccauug

SEQ ID NO: 3809640 - RNA, 13 nt, Salmonella typhimurium LT2
ugccagaaacauc

SEQ ID NO: 3809641 - RNA, 14 nt, Salmonella typhimurium LT2
ugccagaagagaau

SEQ ID NO: 3809642 - RNA, 22 nt, Salmonella typhimurium LT2
ugccagaccauuaacgccgccg

SEQ ID NO: 3809643 - RNA, 17 nt, Salmonella typhimurium LT2
ugccagacgggccaggc

SEQ ID NO: 3809644 - RNA, 22 nt, Salmonella typhimurium LT2
ugccagacgggccaggcgaccg

SEQ ID NO: 3809645 - RNA, 17 nt, Salmonella typhimurium LT2
ugccagauuuuccaggc

SEQ ID NO: 3809646 - RNA, 15 nt, Salmonella typhimurium LT2
ugccagcacagcggu

SEQ ID NO: 3809647 - RNA, 16 nt, Salmonella typhimurium LT2
ugccagcaccagcagu

SEQ ID NO: 3809648 - RNA, 13 nt, Salmonella typhimurium LT2
ugccagcacuaac

SEQ ID NO: 3809649 - RNA, 20 nt, Salmonella typhimurium LT2
ugccagcagauuuucauccg

SEQ ID NO: 3809650 - RNA, 14 nt, Salmonella typhimurium LT2
ugccagcauuaacc

SEQ ID NO: 3809651 - RNA, 15 nt, Salmonella typhimurium LT2
ugccagccgccgccg

SEQ ID NO: 3809652 - RNA, 14 nt, Salmonella typhimurium LT2
ugccagcggccagg

SEQ ID NO: 3809653 - RNA, 20 nt, Salmonella typhimurium LT2
ugccagcguaagucugguaa

SEQ ID NO: 3809654 - RNA, 11 nt, Salmonella typhimurium LT2
ugccaggcauu

SEQ ID NO: 3809655 - RNA, 18 nt, Salmonella typhimurium LT2
ugccaggccgcaucgcgu

SEQ ID NO: 3809656 - RNA, 11 nt, Salmonella typhimurium LT2
ugccagggcca

SEQ ID NO: 3809657 - RNA, 15 nt, Salmonella typhimurium LT2
ugccagggccaauca

SEQ ID NO: 3809658 - RNA, 19 nt, Salmonella typhimurium LT2
ugccagggcggaagcagau

SEQ ID NO: 3809659 - RNA, 11 nt, Salmonella typhimurium LT2
ugccagguaac

SEQ ID NO: 3809660 - RNA, 14 nt, Salmonella typhimurium LT2
ugccagguuauuuc

SEQ ID NO: 3809661 - RNA, 19 nt, Salmonella typhimurium LT2
ugccaguaacguucuucga

SEQ ID NO: 3809662 - RNA, 17 nt, Salmonella typhimurium LT2
ugccaguaccgccgccg

SEQ ID NO: 3809663 - RNA, 16 nt, Salmonella typhimurium LT2
ugccaguacgccaggc

SEQ ID NO: 3809664 - RNA, 19 nt, Salmonella typhimurium LT2
ugccaguacggugaauauu

SEQ ID NO: 3809665 - RNA, 15 nt, Salmonella typhimurium LT2
ugccaguagcugcuc

SEQ ID NO: 3809666 - RNA, 18 nt, Salmonella typhimurium LT2
ugccaguagcugcuccag

SEQ ID NO: 3809667 - RNA, 13 nt, Salmonella typhimurium LT2
ugccggaccugcg

SEQ ID NO: 3809668 - RNA, 15 nt, Salmonella typhimurium LT2
ugccggacugauacc

SEQ ID NO: 3809669 - RNA, 19 nt, Salmonella typhimurium LT2
ugccggagaccuuuuucau

SEQ ID NO: 3809670 - RNA, 21 nt, Salmonella typhimurium LT2
ugccggaguuuuuccgggccg

SEQ ID NO: 3809671 - RNA, 19 nt, Salmonella typhimurium LT2
ugccggauggcgcuaaugc

SEQ ID NO: 3809672 - RNA, 12 nt, Salmonella typhimurium LT2
ugccggcguucc

SEQ ID NO: 3809673 - RNA, 22 nt, Salmonella typhimurium LT2
ugccggcguuccgcacauaauc

SEQ ID NO: 3809674 - RNA, 17 nt, Salmonella typhimurium LT2
ugccggcuuuccgcacc

SEQ ID NO: 3809675 - RNA, 13 nt, Salmonella typhimurium LT2
ugccgggaaaacg

SEQ ID NO: 3809676 - RNA, 21 nt, Salmonella typhimurium LT2
ugccgggcauaaacuaauccc

SEQ ID NO: 3809677 - RNA, 13 nt, Salmonella typhimurium LT2
ugccgggccuggc

SEQ ID NO: 3809678 - RNA, 23 nt, Salmonella typhimurium LT2
ugccggguucguuaacccggcau

SEQ ID NO: 3809679 - RNA, 22 nt, Salmonella typhimurium LT2
ugccgguaaagaaaccggcguc

SEQ ID NO: 3809680 - RNA, 17 nt, Salmonella typhimurium LT2
ugccggugcgagaaaaa

SEQ ID NO: 3809681 - RNA, 18 nt, Salmonella typhimurium LT2
ugccggugcgagaaaaag

SEQ ID NO: 3809682 - RNA, 22 nt, Salmonella typhimurium LT2
ugccguaaauugaguggacauc

SEQ ID NO: 3809683 - RNA, 13 nt, Salmonella typhimurium LT2
ugccguagcgcau

SEQ ID NO: 3809684 - RNA, 22 nt, Salmonella typhimurium LT2
ugccgucaaaggcuauaaccgu

SEQ ID NO: 3809685 - RNA, 16 nt, Salmonella typhimurium LT2
ugccgucaacacgcag

SEQ ID NO: 3809686 - RNA, 20 nt, Salmonella typhimurium LT2
ugccgucaacacgcagaccc

SEQ ID NO: 3809687 - RNA, 14 nt, Salmonella typhimurium LT2
ugccgucacagaga

SEQ ID NO: 3809688 - RNA, 14 nt, Salmonella typhimurium LT2
ugccgucagcuccu

SEQ ID NO: 3809689 - RNA, 15 nt, Salmonella typhimurium LT2
ugccgucauccagca

SEQ ID NO: 3809690 - RNA, 17 nt, Salmonella typhimurium LT2
ugccguccgaucucguu

SEQ ID NO: 3809691 - RNA, 18 nt, Salmonella typhimurium LT2
ugccguccggcaucacaa

SEQ ID NO: 3809692 - RNA, 21 nt, Salmonella typhimurium LT2
ugccgucgcaggcggccaggc

SEQ ID NO: 3809693 - RNA, 19 nt, Salmonella typhimurium LT2
ugccgucgcggcuuucagc

SEQ ID NO: 3809694 - RNA, 21 nt, Salmonella typhimurium LT2
ugccgucggcaauuaacauuu

SEQ ID NO: 3809695 - RNA, 22 nt, Salmonella typhimurium LT2
ugccgugcgccgacaucgccac

SEQ ID NO: 3809696 - RNA, 14 nt, Salmonella typhimurium LT2
ugccguuaacugcu

SEQ ID NO: 3809697 - RNA, 17 nt, Salmonella typhimurium LT2
ugccguuaacugcugcu

SEQ ID NO: 3809698 - RNA, 17 nt, Salmonella typhimurium LT2
ugccguucauuugcaau

SEQ ID NO: 3809699 - RNA, 18 nt, Salmonella typhimurium LT2
ugccguuguugucaauau

SEQ ID NO: 3809700 - RNA, 18 nt, Salmonella typhimurium LT2
ugccguuguuuucgcguu

SEQ ID NO: 3809701 - RNA, 12 nt, Salmonella typhimurium LT2
ugccguuuucaa

SEQ ID NO: 3809702 - RNA, 15 nt, Salmonella typhimurium LT2
ugccguuuuccagcc

SEQ ID NO: 3809703 - RNA, 18 nt, Salmonella typhimurium LT2
ugccguuuuucucaucaa

SEQ ID NO: 3809704 - RNA, 19 nt, Salmonella typhimurium LT2
ugccguuuuucucaucaag

SEQ ID NO: 3809705 - RNA, 18 nt, Salmonella typhimurium LT2
ugccuaaaguggcgccuu

SEQ ID NO: 3809706 - RNA, 20 nt, Salmonella typhimurium LT2
ugccuaaaguggcgccuugc

SEQ ID NO: 3809707 - RNA, 12 nt, Salmonella typhimurium LT2
ugccuacuguuc

SEQ ID NO: 3809708 - RNA, 16 nt, Salmonella typhimurium LT2
ugccucacccugaaau

SEQ ID NO: 3809709 - RNA, 15 nt, Salmonella typhimurium LT2
ugccucgcugaguuc

SEQ ID NO: 3809710 - RNA, 19 nt, Salmonella typhimurium LT2
ugccucguuucccucauau

SEQ ID NO: 3809711 - RNA, 18 nt, Salmonella typhimurium LT2
ugccucuggccaguuuca

SEQ ID NO: 3809712 - RNA, 19 nt, Salmonella typhimurium LT2
ugccucuggccaguuucaa

SEQ ID NO: 3809713 - RNA, 14 nt, Salmonella typhimurium LT2
ugccugaaaagggg

SEQ ID NO: 3809714 - RNA, 22 nt, Salmonella typhimurium LT2
ugccugaaaauagcgccauugc

SEQ ID NO: 3809715 - RNA, 15 nt, Salmonella typhimurium LT2
ugccugaccggcauu

SEQ ID NO: 3809716 - RNA, 22 nt, Salmonella typhimurium LT2
ugccugacgaaaacccgccacc

SEQ ID NO: 3809717 - RNA, 15 nt, Salmonella typhimurium LT2
ugccugacgccacca

SEQ ID NO: 3809718 - RNA, 15 nt, Salmonella typhimurium LT2
ugccugccgcagaag

SEQ ID NO: 3809719 - RNA, 16 nt, Salmonella typhimurium LT2
ugccugccgcagcggc

SEQ ID NO: 3809720 - RNA, 18 nt, Salmonella typhimurium LT2
ugccugccggauuuuuca

SEQ ID NO: 3809721 - RNA, 15 nt, Salmonella typhimurium LT2
ugccugcgucauccc

SEQ ID NO: 3809722 - RNA, 18 nt, Salmonella typhimurium LT2
ugccugcguugcuauggc

SEQ ID NO: 3809723 - RNA, 22 nt, Salmonella typhimurium LT2
ugccugcuucagacaacgccgc

SEQ ID NO: 3809724 - RNA, 14 nt, Salmonella typhimurium LT2
ugccuggagccagc

SEQ ID NO: 3809725 - RNA, 14 nt, Salmonella typhimurium LT2
ugccuggcgaacga

SEQ ID NO: 3809726 - RNA, 15 nt, Salmonella typhimurium LT2
ugccuggcucauucu

SEQ ID NO: 3809727 - RNA, 18 nt, Salmonella typhimurium LT2
ugccuucacccagacugu

SEQ ID NO: 3809728 - RNA, 23 nt, Salmonella typhimurium LT2
ugccuuccgggcggcugucccag

SEQ ID NO: 3809729 - RNA, 11 nt, Salmonella typhimurium LT2
ugccuuccuga

SEQ ID NO: 3809730 - RNA, 18 nt, Salmonella typhimurium LT2
ugccuucucugucgagca

SEQ ID NO: 3809731 - RNA, 21 nt, Salmonella typhimurium LT2
ugccuuguuucgucaauauuu

SEQ ID NO: 3809732 - RNA, 14 nt, Salmonella typhimurium LT2
ugccuuuacuguug

SEQ ID NO: 3809733 - RNA, 19 nt, Salmonella typhimurium LT2
ugccuuuuucccacugcgc

SEQ ID NO: 3809734 - RNA, 18 nt, Salmonella typhimurium LT2
ugccuuuuugcagcgcgg

SEQ ID NO: 3809735 - RNA, 13 nt, Salmonella typhimurium LT2
ugcgaaaagccgg

SEQ ID NO: 3809736 - RNA, 22 nt, Salmonella typhimurium LT2
ugcgaaagaauuacugaauacc

SEQ ID NO: 3809737 - RNA, 14 nt, Salmonella typhimurium LT2
ugcgaaagccucuu

SEQ ID NO: 3809738 - RNA, 19 nt, Salmonella typhimurium LT2
ugcgaaagccucuuccgcc

SEQ ID NO: 3809739 - RNA, 14 nt, Salmonella typhimurium LT2
ugcgaaccgcacag

SEQ ID NO: 3809740 - RNA, 15 nt, Salmonella typhimurium LT2
ugcgaagaccgcauc

SEQ ID NO: 3809741 - RNA, 13 nt, Salmonella typhimurium LT2
ugcgaagguggcg

SEQ ID NO: 3809742 - RNA, 15 nt, Salmonella typhimurium LT2
ugcgaagguggcgga

SEQ ID NO: 3809743 - RNA, 17 nt, Salmonella typhimurium LT2
ugcgaagguuaagaggg

SEQ ID NO: 3809744 - RNA, 19 nt, Salmonella typhimurium LT2
ugcgacacgcugcauauaa

SEQ ID NO: 3809745 - RNA, 22 nt, Salmonella typhimurium LT2
ugcgacagauacacgcccucuc

SEQ ID NO: 3809746 - RNA, 23 nt, Salmonella typhimurium LT2
ugcgacagguucgaaucuuccau

SEQ ID NO: 3809747 - RNA, 15 nt, Salmonella typhimurium LT2
ugcgacaucagccag

SEQ ID NO: 3809748 - RNA, 21 nt, Salmonella typhimurium LT2
ugcgaccacggguagagcuuu

SEQ ID NO: 3809749 - RNA, 22 nt, Salmonella typhimurium LT2
ugcgacgcgcucaccuccgcca

SEQ ID NO: 3809750 - RNA, 17 nt, Salmonella typhimurium LT2
ugcgacuccaggaacag

SEQ ID NO: 3809751 - RNA, 18 nt, Salmonella typhimurium LT2
ugcgacugaaaaucaaaa

SEQ ID NO: 3809752 - RNA, 22 nt, Salmonella typhimurium LT2
ugcgacuuugcgccggcagucc

SEQ ID NO: 3809753 - RNA, 12 nt, Salmonella typhimurium LT2
ugcgagaaaaag

SEQ ID NO: 3809754 - RNA, 21 nt, Salmonella typhimurium LT2
ugcgagacggcggaaagggcc

SEQ ID NO: 3809755 - RNA, 18 nt, Salmonella typhimurium LT2
ugcgagcaguucagcagc

SEQ ID NO: 3809756 - RNA, 17 nt, Salmonella typhimurium LT2
ugcgagcuuuccaccag

SEQ ID NO: 3809757 - RNA, 15 nt, Salmonella typhimurium LT2
ugcgaggucugguca

SEQ ID NO: 3809758 - RNA, 18 nt, Salmonella typhimurium LT2
ugcgagucgucaguucca

SEQ ID NO: 3809759 - RNA, 14 nt, Salmonella typhimurium LT2
ugcgauacagcgua

SEQ ID NO: 3809760 - RNA, 16 nt, Salmonella typhimurium LT2
ugcgauagcccggcau

SEQ ID NO: 3809761 - RNA, 19 nt, Salmonella typhimurium LT2
ugcgauagcugguaaauaa

SEQ ID NO: 3809762 - RNA, 15 nt, Salmonella typhimurium LT2
ugcgaucgccggcaa

SEQ ID NO: 3809763 - RNA, 20 nt, Salmonella typhimurium LT2
ugcgaucgggauuccaguga

SEQ ID NO: 3809764 - RNA, 22 nt, Salmonella typhimurium LT2
ugcgaucgggauuccagugaca

SEQ ID NO: 3809765 - RNA, 17 nt, Salmonella typhimurium LT2
ugcgaugaucuugcuca

SEQ ID NO: 3809766 - RNA, 19 nt, Salmonella typhimurium LT2
ugcgauucaccgugccacc

SEQ ID NO: 3809767 - RNA, 15 nt, Salmonella typhimurium LT2
ugcgcaaaucaaaag

SEQ ID NO: 3809768 - RNA, 18 nt, Salmonella typhimurium LT2
ugcgcaaauccgacggca

SEQ ID NO: 3809769 - RNA, 15 nt, Salmonella typhimurium LT2
ugcgcaacgagugcu

SEQ ID NO: 3809770 - RNA, 22 nt, Salmonella typhimurium LT2
ugcgcaacguuucuuucaucag

SEQ ID NO: 3809771 - RNA, 16 nt, Salmonella typhimurium LT2
ugcgcuuuacuguucc

SEQ ID NO: 3809772 - RNA, 18 nt, Salmonella typhimurium LT2
ugcgcuuuggcugccagu

SEQ ID NO: 3809773 - RNA, 16 nt, Salmonella typhimurium LT2
ugcgcuuuuccaggcg

SEQ ID NO: 3809774 - RNA, 17 nt, Salmonella typhimurium LT2
ugcgcuuuuucaucauc

SEQ ID NO: 3809775 - RNA, 17 nt, Salmonella typhimurium LT2
ugcggaagaucuggcga

SEQ ID NO: 3809776 - RNA, 17 nt, Salmonella typhimurium LT2
ugcggaaucuccggcga

SEQ ID NO: 3809777 - RNA, 18 nt, Salmonella typhimurium LT2
ugcggaccgucgcggcau

SEQ ID NO: 3809778 - RNA, 20 nt, Salmonella typhimurium LT2
ugcggacgcagcucauaccc

SEQ ID NO: 3809779 - RNA, 19 nt, Salmonella typhimurium LT2
ugcggagaagacgccgccg

SEQ ID NO: 3809780 - RNA, 21 nt, Salmonella typhimurium LT2
ugcggaucuucaccacgccau

SEQ ID NO: 3809781 - RNA, 14 nt, Salmonella typhimurium LT2
ugcggaugcgccau

SEQ ID NO: 3809782 - RNA, 15 nt, Salmonella typhimurium LT2
ugcggauguuaauga

SEQ ID NO: 3809783 - RNA, 18 nt, Salmonella typhimurium LT2
ugcggcaaaaauccuucu

SEQ ID NO: 3809784 - RNA, 14 nt, Salmonella typhimurium LT2
ugcggcaagcgcgc

SEQ ID NO: 3809785 - RNA, 21 nt, Salmonella typhimurium LT2
ugcggcaauggccgcagcgcc

SEQ ID NO: 3809786 - RNA, 22 nt, Salmonella typhimurium LT2
ugcggcaauggccgcagcgcca

SEQ ID NO: 3809787 - RNA, 23 nt, Salmonella typhimurium LT2
ugcggcaauggccgcagcgccau

SEQ ID NO: 3809788 - RNA, 18 nt, Salmonella typhimurium LT2
ugcggcaauggcucaggc

SEQ ID NO: 3809789 - RNA, 19 nt, Salmonella typhimurium LT2
ugcggcagaaucacggccg

SEQ ID NO: 3809790 - RNA, 18 nt, Salmonella typhimurium LT2
ugcggcagggcggucugg

SEQ ID NO: 3809791 - RNA, 17 nt, Salmonella typhimurium LT2
ugcggcauuacgcgccu

SEQ ID NO: 3809792 - RNA, 17 nt, Salmonella typhimurium LT2
ugcggccaugaucgccg

SEQ ID NO: 3809793 - RNA, 19 nt, Salmonella typhimurium LT2
ugcggccuuuauccagcgg

SEQ ID NO: 3809794 - RNA, 21 nt, Salmonella typhimurium LT2
ugcggcgaaauauuaucgcca

SEQ ID NO: 3809795 - RNA, 22 nt, Salmonella typhimurium LT2
ugcggcgaggaguaguuaaaaa

SEQ ID NO: 3809796 - RNA, 13 nt, Salmonella typhimurium LT2
ugcggcguacugc

SEQ ID NO: 3809797 - RNA, 16 nt, Salmonella typhimurium LT2
ugcggcguacugcaac

SEQ ID NO: 3809798 - RNA, 14 nt, Salmonella typhimurium LT2
ugcggcguggcgca

SEQ ID NO: 3809799 - RNA, 17 nt, Salmonella typhimurium LT2
ugcggcuauauaaaauc

SEQ ID NO: 3809800 - RNA, 20 nt, Salmonella typhimurium LT2
ugcggcuauauaaaaucggg

SEQ ID NO: 3809801 - RNA, 12 nt, Salmonella typhimurium LT2
ugcggcuuaucg

SEQ ID NO: 3809802 - RNA, 17 nt, Salmonella typhimurium LT2
ugcggcuucagcgacau

SEQ ID NO: 3809803 - RNA, 22 nt, Salmonella typhimurium LT2
ugcggcuugaguuuuccgccau

SEQ ID NO: 3809804 - RNA, 15 nt, Salmonella typhimurium LT2
ugcggcuuucaucau

SEQ ID NO: 3809805 - RNA, 14 nt, Salmonella typhimurium LT2
ugcggcuuuuucac

SEQ ID NO: 3809806 - RNA, 18 nt, Salmonella typhimurium LT2
ugcgggaacagauaaaug

SEQ ID NO: 3809807 - RNA, 16 nt, Salmonella typhimurium LT2
ugcgggacgcaucauc

SEQ ID NO: 3809808 - RNA, 19 nt, Salmonella typhimurium LT2
ugcgggagcuguucuuaua

SEQ ID NO: 3809809 - RNA, 22 nt, Salmonella typhimurium LT2
ugcgggccguaaaguucccagc

SEQ ID NO: 3809810 - RNA, 13 nt, Salmonella typhimurium LT2
ugcgggcuccgga

SEQ ID NO: 3809811 - RNA, 16 nt, Salmonella typhimurium LT2
ugcggguccugaucgg

SEQ ID NO: 3809812 - RNA, 20 nt, Salmonella typhimurium LT2
ugcggguguccguuccugcc

SEQ ID NO: 3809813 - RNA, 15 nt, Salmonella typhimurium LT2
ugcgguaaauaaugc

SEQ ID NO: 3809814 - RNA, 17 nt, Salmonella typhimurium LT2
ugcgguaauaugccagc

SEQ ID NO: 3809815 - RNA, 18 nt, Salmonella typhimurium LT2
ugcgguaauaugccagcu

SEQ ID NO: 3809816 - RNA, 19 nt, Salmonella typhimurium LT2
ugcgguaauaugccagcuc

SEQ ID NO: 3809817 - RNA, 15 nt, Salmonella typhimurium LT2
ugcgguaaucgccgc

SEQ ID NO: 3809818 - RNA, 14 nt, Salmonella typhimurium LT2
ugcgguagcgccga

SEQ ID NO: 3809819 - RNA, 18 nt, Salmonella typhimurium LT2
ugcgguauaucacgccau

SEQ ID NO: 3809820 - RNA, 17 nt, Salmonella typhimurium LT2
ugcggucaaaagcugca

SEQ ID NO: 3809821 - RNA, 21 nt, Salmonella typhimurium LT2
ugcggucuucaacaccgacau

SEQ ID NO: 3809822 - RNA, 23 nt, Salmonella typhimurium LT2
ugcgguuuacgccaugcaucaau

SEQ ID NO: 3809823 - RNA, 17 nt, Salmonella typhimurium LT2
ugcguaaaaucagcauc

SEQ ID NO: 3809824 - RNA, 14 nt, Salmonella typhimurium LT2
ugcguaaauaaaug

SEQ ID NO: 3809825 - RNA, 15 nt, Salmonella typhimurium LT2
ugcguaaucuuuuca

SEQ ID NO: 3809826 - RNA, 22 nt, Salmonella typhimurium LT2
ugcguaccgcuaucgccaaacu

SEQ ID NO: 3809827 - RNA, 14 nt, Salmonella typhimurium LT2
ugcguacucagcag

SEQ ID NO: 3809828 - RNA, 15 nt, Salmonella typhimurium LT2
ugcguaucgcccacc

SEQ ID NO: 3809829 - RNA, 13 nt, Salmonella typhimurium LT2
ugcguauuuccac

SEQ ID NO: 3809830 - RNA, 14 nt, Salmonella typhimurium LT2
ugcgucaaaauaag

SEQ ID NO: 3809831 - RNA, 19 nt, Salmonella typhimurium LT2
ugcgucaaaauaagcaccg

SEQ ID NO: 3809832 - RNA, 11 nt, Salmonella typhimurium LT2
ugcgucaacgc

SEQ ID NO: 3809833 - RNA, 21 nt, Salmonella typhimurium LT2
ugcgucacgauaguuuuaaua

SEQ ID NO: 3809834 - RNA, 17 nt, Salmonella typhimurium LT2
ugcgucaucauccggua

SEQ ID NO: 3809835 - RNA, 14 nt, Salmonella typhimurium LT2
ugcgucauggugua

SEQ ID NO: 3809836 - RNA, 17 nt, Salmonella typhimurium LT2
ugcgucgagcgccguca

SEQ ID NO: 3809837 - RNA, 19 nt, Salmonella typhimurium LT2
ugcgucgccccaaucgcca

SEQ ID NO: 3809838 - RNA, 19 nt, Salmonella typhimurium LT2
ugcgucgcgcuuucaaucg

SEQ ID NO: 3809839 - RNA, 20 nt, Salmonella typhimurium LT2
ugcgucgcguaccagcgccc

SEQ ID NO: 3809840 - RNA, 18 nt, Salmonella typhimurium LT2
ugcgucggcaccauuccc

SEQ ID NO: 3809841 - RNA, 18 nt, Salmonella typhimurium LT2
ugcgucugaauggacucg

SEQ ID NO: 3809842 - RNA, 14 nt, Salmonella typhimurium LT2
ugcgugcgcgccac

SEQ ID NO: 3809843 - RNA, 16 nt, Salmonella typhimurium LT2
ugcgugcuggcggccg

SEQ ID NO: 3809844 - RNA, 21 nt, Salmonella typhimurium LT2
ugcguggcgccugcggcaggc

SEQ ID NO: 3809845 - RNA, 16 nt, Salmonella typhimurium LT2
ugcguggcguaucggc

SEQ ID NO: 3809846 - RNA, 20 nt, Salmonella typhimurium LT2
ugcguucacagcaccauguu

SEQ ID NO: 3809847 - RNA, 20 nt, Salmonella typhimurium LT2
ugcguucaggcggcaaaaaa

SEQ ID NO: 3809848 - RNA, 19 nt, Salmonella typhimurium LT2
ugcguucauggcgcgacau

SEQ ID NO: 3809849 - RNA, 21 nt, Salmonella typhimurium LT2
ugcguucuuccacuucagcag

SEQ ID NO: 3809850 - RNA, 13 nt, Salmonella typhimurium LT2
ugcguugaauaaa

SEQ ID NO: 3809851 - RNA, 16 nt, Salmonella typhimurium LT2
ugcguugcaaauauuc

SEQ ID NO: 3809852 - RNA, 19 nt, Salmonella typhimurium LT2
ugcguugccgccuugcugc

SEQ ID NO: 3809853 - RNA, 15 nt, Salmonella typhimurium LT2
ugcguugcuauggca

SEQ ID NO: 3809854 - RNA, 17 nt, Salmonella typhimurium LT2
ugcguuggaaauacguu

SEQ ID NO: 3809855 - RNA, 19 nt, Salmonella typhimurium LT2
ugcguugucuaccgcgccu

SEQ ID NO: 3809856 - RNA, 23 nt, Salmonella typhimurium LT2
ugcguugucuaccgcgccuuccg

SEQ ID NO: 3809857 - RNA, 19 nt, Salmonella typhimurium LT2
ugcguuguuccugagucac

SEQ ID NO: 3809858 - RNA, 13 nt, Salmonella typhimurium LT2
ugcguuugccgcc

SEQ ID NO: 3809859 - RNA, 12 nt, Salmonella typhimurium LT2
ugcuacgcgcca

SEQ ID NO: 3809860 - RNA, 15 nt, Salmonella typhimurium LT2
ugcuacgcucaccuc

SEQ ID NO: 3809861 - RNA, 21 nt, Salmonella typhimurium LT2
ugcuauaaauaaggccugagc

SEQ ID NO: 3809862 - RNA, 14 nt, Salmonella typhimurium LT2
ugcuauaccgcuuu

SEQ ID NO: 3809863 - RNA, 19 nt, Salmonella typhimurium LT2
ugcuauaugcaggcauaaa

SEQ ID NO: 3809864 - RNA, 14 nt, Salmonella typhimurium LT2
ugcuaucaaacuga

SEQ ID NO: 3809865 - RNA, 12 nt, Salmonella typhimurium LT2
ugcuaucaggau

SEQ ID NO: 3809866 - RNA, 15 nt, Salmonella typhimurium LT2
ugcuauccgccgcca

SEQ ID NO: 3809867 - RNA, 17 nt, Salmonella typhimurium LT2
ugcuaucuuugcugccg

SEQ ID NO: 3809868 - RNA, 17 nt, Salmonella typhimurium LT2
ugcucaaccacgauaac

SEQ ID NO: 3809869 - RNA, 22 nt, Salmonella typhimurium LT2
ugcucaacccgaccuacaaauu

SEQ ID NO: 3809870 - RNA, 14 nt, Salmonella typhimurium LT2
ugcucaacucugug

SEQ ID NO: 3809871 - RNA, 12 nt, Salmonella typhimurium LT2
ugcucaauaagc

SEQ ID NO: 3809872 - RNA, 16 nt, Salmonella typhimurium LT2
ugcucaaucgcaugac

SEQ ID NO: 3809873 - RNA, 24 nt, Salmonella typhimurium LT2
ugcucaccgguaaaaguauguauu

SEQ ID NO: 3809874 - RNA, 15 nt, Salmonella typhimurium LT2
ugcucagcgaccguc

SEQ ID NO: 3809875 - RNA, 20 nt, Salmonella typhimurium LT2
ugcuuccggcacugcgccuu

SEQ ID NO: 3809876 - RNA, 15 nt, Salmonella typhimurium LT2
ugcuuccugccgcga

SEQ ID NO: 3809877 - RNA, 15 nt, Salmonella typhimurium LT2
ugcuucgauggccuc

SEQ ID NO: 3809878 - RNA, 23 nt, Salmonella typhimurium LT2
ugcuucgccacgaccuacaccgu

SEQ ID NO: 3809879 - RNA, 20 nt, Salmonella typhimurium LT2
ugcuucguggcaaucagcaa

SEQ ID NO: 3809880 - RNA, 12 nt, Salmonella typhimurium LT2
ugcuucucgccu

SEQ ID NO: 3809881 - RNA, 15 nt, Salmonella typhimurium LT2
ugcuugagcaggcag

SEQ ID NO: 3809882 - RNA, 23 nt, Salmonella typhimurium LT2
ugcuugugagggcaaaguuccag

SEQ ID NO: 3809883 - RNA, 14 nt, Salmonella typhimurium LT2
ugcuuuaaaugccu

SEQ ID NO: 3809884 - RNA, 19 nt, Salmonella typhimurium LT2
ugcuuuaaaugccuguuua

SEQ ID NO: 3809885 - RNA, 22 nt, Salmonella typhimurium LT2
ugcuuugaucacccacaccaca

SEQ ID NO: 3809886 - RNA, 16 nt, Salmonella typhimurium LT2
ugcuuuuuauuuuucu

SEQ ID NO: 3809887 - RNA, 20 nt, Salmonella typhimurium LT2
ugcuuuuuauuuuucuggcu

SEQ ID NO: 3809888 - RNA, 15 nt, Salmonella typhimurium LT2
uggaaaaaagcgccc

SEQ ID NO: 3809889 - RNA, 20 nt, Salmonella typhimurium LT2
uggaaaaauuccgcagagcu

SEQ ID NO: 3809890 - RNA, 21 nt, Salmonella typhimurium LT2
uggaaaacagcauaauaaagc

SEQ ID NO: 3809891 - RNA, 22 nt, Salmonella typhimurium LT2
uggaaaacagcauaauaaagca

SEQ ID NO: 3809892 - RNA, 22 nt, Salmonella typhimurium LT2
uggaaaaccccaucccggcaac

SEQ ID NO: 3809893 - RNA, 22 nt, Salmonella typhimurium LT2
uggaaaacuuuaccgucagcca

SEQ ID NO: 3809894 - RNA, 14 nt, Salmonella typhimurium LT2
uggaaaagcgacau

SEQ ID NO: 3809895 - RNA, 14 nt, Salmonella typhimurium LT2
uggaaaaucagcga

SEQ ID NO: 3809896 - RNA, 21 nt, Salmonella typhimurium LT2
uggaaacagccaaucauaaac

SEQ ID NO: 3809897 - RNA, 16 nt, Salmonella typhimurium LT2
uggaaacuaugcaaaa

SEQ ID NO: 3809898 - RNA, 17 nt, Salmonella typhimurium LT2
uggaaacuccagcggca

SEQ ID NO: 3809899 - RNA, 17 nt, Salmonella typhimurium LT2
uggaaagcgccucgcaa

SEQ ID NO: 3809900 - RNA, 23 nt, Salmonella typhimurium LT2
uggaaaggcuuuuuaaucaaaau

SEQ ID NO: 3809901 - RNA, 18 nt, Salmonella typhimurium LT2
uggaaagggaaugcgccg

SEQ ID NO: 3809902 - RNA, 21 nt, Salmonella typhimurium LT2
uggaaauaccgguaaucaagc

SEQ ID NO: 3809903 - RNA, 18 nt, Salmonella typhimurium LT2
uggaaauagaauuauaua

SEQ ID NO: 3809904 - RNA, 18 nt, Salmonella typhimurium LT2
uggaaauguucucagcca

SEQ ID NO: 3809905 - RNA, 19 nt, Salmonella typhimurium LT2
uggaacaggccaaacccug

SEQ ID NO: 3809906 - RNA, 22 nt, Salmonella typhimurium LT2
uggaacaggccaaacccugcgc

SEQ ID NO: 3809907 - RNA, 20 nt, Salmonella typhimurium LT2
uggaacaucucccaggcgau

SEQ ID NO: 3809908 - RNA, 15 nt, Salmonella typhimurium LT2
uggaaccgccggaga

SEQ ID NO: 3809909 - RNA, 17 nt, Salmonella typhimurium LT2
uggaacugaucguggcc

SEQ ID NO: 3809910 - RNA, 19 nt, Salmonella typhimurium LT2
uggaacuuuaucgcacggc

SEQ ID NO: 3809911 - RNA, 14 nt, Salmonella typhimurium LT2
uggaagcuguuaau

SEQ ID NO: 3809912 - RNA, 15 nt, Salmonella typhimurium LT2
uggaaggaaggccgc

SEQ ID NO: 3809913 - RNA, 20 nt, Salmonella typhimurium LT2
uggaaggcuucggucagauc

SEQ ID NO: 3809914 - RNA, 21 nt, Salmonella typhimurium LT2
uggaaggcuucggucagaucc

SEQ ID NO: 3809915 - RNA, 19 nt, Salmonella typhimurium LT2
uggaaguacgccucgcgca

SEQ ID NO: 3809916 - RNA, 23 nt, Salmonella typhimurium LT2
uggaaguagucgcgaaugcgcaa

SEQ ID NO: 3809917 - RNA, 14 nt, Salmonella typhimurium LT2
uggaaguugccgcc

SEQ ID NO: 3809918 - RNA, 18 nt, Salmonella typhimurium LT2
uggaauaaacgguaagag

SEQ ID NO: 3809919 - RNA, 16 nt, Salmonella typhimurium LT2
uggaauacaaacccag

SEQ ID NO: 3809920 - RNA, 16 nt, Salmonella typhimurium LT2
uggaaucauccaccag

SEQ ID NO: 3809921 - RNA, 14 nt, Salmonella typhimurium LT2
uggaaugagcaucu

SEQ ID NO: 3809922 - RNA, 13 nt, Salmonella typhimurium LT2
uggaauucuucau

SEQ ID NO: 3809923 - RNA, 24 nt, Salmonella typhimurium LT2
uggaauuugucgucaugcgccagg

SEQ ID NO: 3809924 - RNA, 15 nt, Salmonella typhimurium LT2
uggacaauccgcgaa

SEQ ID NO: 3809925 - RNA, 19 nt, Salmonella typhimurium LT2
uggaccagaacaucaucuu

SEQ ID NO: 3809926 - RNA, 13 nt, Salmonella typhimurium LT2
uggacggcaucag

SEQ ID NO: 3809927 - RNA, 16 nt, Salmonella typhimurium LT2
uggacggcgucaccac

SEQ ID NO: 3809928 - RNA, 17 nt, Salmonella typhimurium LT2
uggacgggaucucgcac

SEQ ID NO: 3809929 - RNA, 13 nt, Salmonella typhimurium LT2
uggacgucaugcc

SEQ ID NO: 3809930 - RNA, 20 nt, Salmonella typhimurium LT2
uggacgugccuuccaucggc

SEQ ID NO: 3809931 - RNA, 19 nt, Salmonella typhimurium LT2
uggagagcagcgccagcga

SEQ ID NO: 3809932 - RNA, 15 nt, Salmonella typhimurium LT2
uggagaguauuuccu

SEQ ID NO: 3809933 - RNA, 21 nt, Salmonella typhimurium LT2
uggagccaauagguaaaccag

SEQ ID NO: 3809934 - RNA, 24 nt, Salmonella typhimurium LT2
uggagcugcccgucgcuacaggca

SEQ ID NO: 3809935 - RNA, 17 nt, Salmonella typhimurium LT2
uggaggaacagcgccgu

SEQ ID NO: 3809936 - RNA, 16 nt, Salmonella typhimurium LT2
uggaggacgucuguca

SEQ ID NO: 3809937 - RNA, 17 nt, Salmonella typhimurium LT2
uggaguagauguagcug

SEQ ID NO: 3809938 - RNA, 15 nt, Salmonella typhimurium LT2
uggauaaauaggcug

SEQ ID NO: 3809939 - RNA, 13 nt, Salmonella typhimurium LT2
uggauaaccugcc

SEQ ID NO: 3809940 - RNA, 23 nt, Salmonella typhimurium LT2
uggauaacgcggguuagcgccgg

SEQ ID NO: 3809941 - RNA, 15 nt, Salmonella typhimurium LT2
uggauaacggcguua

SEQ ID NO: 3809942 - RNA, 18 nt, Salmonella typhimurium LT2
uggauaaggcgugagcca

SEQ ID NO: 3809943 - RNA, 20 nt, Salmonella typhimurium LT2
uggauacuggucgcgucaau

SEQ ID NO: 3809944 - RNA, 18 nt, Salmonella typhimurium LT2
uggauagaguuaaaaggu

SEQ ID NO: 3809945 - RNA, 15 nt, Salmonella typhimurium LT2
uggauauucauugcc

SEQ ID NO: 3809946 - RNA, 16 nt, Salmonella typhimurium LT2
uggaucaggcgcuugc

SEQ ID NO: 3809947 - RNA, 22 nt, Salmonella typhimurium LT2
uggaucaggcgcuugcgccgcc

SEQ ID NO: 3809948 - RNA, 23 nt, Salmonella typhimurium LT2
uggaucaggcgcuugcgccgcca

SEQ ID NO: 3809949 - RNA, 16 nt, Salmonella typhimurium LT2
uggaucccccuggccc

SEQ ID NO: 3809950 - RNA, 13 nt, Salmonella typhimurium LT2
uggaugaacucaa

SEQ ID NO: 3809951 - RNA, 13 nt, Salmonella typhimurium LT2
uggaugcguucaa

SEQ ID NO: 3809952 - RNA, 14 nt, Salmonella typhimurium LT2
uggauuaaggccgg

SEQ ID NO: 3809953 - RNA, 17 nt, Salmonella typhimurium LT2
uggauuacaaaaauaga

SEQ ID NO: 3809954 - RNA, 20 nt, Salmonella typhimurium LT2
uggauuccuggcuugccaga

SEQ ID NO: 3809955 - RNA, 19 nt, Salmonella typhimurium LT2
uggauugcauccaacuuau

SEQ ID NO: 3809956 - RNA, 19 nt, Salmonella typhimurium LT2
uggauuucacaaucaucgc

SEQ ID NO: 3809957 - RNA, 21 nt, Salmonella typhimurium LT2
uggcaaaaaaggccagacuca

SEQ ID NO: 3809958 - RNA, 18 nt, Salmonella typhimurium LT2
uggcaaaaacaccuaacc

SEQ ID NO: 3809959 - RNA, 16 nt, Salmonella typhimurium LT2
uggcaaaacgcaucca

SEQ ID NO: 3809960 - RNA, 14 nt, Salmonella typhimurium LT2
uggcaaaauccaac

SEQ ID NO: 3809961 - RNA, 13 nt, Salmonella typhimurium LT2
uggcaaacugccg

SEQ ID NO: 3809962 - RNA, 18 nt, Salmonella typhimurium LT2
uggcaaaucccguaccgg

SEQ ID NO: 3809963 - RNA, 18 nt, Salmonella typhimurium LT2
uggcaacaaagccugcug

SEQ ID NO: 3809964 - RNA, 20 nt, Salmonella typhimurium LT2
uggcaacauagcaucguuac

SEQ ID NO: 3809965 - RNA, 22 nt, Salmonella typhimurium LT2
uggcaacauagcaucguuaccg

SEQ ID NO: 3809966 - RNA, 22 nt, Salmonella typhimurium LT2
uggcaacccguaccuccagcga

SEQ ID NO: 3809967 - RNA, 15 nt, Salmonella typhimurium LT2
uggcaaccuuaccgg

SEQ ID NO: 3809968 - RNA, 16 nt, Salmonella typhimurium LT2
uggcaacgucgacccg

SEQ ID NO: 3809969 - RNA, 17 nt, Salmonella typhimurium LT2
uggcaagcgccagcaug

SEQ ID NO: 3809970 - RNA, 17 nt, Salmonella typhimurium LT2
uggcaaggguaugaaua

SEQ ID NO: 3809971 - RNA, 12 nt, Salmonella typhimurium LT2
uggcaaucgacg

SEQ ID NO: 3809972 - RNA, 15 nt, Salmonella typhimurium LT2
uggcacgacuuuucc

SEQ ID NO: 3809973 - RNA, 19 nt, Salmonella typhimurium LT2
uggcacgacuuuuccuucc

SEQ ID NO: 3809974 - RNA, 22 nt, Salmonella typhimurium LT2
uggcacuggcgacggcaucggc

SEQ ID NO: 3809975 - RNA, 16 nt, Salmonella typhimurium LT2
uggcagaauaaaacag

SEQ ID NO: 3809976 - RNA, 16 nt, Salmonella typhimurium LT2
uggcagaguccagcgg

SEQ ID NO: 3809977 - RNA, 11 nt, Salmonella typhimurium LT2
uggcagcgccc

SEQ ID NO: 3809978 - RNA, 22 nt, Salmonella typhimurium LT2
uggcagcgugaacgccuuaucc

SEQ ID NO: 3809979 - RNA, 14 nt, Salmonella typhimurium LT2
uggcgguacagcga

SEQ ID NO: 3809980 - RNA, 23 nt, Salmonella typhimurium LT2
uggcgguauaacugccuuauccg

SEQ ID NO: 3809981 - RNA, 16 nt, Salmonella typhimurium LT2
uggcgguccaaugugg

SEQ ID NO: 3809982 - RNA, 15 nt, Salmonella typhimurium LT2
uggcggugacgucaa

SEQ ID NO: 3809983 - RNA, 20 nt, Salmonella typhimurium LT2
uggcgguucgccacaauaua

SEQ ID NO: 3809984 - RNA, 13 nt, Salmonella typhimurium LT2
uggcguaaauauu

SEQ ID NO: 3809985 - RNA, 17 nt, Salmonella typhimurium LT2
uggcguaaauauucguu

SEQ ID NO: 3809986 - RNA, 20 nt, Salmonella typhimurium LT2
uggcguaauuaaccgcgccg

SEQ ID NO: 3809987 - RNA, 17 nt, Salmonella typhimurium LT2
uggcguacgcagaucgu

SEQ ID NO: 3809988 - RNA, 23 nt, Salmonella typhimurium LT2
uggcguacgcauccgcguuaccc

SEQ ID NO: 3809989 - RNA, 17 nt, Salmonella typhimurium LT2
uggcguagaagcuuacc

SEQ ID NO: 3809990 - RNA, 17 nt, Salmonella typhimurium LT2
uggcguagauauucccc

SEQ ID NO: 3809991 - RNA, 20 nt, Salmonella typhimurium LT2
uggcguauuccauacagaaa

SEQ ID NO: 3809992 - RNA, 15 nt, Salmonella typhimurium LT2
uggcgucaaucaacu

SEQ ID NO: 3809993 - RNA, 12 nt, Salmonella typhimurium LT2
uggcgucaauga

SEQ ID NO: 3809994 - RNA, 13 nt, Salmonella typhimurium LT2
uggcguccggaug

SEQ ID NO: 3809995 - RNA, 15 nt, Salmonella typhimurium LT2
uggcgucuuuuaguc

SEQ ID NO: 3809996 - RNA, 24 nt, Salmonella typhimurium LT2
uggcgugaaaagugccgcucacug

SEQ ID NO: 3809997 - RNA, 18 nt, Salmonella typhimurium LT2
uggcguguggcugucgac

SEQ ID NO: 3809998 - RNA, 20 nt, Salmonella typhimurium LT2
uggcguuaccggcaggcugg

SEQ ID NO: 3809999 - RNA, 20 nt, Salmonella typhimurium LT2
uggcuaccgggcgcaaucau

SEQ ID NO: 3810000 - RNA, 14 nt, Salmonella typhimurium LT2
uggcuaucgccgua

SEQ ID NO: 3810001 - RNA, 20 nt, Salmonella typhimurium LT2
uggcucaagauucaguucca

SEQ ID NO: 3810002 - RNA, 16 nt, Salmonella typhimurium LT2
uggcucaauccaggug

SEQ ID NO: 3810003 - RNA, 17 nt, Salmonella typhimurium LT2
uggcucaauccaggugg

SEQ ID NO: 3810004 - RNA, 15 nt, Salmonella typhimurium LT2
uggcucccgcagcca

SEQ ID NO: 3810005 - RNA, 16 nt, Salmonella typhimurium LT2
uggcucggcgucaucc

SEQ ID NO: 3810006 - RNA, 12 nt, Salmonella typhimurium LT2
uggcucucggca

SEQ ID NO: 3810007 - RNA, 13 nt, Salmonella typhimurium LT2
uggcugagaaaaa

SEQ ID NO: 3810008 - RNA, 12 nt, Salmonella typhimurium LT2
uggcugcgccug

SEQ ID NO: 3810009 - RNA, 13 nt, Salmonella typhimurium LT2
uggcugucuuccg

SEQ ID NO: 3810010 - RNA, 20 nt, Salmonella typhimurium LT2
uggcuuauagcuacguagcg

SEQ ID NO: 3810011 - RNA, 18 nt, Salmonella typhimurium LT2
uggcuuccguccccagcc

SEQ ID NO: 3810012 - RNA, 17 nt, Salmonella typhimurium LT2
uggcuuccuacccucac

SEQ ID NO: 3810013 - RNA, 18 nt, Salmonella typhimurium LT2
uggcuugccagcagauuu

SEQ ID NO: 3810014 - RNA, 13 nt, Salmonella typhimurium LT2
uggcuuuaaacgc

SEQ ID NO: 3810015 - RNA, 17 nt, Salmonella typhimurium LT2
uggcuuuauauaaaaaa

SEQ ID NO: 3810016 - RNA, 14 nt, Salmonella typhimurium LT2
uggcuuucauccaa

SEQ ID NO: 3810017 - RNA, 21 nt, Salmonella typhimurium LT2
uggcuuuccugaucaaucaac

SEQ ID NO: 3810018 - RNA, 20 nt, Salmonella typhimurium LT2
uggcuuucuaccugcaaugu

SEQ ID NO: 3810019 - RNA, 15 nt, Salmonella typhimurium LT2
uggcuuugcaacagg

SEQ ID NO: 3810020 - RNA, 14 nt, Salmonella typhimurium LT2
uggcuuugcgccac

SEQ ID NO: 3810021 - RNA, 18 nt, Salmonella typhimurium LT2
uggcuuuuaagguuaauu

SEQ ID NO: 3810022 - RNA, 18 nt, Salmonella typhimurium LT2
uggcuuuuuccugccauu

SEQ ID NO: 3810023 - RNA, 19 nt, Salmonella typhimurium LT2
ugggaagggcgaagggcca

SEQ ID NO: 3810024 - RNA, 18 nt, Salmonella typhimurium LT2
ugggacauaauugcugcc

SEQ ID NO: 3810025 - RNA, 21 nt, Salmonella typhimurium LT2
ugggaccaccgcgcuagugcc

SEQ ID NO: 3810026 - RNA, 20 nt, Salmonella typhimurium LT2
ugggaucgacucauccagca

SEQ ID NO: 3810027 - RNA, 12 nt, Salmonella typhimurium LT2
ugggcagaaacg

SEQ ID NO: 3810028 - RNA, 22 nt, Salmonella typhimurium LT2
ugggcaggagaugaccugccca

SEQ ID NO: 3810029 - RNA, 14 nt, Salmonella typhimurium LT2
ugggcgcacaagcc

SEQ ID NO: 3810030 - RNA, 17 nt, Salmonella typhimurium LT2
ugggcgcacaagccugc

SEQ ID NO: 3810031 - RNA, 17 nt, Salmonella typhimurium LT2
ugggcgcacagcgccau

SEQ ID NO: 3810032 - RNA, 20 nt, Salmonella typhimurium LT2
ugggcgcgacuuuacugcgu

SEQ ID NO: 3810033 - RNA, 14 nt, Salmonella typhimurium LT2
ugggcuuaaugcgc

SEQ ID NO: 3810034 - RNA, 17 nt, Salmonella typhimurium LT2
ugggcuugcauugcuuu

SEQ ID NO: 3810035 - RNA, 13 nt, Salmonella typhimurium LT2
ugggcuuugcaag

SEQ ID NO: 3810036 - RNA, 19 nt, Salmonella typhimurium LT2
uggggaacagaagcgccga

SEQ ID NO: 3810037 - RNA, 19 nt, Salmonella typhimurium LT2
uggggccgauaccggcaac

SEQ ID NO: 3810038 - RNA, 20 nt, Salmonella typhimurium LT2
uggggccuaaugagccagau

SEQ ID NO: 3810039 - RNA, 14 nt, Salmonella typhimurium LT2
uggggcgcuuugcu

SEQ ID NO: 3810040 - RNA, 17 nt, Salmonella typhimurium LT2
uggggcuaagugagcau

SEQ ID NO: 3810041 - RNA, 19 nt, Salmonella typhimurium LT2
ugggguugcccggcgccau

SEQ ID NO: 3810042 - RNA, 17 nt, Salmonella typhimurium LT2
uggguaaaaucagcgcg

SEQ ID NO: 3810043 - RNA, 16 nt, Salmonella typhimurium LT2
uggguaaauaccaggc

SEQ ID NO: 3810044 - RNA, 12 nt, Salmonella typhimurium LT2
uggguaauuuuu

SEQ ID NO: 3810045 - RNA, 14 nt, Salmonella typhimurium LT2
uggguaguccgggc

SEQ ID NO: 3810046 - RNA, 23 nt, Salmonella typhimurium LT2
uggguauagagcaaucuggcagu

SEQ ID NO: 3810047 - RNA, 21 nt, Salmonella typhimurium LT2
uggguauauuugccgaacgcg

SEQ ID NO: 3810048 - RNA, 20 nt, Salmonella typhimurium LT2
uggguauuuuuuagcgccaa

SEQ ID NO: 3810049 - RNA, 19 nt, Salmonella typhimurium LT2
ugggucacgauaaccaggu

SEQ ID NO: 3810050 - RNA, 13 nt, Salmonella typhimurium LT2
ugggucgcggcau

SEQ ID NO: 3810051 - RNA, 14 nt, Salmonella typhimurium LT2
ugggucugcggcgg

SEQ ID NO: 3810052 - RNA, 16 nt, Salmonella typhimurium LT2
uggguugccauauuuu

SEQ ID NO: 3810053 - RNA, 19 nt, Salmonella typhimurium LT2
uggguuuauguaggguggc

SEQ ID NO: 3810054 - RNA, 14 nt, Salmonella typhimurium LT2
uggguuuccggauc

SEQ ID NO: 3810055 - RNA, 14 nt, Salmonella typhimurium LT2
ugguaaaaaaguga

SEQ ID NO: 3810056 - RNA, 17 nt, Salmonella typhimurium LT2
ugguaaauacgcugcgg

SEQ ID NO: 3810057 - RNA, 15 nt, Salmonella typhimurium LT2
ugguaaucauacgcg

SEQ ID NO: 3810058 - RNA, 19 nt, Salmonella typhimurium LT2
ugguaauccacgccaauaa

SEQ ID NO: 3810059 - RNA, 21 nt, Salmonella typhimurium LT2
ugguaauccacgccaauaauc

SEQ ID NO: 3810060 - RNA, 22 nt, Salmonella typhimurium LT2
ugguaccggauuuagcggcagc

SEQ ID NO: 3810061 - RNA, 14 nt, Salmonella typhimurium LT2
ugguacguccaucc

SEQ ID NO: 3810062 - RNA, 14 nt, Salmonella typhimurium LT2
ugguacucaacauc

SEQ ID NO: 3810063 - RNA, 17 nt, Salmonella typhimurium LT2
ugguacucaacaucauu

SEQ ID NO: 3810064 - RNA, 15 nt, Salmonella typhimurium LT2
ugguacuuuucaucc

SEQ ID NO: 3810065 - RNA, 16 nt, Salmonella typhimurium LT2
ugguacuuuucaucca

SEQ ID NO: 3810066 - RNA, 16 nt, Salmonella typhimurium LT2
ugguagacgcaccaga

SEQ ID NO: 3810067 - RNA, 16 nt, Salmonella typhimurium LT2
ugguagacgcgcuagc

SEQ ID NO: 3810068 - RNA, 22 nt, Salmonella typhimurium LT2
ugguagagaucgacaaaccacu

SEQ ID NO: 3810069 - RNA, 18 nt, Salmonella typhimurium LT2
ugguaggccugauaagcg

SEQ ID NO: 3810070 - RNA, 22 nt, Salmonella typhimurium LT2
ugguaggccugauaagcgcagc

SEQ ID NO: 3810071 - RNA, 16 nt, Salmonella typhimurium LT2
ugguauaggccaggcu

SEQ ID NO: 3810072 - RNA, 17 nt, Salmonella typhimurium LT2
ugguauaggccaggcua

SEQ ID NO: 3810073 - RNA, 15 nt, Salmonella typhimurium LT2
ugguaucgcggcagc

SEQ ID NO: 3810074 - RNA, 15 nt, Salmonella typhimurium LT2
ugguauugcgaaacg

SEQ ID NO: 3810075 - RNA, 23 nt, Salmonella typhimurium LT2
uggucaccaugacgcagugcaau

SEQ ID NO: 3810076 - RNA, 12 nt, Salmonella typhimurium LT2
uggucagcagcc

SEQ ID NO: 3810077 - RNA, 12 nt, Salmonella typhimurium LT2
uggucagcgcaa

SEQ ID NO: 3810078 - RNA, 22 nt, Salmonella typhimurium LT2
uggucagcgccgcgccgucggc

SEQ ID NO: 3810079 - RNA, 19 nt, Salmonella typhimurium LT2
uggucagcguaccagcggu

SEQ ID NO: 3810080 - RNA, 17 nt, Salmonella typhimurium LT2
uggucaucaucaggaac

SEQ ID NO: 3810081 - RNA, 16 nt, Salmonella typhimurium LT2
uggucauccccgucuc

SEQ ID NO: 3810082 - RNA, 14 nt, Salmonella typhimurium LT2
uggucaucgaaggc

SEQ ID NO: 3810083 - RNA, 23 nt, Salmonella typhimurium LT2
uguaucugguggaaaagaaaaca

SEQ ID NO: 3810084 - RNA, 13 nt, Salmonella typhimurium LT2
uguaucuugcuuu

SEQ ID NO: 3810085 - RNA, 14 nt, Salmonella typhimurium LT2
uguaugacaaauaa

SEQ ID NO: 3810086 - RNA, 17 nt, Salmonella typhimurium LT2
uguaugcguuacaggac

SEQ ID NO: 3810087 - RNA, 15 nt, Salmonella typhimurium LT2
uguaugcucauaaga

SEQ ID NO: 3810088 - RNA, 19 nt, Salmonella typhimurium LT2
uguauuaucccggccgcgc

SEQ ID NO: 3810089 - RNA, 17 nt, Salmonella typhimurium LT2
uguauuguaauaacgaa

SEQ ID NO: 3810090 - RNA, 13 nt, Salmonella typhimurium LT2
ugucaaagcauug

SEQ ID NO: 3810091 - RNA, 15 nt, Salmonella typhimurium LT2
ugucaaauucaagcc

SEQ ID NO: 3810092 - RNA, 19 nt, Salmonella typhimurium LT2
ugucaacgaccucaaaaua

SEQ ID NO: 3810093 - RNA, 19 nt, Salmonella typhimurium LT2
ugucaagguggugcucuaa

SEQ ID NO: 3810094 - RNA, 22 nt, Salmonella typhimurium LT2
ugucaagguggugcucuaacca

SEQ ID NO: 3810095 - RNA, 23 nt, Salmonella typhimurium LT2
ugucaagguggugcucuaaccaa

SEQ ID NO: 3810096 - RNA, 11 nt, Salmonella typhimurium LT2
ugucacaaacg

SEQ ID NO: 3810097 - RNA, 11 nt, Salmonella typhimurium LT2
ugucaccagca

SEQ ID NO: 3810098 - RNA, 19 nt, Salmonella typhimurium LT2
ugucacuuaaguaaagauu

SEQ ID NO: 3810099 - RNA, 18 nt, Salmonella typhimurium LT2
ugucagaagaagguaaaa

SEQ ID NO: 3810100 - RNA, 19 nt, Salmonella typhimurium LT2
ugucagaagaagguaaaag

SEQ ID NO: 3810101 - RNA, 14 nt, Salmonella typhimurium LT2
ugucagaauuuccc

SEQ ID NO: 3810102 - RNA, 18 nt, Salmonella typhimurium LT2
ugucagaauuuccccagu

SEQ ID NO: 3810103 - RNA, 19 nt, Salmonella typhimurium LT2
ugucagaauuuccccaguu

SEQ ID NO: 3810104 - RNA, 15 nt, Salmonella typhimurium LT2
ugucagggcggaaca

SEQ ID NO: 3810105 - RNA, 21 nt, Salmonella typhimurium LT2
ugucaguaucgguacgcgcgu

SEQ ID NO: 3810106 - RNA, 15 nt, Salmonella typhimurium LT2
ugucagugcuacagg

SEQ ID NO: 3810107 - RNA, 16 nt, Salmonella typhimurium LT2
ugucaguggacgauaa

SEQ ID NO: 3810108 - RNA, 14 nt, Salmonella typhimurium LT2
ugucauagcaauaa

SEQ ID NO: 3810109 - RNA, 22 nt, Salmonella typhimurium LT2
ugucauagucggcgccaaaguu

SEQ ID NO: 3810110 - RNA, 23 nt, Salmonella typhimurium LT2
ugucauagucggcgccaaaguua

SEQ ID NO: 3810111 - RNA, 19 nt, Salmonella typhimurium LT2
ugucaucaguaugagcgaa

SEQ ID NO: 3810112 - RNA, 18 nt, Salmonella typhimurium LT2
ugucauccuguucaucca

SEQ ID NO: 3810113 - RNA, 17 nt, Salmonella typhimurium LT2
ugucaucgccauccugc

SEQ ID NO: 3810114 - RNA, 15 nt, Salmonella typhimurium LT2
ugucaucgccgcuaa

SEQ ID NO: 3810115 - RNA, 16 nt, Salmonella typhimurium LT2
ugucaugcgccacgac

SEQ ID NO: 3810116 - RNA, 16 nt, Salmonella typhimurium LT2
ugucaugcuaaaacag

SEQ ID NO: 3810117 - RNA, 17 nt, Salmonella typhimurium LT2
ugucaugcuaaaacaga

SEQ ID NO: 3810118 - RNA, 21 nt, Salmonella typhimurium LT2
ugucauggcgccaccagcgau

SEQ ID NO: 3810119 - RNA, 10 nt, Salmonella typhimurium LT2
ugucauggcu

SEQ ID NO: 3810120 - RNA, 19 nt, Salmonella typhimurium LT2
uguccaacguugugcuccg

SEQ ID NO: 3810121 - RNA, 16 nt, Salmonella typhimurium LT2
uguccaggucaucacc

SEQ ID NO: 3810122 - RNA, 13 nt, Salmonella typhimurium LT2
uguccauaaaaug

SEQ ID NO: 3810123 - RNA, 17 nt, Salmonella typhimurium LT2
uguccauguaaacucca

SEQ ID NO: 3810124 - RNA, 23 nt, Salmonella typhimurium LT2
uguccauguuuuauacucaaaaa

SEQ ID NO: 3810125 - RNA, 18 nt, Salmonella typhimurium LT2
uguccauugcgagaaaaa

SEQ ID NO: 3810126 - RNA, 15 nt, Salmonella typhimurium LT2
uguccauuuuccucc

SEQ ID NO: 3810127 - RNA, 17 nt, Salmonella typhimurium LT2
uguccauuuuccuccca

SEQ ID NO: 3810128 - RNA, 20 nt, Salmonella typhimurium LT2
ugucccaucguaacgccguc

SEQ ID NO: 3810129 - RNA, 20 nt, Salmonella typhimurium LT2
uguccgccaauuccugccag

SEQ ID NO: 3810130 - RNA, 20 nt, Salmonella typhimurium LT2
uguccgccuuaucaggccug

SEQ ID NO: 3810131 - RNA, 16 nt, Salmonella typhimurium LT2
uguccggcgacuccag

SEQ ID NO: 3810132 - RNA, 19 nt, Salmonella typhimurium LT2
uguccggcgacuccagaau

SEQ ID NO: 3810133 - RNA, 18 nt, Salmonella typhimurium LT2
uguccggguucgcggcaa

SEQ ID NO: 3810134 - RNA, 16 nt, Salmonella typhimurium LT2
uguccgguguccauca

SEQ ID NO: 3810135 - RNA, 16 nt, Salmonella typhimurium LT2
uguccgucagcgcaug

SEQ ID NO: 3810136 - RNA, 16 nt, Salmonella typhimurium LT2
uguccguuuucucaaa

SEQ ID NO: 3810137 - RNA, 19 nt, Salmonella typhimurium LT2
uguccuguucguaaucacu

SEQ ID NO: 3810138 - RNA, 21 nt, Salmonella typhimurium LT2
ugucgagcaucuccagcgcau

SEQ ID NO: 3810139 - RNA, 15 nt, Salmonella typhimurium LT2
ugucgagguuauaaa

SEQ ID NO: 3810140 - RNA, 18 nt, Salmonella typhimurium LT2
ugucgauaauauccagca

SEQ ID NO: 3810141 - RNA, 16 nt, Salmonella typhimurium LT2
ugucgcaaaccaccgg

SEQ ID NO: 3810142 - RNA, 23 nt, Salmonella typhimurium LT2
ugucgcaaccgacacauucaggc

SEQ ID NO: 3810143 - RNA, 20 nt, Salmonella typhimurium LT2
ugucgccaggccaucgccgc

SEQ ID NO: 3810144 - RNA, 16 nt, Salmonella typhimurium LT2
ugucgcggauaugcag

SEQ ID NO: 3810145 - RNA, 21 nt, Salmonella typhimurium LT2
ugucgcggauaugcagcagcc

SEQ ID NO: 3810146 - RNA, 11 nt, Salmonella typhimurium LT2
ugucgcguaac

SEQ ID NO: 3810147 - RNA, 21 nt, Salmonella typhimurium LT2
ugucgcuacuggcguauuauc

SEQ ID NO: 3810148 - RNA, 18 nt, Salmonella typhimurium LT2
ugucgcuggauagcacca

SEQ ID NO: 3810149 - RNA, 20 nt, Salmonella typhimurium LT2
ugucgcuuauucggccuaca

SEQ ID NO: 3810150 - RNA, 23 nt, Salmonella typhimurium LT2
ugucggacguaugcuuacagagc

SEQ ID NO: 3810151 - RNA, 19 nt, Salmonella typhimurium LT2
ugucgggcaaaaugcgucg

SEQ ID NO: 3810152 - RNA, 12 nt, Salmonella typhimurium LT2
ugucgguaaugu

SEQ ID NO: 3810153 - RNA, 11 nt, Salmonella typhimurium LT2
ugucguaccgg

SEQ ID NO: 3810154 - RNA, 14 nt, Salmonella typhimurium LT2
ugucgugaauaguu

SEQ ID NO: 3810155 - RNA, 22 nt, Salmonella typhimurium LT2
ugucguuaaugcucuuaaaaug

SEQ ID NO: 3810156 - RNA, 22 nt, Salmonella typhimurium LT2
ugucguuccacacguccauccg

SEQ ID NO: 3810157 - RNA, 16 nt, Salmonella typhimurium LT2
ugucuaacuuaccagu

SEQ ID NO: 3810158 - RNA, 14 nt, Salmonella typhimurium LT2
ugucuuagugaaau

SEQ ID NO: 3810159 - RNA, 18 nt, Salmonella typhimurium LT2
ugucuucgcacugcccuu

SEQ ID NO: 3810160 - RNA, 14 nt, Salmonella typhimurium LT2
ugucuucugccagc

SEQ ID NO: 3810161 - RNA, 15 nt, Salmonella typhimurium LT2
ugucuugcuaucaaa

SEQ ID NO: 3810162 - RNA, 14 nt, Salmonella typhimurium LT2
ugucuuuacugaau

SEQ ID NO: 3810163 - RNA, 13 nt, Salmonella typhimurium LT2
ugucuuugaauaa

SEQ ID NO: 3810164 - RNA, 12 nt, Salmonella typhimurium LT2
ugucuuuuucuc

SEQ ID NO: 3810165 - RNA, 17 nt, Salmonella typhimurium LT2
ugugaacagcguuuguu

SEQ ID NO: 3810166 - RNA, 16 nt, Salmonella typhimurium LT2
ugugaauccaggccag

SEQ ID NO: 3810167 - RNA, 14 nt, Salmonella typhimurium LT2
ugugaccccggccu

SEQ ID NO: 3810168 - RNA, 22 nt, Salmonella typhimurium LT2
ugugacguuaacgcagcaucgc

SEQ ID NO: 3810169 - RNA, 12 nt, Salmonella typhimurium LT2
ugugagccauaa

SEQ ID NO: 3810170 - RNA, 23 nt, Salmonella typhimurium LT2
ugugagccauaacaacuauuuuu

SEQ ID NO: 3810171 - RNA, 19 nt, Salmonella typhimurium LT2
ugugaggucgggaacugaa

SEQ ID NO: 3810172 - RNA, 15 nt, Salmonella typhimurium LT2
ugugaguaaagagau

SEQ ID NO: 3810173 - RNA, 11 nt, Salmonella typhimurium LT2
ugugauaaaug

SEQ ID NO: 3810174 - RNA, 14 nt, Salmonella typhimurium LT2
ugugauaaaugcga

SEQ ID NO: 3810175 - RNA, 21 nt, Salmonella typhimurium LT2
ugugauaugacccgggcguga

SEQ ID NO: 3810176 - RNA, 22 nt, Salmonella typhimurium LT2
ugugaucgccgcgaggaaaauc

SEQ ID NO: 3810177 - RNA, 14 nt, Salmonella typhimurium LT2
ugugaugccguuag

SEQ ID NO: 3810178 - RNA, 20 nt, Salmonella typhimurium LT2
ugugcagccaguuagcuuca

SEQ ID NO: 3810179 - RNA, 12 nt, Salmonella typhimurium LT2
ugugcaggagca

SEQ ID NO: 3810180 - RNA, 20 nt, Salmonella typhimurium LT2
ugugccaguaccgccgccgg

SEQ ID NO: 3810181 - RNA, 16 nt, Salmonella typhimurium LT2
ugugccgccggguuua

SEQ ID NO: 3810182 - RNA, 13 nt, Salmonella typhimurium LT2
ugugccgcgacaa

SEQ ID NO: 3810183 - RNA, 23 nt, Salmonella typhimurium LT2
ugugccgcggcuucaucaccauc

SEQ ID NO: 3810184 - RNA, 13 nt, Salmonella typhimurium LT2
ugugccgucaucc

SEQ ID NO: 3810185 - RNA, 16 nt, Salmonella typhimurium LT2
ugugccuguaaauguu

SEQ ID NO: 3810186 - RNA, 20 nt, Salmonella typhimurium LT2
ugugcgccgcguucgcauau

SEQ ID NO: 3810187 - RNA, 10 nt, Salmonella typhimurium LT2
uguuucugcg

SEQ ID NO: 3810188 - RNA, 15 nt, Salmonella typhimurium LT2
uguuucugcuggccu

SEQ ID NO: 3810189 - RNA, 17 nt, Salmonella typhimurium LT2
uguuucuguauuuucua

SEQ ID NO: 3810190 - RNA, 12 nt, Salmonella typhimurium LT2
uguuugaugagg

SEQ ID NO: 3810191 - RNA, 16 nt, Salmonella typhimurium LT2
uguuuuagcaugacaa

SEQ ID NO: 3810192 - RNA, 17 nt, Salmonella typhimurium LT2
uguuuucgagccuugcc

SEQ ID NO: 3810193 - RNA, 12 nt, Salmonella typhimurium LT2
uguuuuucagau

SEQ ID NO: 3810194 - RNA, 12 nt, Salmonella typhimurium LT2
uguuuuucucuu

SEQ ID NO: 3810195 - RNA, 20 nt, Salmonella typhimurium LT2
uuaaaaaaauaugcaauuaa

SEQ ID NO: 3810196 - RNA, 18 nt, Salmonella typhimurium LT2
uuaaaaaaggcagaagaa

SEQ ID NO: 3810197 - RNA, 23 nt, Salmonella typhimurium LT2
uuaaaaaaggcagaagaaucugc

SEQ ID NO: 3810198 - RNA, 13 nt, Salmonella typhimurium LT2
uuaaaaacaucau

SEQ ID NO: 3810199 - RNA, 13 nt, Salmonella typhimurium LT2
uuaaaaagagaaa

SEQ ID NO: 3810200 - RNA, 16 nt, Salmonella typhimurium LT2
uuaaaaagcagccaga

SEQ ID NO: 3810201 - RNA, 14 nt, Salmonella typhimurium LT2
uuaaaaagcugcau

SEQ ID NO: 3810202 - RNA, 11 nt, Salmonella typhimurium LT2
uuaaaaccauu

SEQ ID NO: 3810203 - RNA, 13 nt, Salmonella typhimurium LT2
uuaaaacgcacgc

SEQ ID NO: 3810204 - RNA, 19 nt, Salmonella typhimurium LT2
uuaaaacggaucagccuga

SEQ ID NO: 3810205 - RNA, 17 nt, Salmonella typhimurium LT2
uuaaaauaaaucggcau

SEQ ID NO: 3810206 - RNA, 22 nt, Salmonella typhimurium LT2
uuaaaaucggggucuuccagca

SEQ ID NO: 3810207 - RNA, 11 nt, Salmonella typhimurium LT2
uuaaaaugacc

SEQ ID NO: 3810208 - RNA, 21 nt, Salmonella typhimurium LT2
uuaaaaugcggggacuggaug

SEQ ID NO: 3810209 - RNA, 23 nt, Salmonella typhimurium LT2
uuaaaauucagacugcgcauuaa

SEQ ID NO: 3810210 - RNA, 12 nt, Salmonella typhimurium LT2
uuaaacauauaa

SEQ ID NO: 3810211 - RNA, 23 nt, Salmonella typhimurium LT2
uuaaaccacuuaacguuaccuuu

SEQ ID NO: 3810212 - RNA, 14 nt, Salmonella typhimurium LT2
uuaaacguuauuca

SEQ ID NO: 3810213 - RNA, 18 nt, Salmonella typhimurium LT2
uuaaacucugaaaacggu

SEQ ID NO: 3810214 - RNA, 19 nt, Salmonella typhimurium LT2
uuaaagccaauccagaaua

SEQ ID NO: 3810215 - RNA, 13 nt, Salmonella typhimurium LT2
uuaaagccuucau

SEQ ID NO: 3810216 - RNA, 22 nt, Salmonella typhimurium LT2
uuaaagcgcucaagcggcacca

SEQ ID NO: 3810217 - RNA, 19 nt, Salmonella typhimurium LT2
uuaaaguacuucacaauca

SEQ ID NO: 3810218 - RNA, 12 nt, Salmonella typhimurium LT2
uuaaauauuaag

SEQ ID NO: 3810219 - RNA, 13 nt, Salmonella typhimurium LT2
uuaaaugcgccca

SEQ ID NO: 3810220 - RNA, 22 nt, Salmonella typhimurium LT2
uuaaauucccagcguacaucuu

SEQ ID NO: 3810221 - RNA, 17 nt, Salmonella typhimurium LT2
uuaaauugguuauauua

SEQ ID NO: 3810222 - RNA, 21 nt, Salmonella typhimurium LT2
uuaacaaacgccaggcgcugc

SEQ ID NO: 3810223 - RNA, 15 nt, Salmonella typhimurium LT2
uuaacaacuccagca

SEQ ID NO: 3810224 - RNA, 17 nt, Salmonella typhimurium LT2
uuaacaccggcaaauag

SEQ ID NO: 3810225 - RNA, 12 nt, Salmonella typhimurium LT2
uuaacagaauug

SEQ ID NO: 3810226 - RNA, 18 nt, Salmonella typhimurium LT2
uuaacagauaguuaauaa

SEQ ID NO: 3810227 - RNA, 19 nt, Salmonella typhimurium LT2
uuaacagauggcgcuucgu

SEQ ID NO: 3810228 - RNA, 19 nt, Salmonella typhimurium LT2
uuaacagcgcgaccaggaa

SEQ ID NO: 3810229 - RNA, 13 nt, Salmonella typhimurium LT2
uuaacauaugggc

SEQ ID NO: 3810230 - RNA, 15 nt, Salmonella typhimurium LT2
uuaacaucagaaaaa

SEQ ID NO: 3810231 - RNA, 16 nt, Salmonella typhimurium LT2
uuaacaucagaaaaaa

SEQ ID NO: 3810232 - RNA, 20 nt, Salmonella typhimurium LT2
uuaacauguuuuguauuaau

SEQ ID NO: 3810233 - RNA, 16 nt, Salmonella typhimurium LT2
uuaaccguucuuccug

SEQ ID NO: 3810234 - RNA, 19 nt, Salmonella typhimurium LT2
uuaaccugagaauauuaac

SEQ ID NO: 3810235 - RNA, 19 nt, Salmonella typhimurium LT2
uuaacgccgugcucaucca

SEQ ID NO: 3810236 - RNA, 21 nt, Salmonella typhimurium LT2
uuaacgcuuccggaucgcggc

SEQ ID NO: 3810237 - RNA, 17 nt, Salmonella typhimurium LT2
uuaacgcuuucgccagc

SEQ ID NO: 3810238 - RNA, 13 nt, Salmonella typhimurium LT2
uuaacggcaacag

SEQ ID NO: 3810239 - RNA, 20 nt, Salmonella typhimurium LT2
uuaacguuuccccgcuauug

SEQ ID NO: 3810240 - RNA, 14 nt, Salmonella typhimurium LT2
uuaacguuuguaga

SEQ ID NO: 3810241 - RNA, 22 nt, Salmonella typhimurium LT2
uuaacuccuucuaauuccagga

SEQ ID NO: 3810242 - RNA, 22 nt, Salmonella typhimurium LT2
uuaacuggcgacgacuucaccc

SEQ ID NO: 3810243 - RNA, 15 nt, Salmonella typhimurium LT2
uuaacuuaaauaaaa

SEQ ID NO: 3810244 - RNA, 21 nt, Salmonella typhimurium LT2
uuaagaacgguuggaauaauu

SEQ ID NO: 3810245 - RNA, 17 nt, Salmonella typhimurium LT2
uuaagacuuuuuaauuc

SEQ ID NO: 3810246 - RNA, 23 nt, Salmonella typhimurium LT2
uuaagauccugacucaccagcac

SEQ ID NO: 3810247 - RNA, 22 nt, Salmonella typhimurium LT2
uuaagaucgcaggccaaaaaaa

SEQ ID NO: 3810248 - RNA, 20 nt, Salmonella typhimurium LT2
uuaagcaacugcuaguggau

SEQ ID NO: 3810249 - RNA, 15 nt, Salmonella typhimurium LT2
uuaagcccaaccgcg

SEQ ID NO: 3810250 - RNA, 19 nt, Salmonella typhimurium LT2
uuaagccgggucagccccc

SEQ ID NO: 3810251 - RNA, 22 nt, Salmonella typhimurium LT2
uuaagcggauuuuuucgcuuuu

SEQ ID NO: 3810252 - RNA, 19 nt, Salmonella typhimurium LT2
uuaaggacauucagcacgc

SEQ ID NO: 3810253 - RNA, 20 nt, Salmonella typhimurium LT2
uuaaggccggcauuuuauuc

SEQ ID NO: 3810254 - RNA, 21 nt, Salmonella typhimurium LT2
uuaaggccggcauuuuauuca

SEQ ID NO: 3810255 - RNA, 20 nt, Salmonella typhimurium LT2
uuaauaauaaauuuucauua

SEQ ID NO: 3810256 - RNA, 15 nt, Salmonella typhimurium LT2
uuaauacaucagaaa

SEQ ID NO: 3810257 - RNA, 22 nt, Salmonella typhimurium LT2
uuaauacaucagaaaacagcau

SEQ ID NO: 3810258 - RNA, 21 nt, Salmonella typhimurium LT2
uuaauaccagcgccaaucacu

SEQ ID NO: 3810259 - RNA, 17 nt, Salmonella typhimurium LT2
uuaauaugcgcaaucac

SEQ ID NO: 3810260 - RNA, 14 nt, Salmonella typhimurium LT2
uuaauauuuuauca

SEQ ID NO: 3810261 - RNA, 15 nt, Salmonella typhimurium LT2
uuaauauuuuaucac

SEQ ID NO: 3810262 - RNA, 21 nt, Salmonella typhimurium LT2
uuaaucacaaugucaucaaga

SEQ ID NO: 3810263 - RNA, 13 nt, Salmonella typhimurium LT2
uuaaucacccgcg

SEQ ID NO: 3810264 - RNA, 15 nt, Salmonella typhimurium LT2
uuaaucagcgcuguc

SEQ ID NO: 3810265 - RNA, 13 nt, Salmonella typhimurium LT2
uuaaucauaaaac

SEQ ID NO: 3810266 - RNA, 11 nt, Salmonella typhimurium LT2
uuaauccagga

SEQ ID NO: 3810267 - RNA, 22 nt, Salmonella typhimurium LT2
uuaaucccuugcuggcgacggc

SEQ ID NO: 3810268 - RNA, 16 nt, Salmonella typhimurium LT2
uuaaucgagccuuuca

SEQ ID NO: 3810269 - RNA, 22 nt, Salmonella typhimurium LT2
uuaaucgcuucaaucagcgugg

SEQ ID NO: 3810270 - RNA, 22 nt, Salmonella typhimurium LT2
uuaaucucacaaauaucacaaa

SEQ ID NO: 3810271 - RNA, 15 nt, Salmonella typhimurium LT2
uuaaugaccugccgc

SEQ ID NO: 3810272 - RNA, 19 nt, Salmonella typhimurium LT2
uuaaugacuuuuuauauaa

SEQ ID NO: 3810273 - RNA, 23 nt, Salmonella typhimurium LT2
uuaaugcauggcagauaaaccac

SEQ ID NO: 3810274 - RNA, 19 nt, Salmonella typhimurium LT2
uuaaugccgcaaugucccu

SEQ ID NO: 3810275 - RNA, 19 nt, Salmonella typhimurium LT2
uuaaugccguuauacaucg

SEQ ID NO: 3810276 - RNA, 19 nt, Salmonella typhimurium LT2
uuaaugccuucgccgccgc

SEQ ID NO: 3810277 - RNA, 19 nt, Salmonella typhimurium LT2
uuaaugcgccccugcaggc

SEQ ID NO: 3810278 - RNA, 23 nt, Salmonella typhimurium LT2
uuaaugcgccccugcaggcgauc

SEQ ID NO: 3810279 - RNA, 18 nt, Salmonella typhimurium LT2
uuaauggcagaauaaaac

SEQ ID NO: 3810280 - RNA, 22 nt, Salmonella typhimurium LT2
uuaauggcgcuuuacaugccgc

SEQ ID NO: 3810281 - RNA, 14 nt, Salmonella typhimurium LT2
uuaauggcuuucac

SEQ ID NO: 3810282 - RNA, 15 nt, Salmonella typhimurium LT2
uuaauggucagaucu

SEQ ID NO: 3810283 - RNA, 22 nt, Salmonella typhimurium LT2
uuaauggucagaucugcgccca

SEQ ID NO: 3810284 - RNA, 19 nt, Salmonella typhimurium LT2
uuaauggucucgccgauag

SEQ ID NO: 3810285 - RNA, 23 nt, Salmonella typhimurium LT2
uuaauggucuuaaaugccgccgg

SEQ ID NO: 3810286 - RNA, 13 nt, Salmonella typhimurium LT2
uuaauguauuauu

SEQ ID NO: 3810287 - RNA, 14 nt, Salmonella typhimurium LT2
uuaauguccagcag

SEQ ID NO: 3810288 - RNA, 20 nt, Salmonella typhimurium LT2
uuaauguuaggaguaaauaa

SEQ ID NO: 3810289 - RNA, 19 nt, Salmonella typhimurium LT2
uuaauuaaauguuugcuuu

SEQ ID NO: 3810290 - RNA, 14 nt, Salmonella typhimurium LT2
uuaauuauacuguc

SEQ ID NO: 3810291 - RNA, 23 nt, Salmonella typhimurium LT2
uuaauuauuaauccaaugacagu

SEQ ID NO: 3810292 - RNA, 21 nt, Salmonella typhimurium LT2
uuaauuccgcaucauucaucu

SEQ ID NO: 3810293 - RNA, 21 nt, Salmonella typhimurium LT2
uuaauuccucagaauccguca

SEQ ID NO: 3810294 - RNA, 20 nt, Salmonella typhimurium LT2
uuaauuccuggcguaugcuu

SEQ ID NO: 3810295 - RNA, 12 nt, Salmonella typhimurium LT2
uuaauucgucag

SEQ ID NO: 3810296 - RNA, 17 nt, Salmonella typhimurium LT2
uuaauucgucagcggcu

SEQ ID NO: 3810297 - RNA, 21 nt, Salmonella typhimurium LT2
uuaauucguccccagcgaucc

SEQ ID NO: 3810298 - RNA, 20 nt, Salmonella typhimurium LT2
uuaauugccugacgaaaacc

SEQ ID NO: 3810299 - RNA, 19 nt, Salmonella typhimurium LT2
uuaauuguaccgauuguuu

SEQ ID NO: 3810300 - RNA, 15 nt, Salmonella typhimurium LT2
uuaauuuaauaauaa

SEQ ID NO: 3810301 - RNA, 18 nt, Salmonella typhimurium LT2
uuaauuucccgcugguug

SEQ ID NO: 3810302 - RNA, 15 nt, Salmonella typhimurium LT2
uuaauuucuuuccaa

SEQ ID NO: 3810303 - RNA, 18 nt, Salmonella typhimurium LT2
uuaauuugcaucaggcca

SEQ ID NO: 3810304 - RNA, 16 nt, Salmonella typhimurium LT2
uuacaauguacagaau

SEQ ID NO: 3810305 - RNA, 16 nt, Salmonella typhimurium LT2
uuacacaauaucaaua

SEQ ID NO: 3810306 - RNA, 15 nt, Salmonella typhimurium LT2
uuacacagacugcuu

SEQ ID NO: 3810307 - RNA, 22 nt, Salmonella typhimurium LT2
uuacaccucgccacauucaauu

SEQ ID NO: 3810308 - RNA, 16 nt, Salmonella typhimurium LT2
uuacacgaucauuuca

SEQ ID NO: 3810309 - RNA, 19 nt, Salmonella typhimurium LT2
uuacacugauaccccagcg

SEQ ID NO: 3810310 - RNA, 16 nt, Salmonella typhimurium LT2
uuacacugauacggcg

SEQ ID NO: 3810311 - RNA, 19 nt, Salmonella typhimurium LT2
uuacagcauacgccgcugg

SEQ ID NO: 3810312 - RNA, 14 nt, Salmonella typhimurium LT2
uuacagcucauaaa

SEQ ID NO: 3810313 - RNA, 19 nt, Salmonella typhimurium LT2
uuacagcucauaaacgcga

SEQ ID NO: 3810314 - RNA, 22 nt, Salmonella typhimurium LT2
uuacaggcauccgugaccugcu

SEQ ID NO: 3810315 - RNA, 19 nt, Salmonella typhimurium LT2
uuacaggcaucuuccagcg

SEQ ID NO: 3810316 - RNA, 16 nt, Salmonella typhimurium LT2
uuacaggcuccaggua

SEQ ID NO: 3810317 - RNA, 23 nt, Salmonella typhimurium LT2
uuacaucaaaugaacacaaaaaa

SEQ ID NO: 3810318 - RNA, 15 nt, Salmonella typhimurium LT2
uuacaucaauaaaca

SEQ ID NO: 3810319 - RNA, 13 nt, Salmonella typhimurium LT2
uuacaucagauaa

SEQ ID NO: 3810320 - RNA, 15 nt, Salmonella typhimurium LT2
uuacaugacccagcg

SEQ ID NO: 3810321 - RNA, 20 nt, Salmonella typhimurium LT2
uuacauuucaggcaaaaaaa

SEQ ID NO: 3810322 - RNA, 12 nt, Salmonella typhimurium LT2
uuaccaaaagca

SEQ ID NO: 3810323 - RNA, 21 nt, Salmonella typhimurium LT2
uuaccaauauuaauguauuau

SEQ ID NO: 3810324 - RNA, 13 nt, Salmonella typhimurium LT2
uuaccaaucgcgg

SEQ ID NO: 3810325 - RNA, 19 nt, Salmonella typhimurium LT2
uuaccagcaauaacaggca

SEQ ID NO: 3810326 - RNA, 15 nt, Salmonella typhimurium LT2
uuaccagcaucaaua

SEQ ID NO: 3810327 - RNA, 22 nt, Salmonella typhimurium LT2
uuaccaucaggugaguaaauaa

SEQ ID NO: 3810328 - RNA, 23 nt, Salmonella typhimurium LT2
uuaccaucaggugaguaaauaaa

SEQ ID NO: 3810329 - RNA, 13 nt, Salmonella typhimurium LT2
uuacccagccuga

SEQ ID NO: 3810330 - RNA, 17 nt, Salmonella typhimurium LT2
uuacccauaaaaaagcc

SEQ ID NO: 3810331 - RNA, 12 nt, Salmonella typhimurium LT2
uuacccccuucg

SEQ ID NO: 3810332 - RNA, 13 nt, Salmonella typhimurium LT2
uuacccccuucgu

SEQ ID NO: 3810333 - RNA, 19 nt, Salmonella typhimurium LT2
uuacccggccuacacauca

SEQ ID NO: 3810334 - RNA, 20 nt, Salmonella typhimurium LT2
uuacccggcguauugguaca

SEQ ID NO: 3810335 - RNA, 18 nt, Salmonella typhimurium LT2
uuacccgggccaucuuuu

SEQ ID NO: 3810336 - RNA, 18 nt, Salmonella typhimurium LT2
uuaccgaccuguaccgcg

SEQ ID NO: 3810337 - RNA, 17 nt, Salmonella typhimurium LT2
uuaccgcaggucggaca

SEQ ID NO: 3810338 - RNA, 15 nt, Salmonella typhimurium LT2
uuaccgccagcggcg

SEQ ID NO: 3810339 - RNA, 19 nt, Salmonella typhimurium LT2
uuaccgcccuguccuccau

SEQ ID NO: 3810340 - RNA, 12 nt, Salmonella typhimurium LT2
uuaccgccgccg

SEQ ID NO: 3810341 - RNA, 16 nt, Salmonella typhimurium LT2
uuaccgcgcucaaaug

SEQ ID NO: 3810342 - RNA, 14 nt, Salmonella typhimurium LT2
uuaccggcaauagu

SEQ ID NO: 3810343 - RNA, 21 nt, Salmonella typhimurium LT2
uuaccggcaauagucuccaug

SEQ ID NO: 3810344 - RNA, 16 nt, Salmonella typhimurium LT2
uuaccguugcaucaug

SEQ ID NO: 3810345 - RNA, 19 nt, Salmonella typhimurium LT2
uuaccuacgcgauaaaaaa

SEQ ID NO: 3810346 - RNA, 22 nt, Salmonella typhimurium LT2
uuaccugcgcaaucaugacaga

SEQ ID NO: 3810347 - RNA, 16 nt, Salmonella typhimurium LT2
uuaccuuguucuucca

SEQ ID NO: 3810348 - RNA, 17 nt, Salmonella typhimurium LT2
uuaccuuguucuuccau

SEQ ID NO: 3810349 - RNA, 13 nt, Salmonella typhimurium LT2
uuacgaaaagguc

SEQ ID NO: 3810350 - RNA, 22 nt, Salmonella typhimurium LT2
uuacgaccgcagaaacagauag

SEQ ID NO: 3810351 - RNA, 20 nt, Salmonella typhimurium LT2
uuacgagugcguucuuccac

SEQ ID NO: 3810352 - RNA, 17 nt, Salmonella typhimurium LT2
uuacgaguggcgaucag

SEQ ID NO: 3810353 - RNA, 18 nt, Salmonella typhimurium LT2
uuacgauacguuugaaau

SEQ ID NO: 3810354 - RNA, 15 nt, Salmonella typhimurium LT2
uuacgauauuuuucu

SEQ ID NO: 3810355 - RNA, 19 nt, Salmonella typhimurium LT2
uuacgaucguuugcccauu

SEQ ID NO: 3810356 - RNA, 18 nt, Salmonella typhimurium LT2
uuacgcagcaagaacaga

SEQ ID NO: 3810357 - RNA, 13 nt, Salmonella typhimurium LT2
uuacgccacguuc

SEQ ID NO: 3810358 - RNA, 20 nt, Salmonella typhimurium LT2
uuacgcccgguaaacgcuuu

SEQ ID NO: 3810359 - RNA, 23 nt, Salmonella typhimurium LT2
uuacgcccuucgcccaucgccgc

SEQ ID NO: 3810360 - RNA, 11 nt, Salmonella typhimurium LT2
uuacgccgcca

SEQ ID NO: 3810361 - RNA, 12 nt, Salmonella typhimurium LT2
uuacgccgccau

SEQ ID NO: 3810362 - RNA, 19 nt, Salmonella typhimurium LT2
uuacgcggucuuuuaaaag

SEQ ID NO: 3810363 - RNA, 20 nt, Salmonella typhimurium LT2
uuacgcggucuuuuaaaaga

SEQ ID NO: 3810364 - RNA, 11 nt, Salmonella typhimurium LT2
uuacgcugccg

SEQ ID NO: 3810365 - RNA, 19 nt, Salmonella typhimurium LT2
uuacgcugguuugugugca

SEQ ID NO: 3810366 - RNA, 23 nt, Salmonella typhimurium LT2
uuacgcuuaauggcgucaaucaa

SEQ ID NO: 3810367 - RNA, 15 nt, Salmonella typhimurium LT2
uuacggaaaaaauac

SEQ ID NO: 3810368 - RNA, 16 nt, Salmonella typhimurium LT2
uuacggacagaaaaaa

SEQ ID NO: 3810369 - RNA, 19 nt, Salmonella typhimurium LT2
uuacggacgauacaccuuc

SEQ ID NO: 3810370 - RNA, 16 nt, Salmonella typhimurium LT2
uuacggacgugggggu

SEQ ID NO: 3810371 - RNA, 23 nt, Salmonella typhimurium LT2
uuacggcgcgccaccaucgucgc

SEQ ID NO: 3810372 - RNA, 16 nt, Salmonella typhimurium LT2
uuacgguuggccagca

SEQ ID NO: 3810373 - RNA, 13 nt, Salmonella typhimurium LT2
uuacguaguccgg

SEQ ID NO: 3810374 - RNA, 15 nt, Salmonella typhimurium LT2
uuacgucagcaauac

SEQ ID NO: 3810375 - RNA, 19 nt, Salmonella typhimurium LT2
uuacguuaaguucaaggau

SEQ ID NO: 3810376 - RNA, 17 nt, Salmonella typhimurium LT2
uuacuaccaucaauacu

SEQ ID NO: 3810377 - RNA, 14 nt, Salmonella typhimurium LT2
uuacuaucccauuu

SEQ ID NO: 3810378 - RNA, 21 nt, Salmonella typhimurium LT2
uuacucccuggugacgcgcau

SEQ ID NO: 3810379 - RNA, 17 nt, Salmonella typhimurium LT2
uuacuccgcuauaaaaa

SEQ ID NO: 3810380 - RNA, 15 nt, Salmonella typhimurium LT2
uuacucucauguuca

SEQ ID NO: 3810381 - RNA, 12 nt, Salmonella typhimurium LT2
uuacucuuccac

SEQ ID NO: 3810382 - RNA, 14 nt, Salmonella typhimurium LT2
uuacucuuccacca

SEQ ID NO: 3810383 - RNA, 18 nt, Salmonella typhimurium LT2
uuacugcucguagcguuu

SEQ ID NO: 3810384 - RNA, 20 nt, Salmonella typhimurium LT2
uuacuggcuaguauauuaaa

SEQ ID NO: 3810385 - RNA, 23 nt, Salmonella typhimurium LT2
uuacuguagcgccgcuuccaggc

SEQ ID NO: 3810386 - RNA, 18 nt, Salmonella typhimurium LT2
uuacugugccgccggugu

SEQ ID NO: 3810387 - RNA, 13 nt, Salmonella typhimurium LT2
uuacuugucggaa

SEQ ID NO: 3810388 - RNA, 18 nt, Salmonella typhimurium LT2
uuagauauaguuuuucaa

SEQ ID NO: 3810389 - RNA, 14 nt, Salmonella typhimurium LT2
uuagauuaaucacu

SEQ ID NO: 3810390 - RNA, 21 nt, Salmonella typhimurium LT2
uuagcaacacagacuuugcac

SEQ ID NO: 3810391 - RNA, 22 nt, Salmonella typhimurium LT2
uuagcagaauggcgaucaccgc

SEQ ID NO: 3810392 - RNA, 10 nt, Salmonella typhimurium LT2
uuagcagcaa

SEQ ID NO: 3810393 - RNA, 13 nt, Salmonella typhimurium LT2
uuagcagcaauaa

SEQ ID NO: 3810394 - RNA, 19 nt, Salmonella typhimurium LT2
uuagcagccacacacuguu

SEQ ID NO: 3810395 - RNA, 12 nt, Salmonella typhimurium LT2
uuauuaccaaug

SEQ ID NO: 3810396 - RNA, 19 nt, Salmonella typhimurium LT2
uuauuccauucaucgauuu

SEQ ID NO: 3810397 - RNA, 15 nt, Salmonella typhimurium LT2
uuauuccgaauacgg

SEQ ID NO: 3810398 - RNA, 21 nt, Salmonella typhimurium LT2
uuauuccuuuuuaggcuauaa

SEQ ID NO: 3810399 - RNA, 22 nt, Salmonella typhimurium LT2
uuauucgcauguugacugcgcu

SEQ ID NO: 3810400 - RNA, 19 nt, Salmonella typhimurium LT2
uuauucggaaugaugugcu

SEQ ID NO: 3810401 - RNA, 17 nt, Salmonella typhimurium LT2
uuauucgguuuaucccc

SEQ ID NO: 3810402 - RNA, 13 nt, Salmonella typhimurium LT2
uuauucucgcacu

SEQ ID NO: 3810403 - RNA, 18 nt, Salmonella typhimurium LT2
uuauugaccaucgccagc

SEQ ID NO: 3810404 - RNA, 15 nt, Salmonella typhimurium LT2
uuauugagauaauuu

SEQ ID NO: 3810405 - RNA, 21 nt, Salmonella typhimurium LT2
uuauugccaucggacauauuu

SEQ ID NO: 3810406 - RNA, 22 nt, Salmonella typhimurium LT2
uuauugcuguaggcacuuucca

SEQ ID NO: 3810407 - RNA, 17 nt, Salmonella typhimurium LT2
uuauuuaauaaccaauu

SEQ ID NO: 3810408 - RNA, 15 nt, Salmonella typhimurium LT2
uuauuuaauacauca

SEQ ID NO: 3810409 - RNA, 12 nt, Salmonella typhimurium LT2
uuauuucacuuc

SEQ ID NO: 3810410 - RNA, 24 nt, Salmonella typhimurium LT2
uuauuuccaauguaaauuaauuca

SEQ ID NO: 3810411 - RNA, 14 nt, Salmonella typhimurium LT2
uuauuucugcccca

SEQ ID NO: 3810412 - RNA, 11 nt, Salmonella typhimurium LT2
uuauuuuaaau

SEQ ID NO: 3810413 - RNA, 16 nt, Salmonella typhimurium LT2
uuauuuuacgagaacc

SEQ ID NO: 3810414 - RNA, 21 nt, Salmonella typhimurium LT2
uuauuuuagugaaaaaauauc

SEQ ID NO: 3810415 - RNA, 13 nt, Salmonella typhimurium LT2
uuauuuucauacu

SEQ ID NO: 3810416 - RNA, 17 nt, Salmonella typhimurium LT2
uuauuuuucuggcuucu

SEQ ID NO: 3810417 - RNA, 18 nt, Salmonella typhimurium LT2
uuauuuuuucuuuaauua

SEQ ID NO: 3810418 - RNA, 12 nt, Salmonella typhimurium LT2
uucaaaaaagag

SEQ ID NO: 3810419 - RNA, 15 nt, Salmonella typhimurium LT2
uucaaaagagagcug

SEQ ID NO: 3810420 - RNA, 23 nt, Salmonella typhimurium LT2
uucaaaagccuguuuaccaagca

SEQ ID NO: 3810421 - RNA, 13 nt, Salmonella typhimurium LT2
uucaaaaucaaac

SEQ ID NO: 3810422 - RNA, 14 nt, Salmonella typhimurium LT2
uucaaaaucaaaca

SEQ ID NO: 3810423 - RNA, 12 nt, Salmonella typhimurium LT2
uucaaaaugaca

SEQ ID NO: 3810424 - RNA, 17 nt, Salmonella typhimurium LT2
uucaaacggcuggaauc

SEQ ID NO: 3810425 - RNA, 23 nt, Salmonella typhimurium LT2
uucaaagccgccauccggccugu

SEQ ID NO: 3810426 - RNA, 13 nt, Salmonella typhimurium LT2
uucaaauccagcu

SEQ ID NO: 3810427 - RNA, 14 nt, Salmonella typhimurium LT2
uucaaauccagcug

SEQ ID NO: 3810428 - RNA, 20 nt, Salmonella typhimurium LT2
uucaaaugauuuuuauaaaa

SEQ ID NO: 3810429 - RNA, 19 nt, Salmonella typhimurium LT2
uucaaauguuguuugaaaa

SEQ ID NO: 3810430 - RNA, 16 nt, Salmonella typhimurium LT2
uucaacagcucgccau

SEQ ID NO: 3810431 - RNA, 23 nt, Salmonella typhimurium LT2
uucaacaucagcgcuaccagcgc

SEQ ID NO: 3810432 - RNA, 23 nt, Salmonella typhimurium LT2
uucaaccagccgaucagcgccau

SEQ ID NO: 3810433 - RNA, 17 nt, Salmonella typhimurium LT2
uucaacccgaucgccau

SEQ ID NO: 3810434 - RNA, 23 nt, Salmonella typhimurium LT2
uucaaccgagccaaacucaucua

SEQ ID NO: 3810435 - RNA, 15 nt, Salmonella typhimurium LT2
uucaaccguuucuuu

SEQ ID NO: 3810436 - RNA, 20 nt, Salmonella typhimurium LT2
uucaaccugagauggcacaa

SEQ ID NO: 3810437 - RNA, 15 nt, Salmonella typhimurium LT2
uucaaccugauauug

SEQ ID NO: 3810438 - RNA, 20 nt, Salmonella typhimurium LT2
uucaacgaaugccugcauau

SEQ ID NO: 3810439 - RNA, 21 nt, Salmonella typhimurium LT2
uucaacguuuuauuacgcuuc

SEQ ID NO: 3810440 - RNA, 18 nt, Salmonella typhimurium LT2
uucaagaaucgaugguau

SEQ ID NO: 3810441 - RNA, 17 nt, Salmonella typhimurium LT2
uucaagcaguuccagca

SEQ ID NO: 3810442 - RNA, 23 nt, Salmonella typhimurium LT2
uucaaggcucaauacgcauaaug

SEQ ID NO: 3810443 - RNA, 20 nt, Salmonella typhimurium LT2
uucaauaagcgguaauaauu

SEQ ID NO: 3810444 - RNA, 20 nt, Salmonella typhimurium LT2
uucaauaauauugucauaau

SEQ ID NO: 3810445 - RNA, 24 nt, Salmonella typhimurium LT2
uucaauaauauugucauaaugucc

SEQ ID NO: 3810446 - RNA, 21 nt, Salmonella typhimurium LT2
uucaauaauggcgcgaaaaca

SEQ ID NO: 3810447 - RNA, 15 nt, Salmonella typhimurium LT2
uucaauacgaaaacc

SEQ ID NO: 3810448 - RNA, 22 nt, Salmonella typhimurium LT2
uucaauaucauuguucuguccg

SEQ ID NO: 3810449 - RNA, 20 nt, Salmonella typhimurium LT2
uucaauauugaacauuuuuu

SEQ ID NO: 3810450 - RNA, 13 nt, Salmonella typhimurium LT2
uucaaucaucaua

SEQ ID NO: 3810451 - RNA, 17 nt, Salmonella typhimurium LT2
uucaaucaucauauccc

SEQ ID NO: 3810452 - RNA, 18 nt, Salmonella typhimurium LT2
uucaaucgcacccgccau

SEQ ID NO: 3810453 - RNA, 15 nt, Salmonella typhimurium LT2
uucaaugauccacgg

SEQ ID NO: 3810454 - RNA, 18 nt, Salmonella typhimurium LT2
uucaaugcauacugccgg

SEQ ID NO: 3810455 - RNA, 14 nt, Salmonella typhimurium LT2
uucaaugcccaggc

SEQ ID NO: 3810456 - RNA, 19 nt, Salmonella typhimurium LT2
uucaauuagcgccuccccu

SEQ ID NO: 3810457 - RNA, 20 nt, Salmonella typhimurium LT2
uucaauuugugagacaaaaa

SEQ ID NO: 3810458 - RNA, 15 nt, Salmonella typhimurium LT2
uucaauuuucgcuuu

SEQ ID NO: 3810459 - RNA, 15 nt, Salmonella typhimurium LT2
uucacaaaaaguauu

SEQ ID NO: 3810460 - RNA, 16 nt, Salmonella typhimurium LT2
uucacaaccuccacgc

SEQ ID NO: 3810461 - RNA, 16 nt, Salmonella typhimurium LT2
uucacaaucaucgcau

SEQ ID NO: 3810462 - RNA, 22 nt, Salmonella typhimurium LT2
uucacaccaaugucauauuugu

SEQ ID NO: 3810463 - RNA, 21 nt, Salmonella typhimurium LT2
uucacaccguuauccggcaaa

SEQ ID NO: 3810464 - RNA, 21 nt, Salmonella typhimurium LT2
uucacaccuuuauauuuuucc

SEQ ID NO: 3810465 - RNA, 14 nt, Salmonella typhimurium LT2
uucacagaaggcua

SEQ ID NO: 3810466 - RNA, 19 nt, Salmonella typhimurium LT2
uucacaugcaauaccggga

SEQ ID NO: 3810467 - RNA, 24 nt, Salmonella typhimurium LT2
uucaccaaaucaucaaucgcuuuu

SEQ ID NO: 3810468 - RNA, 21 nt, Salmonella typhimurium LT2
uucaccaccacccgaucgccc

SEQ ID NO: 3810469 - RNA, 23 nt, Salmonella typhimurium LT2
uucaccaccggaugauucaguaa

SEQ ID NO: 3810470 - RNA, 20 nt, Salmonella typhimurium LT2
uucacccagacugugauggc

SEQ ID NO: 3810471 - RNA, 15 nt, Salmonella typhimurium LT2
uucacccauugaacc

SEQ ID NO: 3810472 - RNA, 13 nt, Salmonella typhimurium LT2
uucacccccaucg

SEQ ID NO: 3810473 - RNA, 19 nt, Salmonella typhimurium LT2
uucaccccuucaucaguaa

SEQ ID NO: 3810474 - RNA, 23 nt, Salmonella typhimurium LT2
uucaccgcgucguuacgcucguc

SEQ ID NO: 3810475 - RNA, 19 nt, Salmonella typhimurium LT2
uucaccggacgcaucgccg

SEQ ID NO: 3810476 - RNA, 12 nt, Salmonella typhimurium LT2
uucaccggauac

SEQ ID NO: 3810477 - RNA, 15 nt, Salmonella typhimurium LT2
uucaccguaucgccc

SEQ ID NO: 3810478 - RNA, 20 nt, Salmonella typhimurium LT2
uucaccguuuaaaaacauca

SEQ ID NO: 3810479 - RNA, 16 nt, Salmonella typhimurium LT2
uucaccugcauaccga

SEQ ID NO: 3810480 - RNA, 21 nt, Salmonella typhimurium LT2
uucaccuuacccggcguauug

SEQ ID NO: 3810481 - RNA, 14 nt, Salmonella typhimurium LT2
uucacgcacgcgua

SEQ ID NO: 3810482 - RNA, 17 nt, Salmonella typhimurium LT2
uucacgcugcauaaaac

SEQ ID NO: 3810483 - RNA, 24 nt, Salmonella typhimurium LT2
uucacguacccaaauaucaaauac

SEQ ID NO: 3810484 - RNA, 20 nt, Salmonella typhimurium LT2
uucacuggcaucguauauac

SEQ ID NO: 3810485 - RNA, 16 nt, Salmonella typhimurium LT2
uucacuggcaugcgcc

SEQ ID NO: 3810486 - RNA, 13 nt, Salmonella typhimurium LT2
uucacuuauaaau

SEQ ID NO: 3810487 - RNA, 15 nt, Salmonella typhimurium LT2
uucacuuauaaauaa

SEQ ID NO: 3810488 - RNA, 16 nt, Salmonella typhimurium LT2
uucacuucuucauaaa

SEQ ID NO: 3810489 - RNA, 17 nt, Salmonella typhimurium LT2
uucacuuuaccaggcau

SEQ ID NO: 3810490 - RNA, 19 nt, Salmonella typhimurium LT2
uucagaaaucauauaaaac

SEQ ID NO: 3810491 - RNA, 16 nt, Salmonella typhimurium LT2
uucagaaauguauucu

SEQ ID NO: 3810492 - RNA, 19 nt, Salmonella typhimurium LT2
uucagaauacaaccucaaa

SEQ ID NO: 3810493 - RNA, 22 nt, Salmonella typhimurium LT2
uucagaccagaaccucacggag

SEQ ID NO: 3810494 - RNA, 12 nt, Salmonella typhimurium LT2
uucagacgucau

SEQ ID NO: 3810495 - RNA, 21 nt, Salmonella typhimurium LT2
uucagcagcgguacgcaagcg

SEQ ID NO: 3810496 - RNA, 15 nt, Salmonella typhimurium LT2
uucagcauauccagc

SEQ ID NO: 3810497 - RNA, 19 nt, Salmonella typhimurium LT2
uucagccagaguuuuaaaa

SEQ ID NO: 3810498 - RNA, 22 nt, Salmonella typhimurium LT2
uucagccagaguuuuaaaacca

SEQ ID NO: 3810499 - RNA, 15 nt, Salmonella typhimurium LT2
uucagccagcugcug

SEQ ID NO: 3810500 - RNA, 19 nt, Salmonella typhimurium LT2
uucagccaggcggcaauau

SEQ ID NO: 3810501 - RNA, 14 nt, Salmonella typhimurium LT2
uucagcccaggcuu

SEQ ID NO: 3810502 - RNA, 16 nt, Salmonella typhimurium LT2
uucagccuuuucauau

SEQ ID NO: 3810503 - RNA, 13 nt, Salmonella typhimurium LT2
uucagcgacaggc

SEQ ID NO: 3810504 - RNA, 17 nt, Salmonella typhimurium LT2
uucagcgacaggcuguc

SEQ ID NO: 3810505 - RNA, 18 nt, Salmonella typhimurium LT2
uucagcgacaggcugucg

SEQ ID NO: 3810506 - RNA, 18 nt, Salmonella typhimurium LT2
uucagcgccagauaguca

SEQ ID NO: 3810507 - RNA, 18 nt, Salmonella typhimurium LT2
uucagcgcgauaaauacc

SEQ ID NO: 3810508 - RNA, 12 nt, Salmonella typhimurium LT2
uucagcgucaaa

SEQ ID NO: 3810509 - RNA, 19 nt, Salmonella typhimurium LT2
uucagcgucaaauacagca

SEQ ID NO: 3810510 - RNA, 22 nt, Salmonella typhimurium LT2
uucagcucgcaggccauaaaac

SEQ ID NO: 3810511 - RNA, 19 nt, Salmonella typhimurium LT2
uucagcucuuuuagcgccc

SEQ ID NO: 3810512 - RNA, 20 nt, Salmonella typhimurium LT2
uucagcugauugggauaaac

SEQ ID NO: 3810513 - RNA, 23 nt, Salmonella typhimurium LT2
uucagcugcggcugaaccacccu

SEQ ID NO: 3810514 - RNA, 23 nt, Salmonella typhimurium LT2
uucagcuucagucauaauccuuc

SEQ ID NO: 3810515 - RNA, 18 nt, Salmonella typhimurium LT2
uucaggaaggagcaaaca

SEQ ID NO: 3810516 - RNA, 21 nt, Salmonella typhimurium LT2
uucaggacgacgguuuucucg

SEQ ID NO: 3810517 - RNA, 23 nt, Salmonella typhimurium LT2
uucaggacgacgguuuucucguc

SEQ ID NO: 3810518 - RNA, 22 nt, Salmonella typhimurium LT2
uucaggacgagagacugauaau

SEQ ID NO: 3810519 - RNA, 15 nt, Salmonella typhimurium LT2
uucaggcaaaaaaaa

SEQ ID NO: 3810520 - RNA, 17 nt, Salmonella typhimurium LT2
uucaggcaaaaaaaacc

SEQ ID NO: 3810521 - RNA, 14 nt, Salmonella typhimurium LT2
uucaggcaaaguug

SEQ ID NO: 3810522 - RNA, 20 nt, Salmonella typhimurium LT2
uucaggcaaaguuguuuuaa

SEQ ID NO: 3810523 - RNA, 16 nt, Salmonella typhimurium LT2
uucaggccagccugau

SEQ ID NO: 3810524 - RNA, 17 nt, Salmonella typhimurium LT2
uucaggcggcaaaaaac

SEQ ID NO: 3810525 - RNA, 18 nt, Salmonella typhimurium LT2
uucaggcggcaaaaaacg

SEQ ID NO: 3810526 - RNA, 21 nt, Salmonella typhimurium LT2
uucaggcgggguuaacugcuu

SEQ ID NO: 3810527 - RNA, 18 nt, Salmonella typhimurium LT2
uucagggcgacgaaucag

SEQ ID NO: 3810528 - RNA, 23 nt, Salmonella typhimurium LT2
uucagggcuuauucaagcaacug

SEQ ID NO: 3810529 - RNA, 14 nt, Salmonella typhimurium LT2
uucaggggucccca

SEQ ID NO: 3810530 - RNA, 16 nt, Salmonella typhimurium LT2
uucaggucaucggccu

SEQ ID NO: 3810531 - RNA, 22 nt, Salmonella typhimurium LT2
uucaggucuggauuacaaaaau

SEQ ID NO: 3810532 - RNA, 21 nt, Salmonella typhimurium LT2
uucagguuuuuaagcugccca

SEQ ID NO: 3810533 - RNA, 16 nt, Salmonella typhimurium LT2
uucaguaaaucaacuu

SEQ ID NO: 3810534 - RNA, 20 nt, Salmonella typhimurium LT2
uucaguauuacuauacccgc

SEQ ID NO: 3810535 - RNA, 19 nt, Salmonella typhimurium LT2
uucagucgggaucgccaga

SEQ ID NO: 3810536 - RNA, 24 nt, Salmonella typhimurium LT2
uucaguggcgcgccgcugucucgu

SEQ ID NO: 3810537 - RNA, 16 nt, Salmonella typhimurium LT2
uucaguucggagauca

SEQ ID NO: 3810538 - RNA, 22 nt, Salmonella typhimurium LT2
uucaguucguagagcuccacgc

SEQ ID NO: 3810539 - RNA, 20 nt, Salmonella typhimurium LT2
uucaguuguccauuuuccuc

SEQ ID NO: 3810540 - RNA, 13 nt, Salmonella typhimurium LT2
uucaguuucuucg

SEQ ID NO: 3810541 - RNA, 18 nt, Salmonella typhimurium LT2
uucauaaaagaucauucc

SEQ ID NO: 3810542 - RNA, 21 nt, Salmonella typhimurium LT2
uucauaaagugccagggcgga

SEQ ID NO: 3810543 - RNA, 12 nt, Salmonella typhimurium LT2
uucauaaauacg

SEQ ID NO: 3810544 - RNA, 12 nt, Salmonella typhimurium LT2
uucauaaaugua

SEQ ID NO: 3810545 - RNA, 14 nt, Salmonella typhimurium LT2
uucauaacgccgau

SEQ ID NO: 3810546 - RNA, 19 nt, Salmonella typhimurium LT2
uucauaacuugccgccugc

SEQ ID NO: 3810547 - RNA, 15 nt, Salmonella typhimurium LT2
uucauaagucaucca

SEQ ID NO: 3810548 - RNA, 21 nt, Salmonella typhimurium LT2
uucauaauaagcgcucaggca

SEQ ID NO: 3810549 - RNA, 13 nt, Salmonella typhimurium LT2
uucauacgcuuuc

SEQ ID NO: 3810550 - RNA, 17 nt, Salmonella typhimurium LT2
uucauagagaagucuga

SEQ ID NO: 3810551 - RNA, 14 nt, Salmonella typhimurium LT2
uucauagucgcuuu

SEQ ID NO: 3810552 - RNA, 21 nt, Salmonella typhimurium LT2
uucauagucgcuuuucauacu

SEQ ID NO: 3810553 - RNA, 20 nt, Salmonella typhimurium LT2
uucauaugcgccaacugcau

SEQ ID NO: 3810554 - RNA, 14 nt, Salmonella typhimurium LT2
uucauauuguaggu

SEQ ID NO: 3810555 - RNA, 23 nt, Salmonella typhimurium LT2
uucaucaaagaaauacccuucac

SEQ ID NO: 3810556 - RNA, 11 nt, Salmonella typhimurium LT2
uucaucaccau

SEQ ID NO: 3810557 - RNA, 20 nt, Salmonella typhimurium LT2
uucaucagcacaaaauccca

SEQ ID NO: 3810558 - RNA, 18 nt, Salmonella typhimurium LT2
uucaucaggcaauaaaca

SEQ ID NO: 3810559 - RNA, 21 nt, Salmonella typhimurium LT2
uucaucaggcaauaaacauca

SEQ ID NO: 3810560 - RNA, 16 nt, Salmonella typhimurium LT2
uucaucaggccugcaa

SEQ ID NO: 3810561 - RNA, 14 nt, Salmonella typhimurium LT2
uucaucaguaacug

SEQ ID NO: 3810562 - RNA, 20 nt, Salmonella typhimurium LT2
uucaucaugacacuuuauuc

SEQ ID NO: 3810563 - RNA, 13 nt, Salmonella typhimurium LT2
uucaucauucauc

SEQ ID NO: 3810564 - RNA, 15 nt, Salmonella typhimurium LT2
uucauccagcagcag

SEQ ID NO: 3810565 - RNA, 12 nt, Salmonella typhimurium LT2
uucauccagcgc

SEQ ID NO: 3810566 - RNA, 13 nt, Salmonella typhimurium LT2
uucauccaugcca

SEQ ID NO: 3810567 - RNA, 20 nt, Salmonella typhimurium LT2
uucauccaugccaagcggca

SEQ ID NO: 3810568 - RNA, 19 nt, Salmonella typhimurium LT2
uucaucccacucaaucauu

SEQ ID NO: 3810569 - RNA, 16 nt, Salmonella typhimurium LT2
uucauccugauaaucc

SEQ ID NO: 3810570 - RNA, 21 nt, Salmonella typhimurium LT2
uucauccuuaacgucaucauc

SEQ ID NO: 3810571 - RNA, 20 nt, Salmonella typhimurium LT2
uucaucgccacaugcggcag

SEQ ID NO: 3810572 - RNA, 20 nt, Salmonella typhimurium LT2
uucaucgccgauuccugcug

SEQ ID NO: 3810573 - RNA, 20 nt, Salmonella typhimurium LT2
uucaucgcgccuccccugcc

SEQ ID NO: 3810574 - RNA, 16 nt, Salmonella typhimurium LT2
uucaucgcugcucaac

SEQ ID NO: 3810575 - RNA, 23 nt, Salmonella typhimurium LT2
uucaucggucagagcauaaaaau

SEQ ID NO: 3810576 - RNA, 22 nt, Salmonella typhimurium LT2
uucaucuucaccuuuccaguca

SEQ ID NO: 3810577 - RNA, 13 nt, Salmonella typhimurium LT2
uucaucuuccaca

SEQ ID NO: 3810578 - RNA, 18 nt, Salmonella typhimurium LT2
uucaucuuuuaaaaucag

SEQ ID NO: 3810579 - RNA, 16 nt, Salmonella typhimurium LT2
uucaugaaucaucaca

SEQ ID NO: 3810580 - RNA, 16 nt, Salmonella typhimurium LT2
uucaugauauucuguc

SEQ ID NO: 3810581 - RNA, 16 nt, Salmonella typhimurium LT2
uucaugaucuuuccuu

SEQ ID NO: 3810582 - RNA, 22 nt, Salmonella typhimurium LT2
uucaugcacaaaacccgcagcc

SEQ ID NO: 3810583 - RNA, 17 nt, Salmonella typhimurium LT2
uucaugcagcccgcacu

SEQ ID NO: 3810584 - RNA, 23 nt, Salmonella typhimurium LT2
uucaugcaucauugaagcgaugu

SEQ ID NO: 3810585 - RNA, 16 nt, Salmonella typhimurium LT2
uucaugcgacugccca

SEQ ID NO: 3810586 - RNA, 19 nt, Salmonella typhimurium LT2
uucauggcguucgccgcau

SEQ ID NO: 3810587 - RNA, 21 nt, Salmonella typhimurium LT2
uucaugguacucaacaucauu

SEQ ID NO: 3810588 - RNA, 21 nt, Salmonella typhimurium LT2
uucauggucaucgcaaauucu

SEQ ID NO: 3810589 - RNA, 17 nt, Salmonella typhimurium LT2
uucauucaacaucgccc

SEQ ID NO: 3810590 - RNA, 22 nt, Salmonella typhimurium LT2
uucauucggcagauuaccggca

SEQ ID NO: 3810591 - RNA, 20 nt, Salmonella typhimurium LT2
uucauugucuuuuucucaau

SEQ ID NO: 3810592 - RNA, 19 nt, Salmonella typhimurium LT2
uucauuucaggcaaaggaa

SEQ ID NO: 3810593 - RNA, 17 nt, Salmonella typhimurium LT2
uucauuucuuccagcac

SEQ ID NO: 3810594 - RNA, 18 nt, Salmonella typhimurium LT2
uucauuuuauagucccuc

SEQ ID NO: 3810595 - RNA, 16 nt, Salmonella typhimurium LT2
uuccaaaauccaggga

SEQ ID NO: 3810596 - RNA, 23 nt, Salmonella typhimurium LT2
uuccacaaaaggauacagcgccg

SEQ ID NO: 3810597 - RNA, 20 nt, Salmonella typhimurium LT2
uuccacaaucccggcaacug

SEQ ID NO: 3810598 - RNA, 13 nt, Salmonella typhimurium LT2
uuccacagaccca

SEQ ID NO: 3810599 - RNA, 13 nt, Salmonella typhimurium LT2
uuccacgauauua

SEQ ID NO: 3810600 - RNA, 23 nt, Salmonella typhimurium LT2
uuccacgccgucgaugauggcgg

SEQ ID NO: 3810601 - RNA, 19 nt, Salmonella typhimurium LT2
uucgaaacguucgcauccc

SEQ ID NO: 3810602 - RNA, 12 nt, Salmonella typhimurium LT2
uucgaaccugcg

SEQ ID NO: 3810603 - RNA, 20 nt, Salmonella typhimurium LT2
uucgaacuacugauuccugc

SEQ ID NO: 3810604 - RNA, 17 nt, Salmonella typhimurium LT2
uucgaaucagcugcugc

SEQ ID NO: 3810605 - RNA, 11 nt, Salmonella typhimurium LT2
uucgaauccuc

SEQ ID NO: 3810606 - RNA, 17 nt, Salmonella typhimurium LT2
uucgaauuacauaacca

SEQ ID NO: 3810607 - RNA, 13 nt, Salmonella typhimurium LT2
uucgaauucugau

SEQ ID NO: 3810608 - RNA, 22 nt, Salmonella typhimurium LT2
uucgacaagaagauuucuuaau

SEQ ID NO: 3810609 - RNA, 14 nt, Salmonella typhimurium LT2
uucgauaaacucaa

SEQ ID NO: 3810610 - RNA, 23 nt, Salmonella typhimurium LT2
uucgauaaacucaaucaggcuau

SEQ ID NO: 3810611 - RNA, 17 nt, Salmonella typhimurium LT2
uucgauaaccaccagcg

SEQ ID NO: 3810612 - RNA, 18 nt, Salmonella typhimurium LT2
uucgauaaccaccagcgg

SEQ ID NO: 3810613 - RNA, 15 nt, Salmonella typhimurium LT2
uucgaugaaaaagag

SEQ ID NO: 3810614 - RNA, 23 nt, Salmonella typhimurium LT2
uucgaugaugagaugcaggccaa

SEQ ID NO: 3810615 - RNA, 14 nt, Salmonella typhimurium LT2
uucgaugcgcucau

SEQ ID NO: 3810616 - RNA, 13 nt, Salmonella typhimurium LT2
uucgcacccuguc

SEQ ID NO: 3810617 - RNA, 23 nt, Salmonella typhimurium LT2
uucgcagagucgcagcggcgguc

SEQ ID NO: 3810618 - RNA, 20 nt, Salmonella typhimurium LT2
uucgcagaucgccuggaucg

SEQ ID NO: 3810619 - RNA, 16 nt, Salmonella typhimurium LT2
uucgcauauucugcga

SEQ ID NO: 3810620 - RNA, 22 nt, Salmonella typhimurium LT2
uucgccaaagcagugaaucccc

SEQ ID NO: 3810621 - RNA, 21 nt, Salmonella typhimurium LT2
uucgccagcgcgacaauagcc

SEQ ID NO: 3810622 - RNA, 15 nt, Salmonella typhimurium LT2
uucgccagugacaaa

SEQ ID NO: 3810623 - RNA, 22 nt, Salmonella typhimurium LT2
uucgccauucccgcgacgucaa

SEQ ID NO: 3810624 - RNA, 14 nt, Salmonella typhimurium LT2
uucgcccagucauc

SEQ ID NO: 3810625 - RNA, 13 nt, Salmonella typhimurium LT2
uucgcccauaucc

SEQ ID NO: 3810626 - RNA, 16 nt, Salmonella typhimurium LT2
uucgcccaucgccgcc

SEQ ID NO: 3810627 - RNA, 19 nt, Salmonella typhimurium LT2
uucgccgcccaaccagccc

SEQ ID NO: 3810628 - RNA, 16 nt, Salmonella typhimurium LT2
uucgccgucaccugaa

SEQ ID NO: 3810629 - RNA, 17 nt, Salmonella typhimurium LT2
uucgccucccucacccu

SEQ ID NO: 3810630 - RNA, 14 nt, Salmonella typhimurium LT2
uucgccugaacagg

SEQ ID NO: 3810631 - RNA, 21 nt, Salmonella typhimurium LT2
uucgccugccgggguauccgu

SEQ ID NO: 3810632 - RNA, 23 nt, Salmonella typhimurium LT2
uucgccuggugcgggucaaaagc

SEQ ID NO: 3810633 - RNA, 18 nt, Salmonella typhimurium LT2
uucgcgaauagugcagaa

SEQ ID NO: 3810634 - RNA, 20 nt, Salmonella typhimurium LT2
uucgcgcaguucauccacgc

SEQ ID NO: 3810635 - RNA, 22 nt, Salmonella typhimurium LT2
uucgcgcuaaaugacaaauaga

SEQ ID NO: 3810636 - RNA, 22 nt, Salmonella typhimurium LT2
uucgcgucaaaacuuauuuuau

SEQ ID NO: 3810637 - RNA, 21 nt, Salmonella typhimurium LT2
uucgcguuagccggguccgga

SEQ ID NO: 3810638 - RNA, 13 nt, Salmonella typhimurium LT2
uucgcuaaaucag

SEQ ID NO: 3810639 - RNA, 21 nt, Salmonella typhimurium LT2
uucgcuaauccccccuuuuuu

SEQ ID NO: 3810640 - RNA, 17 nt, Salmonella typhimurium LT2
uucgcucccucaucaau

SEQ ID NO: 3810641 - RNA, 22 nt, Salmonella typhimurium LT2
uucgcucccucaucaauacguu

SEQ ID NO: 3810642 - RNA, 13 nt, Salmonella typhimurium LT2
uucgcucgcuuug

SEQ ID NO: 3810643 - RNA, 14 nt, Salmonella typhimurium LT2
uucgcucucuuuuu

SEQ ID NO: 3810644 - RNA, 13 nt, Salmonella typhimurium LT2
uucgcugcccguc

SEQ ID NO: 3810645 - RNA, 20 nt, Salmonella typhimurium LT2
uucgcuucuucuaccaccuu

SEQ ID NO: 3810646 - RNA, 20 nt, Salmonella typhimurium LT2
uucgcuugcccggccguuac

SEQ ID NO: 3810647 - RNA, 16 nt, Salmonella typhimurium LT2
uucggagauauacauc

SEQ ID NO: 3810648 - RNA, 21 nt, Salmonella typhimurium LT2
uucggagcgcuuuuuuuaugc

SEQ ID NO: 3810649 - RNA, 16 nt, Salmonella typhimurium LT2
uucggaucgauaaaag

SEQ ID NO: 3810650 - RNA, 19 nt, Salmonella typhimurium LT2
uucggauuauuggucagca

SEQ ID NO: 3810651 - RNA, 15 nt, Salmonella typhimurium LT2
uucggauucaauauu

SEQ ID NO: 3810652 - RNA, 22 nt, Salmonella typhimurium LT2
uucggcaaaacgccgcagaaaa

SEQ ID NO: 3810653 - RNA, 16 nt, Salmonella typhimurium LT2
uucggcaauccaucac

SEQ ID NO: 3810654 - RNA, 14 nt, Salmonella typhimurium LT2
uucggcauaacgca

SEQ ID NO: 3810655 - RNA, 12 nt, Salmonella typhimurium LT2
uucggcauguuc

SEQ ID NO: 3810656 - RNA, 16 nt, Salmonella typhimurium LT2
uucggcucagacagua

SEQ ID NO: 3810657 - RNA, 13 nt, Salmonella typhimurium LT2
uucggcuccagau

SEQ ID NO: 3810658 - RNA, 17 nt, Salmonella typhimurium LT2
uucggcuucaccgauuu

SEQ ID NO: 3810659 - RNA, 13 nt, Salmonella typhimurium LT2
uucgggccgccgc

SEQ ID NO: 3810660 - RNA, 18 nt, Salmonella typhimurium LT2
uucgggcgcaugcugcca

SEQ ID NO: 3810661 - RNA, 23 nt, Salmonella typhimurium LT2
uucggggauuauuugaucccguc

SEQ ID NO: 3810662 - RNA, 18 nt, Salmonella typhimurium LT2
uucggguaauucaaucuc

SEQ ID NO: 3810663 - RNA, 17 nt, Salmonella typhimurium LT2
uucggugauuuccagaa

SEQ ID NO: 3810664 - RNA, 19 nt, Salmonella typhimurium LT2
uucgguguaaacaggcuuc

SEQ ID NO: 3810665 - RNA, 19 nt, Salmonella typhimurium LT2
uucguacuccugcaucguu

SEQ ID NO: 3810666 - RNA, 13 nt, Salmonella typhimurium LT2
uucguagacucag

SEQ ID NO: 3810667 - RNA, 20 nt, Salmonella typhimurium LT2
uucgucaaugcugcuuugau

SEQ ID NO: 3810668 - RNA, 17 nt, Salmonella typhimurium LT2
uucgucaggaggccuga

SEQ ID NO: 3810669 - RNA, 15 nt, Salmonella typhimurium LT2
uucgucgagcagcag

SEQ ID NO: 3810670 - RNA, 13 nt, Salmonella typhimurium LT2
uucgucuucaucu

SEQ ID NO: 3810671 - RNA, 15 nt, Salmonella typhimurium LT2
uucguuaacccggca

SEQ ID NO: 3810672 - RNA, 14 nt, Salmonella typhimurium LT2
uucguuauagauaa

SEQ ID NO: 3810673 - RNA, 14 nt, Salmonella typhimurium LT2
uucguucaaaucgc

SEQ ID NO: 3810674 - RNA, 15 nt, Salmonella typhimurium LT2
uucguucucugaaua

SEQ ID NO: 3810675 - RNA, 11 nt, Salmonella typhimurium LT2
uucguuuuccg

SEQ ID NO: 3810676 - RNA, 12 nt, Salmonella typhimurium LT2
uucuacaaaugg

SEQ ID NO: 3810677 - RNA, 14 nt, Salmonella typhimurium LT2
uucuacacagcgcg

SEQ ID NO: 3810678 - RNA, 21 nt, Salmonella typhimurium LT2
uucuacauuccaucauguuaa

SEQ ID NO: 3810679 - RNA, 23 nt, Salmonella typhimurium LT2
uucuacuucaauuuuccagauag

SEQ ID NO: 3810680 - RNA, 16 nt, Salmonella typhimurium LT2
uucuaucuuucagacc

SEQ ID NO: 3810681 - RNA, 14 nt, Salmonella typhimurium LT2
uucuaugugcgcca

SEQ ID NO: 3810682 - RNA, 15 nt, Salmonella typhimurium LT2
uucucaaaaacacca

SEQ ID NO: 3810683 - RNA, 15 nt, Salmonella typhimurium LT2
uucucaaagugcgcc

SEQ ID NO: 3810684 - RNA, 14 nt, Salmonella typhimurium LT2
uucucaaugaacag

SEQ ID NO: 3810685 - RNA, 16 nt, Salmonella typhimurium LT2
uucucacggucuccug

SEQ ID NO: 3810686 - RNA, 19 nt, Salmonella typhimurium LT2
uucucauccccccuguagg

SEQ ID NO: 3810687 - RNA, 19 nt, Salmonella typhimurium LT2
uucuccagaucgcauaagc

SEQ ID NO: 3810688 - RNA, 20 nt, Salmonella typhimurium LT2
uucuccaggcgaauccccau

SEQ ID NO: 3810689 - RNA, 21 nt, Salmonella typhimurium LT2
uucuccccgcgcgaucucuuu

SEQ ID NO: 3810690 - RNA, 18 nt, Salmonella typhimurium LT2
uucucccgccagaugcag

SEQ ID NO: 3810691 - RNA, 17 nt, Salmonella typhimurium LT2
uucucccugccaggcca

SEQ ID NO: 3810692 - RNA, 19 nt, Salmonella typhimurium LT2
uucuccugauuaauccgcg

SEQ ID NO: 3810693 - RNA, 22 nt, Salmonella typhimurium LT2
uucuccugcgccagccggauac

SEQ ID NO: 3810694 - RNA, 19 nt, Salmonella typhimurium LT2
uucuccugggauaccggaa

SEQ ID NO: 3810695 - RNA, 23 nt, Salmonella typhimurium LT2
uucuccuucauauuucaagccgc

SEQ ID NO: 3810696 - RNA, 17 nt, Salmonella typhimurium LT2
uucucgaaguucucaau

SEQ ID NO: 3810697 - RNA, 23 nt, Salmonella typhimurium LT2
uucucgccggaaagaaacgccgc

SEQ ID NO: 3810698 - RNA, 17 nt, Salmonella typhimurium LT2
uucucgcgcagccagua

SEQ ID NO: 3810699 - RNA, 21 nt, Salmonella typhimurium LT2
uucucgcguggacgcuuuuau

SEQ ID NO: 3810700 - RNA, 17 nt, Salmonella typhimurium LT2
uucucggcuuuccagcu

SEQ ID NO: 3810701 - RNA, 17 nt, Salmonella typhimurium LT2
uucucgggccucgcgcu

SEQ ID NO: 3810702 - RNA, 16 nt, Salmonella typhimurium LT2
uucucguucaacggca

SEQ ID NO: 3810703 - RNA, 14 nt, Salmonella typhimurium LT2
uucucuguugccgc

SEQ ID NO: 3810704 - RNA, 19 nt, Salmonella typhimurium LT2
uucucuuaugccgcuuuug

SEQ ID NO: 3810705 - RNA, 15 nt, Salmonella typhimurium LT2
uugagguaucaaccc

SEQ ID NO: 3810706 - RNA, 16 nt, Salmonella typhimurium LT2
uugagucgcauccagu

SEQ ID NO: 3810707 - RNA, 14 nt, Salmonella typhimurium LT2
uugauaagagaaaa

SEQ ID NO: 3810708 - RNA, 18 nt, Salmonella typhimurium LT2
uugauaaggugaaugcgu

SEQ ID NO: 3810709 - RNA, 14 nt, Salmonella typhimurium LT2
uugauacauuuuuu

SEQ ID NO: 3810710 - RNA, 23 nt, Salmonella typhimurium LT2
uugauagcgacgcccauuagcau

SEQ ID NO: 3810711 - RNA, 16 nt, Salmonella typhimurium LT2
uugauagcgaucagcg

SEQ ID NO: 3810712 - RNA, 14 nt, Salmonella typhimurium LT2
uugauaucuucaag

SEQ ID NO: 3810713 - RNA, 23 nt, Salmonella typhimurium LT2
uugaucacgguacgcaucaccag

SEQ ID NO: 3810714 - RNA, 23 nt, Salmonella typhimurium LT2
uugaucaucagggcgaacauucc

SEQ ID NO: 3810715 - RNA, 17 nt, Salmonella typhimurium LT2
uugaucauggggaacag

SEQ ID NO: 3810716 - RNA, 17 nt, Salmonella typhimurium LT2
uugaucguaaaaugaaa

SEQ ID NO: 3810717 - RNA, 22 nt, Salmonella typhimurium LT2
uugaucugaagcguauuucugu

SEQ ID NO: 3810718 - RNA, 21 nt, Salmonella typhimurium LT2
uugaugaaccgagauacauuc

SEQ ID NO: 3810719 - RNA, 13 nt, Salmonella typhimurium LT2
uugaugaaccgcu

SEQ ID NO: 3810720 - RNA, 20 nt, Salmonella typhimurium LT2
uugaugaaccgcuguagcgu

SEQ ID NO: 3810721 - RNA, 18 nt, Salmonella typhimurium LT2
uugaugcuaacgcccucu

SEQ ID NO: 3810722 - RNA, 17 nt, Salmonella typhimurium LT2
uugauuaaucgucaucc

SEQ ID NO: 3810723 - RNA, 19 nt, Salmonella typhimurium LT2
uugauuuuucugguaaacc

SEQ ID NO: 3810724 - RNA, 16 nt, Salmonella typhimurium LT2
uugcaaagcccauaaa

SEQ ID NO: 3810725 - RNA, 17 nt, Salmonella typhimurium LT2
uugcaaugcgcuccagc

SEQ ID NO: 3810726 - RNA, 21 nt, Salmonella typhimurium LT2
uugcaauuccaagaucaaccg

SEQ ID NO: 3810727 - RNA, 19 nt, Salmonella typhimurium LT2
uugcaccgcuaaaaaacag

SEQ ID NO: 3810728 - RNA, 22 nt, Salmonella typhimurium LT2
uugcagcagcgagauggcuuuu

SEQ ID NO: 3810729 - RNA, 20 nt, Salmonella typhimurium LT2
uugcagccacguugcgcgcg

SEQ ID NO: 3810730 - RNA, 14 nt, Salmonella typhimurium LT2
uugcagccagaacu

SEQ ID NO: 3810731 - RNA, 12 nt, Salmonella typhimurium LT2
uugcagcgcagc

SEQ ID NO: 3810732 - RNA, 11 nt, Salmonella typhimurium LT2
uugcagcgcca

SEQ ID NO: 3810733 - RNA, 19 nt, Salmonella typhimurium LT2
uugcagcgcuguccagaua

SEQ ID NO: 3810734 - RNA, 19 nt, Salmonella typhimurium LT2
uugcaggaaaaacuguccc

SEQ ID NO: 3810735 - RNA, 17 nt, Salmonella typhimurium LT2
uugcaggaagggcagca

SEQ ID NO: 3810736 - RNA, 22 nt, Salmonella typhimurium LT2
uugcaguugcgcgucuaaaaau

SEQ ID NO: 3810737 - RNA, 13 nt, Salmonella typhimurium LT2
uugcauaaauaau

SEQ ID NO: 3810738 - RNA, 13 nt, Salmonella typhimurium LT2
uugcauacauaaa

SEQ ID NO: 3810739 - RNA, 23 nt, Salmonella typhimurium LT2
uugcauauaaggcccauacccca

SEQ ID NO: 3810740 - RNA, 12 nt, Salmonella typhimurium LT2
uugcauccaacu

SEQ ID NO: 3810741 - RNA, 14 nt, Salmonella typhimurium LT2
uugcaugaccaucc

SEQ ID NO: 3810742 - RNA, 17 nt, Salmonella typhimurium LT2
uugcauuuuaucuuuug

SEQ ID NO: 3810743 - RNA, 19 nt, Salmonella typhimurium LT2
uugccaaaaaaucagcaau

SEQ ID NO: 3810744 - RNA, 16 nt, Salmonella typhimurium LT2
uugccaagaaacgcag

SEQ ID NO: 3810745 - RNA, 20 nt, Salmonella typhimurium LT2
uugccacuacgcagcuccag

SEQ ID NO: 3810746 - RNA, 13 nt, Salmonella typhimurium LT2
uugccacugccac

SEQ ID NO: 3810747 - RNA, 13 nt, Salmonella typhimurium LT2
uugccacuggccu

SEQ ID NO: 3810748 - RNA, 18 nt, Salmonella typhimurium LT2
uugccagacgggccaggc

SEQ ID NO: 3810749 - RNA, 17 nt, Salmonella typhimurium LT2
uugccagugaaaaaaag

SEQ ID NO: 3810750 - RNA, 19 nt, Salmonella typhimurium LT2
uugccagugaaaaaaagca

SEQ ID NO: 3810751 - RNA, 14 nt, Salmonella typhimurium LT2
uugccauauugccg

SEQ ID NO: 3810752 - RNA, 19 nt, Salmonella typhimurium LT2
uugccaugaugagcgccau

SEQ ID NO: 3810753 - RNA, 20 nt, Salmonella typhimurium LT2
uugccauuacgauaaaugcg

SEQ ID NO: 3810754 - RNA, 22 nt, Salmonella typhimurium LT2
uugcccauggcaucaaucccgc

SEQ ID NO: 3810755 - RNA, 23 nt, Salmonella typhimurium LT2
uugcccauuuaacagauaguuaa

SEQ ID NO: 3810756 - RNA, 24 nt, Salmonella typhimurium LT2
uugccccgcuuucagcguugcagc

SEQ ID NO: 3810757 - RNA, 15 nt, Salmonella typhimurium LT2
uugcccgaugcgccc

SEQ ID NO: 3810758 - RNA, 23 nt, Salmonella typhimurium LT2
uugcccgcaggcuuccagauaca

SEQ ID NO: 3810759 - RNA, 17 nt, Salmonella typhimurium LT2
uugcccgguggcgcugc

SEQ ID NO: 3810760 - RNA, 18 nt, Salmonella typhimurium LT2
uugcccuucgcgcgauaa

SEQ ID NO: 3810761 - RNA, 20 nt, Salmonella typhimurium LT2
uugccgauuccaugcccagu

SEQ ID NO: 3810762 - RNA, 21 nt, Salmonella typhimurium LT2
uugccggagagaugccgccag

SEQ ID NO: 3810763 - RNA, 20 nt, Salmonella typhimurium LT2
uugccggauggcgcugcgcu

SEQ ID NO: 3810764 - RNA, 17 nt, Salmonella typhimurium LT2
uugccggauggcgcuuu

SEQ ID NO: 3810765 - RNA, 14 nt, Salmonella typhimurium LT2
uugccggcaucauu

SEQ ID NO: 3810766 - RNA, 20 nt, Salmonella typhimurium LT2
uugccgguuuuuuuugccug

SEQ ID NO: 3810767 - RNA, 19 nt, Salmonella typhimurium LT2
uugccugauggcgcucgcu

SEQ ID NO: 3810768 - RNA, 18 nt, Salmonella typhimurium LT2
uugccugccgcagcggcu

SEQ ID NO: 3810769 - RNA, 13 nt, Salmonella typhimurium LT2
uugccuuauucac

SEQ ID NO: 3810770 - RNA, 19 nt, Salmonella typhimurium LT2
uugccuucgaagaauucca

SEQ ID NO: 3810771 - RNA, 12 nt, Salmonella typhimurium LT2
uugccuuucaau

SEQ ID NO: 3810772 - RNA, 19 nt, Salmonella typhimurium LT2
uugcgaaccgcacagauua

SEQ ID NO: 3810773 - RNA, 21 nt, Salmonella typhimurium LT2
uugcgacaagcucauuuccca

SEQ ID NO: 3810774 - RNA, 19 nt, Salmonella typhimurium LT2
uugcgacuguucaucaaag

SEQ ID NO: 3810775 - RNA, 19 nt, Salmonella typhimurium LT2
uugcgcaggguaucaucgc

SEQ ID NO: 3810776 - RNA, 18 nt, Salmonella typhimurium LT2
uugcgccacggauggccu

SEQ ID NO: 3810777 - RNA, 16 nt, Salmonella typhimurium LT2
uugcgccagauaacca

SEQ ID NO: 3810778 - RNA, 17 nt, Salmonella typhimurium LT2
uugcgccagcacgccua

SEQ ID NO: 3810779 - RNA, 16 nt, Salmonella typhimurium LT2
uugcgccagcaucaug

SEQ ID NO: 3810780 - RNA, 14 nt, Salmonella typhimurium LT2
uugcgccauugccg

SEQ ID NO: 3810781 - RNA, 22 nt, Salmonella typhimurium LT2
uugcgcgauuuauagagcgcca

SEQ ID NO: 3810782 - RNA, 14 nt, Salmonella typhimurium LT2
uugcgcgccacgcc

SEQ ID NO: 3810783 - RNA, 15 nt, Salmonella typhimurium LT2
uugcgcugaaguaau

SEQ ID NO: 3810784 - RNA, 18 nt, Salmonella typhimurium LT2
uugcggaauaugagcaca

SEQ ID NO: 3810785 - RNA, 13 nt, Salmonella typhimurium LT2
uugcgguccagua

SEQ ID NO: 3810786 - RNA, 22 nt, Salmonella typhimurium LT2
uugcggugagaaacgcgccacg

SEQ ID NO: 3810787 - RNA, 15 nt, Salmonella typhimurium LT2
uugcguaagcagcug

SEQ ID NO: 3810788 - RNA, 12 nt, Salmonella typhimurium LT2
uugcgucauggu

SEQ ID NO: 3810789 - RNA, 14 nt, Salmonella typhimurium LT2
uugcgucuguuuuu

SEQ ID NO: 3810790 - RNA, 14 nt, Salmonella typhimurium LT2
uugcguucccaguu

SEQ ID NO: 3810791 - RNA, 17 nt, Salmonella typhimurium LT2
uugcuauagcccacgca

SEQ ID NO: 3810792 - RNA, 15 nt, Salmonella typhimurium LT2
uugcuauugaaaaaa

SEQ ID NO: 3810793 - RNA, 23 nt, Salmonella typhimurium LT2
uugcucaacuggaugacugaauu

SEQ ID NO: 3810794 - RNA, 17 nt, Salmonella typhimurium LT2
uugcucaauggauuuuc

SEQ ID NO: 3810795 - RNA, 13 nt, Salmonella typhimurium LT2
uugcucaauuuuu

SEQ ID NO: 3810796 - RNA, 24 nt, Salmonella typhimurium LT2
uugcucacggcgauaccaguaaua

SEQ ID NO: 3810797 - RNA, 23 nt, Salmonella typhimurium LT2
uugcuccagcagcgccaguuuuu

SEQ ID NO: 3810798 - RNA, 22 nt, Salmonella typhimurium LT2
uugcucccagaaaccgccccug

SEQ ID NO: 3810799 - RNA, 11 nt, Salmonella typhimurium LT2
uugcucgcacu

SEQ ID NO: 3810800 - RNA, 18 nt, Salmonella typhimurium LT2
uugcugaaucugcggcug

SEQ ID NO: 3810801 - RNA, 22 nt, Salmonella typhimurium LT2
uugcugagaauuuccaguucaa

SEQ ID NO: 3810802 - RNA, 14 nt, Salmonella typhimurium LT2
uugcugauaaucaa

SEQ ID NO: 3810803 - RNA, 20 nt, Salmonella typhimurium LT2
uugcugcguaaaagcguuac

SEQ ID NO: 3810804 - RNA, 19 nt, Salmonella typhimurium LT2
uugcugcguugccgccuug

SEQ ID NO: 3810805 - RNA, 22 nt, Salmonella typhimurium LT2
uugcugcuguuaccggacagca

SEQ ID NO: 3810806 - RNA, 20 nt, Salmonella typhimurium LT2
uugcuggcgugaaccgguaa

SEQ ID NO: 3810807 - RNA, 17 nt, Salmonella typhimurium LT2
uugcugguagacaaaca

SEQ ID NO: 3810808 - RNA, 17 nt, Salmonella typhimurium LT2
uugcugguuaacucuuu

SEQ ID NO: 3810809 - RNA, 23 nt, Salmonella typhimurium LT2
uuuacaaccguggcguuuucauu

SEQ ID NO: 3810810 - RNA, 15 nt, Salmonella typhimurium LT2
uuuacacaauucuga

SEQ ID NO: 3810811 - RNA, 17 nt, Salmonella typhimurium LT2
uuuacacaauucugauu

SEQ ID NO: 3810812 - RNA, 14 nt, Salmonella typhimurium LT2
uuuacagccgccau

SEQ ID NO: 3810813 - RNA, 12 nt, Salmonella typhimurium LT2
uuuacaguaucu

SEQ ID NO: 3810814 - RNA, 13 nt, Salmonella typhimurium LT2
uuuacauucucaa

SEQ ID NO: 3810815 - RNA, 18 nt, Salmonella typhimurium LT2
uuuaccaucuacuaucau

SEQ ID NO: 3810816 - RNA, 18 nt, Salmonella typhimurium LT2
uuuacccacuucuuccag

SEQ ID NO: 3810817 - RNA, 13 nt, Salmonella typhimurium LT2
uuuaccgcaauaa

SEQ ID NO: 3810818 - RNA, 18 nt, Salmonella typhimurium LT2
uuuaccugcaaaaacgcc

SEQ ID NO: 3810819 - RNA, 23 nt, Salmonella typhimurium LT2
uuuacgcccucaucggcaaacau

SEQ ID NO: 3810820 - RNA, 13 nt, Salmonella typhimurium LT2
uuuacgcugcucc

SEQ ID NO: 3810821 - RNA, 13 nt, Salmonella typhimurium LT2
uuuacggcaggcc

SEQ ID NO: 3810822 - RNA, 15 nt, Salmonella typhimurium LT2
uuuacgucagcaaua

SEQ ID NO: 3810823 - RNA, 14 nt, Salmonella typhimurium LT2
uuuacugacaauaa

SEQ ID NO: 3810824 - RNA, 16 nt, Salmonella typhimurium LT2
uuuacuuaauucugcu

SEQ ID NO: 3810825 - RNA, 16 nt, Salmonella typhimurium LT2
uuuagaaccaauagua

SEQ ID NO: 3810826 - RNA, 17 nt, Salmonella typhimurium LT2
uuuagaacuaucugaaa

SEQ ID NO: 3810827 - RNA, 13 nt, Salmonella typhimurium LT2
uuuagcagcaaua

SEQ ID NO: 3810828 - RNA, 19 nt, Salmonella typhimurium LT2
uuuagcauaacguuuccuu

SEQ ID NO: 3810829 - RNA, 15 nt, Salmonella typhimurium LT2
uuuagcaugacaaua

SEQ ID NO: 3810830 - RNA, 16 nt, Salmonella typhimurium LT2
uuuagcgccagcagca

SEQ ID NO: 3810831 - RNA, 20 nt, Salmonella typhimurium LT2
uuuagcguuucaucggugua

SEQ ID NO: 3810832 - RNA, 16 nt, Salmonella typhimurium LT2
uuuaguuaucaggcau

SEQ ID NO: 3810833 - RNA, 21 nt, Salmonella typhimurium LT2
uuuaguucagcauauuucuaa

SEQ ID NO: 3810834 - RNA, 13 nt, Salmonella typhimurium LT2
uuuauaaaauuua

SEQ ID NO: 3810835 - RNA, 14 nt, Salmonella typhimurium LT2
uuuauaaaauuuaa

SEQ ID NO: 3810836 - RNA, 19 nt, Salmonella typhimurium LT2
uuuauaacuaaacucaucu

SEQ ID NO: 3810837 - RNA, 22 nt, Salmonella typhimurium LT2
uuuauaccgaaacagucacgcu

SEQ ID NO: 3810838 - RNA, 15 nt, Salmonella typhimurium LT2
uuuauacucaaaaaa

SEQ ID NO: 3810839 - RNA, 21 nt, Salmonella typhimurium LT2
uuuauauucugggcuuacuuu

SEQ ID NO: 3810840 - RNA, 11 nt, Salmonella typhimurium LT2
uuuauauugug

SEQ ID NO: 3810841 - RNA, 22 nt, Salmonella typhimurium LT2
uuuaucaaacaaaccaaacuga

SEQ ID NO: 3810842 - RNA, 15 nt, Salmonella typhimurium LT2
uuuaucacuauuacg

SEQ ID NO: 3810843 - RNA, 16 nt, Salmonella typhimurium LT2
uuuauccacgccgcua

SEQ ID NO: 3810844 - RNA, 17 nt, Salmonella typhimurium LT2
uuuauccacgccgcuau

SEQ ID NO: 3810845 - RNA, 16 nt, Salmonella typhimurium LT2
uuuauccaguaacgcg

SEQ ID NO: 3810846 - RNA, 22 nt, Salmonella typhimurium LT2
uuuauccccgcuggcgcgggga

SEQ ID NO: 3810847 - RNA, 23 nt, Salmonella typhimurium LT2
uuuauccggaugaaacgcaucca

SEQ ID NO: 3810848 - RNA, 18 nt, Salmonella typhimurium LT2
uuuauccggcgcuggucg

SEQ ID NO: 3810849 - RNA, 23 nt, Salmonella typhimurium LT2
uuuaucgaaguaauaaaaaacaa

SEQ ID NO: 3810850 - RNA, 13 nt, Salmonella typhimurium LT2
uuuaucgacacua

SEQ ID NO: 3810851 - RNA, 17 nt, Salmonella typhimurium LT2
uuuaucgaucuccaucu

SEQ ID NO: 3810852 - RNA, 14 nt, Salmonella typhimurium LT2
uuuaucggccagca

SEQ ID NO: 3810853 - RNA, 17 nt, Salmonella typhimurium LT2
uuuaucugcccuuucuu

SEQ ID NO: 3810854 - RNA, 21 nt, Salmonella typhimurium LT2
uuuaucugcgugaugcaucag

SEQ ID NO: 3810855 - RNA, 22 nt, Salmonella typhimurium LT2
uuuaucuuuaaauuucagggcu

SEQ ID NO: 3810856 - RNA, 16 nt, Salmonella typhimurium LT2
uuuaugcagccgauag

SEQ ID NO: 3810857 - RNA, 20 nt, Salmonella typhimurium LT2
uuuaugcaguuccguugcaa

SEQ ID NO: 3810858 - RNA, 15 nt, Salmonella typhimurium LT2
uuuaugcguuauaga

SEQ ID NO: 3810859 - RNA, 19 nt, Salmonella typhimurium LT2
uuuaugcuguagugaggcu

SEQ ID NO: 3810860 - RNA, 16 nt, Salmonella typhimurium LT2
uuuaugggaaaauucc

SEQ ID NO: 3810861 - RNA, 16 nt, Salmonella typhimurium LT2
uuuaugggcauuucau

SEQ ID NO: 3810862 - RNA, 19 nt, Salmonella typhimurium LT2
uuuaugucaguaauauauu

SEQ ID NO: 3810863 - RNA, 19 nt, Salmonella typhimurium LT2
uuuauguguauagcuuuuc

SEQ ID NO: 3810864 - RNA, 12 nt, Salmonella typhimurium LT2
uuuauuauuaca

SEQ ID NO: 3810865 - RNA, 15 nt, Salmonella typhimurium LT2
uuuauuauuacagga

SEQ ID NO: 3810866 - RNA, 23 nt, Salmonella typhimurium LT2
uuuauugugcgcaagaaaaguuu

SEQ ID NO: 3810867 - RNA, 18 nt, Salmonella typhimurium LT2
uuuauuuaggauuugucu

SEQ ID NO: 3810868 - RNA, 21 nt, Salmonella typhimurium LT2
uuuauuuccaauguaaauuaa

SEQ ID NO: 3810869 - RNA, 23 nt, Salmonella typhimurium LT2
uuuauuuggcucugaagcguaaa

SEQ ID NO: 3810870 - RNA, 15 nt, Salmonella typhimurium LT2
uuuauuuuggcauuu

SEQ ID NO: 3810871 - RNA, 21 nt, Salmonella typhimurium LT2
uuuauuuuuuuacauuauucc

SEQ ID NO: 3810872 - RNA, 13 nt, Salmonella typhimurium LT2
uuucaaaaaagag

SEQ ID NO: 3810873 - RNA, 16 nt, Salmonella typhimurium LT2
uuucaaaaaagagaag

SEQ ID NO: 3810874 - RNA, 20 nt, Salmonella typhimurium LT2
uuucaacauauuuuucacac

SEQ ID NO: 3810875 - RNA, 23 nt, Salmonella typhimurium LT2
uuucaacauauuuuucacacaua

SEQ ID NO: 3810876 - RNA, 18 nt, Salmonella typhimurium LT2
uuucaacccccucagcaa

SEQ ID NO: 3810877 - RNA, 23 nt, Salmonella typhimurium LT2
uuucaacccccucagcaaugauu

SEQ ID NO: 3810878 - RNA, 17 nt, Salmonella typhimurium LT2
uuucaagacagaacuug

SEQ ID NO: 3810879 - RNA, 16 nt, Salmonella typhimurium LT2
uuucaauaagcgguaa

SEQ ID NO: 3810880 - RNA, 21 nt, Salmonella typhimurium LT2
uuucaauaaucccuucuuuua

SEQ ID NO: 3810881 - RNA, 12 nt, Salmonella typhimurium LT2
uuucaauaaucu

SEQ ID NO: 3810882 - RNA, 23 nt, Salmonella typhimurium LT2
uuucaauaauggcgcgaaaacag

SEQ ID NO: 3810883 - RNA, 19 nt, Salmonella typhimurium LT2
uuucaauauagccguggcu

SEQ ID NO: 3810884 - RNA, 13 nt, Salmonella typhimurium LT2
uuucaaucaucau

SEQ ID NO: 3810885 - RNA, 18 nt, Salmonella typhimurium LT2
uuucaauccuucuucuga

SEQ ID NO: 3810886 - RNA, 17 nt, Salmonella typhimurium LT2
uuucaauuccacaggcg

SEQ ID NO: 3810887 - RNA, 14 nt, Salmonella typhimurium LT2
uuucaauuuccagu

SEQ ID NO: 3810888 - RNA, 18 nt, Salmonella typhimurium LT2
uuucaauuugugagacaa

SEQ ID NO: 3810889 - RNA, 14 nt, Salmonella typhimurium LT2
uuucaccauuaaga

SEQ ID NO: 3810890 - RNA, 24 nt, Salmonella typhimurium LT2
uuucaccgcgucguuacgcucguc

SEQ ID NO: 3810891 - RNA, 15 nt, Salmonella typhimurium LT2
uuucaccuccacgua

SEQ ID NO: 3810892 - RNA, 20 nt, Salmonella typhimurium LT2
uuucacugucgccaggccau

SEQ ID NO: 3810893 - RNA, 17 nt, Salmonella typhimurium LT2
uuucacuuucaaugaca

SEQ ID NO: 3810894 - RNA, 18 nt, Salmonella typhimurium LT2
uuucagauagcgaaccau

SEQ ID NO: 3810895 - RNA, 18 nt, Salmonella typhimurium LT2
uuucagaucggcaaaagu

SEQ ID NO: 3810896 - RNA, 11 nt, Salmonella typhimurium LT2
uuucagcagcg

SEQ ID NO: 3810897 - RNA, 18 nt, Salmonella typhimurium LT2
uuucagccgcgcauagcu

SEQ ID NO: 3810898 - RNA, 23 nt, Salmonella typhimurium LT2
uuucagcucgcaggccauaaaac

SEQ ID NO: 3810899 - RNA, 20 nt, Salmonella typhimurium LT2
uuucaggcaccgguugcccc

SEQ ID NO: 3810900 - RNA, 12 nt, Salmonella typhimurium LT2
uuucagggcuua

SEQ ID NO: 3810901 - RNA, 13 nt, Salmonella typhimurium LT2
uuucaguauuacu

SEQ ID NO: 3810902 - RNA, 21 nt, Salmonella typhimurium LT2
uuucagugacgcguuaauauc

SEQ ID NO: 3810903 - RNA, 15 nt, Salmonella typhimurium LT2
uuucaguuguccauu

SEQ ID NO: 3810904 - RNA, 18 nt, Salmonella typhimurium LT2
uuucauaauaagcgcuca

SEQ ID NO: 3810905 - RNA, 15 nt, Salmonella typhimurium LT2
uuucauagaaccacu

SEQ ID NO: 3810906 - RNA, 12 nt, Salmonella typhimurium LT2
uuucaucaccau

SEQ ID NO: 3810907 - RNA, 12 nt, Salmonella typhimurium LT2
uuucaucacgcu

SEQ ID NO: 3810908 - RNA, 15 nt, Salmonella typhimurium LT2
uuucaucaucgccga

SEQ ID NO: 3810909 - RNA, 11 nt, Salmonella typhimurium LT2
uuucauccucu

SEQ ID NO: 3810910 - RNA, 19 nt, Salmonella typhimurium LT2
uuucaucgccgauuccugc

SEQ ID NO: 3810911 - RNA, 22 nt, Salmonella typhimurium LT2
uuucaucuauuauuuuucuauu

SEQ ID NO: 3810912 - RNA, 16 nt, Salmonella typhimurium LT2
uuucaugauauucugu

SEQ ID NO: 3810913 - RNA, 12 nt, Salmonella typhimurium LT2
uuugacaacaaa

SEQ ID NO: 3810914 - RNA, 13 nt, Salmonella typhimurium LT2
uuugaccucgccu

SEQ ID NO: 3810915 - RNA, 22 nt, Salmonella typhimurium LT2
uuugacgccgggaaauuuuucg

SEQ ID NO: 3810916 - RNA, 15 nt, Salmonella typhimurium LT2
uuugagcagcgccau

SEQ ID NO: 3810917 - RNA, 14 nt, Salmonella typhimurium LT2
uuugaucagcacgc

SEQ ID NO: 3810918 - RNA, 19 nt, Salmonella typhimurium LT2
uuugaucccgcugaagacu

SEQ ID NO: 3810919 - RNA, 18 nt, Salmonella typhimurium LT2
uuugauccguuucagaaa

SEQ ID NO: 3810920 - RNA, 20 nt, Salmonella typhimurium LT2
uuugaucgcggucgcguuau

SEQ ID NO: 3810921 - RNA, 14 nt, Salmonella typhimurium LT2
uuugauggacacua

SEQ ID NO: 3810922 - RNA, 22 nt, Salmonella typhimurium LT2
uuugaugucgaggaaaaacaua

SEQ ID NO: 3810923 - RNA, 22 nt, Salmonella typhimurium LT2
uuugauucaguucaucuuccac

SEQ ID NO: 3810924 - RNA, 12 nt, Salmonella typhimurium LT2
uuugauuuaauu

SEQ ID NO: 3810925 - RNA, 13 nt, Salmonella typhimurium LT2
uuugcaaaacuga

SEQ ID NO: 3810926 - RNA, 19 nt, Salmonella typhimurium LT2
uuugcaccgcuaaaaaaca

SEQ ID NO: 3810927 - RNA, 17 nt, Salmonella typhimurium LT2
uuugcacguucugcugg

SEQ ID NO: 3810928 - RNA, 17 nt, Salmonella typhimurium LT2
uuugcagcaaauacaga

SEQ ID NO: 3810929 - RNA, 13 nt, Salmonella typhimurium LT2
uuugcagcaacug

SEQ ID NO: 3810930 - RNA, 13 nt, Salmonella typhimurium LT2
uuugcagcagcgu

SEQ ID NO: 3810931 - RNA, 15 nt, Salmonella typhimurium LT2
uuugcauuaaccuga

SEQ ID NO: 3810932 - RNA, 13 nt, Salmonella typhimurium LT2
uuugcauucgcuc

SEQ ID NO: 3810933 - RNA, 15 nt, Salmonella typhimurium LT2
uuugcauucgcuccu

SEQ ID NO: 3810934 - RNA, 20 nt, Salmonella typhimurium LT2
uuugccagauauucucccua

SEQ ID NO: 3810935 - RNA, 14 nt, Salmonella typhimurium LT2
uuugccagcaccag

SEQ ID NO: 3810936 - RNA, 15 nt, Salmonella typhimurium LT2
uuugcccagcgcugg

SEQ ID NO: 3810937 - RNA, 21 nt, Salmonella typhimurium LT2
uuugccccauuguucuuucau

SEQ ID NO: 3810938 - RNA, 17 nt, Salmonella typhimurium LT2
uuugccgccuugucuca

SEQ ID NO: 3810939 - RNA, 17 nt, Salmonella typhimurium LT2
uuugccugagcgcgaac

SEQ ID NO: 3810940 - RNA, 15 nt, Salmonella typhimurium LT2
uuugccuuucuuauu

SEQ ID NO: 3810941 - RNA, 21 nt, Salmonella typhimurium LT2
uuugccuuuugacagcacaua

SEQ ID NO: 3810942 - RNA, 15 nt, Salmonella typhimurium LT2
uuugcgaaaagccgg

SEQ ID NO: 3810943 - RNA, 13 nt, Salmonella typhimurium LT2
uuugcgacaucag

SEQ ID NO: 3810944 - RNA, 19 nt, Salmonella typhimurium LT2
uuugcgacggaacagacga

SEQ ID NO: 3810945 - RNA, 15 nt, Salmonella typhimurium LT2
uuugcgauaagcgcg

SEQ ID NO: 3810946 - RNA, 21 nt, Salmonella typhimurium LT2
uuugcgcgaggucgagcucag

SEQ ID NO: 3810947 - RNA, 21 nt, Salmonella typhimurium LT2
uuugcgcucgcgccagaugcu

SEQ ID NO: 3810948 - RNA, 20 nt, Salmonella typhimurium LT2
uuugcggaauaugagcacag

SEQ ID NO: 3810949 - RNA, 18 nt, Salmonella typhimurium LT2
uuugcgguuuuaauuucc

SEQ ID NO: 3810950 - RNA, 19 nt, Salmonella typhimurium LT2
uuugcguaaaaaaacauca

SEQ ID NO: 3810951 - RNA, 17 nt, Salmonella typhimurium LT2
uuugcguacucagcaga

SEQ ID NO: 3810952 - RNA, 16 nt, Salmonella typhimurium LT2
uuugcucaauuuuuuu

SEQ ID NO: 3810953 - RNA, 17 nt, Salmonella typhimurium LT2
uuugcucuggcuuguuc

SEQ ID NO: 3810954 - RNA, 16 nt, Salmonella typhimurium LT2
uuugcugaaguucuca

SEQ ID NO: 3810955 - RNA, 15 nt, Salmonella typhimurium LT2
uuugcugcauuucuu

SEQ ID NO: 3810956 - RNA, 19 nt, Salmonella typhimurium LT2
uuugcugcauuucuuguug

SEQ ID NO: 3810957 - RNA, 11 nt, Salmonella typhimurium LT2
uuugcugccac

SEQ ID NO: 3810958 - RNA, 18 nt, Salmonella typhimurium LT2
uuugcugcuguuaccgga

SEQ ID NO: 3810959 - RNA, 20 nt, Salmonella typhimurium LT2
uuugcuggaaaaauaagagg

SEQ ID NO: 3810960 - RNA, 22 nt, Salmonella typhimurium LT2
uuugcuucgccaucuccaucau

SEQ ID NO: 3810961 - RNA, 17 nt, Salmonella typhimurium LT2
uuugcuucucgccuuca

SEQ ID NO: 3810962 - RNA, 13 nt, Salmonella typhimurium LT2
uuugcuucuucag

SEQ ID NO: 3810963 - RNA, 20 nt, Salmonella typhimurium LT2
uuuggcagacaaccauauuu

SEQ ID NO: 3810964 - RNA, 24 nt, Salmonella typhimurium LT2
uuuggcaggccucuaucuucucag

SEQ ID NO: 3810965 - RNA, 21 nt, Salmonella typhimurium LT2
uuuggcgacagacgcuuaucg

SEQ ID NO: 3810966 - RNA, 21 nt, Salmonella typhimurium LT2
uuuggcggcaagaucauccgg

SEQ ID NO: 3810967 - RNA, 22 nt, Salmonella typhimurium LT2
uuuggcguacuuagguacuucc

SEQ ID NO: 3810968 - RNA, 11 nt, Salmonella typhimurium LT2
uuuggcugccg

SEQ ID NO: 3810969 - RNA, 21 nt, Salmonella typhimurium LT2
uuugggaacuagcgaaucaca

SEQ ID NO: 3810970 - RNA, 20 nt, Salmonella typhimurium LT2
uuuggguaaauaccaggcac

SEQ ID NO: 3810971 - RNA, 21 nt, Salmonella typhimurium LT2
uuuggugcccgcguggaaaac

SEQ ID NO: 3810972 - RNA, 18 nt, Salmonella typhimurium LT2
uuugguuacuauuuuuca

SEQ ID NO: 3810973 - RNA, 19 nt, Salmonella typhimurium LT2
uuugguuagggaucaucuu

SEQ ID NO: 3810974 - RNA, 14 nt, Salmonella typhimurium LT2
uuugguuccuucag

SEQ ID NO: 3810975 - RNA, 14 nt, Salmonella typhimurium LT2
uuuguaacauauuu

SEQ ID NO: 3810976 - RNA, 19 nt, Salmonella typhimurium LT2
uuuguaaccaacaaacgcg

SEQ ID NO: 3810977 - RNA, 13 nt, Salmonella typhimurium LT2
uuuguacaaaaaa

SEQ ID NO: 3810978 - RNA, 15 nt, Salmonella typhimurium LT2
uuuguacagcuugcc

SEQ ID NO: 3810979 - RNA, 20 nt, Salmonella typhimurium LT2
uuuguaucccuuucaaaaaa

SEQ ID NO: 3810980 - RNA, 22 nt, Salmonella typhimurium LT2
uuuguauuaacggcgcugcgcu

SEQ ID NO: 3810981 - RNA, 14 nt, Salmonella typhimurium LT2
uuuguccauuucuu

SEQ ID NO: 3810982 - RNA, 18 nt, Salmonella typhimurium LT2
uuugucccuguuccaucu

SEQ ID NO: 3810983 - RNA, 18 nt, Salmonella typhimurium LT2
uuugucguccccuggacg

SEQ ID NO: 3810984 - RNA, 13 nt, Salmonella typhimurium LT2
uuugugaguucau

SEQ ID NO: 3810985 - RNA, 18 nt, Salmonella typhimurium LT2
uuugugcccguuuuacau

SEQ ID NO: 3810986 - RNA, 12 nt, Salmonella typhimurium LT2
uuugugcgcgcc

SEQ ID NO: 3810987 - RNA, 11 nt, Salmonella typhimurium LT2
uuuguuacucu

SEQ ID NO: 3810988 - RNA, 17 nt, Salmonella typhimurium LT2
uuuguucauaucgaaga

SEQ ID NO: 3810989 - RNA, 14 nt, Salmonella typhimurium LT2
uuuuaaaaaaccag

SEQ ID NO: 3810990 - RNA, 13 nt, Salmonella typhimurium LT2
uuuuaaaaccauu

SEQ ID NO: 3810991 - RNA, 14 nt, Salmonella typhimurium LT2
uuuuaaaaucagau

SEQ ID NO: 3810992 - RNA, 13 nt, Salmonella typhimurium LT2
uuuuaaauugaag

SEQ ID NO: 3810993 - RNA, 12 nt, Salmonella typhimurium LT2
uuuuaaccguca

SEQ ID NO: 3810994 - RNA, 22 nt, Salmonella typhimurium LT2
uuuuaacgucaucaccaguuga

SEQ ID NO: 3810995 - RNA, 18 nt, Salmonella typhimurium LT2
uuuuaagcauccaggaag

SEQ ID NO: 3810996 - RNA, 19 nt, Salmonella typhimurium LT2
uuuuaaugacuuuuuauau

SEQ ID NO: 3810997 - RNA, 18 nt, Salmonella typhimurium LT2
uuuuaaugauguagucau

SEQ ID NO: 3810998 - RNA, 14 nt, Salmonella typhimurium LT2
uuuuaauuuaauaa

SEQ ID NO: 3810999 - RNA, 22 nt, Salmonella typhimurium LT2
uuuuaauuuaauaauaaauuuu

SEQ ID NO: 3811000 - RNA, 14 nt, Salmonella typhimurium LT2
uuuuacaggccgga

SEQ ID NO: 3811001 - RNA, 21 nt, Salmonella typhimurium LT2
uuuuagcagcaauaauuacag

SEQ ID NO: 3811002 - RNA, 17 nt, Salmonella typhimurium LT2
uuuuagccgcaucuucc

SEQ ID NO: 3811003 - RNA, 20 nt, Salmonella typhimurium LT2
uuuuagggcguaaauauaac

SEQ ID NO: 3811004 - RNA, 18 nt, Salmonella typhimurium LT2
uuuuauagucuaauaaca

SEQ ID NO: 3811005 - RNA, 21 nt, Salmonella typhimurium LT2
uuuuaucugggucaggaacug

SEQ ID NO: 3811006 - RNA, 14 nt, Salmonella typhimurium LT2
uuuuaugaaggcuc

SEQ ID NO: 3811007 - RNA, 21 nt, Salmonella typhimurium LT2
uuuuaugaaggcucaaauuug

SEQ ID NO: 3811008 - RNA, 12 nt, Salmonella typhimurium LT2
uuuuaugccccu

SEQ ID NO: 3811009 - RNA, 12 nt, Salmonella typhimurium LT2
uuuuaugcguuu

SEQ ID NO: 3811010 - RNA, 20 nt, Salmonella typhimurium LT2
uuuuaugcguuuaauugaau

SEQ ID NO: 3811011 - RNA, 23 nt, Salmonella typhimurium LT2
uuuuauuaaaauuguaauaauuu

SEQ ID NO: 3811012 - RNA, 15 nt, Salmonella typhimurium LT2
uuuuauuaagcaggc

SEQ ID NO: 3811013 - RNA, 21 nt, Salmonella typhimurium LT2
uuuuauucauauuauauguuu

SEQ ID NO: 3811014 - RNA, 19 nt, Salmonella typhimurium LT2
uuuuauuucaucuauuauu

SEQ ID NO: 3811015 - RNA, 13 nt, Salmonella typhimurium LT2
uuuuauuuucagc

SEQ ID NO: 3811016 - RNA, 17 nt, Salmonella typhimurium LT2
uuuuauuuuuauauucc

SEQ ID NO: 3811017 - RNA, 23 nt, Salmonella typhimurium LT2
acgccgccgcgucugaccgccgc

SEQ ID NO: 3811018 - RNA, 14 nt, Salmonella typhimurium LT2
acgccgcgcuggau

SEQ ID NO: 3811019 - RNA, 16 nt, Salmonella typhimurium LT2
acgccgcgcuucugga

SEQ ID NO: 3811020 - RNA, 16 nt, Salmonella typhimurium LT2
acgccgcucgaaucgc

SEQ ID NO: 3811021 - RNA, 20 nt, Salmonella typhimurium LT2
acgccgcuggugcuguuuuu

SEQ ID NO: 3811022 - RNA, 17 nt, Salmonella typhimurium LT2
acgccggagaccggcga

SEQ ID NO: 3811023 - RNA, 16 nt, Salmonella typhimurium LT2
acgccggaugacacau

SEQ ID NO: 3811024 - RNA, 14 nt, Salmonella typhimurium LT2
acgccggaugcgag

SEQ ID NO: 3811025 - RNA, 15 nt, Salmonella typhimurium LT2
acgccggcaucauca

SEQ ID NO: 3811026 - RNA, 14 nt, Salmonella typhimurium LT2
acgccgggccugcc

SEQ ID NO: 3811027 - RNA, 21 nt, Salmonella typhimurium LT2
acgccggggauaucaaugcgc

SEQ ID NO: 3811028 - RNA, 22 nt, Salmonella typhimurium LT2
acgccggggauaucaaugcgcg

SEQ ID NO: 3811029 - RNA, 16 nt, Salmonella typhimurium LT2
acgccgguacgcagca

SEQ ID NO: 3811030 - RNA, 21 nt, Salmonella typhimurium LT2
acgccgguacgggcagcggcu

SEQ ID NO: 3811031 - RNA, 19 nt, Salmonella typhimurium LT2
acgccggucaggauacagc

SEQ ID NO: 3811032 - RNA, 23 nt, Salmonella typhimurium LT2
acgccggucaggauacagccgac

SEQ ID NO: 3811033 - RNA, 21 nt, Salmonella typhimurium LT2
acgucaguacguagccgcaaa

SEQ ID NO: 3811034 - RNA, 17 nt, Salmonella typhimurium LT2
acgucaguggaaaacag

SEQ ID NO: 3811035 - RNA, 19 nt, Salmonella typhimurium LT2
acgucaguggaaaacagca

SEQ ID NO: 3811036 - RNA, 15 nt, Salmonella typhimurium LT2
acgucauaucaucca

SEQ ID NO: 3811037 - RNA, 14 nt, Salmonella typhimurium LT2
acgucaucaccagu

SEQ ID NO: 3811038 - RNA, 23 nt, Salmonella typhimurium LT2
acgucaugccuuuuuuaccaauu

SEQ ID NO: 3811039 - RNA, 16 nt, Salmonella typhimurium LT2
acgucauuuuuucaau

SEQ ID NO: 3811040 - RNA, 13 nt, Salmonella typhimurium LT2
acguccaccguua

SEQ ID NO: 3811041 - RNA, 21 nt, Salmonella typhimurium LT2
acguccauaccgguugcgcgc

SEQ ID NO: 3811042 - RNA, 19 nt, Salmonella typhimurium LT2
acguccauccggguaauuu

SEQ ID NO: 3811043 - RNA, 14 nt, Salmonella typhimurium LT2
acguccguuagcug

SEQ ID NO: 3811044 - RNA, 22 nt, Salmonella typhimurium LT2
acgucgacgccuuucuucacga

SEQ ID NO: 3811045 - RNA, 18 nt, Salmonella typhimurium LT2
acgucgccuuccugcagg

SEQ ID NO: 3811046 - RNA, 17 nt, Salmonella typhimurium LT2
acgucgcgaagcugugc

SEQ ID NO: 3811047 - RNA, 14 nt, Salmonella typhimurium LT2
acgucgcgaaucgu

SEQ ID NO: 3811048 - RNA, 21 nt, Salmonella typhimurium LT2
acgucggugaaaaugaaaaau

SEQ ID NO: 3811049 - RNA, 15 nt, Salmonella typhimurium LT2
acgucgucaccacgg

SEQ ID NO: 3811050 - RNA, 13 nt, Salmonella typhimurium LT2
acgucugaagaag

SEQ ID NO: 3811051 - RNA, 20 nt, Salmonella typhimurium LT2
acgucuggaaacccgcucgc

SEQ ID NO: 3811052 - RNA, 17 nt, Salmonella typhimurium LT2
acgucugucagaacccu

SEQ ID NO: 3811053 - RNA, 18 nt, Salmonella typhimurium LT2
acgucuuuuuccagcagc

SEQ ID NO: 3811054 - RNA, 21 nt, Salmonella typhimurium LT2
acgugaaacugauaguuuaaa

SEQ ID NO: 3811055 - RNA, 19 nt, Salmonella typhimurium LT2
acgugaauuaauggucaga

SEQ ID NO: 3811056 - RNA, 16 nt, Salmonella typhimurium LT2
acgugaccaaaccugc

SEQ ID NO: 3811057 - RNA, 14 nt, Salmonella typhimurium LT2
acgugacgcgccag

SEQ ID NO: 3811058 - RNA, 17 nt, Salmonella typhimurium LT2
acgugacgcgccagcgg

SEQ ID NO: 3811059 - RNA, 16 nt, Salmonella typhimurium LT2
acgugagguuugacuc

SEQ ID NO: 3811060 - RNA, 18 nt, Salmonella typhimurium LT2
acgugccagaaacaagaa

SEQ ID NO: 3811061 - RNA, 20 nt, Salmonella typhimurium LT2
acgugcgguauaucacgcca

SEQ ID NO: 3811062 - RNA, 21 nt, Salmonella typhimurium LT2
acgugcucaaucgccugccgu

SEQ ID NO: 3811063 - RNA, 17 nt, Salmonella typhimurium LT2
acgugcuccagcgccug

SEQ ID NO: 3811064 - RNA, 19 nt, Salmonella typhimurium LT2
acguggccagcaugcccgc

SEQ ID NO: 3811065 - RNA, 20 nt, Salmonella typhimurium LT2
acguggcgcgaauuuucgau

SEQ ID NO: 3811066 - RNA, 21 nt, Salmonella typhimurium LT2
acgugggcuacggcucccucg

SEQ ID NO: 3811067 - RNA, 20 nt, Salmonella typhimurium LT2
acguggggguucaagucccc

SEQ ID NO: 3811068 - RNA, 19 nt, Salmonella typhimurium LT2
acgugugcugcgucaacgc

SEQ ID NO: 3811069 - RNA, 16 nt, Salmonella typhimurium LT2
acguguuaugcgccug

SEQ ID NO: 3811070 - RNA, 16 nt, Salmonella typhimurium LT2
acguguuuauccccgc

SEQ ID NO: 3811071 - RNA, 18 nt, Salmonella typhimurium LT2
acguguuuauccccgcug

SEQ ID NO: 3811072 - RNA, 16 nt, Salmonella typhimurium LT2
acguuaaagccgacca

SEQ ID NO: 3811073 - RNA, 21 nt, Salmonella typhimurium LT2
acguuaaagccgaccaucgcg

SEQ ID NO: 3811074 - RNA, 16 nt, Salmonella typhimurium LT2
acguuaacgccgcauu

SEQ ID NO: 3811075 - RNA, 15 nt, Salmonella typhimurium LT2
acguuacgcaucugc

SEQ ID NO: 3811076 - RNA, 17 nt, Salmonella typhimurium LT2
acguuacuugauggaaa

SEQ ID NO: 3811077 - RNA, 14 nt, Salmonella typhimurium LT2
acguuauucuccag

SEQ ID NO: 3811078 - RNA, 20 nt, Salmonella typhimurium LT2
acguucaauucauagagcgc

SEQ ID NO: 3811079 - RNA, 17 nt, Salmonella typhimurium LT2
acguucagcauauccag

SEQ ID NO: 3811080 - RNA, 20 nt, Salmonella typhimurium LT2
acguucagcauauccagcgc

SEQ ID NO: 3811081 - RNA, 14 nt, Salmonella typhimurium LT2
acguucaucauuuu

SEQ ID NO: 3811082 - RNA, 21 nt, Salmonella typhimurium LT2
acguucaucauuuucccacug

SEQ ID NO: 3811083 - RNA, 15 nt, Salmonella typhimurium LT2
acguuccaacguuuc

SEQ ID NO: 3811084 - RNA, 15 nt, Salmonella typhimurium LT2
acguuccagcagcgc

SEQ ID NO: 3811085 - RNA, 21 nt, Salmonella typhimurium LT2
acguucccggggauuugcugc

SEQ ID NO: 3811086 - RNA, 22 nt, Salmonella typhimurium LT2
acguucccggggauuugcugcg

SEQ ID NO: 3811087 - RNA, 12 nt, Salmonella typhimurium LT2
acguucgcgcau

SEQ ID NO: 3811088 - RNA, 19 nt, Salmonella typhimurium LT2
acguucggguagcuggaga

SEQ ID NO: 3811089 - RNA, 21 nt, Salmonella typhimurium LT2
acguucuaucagguaucccgc

SEQ ID NO: 3811090 - RNA, 19 nt, Salmonella typhimurium LT2
acguucuucgauaaaggga

SEQ ID NO: 3811091 - RNA, 14 nt, Salmonella typhimurium LT2
acguucuucuccca

SEQ ID NO: 3811092 - RNA, 17 nt, Salmonella typhimurium LT2
acguugaugauaaauug

SEQ ID NO: 3811093 - RNA, 22 nt, Salmonella typhimurium LT2
acguugaugauaaauugcggca

SEQ ID NO: 3811094 - RNA, 13 nt, Salmonella typhimurium LT2
acguugcgccaug

SEQ ID NO: 3811095 - RNA, 23 nt, Salmonella typhimurium LT2
acguugcggacuucggggauuuc

SEQ ID NO: 3811096 - RNA, 23 nt, Salmonella typhimurium LT2
acguugcggcgcguucagcaucg

SEQ ID NO: 3811097 - RNA, 20 nt, Salmonella typhimurium LT2
acguugggauuaucgcggau

SEQ ID NO: 3811098 - RNA, 19 nt, Salmonella typhimurium LT2
acguuggggauaaccagaa

SEQ ID NO: 3811099 - RNA, 17 nt, Salmonella typhimurium LT2
acguugugauaaaucgu

SEQ ID NO: 3811100 - RNA, 13 nt, Salmonella typhimurium LT2
acguuuacgccgc

SEQ ID NO: 3811101 - RNA, 23 nt, Salmonella typhimurium LT2
acguuuccggaaugagaugcacg

SEQ ID NO: 3811102 - RNA, 17 nt, Salmonella typhimurium LT2
acguuucuuucaucaga

SEQ ID NO: 3811103 - RNA, 18 nt, Salmonella typhimurium LT2
acguuuugcagcgccauc

SEQ ID NO: 3811104 - RNA, 17 nt, Salmonella typhimurium LT2
acguuuuuacucuuguu

SEQ ID NO: 3811105 - RNA, 19 nt, Salmonella typhimurium LT2
acguuuuucagccgcgcau

SEQ ID NO: 3811106 - RNA, 19 nt, Salmonella typhimurium LT2
acguuuuuuacgucagcaa

SEQ ID NO: 3811107 - RNA, 15 nt, Salmonella typhimurium LT2
acuaaaguuuauuua

SEQ ID NO: 3811108 - RNA, 15 nt, Salmonella typhimurium LT2
acuaacgaggccacc

SEQ ID NO: 3811109 - RNA, 19 nt, Salmonella typhimurium LT2
acuaacgaggccaccauca

SEQ ID NO: 3811110 - RNA, 11 nt, Salmonella typhimurium LT2
acuaacugccg

SEQ ID NO: 3811111 - RNA, 16 nt, Salmonella typhimurium LT2
acuaagaccagcauca

SEQ ID NO: 3811112 - RNA, 20 nt, Salmonella typhimurium LT2
acuaagaccagcaucagaau

SEQ ID NO: 3811113 - RNA, 22 nt, Salmonella typhimurium LT2
acuaaguucucguucaacggca

SEQ ID NO: 3811114 - RNA, 22 nt, Salmonella typhimurium LT2
acuaauccaguccucgcccacu

SEQ ID NO: 3811115 - RNA, 17 nt, Salmonella typhimurium LT2
acuaauccccauuuuuu

SEQ ID NO: 3811116 - RNA, 21 nt, Salmonella typhimurium LT2
acuaaucugucgcuaaagcac

SEQ ID NO: 3811117 - RNA, 16 nt, Salmonella typhimurium LT2
acuaaugccuggcagu

SEQ ID NO: 3811118 - RNA, 13 nt, Salmonella typhimurium LT2
acuaauuuaagcg

SEQ ID NO: 3811119 - RNA, 21 nt, Salmonella typhimurium LT2
acuaauuuaagcgauucuaaa

SEQ ID NO: 3811120 - RNA, 21 nt, Salmonella typhimurium LT2
acuacaugccaacuuuacuua

SEQ ID NO: 3811121 - RNA, 18 nt, Salmonella typhimurium LT2
acuaccagaaacaacacg

SEQ ID NO: 3811122 - RNA, 15 nt, Salmonella typhimurium LT2
acuaccagacacagu

SEQ ID NO: 3811123 - RNA, 16 nt, Salmonella typhimurium LT2
acuaccggcaccagca

SEQ ID NO: 3811124 - RNA, 22 nt, Salmonella typhimurium LT2
acuacggguucuuguguugaaa

SEQ ID NO: 3811125 - RNA, 21 nt, Salmonella typhimurium LT2
acuacgguaaaccaggccagc

SEQ ID NO: 3811126 - RNA, 16 nt, Salmonella typhimurium LT2
acuacggugugccugc

SEQ ID NO: 3811127 - RNA, 18 nt, Salmonella typhimurium LT2
acuacggugugccugcgc

SEQ ID NO: 3811128 - RNA, 21 nt, Salmonella typhimurium LT2
acuacgguugccuuucgccag

SEQ ID NO: 3811129 - RNA, 17 nt, Salmonella typhimurium LT2
acuacguucaucaggca

SEQ ID NO: 3811130 - RNA, 13 nt, Salmonella typhimurium LT2
acuacuaaauccu

SEQ ID NO: 3811131 - RNA, 18 nt, Salmonella typhimurium LT2
acuacuaaauccuugagu

SEQ ID NO: 3811132 - RNA, 12 nt, Salmonella typhimurium LT2
acuacugaaaag

SEQ ID NO: 3811133 - RNA, 22 nt, Salmonella typhimurium LT2
acuacuucuucaguuccgccag

SEQ ID NO: 3811134 - RNA, 15 nt, Salmonella typhimurium LT2
acuacuuuuuuguag

SEQ ID NO: 3811135 - RNA, 14 nt, Salmonella typhimurium LT2
acuagcaaaacaua

SEQ ID NO: 3811136 - RNA, 17 nt, Salmonella typhimurium LT2
acucuuccgcaaucaca

SEQ ID NO: 3811137 - RNA, 22 nt, Salmonella typhimurium LT2
acucuucgacacauuucagcgc

SEQ ID NO: 3811138 - RNA, 19 nt, Salmonella typhimurium LT2
acucuuuacccagcgggug

SEQ ID NO: 3811139 - RNA, 22 nt, Salmonella typhimurium LT2
acucuuucuugaauauggcggu

SEQ ID NO: 3811140 - RNA, 17 nt, Salmonella typhimurium LT2
acucuuuggacggcauc

SEQ ID NO: 3811141 - RNA, 16 nt, Salmonella typhimurium LT2
acucuuuuuccgcgag

SEQ ID NO: 3811142 - RNA, 22 nt, Salmonella typhimurium LT2
acugaaaaaagcgaucaccucu

SEQ ID NO: 3811143 - RNA, 13 nt, Salmonella typhimurium LT2
acugaaaaucaaa

SEQ ID NO: 3811144 - RNA, 11 nt, Salmonella typhimurium LT2
acugaacccgg

SEQ ID NO: 3811145 - RNA, 16 nt, Salmonella typhimurium LT2
acugaacuauaggaaa

SEQ ID NO: 3811146 - RNA, 11 nt, Salmonella typhimurium LT2
acugaacugcg

SEQ ID NO: 3811147 - RNA, 13 nt, Salmonella typhimurium LT2
acugaagauaaac

SEQ ID NO: 3811148 - RNA, 21 nt, Salmonella typhimurium LT2
acugaagauaaacagcagcgc

SEQ ID NO: 3811149 - RNA, 18 nt, Salmonella typhimurium LT2
acugaagcauacccuucc

SEQ ID NO: 3811150 - RNA, 12 nt, Salmonella typhimurium LT2
acugaauaccuu

SEQ ID NO: 3811151 - RNA, 15 nt, Salmonella typhimurium LT2
acugaaugccauccc

SEQ ID NO: 3811152 - RNA, 17 nt, Salmonella typhimurium LT2
acugacacgccaguuca

SEQ ID NO: 3811153 - RNA, 16 nt, Salmonella typhimurium LT2
acugacagcagugaca

SEQ ID NO: 3811154 - RNA, 17 nt, Salmonella typhimurium LT2
acugacagcagugacau

SEQ ID NO: 3811155 - RNA, 18 nt, Salmonella typhimurium LT2
acugacguugcgaaucag

SEQ ID NO: 3811156 - RNA, 23 nt, Salmonella typhimurium LT2
acugacguugcgaaucagguaca

SEQ ID NO: 3811157 - RNA, 21 nt, Salmonella typhimurium LT2
acugacuauccacagcgaauu

SEQ ID NO: 3811158 - RNA, 15 nt, Salmonella typhimurium LT2
acugacugcugucau

SEQ ID NO: 3811159 - RNA, 20 nt, Salmonella typhimurium LT2
acugacuuaauaacagcggc

SEQ ID NO: 3811160 - RNA, 17 nt, Salmonella typhimurium LT2
acugacuucaucaaaua

SEQ ID NO: 3811161 - RNA, 12 nt, Salmonella typhimurium LT2
acugagcgaauc

SEQ ID NO: 3811162 - RNA, 15 nt, Salmonella typhimurium LT2
acugagugugucuuu

SEQ ID NO: 3811163 - RNA, 22 nt, Salmonella typhimurium LT2
acugagugugucuuuuacgcca

SEQ ID NO: 3811164 - RNA, 17 nt, Salmonella typhimurium LT2
acugaguuucaccgcca

SEQ ID NO: 3811165 - RNA, 22 nt, Salmonella typhimurium LT2
acugaguuucaccgccagagca

SEQ ID NO: 3811166 - RNA, 18 nt, Salmonella typhimurium LT2
acugauaagggccuucau

SEQ ID NO: 3811167 - RNA, 22 nt, Salmonella typhimurium LT2
acugauaccccagcgaucccaa

SEQ ID NO: 3811168 - RNA, 19 nt, Salmonella typhimurium LT2
acugauacuggauaaccgc

SEQ ID NO: 3811169 - RNA, 17 nt, Salmonella typhimurium LT2
acugauagcgaggcagc

SEQ ID NO: 3811170 - RNA, 19 nt, Salmonella typhimurium LT2
acugauaguccaucaccuc

SEQ ID NO: 3811171 - RNA, 22 nt, Salmonella typhimurium LT2
acugauaguuuaaauccagcgc

SEQ ID NO: 3811172 - RNA, 23 nt, Salmonella typhimurium LT2
acugauaucuaugguaauuuaaa

SEQ ID NO: 3811173 - RNA, 19 nt, Salmonella typhimurium LT2
acugaucaguuugccuuua

SEQ ID NO: 3811174 - RNA, 21 nt, Salmonella typhimurium LT2
acugaucgccgcugcuggcga

SEQ ID NO: 3811175 - RNA, 20 nt, Salmonella typhimurium LT2
acugaucgcuggugcccggu

SEQ ID NO: 3811176 - RNA, 21 nt, Salmonella typhimurium LT2
acugauggaguuucaucagca

SEQ ID NO: 3811177 - RNA, 22 nt, Salmonella typhimurium LT2
acugauggaguuucaucagcac

SEQ ID NO: 3811178 - RNA, 21 nt, Salmonella typhimurium LT2
acugauggcgcuaagccagcc

SEQ ID NO: 3811179 - RNA, 15 nt, Salmonella typhimurium LT2
acugaugugacauuu

SEQ ID NO: 3811180 - RNA, 17 nt, Salmonella typhimurium LT2
acugauuaaucugccga

SEQ ID NO: 3811181 - RNA, 21 nt, Salmonella typhimurium LT2
acugauucaaaaggugagaaa

SEQ ID NO: 3811182 - RNA, 21 nt, Salmonella typhimurium LT2
acugcaaaggagguucaucau

SEQ ID NO: 3811183 - RNA, 19 nt, Salmonella typhimurium LT2
acugcaaauaccacaucag

SEQ ID NO: 3811184 - RNA, 18 nt, Salmonella typhimurium LT2
acugcaaccgacgaacaa

SEQ ID NO: 3811185 - RNA, 16 nt, Salmonella typhimurium LT2
acugcauaauggcgac

SEQ ID NO: 3811186 - RNA, 15 nt, Salmonella typhimurium LT2
acugcaucucuucca

SEQ ID NO: 3811187 - RNA, 13 nt, Salmonella typhimurium LT2
acugccaaaccac

SEQ ID NO: 3811188 - RNA, 20 nt, Salmonella typhimurium LT2
acugccacgagccuucuggc

SEQ ID NO: 3811189 - RNA, 21 nt, Salmonella typhimurium LT2
acugccagggccaaucagaau

SEQ ID NO: 3811190 - RNA, 22 nt, Salmonella typhimurium LT2
acugcccaaauaaaagccgcca

SEQ ID NO: 3811191 - RNA, 12 nt, Salmonella typhimurium LT2
acugcccggcau

SEQ ID NO: 3811192 - RNA, 15 nt, Salmonella typhimurium LT2
acugccgcagccgcu

SEQ ID NO: 3811193 - RNA, 21 nt, Salmonella typhimurium LT2
acugccgcagccgcucagggu

SEQ ID NO: 3811194 - RNA, 15 nt, Salmonella typhimurium LT2
acugccgcccaucgc

SEQ ID NO: 3811195 - RNA, 18 nt, Salmonella typhimurium LT2
acugccgccgucaucugc

SEQ ID NO: 3811196 - RNA, 16 nt, Salmonella typhimurium LT2
acugcgccauguucau

SEQ ID NO: 3811197 - RNA, 11 nt, Salmonella typhimurium LT2
acugcgccauu

SEQ ID NO: 3811198 - RNA, 18 nt, Salmonella typhimurium LT2
acugcgccgccagcgaca

SEQ ID NO: 3811199 - RNA, 23 nt, Salmonella typhimurium LT2
acugcgcgauaucugccgcgcca

SEQ ID NO: 3811200 - RNA, 15 nt, Salmonella typhimurium LT2
acugcgcguggcaaa

SEQ ID NO: 3811201 - RNA, 20 nt, Salmonella typhimurium LT2
acugcggaacgccccucggu

SEQ ID NO: 3811202 - RNA, 19 nt, Salmonella typhimurium LT2
acugcggagguuucuuuuu

SEQ ID NO: 3811203 - RNA, 12 nt, Salmonella typhimurium LT2
acugcggcauua

SEQ ID NO: 3811204 - RNA, 14 nt, Salmonella typhimurium LT2
acugcgugcuggcg

SEQ ID NO: 3811205 - RNA, 19 nt, Salmonella typhimurium LT2
acugcucauaacccuccug

SEQ ID NO: 3811206 - RNA, 22 nt, Salmonella typhimurium LT2
acugcucuaccaacugagcuaa

SEQ ID NO: 3811207 - RNA, 18 nt, Salmonella typhimurium LT2
acugcugacaaucagcac

SEQ ID NO: 3811208 - RNA, 17 nt, Salmonella typhimurium LT2
acugcugcccuggaacc

SEQ ID NO: 3811209 - RNA, 18 nt, Salmonella typhimurium LT2
acugcugcccuggaaccu

SEQ ID NO: 3811210 - RNA, 23 nt, Salmonella typhimurium LT2
acugcuguguccaggucaucacc

SEQ ID NO: 3811211 - RNA, 18 nt, Salmonella typhimurium LT2
acugcuuagcucaucagc

SEQ ID NO: 3811212 - RNA, 20 nt, Salmonella typhimurium LT2
acugcuuccccaauugcugc

SEQ ID NO: 3811213 - RNA, 23 nt, Salmonella typhimurium LT2
acugcuuuuccggcagcgcauaa

SEQ ID NO: 3811214 - RNA, 19 nt, Salmonella typhimurium LT2
acuggaaaagcgacauucc

SEQ ID NO: 3811215 - RNA, 15 nt, Salmonella typhimurium LT2
acuggaaacagccaa

SEQ ID NO: 3811216 - RNA, 20 nt, Salmonella typhimurium LT2
acuggaaggcuucggucaga

SEQ ID NO: 3811217 - RNA, 15 nt, Salmonella typhimurium LT2
acuggaauucguuac

SEQ ID NO: 3811218 - RNA, 15 nt, Salmonella typhimurium LT2
acuggaucacuuuug

SEQ ID NO: 3811219 - RNA, 12 nt, Salmonella typhimurium LT2
acuggauuaucg

SEQ ID NO: 3811220 - RNA, 22 nt, Salmonella typhimurium LT2
acuggcagccucguccugcaau

SEQ ID NO: 3811221 - RNA, 19 nt, Salmonella typhimurium LT2
acuggcagcgccugacggc

SEQ ID NO: 3811222 - RNA, 15 nt, Salmonella typhimurium LT2
acuggcauugugagc

SEQ ID NO: 3811223 - RNA, 16 nt, Salmonella typhimurium LT2
acuggcccccuguucc

SEQ ID NO: 3811224 - RNA, 20 nt, Salmonella typhimurium LT2
acuggccguuuucccggcaa

SEQ ID NO: 3811225 - RNA, 17 nt, Salmonella typhimurium LT2
acuggcgacagccgcgu

SEQ ID NO: 3811226 - RNA, 21 nt, Salmonella typhimurium LT2
acuggcgccuuuuggcagcag

SEQ ID NO: 3811227 - RNA, 14 nt, Salmonella typhimurium LT2
acuggcggcgggca

SEQ ID NO: 3811228 - RNA, 18 nt, Salmonella typhimurium LT2
acuggcuuuccugaucaa

SEQ ID NO: 3811229 - RNA, 21 nt, Salmonella typhimurium LT2
acuggcuuuccugaucaauca

SEQ ID NO: 3811230 - RNA, 16 nt, Salmonella typhimurium LT2
acugggcgaagguggc

SEQ ID NO: 3811231 - RNA, 20 nt, Salmonella typhimurium LT2
acuggguaaggcgcuugccu

SEQ ID NO: 3811232 - RNA, 19 nt, Salmonella typhimurium LT2
acugggucaaaaauuguug

SEQ ID NO: 3811233 - RNA, 21 nt, Salmonella typhimurium LT2
acugguaaugucauccagcga

SEQ ID NO: 3811234 - RNA, 16 nt, Salmonella typhimurium LT2
acuggugacaucgcca

SEQ ID NO: 3811235 - RNA, 20 nt, Salmonella typhimurium LT2
acuggugcccgcaaaaccuu

SEQ ID NO: 3811236 - RNA, 21 nt, Salmonella typhimurium LT2
acugguggcaagauaagccgu

SEQ ID NO: 3811237 - RNA, 23 nt, Salmonella typhimurium LT2
acuguaaaucugccgucaucgac

SEQ ID NO: 3811238 - RNA, 18 nt, Salmonella typhimurium LT2
acuguacgcgggaaauac

SEQ ID NO: 3811239 - RNA, 20 nt, Salmonella typhimurium LT2
acuuugauuuaauucgauaa

SEQ ID NO: 3811240 - RNA, 16 nt, Salmonella typhimurium LT2
acuuugccaugaauaa

SEQ ID NO: 3811241 - RNA, 19 nt, Salmonella typhimurium LT2
acuuugcccuuuuugcauu

SEQ ID NO: 3811242 - RNA, 14 nt, Salmonella typhimurium LT2
acuuugcgaaaaag

SEQ ID NO: 3811243 - RNA, 16 nt, Salmonella typhimurium LT2
acuuugcgcuccugcu

SEQ ID NO: 3811244 - RNA, 20 nt, Salmonella typhimurium LT2
acuuugcgguuacguucggc

SEQ ID NO: 3811245 - RNA, 17 nt, Salmonella typhimurium LT2
acuuugcuuuucugcuu

SEQ ID NO: 3811246 - RNA, 17 nt, Salmonella typhimurium LT2
acuuuuaaauugaagag

SEQ ID NO: 3811247 - RNA, 21 nt, Salmonella typhimurium LT2
acuuuuccacuaacuggcaau

SEQ ID NO: 3811248 - RNA, 13 nt, Salmonella typhimurium LT2
acuuuuccggcac

SEQ ID NO: 3811249 - RNA, 15 nt, Salmonella typhimurium LT2
acuuuuccuuccgcc

SEQ ID NO: 3811250 - RNA, 22 nt, Salmonella typhimurium LT2
acuuuucugcguccugcuuaug

SEQ ID NO: 3811251 - RNA, 18 nt, Salmonella typhimurium LT2
acuuuucuuuccugcaaa

SEQ ID NO: 3811252 - RNA, 23 nt, Salmonella typhimurium LT2
acuuuugaacauaaagucagaca

SEQ ID NO: 3811253 - RNA, 20 nt, Salmonella typhimurium LT2
acuuuugccaggcggauaaa

SEQ ID NO: 3811254 - RNA, 21 nt, Salmonella typhimurium LT2
acuuuuggcacgacuuuuccu

SEQ ID NO: 3811255 - RNA, 18 nt, Salmonella typhimurium LT2
acuuuuugaucuaaaaau

SEQ ID NO: 3811256 - RNA, 19 nt, Salmonella typhimurium LT2
acuuuuugaucuaaaaauu

SEQ ID NO: 3811257 - RNA, 22 nt, Salmonella typhimurium LT2
acuuuuuggcuguugguaugca

SEQ ID NO: 3811258 - RNA, 16 nt, Salmonella typhimurium LT2
acuuuuuuauggccaa

SEQ ID NO: 3811259 - RNA, 19 nt, Salmonella typhimurium LT2
acuuuuuucaaauccagcu

SEQ ID NO: 3811260 - RNA, 18 nt, Salmonella typhimurium LT2
agaaaaaacucaggaaau

SEQ ID NO: 3811261 - RNA, 17 nt, Salmonella typhimurium LT2
agaaaaacaucauggcu

SEQ ID NO: 3811262 - RNA, 19 nt, Salmonella typhimurium LT2
agaaaaagaagaaaaaauu

SEQ ID NO: 3811263 - RNA, 15 nt, Salmonella typhimurium LT2
agaaaaagucauuuu

SEQ ID NO: 3811264 - RNA, 23 nt, Salmonella typhimurium LT2
agaaaacagcaugguguuaguuu

SEQ ID NO: 3811265 - RNA, 23 nt, Salmonella typhimurium LT2
agaaaacagugauuacaaaaugu

SEQ ID NO: 3811266 - RNA, 16 nt, Salmonella typhimurium LT2
agaaaaccccguacag

SEQ ID NO: 3811267 - RNA, 19 nt, Salmonella typhimurium LT2
agaaaaccgacagcaauau

SEQ ID NO: 3811268 - RNA, 13 nt, Salmonella typhimurium LT2
agaaaacugccag

SEQ ID NO: 3811269 - RNA, 16 nt, Salmonella typhimurium LT2
agaaaagcgaaaauaa

SEQ ID NO: 3811270 - RNA, 19 nt, Salmonella typhimurium LT2
agaaaaggaagaauaaaua

SEQ ID NO: 3811271 - RNA, 15 nt, Salmonella typhimurium LT2
agaaaaggaauaccu

SEQ ID NO: 3811272 - RNA, 21 nt, Salmonella typhimurium LT2
agaaaaugcucaguauggcca

SEQ ID NO: 3811273 - RNA, 22 nt, Salmonella typhimurium LT2
agaaaauuacgcccaucagucc

SEQ ID NO: 3811274 - RNA, 19 nt, Salmonella typhimurium LT2
agaaacaacaccguaaaag

SEQ ID NO: 3811275 - RNA, 13 nt, Salmonella typhimurium LT2
agaaacaacacga

SEQ ID NO: 3811276 - RNA, 17 nt, Salmonella typhimurium LT2
agaaaccgcagaaaaag

SEQ ID NO: 3811277 - RNA, 14 nt, Salmonella typhimurium LT2
agaaacgcugaucu

SEQ ID NO: 3811278 - RNA, 14 nt, Salmonella typhimurium LT2
agaaacugcuguag

SEQ ID NO: 3811279 - RNA, 22 nt, Salmonella typhimurium LT2
agaaagauaaaauacgugcgga

SEQ ID NO: 3811280 - RNA, 13 nt, Salmonella typhimurium LT2
agaaagcggcuua

SEQ ID NO: 3811281 - RNA, 23 nt, Salmonella typhimurium LT2
agaaagucuuuuguuuuucucuu

SEQ ID NO: 3811282 - RNA, 22 nt, Salmonella typhimurium LT2
agaaauaaaauacgcucaauau

SEQ ID NO: 3811283 - RNA, 22 nt, Salmonella typhimurium LT2
agaaauaacucccuauaaugcg

SEQ ID NO: 3811284 - RNA, 20 nt, Salmonella typhimurium LT2
agaaauacccuucacgguca

SEQ ID NO: 3811285 - RNA, 14 nt, Salmonella typhimurium LT2
agaaauagaaaaau

SEQ ID NO: 3811286 - RNA, 23 nt, Salmonella typhimurium LT2
agaaauagacgagcgaaaaacug

SEQ ID NO: 3811287 - RNA, 13 nt, Salmonella typhimurium LT2
agaaauagcgcgc

SEQ ID NO: 3811288 - RNA, 19 nt, Salmonella typhimurium LT2
agaaaucaacgaaaucaga

SEQ ID NO: 3811289 - RNA, 14 nt, Salmonella typhimurium LT2
agaaaucaacguga

SEQ ID NO: 3811290 - RNA, 13 nt, Salmonella typhimurium LT2
agaaaucagcagg

SEQ ID NO: 3811291 - RNA, 13 nt, Salmonella typhimurium LT2
agaaauccacauu

SEQ ID NO: 3811292 - RNA, 14 nt, Salmonella typhimurium LT2
agaaaucccacauu

SEQ ID NO: 3811293 - RNA, 15 nt, Salmonella typhimurium LT2
agaaauccgcgaaua

SEQ ID NO: 3811294 - RNA, 23 nt, Salmonella typhimurium LT2
agaaaucgccgggcuauccggcu

SEQ ID NO: 3811295 - RNA, 22 nt, Salmonella typhimurium LT2
agaaaucucaucugcaaaauau

SEQ ID NO: 3811296 - RNA, 23 nt, Salmonella typhimurium LT2
agaaauuuaggucaaaaaagcga

SEQ ID NO: 3811297 - RNA, 17 nt, Salmonella typhimurium LT2
agaacagggggcgcauc

SEQ ID NO: 3811298 - RNA, 22 nt, Salmonella typhimurium LT2
agaaccaacgucaucaugaaaa

SEQ ID NO: 3811299 - RNA, 21 nt, Salmonella typhimurium LT2
agaacccacuuugcuuuucug

SEQ ID NO: 3811300 - RNA, 19 nt, Salmonella typhimurium LT2
agaaccguugcgcccauca

SEQ ID NO: 3811301 - RNA, 22 nt, Salmonella typhimurium LT2
agaaccguugcgcccaucauca

SEQ ID NO: 3811302 - RNA, 13 nt, Salmonella typhimurium LT2
agaacgaauuuac

SEQ ID NO: 3811303 - RNA, 21 nt, Salmonella typhimurium LT2
agaacgacgcauaaaaaauga

SEQ ID NO: 3811304 - RNA, 13 nt, Salmonella typhimurium LT2
agaacgccgggcc

SEQ ID NO: 3811305 - RNA, 14 nt, Salmonella typhimurium LT2
agaacgguuuaucc

SEQ ID NO: 3811306 - RNA, 14 nt, Salmonella typhimurium LT2
agaacuauuugccu

SEQ ID NO: 3811307 - RNA, 12 nt, Salmonella typhimurium LT2
agaacucaucuu

SEQ ID NO: 3811308 - RNA, 22 nt, Salmonella typhimurium LT2
agaacugcaaauaccacaucag

SEQ ID NO: 3811309 - RNA, 16 nt, Salmonella typhimurium LT2
agaacuuccaacuaaa

SEQ ID NO: 3811310 - RNA, 17 nt, Salmonella typhimurium LT2
agaacuuguaaaaaugc

SEQ ID NO: 3811311 - RNA, 20 nt, Salmonella typhimurium LT2
agaagaaaccgcagaaaaag

SEQ ID NO: 3811312 - RNA, 19 nt, Salmonella typhimurium LT2
agaagagaauggccagcac

SEQ ID NO: 3811313 - RNA, 16 nt, Salmonella typhimurium LT2
agaagaucgccggaau

SEQ ID NO: 3811314 - RNA, 23 nt, Salmonella typhimurium LT2
agaagaucgccggaauagcaggc

SEQ ID NO: 3811315 - RNA, 15 nt, Salmonella typhimurium LT2
agaagauuucuuaau

SEQ ID NO: 3811316 - RNA, 15 nt, Salmonella typhimurium LT2
agaagcacaucgggc

SEQ ID NO: 3811317 - RNA, 13 nt, Salmonella typhimurium LT2
agaagccaucaaa

SEQ ID NO: 3811318 - RNA, 15 nt, Salmonella typhimurium LT2
agaagcccggccaca

SEQ ID NO: 3811319 - RNA, 19 nt, Salmonella typhimurium LT2
agaagcccggcggcgcauc

SEQ ID NO: 3811320 - RNA, 17 nt, Salmonella typhimurium LT2
agaagccgucgauaaaa

SEQ ID NO: 3811321 - RNA, 22 nt, Salmonella typhimurium LT2
agaagcucaugugcagcaucca

SEQ ID NO: 3811322 - RNA, 13 nt, Salmonella typhimurium LT2
agaagcuuaccac

SEQ ID NO: 3811323 - RNA, 16 nt, Salmonella typhimurium LT2
agaaggcgaacauaag

SEQ ID NO: 3811324 - RNA, 16 nt, Salmonella typhimurium LT2
agaaggcgaguuucgc

SEQ ID NO: 3811325 - RNA, 12 nt, Salmonella typhimurium LT2
agaaggguuuug

SEQ ID NO: 3811326 - RNA, 13 nt, Salmonella typhimurium LT2
agaaggguuuugc

SEQ ID NO: 3811327 - RNA, 20 nt, Salmonella typhimurium LT2
agaagguuauucgccuuuca

SEQ ID NO: 3811328 - RNA, 16 nt, Salmonella typhimurium LT2
agaaguagcagagaaa

SEQ ID NO: 3811329 - RNA, 14 nt, Salmonella typhimurium LT2
agaaguagcguucg

SEQ ID NO: 3811330 - RNA, 22 nt, Salmonella typhimurium LT2
agaagucugugaggaaagcgaa

SEQ ID NO: 3811331 - RNA, 23 nt, Salmonella typhimurium LT2
agaauaaaaagugcgcacucaga

SEQ ID NO: 3811332 - RNA, 14 nt, Salmonella typhimurium LT2
agaauaaaacagcu

SEQ ID NO: 3811333 - RNA, 14 nt, Salmonella typhimurium LT2
agaauaaacggcag

SEQ ID NO: 3811334 - RNA, 17 nt, Salmonella typhimurium LT2
agaauaaugcuggcgga

SEQ ID NO: 3811335 - RNA, 14 nt, Salmonella typhimurium LT2
agaauagacuggcg

SEQ ID NO: 3811336 - RNA, 16 nt, Salmonella typhimurium LT2
agaauauaggagagcg

SEQ ID NO: 3811337 - RNA, 22 nt, Salmonella typhimurium LT2
agaauauauucuuuguuuaaaa

SEQ ID NO: 3811338 - RNA, 12 nt, Salmonella typhimurium LT2
agaauaugccag

SEQ ID NO: 3811339 - RNA, 13 nt, Salmonella typhimurium LT2
agaauaugccagg

SEQ ID NO: 3811340 - RNA, 19 nt, Salmonella typhimurium LT2
agaauauucacgacaugag

SEQ ID NO: 3811341 - RNA, 12 nt, Salmonella typhimurium LT2
agaaucaccucu

SEQ ID NO: 3811342 - RNA, 12 nt, Salmonella typhimurium LT2
agaaucagaugc

SEQ ID NO: 3811343 - RNA, 14 nt, Salmonella typhimurium LT2
agacgcgcagcacc

SEQ ID NO: 3811344 - RNA, 16 nt, Salmonella typhimurium LT2
agacgcgcuagcuuca

SEQ ID NO: 3811345 - RNA, 17 nt, Salmonella typhimurium LT2
agacgcgcuagcuucag

SEQ ID NO: 3811346 - RNA, 18 nt, Salmonella typhimurium LT2
agacgcgcuagcuucagg

SEQ ID NO: 3811347 - RNA, 19 nt, Salmonella typhimurium LT2
agacgcuccgcaguaauca

SEQ ID NO: 3811348 - RNA, 18 nt, Salmonella typhimurium LT2
agacgcucgacguccagc

SEQ ID NO: 3811349 - RNA, 18 nt, Salmonella typhimurium LT2
agacgcuggcacuggcag

SEQ ID NO: 3811350 - RNA, 16 nt, Salmonella typhimurium LT2
agacgcuucauaucgc

SEQ ID NO: 3811351 - RNA, 21 nt, Salmonella typhimurium LT2
agacgcuucauaucgcccagc

SEQ ID NO: 3811352 - RNA, 13 nt, Salmonella typhimurium LT2
agacggcagcgcc

SEQ ID NO: 3811353 - RNA, 22 nt, Salmonella typhimurium LT2
agacggcggcuuaccgaaucuu

SEQ ID NO: 3811354 - RNA, 12 nt, Salmonella typhimurium LT2
agacggcugggc

SEQ ID NO: 3811355 - RNA, 19 nt, Salmonella typhimurium LT2
agacgguuucagugauaaa

SEQ ID NO: 3811356 - RNA, 19 nt, Salmonella typhimurium LT2
agacgucaaagaguuccug

SEQ ID NO: 3811357 - RNA, 13 nt, Salmonella typhimurium LT2
agacguuuaagca

SEQ ID NO: 3811358 - RNA, 16 nt, Salmonella typhimurium LT2
agacguuuacgccgcc

SEQ ID NO: 3811359 - RNA, 19 nt, Salmonella typhimurium LT2
agacguuuauaccccacca

SEQ ID NO: 3811360 - RNA, 16 nt, Salmonella typhimurium LT2
agacuaaaaagcgcgu

SEQ ID NO: 3811361 - RNA, 19 nt, Salmonella typhimurium LT2
agacuacgcaaaaaaagcc

SEQ ID NO: 3811362 - RNA, 18 nt, Salmonella typhimurium LT2
agacuauccguccucuuu

SEQ ID NO: 3811363 - RNA, 23 nt, Salmonella typhimurium LT2
agacuauccguccucuuucccuu

SEQ ID NO: 3811364 - RNA, 15 nt, Salmonella typhimurium LT2
agacuaucuucgaua

SEQ ID NO: 3811365 - RNA, 20 nt, Salmonella typhimurium LT2
agacucaacugcgggaagua

SEQ ID NO: 3811366 - RNA, 12 nt, Salmonella typhimurium LT2
agacucaggcgc

SEQ ID NO: 3811367 - RNA, 16 nt, Salmonella typhimurium LT2
agacucaggcgcaucu

SEQ ID NO: 3811368 - RNA, 21 nt, Salmonella typhimurium LT2
agacucgcgccuucgccgggu

SEQ ID NO: 3811369 - RNA, 16 nt, Salmonella typhimurium LT2
agacucgcggguuuca

SEQ ID NO: 3811370 - RNA, 14 nt, Salmonella typhimurium LT2
agacucucuuuaau

SEQ ID NO: 3811371 - RNA, 14 nt, Salmonella typhimurium LT2
agacugacaaugac

SEQ ID NO: 3811372 - RNA, 14 nt, Salmonella typhimurium LT2
agacugauaagacu

SEQ ID NO: 3811373 - RNA, 15 nt, Salmonella typhimurium LT2
agacugauauccauc

SEQ ID NO: 3811374 - RNA, 18 nt, Salmonella typhimurium LT2
agacuggcgaccgccacc

SEQ ID NO: 3811375 - RNA, 16 nt, Salmonella typhimurium LT2
agacuggucgcccgga

SEQ ID NO: 3811376 - RNA, 15 nt, Salmonella typhimurium LT2
agacuucaaugccgc

SEQ ID NO: 3811377 - RNA, 23 nt, Salmonella typhimurium LT2
agacuucacgccauuccagcugg

SEQ ID NO: 3811378 - RNA, 16 nt, Salmonella typhimurium LT2
agacuucauuuuccac

SEQ ID NO: 3811379 - RNA, 18 nt, Salmonella typhimurium LT2
agacuuugcacagucugc

SEQ ID NO: 3811380 - RNA, 14 nt, Salmonella typhimurium LT2
agacuuuuuugccg

SEQ ID NO: 3811381 - RNA, 11 nt, Salmonella typhimurium LT2
agagaaaaaaa

SEQ ID NO: 3811382 - RNA, 12 nt, Salmonella typhimurium LT2
agagaaaaaauu

SEQ ID NO: 3811383 - RNA, 21 nt, Salmonella typhimurium LT2
agagaaaaccccguacaggac

SEQ ID NO: 3811384 - RNA, 15 nt, Salmonella typhimurium LT2
agagaaacaacaccg

SEQ ID NO: 3811385 - RNA, 22 nt, Salmonella typhimurium LT2
agagaaacaacaccguaaaagg

SEQ ID NO: 3811386 - RNA, 14 nt, Salmonella typhimurium LT2
agagaaccugaaca

SEQ ID NO: 3811387 - RNA, 16 nt, Salmonella typhimurium LT2
agagaaccugaacaau

SEQ ID NO: 3811388 - RNA, 18 nt, Salmonella typhimurium LT2
agagaaccugaacaauaa

SEQ ID NO: 3811389 - RNA, 20 nt, Salmonella typhimurium LT2
agagaaccugaacaauaauc

SEQ ID NO: 3811390 - RNA, 17 nt, Salmonella typhimurium LT2
agagaagucugagcgca

SEQ ID NO: 3811391 - RNA, 17 nt, Salmonella typhimurium LT2
agagaauggccagcaca

SEQ ID NO: 3811392 - RNA, 16 nt, Salmonella typhimurium LT2
agagaauuaacagcgc

SEQ ID NO: 3811393 - RNA, 18 nt, Salmonella typhimurium LT2
agagaauuuuuagcgugc

SEQ ID NO: 3811394 - RNA, 14 nt, Salmonella typhimurium LT2
agagacgccaacgu

SEQ ID NO: 3811395 - RNA, 22 nt, Salmonella typhimurium LT2
agagacggcgacaguugauauu

SEQ ID NO: 3811396 - RNA, 15 nt, Salmonella typhimurium LT2
agagacugaaaauaa

SEQ ID NO: 3811397 - RNA, 15 nt, Salmonella typhimurium LT2
agagagaaucggguc

SEQ ID NO: 3811398 - RNA, 20 nt, Salmonella typhimurium LT2
agagagauccugagaaauca

SEQ ID NO: 3811399 - RNA, 16 nt, Salmonella typhimurium LT2
agagaguauaagcgcc

SEQ ID NO: 3811400 - RNA, 16 nt, Salmonella typhimurium LT2
agagaguugagccaga

SEQ ID NO: 3811401 - RNA, 16 nt, Salmonella typhimurium LT2
agagauaauuuuccca

SEQ ID NO: 3811402 - RNA, 19 nt, Salmonella typhimurium LT2
agagaucgaacaauuaccg

SEQ ID NO: 3811403 - RNA, 22 nt, Salmonella typhimurium LT2
agagaucgaacaauuaccgaug

SEQ ID NO: 3811404 - RNA, 14 nt, Salmonella typhimurium LT2
agagcaaaccgccg

SEQ ID NO: 3811405 - RNA, 21 nt, Salmonella typhimurium LT2
agagcaaaggaucgcaaccac

SEQ ID NO: 3811406 - RNA, 15 nt, Salmonella typhimurium LT2
agagcaguacgccaa

SEQ ID NO: 3811407 - RNA, 16 nt, Salmonella typhimurium LT2
agagcaguacgccaaa

SEQ ID NO: 3811408 - RNA, 17 nt, Salmonella typhimurium LT2
agagcaucaauggugaa

SEQ ID NO: 3811409 - RNA, 15 nt, Salmonella typhimurium LT2
agagcccucuaucca

SEQ ID NO: 3811410 - RNA, 16 nt, Salmonella typhimurium LT2
agagccuuauaggcgc

SEQ ID NO: 3811411 - RNA, 17 nt, Salmonella typhimurium LT2
agagcgaaugcgcgcca

SEQ ID NO: 3811412 - RNA, 15 nt, Salmonella typhimurium LT2
agagcgcaccgcgcg

SEQ ID NO: 3811413 - RNA, 11 nt, Salmonella typhimurium LT2
agagcgcauca

SEQ ID NO: 3811414 - RNA, 21 nt, Salmonella typhimurium LT2
agagcgcgcucugccuuuuuu

SEQ ID NO: 3811415 - RNA, 21 nt, Salmonella typhimurium LT2
agagcgcuucuaacaaaacag

SEQ ID NO: 3811416 - RNA, 22 nt, Salmonella typhimurium LT2
agagcggauaagcgcagcgcca

SEQ ID NO: 3811417 - RNA, 24 nt, Salmonella typhimurium LT2
agagcggcuuauaaaacgcccugu

SEQ ID NO: 3811418 - RNA, 18 nt, Salmonella typhimurium LT2
agagcgggucaacgccaa

SEQ ID NO: 3811419 - RNA, 13 nt, Salmonella typhimurium LT2
agagcguauccag

SEQ ID NO: 3811420 - RNA, 19 nt, Salmonella typhimurium LT2
agagcgucucauccggcag

SEQ ID NO: 3811421 - RNA, 23 nt, Salmonella typhimurium LT2
agagcgucuuuuauccccacuac

SEQ ID NO: 3811422 - RNA, 16 nt, Salmonella typhimurium LT2
agagcuuauuuugacu

SEQ ID NO: 3811423 - RNA, 11 nt, Salmonella typhimurium LT2
agaggaaagcg

SEQ ID NO: 3811424 - RNA, 21 nt, Salmonella typhimurium LT2
agaggaaauccuuccagcgcc

SEQ ID NO: 3811425 - RNA, 18 nt, Salmonella typhimurium LT2
agaggaauauuaucaauc

SEQ ID NO: 3811426 - RNA, 15 nt, Salmonella typhimurium LT2
agaggaauguccagc

SEQ ID NO: 3811427 - RNA, 16 nt, Salmonella typhimurium LT2
agaggaauguccagcu

SEQ ID NO: 3811428 - RNA, 16 nt, Salmonella typhimurium LT2
agaggaucuggacgcc

SEQ ID NO: 3811429 - RNA, 16 nt, Salmonella typhimurium LT2
agaggaugcuccgcca

SEQ ID NO: 3811430 - RNA, 15 nt, Salmonella typhimurium LT2
agaggcagcaaagcu

SEQ ID NO: 3811431 - RNA, 18 nt, Salmonella typhimurium LT2
agaggccaccagcgccag

SEQ ID NO: 3811432 - RNA, 21 nt, Salmonella typhimurium LT2
agaggccuuuugcagcagcga

SEQ ID NO: 3811433 - RNA, 15 nt, Salmonella typhimurium LT2
agaggcuaaucagga

SEQ ID NO: 3811434 - RNA, 23 nt, Salmonella typhimurium LT2
agaggcugaaggcgcuccccugc

SEQ ID NO: 3811435 - RNA, 16 nt, Salmonella typhimurium LT2
agaggcugcgcgaauu

SEQ ID NO: 3811436 - RNA, 14 nt, Salmonella typhimurium LT2
agagguaauuuggc

SEQ ID NO: 3811437 - RNA, 13 nt, Salmonella typhimurium LT2
agagguuccaggc

SEQ ID NO: 3811438 - RNA, 18 nt, Salmonella typhimurium LT2
agagguuccaggcacuca

SEQ ID NO: 3811439 - RNA, 15 nt, Salmonella typhimurium LT2
agaguaaauuauuua

SEQ ID NO: 3811440 - RNA, 19 nt, Salmonella typhimurium LT2
agaguaaccacgauaaaga

SEQ ID NO: 3811441 - RNA, 21 nt, Salmonella typhimurium LT2
agaguaaccacgauaaagaca

SEQ ID NO: 3811442 - RNA, 21 nt, Salmonella typhimurium LT2
agaguaaucguauucauugcc

SEQ ID NO: 3811443 - RNA, 18 nt, Salmonella typhimurium LT2
agaguauaagcgccgcug

SEQ ID NO: 3811444 - RNA, 13 nt, Salmonella typhimurium LT2
agaguccagccau

SEQ ID NO: 3811445 - RNA, 22 nt, Salmonella typhimurium LT2
agaguccauucggccugcggug

SEQ ID NO: 3811446 - RNA, 10 nt, Salmonella typhimurium LT2
agagugaaca

SEQ ID NO: 3811447 - RNA, 17 nt, Salmonella typhimurium LT2
agaugcccgcagaucug

SEQ ID NO: 3811448 - RNA, 14 nt, Salmonella typhimurium LT2
agaugccgccaguu

SEQ ID NO: 3811449 - RNA, 19 nt, Salmonella typhimurium LT2
agaugccugaaaauagcgc

SEQ ID NO: 3811450 - RNA, 13 nt, Salmonella typhimurium LT2
agaugcgaaucuu

SEQ ID NO: 3811451 - RNA, 23 nt, Salmonella typhimurium LT2
agaugcgccagauucaugauuuc

SEQ ID NO: 3811452 - RNA, 16 nt, Salmonella typhimurium LT2
agaugcggaugccgca

SEQ ID NO: 3811453 - RNA, 20 nt, Salmonella typhimurium LT2
agaugcugggcgugucccug

SEQ ID NO: 3811454 - RNA, 21 nt, Salmonella typhimurium LT2
agaugcugucuuagugaaaua

SEQ ID NO: 3811455 - RNA, 16 nt, Salmonella typhimurium LT2
agaugcuuaaugcucu

SEQ ID NO: 3811456 - RNA, 14 nt, Salmonella typhimurium LT2
agauggcaaacggu

SEQ ID NO: 3811457 - RNA, 16 nt, Salmonella typhimurium LT2
agauggcgcuaaaacc

SEQ ID NO: 3811458 - RNA, 16 nt, Salmonella typhimurium LT2
agauggcggcugcgcc

SEQ ID NO: 3811459 - RNA, 20 nt, Salmonella typhimurium LT2
agauggcgucacauggcgaa

SEQ ID NO: 3811460 - RNA, 21 nt, Salmonella typhimurium LT2
agaugguauaaaucacgcuga

SEQ ID NO: 3811461 - RNA, 22 nt, Salmonella typhimurium LT2
agaugucgcaauaaacgggcag

SEQ ID NO: 3811462 - RNA, 19 nt, Salmonella typhimurium LT2
agauguucagguaaaugag

SEQ ID NO: 3811463 - RNA, 22 nt, Salmonella typhimurium LT2
agauguugagcaaugggaagga

SEQ ID NO: 3811464 - RNA, 16 nt, Salmonella typhimurium LT2
agauguugauacagaa

SEQ ID NO: 3811465 - RNA, 20 nt, Salmonella typhimurium LT2
agauguugauacagaaaacc

SEQ ID NO: 3811466 - RNA, 21 nt, Salmonella typhimurium LT2
agauguuuuaaucucuucuau

SEQ ID NO: 3811467 - RNA, 18 nt, Salmonella typhimurium LT2
agauguuuuaccaguaca

SEQ ID NO: 3811468 - RNA, 22 nt, Salmonella typhimurium LT2
agauuaacgaccagguaaugga

SEQ ID NO: 3811469 - RNA, 20 nt, Salmonella typhimurium LT2
agauuaauaauugagcgcaa

SEQ ID NO: 3811470 - RNA, 15 nt, Salmonella typhimurium LT2
agauuaaucagcaga

SEQ ID NO: 3811471 - RNA, 18 nt, Salmonella typhimurium LT2
agauuagguacguacauc

SEQ ID NO: 3811472 - RNA, 19 nt, Salmonella typhimurium LT2
agauucaccaccacccgau

SEQ ID NO: 3811473 - RNA, 15 nt, Salmonella typhimurium LT2
agauuccccaauccc

SEQ ID NO: 3811474 - RNA, 14 nt, Salmonella typhimurium LT2
agauucuaacauaa

SEQ ID NO: 3811475 - RNA, 10 nt, Salmonella typhimurium LT2
agauucugau

SEQ ID NO: 3811476 - RNA, 21 nt, Salmonella typhimurium LT2
agauucugcgguaauaugcca

SEQ ID NO: 3811477 - RNA, 14 nt, Salmonella typhimurium LT2
agauucuucugccu

SEQ ID NO: 3811478 - RNA, 14 nt, Salmonella typhimurium LT2
agauugaacgcugg

SEQ ID NO: 3811479 - RNA, 15 nt, Salmonella typhimurium LT2
agauugacagaauaa

SEQ ID NO: 3811480 - RNA, 17 nt, Salmonella typhimurium LT2
agauugacagaauaaug

SEQ ID NO: 3811481 - RNA, 19 nt, Salmonella typhimurium LT2
agauugacagaauaaugcc

SEQ ID NO: 3811482 - RNA, 17 nt, Salmonella typhimurium LT2
agauugauaaucagcaa

SEQ ID NO: 3811483 - RNA, 19 nt, Salmonella typhimurium LT2
agauugauaaucagcaaga

SEQ ID NO: 3811484 - RNA, 14 nt, Salmonella typhimurium LT2
agauugauuuauuc

SEQ ID NO: 3811485 - RNA, 15 nt, Salmonella typhimurium LT2
agauugucaccguaa

SEQ ID NO: 3811486 - RNA, 17 nt, Salmonella typhimurium LT2
agauugucaccguaaua

SEQ ID NO: 3811487 - RNA, 19 nt, Salmonella typhimurium LT2
agauugucaccguaauaua

SEQ ID NO: 3811488 - RNA, 17 nt, Salmonella typhimurium LT2
agauuuaucaauuuuua

SEQ ID NO: 3811489 - RNA, 19 nt, Salmonella typhimurium LT2
agauuucggcauuuuuaau

SEQ ID NO: 3811490 - RNA, 16 nt, Salmonella typhimurium LT2
agauuucuuaauuccu

SEQ ID NO: 3811491 - RNA, 13 nt, Salmonella typhimurium LT2
agauuuucaucau

SEQ ID NO: 3811492 - RNA, 19 nt, Salmonella typhimurium LT2
agauuuuguacuuuugcca

SEQ ID NO: 3811493 - RNA, 19 nt, Salmonella typhimurium LT2
agcaaaaaagcgccuuuag

SEQ ID NO: 3811494 - RNA, 22 nt, Salmonella typhimurium LT2
agcaaaauaauaucgcgcucuu

SEQ ID NO: 3811495 - RNA, 15 nt, Salmonella typhimurium LT2
agcaaaauggcaauu

SEQ ID NO: 3811496 - RNA, 15 nt, Salmonella typhimurium LT2
agcaaaguaaaacaa

SEQ ID NO: 3811497 - RNA, 16 nt, Salmonella typhimurium LT2
agcaaaguaaaacaag

SEQ ID NO: 3811498 - RNA, 21 nt, Salmonella typhimurium LT2
agcaaauaaucgcccaccuga

SEQ ID NO: 3811499 - RNA, 20 nt, Salmonella typhimurium LT2
agcaaauccucgucaaggcu

SEQ ID NO: 3811500 - RNA, 18 nt, Salmonella typhimurium LT2
agcaaaucgggaaaauga

SEQ ID NO: 3811501 - RNA, 14 nt, Salmonella typhimurium LT2
agcaaauugcugau

SEQ ID NO: 3811502 - RNA, 22 nt, Salmonella typhimurium LT2
agcaacacuuugcgcugcgcau

SEQ ID NO: 3811503 - RNA, 22 nt, Salmonella typhimurium LT2
agcaacauagccauaucgucau

SEQ ID NO: 3811504 - RNA, 13 nt, Salmonella typhimurium LT2
agcaaccagaaug

SEQ ID NO: 3811505 - RNA, 19 nt, Salmonella typhimurium LT2
agcaaccagcuaaccuguu

SEQ ID NO: 3811506 - RNA, 22 nt, Salmonella typhimurium LT2
agcaacccugccgucucaacca

SEQ ID NO: 3811507 - RNA, 22 nt, Salmonella typhimurium LT2
agcaacgggacggcggccagca

SEQ ID NO: 3811508 - RNA, 22 nt, Salmonella typhimurium LT2
agcaacguuuguaacagcagga

SEQ ID NO: 3811509 - RNA, 20 nt, Salmonella typhimurium LT2
agcaacugcgcgcggguuuc

SEQ ID NO: 3811510 - RNA, 24 nt, Salmonella typhimurium LT2
agcaacuuuuccgccucgcgcacc

SEQ ID NO: 3811511 - RNA, 16 nt, Salmonella typhimurium LT2
agcaagaacagagcaa

SEQ ID NO: 3811512 - RNA, 19 nt, Salmonella typhimurium LT2
agcaagaacagagcaauua

SEQ ID NO: 3811513 - RNA, 21 nt, Salmonella typhimurium LT2
agcaagaagcagguguuauuu

SEQ ID NO: 3811514 - RNA, 13 nt, Salmonella typhimurium LT2
agcaagcgccauc

SEQ ID NO: 3811515 - RNA, 13 nt, Salmonella typhimurium LT2
agcaaggcggcgg

SEQ ID NO: 3811516 - RNA, 14 nt, Salmonella typhimurium LT2
agcaagugcuggag

SEQ ID NO: 3811517 - RNA, 17 nt, Salmonella typhimurium LT2
agcaauacagccagcac

SEQ ID NO: 3811518 - RNA, 14 nt, Salmonella typhimurium LT2
agcaaucaagguug

SEQ ID NO: 3811519 - RNA, 14 nt, Salmonella typhimurium LT2
agcaaucuggcagu

SEQ ID NO: 3811520 - RNA, 17 nt, Salmonella typhimurium LT2
agcaaugaagcaagugc

SEQ ID NO: 3811521 - RNA, 14 nt, Salmonella typhimurium LT2
agcaaugauuuuua

SEQ ID NO: 3811522 - RNA, 15 nt, Salmonella typhimurium LT2
agcaaugauuuuuag

SEQ ID NO: 3811523 - RNA, 15 nt, Salmonella typhimurium LT2
agcaaugcagaaguu

SEQ ID NO: 3811524 - RNA, 12 nt, Salmonella typhimurium LT2
agcaaugccgcc

SEQ ID NO: 3811525 - RNA, 20 nt, Salmonella typhimurium LT2
agcaauggguaggccggaua

SEQ ID NO: 3811526 - RNA, 15 nt, Salmonella typhimurium LT2
agcaauuaacaaaua

SEQ ID NO: 3811527 - RNA, 19 nt, Salmonella typhimurium LT2
agcaauuccgccaucucau

SEQ ID NO: 3811528 - RNA, 14 nt, Salmonella typhimurium LT2
agcaauuuccucug

SEQ ID NO: 3811529 - RNA, 23 nt, Salmonella typhimurium LT2
agcaauuucucgcccgccagauc

SEQ ID NO: 3811530 - RNA, 14 nt, Salmonella typhimurium LT2
agcacaaaaaucau

SEQ ID NO: 3811531 - RNA, 17 nt, Salmonella typhimurium LT2
agcacaaaaaucaugcu

SEQ ID NO: 3811532 - RNA, 20 nt, Salmonella typhimurium LT2
agcacaaaaaucaugcucau

SEQ ID NO: 3811533 - RNA, 20 nt, Salmonella typhimurium LT2
agcacaaagugcgcugucag

SEQ ID NO: 3811534 - RNA, 14 nt, Salmonella typhimurium LT2
agcacaaucagcgc

SEQ ID NO: 3811535 - RNA, 15 nt, Salmonella typhimurium LT2
agcacaaucagcgcg

SEQ ID NO: 3811536 - RNA, 16 nt, Salmonella typhimurium LT2
agcacaccauuucaca

SEQ ID NO: 3811537 - RNA, 19 nt, Salmonella typhimurium LT2
agcacaccauuucacaaau

SEQ ID NO: 3811538 - RNA, 17 nt, Salmonella typhimurium LT2
agcacagcccaguaaua

SEQ ID NO: 3811539 - RNA, 19 nt, Salmonella typhimurium LT2
agcacagcccauaccagcg

SEQ ID NO: 3811540 - RNA, 12 nt, Salmonella typhimurium LT2
agcacaggccau

SEQ ID NO: 3811541 - RNA, 14 nt, Salmonella typhimurium LT2
agcacauagcugag

SEQ ID NO: 3811542 - RNA, 21 nt, Salmonella typhimurium LT2
agcacaucacucauaaugaug

SEQ ID NO: 3811543 - RNA, 12 nt, Salmonella typhimurium LT2
agcacauccaug

SEQ ID NO: 3811544 - RNA, 22 nt, Salmonella typhimurium LT2
agcacauuacaggcaucuucca

SEQ ID NO: 3811545 - RNA, 15 nt, Salmonella typhimurium LT2
agcaccaacgccgcu

SEQ ID NO: 3811546 - RNA, 12 nt, Salmonella typhimurium LT2
agcaccaccugc

SEQ ID NO: 3811547 - RNA, 15 nt, Salmonella typhimurium LT2
agcaccacgcccgga

SEQ ID NO: 3811548 - RNA, 18 nt, Salmonella typhimurium LT2
agcaccagaccgacaagc

SEQ ID NO: 3811549 - RNA, 13 nt, Salmonella typhimurium LT2
agcaccagcagcg

SEQ ID NO: 3811550 - RNA, 13 nt, Salmonella typhimurium LT2
agcaccagcaggu

SEQ ID NO: 3811551 - RNA, 19 nt, Salmonella typhimurium LT2
agcauaagcuaugcggaag

SEQ ID NO: 3811552 - RNA, 20 nt, Salmonella typhimurium LT2
agcauaaugugaugcagacg

SEQ ID NO: 3811553 - RNA, 15 nt, Salmonella typhimurium LT2
agcauagacgaucag

SEQ ID NO: 3811554 - RNA, 14 nt, Salmonella typhimurium LT2
agcauagcgccauc

SEQ ID NO: 3811555 - RNA, 14 nt, Salmonella typhimurium LT2
agcauagcgcugaa

SEQ ID NO: 3811556 - RNA, 16 nt, Salmonella typhimurium LT2
agcaucaauagcagcu

SEQ ID NO: 3811557 - RNA, 15 nt, Salmonella typhimurium LT2
agcaucaucugccau

SEQ ID NO: 3811558 - RNA, 16 nt, Salmonella typhimurium LT2
agcaucaucugccauu

SEQ ID NO: 3811559 - RNA, 14 nt, Salmonella typhimurium LT2
agcaucauuuuuua

SEQ ID NO: 3811560 - RNA, 18 nt, Salmonella typhimurium LT2
agcauccacgccacaaua

SEQ ID NO: 3811561 - RNA, 16 nt, Salmonella typhimurium LT2
agcauccccacaggau

SEQ ID NO: 3811562 - RNA, 21 nt, Salmonella typhimurium LT2
agcauccgcaagacacgcuuc

SEQ ID NO: 3811563 - RNA, 21 nt, Salmonella typhimurium LT2
agcauccgggauauaaaauua

SEQ ID NO: 3811564 - RNA, 17 nt, Salmonella typhimurium LT2
agcaucgcccgggcaau

SEQ ID NO: 3811565 - RNA, 12 nt, Salmonella typhimurium LT2
agcaucgccggu

SEQ ID NO: 3811566 - RNA, 20 nt, Salmonella typhimurium LT2
agcaucgccgguagcuucag

SEQ ID NO: 3811567 - RNA, 17 nt, Salmonella typhimurium LT2
agcaucgcuaaccggcg

SEQ ID NO: 3811568 - RNA, 21 nt, Salmonella typhimurium LT2
agcaucgcuuuuaggcugaaa

SEQ ID NO: 3811569 - RNA, 15 nt, Salmonella typhimurium LT2
agcaucgggaaucau

SEQ ID NO: 3811570 - RNA, 15 nt, Salmonella typhimurium LT2
agcaucguuaccgcu

SEQ ID NO: 3811571 - RNA, 18 nt, Salmonella typhimurium LT2
agcaucugcggcuuucau

SEQ ID NO: 3811572 - RNA, 15 nt, Salmonella typhimurium LT2
agcaugacaauaacg

SEQ ID NO: 3811573 - RNA, 17 nt, Salmonella typhimurium LT2
agcauggcgucucagcg

SEQ ID NO: 3811574 - RNA, 22 nt, Salmonella typhimurium LT2
agcauguuugccgaauggcggc

SEQ ID NO: 3811575 - RNA, 16 nt, Salmonella typhimurium LT2
agcauuaagaucgcag

SEQ ID NO: 3811576 - RNA, 23 nt, Salmonella typhimurium LT2
agcauuacccccgccauaauaca

SEQ ID NO: 3811577 - RNA, 22 nt, Salmonella typhimurium LT2
agcauuagccagaggcuaauca

SEQ ID NO: 3811578 - RNA, 13 nt, Salmonella typhimurium LT2
agcauuauuuuua

SEQ ID NO: 3811579 - RNA, 18 nt, Salmonella typhimurium LT2
agcauucugaagccgaua

SEQ ID NO: 3811580 - RNA, 19 nt, Salmonella typhimurium LT2
agcauugaggcuacccaga

SEQ ID NO: 3811581 - RNA, 21 nt, Salmonella typhimurium LT2
agcauugaggcuacccagaca

SEQ ID NO: 3811582 - RNA, 15 nt, Salmonella typhimurium LT2
agcauugauuuuuca

SEQ ID NO: 3811583 - RNA, 21 nt, Salmonella typhimurium LT2
agcauugauuuuucaucugca

SEQ ID NO: 3811584 - RNA, 18 nt, Salmonella typhimurium LT2
agcauugccguuuucaau

SEQ ID NO: 3811585 - RNA, 15 nt, Salmonella typhimurium LT2
agcauugggccgaua

SEQ ID NO: 3811586 - RNA, 23 nt, Salmonella typhimurium LT2
agcauuggucaucgcccaugaca

SEQ ID NO: 3811587 - RNA, 18 nt, Salmonella typhimurium LT2
agcauugugcagccaugu

SEQ ID NO: 3811588 - RNA, 15 nt, Salmonella typhimurium LT2
agccaaaaauaacgc

SEQ ID NO: 3811589 - RNA, 14 nt, Salmonella typhimurium LT2
agccaaaacccuuc

SEQ ID NO: 3811590 - RNA, 15 nt, Salmonella typhimurium LT2
agccaaacucuucca

SEQ ID NO: 3811591 - RNA, 19 nt, Salmonella typhimurium LT2
agccaaauagcgccagaca

SEQ ID NO: 3811592 - RNA, 14 nt, Salmonella typhimurium LT2
agccaacgcaguca

SEQ ID NO: 3811593 - RNA, 21 nt, Salmonella typhimurium LT2
agccaacuuuuucuuaagcug

SEQ ID NO: 3811594 - RNA, 16 nt, Salmonella typhimurium LT2
agccaauauccggaua

SEQ ID NO: 3811595 - RNA, 23 nt, Salmonella typhimurium LT2
agccaauauccggauauucugca

SEQ ID NO: 3811596 - RNA, 17 nt, Salmonella typhimurium LT2
agccacaaucugauaau

SEQ ID NO: 3811597 - RNA, 21 nt, Salmonella typhimurium LT2
agccacacgacgguauuggua

SEQ ID NO: 3811598 - RNA, 21 nt, Salmonella typhimurium LT2
agccacagaaugccguugacc

SEQ ID NO: 3811599 - RNA, 15 nt, Salmonella typhimurium LT2
agccaccaucuuuuu

SEQ ID NO: 3811600 - RNA, 20 nt, Salmonella typhimurium LT2
agccaccgccagcaguagcc

SEQ ID NO: 3811601 - RNA, 19 nt, Salmonella typhimurium LT2
agccacggaauaucuuuuu

SEQ ID NO: 3811602 - RNA, 12 nt, Salmonella typhimurium LT2
agccacggcgca

SEQ ID NO: 3811603 - RNA, 22 nt, Salmonella typhimurium LT2
agccacgguucucaccguggca

SEQ ID NO: 3811604 - RNA, 16 nt, Salmonella typhimurium LT2
agccacguaaagacga

SEQ ID NO: 3811605 - RNA, 19 nt, Salmonella typhimurium LT2
agccacucacguucagcgc

SEQ ID NO: 3811606 - RNA, 18 nt, Salmonella typhimurium LT2
agccacugcccagagaau

SEQ ID NO: 3811607 - RNA, 11 nt, Salmonella typhimurium LT2
agccacuggcu

SEQ ID NO: 3811608 - RNA, 22 nt, Salmonella typhimurium LT2
agccacuuaccaaucgcggcga

SEQ ID NO: 3811609 - RNA, 18 nt, Salmonella typhimurium LT2
agccacuucaugcgcuuu

SEQ ID NO: 3811610 - RNA, 15 nt, Salmonella typhimurium LT2
agccagaacucaucu

SEQ ID NO: 3811611 - RNA, 16 nt, Salmonella typhimurium LT2
agccagaacucaucuu

SEQ ID NO: 3811612 - RNA, 17 nt, Salmonella typhimurium LT2
agccagaagcccggguc

SEQ ID NO: 3811613 - RNA, 17 nt, Salmonella typhimurium LT2
agccagaaugacauggu

SEQ ID NO: 3811614 - RNA, 14 nt, Salmonella typhimurium LT2
agccagacgcgcag

SEQ ID NO: 3811615 - RNA, 23 nt, Salmonella typhimurium LT2
agccagacggcgcccagccugcc

SEQ ID NO: 3811616 - RNA, 14 nt, Salmonella typhimurium LT2
agccagagcgcgcu

SEQ ID NO: 3811617 - RNA, 21 nt, Salmonella typhimurium LT2
agccagaguuuuaaaaccauu

SEQ ID NO: 3811618 - RNA, 14 nt, Salmonella typhimurium LT2
agccagauaaagca

SEQ ID NO: 3811619 - RNA, 13 nt, Salmonella typhimurium LT2
agccagcagcuca

SEQ ID NO: 3811620 - RNA, 18 nt, Salmonella typhimurium LT2
agccagcaucaugggcuc

SEQ ID NO: 3811621 - RNA, 13 nt, Salmonella typhimurium LT2
agccagccaaagc

SEQ ID NO: 3811622 - RNA, 15 nt, Salmonella typhimurium LT2
agccagccaaagcug

SEQ ID NO: 3811623 - RNA, 20 nt, Salmonella typhimurium LT2
agccagcccuaaggucacgc

SEQ ID NO: 3811624 - RNA, 19 nt, Salmonella typhimurium LT2
agccagccgccaaaaauau

SEQ ID NO: 3811625 - RNA, 23 nt, Salmonella typhimurium LT2
agccagcguaaauagcccggauc

SEQ ID NO: 3811626 - RNA, 15 nt, Salmonella typhimurium LT2
agccagcgugaaccu

SEQ ID NO: 3811627 - RNA, 20 nt, Salmonella typhimurium LT2
agccagcucaccagccaaau

SEQ ID NO: 3811628 - RNA, 16 nt, Salmonella typhimurium LT2
agccaggaauauacca

SEQ ID NO: 3811629 - RNA, 21 nt, Salmonella typhimurium LT2
agccaggaauauaccaucacc

SEQ ID NO: 3811630 - RNA, 19 nt, Salmonella typhimurium LT2
agccaggcuuuaaauucag

SEQ ID NO: 3811631 - RNA, 15 nt, Salmonella typhimurium LT2
agccagggaacucca

SEQ ID NO: 3811632 - RNA, 17 nt, Salmonella typhimurium LT2
agccaggucagcggaga

SEQ ID NO: 3811633 - RNA, 14 nt, Salmonella typhimurium LT2
agccagguccagau

SEQ ID NO: 3811634 - RNA, 13 nt, Salmonella typhimurium LT2
agccagguugcgc

SEQ ID NO: 3811635 - RNA, 20 nt, Salmonella typhimurium LT2
agccagguugcgcccggcgc

SEQ ID NO: 3811636 - RNA, 17 nt, Salmonella typhimurium LT2
agccagucgccaggcaa

SEQ ID NO: 3811637 - RNA, 20 nt, Salmonella typhimurium LT2
agccaguuauuaaucaagcc

SEQ ID NO: 3811638 - RNA, 13 nt, Salmonella typhimurium LT2
agccaguucucaa

SEQ ID NO: 3811639 - RNA, 19 nt, Salmonella typhimurium LT2
agccaguuuggacacggac

SEQ ID NO: 3811640 - RNA, 17 nt, Salmonella typhimurium LT2
agccauaauacaauccg

SEQ ID NO: 3811641 - RNA, 12 nt, Salmonella typhimurium LT2
agccauaaugcu

SEQ ID NO: 3811642 - RNA, 14 nt, Salmonella typhimurium LT2
agccauaaugcugc

SEQ ID NO: 3811643 - RNA, 21 nt, Salmonella typhimurium LT2
agccauaaugcugccagcaug

SEQ ID NO: 3811644 - RNA, 22 nt, Salmonella typhimurium LT2
agccauaaugcugccagcauga

SEQ ID NO: 3811645 - RNA, 15 nt, Salmonella typhimurium LT2
agccaucauuaccaa

SEQ ID NO: 3811646 - RNA, 14 nt, Salmonella typhimurium LT2
agccaucccggcga

SEQ ID NO: 3811647 - RNA, 16 nt, Salmonella typhimurium LT2
agccaucggcaaacgc

SEQ ID NO: 3811648 - RNA, 22 nt, Salmonella typhimurium LT2
agccaucggcauaacccgccgc

SEQ ID NO: 3811649 - RNA, 13 nt, Salmonella typhimurium LT2
agccaugcccggc

SEQ ID NO: 3811650 - RNA, 14 nt, Salmonella typhimurium LT2
agccauggcccaaa

SEQ ID NO: 3811651 - RNA, 19 nt, Salmonella typhimurium LT2
agccauguaaaauagcgcc

SEQ ID NO: 3811652 - RNA, 14 nt, Salmonella typhimurium LT2
agccaugucuuuuu

SEQ ID NO: 3811653 - RNA, 22 nt, Salmonella typhimurium LT2
agccaugucuuuuucagucauc

SEQ ID NO: 3811654 - RNA, 22 nt, Salmonella typhimurium LT2
agccaugugacggcauguccgg

SEQ ID NO: 3811655 - RNA, 20 nt, Salmonella typhimurium LT2
agccugccagcaccagcagc

SEQ ID NO: 3811656 - RNA, 20 nt, Salmonella typhimurium LT2
agccugcccugcggcaggca

SEQ ID NO: 3811657 - RNA, 14 nt, Salmonella typhimurium LT2
agccugcgccagcg

SEQ ID NO: 3811658 - RNA, 20 nt, Salmonella typhimurium LT2
agccugcuggguacgugcaa

SEQ ID NO: 3811659 - RNA, 17 nt, Salmonella typhimurium LT2
agccuggagagcagcgc

SEQ ID NO: 3811660 - RNA, 19 nt, Salmonella typhimurium LT2
agccuggagagcagcgcca

SEQ ID NO: 3811661 - RNA, 16 nt, Salmonella typhimurium LT2
agccuggcauaacauu

SEQ ID NO: 3811662 - RNA, 14 nt, Salmonella typhimurium LT2
agccuggcggcuuc

SEQ ID NO: 3811663 - RNA, 14 nt, Salmonella typhimurium LT2
agccugggcaaggc

SEQ ID NO: 3811664 - RNA, 21 nt, Salmonella typhimurium LT2
agccugucgccgucaauguca

SEQ ID NO: 3811665 - RNA, 21 nt, Salmonella typhimurium LT2
agccuguuccagcugcgacag

SEQ ID NO: 3811666 - RNA, 18 nt, Salmonella typhimurium LT2
agccuuaaucaacugcgc

SEQ ID NO: 3811667 - RNA, 22 nt, Salmonella typhimurium LT2
agccuuaaucaacugcgccaca

SEQ ID NO: 3811668 - RNA, 16 nt, Salmonella typhimurium LT2
agccuuacuaucccau

SEQ ID NO: 3811669 - RNA, 22 nt, Salmonella typhimurium LT2
agccuuauaggcgcaucugaaa

SEQ ID NO: 3811670 - RNA, 13 nt, Salmonella typhimurium LT2
agccuucaacaaa

SEQ ID NO: 3811671 - RNA, 15 nt, Salmonella typhimurium LT2
agccuucaccccuuc

SEQ ID NO: 3811672 - RNA, 22 nt, Salmonella typhimurium LT2
agccuucaccccuucaucagua

SEQ ID NO: 3811673 - RNA, 19 nt, Salmonella typhimurium LT2
agccuugacgcaauagagu

SEQ ID NO: 3811674 - RNA, 15 nt, Salmonella typhimurium LT2
agccuuuaucgcuga

SEQ ID NO: 3811675 - RNA, 14 nt, Salmonella typhimurium LT2
agccuuugucgaaa

SEQ ID NO: 3811676 - RNA, 22 nt, Salmonella typhimurium LT2
agccuuuuaccgucacgcggcu

SEQ ID NO: 3811677 - RNA, 19 nt, Salmonella typhimurium LT2
agcgaaaaaauaauccgcu

SEQ ID NO: 3811678 - RNA, 19 nt, Salmonella typhimurium LT2
agcgaaaauaaacgcuuga

SEQ ID NO: 3811679 - RNA, 21 nt, Salmonella typhimurium LT2
agcgaaaccccaccguauuuu

SEQ ID NO: 3811680 - RNA, 20 nt, Salmonella typhimurium LT2
agcgaaacgcgcuaucaacg

SEQ ID NO: 3811681 - RNA, 21 nt, Salmonella typhimurium LT2
agcgaaaugacagccaccagc

SEQ ID NO: 3811682 - RNA, 15 nt, Salmonella typhimurium LT2
agcgaaaugcgaauc

SEQ ID NO: 3811683 - RNA, 17 nt, Salmonella typhimurium LT2
agcgaaaugcgaauccg

SEQ ID NO: 3811684 - RNA, 13 nt, Salmonella typhimurium LT2
agcgaagaauucg

SEQ ID NO: 3811685 - RNA, 20 nt, Salmonella typhimurium LT2
agcgaagaucaggaguaaau

SEQ ID NO: 3811686 - RNA, 23 nt, Salmonella typhimurium LT2
agcgaagcgucauccggcaauca

SEQ ID NO: 3811687 - RNA, 18 nt, Salmonella typhimurium LT2
agcgaauccagaucgccc

SEQ ID NO: 3811688 - RNA, 19 nt, Salmonella typhimurium LT2
agcgaauccagaucgcccu

SEQ ID NO: 3811689 - RNA, 13 nt, Salmonella typhimurium LT2
agcgaauccagcg

SEQ ID NO: 3811690 - RNA, 15 nt, Salmonella typhimurium LT2
agcgaauccagcgcc

SEQ ID NO: 3811691 - RNA, 18 nt, Salmonella typhimurium LT2
agcgaauccccgggcaca

SEQ ID NO: 3811692 - RNA, 15 nt, Salmonella typhimurium LT2
agcgaaugcgcgcca

SEQ ID NO: 3811693 - RNA, 23 nt, Salmonella typhimurium LT2
agcgaauguauuaacgcuuugcc

SEQ ID NO: 3811694 - RNA, 21 nt, Salmonella typhimurium LT2
agcgaauuaugacggaugcca

SEQ ID NO: 3811695 - RNA, 22 nt, Salmonella typhimurium LT2
agcgaauugccgucgccggaau

SEQ ID NO: 3811696 - RNA, 15 nt, Salmonella typhimurium LT2
agcgacaaaucugcc

SEQ ID NO: 3811697 - RNA, 13 nt, Salmonella typhimurium LT2
agcgacaaaugaa

SEQ ID NO: 3811698 - RNA, 17 nt, Salmonella typhimurium LT2
agcgacagccaguaaug

SEQ ID NO: 3811699 - RNA, 18 nt, Salmonella typhimurium LT2
agcgacaucgucacaaua

SEQ ID NO: 3811700 - RNA, 12 nt, Salmonella typhimurium LT2
agcgacauuccc

SEQ ID NO: 3811701 - RNA, 23 nt, Salmonella typhimurium LT2
agcgaccacgacgccggagaccg

SEQ ID NO: 3811702 - RNA, 20 nt, Salmonella typhimurium LT2
agcgaccggcacucaccucu

SEQ ID NO: 3811703 - RNA, 17 nt, Salmonella typhimurium LT2
agcgaccggcgucauca

SEQ ID NO: 3811704 - RNA, 18 nt, Salmonella typhimurium LT2
agcgacgaggcauggcga

SEQ ID NO: 3811705 - RNA, 15 nt, Salmonella typhimurium LT2
agcgacggcgcgcca

SEQ ID NO: 3811706 - RNA, 17 nt, Salmonella typhimurium LT2
agcgacguaaugaucag

SEQ ID NO: 3811707 - RNA, 19 nt, Salmonella typhimurium LT2
agcgacucauucagcaacu

SEQ ID NO: 3811708 - RNA, 13 nt, Salmonella typhimurium LT2
agcgacuggucau

SEQ ID NO: 3811709 - RNA, 19 nt, Salmonella typhimurium LT2
agcgagauaaucgggaaua

SEQ ID NO: 3811710 - RNA, 20 nt, Salmonella typhimurium LT2
agcgagauaaucgggaauac

SEQ ID NO: 3811711 - RNA, 11 nt, Salmonella typhimurium LT2
agcgagucaga

SEQ ID NO: 3811712 - RNA, 17 nt, Salmonella typhimurium LT2
agcgauaaacucagcgc

SEQ ID NO: 3811713 - RNA, 18 nt, Salmonella typhimurium LT2
agcgauaaacucagcgcc

SEQ ID NO: 3811714 - RNA, 22 nt, Salmonella typhimurium LT2
agcgauaaacucagcgccagcg

SEQ ID NO: 3811715 - RNA, 18 nt, Salmonella typhimurium LT2
agcgauagucguugcgcc

SEQ ID NO: 3811716 - RNA, 16 nt, Salmonella typhimurium LT2
agcgaucacgccgucc

SEQ ID NO: 3811717 - RNA, 18 nt, Salmonella typhimurium LT2
agcgaucaggggucagcg

SEQ ID NO: 3811718 - RNA, 16 nt, Salmonella typhimurium LT2
agcgauccagaccggc

SEQ ID NO: 3811719 - RNA, 19 nt, Salmonella typhimurium LT2
agcgauccagaccggcaug

SEQ ID NO: 3811720 - RNA, 15 nt, Salmonella typhimurium LT2
agcgaucgagauaag

SEQ ID NO: 3811721 - RNA, 18 nt, Salmonella typhimurium LT2
agcgaucgagauaagauc

SEQ ID NO: 3811722 - RNA, 17 nt, Salmonella typhimurium LT2
agcgaugagcgccagca

SEQ ID NO: 3811723 - RNA, 23 nt, Salmonella typhimurium LT2
agcgaugcgguucaacgcgcugc

SEQ ID NO: 3811724 - RNA, 20 nt, Salmonella typhimurium LT2
agcgauuuuugaucucuuua

SEQ ID NO: 3811725 - RNA, 15 nt, Salmonella typhimurium LT2
agcgcaaacaacccg

SEQ ID NO: 3811726 - RNA, 16 nt, Salmonella typhimurium LT2
agcgcaaacgcgcgau

SEQ ID NO: 3811727 - RNA, 17 nt, Salmonella typhimurium LT2
agcgcaaacucagagag

SEQ ID NO: 3811728 - RNA, 16 nt, Salmonella typhimurium LT2
agcgcaacgcgcauca

SEQ ID NO: 3811729 - RNA, 11 nt, Salmonella typhimurium LT2
agcgcaaugcu

SEQ ID NO: 3811730 - RNA, 19 nt, Salmonella typhimurium LT2
agcgcaccgcgcggcuggu

SEQ ID NO: 3811731 - RNA, 23 nt, Salmonella typhimurium LT2
agcgcacuguuugcugacaaucu

SEQ ID NO: 3811732 - RNA, 12 nt, Salmonella typhimurium LT2
agcgcagcacgu

SEQ ID NO: 3811733 - RNA, 12 nt, Salmonella typhimurium LT2
agcgcagcgcca

SEQ ID NO: 3811734 - RNA, 21 nt, Salmonella typhimurium LT2
agcgcagcgccaccgggcaac

SEQ ID NO: 3811735 - RNA, 17 nt, Salmonella typhimurium LT2
agcgcagcgccaucagg

SEQ ID NO: 3811736 - RNA, 20 nt, Salmonella typhimurium LT2
agcgcagcgccaucaggcaa

SEQ ID NO: 3811737 - RNA, 22 nt, Salmonella typhimurium LT2
agcgcagcgccauugagcauuc

SEQ ID NO: 3811738 - RNA, 15 nt, Salmonella typhimurium LT2
agcgcagcggaaagu

SEQ ID NO: 3811739 - RNA, 15 nt, Salmonella typhimurium LT2
agcgcaggcaacgcc

SEQ ID NO: 3811740 - RNA, 18 nt, Salmonella typhimurium LT2
agcgcagugaccagcauc

SEQ ID NO: 3811741 - RNA, 17 nt, Salmonella typhimurium LT2
agcgcaucauaaaaccc

SEQ ID NO: 3811742 - RNA, 23 nt, Salmonella typhimurium LT2
agcgcaucauccccaccacugau

SEQ ID NO: 3811743 - RNA, 14 nt, Salmonella typhimurium LT2
agcgcauccggcca

SEQ ID NO: 3811744 - RNA, 16 nt, Salmonella typhimurium LT2
agcgcaucgagauaau

SEQ ID NO: 3811745 - RNA, 16 nt, Salmonella typhimurium LT2
agcgcaucgcucccca

SEQ ID NO: 3811746 - RNA, 15 nt, Salmonella typhimurium LT2
agcgcauggcggcca

SEQ ID NO: 3811747 - RNA, 19 nt, Salmonella typhimurium LT2
agcgcauuaccgccgccuu

SEQ ID NO: 3811748 - RNA, 14 nt, Salmonella typhimurium LT2
agcgcauugcccuu

SEQ ID NO: 3811749 - RNA, 20 nt, Salmonella typhimurium LT2
agcgcauugcgucccagcac

SEQ ID NO: 3811750 - RNA, 21 nt, Salmonella typhimurium LT2
agcgcauugcgucccagcaca

SEQ ID NO: 3811751 - RNA, 14 nt, Salmonella typhimurium LT2
agcgccaaucacua

SEQ ID NO: 3811752 - RNA, 19 nt, Salmonella typhimurium LT2
agcgccacacguucgucca

SEQ ID NO: 3811753 - RNA, 17 nt, Salmonella typhimurium LT2
agcgccacggagcauaa

SEQ ID NO: 3811754 - RNA, 16 nt, Salmonella typhimurium LT2
agcgccagacacugga

SEQ ID NO: 3811755 - RNA, 16 nt, Salmonella typhimurium LT2
agcgccagauagucac

SEQ ID NO: 3811756 - RNA, 13 nt, Salmonella typhimurium LT2
agcgccagcagca

SEQ ID NO: 3811757 - RNA, 15 nt, Salmonella typhimurium LT2
agcgccagcgacaga

SEQ ID NO: 3811758 - RNA, 16 nt, Salmonella typhimurium LT2
agcgccagcgguuuca

SEQ ID NO: 3811759 - RNA, 19 nt, Salmonella typhimurium LT2
agcggcacguacugcacca

SEQ ID NO: 3811760 - RNA, 21 nt, Salmonella typhimurium LT2
agcggcagaucguuuacgacc

SEQ ID NO: 3811761 - RNA, 22 nt, Salmonella typhimurium LT2
agcggcagaucguuuacgaccu

SEQ ID NO: 3811762 - RNA, 13 nt, Salmonella typhimurium LT2
agcggcaggccgu

SEQ ID NO: 3811763 - RNA, 14 nt, Salmonella typhimurium LT2
agcggcaguaaauu

SEQ ID NO: 3811764 - RNA, 16 nt, Salmonella typhimurium LT2
agcggcauauggccgu

SEQ ID NO: 3811765 - RNA, 16 nt, Salmonella typhimurium LT2
agcggcaucucgccaa

SEQ ID NO: 3811766 - RNA, 16 nt, Salmonella typhimurium LT2
agcggcccgcgcugaa

SEQ ID NO: 3811767 - RNA, 23 nt, Salmonella typhimurium LT2
agcggcgacuagucgcccgcuaa

SEQ ID NO: 3811768 - RNA, 12 nt, Salmonella typhimurium LT2
agcggcgaggca

SEQ ID NO: 3811769 - RNA, 19 nt, Salmonella typhimurium LT2
agcggcgcagacacugcca

SEQ ID NO: 3811770 - RNA, 16 nt, Salmonella typhimurium LT2
agcggcgcaggggcau

SEQ ID NO: 3811771 - RNA, 16 nt, Salmonella typhimurium LT2
agcggcggcaguaguc

SEQ ID NO: 3811772 - RNA, 22 nt, Salmonella typhimurium LT2
agcggcguugcccaguacggcg

SEQ ID NO: 3811773 - RNA, 16 nt, Salmonella typhimurium LT2
agcggcucauccagca

SEQ ID NO: 3811774 - RNA, 19 nt, Salmonella typhimurium LT2
agcggcucauccagcaaca

SEQ ID NO: 3811775 - RNA, 18 nt, Salmonella typhimurium LT2
agcggcugacacucaucc

SEQ ID NO: 3811776 - RNA, 14 nt, Salmonella typhimurium LT2
agcggcugcgccug

SEQ ID NO: 3811777 - RNA, 17 nt, Salmonella typhimurium LT2
agcggcuuauaaaacgc

SEQ ID NO: 3811778 - RNA, 13 nt, Salmonella typhimurium LT2
agcggcuucaaua

SEQ ID NO: 3811779 - RNA, 18 nt, Salmonella typhimurium LT2
agcgggaccauacuggcg

SEQ ID NO: 3811780 - RNA, 15 nt, Salmonella typhimurium LT2
agcgggaggcgguuc

SEQ ID NO: 3811781 - RNA, 20 nt, Salmonella typhimurium LT2
agcgggcagcauugaccacc

SEQ ID NO: 3811782 - RNA, 14 nt, Salmonella typhimurium LT2
agcgggcuauuuua

SEQ ID NO: 3811783 - RNA, 13 nt, Salmonella typhimurium LT2
agcggguaaacag

SEQ ID NO: 3811784 - RNA, 16 nt, Salmonella typhimurium LT2
agcggguagagcuuuu

SEQ ID NO: 3811785 - RNA, 18 nt, Salmonella typhimurium LT2
agcgggucaggaaacugg

SEQ ID NO: 3811786 - RNA, 18 nt, Salmonella typhimurium LT2
agcgggucccagaagaaa

SEQ ID NO: 3811787 - RNA, 11 nt, Salmonella typhimurium LT2
agcggucagcg

SEQ ID NO: 3811788 - RNA, 14 nt, Salmonella typhimurium LT2
agcggucagcgaug

SEQ ID NO: 3811789 - RNA, 20 nt, Salmonella typhimurium LT2
agcggucggagguucgaauc

SEQ ID NO: 3811790 - RNA, 18 nt, Salmonella typhimurium LT2
agcgguggcgcuccagcc

SEQ ID NO: 3811791 - RNA, 22 nt, Salmonella typhimurium LT2
agcgguuuuuuuguggccugcu

SEQ ID NO: 3811792 - RNA, 19 nt, Salmonella typhimurium LT2
agcguaaauagcccggauc

SEQ ID NO: 3811793 - RNA, 21 nt, Salmonella typhimurium LT2
agcguaacgccccccuaccgg

SEQ ID NO: 3811794 - RNA, 22 nt, Salmonella typhimurium LT2
agcguaacuguugccccgcuuu

SEQ ID NO: 3811795 - RNA, 13 nt, Salmonella typhimurium LT2
agcguaauaugca

SEQ ID NO: 3811796 - RNA, 18 nt, Salmonella typhimurium LT2
agcguaaugcgccaggca

SEQ ID NO: 3811797 - RNA, 21 nt, Salmonella typhimurium LT2
agcguaaugcgccaggcagca

SEQ ID NO: 3811798 - RNA, 19 nt, Salmonella typhimurium LT2
agcguaauggccaccagca

SEQ ID NO: 3811799 - RNA, 23 nt, Salmonella typhimurium LT2
agcguaauuccggccucuuguag

SEQ ID NO: 3811800 - RNA, 19 nt, Salmonella typhimurium LT2
agcguaauuucugguacca

SEQ ID NO: 3811801 - RNA, 18 nt, Salmonella typhimurium LT2
agcguacaggcggaugaa

SEQ ID NO: 3811802 - RNA, 16 nt, Salmonella typhimurium LT2
agcguaccggccacaa

SEQ ID NO: 3811803 - RNA, 14 nt, Salmonella typhimurium LT2
agcguagcgccauc

SEQ ID NO: 3811804 - RNA, 14 nt, Salmonella typhimurium LT2
agcguaguccaggu

SEQ ID NO: 3811805 - RNA, 22 nt, Salmonella typhimurium LT2
agcguaguuuauucuucuccuc

SEQ ID NO: 3811806 - RNA, 15 nt, Salmonella typhimurium LT2
agcguaucgccggcg

SEQ ID NO: 3811807 - RNA, 16 nt, Salmonella typhimurium LT2
agcgucaacugcgccu

SEQ ID NO: 3811808 - RNA, 18 nt, Salmonella typhimurium LT2
agcgucagcaccaguaca

SEQ ID NO: 3811809 - RNA, 13 nt, Salmonella typhimurium LT2
agcgucagcaugg

SEQ ID NO: 3811810 - RNA, 17 nt, Salmonella typhimurium LT2
agcgucagcgggccaaa

SEQ ID NO: 3811811 - RNA, 17 nt, Salmonella typhimurium LT2
agcgucaggguuaucgu

SEQ ID NO: 3811812 - RNA, 15 nt, Salmonella typhimurium LT2
agcgucauccggcaa

SEQ ID NO: 3811813 - RNA, 23 nt, Salmonella typhimurium LT2
agcguccaguccugccccugcca

SEQ ID NO: 3811814 - RNA, 16 nt, Salmonella typhimurium LT2
agcgucgccaguaaca

SEQ ID NO: 3811815 - RNA, 22 nt, Salmonella typhimurium LT2
agcgucgccaguaacaccacga

SEQ ID NO: 3811816 - RNA, 14 nt, Salmonella typhimurium LT2
agcgucgccaugcg

SEQ ID NO: 3811817 - RNA, 12 nt, Salmonella typhimurium LT2
agcgucgccugg

SEQ ID NO: 3811818 - RNA, 22 nt, Salmonella typhimurium LT2
agcgucgggccgcgcugcgccu

SEQ ID NO: 3811819 - RNA, 16 nt, Salmonella typhimurium LT2
agcgucucagcaggcg

SEQ ID NO: 3811820 - RNA, 14 nt, Salmonella typhimurium LT2
agcgucugcggcug

SEQ ID NO: 3811821 - RNA, 19 nt, Salmonella typhimurium LT2
agcgucuguuucaacacau

SEQ ID NO: 3811822 - RNA, 22 nt, Salmonella typhimurium LT2
agcgucuuagcuaucugcccug

SEQ ID NO: 3811823 - RNA, 23 nt, Salmonella typhimurium LT2
agcgucuuuauucugaaagaaaa

SEQ ID NO: 3811824 - RNA, 20 nt, Salmonella typhimurium LT2
agcgucuuuuauccccacua

SEQ ID NO: 3811825 - RNA, 14 nt, Salmonella typhimurium LT2
agcgugacgaccgg

SEQ ID NO: 3811826 - RNA, 12 nt, Salmonella typhimurium LT2
agcgugcagaug

SEQ ID NO: 3811827 - RNA, 22 nt, Salmonella typhimurium LT2
agcgugccgacguucaugccga

SEQ ID NO: 3811828 - RNA, 18 nt, Salmonella typhimurium LT2
agcgugccgguaaagggc

SEQ ID NO: 3811829 - RNA, 17 nt, Salmonella typhimurium LT2
agcguggaaaacagcgc

SEQ ID NO: 3811830 - RNA, 19 nt, Salmonella typhimurium LT2
agcguggaaaacagcgccg

SEQ ID NO: 3811831 - RNA, 23 nt, Salmonella typhimurium LT2
agcguggcgacgauagucagcgc

SEQ ID NO: 3811832 - RNA, 18 nt, Salmonella typhimurium LT2
agcgugggcaaaucaucg

SEQ ID NO: 3811833 - RNA, 17 nt, Salmonella typhimurium LT2
agcgugguuuccggcag

SEQ ID NO: 3811834 - RNA, 16 nt, Salmonella typhimurium LT2
agcgugucgcccggug

SEQ ID NO: 3811835 - RNA, 13 nt, Salmonella typhimurium LT2
agcguguuucauc

SEQ ID NO: 3811836 - RNA, 18 nt, Salmonella typhimurium LT2
agcguuaaacuggcggcg

SEQ ID NO: 3811837 - RNA, 23 nt, Salmonella typhimurium LT2
agcguuaacgacgcuccagaauc

SEQ ID NO: 3811838 - RNA, 15 nt, Salmonella typhimurium LT2
agcguuaaucaccuc

SEQ ID NO: 3811839 - RNA, 19 nt, Salmonella typhimurium LT2
agcguuacgggaacagaau

SEQ ID NO: 3811840 - RNA, 20 nt, Salmonella typhimurium LT2
agcguuacgggaacagaauu

SEQ ID NO: 3811841 - RNA, 19 nt, Salmonella typhimurium LT2
agcguuaucuguaauugac

SEQ ID NO: 3811842 - RNA, 17 nt, Salmonella typhimurium LT2
agcguucucuccaguuc

SEQ ID NO: 3811843 - RNA, 21 nt, Salmonella typhimurium LT2
agcguugccaauagcaaugaa

SEQ ID NO: 3811844 - RNA, 18 nt, Salmonella typhimurium LT2
agcguugcuauugaaaaa

SEQ ID NO: 3811845 - RNA, 17 nt, Salmonella typhimurium LT2
agcguuggcgucagacc

SEQ ID NO: 3811846 - RNA, 24 nt, Salmonella typhimurium LT2
agcguuggcgucagaccggcaauc

SEQ ID NO: 3811847 - RNA, 19 nt, Salmonella typhimurium LT2
agcguuucuacgccauggc

SEQ ID NO: 3811848 - RNA, 19 nt, Salmonella typhimurium LT2
agcguuugacggauuuuuu

SEQ ID NO: 3811849 - RNA, 17 nt, Salmonella typhimurium LT2
agcguuuugauguccag

SEQ ID NO: 3811850 - RNA, 22 nt, Salmonella typhimurium LT2
agcguuuugauguccagaugcu

SEQ ID NO: 3811851 - RNA, 13 nt, Salmonella typhimurium LT2
agcuaaaaacagc

SEQ ID NO: 3811852 - RNA, 17 nt, Salmonella typhimurium LT2
agcuaaagauagccacc

SEQ ID NO: 3811853 - RNA, 20 nt, Salmonella typhimurium LT2
agcuaaauuaaaaauaauca

SEQ ID NO: 3811854 - RNA, 22 nt, Salmonella typhimurium LT2
agcuaacgacccgaaguggugg

SEQ ID NO: 3811855 - RNA, 18 nt, Salmonella typhimurium LT2
agcuaaguuuguaaaaua

SEQ ID NO: 3811856 - RNA, 15 nt, Salmonella typhimurium LT2
agcuaaucacccacu

SEQ ID NO: 3811857 - RNA, 17 nt, Salmonella typhimurium LT2
agcuaaucacccacuuc

SEQ ID NO: 3811858 - RNA, 18 nt, Salmonella typhimurium LT2
agcuaaugcaauaaacua

SEQ ID NO: 3811859 - RNA, 22 nt, Salmonella typhimurium LT2
agcuacaggucgacgugaacug

SEQ ID NO: 3811860 - RNA, 19 nt, Salmonella typhimurium LT2
agcuauccacgcagacgcc

SEQ ID NO: 3811861 - RNA, 19 nt, Salmonella typhimurium LT2
agcuauccagcuucugacg

SEQ ID NO: 3811862 - RNA, 15 nt, Salmonella typhimurium LT2
aggaaagagaaaagc

SEQ ID NO: 3811863 - RNA, 16 nt, Salmonella typhimurium LT2
aggaaauaacaugcca

SEQ ID NO: 3811864 - RNA, 12 nt, Salmonella typhimurium LT2
aggaaauccagc

SEQ ID NO: 3811865 - RNA, 14 nt, Salmonella typhimurium LT2
aggaacagauacug

SEQ ID NO: 3811866 - RNA, 21 nt, Salmonella typhimurium LT2
aggaaccgguagccaggcgcg

SEQ ID NO: 3811867 - RNA, 23 nt, Salmonella typhimurium LT2
aggaacgcgcaguccguuuucaa

SEQ ID NO: 3811868 - RNA, 17 nt, Salmonella typhimurium LT2
aggaagaguaucucucu

SEQ ID NO: 3811869 - RNA, 17 nt, Salmonella typhimurium LT2
aggaagauagcgggcaa

SEQ ID NO: 3811870 - RNA, 15 nt, Salmonella typhimurium LT2
aggaagcagcuugcu

SEQ ID NO: 3811871 - RNA, 15 nt, Salmonella typhimurium LT2
cagggguuccggcaa

SEQ ID NO: 3811872 - RNA, 16 nt, Salmonella typhimurium LT2
cagggguuccggcaau

SEQ ID NO: 3811873 - RNA, 17 nt, Salmonella typhimurium LT2
caggguaaucaccauua

SEQ ID NO: 3811874 - RNA, 23 nt, Salmonella typhimurium LT2
caggguaucaucaauacgcgaca

SEQ ID NO: 3811875 - RNA, 16 nt, Salmonella typhimurium LT2
cagggucgauucccag

SEQ ID NO: 3811876 - RNA, 21 nt, Salmonella typhimurium LT2
cagggucgcggcauuaaaugc

SEQ ID NO: 3811877 - RNA, 23 nt, Salmonella typhimurium LT2
cagggucuuauuucuccugcgcc

SEQ ID NO: 3811878 - RNA, 16 nt, Salmonella typhimurium LT2
cagggugaauaccagc

SEQ ID NO: 3811879 - RNA, 20 nt, Salmonella typhimurium LT2
cagggugacucauuucaaca

SEQ ID NO: 3811880 - RNA, 23 nt, Salmonella typhimurium LT2
caggguuauuuccgcuggccggu

SEQ ID NO: 3811881 - RNA, 14 nt, Salmonella typhimurium LT2
caggguugcguucg

SEQ ID NO: 3811882 - RNA, 13 nt, Salmonella typhimurium LT2
caggguuuacugc

SEQ ID NO: 3811883 - RNA, 21 nt, Salmonella typhimurium LT2
caggguuugccagcaccagca

SEQ ID NO: 3811884 - RNA, 23 nt, Salmonella typhimurium LT2
caggguuugcgcagacugcgcca

SEQ ID NO: 3811885 - RNA, 16 nt, Salmonella typhimurium LT2
caggguuuucaggaag

SEQ ID NO: 3811886 - RNA, 23 nt, Salmonella typhimurium LT2
cagguaaaauugccgccaaccgu

SEQ ID NO: 3811887 - RNA, 22 nt, Salmonella typhimurium LT2
cagguaaaauuucucauuaaaa

SEQ ID NO: 3811888 - RNA, 13 nt, Salmonella typhimurium LT2
cagguaagcccuu

SEQ ID NO: 3811889 - RNA, 21 nt, Salmonella typhimurium LT2
cagguaccccagccauauuuc

SEQ ID NO: 3811890 - RNA, 15 nt, Salmonella typhimurium LT2
cagguaccccgccac

SEQ ID NO: 3811891 - RNA, 17 nt, Salmonella typhimurium LT2
cagguaccccgccaccg

SEQ ID NO: 3811892 - RNA, 20 nt, Salmonella typhimurium LT2
cagguaccccgccaccgccg

SEQ ID NO: 3811893 - RNA, 22 nt, Salmonella typhimurium LT2
cagguacgcguuucacaaccuc

SEQ ID NO: 3811894 - RNA, 21 nt, Salmonella typhimurium LT2
cagguaguuaccguauucugc

SEQ ID NO: 3811895 - RNA, 13 nt, Salmonella typhimurium LT2
cagguaucauaug

SEQ ID NO: 3811896 - RNA, 19 nt, Salmonella typhimurium LT2
ccaucaccuggcaacauag

SEQ ID NO: 3811897 - RNA, 16 nt, Salmonella typhimurium LT2
ccaucacgcccggaug

SEQ ID NO: 3811898 - RNA, 23 nt, Salmonella typhimurium LT2
ccaucacgcugcggucuucaaca

SEQ ID NO: 3811899 - RNA, 21 nt, Salmonella typhimurium LT2
ccaucagaaugcuggucacgg

SEQ ID NO: 3811900 - RNA, 16 nt, Salmonella typhimurium LT2
ccaucagaucgaucuu

SEQ ID NO: 3811901 - RNA, 15 nt, Salmonella typhimurium LT2
ccaucagauucaaca

SEQ ID NO: 3811902 - RNA, 20 nt, Salmonella typhimurium LT2
ccaucagcaucaucaccgcc

SEQ ID NO: 3811903 - RNA, 13 nt, Salmonella typhimurium LT2
ccaucagcgccag

SEQ ID NO: 3811904 - RNA, 20 nt, Salmonella typhimurium LT2
ccaucagcgccagcccugcg

SEQ ID NO: 3811905 - RNA, 20 nt, Salmonella typhimurium LT2
ccaucagcgcgggauaacgc

SEQ ID NO: 3811906 - RNA, 21 nt, Salmonella typhimurium LT2
ccaucagcgcgggauaacgca

SEQ ID NO: 3811907 - RNA, 13 nt, Salmonella typhimurium LT2
ccaucagcgucau

SEQ ID NO: 3811908 - RNA, 14 nt, Salmonella typhimurium LT2
ccaucaggaaauuc

SEQ ID NO: 3811909 - RNA, 12 nt, Salmonella typhimurium LT2
ccaucaggcaau

SEQ ID NO: 3811910 - RNA, 16 nt, Salmonella typhimurium LT2
ccaucaggcaauaugu

SEQ ID NO: 3811911 - RNA, 14 nt, Salmonella typhimurium LT2
ccaucaggccuacg

SEQ ID NO: 3811912 - RNA, 16 nt, Salmonella typhimurium LT2
ccaucauggcuuucag

SEQ ID NO: 3811913 - RNA, 18 nt, Salmonella typhimurium LT2
ccaucauguuaaugauuc

SEQ ID NO: 3811914 - RNA, 13 nt, Salmonella typhimurium LT2
ccaucauuaauau

SEQ ID NO: 3811915 - RNA, 15 nt, Salmonella typhimurium LT2
ccaucauuaauauaa

SEQ ID NO: 3811916 - RNA, 15 nt, Salmonella typhimurium LT2
ccaucauucaacgca

SEQ ID NO: 3811917 - RNA, 16 nt, Salmonella typhimurium LT2
ccaucauuuccggcgg

SEQ ID NO: 3811918 - RNA, 13 nt, Salmonella typhimurium LT2
ccauccaccagaa

SEQ ID NO: 3811919 - RNA, 19 nt, Salmonella typhimurium LT2
ccauccagacaugcacaug

SEQ ID NO: 3811920 - RNA, 21 nt, Salmonella typhimurium LT2
ccaucccugauuuaucacguc

SEQ ID NO: 3811921 - RNA, 13 nt, Salmonella typhimurium LT2
ccauccgauugcu

SEQ ID NO: 3811922 - RNA, 18 nt, Salmonella typhimurium LT2
ccauccggcaauuaaccg

SEQ ID NO: 3811923 - RNA, 18 nt, Salmonella typhimurium LT2
ccauccggcacaaaauau

SEQ ID NO: 3811924 - RNA, 20 nt, Salmonella typhimurium LT2
ccauccggcacacagaauua

SEQ ID NO: 3811925 - RNA, 17 nt, Salmonella typhimurium LT2
ccauccggcacaguauu

SEQ ID NO: 3811926 - RNA, 22 nt, Salmonella typhimurium LT2
ccauccggcacggucaaucauc

SEQ ID NO: 3811927 - RNA, 16 nt, Salmonella typhimurium LT2
ccauccggcauuuuuu

SEQ ID NO: 3811928 - RNA, 16 nt, Salmonella typhimurium LT2
ccauccgggccacucu

SEQ ID NO: 3811929 - RNA, 19 nt, Salmonella typhimurium LT2
ccauccgggccacucucca

SEQ ID NO: 3811930 - RNA, 17 nt, Salmonella typhimurium LT2
ccaucgacagcgccaua

SEQ ID NO: 3811931 - RNA, 18 nt, Salmonella typhimurium LT2
ccaucgacccccaccaug

SEQ ID NO: 3811932 - RNA, 16 nt, Salmonella typhimurium LT2
ccaucgacgaaauggu

SEQ ID NO: 3811933 - RNA, 20 nt, Salmonella typhimurium LT2
ccaucgcacucgcuguaaau

SEQ ID NO: 3811934 - RNA, 17 nt, Salmonella typhimurium LT2
ccaucgccacagcggaa

SEQ ID NO: 3811935 - RNA, 15 nt, Salmonella typhimurium LT2
ccaucgccaguaccg

SEQ ID NO: 3811936 - RNA, 13 nt, Salmonella typhimurium LT2
ccaucgccgccau

SEQ ID NO: 3811937 - RNA, 20 nt, Salmonella typhimurium LT2
ccaucgccugaugaccgccg

SEQ ID NO: 3811938 - RNA, 21 nt, Salmonella typhimurium LT2
ccaucgccugaugaccgccgu

SEQ ID NO: 3811939 - RNA, 22 nt, Salmonella typhimurium LT2
ccaucgcgacuucaaucgccaa

SEQ ID NO: 3811940 - RNA, 17 nt, Salmonella typhimurium LT2
ccaucgcgaucaucagc

SEQ ID NO: 3811941 - RNA, 13 nt, Salmonella typhimurium LT2
ccaucgcgcagcc

SEQ ID NO: 3811942 - RNA, 22 nt, Salmonella typhimurium LT2
ccaucgcuuuacguuuggcggc

SEQ ID NO: 3811943 - RNA, 22 nt, Salmonella typhimurium LT2
ccaucggaaacuauccuggccu

SEQ ID NO: 3811944 - RNA, 23 nt, Salmonella typhimurium LT2
ccaucggcacacuacgcagcggu

SEQ ID NO: 3811945 - RNA, 18 nt, Salmonella typhimurium LT2
ccaucgggcauucaguuu

SEQ ID NO: 3811946 - RNA, 23 nt, Salmonella typhimurium LT2
ccaucgggcauucaguuugcaac

SEQ ID NO: 3811947 - RNA, 17 nt, Salmonella typhimurium LT2
ccaucgggucggccaua

SEQ ID NO: 3811948 - RNA, 14 nt, Salmonella typhimurium LT2
ccaucguccagcca

SEQ ID NO: 3811949 - RNA, 15 nt, Salmonella typhimurium LT2
ccaucguccagccau

SEQ ID NO: 3811950 - RNA, 13 nt, Salmonella typhimurium LT2
ccaucuaacacaa

SEQ ID NO: 3811951 - RNA, 15 nt, Salmonella typhimurium LT2
ccaucucaauaaucu

SEQ ID NO: 3811952 - RNA, 19 nt, Salmonella typhimurium LT2
ccaucucauucgccagcgg

SEQ ID NO: 3811953 - RNA, 14 nt, Salmonella typhimurium LT2
ccaucugacccggg

SEQ ID NO: 3811954 - RNA, 21 nt, Salmonella typhimurium LT2
ccaucuggcguugccugcuau

SEQ ID NO: 3811955 - RNA, 13 nt, Salmonella typhimurium LT2
ccaucuucacgca

SEQ ID NO: 3811956 - RNA, 15 nt, Salmonella typhimurium LT2
ccaucuuccggagua

SEQ ID NO: 3811957 - RNA, 16 nt, Salmonella typhimurium LT2
ccaucuuuaccaaugu

SEQ ID NO: 3811958 - RNA, 16 nt, Salmonella typhimurium LT2
ccaucuuucacccauu

SEQ ID NO: 3811959 - RNA, 22 nt, Salmonella typhimurium LT2
ccaucuuugcaccgcuaaaaaa

SEQ ID NO: 3811960 - RNA, 14 nt, Salmonella typhimurium LT2
ccaugaacgacccg

SEQ ID NO: 3811961 - RNA, 14 nt, Salmonella typhimurium LT2
ccaugaccacaaag

SEQ ID NO: 3811962 - RNA, 15 nt, Salmonella typhimurium LT2
ccaugaccacaaaga

SEQ ID NO: 3811963 - RNA, 14 nt, Salmonella typhimurium LT2
ccaugacgacaggu

SEQ ID NO: 3811964 - RNA, 19 nt, Salmonella typhimurium LT2
ccaugacgcagugcaauau

SEQ ID NO: 3811965 - RNA, 22 nt, Salmonella typhimurium LT2
ccaugagcgaaacuccagcgau

SEQ ID NO: 3811966 - RNA, 23 nt, Salmonella typhimurium LT2
ccaugaguuggccuaccauuuga

SEQ ID NO: 3811967 - RNA, 14 nt, Salmonella typhimurium LT2
ccaugauaaucagc

SEQ ID NO: 3811968 - RNA, 22 nt, Salmonella typhimurium LT2
ccaugaucgauagcgacggcgc

SEQ ID NO: 3811969 - RNA, 14 nt, Salmonella typhimurium LT2
ccaugaucgucagg

SEQ ID NO: 3811970 - RNA, 17 nt, Salmonella typhimurium LT2
ccaugcaaaaugcuucu

SEQ ID NO: 3811971 - RNA, 16 nt, Salmonella typhimurium LT2
ccaugcaccagcccca

SEQ ID NO: 3811972 - RNA, 21 nt, Salmonella typhimurium LT2
ccaugccgaagacuccccugc

SEQ ID NO: 3811973 - RNA, 19 nt, Salmonella typhimurium LT2
ccaugccugauggcgcagc

SEQ ID NO: 3811974 - RNA, 15 nt, Salmonella typhimurium LT2
ccaugcuauucagca

SEQ ID NO: 3811975 - RNA, 23 nt, Salmonella typhimurium LT2
ccaugcuuuccgggccuacaagu

SEQ ID NO: 3811976 - RNA, 16 nt, Salmonella typhimurium LT2
ccauggcaggcagcac

SEQ ID NO: 3811977 - RNA, 15 nt, Salmonella typhimurium LT2
ccauggcccaaaagg

SEQ ID NO: 3811978 - RNA, 14 nt, Salmonella typhimurium LT2
ccauggccgcagcc

SEQ ID NO: 3811979 - RNA, 18 nt, Salmonella typhimurium LT2
ccauggccgcagcccgcc

SEQ ID NO: 3811980 - RNA, 17 nt, Salmonella typhimurium LT2
ccauggcgccaaguucg

SEQ ID NO: 3811981 - RNA, 21 nt, Salmonella typhimurium LT2
ccaugggcgcguuaaugcauu

SEQ ID NO: 3811982 - RNA, 20 nt, Salmonella typhimurium LT2
ccauggguuauccucuccug

SEQ ID NO: 3811983 - RNA, 14 nt, Salmonella typhimurium LT2
ccauguacgcaggc

SEQ ID NO: 3811984 - RNA, 16 nt, Salmonella typhimurium LT2
ccauguacgcaggcgg

SEQ ID NO: 3811985 - RNA, 15 nt, Salmonella typhimurium LT2
ccauguacuccuggu

SEQ ID NO: 3811986 - RNA, 20 nt, Salmonella typhimurium LT2
ccaugucuugcuaucaaacu

SEQ ID NO: 3811987 - RNA, 21 nt, Salmonella typhimurium LT2
ccauguugagcgcuugcugcg

SEQ ID NO: 3811988 - RNA, 14 nt, Salmonella typhimurium LT2
ccauguugccauga

SEQ ID NO: 3811989 - RNA, 15 nt, Salmonella typhimurium LT2
ccauguugcgccgaa

SEQ ID NO: 3811990 - RNA, 19 nt, Salmonella typhimurium LT2
ccauguuuaccaucgcguu

SEQ ID NO: 3811991 - RNA, 23 nt, Salmonella typhimurium LT2
ccauguuuuauacucaaaaaauc

SEQ ID NO: 3811992 - RNA, 22 nt, Salmonella typhimurium LT2
ccauguuuuuuacaggcauccg

SEQ ID NO: 3811993 - RNA, 22 nt, Salmonella typhimurium LT2
ccauuaaaagccagcacggcuu

SEQ ID NO: 3811994 - RNA, 18 nt, Salmonella typhimurium LT2
ccauuaauauuuuaucac

SEQ ID NO: 3811995 - RNA, 23 nt, Salmonella typhimurium LT2
ccauuaauauuuuaucacuauua

SEQ ID NO: 3811996 - RNA, 12 nt, Salmonella typhimurium LT2
ccauuacucuca

SEQ ID NO: 3811997 - RNA, 17 nt, Salmonella typhimurium LT2
ccauuaucgcgccggaa

SEQ ID NO: 3811998 - RNA, 24 nt, Salmonella typhimurium LT2
ccauuauuuauuuucauacuauuu

SEQ ID NO: 3811999 - RNA, 14 nt, Salmonella typhimurium LT2
ccauucaaccagcc

SEQ ID NO: 3812000 - RNA, 12 nt, Salmonella typhimurium LT2
cccagcgccccc

SEQ ID NO: 3812001 - RNA, 14 nt, Salmonella typhimurium LT2
cccagcgcccccag

SEQ ID NO: 3812002 - RNA, 16 nt, Salmonella typhimurium LT2
cccagcgcccccagca

SEQ ID NO: 3812003 - RNA, 15 nt, Salmonella typhimurium LT2
cccagcgcgaccugc

SEQ ID NO: 3812004 - RNA, 12 nt, Salmonella typhimurium LT2
cccagcgcgccg

SEQ ID NO: 3812005 - RNA, 19 nt, Salmonella typhimurium LT2
cccagcgcggcccauucaa

SEQ ID NO: 3812006 - RNA, 17 nt, Salmonella typhimurium LT2
cccagcgcuccaccaac

SEQ ID NO: 3812007 - RNA, 15 nt, Salmonella typhimurium LT2
cccagcgcuggcaga

SEQ ID NO: 3812008 - RNA, 22 nt, Salmonella typhimurium LT2
cccagcggaugucggucaucag

SEQ ID NO: 3812009 - RNA, 22 nt, Salmonella typhimurium LT2
cccagcgggugaugcgccagcc

SEQ ID NO: 3812010 - RNA, 17 nt, Salmonella typhimurium LT2
cccagcguaccacgccg

SEQ ID NO: 3812011 - RNA, 14 nt, Salmonella typhimurium LT2
cccagcgucgccag

SEQ ID NO: 3812012 - RNA, 13 nt, Salmonella typhimurium LT2
cccagcugacugg

SEQ ID NO: 3812013 - RNA, 22 nt, Salmonella typhimurium LT2
cccagcugagcuaaucacccac

SEQ ID NO: 3812014 - RNA, 23 nt, Salmonella typhimurium LT2
cccaggagauaucaaaaguauca

SEQ ID NO: 3812015 - RNA, 21 nt, Salmonella typhimurium LT2
cccaggcaaaugauuaucucc

SEQ ID NO: 3812016 - RNA, 20 nt, Salmonella typhimurium LT2
cccaggcauaaaaaaagcgc

SEQ ID NO: 3812017 - RNA, 15 nt, Salmonella typhimurium LT2
cccaggccgccaccg

SEQ ID NO: 3812018 - RNA, 21 nt, Salmonella typhimurium LT2
cccaggccgccaccgccucgc

SEQ ID NO: 3812019 - RNA, 13 nt, Salmonella typhimurium LT2
cccaggccgggug

SEQ ID NO: 3812020 - RNA, 18 nt, Salmonella typhimurium LT2
cccaggcgauaccgcgcu

SEQ ID NO: 3812021 - RNA, 21 nt, Salmonella typhimurium LT2
cccaggcgauauccacaaugu

SEQ ID NO: 3812022 - RNA, 13 nt, Salmonella typhimurium LT2
cccaggcgcgcag

SEQ ID NO: 3812023 - RNA, 13 nt, Salmonella typhimurium LT2
cccaggcguccag

SEQ ID NO: 3812024 - RNA, 18 nt, Salmonella typhimurium LT2
cccaggucuccgcccagc

SEQ ID NO: 3812025 - RNA, 22 nt, Salmonella typhimurium LT2
cccaggucugaugagcgcagcg

SEQ ID NO: 3812026 - RNA, 18 nt, Salmonella typhimurium LT2
cccagguuagcagccaca

SEQ ID NO: 3812027 - RNA, 19 nt, Salmonella typhimurium LT2
cccagguuauucaggugga

SEQ ID NO: 3812028 - RNA, 23 nt, Salmonella typhimurium LT2
cccagguuguaucauguuccggc

SEQ ID NO: 3812029 - RNA, 17 nt, Salmonella typhimurium LT2
cccaguacaaacaaaua

SEQ ID NO: 3812030 - RNA, 20 nt, Salmonella typhimurium LT2
cccagucaucgucugcgucu

SEQ ID NO: 3812031 - RNA, 19 nt, Salmonella typhimurium LT2
cccaguccacguuuuacuu

SEQ ID NO: 3812032 - RNA, 21 nt, Salmonella typhimurium LT2
cccaguccuuccggcgagaga

SEQ ID NO: 3812033 - RNA, 20 nt, Salmonella typhimurium LT2
cccagucgauaaucgguagc

SEQ ID NO: 3812034 - RNA, 15 nt, Salmonella typhimurium LT2
cccagucgucauccc

SEQ ID NO: 3812035 - RNA, 18 nt, Salmonella typhimurium LT2
cccagugccaccagccgg

SEQ ID NO: 3812036 - RNA, 16 nt, Salmonella typhimurium LT2
cccagugcccgaacgc

SEQ ID NO: 3812037 - RNA, 17 nt, Salmonella typhimurium LT2
cccagugcgcggucaua

SEQ ID NO: 3812038 - RNA, 12 nt, Salmonella typhimurium LT2
cccaguuuaccc

SEQ ID NO: 3812039 - RNA, 18 nt, Salmonella typhimurium LT2
cccaguuucaucaucgcc

SEQ ID NO: 3812040 - RNA, 21 nt, Salmonella typhimurium LT2
cccaguuucaucaucgccgau

SEQ ID NO: 3812041 - RNA, 18 nt, Salmonella typhimurium LT2
cccaguuucuucaggcca

SEQ ID NO: 3812042 - RNA, 20 nt, Salmonella typhimurium LT2
cccaguuucuucaggccagc

SEQ ID NO: 3812043 - RNA, 22 nt, Salmonella typhimurium LT2
cccaguuucuucaggccagccu

SEQ ID NO: 3812044 - RNA, 18 nt, Salmonella typhimurium LT2
cccaguuuuuuucugcca

SEQ ID NO: 3812045 - RNA, 16 nt, Salmonella typhimurium LT2
cccauaaaaaagcccu

SEQ ID NO: 3812046 - RNA, 19 nt, Salmonella typhimurium LT2
cccauaaccgaugcacaug

SEQ ID NO: 3812047 - RNA, 11 nt, Salmonella typhimurium LT2
cccauaaucac

SEQ ID NO: 3812048 - RNA, 14 nt, Salmonella typhimurium LT2
cccauacacaccag

SEQ ID NO: 3812049 - RNA, 15 nt, Salmonella typhimurium LT2
cccauacugcccagc

SEQ ID NO: 3812050 - RNA, 23 nt, Salmonella typhimurium LT2
cccauaguuucauauccgacaga

SEQ ID NO: 3812051 - RNA, 22 nt, Salmonella typhimurium LT2
cccaucaauaacgauaauuuua

SEQ ID NO: 3812052 - RNA, 22 nt, Salmonella typhimurium LT2
cccaucaauaagcgaauugccg

SEQ ID NO: 3812053 - RNA, 12 nt, Salmonella typhimurium LT2
cccaucaaucac

SEQ ID NO: 3812054 - RNA, 13 nt, Salmonella typhimurium LT2
cccaucaccugac

SEQ ID NO: 3812055 - RNA, 17 nt, Salmonella typhimurium LT2
cccaucagcgccagccc

SEQ ID NO: 3812056 - RNA, 14 nt, Salmonella typhimurium LT2
cccaucauugacuu

SEQ ID NO: 3812057 - RNA, 14 nt, Salmonella typhimurium LT2
cccauccagcacag

SEQ ID NO: 3812058 - RNA, 11 nt, Salmonella typhimurium LT2
cccaucccaga

SEQ ID NO: 3812059 - RNA, 16 nt, Salmonella typhimurium LT2
cccauccgcccaccca

SEQ ID NO: 3812060 - RNA, 14 nt, Salmonella typhimurium LT2
cccaucgagccaac

SEQ ID NO: 3812061 - RNA, 23 nt, Salmonella typhimurium LT2
cccaucgccccgaauccacuguc

SEQ ID NO: 3812062 - RNA, 20 nt, Salmonella typhimurium LT2
cccaucgcuuugcagaaaau

SEQ ID NO: 3812063 - RNA, 21 nt, Salmonella typhimurium LT2
cccaucgggccgcucagcauc

SEQ ID NO: 3812064 - RNA, 18 nt, Salmonella typhimurium LT2
cccaucguaacgccgucg

SEQ ID NO: 3812065 - RNA, 14 nt, Salmonella typhimurium LT2
cccaucuuuuuccu

SEQ ID NO: 3812066 - RNA, 14 nt, Salmonella typhimurium LT2
cccaugaucaggcg

SEQ ID NO: 3812067 - RNA, 18 nt, Salmonella typhimurium LT2
cccaugaugggcaagcgu

SEQ ID NO: 3812068 - RNA, 21 nt, Salmonella typhimurium LT2
cccaugaugggcaagcguagu

SEQ ID NO: 3812069 - RNA, 18 nt, Salmonella typhimurium LT2
cccaugauggugaacaga

SEQ ID NO: 3812070 - RNA, 17 nt, Salmonella typhimurium LT2
cccaugcaccagcccca

SEQ ID NO: 3812071 - RNA, 19 nt, Salmonella typhimurium LT2
cccauggcaucaaucccgc

SEQ ID NO: 3812072 - RNA, 19 nt, Salmonella typhimurium LT2
cccaugggcggccugcgcc

SEQ ID NO: 3812073 - RNA, 15 nt, Salmonella typhimurium LT2
cccauguucaugcga

SEQ ID NO: 3812074 - RNA, 14 nt, Salmonella typhimurium LT2
cccauguugcgccg

SEQ ID NO: 3812075 - RNA, 20 nt, Salmonella typhimurium LT2
cccauuacuccgcuauaaaa

SEQ ID NO: 3812076 - RNA, 18 nt, Salmonella typhimurium LT2
cccauugaugccugcccg

SEQ ID NO: 3812077 - RNA, 20 nt, Salmonella typhimurium LT2
cccauugcuauagcccacgc

SEQ ID NO: 3812078 - RNA, 21 nt, Salmonella typhimurium LT2
cccauugucaucaguaugagc

SEQ ID NO: 3812079 - RNA, 22 nt, Salmonella typhimurium LT2
cccauuugcggguggugugcgu

SEQ ID NO: 3812080 - RNA, 14 nt, Salmonella typhimurium LT2
cccauuuuuuguau

SEQ ID NO: 3812081 - RNA, 17 nt, Salmonella typhimurium LT2
ccccaaaaugccgccca

SEQ ID NO: 3812082 - RNA, 17 nt, Salmonella typhimurium LT2
ccccaaacaccaacaaa

SEQ ID NO: 3812083 - RNA, 14 nt, Salmonella typhimurium LT2
ccccaaacgcucau

SEQ ID NO: 3812084 - RNA, 15 nt, Salmonella typhimurium LT2
ccccaaacgcucaua

SEQ ID NO: 3812085 - RNA, 11 nt, Salmonella typhimurium LT2
ccccaacgcgc

SEQ ID NO: 3812086 - RNA, 22 nt, Salmonella typhimurium LT2
ccccaacgcgcuaucguugcgc

SEQ ID NO: 3812087 - RNA, 16 nt, Salmonella typhimurium LT2
ccccaaguggaccggu

SEQ ID NO: 3812088 - RNA, 19 nt, Salmonella typhimurium LT2
ccccacaaucccgccagac

SEQ ID NO: 3812089 - RNA, 19 nt, Salmonella typhimurium LT2
ccccacaggaucaccgcca

SEQ ID NO: 3812090 - RNA, 22 nt, Salmonella typhimurium LT2
ccccaccaugucaagguggugc

SEQ ID NO: 3812091 - RNA, 12 nt, Salmonella typhimurium LT2
ccccagaaaauu

SEQ ID NO: 3812092 - RNA, 15 nt, Salmonella typhimurium LT2
ccccagauagcccuc

SEQ ID NO: 3812093 - RNA, 12 nt, Salmonella typhimurium LT2
ccccagccagag

SEQ ID NO: 3812094 - RNA, 21 nt, Salmonella typhimurium LT2
ccccagcgcuccaccaaccag

SEQ ID NO: 3812095 - RNA, 21 nt, Salmonella typhimurium LT2
ccccaggcgauaccgcgcugg

SEQ ID NO: 3812096 - RNA, 19 nt, Salmonella typhimurium LT2
ccccagguaaauccgccag

SEQ ID NO: 3812097 - RNA, 20 nt, Salmonella typhimurium LT2
ccccagguuauucaggugga

SEQ ID NO: 3812098 - RNA, 19 nt, Salmonella typhimurium LT2
ccccaguaauccggcaacu

SEQ ID NO: 3812099 - RNA, 13 nt, Salmonella typhimurium LT2
ccccaucccagac

SEQ ID NO: 3812100 - RNA, 14 nt, Salmonella typhimurium LT2
ccccaucccggcaa

SEQ ID NO: 3812101 - RNA, 21 nt, Salmonella typhimurium LT2
ccccauguucaguucaaccug

SEQ ID NO: 3812102 - RNA, 18 nt, Salmonella typhimurium LT2
cccccaacgucaccauca

SEQ ID NO: 3812103 - RNA, 18 nt, Salmonella typhimurium LT2
cccccagccgcagccacc

SEQ ID NO: 3812104 - RNA, 19 nt, Salmonella typhimurium LT2
cccgccgggcgucacccgc

SEQ ID NO: 3812105 - RNA, 22 nt, Salmonella typhimurium LT2
cccgccgggcgucacccgccgg

SEQ ID NO: 3812106 - RNA, 20 nt, Salmonella typhimurium LT2
cccgccgguucaauaaauca

SEQ ID NO: 3812107 - RNA, 15 nt, Salmonella typhimurium LT2
cccgccguuaaauca

SEQ ID NO: 3812108 - RNA, 20 nt, Salmonella typhimurium LT2
cccgccucggucaguauuuc

SEQ ID NO: 3812109 - RNA, 15 nt, Salmonella typhimurium LT2
cccgccuugcggcgc

SEQ ID NO: 3812110 - RNA, 15 nt, Salmonella typhimurium LT2
cccgcgcagcgccag

SEQ ID NO: 3812111 - RNA, 13 nt, Salmonella typhimurium LT2
cccgcgcauccca

SEQ ID NO: 3812112 - RNA, 12 nt, Salmonella typhimurium LT2
cccgcgccagca

SEQ ID NO: 3812113 - RNA, 14 nt, Salmonella typhimurium LT2
cccgcgccagcagg

SEQ ID NO: 3812114 - RNA, 19 nt, Salmonella typhimurium LT2
cccgcgccguucggaguug

SEQ ID NO: 3812115 - RNA, 15 nt, Salmonella typhimurium LT2
cccgcgcgaucucuu

SEQ ID NO: 3812116 - RNA, 15 nt, Salmonella typhimurium LT2
cccgcgcgccagcgg

SEQ ID NO: 3812117 - RNA, 17 nt, Salmonella typhimurium LT2
cccgcgcugaggcgaca

SEQ ID NO: 3812118 - RNA, 19 nt, Salmonella typhimurium LT2
cccgcguaauaugggcaca

SEQ ID NO: 3812119 - RNA, 17 nt, Salmonella typhimurium LT2
cccgcgugaacacaccc

SEQ ID NO: 3812120 - RNA, 17 nt, Salmonella typhimurium LT2
cccgcguuaagccccuc

SEQ ID NO: 3812121 - RNA, 16 nt, Salmonella typhimurium LT2
cccgcguucugcugug

SEQ ID NO: 3812122 - RNA, 23 nt, Salmonella typhimurium LT2
cccgcuccagaagcacuucucca

SEQ ID NO: 3812123 - RNA, 22 nt, Salmonella typhimurium LT2
cccgcucgguaauauauuucac

SEQ ID NO: 3812124 - RNA, 20 nt, Salmonella typhimurium LT2
cccgcugacguuggccgccg

SEQ ID NO: 3812125 - RNA, 15 nt, Salmonella typhimurium LT2
cccgcugcgccgcuc

SEQ ID NO: 3812126 - RNA, 16 nt, Salmonella typhimurium LT2
cccgcugcgccgcucc

SEQ ID NO: 3812127 - RNA, 16 nt, Salmonella typhimurium LT2
cccgcuucccgaugcc

SEQ ID NO: 3812128 - RNA, 14 nt, Salmonella typhimurium LT2
cccgcuucgucgcc

SEQ ID NO: 3812129 - RNA, 14 nt, Salmonella typhimurium LT2
cccgcuuuaccgaa

SEQ ID NO: 3812130 - RNA, 21 nt, Salmonella typhimurium LT2
cccggacgaaccuggcgguaa

SEQ ID NO: 3812131 - RNA, 21 nt, Salmonella typhimurium LT2
cccggagagagcaacuggcaa

SEQ ID NO: 3812132 - RNA, 13 nt, Salmonella typhimurium LT2
cccggaucaccgg

SEQ ID NO: 3812133 - RNA, 21 nt, Salmonella typhimurium LT2
cccggaucggucugacgcaua

SEQ ID NO: 3812134 - RNA, 20 nt, Salmonella typhimurium LT2
cccggcaaaccuaccggcau

SEQ ID NO: 3812135 - RNA, 24 nt, Salmonella typhimurium LT2
cccggcaaccuuaaacaucgcccu

SEQ ID NO: 3812136 - RNA, 14 nt, Salmonella typhimurium LT2
cccggcaacugcgc

SEQ ID NO: 3812137 - RNA, 15 nt, Salmonella typhimurium LT2
cccggcaacugcgcc

SEQ ID NO: 3812138 - RNA, 13 nt, Salmonella typhimurium LT2
cccggcaaucgcg

SEQ ID NO: 3812139 - RNA, 18 nt, Salmonella typhimurium LT2
cccggcaauuaccgccag

SEQ ID NO: 3812140 - RNA, 21 nt, Salmonella typhimurium LT2
cccggcaauuaccgccagcgg

SEQ ID NO: 3812141 - RNA, 24 nt, Salmonella typhimurium LT2
cccggcaauuaccgccagcggcgu

SEQ ID NO: 3812142 - RNA, 19 nt, Salmonella typhimurium LT2
cccggcaggcaucgcgccg

SEQ ID NO: 3812143 - RNA, 23 nt, Salmonella typhimurium LT2
cccggcaggcaucgcgccgccgg

SEQ ID NO: 3812144 - RNA, 21 nt, Salmonella typhimurium LT2
cccggcaggcgucauagccgc

SEQ ID NO: 3812145 - RNA, 12 nt, Salmonella typhimurium LT2
cccggccacagc

SEQ ID NO: 3812146 - RNA, 19 nt, Salmonella typhimurium LT2
cccggccacaggcgucgcg

SEQ ID NO: 3812147 - RNA, 17 nt, Salmonella typhimurium LT2
cccggcccgucaucuuc

SEQ ID NO: 3812148 - RNA, 9 nt, Salmonella typhimurium LT2
cccggccgc

SEQ ID NO: 3812149 - RNA, 10 nt, Salmonella typhimurium LT2
cccggccgcg

SEQ ID NO: 3812150 - RNA, 15 nt, Salmonella typhimurium LT2
cccggccuacacauc

SEQ ID NO: 3812151 - RNA, 14 nt, Salmonella typhimurium LT2
cccggccugacgca

SEQ ID NO: 3812152 - RNA, 15 nt, Salmonella typhimurium LT2
cccggcgacccgccc

SEQ ID NO: 3812153 - RNA, 22 nt, Salmonella typhimurium LT2
cccggcgauccguagcccugga

SEQ ID NO: 3812154 - RNA, 15 nt, Salmonella typhimurium LT2
cccggcgcacacccu

SEQ ID NO: 3812155 - RNA, 17 nt, Salmonella typhimurium LT2
cccggcgcacacccugc

SEQ ID NO: 3812156 - RNA, 21 nt, Salmonella typhimurium LT2
cccggcgccaaucaccgccag

SEQ ID NO: 3812157 - RNA, 21 nt, Salmonella typhimurium LT2
cccggcggauaaaucaucauc

SEQ ID NO: 3812158 - RNA, 21 nt, Salmonella typhimurium LT2
cccggcggguauggcaaugcc

SEQ ID NO: 3812159 - RNA, 15 nt, Salmonella typhimurium LT2
cccggcguagcgcgc

SEQ ID NO: 3812160 - RNA, 20 nt, Salmonella typhimurium LT2
cccggcguauccaguaacca

SEQ ID NO: 3812161 - RNA, 17 nt, Salmonella typhimurium LT2
cccggcguaugccgggc

SEQ ID NO: 3812162 - RNA, 22 nt, Salmonella typhimurium LT2
cccggcuaaaugacgcgcgaga

SEQ ID NO: 3812163 - RNA, 21 nt, Salmonella typhimurium LT2
cccggcuuaccggcuaucagc

SEQ ID NO: 3812164 - RNA, 15 nt, Salmonella typhimurium LT2
cccggcuuccaucgc

SEQ ID NO: 3812165 - RNA, 20 nt, Salmonella typhimurium LT2
cccgggagaacgccgggccu

SEQ ID NO: 3812166 - RNA, 17 nt, Salmonella typhimurium LT2
cccggguaaugcugcag

SEQ ID NO: 3812167 - RNA, 14 nt, Salmonella typhimurium LT2
cccgggugcgcagc

SEQ ID NO: 3812168 - RNA, 16 nt, Salmonella typhimurium LT2
cccggucaacgcgccg

SEQ ID NO: 3812169 - RNA, 19 nt, Salmonella typhimurium LT2
cccggucaacgcgccgcca

SEQ ID NO: 3812170 - RNA, 12 nt, Salmonella typhimurium LT2
cccggucacauu

SEQ ID NO: 3812171 - RNA, 15 nt, Salmonella typhimurium LT2
cccgguccugcggug

SEQ ID NO: 3812172 - RNA, 14 nt, Salmonella typhimurium LT2
cccggucgcgccag

SEQ ID NO: 3812173 - RNA, 20 nt, Salmonella typhimurium LT2
cccggugaaaaacaucggca

SEQ ID NO: 3812174 - RNA, 16 nt, Salmonella typhimurium LT2
cccggugagcgccgcg

SEQ ID NO: 3812175 - RNA, 15 nt, Salmonella typhimurium LT2
cccgguggcgccgcg

SEQ ID NO: 3812176 - RNA, 17 nt, Salmonella typhimurium LT2
cccgguggcgccgcgcc

SEQ ID NO: 3812177 - RNA, 20 nt, Salmonella typhimurium LT2
cccgguggcgguaccggcau

SEQ ID NO: 3812178 - RNA, 17 nt, Salmonella typhimurium LT2
cccgguucauuaccgac

SEQ ID NO: 3812179 - RNA, 16 nt, Salmonella typhimurium LT2
cccgguuuauccccgc

SEQ ID NO: 3812180 - RNA, 23 nt, Salmonella typhimurium LT2
cccgguuuauccccgcuggcgcg

SEQ ID NO: 3812181 - RNA, 14 nt, Salmonella typhimurium LT2
cccguaauauugac

SEQ ID NO: 3812182 - RNA, 16 nt, Salmonella typhimurium LT2
cccguaucacugauau

SEQ ID NO: 3812183 - RNA, 12 nt, Salmonella typhimurium LT2
cccgucauacuu

SEQ ID NO: 3812184 - RNA, 20 nt, Salmonella typhimurium LT2
cccgucgccuguuucugcgc

SEQ ID NO: 3812185 - RNA, 20 nt, Salmonella typhimurium LT2
cccgucuaaccgggccugau

SEQ ID NO: 3812186 - RNA, 13 nt, Salmonella typhimurium LT2
cccguuccaggcg

SEQ ID NO: 3812187 - RNA, 18 nt, Salmonella typhimurium LT2
cccguuccucguccugau

SEQ ID NO: 3812188 - RNA, 15 nt, Salmonella typhimurium LT2
cccguucucgccgcg

SEQ ID NO: 3812189 - RNA, 22 nt, Salmonella typhimurium LT2
cccguuucccggauaaauguuu

SEQ ID NO: 3812190 - RNA, 13 nt, Salmonella typhimurium LT2
cccuaaaagcgcg

SEQ ID NO: 3812191 - RNA, 17 nt, Salmonella typhimurium LT2
cccuaaagcucaucaau

SEQ ID NO: 3812192 - RNA, 18 nt, Salmonella typhimurium LT2
cccuaacuggucaaacaa

SEQ ID NO: 3812193 - RNA, 20 nt, Salmonella typhimurium LT2
cccuaucaccauaaucgcga

SEQ ID NO: 3812194 - RNA, 23 nt, Salmonella typhimurium LT2
cccucaaguuauguuauccccac

SEQ ID NO: 3812195 - RNA, 18 nt, Salmonella typhimurium LT2
cccucaauaucuuugccu

SEQ ID NO: 3812196 - RNA, 15 nt, Salmonella typhimurium LT2
cccuccagccagcgc

SEQ ID NO: 3812197 - RNA, 21 nt, Salmonella typhimurium LT2
cccuccgcaucaaaaugaugu

SEQ ID NO: 3812198 - RNA, 12 nt, Salmonella typhimurium LT2
cccuccugccuu

SEQ ID NO: 3812199 - RNA, 13 nt, Salmonella typhimurium LT2
cccucgcaccaaa

SEQ ID NO: 3812200 - RNA, 14 nt, Salmonella typhimurium LT2
cccucgguuuaucc

SEQ ID NO: 3812201 - RNA, 19 nt, Salmonella typhimurium LT2
cccucgguuuauccccgcu

SEQ ID NO: 3812202 - RNA, 14 nt, Salmonella typhimurium LT2
cccucuuccaucag

SEQ ID NO: 3812203 - RNA, 22 nt, Salmonella typhimurium LT2
cccucuuccaucagccaggcgg

SEQ ID NO: 3812204 - RNA, 15 nt, Salmonella typhimurium LT2
cccucuuccggcgcu

SEQ ID NO: 3812205 - RNA, 18 nt, Salmonella typhimurium LT2
cccugaauuucaauaauc

SEQ ID NO: 3812206 - RNA, 16 nt, Salmonella typhimurium LT2
cccugaucccacagcg

SEQ ID NO: 3812207 - RNA, 22 nt, Salmonella typhimurium LT2
cccugaugcguauccagcgcgg

SEQ ID NO: 3812208 - RNA, 16 nt, Salmonella typhimurium LT2
ccgacguuaacugccg

SEQ ID NO: 3812209 - RNA, 16 nt, Salmonella typhimurium LT2
ccgacuaccggcacca

SEQ ID NO: 3812210 - RNA, 19 nt, Salmonella typhimurium LT2
ccgacuaccggcaccagca

SEQ ID NO: 3812211 - RNA, 15 nt, Salmonella typhimurium LT2
ccgacuacgccuccu

SEQ ID NO: 3812212 - RNA, 20 nt, Salmonella typhimurium LT2
ccgacuauuccgcaaacgcc

SEQ ID NO: 3812213 - RNA, 15 nt, Salmonella typhimurium LT2
ccgacugccaccacg

SEQ ID NO: 3812214 - RNA, 20 nt, Salmonella typhimurium LT2
ccgacugucgaaaccagcau

SEQ ID NO: 3812215 - RNA, 13 nt, Salmonella typhimurium LT2
ccgacuuucaaau

SEQ ID NO: 3812216 - RNA, 22 nt, Salmonella typhimurium LT2
ccgacuuuuuugccuuucagau

SEQ ID NO: 3812217 - RNA, 18 nt, Salmonella typhimurium LT2
ccgagagcuacaguguua

SEQ ID NO: 3812218 - RNA, 18 nt, Salmonella typhimurium LT2
ccgagcagccuggcggcu

SEQ ID NO: 3812219 - RNA, 20 nt, Salmonella typhimurium LT2
ccgagcaggacgcgcgcgaa

SEQ ID NO: 3812220 - RNA, 23 nt, Salmonella typhimurium LT2
ccgagcaggacgcgcgcgaaaag

SEQ ID NO: 3812221 - RNA, 15 nt, Salmonella typhimurium LT2
ccgagguucaccagc

SEQ ID NO: 3812222 - RNA, 21 nt, Salmonella typhimurium LT2
ccgagguucaccagcgcgccg

SEQ ID NO: 3812223 - RNA, 19 nt, Salmonella typhimurium LT2
ccgaguaacaccgcggcgc

SEQ ID NO: 3812224 - RNA, 22 nt, Salmonella typhimurium LT2
ccgagugcuuauguaggccuga

SEQ ID NO: 3812225 - RNA, 22 nt, Salmonella typhimurium LT2
ccgauaaaucaaacgcaccacc

SEQ ID NO: 3812226 - RNA, 15 nt, Salmonella typhimurium LT2
ccgauaacgcggccc

SEQ ID NO: 3812227 - RNA, 19 nt, Salmonella typhimurium LT2
ccgauaagcaaagcgccau

SEQ ID NO: 3812228 - RNA, 18 nt, Salmonella typhimurium LT2
ccgauaagcaagcgccau

SEQ ID NO: 3812229 - RNA, 21 nt, Salmonella typhimurium LT2
ccgauaagcuuacgccaucgg

SEQ ID NO: 3812230 - RNA, 17 nt, Salmonella typhimurium LT2
ccgauacaggacugacu

SEQ ID NO: 3812231 - RNA, 23 nt, Salmonella typhimurium LT2
ccgauacaggacugacugcuguc

SEQ ID NO: 3812232 - RNA, 13 nt, Salmonella typhimurium LT2
ccgauaccaaaau

SEQ ID NO: 3812233 - RNA, 13 nt, Salmonella typhimurium LT2
ccgauagcauuau

SEQ ID NO: 3812234 - RNA, 23 nt, Salmonella typhimurium LT2
ccgauagcgaaacugauauuaga

SEQ ID NO: 3812235 - RNA, 16 nt, Salmonella typhimurium LT2
ccgauagcgccgcgcu

SEQ ID NO: 3812236 - RNA, 16 nt, Salmonella typhimurium LT2
ccgauagcggcggcgc

SEQ ID NO: 3812237 - RNA, 19 nt, Salmonella typhimurium LT2
ccgauaggugccgccgcac

SEQ ID NO: 3812238 - RNA, 16 nt, Salmonella typhimurium LT2
ccgauaguguaaacgc

SEQ ID NO: 3812239 - RNA, 20 nt, Salmonella typhimurium LT2
ccgauaguguaaacgcgcca

SEQ ID NO: 3812240 - RNA, 23 nt, Salmonella typhimurium LT2
ccgauauugccuucacccagacu

SEQ ID NO: 3812241 - RNA, 18 nt, Salmonella typhimurium LT2
ccgauauuggucaugcgg

SEQ ID NO: 3812242 - RNA, 11 nt, Salmonella typhimurium LT2
ccgaucaggcc

SEQ ID NO: 3812243 - RNA, 23 nt, Salmonella typhimurium LT2
ccgaucaucguaccaauacccag

SEQ ID NO: 3812244 - RNA, 23 nt, Salmonella typhimurium LT2
ccgauccgaagaacagauucauu

SEQ ID NO: 3812245 - RNA, 18 nt, Salmonella typhimurium LT2
ccgaucgcgauacgcgcg

SEQ ID NO: 3812246 - RNA, 19 nt, Salmonella typhimurium LT2
ccgaucucaugcaacuggc

SEQ ID NO: 3812247 - RNA, 12 nt, Salmonella typhimurium LT2
ccgaucucccag

SEQ ID NO: 3812248 - RNA, 13 nt, Salmonella typhimurium LT2
ccgaucucccagc

SEQ ID NO: 3812249 - RNA, 21 nt, Salmonella typhimurium LT2
ccgaucugguuguccaccagc

SEQ ID NO: 3812250 - RNA, 15 nt, Salmonella typhimurium LT2
ccgaugacucccagu

SEQ ID NO: 3812251 - RNA, 14 nt, Salmonella typhimurium LT2
ccgaugaucccggc

SEQ ID NO: 3812252 - RNA, 11 nt, Salmonella typhimurium LT2
ccgaugcacau

SEQ ID NO: 3812253 - RNA, 14 nt, Salmonella typhimurium LT2
ccgaugcccagcuu

SEQ ID NO: 3812254 - RNA, 14 nt, Salmonella typhimurium LT2
ccgaugcccggcaa

SEQ ID NO: 3812255 - RNA, 20 nt, Salmonella typhimurium LT2
ccgaugucgccacgccgccc

SEQ ID NO: 3812256 - RNA, 19 nt, Salmonella typhimurium LT2
ccgaugugcguauucagcg

SEQ ID NO: 3812257 - RNA, 15 nt, Salmonella typhimurium LT2
ccgauucccgccugc

SEQ ID NO: 3812258 - RNA, 18 nt, Salmonella typhimurium LT2
ccgauugccgcucagcuc

SEQ ID NO: 3812259 - RNA, 20 nt, Salmonella typhimurium LT2
ccgauuucacgaccgccgau

SEQ ID NO: 3812260 - RNA, 23 nt, Salmonella typhimurium LT2
ccgauuuugucggaauuuccggg

SEQ ID NO: 3812261 - RNA, 23 nt, Salmonella typhimurium LT2
ccgauuuuuuaucucgccgucga

SEQ ID NO: 3812262 - RNA, 21 nt, Salmonella typhimurium LT2
ccgcaaacggaauagcgccuu

SEQ ID NO: 3812263 - RNA, 21 nt, Salmonella typhimurium LT2
ccgcaaacuggccacagcaaa

SEQ ID NO: 3812264 - RNA, 20 nt, Salmonella typhimurium LT2
ccgcaaagaaccaacaccag

SEQ ID NO: 3812265 - RNA, 15 nt, Salmonella typhimurium LT2
ccgcaaagcccauca

SEQ ID NO: 3812266 - RNA, 21 nt, Salmonella typhimurium LT2
ccgcaaagcccaucagcgcca

SEQ ID NO: 3812267 - RNA, 20 nt, Salmonella typhimurium LT2
ccgcaaauccacuggucguc

SEQ ID NO: 3812268 - RNA, 21 nt, Salmonella typhimurium LT2
ccgcaaauucgucgccgccaa

SEQ ID NO: 3812269 - RNA, 18 nt, Salmonella typhimurium LT2
ccgcaacggcuugugagc

SEQ ID NO: 3812270 - RNA, 15 nt, Salmonella typhimurium LT2
ccgcaacggucgguc

SEQ ID NO: 3812271 - RNA, 23 nt, Salmonella typhimurium LT2
ccgcaagaaacaggcugacaaag

SEQ ID NO: 3812272 - RNA, 23 nt, Salmonella typhimurium LT2
ccgcaagcauaaaaaacaucaug

SEQ ID NO: 3812273 - RNA, 22 nt, Salmonella typhimurium LT2
ccgcaagcggcaaucgccucau

SEQ ID NO: 3812274 - RNA, 13 nt, Salmonella typhimurium LT2
ccgcaauaacagg

SEQ ID NO: 3812275 - RNA, 15 nt, Salmonella typhimurium LT2
ccgcaauacagcccg

SEQ ID NO: 3812276 - RNA, 22 nt, Salmonella typhimurium LT2
ccgcaauaccaauuaccggcuu

SEQ ID NO: 3812277 - RNA, 17 nt, Salmonella typhimurium LT2
ccgcaauacgcuucaua

SEQ ID NO: 3812278 - RNA, 14 nt, Salmonella typhimurium LT2
ccgcaauccuggcu

SEQ ID NO: 3812279 - RNA, 18 nt, Salmonella typhimurium LT2
ccgcaaucgcugccuuga

SEQ ID NO: 3812280 - RNA, 17 nt, Salmonella typhimurium LT2
ccgcaaugaccacaaau

SEQ ID NO: 3812281 - RNA, 17 nt, Salmonella typhimurium LT2
ccgcaauuaaaugaaug

SEQ ID NO: 3812282 - RNA, 18 nt, Salmonella typhimurium LT2
ccgcaauugguaauuaaa

SEQ ID NO: 3812283 - RNA, 14 nt, Salmonella typhimurium LT2
ccgcacagaaucgc

SEQ ID NO: 3812284 - RNA, 14 nt, Salmonella typhimurium LT2
ccgcacagcagaca

SEQ ID NO: 3812285 - RNA, 14 nt, Salmonella typhimurium LT2
ccgcacauaaucac

SEQ ID NO: 3812286 - RNA, 23 nt, Salmonella typhimurium LT2
ccgcacaucggcaggaacagaua

SEQ ID NO: 3812287 - RNA, 22 nt, Salmonella typhimurium LT2
ccgcaccuggguauuccacugg

SEQ ID NO: 3812288 - RNA, 13 nt, Salmonella typhimurium LT2
ccgcacgccggug

SEQ ID NO: 3812289 - RNA, 12 nt, Salmonella typhimurium LT2
ccgcacgcgcgc

SEQ ID NO: 3812290 - RNA, 20 nt, Salmonella typhimurium LT2
ccgcacgguggauggucucu

SEQ ID NO: 3812291 - RNA, 13 nt, Salmonella typhimurium LT2
ccgcacugcaucg

SEQ ID NO: 3812292 - RNA, 14 nt, Salmonella typhimurium LT2
ccgcagaaaaagcc

SEQ ID NO: 3812293 - RNA, 22 nt, Salmonella typhimurium LT2
ccgcagcacccguucgcugcau

SEQ ID NO: 3812294 - RNA, 23 nt, Salmonella typhimurium LT2
ccgcagcacccguucgcugcauu

SEQ ID NO: 3812295 - RNA, 15 nt, Salmonella typhimurium LT2
ccgcagcaggcgggc

SEQ ID NO: 3812296 - RNA, 16 nt, Salmonella typhimurium LT2
ccgcagccaccccggc

SEQ ID NO: 3812297 - RNA, 11 nt, Salmonella typhimurium LT2
ccgcagccacu

SEQ ID NO: 3812298 - RNA, 12 nt, Salmonella typhimurium LT2
ccgcagccagaa

SEQ ID NO: 3812299 - RNA, 19 nt, Salmonella typhimurium LT2
ccgcagccagaaucagccg

SEQ ID NO: 3812300 - RNA, 21 nt, Salmonella typhimurium LT2
ccgcagcccgcccacaggcug

SEQ ID NO: 3812301 - RNA, 10 nt, Salmonella typhimurium LT2
ccgcagccgg

SEQ ID NO: 3812302 - RNA, 13 nt, Salmonella typhimurium LT2
ccgcagccggaua

SEQ ID NO: 3812303 - RNA, 22 nt, Salmonella typhimurium LT2
ccgcagccuaguucugcgccag

SEQ ID NO: 3812304 - RNA, 13 nt, Salmonella typhimurium LT2
ccgcagccugaug

SEQ ID NO: 3812305 - RNA, 12 nt, Salmonella typhimurium LT2
ccgcagcgccau

SEQ ID NO: 3812306 - RNA, 22 nt, Salmonella typhimurium LT2
ccgcagcgccuuaccguaugca

SEQ ID NO: 3812307 - RNA, 15 nt, Salmonella typhimurium LT2
ccgcagcggaggcgu

SEQ ID NO: 3812308 - RNA, 18 nt, Salmonella typhimurium LT2
ccgcagcggauugccgcg

SEQ ID NO: 3812309 - RNA, 12 nt, Salmonella typhimurium LT2
ccgcagcucaua

SEQ ID NO: 3812310 - RNA, 18 nt, Salmonella typhimurium LT2
ccgcagcucauaacggcu

SEQ ID NO: 3812311 - RNA, 14 nt, Salmonella typhimurium LT2
ccgcaggcuuccag

SEQ ID NO: 3812312 - RNA, 15 nt, Salmonella typhimurium LT2
ccgccuugcggcggc

SEQ ID NO: 3812313 - RNA, 11 nt, Salmonella typhimurium LT2
ccgccuugucu

SEQ ID NO: 3812314 - RNA, 23 nt, Salmonella typhimurium LT2
ccgccuuuucccccagcaucuua

SEQ ID NO: 3812315 - RNA, 17 nt, Salmonella typhimurium LT2
ccgcgaaccggaccagc

SEQ ID NO: 3812316 - RNA, 16 nt, Salmonella typhimurium LT2
ccgcgacagucgcaga

SEQ ID NO: 3812317 - RNA, 15 nt, Salmonella typhimurium LT2
ccgcgacuuuggcuu

SEQ ID NO: 3812318 - RNA, 16 nt, Salmonella typhimurium LT2
ccgcgagaaucgccag

SEQ ID NO: 3812319 - RNA, 19 nt, Salmonella typhimurium LT2
ccgcgauagaccacgccau

SEQ ID NO: 3812320 - RNA, 16 nt, Salmonella typhimurium LT2
ccgcgaucgcggcaac

SEQ ID NO: 3812321 - RNA, 22 nt, Salmonella typhimurium LT2
ccgcgaugaucgucgcgaucgc

SEQ ID NO: 3812322 - RNA, 21 nt, Salmonella typhimurium LT2
ccgcgauguuugcucgccaua

SEQ ID NO: 3812323 - RNA, 18 nt, Salmonella typhimurium LT2
ccgcgauuuagcguuggc

SEQ ID NO: 3812324 - RNA, 16 nt, Salmonella typhimurium LT2
ccgcgcaaagcaauac

SEQ ID NO: 3812325 - RNA, 13 nt, Salmonella typhimurium LT2
ccgcgcacgccgc

SEQ ID NO: 3812326 - RNA, 16 nt, Salmonella typhimurium LT2
ccgcgcacgccgcucg

SEQ ID NO: 3812327 - RNA, 20 nt, Salmonella typhimurium LT2
ccgcgcacgcgcgcgcguca

SEQ ID NO: 3812328 - RNA, 15 nt, Salmonella typhimurium LT2
ccgcgcauagcuggc

SEQ ID NO: 3812329 - RNA, 11 nt, Salmonella typhimurium LT2
ccgcgccaccg

SEQ ID NO: 3812330 - RNA, 15 nt, Salmonella typhimurium LT2
ccgcgccaccgggcc

SEQ ID NO: 3812331 - RNA, 14 nt, Salmonella typhimurium LT2
ccgcgccagaccgc

SEQ ID NO: 3812332 - RNA, 16 nt, Salmonella typhimurium LT2
ccgcgccagaccgcuu

SEQ ID NO: 3812333 - RNA, 14 nt, Salmonella typhimurium LT2
ccgcgccagcaggu

SEQ ID NO: 3812334 - RNA, 13 nt, Salmonella typhimurium LT2
ccgcgccaggcgg

SEQ ID NO: 3812335 - RNA, 11 nt, Salmonella typhimurium LT2
ccgcgccgccc

SEQ ID NO: 3812336 - RNA, 11 nt, Salmonella typhimurium LT2
ccgcgccggac

SEQ ID NO: 3812337 - RNA, 15 nt, Salmonella typhimurium LT2
ccgcgccuaccagcg

SEQ ID NO: 3812338 - RNA, 20 nt, Salmonella typhimurium LT2
ccgcgcgaaccaugaacgau

SEQ ID NO: 3812339 - RNA, 13 nt, Salmonella typhimurium LT2
ccgcgcgaagagg

SEQ ID NO: 3812340 - RNA, 15 nt, Salmonella typhimurium LT2
ccgcgcgccagcgga

SEQ ID NO: 3812341 - RNA, 15 nt, Salmonella typhimurium LT2
ccgcgcggaucgcca

SEQ ID NO: 3812342 - RNA, 14 nt, Salmonella typhimurium LT2
ccgcgcggcguucu

SEQ ID NO: 3812343 - RNA, 16 nt, Salmonella typhimurium LT2
ccgcgcggcguucugc

SEQ ID NO: 3812344 - RNA, 15 nt, Salmonella typhimurium LT2
ccgcgcgucagcgug

SEQ ID NO: 3812345 - RNA, 18 nt, Salmonella typhimurium LT2
ccgcgcuagugccgccag

SEQ ID NO: 3812346 - RNA, 20 nt, Salmonella typhimurium LT2
ccgcgcuaucgggucugcgc

SEQ ID NO: 3812347 - RNA, 12 nt, Salmonella typhimurium LT2
ccgcgcucaccg

SEQ ID NO: 3812348 - RNA, 13 nt, Salmonella typhimurium LT2
ccgcgcucaguca

SEQ ID NO: 3812349 - RNA, 16 nt, Salmonella typhimurium LT2
ccgcgcugcgccgcaa

SEQ ID NO: 3812350 - RNA, 19 nt, Salmonella typhimurium LT2
ccgcgcuuucuggcgcaga

SEQ ID NO: 3812351 - RNA, 18 nt, Salmonella typhimurium LT2
ccgcggagaucgcucccg

SEQ ID NO: 3812352 - RNA, 19 nt, Salmonella typhimurium LT2
ccgcggagaucgcucccgc

SEQ ID NO: 3812353 - RNA, 15 nt, Salmonella typhimurium LT2
ccgcggauagacgau

SEQ ID NO: 3812354 - RNA, 15 nt, Salmonella typhimurium LT2
ccgcggccuuaaccu

SEQ ID NO: 3812355 - RNA, 15 nt, Salmonella typhimurium LT2
ccgcggcggacagcg

SEQ ID NO: 3812356 - RNA, 19 nt, Salmonella typhimurium LT2
ccgcgguacgaaucgccgc

SEQ ID NO: 3812357 - RNA, 21 nt, Salmonella typhimurium LT2
ccgcgguacgaaucgccgcgc

SEQ ID NO: 3812358 - RNA, 23 nt, Salmonella typhimurium LT2
ccgcguaauaugggcacaacccu

SEQ ID NO: 3812359 - RNA, 20 nt, Salmonella typhimurium LT2
ccgcguagcccagcgccgca

SEQ ID NO: 3812360 - RNA, 19 nt, Salmonella typhimurium LT2
ccgcguaucauugcgcucu

SEQ ID NO: 3812361 - RNA, 20 nt, Salmonella typhimurium LT2
ccgcgucguuacgcucguca

SEQ ID NO: 3812362 - RNA, 20 nt, Salmonella typhimurium LT2
ccgcgucugaccgccgcgau

SEQ ID NO: 3812363 - RNA, 18 nt, Salmonella typhimurium LT2
ccgcgucuucgaugccau

SEQ ID NO: 3812364 - RNA, 17 nt, Salmonella typhimurium LT2
ccgcgugaacacacccu

SEQ ID NO: 3812365 - RNA, 15 nt, Salmonella typhimurium LT2
ccgcguuacccugcg

SEQ ID NO: 3812366 - RNA, 20 nt, Salmonella typhimurium LT2
ccgcguugcgccaagcgccu

SEQ ID NO: 3812367 - RNA, 19 nt, Salmonella typhimurium LT2
ccgcguuuaacgcagcgcg

SEQ ID NO: 3812368 - RNA, 18 nt, Salmonella typhimurium LT2
ccgcguuuuaaaccgcga

SEQ ID NO: 3812369 - RNA, 17 nt, Salmonella typhimurium LT2
ccgcuaagggcaccagc

SEQ ID NO: 3812370 - RNA, 13 nt, Salmonella typhimurium LT2
ccgcuaauaccga

SEQ ID NO: 3812371 - RNA, 14 nt, Salmonella typhimurium LT2
ccgcuacaauccag

SEQ ID NO: 3812372 - RNA, 16 nt, Salmonella typhimurium LT2
ccgcuaccgcuuugac

SEQ ID NO: 3812373 - RNA, 23 nt, Salmonella typhimurium LT2
ccgcuacguaaccggccagccug

SEQ ID NO: 3812374 - RNA, 15 nt, Salmonella typhimurium LT2
ccgcuaucauaccua

SEQ ID NO: 3812375 - RNA, 15 nt, Salmonella typhimurium LT2
ccgcuaucgaccagc

SEQ ID NO: 3812376 - RNA, 16 nt, Salmonella typhimurium LT2
ccgcuaucgccaaacu

SEQ ID NO: 3812377 - RNA, 20 nt, Salmonella typhimurium LT2
ccgcuaucugcuccgccagc

SEQ ID NO: 3812378 - RNA, 14 nt, Salmonella typhimurium LT2
ccgcucaauaauau

SEQ ID NO: 3812379 - RNA, 15 nt, Salmonella typhimurium LT2
ccgcucacaaugccg

SEQ ID NO: 3812380 - RNA, 14 nt, Salmonella typhimurium LT2
ccgcucagcucgac

SEQ ID NO: 3812381 - RNA, 21 nt, Salmonella typhimurium LT2
ccgcucagcucgacgacgugg

SEQ ID NO: 3812382 - RNA, 21 nt, Salmonella typhimurium LT2
ccgcucaucgcgucucccaga

SEQ ID NO: 3812383 - RNA, 18 nt, Salmonella typhimurium LT2
ccgcucccgcauggacaa

SEQ ID NO: 3812384 - RNA, 14 nt, Salmonella typhimurium LT2
ccgcucgaaucgcc

SEQ ID NO: 3812385 - RNA, 18 nt, Salmonella typhimurium LT2
ccgcucgcccgcagcaaa

SEQ ID NO: 3812386 - RNA, 12 nt, Salmonella typhimurium LT2
ccgcucggcaua

SEQ ID NO: 3812387 - RNA, 16 nt, Salmonella typhimurium LT2
ccgcucuucagcgucc

SEQ ID NO: 3812388 - RNA, 19 nt, Salmonella typhimurium LT2
ccgcugaaauagccccguc

SEQ ID NO: 3812389 - RNA, 19 nt, Salmonella typhimurium LT2
ccgcugacacgcgcaguac

SEQ ID NO: 3812390 - RNA, 24 nt, Salmonella typhimurium LT2
ccgcugacacgcgcaguacggcgc

SEQ ID NO: 3812391 - RNA, 19 nt, Salmonella typhimurium LT2
ccgcugacguuggccgccg

SEQ ID NO: 3812392 - RNA, 24 nt, Salmonella typhimurium LT2
ccgcugacguuggccgccggacag

SEQ ID NO: 3812393 - RNA, 15 nt, Salmonella typhimurium LT2
ccgcugcgcacggca

SEQ ID NO: 3812394 - RNA, 19 nt, Salmonella typhimurium LT2
ccgcugcggucaggaauga

SEQ ID NO: 3812395 - RNA, 19 nt, Salmonella typhimurium LT2
ccgcugcugccuuccaguu

SEQ ID NO: 3812396 - RNA, 12 nt, Salmonella typhimurium LT2
ccgcuggaauaa

SEQ ID NO: 3812397 - RNA, 13 nt, Salmonella typhimurium LT2
ccgcuggccgguu

SEQ ID NO: 3812398 - RNA, 19 nt, Salmonella typhimurium LT2
ccgcuggcgaccagccugc

SEQ ID NO: 3812399 - RNA, 12 nt, Salmonella typhimurium LT2
ccgcuggcgucu

SEQ ID NO: 3812400 - RNA, 23 nt, Salmonella typhimurium LT2
ccgcugggauucggcaacaccca

SEQ ID NO: 3812401 - RNA, 17 nt, Salmonella typhimurium LT2
ccgcugguugccuuccu

SEQ ID NO: 3812402 - RNA, 20 nt, Salmonella typhimurium LT2
ccgcugguugccuuccugau

SEQ ID NO: 3812403 - RNA, 20 nt, Salmonella typhimurium LT2
ccgcuguuuagccccacauu

SEQ ID NO: 3812404 - RNA, 18 nt, Salmonella typhimurium LT2
ccgcuguuuuucaucauc

SEQ ID NO: 3812405 - RNA, 19 nt, Salmonella typhimurium LT2
ccgcuuaaguugccgccgc

SEQ ID NO: 3812406 - RNA, 23 nt, Salmonella typhimurium LT2
ccgcuuacucguuuugccgauac

SEQ ID NO: 3812407 - RNA, 18 nt, Salmonella typhimurium LT2
ccgcuuccagcgcgucgg

SEQ ID NO: 3812408 - RNA, 16 nt, Salmonella typhimurium LT2
ccgcuucgcgcgccag

SEQ ID NO: 3812409 - RNA, 13 nt, Salmonella typhimurium LT2
ccgcuucuuccau

SEQ ID NO: 3812410 - RNA, 16 nt, Salmonella typhimurium LT2
ccgcuugcaccauggc

SEQ ID NO: 3812411 - RNA, 19 nt, Salmonella typhimurium LT2
ccgcuugcaccauggcggc

SEQ ID NO: 3812412 - RNA, 15 nt, Salmonella typhimurium LT2
ccgcuuuaagcgcug

SEQ ID NO: 3812413 - RNA, 15 nt, Salmonella typhimurium LT2
ccgcuuucaccaucg

SEQ ID NO: 3812414 - RNA, 15 nt, Salmonella typhimurium LT2
ccgcuuucccggcau

SEQ ID NO: 3812415 - RNA, 16 nt, Salmonella typhimurium LT2
ccgcuuugaggaucaa

SEQ ID NO: 3812416 - RNA, 16 nt, Salmonella typhimurium LT2
ccgcuuugccgcgcuc

SEQ ID NO: 3812417 - RNA, 19 nt, Salmonella typhimurium LT2
ccggccucgcccgcgauga

SEQ ID NO: 3812418 - RNA, 15 nt, Salmonella typhimurium LT2
ccggccugcaggcaa

SEQ ID NO: 3812419 - RNA, 15 nt, Salmonella typhimurium LT2
ccggccugccccuga

SEQ ID NO: 3812420 - RNA, 13 nt, Salmonella typhimurium LT2
ccggccuggcgca

SEQ ID NO: 3812421 - RNA, 15 nt, Salmonella typhimurium LT2
ccggccuggcgcagc

SEQ ID NO: 3812422 - RNA, 15 nt, Salmonella typhimurium LT2
ccggccuuaucuucc

SEQ ID NO: 3812423 - RNA, 19 nt, Salmonella typhimurium LT2
ccggcgaaaaaccaggcaa

SEQ ID NO: 3812424 - RNA, 18 nt, Salmonella typhimurium LT2
ccggcgaauagucgccgc

SEQ ID NO: 3812425 - RNA, 16 nt, Salmonella typhimurium LT2
ccggcgaauuucauca

SEQ ID NO: 3812426 - RNA, 21 nt, Salmonella typhimurium LT2
ccggcgaccacuagcgccgcc

SEQ ID NO: 3812427 - RNA, 13 nt, Salmonella typhimurium LT2
ccggcgacccgcc

SEQ ID NO: 3812428 - RNA, 13 nt, Salmonella typhimurium LT2
ccggcgacucaug

SEQ ID NO: 3812429 - RNA, 13 nt, Salmonella typhimurium LT2
ccggcgauggugc

SEQ ID NO: 3812430 - RNA, 16 nt, Salmonella typhimurium LT2
ccggcgauguuggcgc

SEQ ID NO: 3812431 - RNA, 22 nt, Salmonella typhimurium LT2
ccggcgcaaacaguacgcccgc

SEQ ID NO: 3812432 - RNA, 18 nt, Salmonella typhimurium LT2
ccggcgcagcaucugcgg

SEQ ID NO: 3812433 - RNA, 13 nt, Salmonella typhimurium LT2
ccggcgcagcgaa

SEQ ID NO: 3812434 - RNA, 14 nt, Salmonella typhimurium LT2
ccggcgcauccagu

SEQ ID NO: 3812435 - RNA, 21 nt, Salmonella typhimurium LT2
ccggcgccaaucaccgccagc

SEQ ID NO: 3812436 - RNA, 18 nt, Salmonella typhimurium LT2
ccggcgccagaagcuggc

SEQ ID NO: 3812437 - RNA, 14 nt, Salmonella typhimurium LT2
ccggcgccauaauc

SEQ ID NO: 3812438 - RNA, 12 nt, Salmonella typhimurium LT2
ccggcgccugaa

SEQ ID NO: 3812439 - RNA, 13 nt, Salmonella typhimurium LT2
ccggcgcgccagc

SEQ ID NO: 3812440 - RNA, 11 nt, Salmonella typhimurium LT2
ccggcgcgccu

SEQ ID NO: 3812441 - RNA, 17 nt, Salmonella typhimurium LT2
ccggcgcgccuuccagc

SEQ ID NO: 3812442 - RNA, 14 nt, Salmonella typhimurium LT2
ccggcgcgggugau

SEQ ID NO: 3812443 - RNA, 22 nt, Salmonella typhimurium LT2
ccggcgcuggacaaaccacagu

SEQ ID NO: 3812444 - RNA, 17 nt, Salmonella typhimurium LT2
ccggcgcuggcgcacgc

SEQ ID NO: 3812445 - RNA, 21 nt, Salmonella typhimurium LT2
ccggcgcuuuauacagauguc

SEQ ID NO: 3812446 - RNA, 19 nt, Salmonella typhimurium LT2
ccggcggcaaggucugcgc

SEQ ID NO: 3812447 - RNA, 13 nt, Salmonella typhimurium LT2
ccggcggcagccg

SEQ ID NO: 3812448 - RNA, 17 nt, Salmonella typhimurium LT2
ccggcggcgacuggcua

SEQ ID NO: 3812449 - RNA, 21 nt, Salmonella typhimurium LT2
ccggcgggcaaccuucaaguu

SEQ ID NO: 3812450 - RNA, 20 nt, Salmonella typhimurium LT2
ccggcggucaugcuggcgau

SEQ ID NO: 3812451 - RNA, 20 nt, Salmonella typhimurium LT2
ccggcggucgauuuugccuu

SEQ ID NO: 3812452 - RNA, 17 nt, Salmonella typhimurium LT2
ccggcguaauugcgccu

SEQ ID NO: 3812453 - RNA, 18 nt, Salmonella typhimurium LT2
ccggcguaauugcgccug

SEQ ID NO: 3812454 - RNA, 20 nt, Salmonella typhimurium LT2
ccggcgucagcauggugugu

SEQ ID NO: 3812455 - RNA, 17 nt, Salmonella typhimurium LT2
ccggcguccggcgccug

SEQ ID NO: 3812456 - RNA, 19 nt, Salmonella typhimurium LT2
ccggcguccggcgccugaa

SEQ ID NO: 3812457 - RNA, 22 nt, Salmonella typhimurium LT2
ccggcgucgcguucagcgccgg

SEQ ID NO: 3812458 - RNA, 21 nt, Salmonella typhimurium LT2
ccggcgucucgcacucgccgc

SEQ ID NO: 3812459 - RNA, 20 nt, Salmonella typhimurium LT2
ccggcgugcgcuuagccugc

SEQ ID NO: 3812460 - RNA, 19 nt, Salmonella typhimurium LT2
ccggcgugguggcgucaau

SEQ ID NO: 3812461 - RNA, 18 nt, Salmonella typhimurium LT2
ccggcguucucccgggcc

SEQ ID NO: 3812462 - RNA, 22 nt, Salmonella typhimurium LT2
ccggcguuuuugugucgaaccc

SEQ ID NO: 3812463 - RNA, 22 nt, Salmonella typhimurium LT2
ccggcuaacaacguuacgccag

SEQ ID NO: 3812464 - RNA, 22 nt, Salmonella typhimurium LT2
ccggcuacaggcgucacggcga

SEQ ID NO: 3812465 - RNA, 11 nt, Salmonella typhimurium LT2
ccggcucgccc

SEQ ID NO: 3812466 - RNA, 18 nt, Salmonella typhimurium LT2
ccggcucgccuugcgguu

SEQ ID NO: 3812467 - RNA, 14 nt, Salmonella typhimurium LT2
ccggcugacugccg

SEQ ID NO: 3812468 - RNA, 18 nt, Salmonella typhimurium LT2
ccggcugauaucauucug

SEQ ID NO: 3812469 - RNA, 15 nt, Salmonella typhimurium LT2
ccggcugccauuauc

SEQ ID NO: 3812470 - RNA, 20 nt, Salmonella typhimurium LT2
ccggcugcgucgcuuccugu

SEQ ID NO: 3812471 - RNA, 23 nt, Salmonella typhimurium LT2
ccggcuguucgacgaauggcggc

SEQ ID NO: 3812472 - RNA, 20 nt, Salmonella typhimurium LT2
ccggcuguuuugcuucuuca

SEQ ID NO: 3812473 - RNA, 17 nt, Salmonella typhimurium LT2
ccggcuuaaugcauggc

SEQ ID NO: 3812474 - RNA, 19 nt, Salmonella typhimurium LT2
ccggcuuaaugcccggccc

SEQ ID NO: 3812475 - RNA, 20 nt, Salmonella typhimurium LT2
ccggcuuaaugcccggcccg

SEQ ID NO: 3812476 - RNA, 21 nt, Salmonella typhimurium LT2
ccggcuuaccggcuaucagcc

SEQ ID NO: 3812477 - RNA, 17 nt, Salmonella typhimurium LT2
ccggcuucuuccggccc

SEQ ID NO: 3812478 - RNA, 23 nt, Salmonella typhimurium LT2
ccggcuuuauuauuucuucuucg

SEQ ID NO: 3812479 - RNA, 16 nt, Salmonella typhimurium LT2
ccggcuuuccgcaccg

SEQ ID NO: 3812480 - RNA, 20 nt, Salmonella typhimurium LT2
ccggcuuuuuuauaucaggc

SEQ ID NO: 3812481 - RNA, 22 nt, Salmonella typhimurium LT2
ccgggaaagcggaucggaacgc

SEQ ID NO: 3812482 - RNA, 20 nt, Salmonella typhimurium LT2
ccgggaaaucuucuacuuca

SEQ ID NO: 3812483 - RNA, 13 nt, Salmonella typhimurium LT2
ccgggaagcccuu

SEQ ID NO: 3812484 - RNA, 19 nt, Salmonella typhimurium LT2
ccgggagaaaacgcggccu

SEQ ID NO: 3812485 - RNA, 14 nt, Salmonella typhimurium LT2
ccgggauaaucagg

SEQ ID NO: 3812486 - RNA, 13 nt, Salmonella typhimurium LT2
ccgggauauaaaa

SEQ ID NO: 3812487 - RNA, 13 nt, Salmonella typhimurium LT2
ccgggaucagcgg

SEQ ID NO: 3812488 - RNA, 15 nt, Salmonella typhimurium LT2
ccgggcaaacagcac

SEQ ID NO: 3812489 - RNA, 18 nt, Salmonella typhimurium LT2
ccgggcagacaucaccgu

SEQ ID NO: 3812490 - RNA, 13 nt, Salmonella typhimurium LT2
ccgggccaaugcc

SEQ ID NO: 3812491 - RNA, 16 nt, Salmonella typhimurium LT2
ccgggccugagcgcgc

SEQ ID NO: 3812492 - RNA, 17 nt, Salmonella typhimurium LT2
ccgggccugagcgcgca

SEQ ID NO: 3812493 - RNA, 15 nt, Salmonella typhimurium LT2
ccgggcgcaaucauc

SEQ ID NO: 3812494 - RNA, 22 nt, Salmonella typhimurium LT2
ccgggcgcaccaguuccccaua

SEQ ID NO: 3812495 - RNA, 14 nt, Salmonella typhimurium LT2
ccgggcgcccggcc

SEQ ID NO: 3812496 - RNA, 18 nt, Salmonella typhimurium LT2
ccgggcggcugucccaga

SEQ ID NO: 3812497 - RNA, 17 nt, Salmonella typhimurium LT2
ccgggcuauuugcagau

SEQ ID NO: 3812498 - RNA, 23 nt, Salmonella typhimurium LT2
ccgggcucauuuuauccaacagc

SEQ ID NO: 3812499 - RNA, 19 nt, Salmonella typhimurium LT2
ccgggcuccauagggcagg

SEQ ID NO: 3812500 - RNA, 19 nt, Salmonella typhimurium LT2
ccggggaucaagcccccgc

SEQ ID NO: 3812501 - RNA, 13 nt, Salmonella typhimurium LT2
ccggggcgcuggc

SEQ ID NO: 3812502 - RNA, 23 nt, Salmonella typhimurium LT2
ccggguaggacauagccgccacc

SEQ ID NO: 3812503 - RNA, 21 nt, Salmonella typhimurium LT2
ccggguauuucugaaaaaccg

SEQ ID NO: 3812504 - RNA, 18 nt, Salmonella typhimurium LT2
ccgggucagcccccaguu

SEQ ID NO: 3812505 - RNA, 23 nt, Salmonella typhimurium LT2
ccgggucggacgagcgcgucagc

SEQ ID NO: 3812506 - RNA, 19 nt, Salmonella typhimurium LT2
ccgggugacgcuaacgcgc

SEQ ID NO: 3812507 - RNA, 12 nt, Salmonella typhimurium LT2
ccggguggcggc

SEQ ID NO: 3812508 - RNA, 21 nt, Salmonella typhimurium LT2
ccggguucguuaacccggcau

SEQ ID NO: 3812509 - RNA, 13 nt, Salmonella typhimurium LT2
ccggguugcggaa

SEQ ID NO: 3812510 - RNA, 18 nt, Salmonella typhimurium LT2
ccgguaaagaaaccggcg

SEQ ID NO: 3812511 - RNA, 21 nt, Salmonella typhimurium LT2
ccgguaaaucaacaaccggcu

SEQ ID NO: 3812512 - RNA, 21 nt, Salmonella typhimurium LT2
ccgguaaauuucacuucgccc

SEQ ID NO: 3812513 - RNA, 16 nt, Salmonella typhimurium LT2
ccgguaacgccguagg

SEQ ID NO: 3812514 - RNA, 15 nt, Salmonella typhimurium LT2
ccgguaacguaaaua

SEQ ID NO: 3812515 - RNA, 20 nt, Salmonella typhimurium LT2
ccgguaacguaaauacccag

SEQ ID NO: 3812516 - RNA, 17 nt, Salmonella typhimurium LT2
ccgguaagcgcagcgcc

SEQ ID NO: 3812517 - RNA, 19 nt, Salmonella typhimurium LT2
ccgguaagcgcagcgccac

SEQ ID NO: 3812518 - RNA, 13 nt, Salmonella typhimurium LT2
ccgguaaggccaa

SEQ ID NO: 3812519 - RNA, 22 nt, Salmonella typhimurium LT2
ccgguaauaauuggcauccagc

SEQ ID NO: 3812520 - RNA, 19 nt, Salmonella typhimurium LT2
ccgguacgcagcaggcaga

SEQ ID NO: 3812521 - RNA, 22 nt, Salmonella typhimurium LT2
ccgugaaauuuccuccgccgau

SEQ ID NO: 3812522 - RNA, 16 nt, Salmonella typhimurium LT2
ccgugaagcccggcgg

SEQ ID NO: 3812523 - RNA, 13 nt, Salmonella typhimurium LT2
ccgugagcggaua

SEQ ID NO: 3812524 - RNA, 14 nt, Salmonella typhimurium LT2
ccgugaguuuuaac

SEQ ID NO: 3812525 - RNA, 19 nt, Salmonella typhimurium LT2
ccgugaugcggacgcugac

SEQ ID NO: 3812526 - RNA, 23 nt, Salmonella typhimurium LT2
ccgugaugcggacgcugacgcca

SEQ ID NO: 3812527 - RNA, 18 nt, Salmonella typhimurium LT2
ccgugcacuucugcggua

SEQ ID NO: 3812528 - RNA, 23 nt, Salmonella typhimurium LT2
ccgugcaguuuugcuucaugcac

SEQ ID NO: 3812529 - RNA, 13 nt, Salmonella typhimurium LT2
ccgugcccagcau

SEQ ID NO: 3812530 - RNA, 15 nt, Salmonella typhimurium LT2
ccgugcccaggucuc

SEQ ID NO: 3812531 - RNA, 14 nt, Salmonella typhimurium LT2
ccgugccgccgcga

SEQ ID NO: 3812532 - RNA, 22 nt, Salmonella typhimurium LT2
ccgugcgccgacaucgccaccg

SEQ ID NO: 3812533 - RNA, 15 nt, Salmonella typhimurium LT2
ccguggcauucgcuu

SEQ ID NO: 3812534 - RNA, 19 nt, Salmonella typhimurium LT2
ccguggcugcgccugcgcg

SEQ ID NO: 3812535 - RNA, 16 nt, Salmonella typhimurium LT2
ccguggguggcaaggc

SEQ ID NO: 3812536 - RNA, 18 nt, Salmonella typhimurium LT2
ccguggugcguugcgcca

SEQ ID NO: 3812537 - RNA, 13 nt, Salmonella typhimurium LT2
ccguguuccagcg

SEQ ID NO: 3812538 - RNA, 20 nt, Salmonella typhimurium LT2
ccguguugauuaaugcgaua

SEQ ID NO: 3812539 - RNA, 19 nt, Salmonella typhimurium LT2
ccguguugugugccgcgcu

SEQ ID NO: 3812540 - RNA, 15 nt, Salmonella typhimurium LT2
ccguuaacugcugcu

SEQ ID NO: 3812541 - RNA, 16 nt, Salmonella typhimurium LT2
ccguuaaggccuuauu

SEQ ID NO: 3812542 - RNA, 13 nt, Salmonella typhimurium LT2
ccguucaggcaaa

SEQ ID NO: 3812543 - RNA, 20 nt, Salmonella typhimurium LT2
ccguucaggcaaaguuguuu

SEQ ID NO: 3812544 - RNA, 16 nt, Salmonella typhimurium LT2
ccguucaucgguaaua

SEQ ID NO: 3812545 - RNA, 16 nt, Salmonella typhimurium LT2
ccguucaucuaucgcc

SEQ ID NO: 3812546 - RNA, 15 nt, Salmonella typhimurium LT2
ccguucauuugcaau

SEQ ID NO: 3812547 - RNA, 17 nt, Salmonella typhimurium LT2
ccguuccaaucucuuuu

SEQ ID NO: 3812548 - RNA, 13 nt, Salmonella typhimurium LT2
ccguucccucuga

SEQ ID NO: 3812549 - RNA, 15 nt, Salmonella typhimurium LT2
ccguuccugccguca

SEQ ID NO: 3812550 - RNA, 14 nt, Salmonella typhimurium LT2
ccguucuccagcgu

SEQ ID NO: 3812551 - RNA, 18 nt, Salmonella typhimurium LT2
ccguucugugcgccgcug

SEQ ID NO: 3812552 - RNA, 17 nt, Salmonella typhimurium LT2
ccguugagaauggcggg

SEQ ID NO: 3812553 - RNA, 20 nt, Salmonella typhimurium LT2
ccguugcaauauaguugagc

SEQ ID NO: 3812554 - RNA, 22 nt, Salmonella typhimurium LT2
ccguugccacccaaugauccgg

SEQ ID NO: 3812555 - RNA, 17 nt, Salmonella typhimurium LT2
ccguugcgcccaucauc

SEQ ID NO: 3812556 - RNA, 19 nt, Salmonella typhimurium LT2
ccguuggcguaaaucaggc

SEQ ID NO: 3812557 - RNA, 23 nt, Salmonella typhimurium LT2
ccguuggcuugaucaacgccgcg

SEQ ID NO: 3812558 - RNA, 16 nt, Salmonella typhimurium LT2
ccguuguugcaccacc

SEQ ID NO: 3812559 - RNA, 17 nt, Salmonella typhimurium LT2
ccguuguugucaauauc

SEQ ID NO: 3812560 - RNA, 21 nt, Salmonella typhimurium LT2
ccguuucagaaagagauuaga

SEQ ID NO: 3812561 - RNA, 16 nt, Salmonella typhimurium LT2
ccguuucccucuuaau

SEQ ID NO: 3812562 - RNA, 21 nt, Salmonella typhimurium LT2
ccguuucguugccagaguuca

SEQ ID NO: 3812563 - RNA, 15 nt, Salmonella typhimurium LT2
ccguuugcagccaga

SEQ ID NO: 3812564 - RNA, 14 nt, Salmonella typhimurium LT2
ccguuugccgggca

SEQ ID NO: 3812565 - RNA, 19 nt, Salmonella typhimurium LT2
ccguuuuacacggcgugac

SEQ ID NO: 3812566 - RNA, 12 nt, Salmonella typhimurium LT2
ccguuuucaaac

SEQ ID NO: 3812567 - RNA, 17 nt, Salmonella typhimurium LT2
ccguuuucgucaacaua

SEQ ID NO: 3812568 - RNA, 19 nt, Salmonella typhimurium LT2
ccguuuuguugccgcccgu

SEQ ID NO: 3812569 - RNA, 19 nt, Salmonella typhimurium LT2
ccguuuuucauccagcggu

SEQ ID NO: 3812570 - RNA, 17 nt, Salmonella typhimurium LT2
ccguuuuucucaucaag

SEQ ID NO: 3812571 - RNA, 17 nt, Salmonella typhimurium LT2
ccuaaaaaccagaacuu

SEQ ID NO: 3812572 - RNA, 11 nt, Salmonella typhimurium LT2
ccuaaaaauag

SEQ ID NO: 3812573 - RNA, 19 nt, Salmonella typhimurium LT2
ccuaaaacauuaaucgcca

SEQ ID NO: 3812574 - RNA, 20 nt, Salmonella typhimurium LT2
ccuaaagagggugaaccaaa

SEQ ID NO: 3812575 - RNA, 12 nt, Salmonella typhimurium LT2
ccuaacgccugc

SEQ ID NO: 3812576 - RNA, 15 nt, Salmonella typhimurium LT2
ccuaacuggaaaaag

SEQ ID NO: 3812577 - RNA, 18 nt, Salmonella typhimurium LT2
ccuaacuggaaaaagacc

SEQ ID NO: 3812578 - RNA, 23 nt, Salmonella typhimurium LT2
ccuaagccggcaggcagcgccag

SEQ ID NO: 3812579 - RNA, 15 nt, Salmonella typhimurium LT2
ccuaauaaaauaacu

SEQ ID NO: 3812580 - RNA, 15 nt, Salmonella typhimurium LT2
ccuacaaaaucgccc

SEQ ID NO: 3812581 - RNA, 18 nt, Salmonella typhimurium LT2
ccuacaagaauuuaucgc

SEQ ID NO: 3812582 - RNA, 16 nt, Salmonella typhimurium LT2
ccuacaagauuugcaa

SEQ ID NO: 3812583 - RNA, 14 nt, Salmonella typhimurium LT2
ccuacaagccgccu

SEQ ID NO: 3812584 - RNA, 18 nt, Salmonella typhimurium LT2
ccuacacaaaaucauucg

SEQ ID NO: 3812585 - RNA, 18 nt, Salmonella typhimurium LT2
ccuacagguugucgcaac

SEQ ID NO: 3812586 - RNA, 13 nt, Salmonella typhimurium LT2
ccuaccagacgcg

SEQ ID NO: 3812587 - RNA, 11 nt, Salmonella typhimurium LT2
ccuacccgcgu

SEQ ID NO: 3812588 - RNA, 16 nt, Salmonella typhimurium LT2
ccuaccgaggcagggg

SEQ ID NO: 3812589 - RNA, 18 nt, Salmonella typhimurium LT2
ccuaccggcggcacccgu

SEQ ID NO: 3812590 - RNA, 19 nt, Salmonella typhimurium LT2
ccuacgauuucgcucgcuu

SEQ ID NO: 3812591 - RNA, 18 nt, Salmonella typhimurium LT2
ccuacgccaagcaccuag

SEQ ID NO: 3812592 - RNA, 20 nt, Salmonella typhimurium LT2
ccuacgcugacgcgaucgcc

SEQ ID NO: 3812593 - RNA, 18 nt, Salmonella typhimurium LT2
ccuacggugugccugcgu

SEQ ID NO: 3812594 - RNA, 16 nt, Salmonella typhimurium LT2
ccuacgugcucacggc

SEQ ID NO: 3812595 - RNA, 18 nt, Salmonella typhimurium LT2
ccuacucucgcaugggga

SEQ ID NO: 3812596 - RNA, 15 nt, Salmonella typhimurium LT2
ccuagaugaaugacu

SEQ ID NO: 3812597 - RNA, 21 nt, Salmonella typhimurium LT2
ccuagaugaaugacuguccac

SEQ ID NO: 3812598 - RNA, 22 nt, Salmonella typhimurium LT2
ccuaggguggacaugauaagcg

SEQ ID NO: 3812599 - RNA, 14 nt, Salmonella typhimurium LT2
ccuauaacagcgcc

SEQ ID NO: 3812600 - RNA, 15 nt, Salmonella typhimurium LT2
ccuauaacagcgcca

SEQ ID NO: 3812601 - RNA, 13 nt, Salmonella typhimurium LT2
ccuaucgccauau

SEQ ID NO: 3812602 - RNA, 21 nt, Salmonella typhimurium LT2
ccuauguuaugcacaaccagc

SEQ ID NO: 3812603 - RNA, 19 nt, Salmonella typhimurium LT2
ccuauuaucggcaccaucu

SEQ ID NO: 3812604 - RNA, 20 nt, Salmonella typhimurium LT2
ccuauuaucggcaccaucua

SEQ ID NO: 3812605 - RNA, 23 nt, Salmonella typhimurium LT2
ccuauuucaguacagccaaaaau

SEQ ID NO: 3812606 - RNA, 18 nt, Salmonella typhimurium LT2
ccuauuuuaaauucccag

SEQ ID NO: 3812607 - RNA, 14 nt, Salmonella typhimurium LT2
ccuauuuugcaaaa

SEQ ID NO: 3812608 - RNA, 17 nt, Salmonella typhimurium LT2
ccuauuuugcaaaacug

SEQ ID NO: 3812609 - RNA, 14 nt, Salmonella typhimurium LT2
ccuauuuugcgccu

SEQ ID NO: 3812610 - RNA, 18 nt, Salmonella typhimurium LT2
ccucaaagacccggaacu

SEQ ID NO: 3812611 - RNA, 17 nt, Salmonella typhimurium LT2
ccucaacaucucuucgu

SEQ ID NO: 3812612 - RNA, 16 nt, Salmonella typhimurium LT2
ccucaacgcccugcuc

SEQ ID NO: 3812613 - RNA, 22 nt, Salmonella typhimurium LT2
ccucaacgcccugcucccacag

SEQ ID NO: 3812614 - RNA, 23 nt, Salmonella typhimurium LT2
ccucaacgcccugcucccacagc

SEQ ID NO: 3812615 - RNA, 13 nt, Salmonella typhimurium LT2
ccucaacgcucau

SEQ ID NO: 3812616 - RNA, 24 nt, Salmonella typhimurium LT2
ccucaacgcucauaccuggcuuga

SEQ ID NO: 3812617 - RNA, 17 nt, Salmonella typhimurium LT2
ccucaagaauaucuuua

SEQ ID NO: 3812618 - RNA, 22 nt, Salmonella typhimurium LT2
ccucaagugucgauaaccugga

SEQ ID NO: 3812619 - RNA, 10 nt, Salmonella typhimurium LT2
ccucaauaua

SEQ ID NO: 3812620 - RNA, 20 nt, Salmonella typhimurium LT2
ccucaaugguuucacgcucu

SEQ ID NO: 3812621 - RNA, 20 nt, Salmonella typhimurium LT2
ccucacccugaaauccggcu

SEQ ID NO: 3812622 - RNA, 16 nt, Salmonella typhimurium LT2
ccucaccguagcucca

SEQ ID NO: 3812623 - RNA, 13 nt, Salmonella typhimurium LT2
ccucacgcaacca

SEQ ID NO: 3812624 - RNA, 18 nt, Salmonella typhimurium LT2
ccucacgcaaccagguca

SEQ ID NO: 3812625 - RNA, 17 nt, Salmonella typhimurium LT2
ccugaaaauagcgccau

SEQ ID NO: 3812626 - RNA, 16 nt, Salmonella typhimurium LT2
ccugaaacaggugugc

SEQ ID NO: 3812627 - RNA, 15 nt, Salmonella typhimurium LT2
ccugaaaccaggcgc

SEQ ID NO: 3812628 - RNA, 13 nt, Salmonella typhimurium LT2
ccugaaaccgccg

SEQ ID NO: 3812629 - RNA, 12 nt, Salmonella typhimurium LT2
ccugaaacgcgg

SEQ ID NO: 3812630 - RNA, 13 nt, Salmonella typhimurium LT2
ccugaaacgcggc

SEQ ID NO: 3812631 - RNA, 23 nt, Salmonella typhimurium LT2
ccugaaauccggcuuugacaaaa

SEQ ID NO: 3812632 - RNA, 15 nt, Salmonella typhimurium LT2
ccugaaccagcggca

SEQ ID NO: 3812633 - RNA, 18 nt, Salmonella typhimurium LT2
ccugaaccagcggcacca

SEQ ID NO: 3812634 - RNA, 16 nt, Salmonella typhimurium LT2
ccugaaccucuucacc

SEQ ID NO: 3812635 - RNA, 17 nt, Salmonella typhimurium LT2
ccugaaccucuucaccg

SEQ ID NO: 3812636 - RNA, 17 nt, Salmonella typhimurium LT2
ccugaacgccuaccgcu

SEQ ID NO: 3812637 - RNA, 23 nt, Salmonella typhimurium LT2
ccugaagauagucgauccccaac

SEQ ID NO: 3812638 - RNA, 18 nt, Salmonella typhimurium LT2
ccugaagcggcgcaauuu

SEQ ID NO: 3812639 - RNA, 18 nt, Salmonella typhimurium LT2
ccugaaggacaagcugcg

SEQ ID NO: 3812640 - RNA, 19 nt, Salmonella typhimurium LT2
ccugaauaacccgcagccc

SEQ ID NO: 3812641 - RNA, 23 nt, Salmonella typhimurium LT2
ccugaauaacccgcagcccugcg

SEQ ID NO: 3812642 - RNA, 18 nt, Salmonella typhimurium LT2
ccugaauaaucggcguca

SEQ ID NO: 3812643 - RNA, 15 nt, Salmonella typhimurium LT2
ccugaauagcaggca

SEQ ID NO: 3812644 - RNA, 15 nt, Salmonella typhimurium LT2
ccugaauauggccag

SEQ ID NO: 3812645 - RNA, 19 nt, Salmonella typhimurium LT2
ccugaaucgccucaacgcu

SEQ ID NO: 3812646 - RNA, 18 nt, Salmonella typhimurium LT2
ccugaaucucuucgaccg

SEQ ID NO: 3812647 - RNA, 22 nt, Salmonella typhimurium LT2
ccugaaugcagaccucugcuuu

SEQ ID NO: 3812648 - RNA, 17 nt, Salmonella typhimurium LT2
ccugaaugcucucauau

SEQ ID NO: 3812649 - RNA, 19 nt, Salmonella typhimurium LT2
ccugaaugcucucauauuc

SEQ ID NO: 3812650 - RNA, 21 nt, Salmonella typhimurium LT2
ccugaauuucaauaaucccuu

SEQ ID NO: 3812651 - RNA, 20 nt, Salmonella typhimurium LT2
ccugaauuucacgcugcagu

SEQ ID NO: 3812652 - RNA, 20 nt, Salmonella typhimurium LT2
ccugacaaauuauaaacuac

SEQ ID NO: 3812653 - RNA, 22 nt, Salmonella typhimurium LT2
ccugacagagcucgucaaaaau

SEQ ID NO: 3812654 - RNA, 14 nt, Salmonella typhimurium LT2
ccugacagcaauga

SEQ ID NO: 3812655 - RNA, 13 nt, Salmonella typhimurium LT2
ccugaccagcgac

SEQ ID NO: 3812656 - RNA, 15 nt, Salmonella typhimurium LT2
ccugaccauugcugu

SEQ ID NO: 3812657 - RNA, 19 nt, Salmonella typhimurium LT2
ccugaccgauauagccacu

SEQ ID NO: 3812658 - RNA, 23 nt, Salmonella typhimurium LT2
ccugaccguugaucuccgcgcaa

SEQ ID NO: 3812659 - RNA, 17 nt, Salmonella typhimurium LT2
ccugacggcgcugucac

SEQ ID NO: 3812660 - RNA, 14 nt, Salmonella typhimurium LT2
ccugacucaccagc

SEQ ID NO: 3812661 - RNA, 13 nt, Salmonella typhimurium LT2
ccugacugaagac

SEQ ID NO: 3812662 - RNA, 20 nt, Salmonella typhimurium LT2
ccugacugcgcgccugcgcu

SEQ ID NO: 3812663 - RNA, 21 nt, Salmonella typhimurium LT2
ccugagcagacauauuuucuc

SEQ ID NO: 3812664 - RNA, 19 nt, Salmonella typhimurium LT2
ccugagcccaaucgguuga

SEQ ID NO: 3812665 - RNA, 19 nt, Salmonella typhimurium LT2
ccugagcuuuccugacaaa

SEQ ID NO: 3812666 - RNA, 13 nt, Salmonella typhimurium LT2
ccugagucacaga

SEQ ID NO: 3812667 - RNA, 20 nt, Salmonella typhimurium LT2
ccugauaaccuauuuugcaa

SEQ ID NO: 3812668 - RNA, 19 nt, Salmonella typhimurium LT2
ccugauaagcacaggccau

SEQ ID NO: 3812669 - RNA, 20 nt, Salmonella typhimurium LT2
ccugauaagcauagcgccau

SEQ ID NO: 3812670 - RNA, 20 nt, Salmonella typhimurium LT2
ccugauaagcgcagcgccau

SEQ ID NO: 3812671 - RNA, 20 nt, Salmonella typhimurium LT2
ccugauaagcguagcgccau

SEQ ID NO: 3812672 - RNA, 22 nt, Salmonella typhimurium LT2
ccugauaagguaaagccgccau

SEQ ID NO: 3812673 - RNA, 13 nt, Salmonella typhimurium LT2
ccugauaauccag

SEQ ID NO: 3812674 - RNA, 19 nt, Salmonella typhimurium LT2
ccugauagccguaaauaau

SEQ ID NO: 3812675 - RNA, 23 nt, Salmonella typhimurium LT2
ccugauauugcguaagcagcugc

SEQ ID NO: 3812676 - RNA, 13 nt, Salmonella typhimurium LT2
ccugaucaaacac

SEQ ID NO: 3812677 - RNA, 19 nt, Salmonella typhimurium LT2
ccugauccagcucuucuuc

SEQ ID NO: 3812678 - RNA, 21 nt, Salmonella typhimurium LT2
ccugauccugcaacagcacca

SEQ ID NO: 3812679 - RNA, 23 nt, Salmonella typhimurium LT2
ccugaucgauucucuucuucuuu

SEQ ID NO: 3812680 - RNA, 21 nt, Salmonella typhimurium LT2
ccugaucgcgcagacaguggc

SEQ ID NO: 3812681 - RNA, 22 nt, Salmonella typhimurium LT2
ccugaucggcggcccacucauc

SEQ ID NO: 3812682 - RNA, 21 nt, Salmonella typhimurium LT2
ccugaucggcguuuagcccga

SEQ ID NO: 3812683 - RNA, 18 nt, Salmonella typhimurium LT2
ccugaugcgacgcuuacc

SEQ ID NO: 3812684 - RNA, 19 nt, Salmonella typhimurium LT2
ccugaugcgacgcuuaccg

SEQ ID NO: 3812685 - RNA, 22 nt, Salmonella typhimurium LT2
ccugaugcgcguuuagcgccag

SEQ ID NO: 3812686 - RNA, 23 nt, Salmonella typhimurium LT2
ccugaugcugcgaggccaacggc

SEQ ID NO: 3812687 - RNA, 22 nt, Salmonella typhimurium LT2
ccugauggcgacguuagcgcau

SEQ ID NO: 3812688 - RNA, 19 nt, Salmonella typhimurium LT2
ccugauggcgcagcgccau

SEQ ID NO: 3812689 - RNA, 12 nt, Salmonella typhimurium LT2
ccugauggcgcg

SEQ ID NO: 3812690 - RNA, 15 nt, Salmonella typhimurium LT2
ccugauggcgcgcca

SEQ ID NO: 3812691 - RNA, 21 nt, Salmonella typhimurium LT2
ccugauggcgcuacgccugaa

SEQ ID NO: 3812692 - RNA, 22 nt, Salmonella typhimurium LT2
ccugauggcgcuacguuuaucu

SEQ ID NO: 3812693 - RNA, 17 nt, Salmonella typhimurium LT2
ccugauggcgcugcgcu

SEQ ID NO: 3812694 - RNA, 18 nt, Salmonella typhimurium LT2
ccugauuaaacgccugau

SEQ ID NO: 3812695 - RNA, 21 nt, Salmonella typhimurium LT2
ccugauuaaguuuuuuuaaaa

SEQ ID NO: 3812696 - RNA, 22 nt, Salmonella typhimurium LT2
ccugauuaaguuuuuuuaaaaa

SEQ ID NO: 3812697 - RNA, 14 nt, Salmonella typhimurium LT2
ccugauuaaucagc

SEQ ID NO: 3812698 - RNA, 20 nt, Salmonella typhimurium LT2
ccugauugauacgcgcccga

SEQ ID NO: 3812699 - RNA, 19 nt, Salmonella typhimurium LT2
ccugauuuaacgaguugaa

SEQ ID NO: 3812700 - RNA, 13 nt, Salmonella typhimurium LT2
ccugauuuaucac

SEQ ID NO: 3812701 - RNA, 14 nt, Salmonella typhimurium LT2
ccugauuuaucacg

SEQ ID NO: 3812702 - RNA, 15 nt, Salmonella typhimurium LT2
ccugcaaaaacgcca

SEQ ID NO: 3812703 - RNA, 22 nt, Salmonella typhimurium LT2
ccugcaaaaggaacaguugcag

SEQ ID NO: 3812704 - RNA, 20 nt, Salmonella typhimurium LT2
ccugcaacgcuuuagugccg

SEQ ID NO: 3812705 - RNA, 23 nt, Salmonella typhimurium LT2
ccugcaacgcuuuagugccgcca

SEQ ID NO: 3812706 - RNA, 23 nt, Salmonella typhimurium LT2
ccugcaaggcaucgucggcgauu

SEQ ID NO: 3812707 - RNA, 12 nt, Salmonella typhimurium LT2
ccugcaauuccg

SEQ ID NO: 3812708 - RNA, 23 nt, Salmonella typhimurium LT2
ccugcaauuccggcgaaaaacca

SEQ ID NO: 3812709 - RNA, 22 nt, Salmonella typhimurium LT2
ccugcaauuuccccugcgaaca

SEQ ID NO: 3812710 - RNA, 14 nt, Salmonella typhimurium LT2
ccugcacaucgcca

SEQ ID NO: 3812711 - RNA, 20 nt, Salmonella typhimurium LT2
ccugcacggcgucauccaca

SEQ ID NO: 3812712 - RNA, 13 nt, Salmonella typhimurium LT2
ccugcacuuccag

SEQ ID NO: 3812713 - RNA, 15 nt, Salmonella typhimurium LT2
ccugcagaauaagcu

SEQ ID NO: 3812714 - RNA, 14 nt, Salmonella typhimurium LT2
ccugcagaugcugc

SEQ ID NO: 3812715 - RNA, 22 nt, Salmonella typhimurium LT2
ccugcaggcggugcgcagccac

SEQ ID NO: 3812716 - RNA, 12 nt, Salmonella typhimurium LT2
ccugcagggaau

SEQ ID NO: 3812717 - RNA, 23 nt, Salmonella typhimurium LT2
ccugcauauauccuaacuuauua

SEQ ID NO: 3812718 - RNA, 16 nt, Salmonella typhimurium LT2
ccugcauauuuuucau

SEQ ID NO: 3812719 - RNA, 17 nt, Salmonella typhimurium LT2
ccugcaucacgcccggc

SEQ ID NO: 3812720 - RNA, 17 nt, Salmonella typhimurium LT2
ccugcaucgacauccga

SEQ ID NO: 3812721 - RNA, 15 nt, Salmonella typhimurium LT2
ccugcaucguuuugg

SEQ ID NO: 3812722 - RNA, 14 nt, Salmonella typhimurium LT2
ccugccaccagcgu

SEQ ID NO: 3812723 - RNA, 19 nt, Salmonella typhimurium LT2
ccugccagaauuuccgcuu

SEQ ID NO: 3812724 - RNA, 14 nt, Salmonella typhimurium LT2
ccugccagauaguu

SEQ ID NO: 3812725 - RNA, 21 nt, Salmonella typhimurium LT2
ccugccagcaacccaccugcc

SEQ ID NO: 3812726 - RNA, 17 nt, Salmonella typhimurium LT2
ccugccagcacagcggu

SEQ ID NO: 3812727 - RNA, 20 nt, Salmonella typhimurium LT2
ccugccagcacagcgguagc

SEQ ID NO: 3812728 - RNA, 21 nt, Salmonella typhimurium LT2
ccugucgaucauccacccggc

SEQ ID NO: 3812729 - RNA, 19 nt, Salmonella typhimurium LT2
ccugucgccgucaauguca

SEQ ID NO: 3812730 - RNA, 14 nt, Salmonella typhimurium LT2
ccugucguacucca

SEQ ID NO: 3812731 - RNA, 14 nt, Salmonella typhimurium LT2
ccugucuccgcagc

SEQ ID NO: 3812732 - RNA, 22 nt, Salmonella typhimurium LT2
ccugucugucaaaacccagccc

SEQ ID NO: 3812733 - RNA, 23 nt, Salmonella typhimurium LT2
ccugucugucaaaacccagccca

SEQ ID NO: 3812734 - RNA, 22 nt, Salmonella typhimurium LT2
ccugucugucauaacugauaug

SEQ ID NO: 3812735 - RNA, 16 nt, Salmonella typhimurium LT2
ccugugaaguaaaaaa

SEQ ID NO: 3812736 - RNA, 12 nt, Salmonella typhimurium LT2
ccugugcaauca

SEQ ID NO: 3812737 - RNA, 16 nt, Salmonella typhimurium LT2
ccugugcaaucagcga

SEQ ID NO: 3812738 - RNA, 18 nt, Salmonella typhimurium LT2
ccugugccguugagcaca

SEQ ID NO: 3812739 - RNA, 13 nt, Salmonella typhimurium LT2
ccugugcucccgc

SEQ ID NO: 3812740 - RNA, 19 nt, Salmonella typhimurium LT2
ccugugcuuucgccaccag

SEQ ID NO: 3812741 - RNA, 20 nt, Salmonella typhimurium LT2
ccugugcuuucgccaccagc

SEQ ID NO: 3812742 - RNA, 24 nt, Salmonella typhimurium LT2
ccuguguaucgcccugccagcuca

SEQ ID NO: 3812743 - RNA, 19 nt, Salmonella typhimurium LT2
ccuguguauucugcgccag

SEQ ID NO: 3812744 - RNA, 22 nt, Salmonella typhimurium LT2
ccugugucguuucauccugaca

SEQ ID NO: 3812745 - RNA, 23 nt, Salmonella typhimurium LT2
ccuguuaacgcggguuuuuacuu

SEQ ID NO: 3812746 - RNA, 14 nt, Salmonella typhimurium LT2
ccuguuaucaggau

SEQ ID NO: 3812747 - RNA, 18 nt, Salmonella typhimurium LT2
ccuguuaugaaacccgcc

SEQ ID NO: 3812748 - RNA, 13 nt, Salmonella typhimurium LT2
ccuguucaacaug

SEQ ID NO: 3812749 - RNA, 19 nt, Salmonella typhimurium LT2
ccuguucaagcaauaaugc

SEQ ID NO: 3812750 - RNA, 21 nt, Salmonella typhimurium LT2
ccuguucaaguggcaaucgac

SEQ ID NO: 3812751 - RNA, 17 nt, Salmonella typhimurium LT2
ccuguuccaugauggcg

SEQ ID NO: 3812752 - RNA, 12 nt, Salmonella typhimurium LT2
ccuguucccggc

SEQ ID NO: 3812753 - RNA, 21 nt, Salmonella typhimurium LT2
ccuguucgcuuauuccuccgc

SEQ ID NO: 3812754 - RNA, 17 nt, Salmonella typhimurium LT2
ccuguucguaaucacuu

SEQ ID NO: 3812755 - RNA, 22 nt, Salmonella typhimurium LT2
ccuguucuggccgcgaugguua

SEQ ID NO: 3812756 - RNA, 18 nt, Salmonella typhimurium LT2
ccuguugcacgcauggca

SEQ ID NO: 3812757 - RNA, 16 nt, Salmonella typhimurium LT2
ccuguuuaucugaugc

SEQ ID NO: 3812758 - RNA, 18 nt, Salmonella typhimurium LT2
ccuguuucugcgccgcuu

SEQ ID NO: 3812759 - RNA, 22 nt, Salmonella typhimurium LT2
ccuuaaucgacugcguuaucgc

SEQ ID NO: 3812760 - RNA, 22 nt, Salmonella typhimurium LT2
ccuuaauuucuuugccccauaa

SEQ ID NO: 3812761 - RNA, 18 nt, Salmonella typhimurium LT2
ccuuacaaaaaucaugcc

SEQ ID NO: 3812762 - RNA, 13 nt, Salmonella typhimurium LT2
ccuuacagggcaa

SEQ ID NO: 3812763 - RNA, 18 nt, Salmonella typhimurium LT2
ccuuacccggccuacauc

SEQ ID NO: 3812764 - RNA, 16 nt, Salmonella typhimurium LT2
ccuuacgcucgcugau

SEQ ID NO: 3812765 - RNA, 19 nt, Salmonella typhimurium LT2
ccuuacuaagccaguucuc

SEQ ID NO: 3812766 - RNA, 13 nt, Salmonella typhimurium LT2
ccuuacuauccca

SEQ ID NO: 3812767 - RNA, 23 nt, Salmonella typhimurium LT2
ccuuacuguagcgccgcuuccag

SEQ ID NO: 3812768 - RNA, 12 nt, Salmonella typhimurium LT2
ccuuauaaugcu

SEQ ID NO: 3812769 - RNA, 21 nt, Salmonella typhimurium LT2
ccuuauaggcgcaucugaaaa

SEQ ID NO: 3812770 - RNA, 13 nt, Salmonella typhimurium LT2
ccuuaucaagccu

SEQ ID NO: 3812771 - RNA, 15 nt, Salmonella typhimurium LT2
ccuuauccagacgcu

SEQ ID NO: 3812772 - RNA, 22 nt, Salmonella typhimurium LT2
ccuuauccggccugcaggcaac

SEQ ID NO: 3812773 - RNA, 15 nt, Salmonella typhimurium LT2
ccuuaucgagaauac

SEQ ID NO: 3812774 - RNA, 18 nt, Salmonella typhimurium LT2
ccuuaucgcagucagccu

SEQ ID NO: 3812775 - RNA, 14 nt, Salmonella typhimurium LT2
ccuuauucagccca

SEQ ID NO: 3812776 - RNA, 12 nt, Salmonella typhimurium LT2
ccuuauucaggc

SEQ ID NO: 3812777 - RNA, 17 nt, Salmonella typhimurium LT2
ccuuauucgguuuaucc

SEQ ID NO: 3812778 - RNA, 18 nt, Salmonella typhimurium LT2
ccuucacacagugcgcga

SEQ ID NO: 3812779 - RNA, 12 nt, Salmonella typhimurium LT2
ccuucaccacuu

SEQ ID NO: 3812780 - RNA, 14 nt, Salmonella typhimurium LT2
ccuucacgccgcca

SEQ ID NO: 3812781 - RNA, 13 nt, Salmonella typhimurium LT2
ccuucagacgcau

SEQ ID NO: 3812782 - RNA, 22 nt, Salmonella typhimurium LT2
ccuucagugauaaagcacagcc

SEQ ID NO: 3812783 - RNA, 12 nt, Salmonella typhimurium LT2
ccuucauaaaua

SEQ ID NO: 3812784 - RNA, 17 nt, Salmonella typhimurium LT2
ccuucauauuucaagcc

SEQ ID NO: 3812785 - RNA, 20 nt, Salmonella typhimurium LT2
ccuucauauuucaagccgca

SEQ ID NO: 3812786 - RNA, 21 nt, Salmonella typhimurium LT2
ccuucauauuucaagccgcag

SEQ ID NO: 3812787 - RNA, 15 nt, Salmonella typhimurium LT2
ccuucaucagccagc

SEQ ID NO: 3812788 - RNA, 19 nt, Salmonella typhimurium LT2
ccuucauuaauuuucacgc

SEQ ID NO: 3812789 - RNA, 19 nt, Salmonella typhimurium LT2
ccuuccaccgucuugcugc

SEQ ID NO: 3812790 - RNA, 13 nt, Salmonella typhimurium LT2
ccuuccagcgcca

SEQ ID NO: 3812791 - RNA, 12 nt, Salmonella typhimurium LT2
ccuucccagccc

SEQ ID NO: 3812792 - RNA, 18 nt, Salmonella typhimurium LT2
ccuuccccaucaaaacug

SEQ ID NO: 3812793 - RNA, 19 nt, Salmonella typhimurium LT2
ccuucccccaaaaugccgc

SEQ ID NO: 3812794 - RNA, 17 nt, Salmonella typhimurium LT2
ccuuccggcgccuccag

SEQ ID NO: 3812795 - RNA, 20 nt, Salmonella typhimurium LT2
ccuuccguauugagcagcgg

SEQ ID NO: 3812796 - RNA, 19 nt, Salmonella typhimurium LT2
ccuuccucauuauugccca

SEQ ID NO: 3812797 - RNA, 15 nt, Salmonella typhimurium LT2
ccuuccuccaccacc

SEQ ID NO: 3812798 - RNA, 18 nt, Salmonella typhimurium LT2
ccuucgaucaugccuuua

SEQ ID NO: 3812799 - RNA, 22 nt, Salmonella typhimurium LT2
ccuucgcauauuguaccugccg

SEQ ID NO: 3812800 - RNA, 14 nt, Salmonella typhimurium LT2
ccuucgccgccgcu

SEQ ID NO: 3812801 - RNA, 13 nt, Salmonella typhimurium LT2
ccuucgccuucac

SEQ ID NO: 3812802 - RNA, 18 nt, Salmonella typhimurium LT2
ccuucgccuuccagugcg

SEQ ID NO: 3812803 - RNA, 17 nt, Salmonella typhimurium LT2
ccuucgcgcgauaauac

SEQ ID NO: 3812804 - RNA, 19 nt, Salmonella typhimurium LT2
ccuucgcggugaucccagg

SEQ ID NO: 3812805 - RNA, 18 nt, Salmonella typhimurium LT2
ccuucgcguaaugcaauc

SEQ ID NO: 3812806 - RNA, 18 nt, Salmonella typhimurium LT2
ccuucgcguuuaucacca

SEQ ID NO: 3812807 - RNA, 22 nt, Salmonella typhimurium LT2
ccuucggucguuugccgugcau

SEQ ID NO: 3812808 - RNA, 14 nt, Salmonella typhimurium LT2
ccuucggugccaua

SEQ ID NO: 3812809 - RNA, 18 nt, Salmonella typhimurium LT2
ccuucgguguaaacaggc

SEQ ID NO: 3812810 - RNA, 17 nt, Salmonella typhimurium LT2
ccuucgguuuuauauuc

SEQ ID NO: 3812811 - RNA, 17 nt, Salmonella typhimurium LT2
ccuucuaccgucagcag

SEQ ID NO: 3812812 - RNA, 22 nt, Salmonella typhimurium LT2
ccuucuccggucaucaccagau

SEQ ID NO: 3812813 - RNA, 17 nt, Salmonella typhimurium LT2
ccuucucugucgagcau

SEQ ID NO: 3812814 - RNA, 18 nt, Salmonella typhimurium LT2
ccuucugguagccagaca

SEQ ID NO: 3812815 - RNA, 19 nt, Salmonella typhimurium LT2
ccuucugguagccagacau

SEQ ID NO: 3812816 - RNA, 22 nt, Salmonella typhimurium LT2
ccuucuguacgcugaacaaccc

SEQ ID NO: 3812817 - RNA, 15 nt, Salmonella typhimurium LT2
ccuucuucacccacu

SEQ ID NO: 3812818 - RNA, 11 nt, Salmonella typhimurium LT2
ccuucuucaua

SEQ ID NO: 3812819 - RNA, 18 nt, Salmonella typhimurium LT2
ccuucuucaucuucaccu

SEQ ID NO: 3812820 - RNA, 14 nt, Salmonella typhimurium LT2
ccuucuucgccaac

SEQ ID NO: 3812821 - RNA, 20 nt, Salmonella typhimurium LT2
ccuucuuuauucacuuuuuc

SEQ ID NO: 3812822 - RNA, 12 nt, Salmonella typhimurium LT2
ccuucuuuuacu

SEQ ID NO: 3812823 - RNA, 15 nt, Salmonella typhimurium LT2
ccuugaccgccugau

SEQ ID NO: 3812824 - RNA, 17 nt, Salmonella typhimurium LT2
ccuugacgauaugcugc

SEQ ID NO: 3812825 - RNA, 16 nt, Salmonella typhimurium LT2
ccuugagcaaaacaca

SEQ ID NO: 3812826 - RNA, 14 nt, Salmonella typhimurium LT2
ccuugaguaucaau

SEQ ID NO: 3812827 - RNA, 17 nt, Salmonella typhimurium LT2
ccuugccagugaaaaaa

SEQ ID NO: 3812828 - RNA, 13 nt, Salmonella typhimurium LT2
ccuugcgaagacc

SEQ ID NO: 3812829 - RNA, 21 nt, Salmonella typhimurium LT2
ccuugcuggccuguucaagug

SEQ ID NO: 3812830 - RNA, 16 nt, Salmonella typhimurium LT2
ccuuguaagccggaua

SEQ ID NO: 3812831 - RNA, 14 nt, Salmonella typhimurium LT2
ccuuguaagggagg

SEQ ID NO: 3812832 - RNA, 24 nt, Salmonella typhimurium LT2
cgaacggcuuuccagcagccagaa

SEQ ID NO: 3812833 - RNA, 23 nt, Salmonella typhimurium LT2
cgaacgugcuggauagccucguu

SEQ ID NO: 3812834 - RNA, 14 nt, Salmonella typhimurium LT2
cgaacuccagcgcg

SEQ ID NO: 3812835 - RNA, 18 nt, Salmonella typhimurium LT2
cgaacuccagcgcgacgc

SEQ ID NO: 3812836 - RNA, 14 nt, Salmonella typhimurium LT2
cgaacucuuccaga

SEQ ID NO: 3812837 - RNA, 17 nt, Salmonella typhimurium LT2
cgaacugacccgccagu

SEQ ID NO: 3812838 - RNA, 13 nt, Salmonella typhimurium LT2
cgaacugauggcg

SEQ ID NO: 3812839 - RNA, 22 nt, Salmonella typhimurium LT2
cgaacugauggcgcuaagccag

SEQ ID NO: 3812840 - RNA, 20 nt, Salmonella typhimurium LT2
cgaacugucugaaucaaugc

SEQ ID NO: 3812841 - RNA, 18 nt, Salmonella typhimurium LT2
cgaacuuacggcgcgcca

SEQ ID NO: 3812842 - RNA, 23 nt, Salmonella typhimurium LT2
cgaacuuacggcgcgccaccauc

SEQ ID NO: 3812843 - RNA, 16 nt, Salmonella typhimurium LT2
cgaacuucauccacgc

SEQ ID NO: 3812844 - RNA, 19 nt, Salmonella typhimurium LT2
cgaacuucauccacgccga

SEQ ID NO: 3812845 - RNA, 20 nt, Salmonella typhimurium LT2
cgaacuucgcgguugcgccc

SEQ ID NO: 3812846 - RNA, 22 nt, Salmonella typhimurium LT2
cgaagaccgcaucacggcagca

SEQ ID NO: 3812847 - RNA, 14 nt, Salmonella typhimurium LT2
cgaagacggcgaaa

SEQ ID NO: 3812848 - RNA, 14 nt, Salmonella typhimurium LT2
cgaagacuccccug

SEQ ID NO: 3812849 - RNA, 17 nt, Salmonella typhimurium LT2
cgaagagaugccggaug

SEQ ID NO: 3812850 - RNA, 19 nt, Salmonella typhimurium LT2
cgaagaucguuauccagca

SEQ ID NO: 3812851 - RNA, 23 nt, Salmonella typhimurium LT2
cgaagccgccacccgguuuuuuu

SEQ ID NO: 3812852 - RNA, 19 nt, Salmonella typhimurium LT2
cgaagcgucauccggcaau

SEQ ID NO: 3812853 - RNA, 15 nt, Salmonella typhimurium LT2
cgaagcugaccagac

SEQ ID NO: 3812854 - RNA, 15 nt, Salmonella typhimurium LT2
cgaaggaugaccggc

SEQ ID NO: 3812855 - RNA, 18 nt, Salmonella typhimurium LT2
cgaaggccagcaccagcg

SEQ ID NO: 3812856 - RNA, 14 nt, Salmonella typhimurium LT2
cgaaggcgauaccg

SEQ ID NO: 3812857 - RNA, 16 nt, Salmonella typhimurium LT2
cgaagggccagagaaa

SEQ ID NO: 3812858 - RNA, 23 nt, Salmonella typhimurium LT2
cgaaggguagggauagcaucuuc

SEQ ID NO: 3812859 - RNA, 13 nt, Salmonella typhimurium LT2
cgaaggucgcgcc

SEQ ID NO: 3812860 - RNA, 15 nt, Salmonella typhimurium LT2
cgaagguggcggaau

SEQ ID NO: 3812861 - RNA, 22 nt, Salmonella typhimurium LT2
cgaaguaauaaaaaacaacucu

SEQ ID NO: 3812862 - RNA, 14 nt, Salmonella typhimurium LT2
cgaagucgccaccc

SEQ ID NO: 3812863 - RNA, 15 nt, Salmonella typhimurium LT2
cgaagucgccacccg

SEQ ID NO: 3812864 - RNA, 22 nt, Salmonella typhimurium LT2
cgaagugcagcguuuccagcca

SEQ ID NO: 3812865 - RNA, 17 nt, Salmonella typhimurium LT2
cgaaguucauaaaugua

SEQ ID NO: 3812866 - RNA, 13 nt, Salmonella typhimurium LT2
cgaaguucucaau

SEQ ID NO: 3812867 - RNA, 14 nt, Salmonella typhimurium LT2
cgaauaaaacugcc

SEQ ID NO: 3812868 - RNA, 13 nt, Salmonella typhimurium LT2
cgaauaacaaaau

SEQ ID NO: 3812869 - RNA, 16 nt, Salmonella typhimurium LT2
cgaauaacaaaaugag

SEQ ID NO: 3812870 - RNA, 14 nt, Salmonella typhimurium LT2
cgaauaaucgccgg

SEQ ID NO: 3812871 - RNA, 17 nt, Salmonella typhimurium LT2
cgaauacuguuccaggc

SEQ ID NO: 3812872 - RNA, 21 nt, Salmonella typhimurium LT2
cgaauagaguaauacauccau

SEQ ID NO: 3812873 - RNA, 19 nt, Salmonella typhimurium LT2
cgaauagcgacaaaugaag

SEQ ID NO: 3812874 - RNA, 13 nt, Salmonella typhimurium LT2
cgaauagcgccag

SEQ ID NO: 3812875 - RNA, 23 nt, Salmonella typhimurium LT2
cgaauagcgccuacgggcauucc

SEQ ID NO: 3812876 - RNA, 15 nt, Salmonella typhimurium LT2
cgaauauccagacug

SEQ ID NO: 3812877 - RNA, 17 nt, Salmonella typhimurium LT2
cgaaucauguuuuucuc

SEQ ID NO: 3812878 - RNA, 19 nt, Salmonella typhimurium LT2
cgaauccccaucuccagac

SEQ ID NO: 3812879 - RNA, 14 nt, Salmonella typhimurium LT2
cgaaucccgcguuc

SEQ ID NO: 3812880 - RNA, 12 nt, Salmonella typhimurium LT2
cgaauccuccug

SEQ ID NO: 3812881 - RNA, 13 nt, Salmonella typhimurium LT2
cgaauccuccugu

SEQ ID NO: 3812882 - RNA, 16 nt, Salmonella typhimurium LT2
cgaauccuccuguuga

SEQ ID NO: 3812883 - RNA, 21 nt, Salmonella typhimurium LT2
cgaaucgacaauccgccacgc

SEQ ID NO: 3812884 - RNA, 17 nt, Salmonella typhimurium LT2
cgaaucgccgcuuuuuc

SEQ ID NO: 3812885 - RNA, 22 nt, Salmonella typhimurium LT2
cgaaucgccuguaccgggcaga

SEQ ID NO: 3812886 - RNA, 13 nt, Salmonella typhimurium LT2
cgaaucucaaugc

SEQ ID NO: 3812887 - RNA, 18 nt, Salmonella typhimurium LT2
cgaaugcgccagcgagac

SEQ ID NO: 3812888 - RNA, 23 nt, Salmonella typhimurium LT2
cgaaugcuggggcggcgccaccu

SEQ ID NO: 3812889 - RNA, 16 nt, Salmonella typhimurium LT2
cgaaugugcuuaucac

SEQ ID NO: 3812890 - RNA, 14 nt, Salmonella typhimurium LT2
cgaauugucgguuu

SEQ ID NO: 3812891 - RNA, 15 nt, Salmonella typhimurium LT2
cgaauuucaucaguu

SEQ ID NO: 3812892 - RNA, 17 nt, Salmonella typhimurium LT2
cgaauuugccccagaua

SEQ ID NO: 3812893 - RNA, 23 nt, Salmonella typhimurium LT2
cgacaaaacuuuuggugcccauc

SEQ ID NO: 3812894 - RNA, 15 nt, Salmonella typhimurium LT2
cgacaaaagccagau

SEQ ID NO: 3812895 - RNA, 13 nt, Salmonella typhimurium LT2
cgacaaagccaac

SEQ ID NO: 3812896 - RNA, 13 nt, Salmonella typhimurium LT2
cgacaaauccucc

SEQ ID NO: 3812897 - RNA, 14 nt, Salmonella typhimurium LT2
cgacaacaagucca

SEQ ID NO: 3812898 - RNA, 14 nt, Salmonella typhimurium LT2
cgacaaccagcgaa

SEQ ID NO: 3812899 - RNA, 16 nt, Salmonella typhimurium LT2
cgacaaccagcgaaau

SEQ ID NO: 3812900 - RNA, 16 nt, Salmonella typhimurium LT2
cgacaacggaucgcaa

SEQ ID NO: 3812901 - RNA, 21 nt, Salmonella typhimurium LT2
cgacaacuucuaauuuuucca

SEQ ID NO: 3812902 - RNA, 23 nt, Salmonella typhimurium LT2
cgacaacuucuaauuuuuccagc

SEQ ID NO: 3812903 - RNA, 23 nt, Salmonella typhimurium LT2
cgacaagaagauuucuuaauucc

SEQ ID NO: 3812904 - RNA, 18 nt, Salmonella typhimurium LT2
cgacaagcuaauccccag

SEQ ID NO: 3812905 - RNA, 22 nt, Salmonella typhimurium LT2
cgacaagcuaauccccagcgcu

SEQ ID NO: 3812906 - RNA, 17 nt, Salmonella typhimurium LT2
cgacaauauguaacacg

SEQ ID NO: 3812907 - RNA, 17 nt, Salmonella typhimurium LT2
cgacaauauuuuucagc

SEQ ID NO: 3812908 - RNA, 19 nt, Salmonella typhimurium LT2
cgacaaucagaugcugacu

SEQ ID NO: 3812909 - RNA, 18 nt, Salmonella typhimurium LT2
cgacaauccgccacgcuc

SEQ ID NO: 3812910 - RNA, 13 nt, Salmonella typhimurium LT2
cgacaauggcgac

SEQ ID NO: 3812911 - RNA, 21 nt, Salmonella typhimurium LT2
cgacaauggcgacgaucagcg

SEQ ID NO: 3812912 - RNA, 21 nt, Salmonella typhimurium LT2
cgacaauuuugauaagagaaa

SEQ ID NO: 3812913 - RNA, 12 nt, Salmonella typhimurium LT2
cgacacaggcgu

SEQ ID NO: 3812914 - RNA, 14 nt, Salmonella typhimurium LT2
cgacacaucaucgc

SEQ ID NO: 3812915 - RNA, 18 nt, Salmonella typhimurium LT2
cgacacccgauacacgcc

SEQ ID NO: 3812916 - RNA, 19 nt, Salmonella typhimurium LT2
cgacacccgauacacgccg

SEQ ID NO: 3812917 - RNA, 18 nt, Salmonella typhimurium LT2
cgacacggcgcagauauu

SEQ ID NO: 3812918 - RNA, 15 nt, Salmonella typhimurium LT2
cgacacuccgcgcau

SEQ ID NO: 3812919 - RNA, 19 nt, Salmonella typhimurium LT2
cgacagaauaugcauauuc

SEQ ID NO: 3812920 - RNA, 23 nt, Salmonella typhimurium LT2
cgacagaauaugcauauucauau

SEQ ID NO: 3812921 - RNA, 16 nt, Salmonella typhimurium LT2
cgacagagccaacaga

SEQ ID NO: 3812922 - RNA, 18 nt, Salmonella typhimurium LT2
cgacagauagcccugauc

SEQ ID NO: 3812923 - RNA, 21 nt, Salmonella typhimurium LT2
cgacagauuggucagcagccc

SEQ ID NO: 3812924 - RNA, 15 nt, Salmonella typhimurium LT2
cgacagccaguaaug

SEQ ID NO: 3812925 - RNA, 16 nt, Salmonella typhimurium LT2
cgacagccaguaaugc

SEQ ID NO: 3812926 - RNA, 22 nt, Salmonella typhimurium LT2
cgacagccauaccggcgcgcgc

SEQ ID NO: 3812927 - RNA, 15 nt, Salmonella typhimurium LT2
cgacagcccgccagc

SEQ ID NO: 3812928 - RNA, 20 nt, Salmonella typhimurium LT2
cgacagcccgccagcauaca

SEQ ID NO: 3812929 - RNA, 21 nt, Salmonella typhimurium LT2
cgacagccgcguuuugccgcu

SEQ ID NO: 3812930 - RNA, 11 nt, Salmonella typhimurium LT2
cgacagcgcca

SEQ ID NO: 3812931 - RNA, 13 nt, Salmonella typhimurium LT2
cgacagcgcuggc

SEQ ID NO: 3812932 - RNA, 14 nt, Salmonella typhimurium LT2
cgacagcguaaugc

SEQ ID NO: 3812933 - RNA, 15 nt, Salmonella typhimurium LT2
cgacaggcagcguca

SEQ ID NO: 3812934 - RNA, 12 nt, Salmonella typhimurium LT2
cgacaggcugcc

SEQ ID NO: 3812935 - RNA, 17 nt, Salmonella typhimurium LT2
cgacagggcgugaacca

SEQ ID NO: 3812936 - RNA, 17 nt, Salmonella typhimurium LT2
cgagacugcccggcaua

SEQ ID NO: 3812937 - RNA, 14 nt, Salmonella typhimurium LT2
cgagagaaaaaaau

SEQ ID NO: 3812938 - RNA, 15 nt, Salmonella typhimurium LT2
cgagagaaaaaaauc

SEQ ID NO: 3812939 - RNA, 21 nt, Salmonella typhimurium LT2
cgagagaauuaacagcgcgac

SEQ ID NO: 3812940 - RNA, 22 nt, Salmonella typhimurium LT2
cgagagaauuaacagcgcgacc

SEQ ID NO: 3812941 - RNA, 23 nt, Salmonella typhimurium LT2
cgagagaauuaacagcgcgacca

SEQ ID NO: 3812942 - RNA, 13 nt, Salmonella typhimurium LT2
cgagagcuacagu

SEQ ID NO: 3812943 - RNA, 17 nt, Salmonella typhimurium LT2
cgagagugacgacgcca

SEQ ID NO: 3812944 - RNA, 23 nt, Salmonella typhimurium LT2
cgagagugacgacgccaggcggu

SEQ ID NO: 3812945 - RNA, 20 nt, Salmonella typhimurium LT2
cgagauaaccaucgcgcagc

SEQ ID NO: 3812946 - RNA, 17 nt, Salmonella typhimurium LT2
cgagauaauccagccac

SEQ ID NO: 3812947 - RNA, 20 nt, Salmonella typhimurium LT2
cgagauacugcaacgccaga

SEQ ID NO: 3812948 - RNA, 15 nt, Salmonella typhimurium LT2
cgagaucgccaccgc

SEQ ID NO: 3812949 - RNA, 17 nt, Salmonella typhimurium LT2
cgagaugcauaaaaaaa

SEQ ID NO: 3812950 - RNA, 14 nt, Salmonella typhimurium LT2
cgagauucaauaac

SEQ ID NO: 3812951 - RNA, 22 nt, Salmonella typhimurium LT2
cgagauuuuucugcgccaccag

SEQ ID NO: 3812952 - RNA, 23 nt, Salmonella typhimurium LT2
cgagauuuuucugcgccaccagc

SEQ ID NO: 3812953 - RNA, 19 nt, Salmonella typhimurium LT2
cgagcaauuuccucugccg

SEQ ID NO: 3812954 - RNA, 15 nt, Salmonella typhimurium LT2
cgagcaggaaccaca

SEQ ID NO: 3812955 - RNA, 14 nt, Salmonella typhimurium LT2
cgagcaggacgcgc

SEQ ID NO: 3812956 - RNA, 15 nt, Salmonella typhimurium LT2
cgagcaguacgccug

SEQ ID NO: 3812957 - RNA, 14 nt, Salmonella typhimurium LT2
cgagccagaaaugu

SEQ ID NO: 3812958 - RNA, 23 nt, Salmonella typhimurium LT2
cgagcccgaggcgaaacggcgga

SEQ ID NO: 3812959 - RNA, 18 nt, Salmonella typhimurium LT2
cgagccgucgccggccug

SEQ ID NO: 3812960 - RNA, 13 nt, Salmonella typhimurium LT2
cgagcgauagaga

SEQ ID NO: 3812961 - RNA, 23 nt, Salmonella typhimurium LT2
cgagcgauagagaguuccuccug

SEQ ID NO: 3812962 - RNA, 15 nt, Salmonella typhimurium LT2
cgagcgaugcugcuu

SEQ ID NO: 3812963 - RNA, 23 nt, Salmonella typhimurium LT2
cgagcgccgcuuugcccggccac

SEQ ID NO: 3812964 - RNA, 16 nt, Salmonella typhimurium LT2
cgagcgccgucacucc

SEQ ID NO: 3812965 - RNA, 12 nt, Salmonella typhimurium LT2
cgagcgccugau

SEQ ID NO: 3812966 - RNA, 13 nt, Salmonella typhimurium LT2
cgagcgccugaug

SEQ ID NO: 3812967 - RNA, 17 nt, Salmonella typhimurium LT2
cgagcgcggaggggcga

SEQ ID NO: 3812968 - RNA, 20 nt, Salmonella typhimurium LT2
cgagcgcuccgcacgccggu

SEQ ID NO: 3812969 - RNA, 14 nt, Salmonella typhimurium LT2
cgagcggccaaagg

SEQ ID NO: 3812970 - RNA, 17 nt, Salmonella typhimurium LT2
cgagcggucaggccagc

SEQ ID NO: 3812971 - RNA, 22 nt, Salmonella typhimurium LT2
cgagcgugauacucugcgcugc

SEQ ID NO: 3812972 - RNA, 14 nt, Salmonella typhimurium LT2
cgagcuacaggugc

SEQ ID NO: 3812973 - RNA, 19 nt, Salmonella typhimurium LT2
cgagcuauguuuaagccag

SEQ ID NO: 3812974 - RNA, 21 nt, Salmonella typhimurium LT2
cgagcucaguccagccgccgc

SEQ ID NO: 3812975 - RNA, 22 nt, Salmonella typhimurium LT2
cgagcugcgcuuuuucaucauc

SEQ ID NO: 3812976 - RNA, 18 nt, Salmonella typhimurium LT2
cgagcugguuucaaugcu

SEQ ID NO: 3812977 - RNA, 13 nt, Salmonella typhimurium LT2
cgagcuuacgcac

SEQ ID NO: 3812978 - RNA, 20 nt, Salmonella typhimurium LT2
cgaggaaaacgcuucuaccu

SEQ ID NO: 3812979 - RNA, 21 nt, Salmonella typhimurium LT2
cgaggaacaucagccagcagc

SEQ ID NO: 3812980 - RNA, 23 nt, Salmonella typhimurium LT2
cgaggaacaucagccagcagcuc

SEQ ID NO: 3812981 - RNA, 15 nt, Salmonella typhimurium LT2
cgaggaacgcgcagu

SEQ ID NO: 3812982 - RNA, 22 nt, Salmonella typhimurium LT2
cgaggaguaguuaaaaaagguc

SEQ ID NO: 3812983 - RNA, 20 nt, Salmonella typhimurium LT2
cgaggauacggucgacacca

SEQ ID NO: 3812984 - RNA, 22 nt, Salmonella typhimurium LT2
cgaggauacggucgacaccagc

SEQ ID NO: 3812985 - RNA, 17 nt, Salmonella typhimurium LT2
cgaggaucaguaacagg

SEQ ID NO: 3812986 - RNA, 16 nt, Salmonella typhimurium LT2
cgaggcaacagauacg

SEQ ID NO: 3812987 - RNA, 18 nt, Salmonella typhimurium LT2
cgaggcgaaacggcggaa

SEQ ID NO: 3812988 - RNA, 17 nt, Salmonella typhimurium LT2
cgaggcuuaauacagca

SEQ ID NO: 3812989 - RNA, 20 nt, Salmonella typhimurium LT2
cgaggcuuaauacagcaacg

SEQ ID NO: 3812990 - RNA, 18 nt, Salmonella typhimurium LT2
cgagguacuugacgucgc

SEQ ID NO: 3812991 - RNA, 22 nt, Salmonella typhimurium LT2
cgaggugguucguaacaccuua

SEQ ID NO: 3812992 - RNA, 18 nt, Salmonella typhimurium LT2
cgagguucccgccgccau

SEQ ID NO: 3812993 - RNA, 23 nt, Salmonella typhimurium LT2
cgaguaacaccgcggcgcucgcc

SEQ ID NO: 3812994 - RNA, 20 nt, Salmonella typhimurium LT2
cgaguaauccguagccaaca

SEQ ID NO: 3812995 - RNA, 16 nt, Salmonella typhimurium LT2
cgaguaauuugugauc

SEQ ID NO: 3812996 - RNA, 21 nt, Salmonella typhimurium LT2
cgaguagcaaaucccgguaaa

SEQ ID NO: 3812997 - RNA, 16 nt, Salmonella typhimurium LT2
cgaguagcgaaacccc

SEQ ID NO: 3812998 - RNA, 18 nt, Salmonella typhimurium LT2
cgaguauucgcgcccuca

SEQ ID NO: 3812999 - RNA, 16 nt, Salmonella typhimurium LT2
cgagucuuaccagguc

SEQ ID NO: 3813000 - RNA, 16 nt, Salmonella typhimurium LT2
cgagugcguucuucca

SEQ ID NO: 3813001 - RNA, 19 nt, Salmonella typhimurium LT2
cgagugcguucuuccacuu

SEQ ID NO: 3813002 - RNA, 13 nt, Salmonella typhimurium LT2
cgaguuaagcgcc

SEQ ID NO: 3813003 - RNA, 12 nt, Salmonella typhimurium LT2
cgaguucaaguc

SEQ ID NO: 3813004 - RNA, 15 nt, Salmonella typhimurium LT2
cgaguuccaguccac

SEQ ID NO: 3813005 - RNA, 22 nt, Salmonella typhimurium LT2
cgaguucucgccggauggcgac

SEQ ID NO: 3813006 - RNA, 14 nt, Salmonella typhimurium LT2
cgauaaaaaagccu

SEQ ID NO: 3813007 - RNA, 14 nt, Salmonella typhimurium LT2
cgauaaacagauau

SEQ ID NO: 3813008 - RNA, 15 nt, Salmonella typhimurium LT2
cgauaaaccaggcag

SEQ ID NO: 3813009 - RNA, 18 nt, Salmonella typhimurium LT2
cgauaaacgccucgcucu

SEQ ID NO: 3813010 - RNA, 17 nt, Salmonella typhimurium LT2
cgauaaacucaaucagg

SEQ ID NO: 3813011 - RNA, 15 nt, Salmonella typhimurium LT2
cgauaaacucagcgc

SEQ ID NO: 3813012 - RNA, 19 nt, Salmonella typhimurium LT2
cgauaaacucagcgccagc

SEQ ID NO: 3813013 - RNA, 13 nt, Salmonella typhimurium LT2
cgauaaagacagg

SEQ ID NO: 3813014 - RNA, 12 nt, Salmonella typhimurium LT2
cgauaaagcugg

SEQ ID NO: 3813015 - RNA, 17 nt, Salmonella typhimurium LT2
cgauaaaguggcauccg

SEQ ID NO: 3813016 - RNA, 16 nt, Salmonella typhimurium LT2
cgauaaauaccguaau

SEQ ID NO: 3813017 - RNA, 13 nt, Salmonella typhimurium LT2
cgauaaaucgcca

SEQ ID NO: 3813018 - RNA, 15 nt, Salmonella typhimurium LT2
cgauaaccaccagcg

SEQ ID NO: 3813019 - RNA, 14 nt, Salmonella typhimurium LT2
cgauaaccagcgcg

SEQ ID NO: 3813020 - RNA, 12 nt, Salmonella typhimurium LT2
cgauaaccgaug

SEQ ID NO: 3813021 - RNA, 17 nt, Salmonella typhimurium LT2
cgauaaccucucaccgc

SEQ ID NO: 3813022 - RNA, 19 nt, Salmonella typhimurium LT2
cgauaaccuguaaauaaua

SEQ ID NO: 3813023 - RNA, 15 nt, Salmonella typhimurium LT2
cgauaacgcagcgcg

SEQ ID NO: 3813024 - RNA, 12 nt, Salmonella typhimurium LT2
cgauaacgguca

SEQ ID NO: 3813025 - RNA, 19 nt, Salmonella typhimurium LT2
cgauaacguuaccgcagcg

SEQ ID NO: 3813026 - RNA, 18 nt, Salmonella typhimurium LT2
cgauaagcgccgcgccau

SEQ ID NO: 3813027 - RNA, 13 nt, Salmonella typhimurium LT2
cgauaauaaugag

SEQ ID NO: 3813028 - RNA, 21 nt, Salmonella typhimurium LT2
cgauaauagccucauccccaa

SEQ ID NO: 3813029 - RNA, 14 nt, Salmonella typhimurium LT2
cgauaaucaccagc

SEQ ID NO: 3813030 - RNA, 15 nt, Salmonella typhimurium LT2
cgauacaccuucaca

SEQ ID NO: 3813031 - RNA, 18 nt, Salmonella typhimurium LT2
cgauacacgccgacgcau

SEQ ID NO: 3813032 - RNA, 19 nt, Salmonella typhimurium LT2
cgauaccaauucccagacc

SEQ ID NO: 3813033 - RNA, 14 nt, Salmonella typhimurium LT2
cgauaccaguaaua

SEQ ID NO: 3813034 - RNA, 19 nt, Salmonella typhimurium LT2
cgauacccgcccagaucag

SEQ ID NO: 3813035 - RNA, 14 nt, Salmonella typhimurium LT2
cgauaccgguaauc

SEQ ID NO: 3813036 - RNA, 22 nt, Salmonella typhimurium LT2
cgauacgcagaaccgccgcgau

SEQ ID NO: 3813037 - RNA, 22 nt, Salmonella typhimurium LT2
cgauacggucaaggaaccaacg

SEQ ID NO: 3813038 - RNA, 17 nt, Salmonella typhimurium LT2
cgauacgucccugcugg

SEQ ID NO: 3813039 - RNA, 22 nt, Salmonella typhimurium LT2
cgauacgucccugcuggcgaac

SEQ ID NO: 3813040 - RNA, 16 nt, Salmonella typhimurium LT2
cgauucgcaugaauuc

SEQ ID NO: 3813041 - RNA, 19 nt, Salmonella typhimurium LT2
cgauucgcgcgucaacggc

SEQ ID NO: 3813042 - RNA, 16 nt, Salmonella typhimurium LT2
cgauucggacuaauac

SEQ ID NO: 3813043 - RNA, 15 nt, Salmonella typhimurium LT2
cgauugacccgccgc

SEQ ID NO: 3813044 - RNA, 12 nt, Salmonella typhimurium LT2
cgauugaucgga

SEQ ID NO: 3813045 - RNA, 21 nt, Salmonella typhimurium LT2
cgauugccgcucagcucgacg

SEQ ID NO: 3813046 - RNA, 14 nt, Salmonella typhimurium LT2
cgauugcgccagac

SEQ ID NO: 3813047 - RNA, 22 nt, Salmonella typhimurium LT2
cgauuguugacugccagcguug

SEQ ID NO: 3813048 - RNA, 21 nt, Salmonella typhimurium LT2
cgauuuaccucucaccaguag

SEQ ID NO: 3813049 - RNA, 21 nt, Salmonella typhimurium LT2
cgauuucacgaccgccgauaa

SEQ ID NO: 3813050 - RNA, 17 nt, Salmonella typhimurium LT2
cgauuucaucagcgacg

SEQ ID NO: 3813051 - RNA, 11 nt, Salmonella typhimurium LT2
cgauuuccagc

SEQ ID NO: 3813052 - RNA, 14 nt, Salmonella typhimurium LT2
cgauuuccagcgaa

SEQ ID NO: 3813053 - RNA, 19 nt, Salmonella typhimurium LT2
cgauuucgcuccacuggcc

SEQ ID NO: 3813054 - RNA, 22 nt, Salmonella typhimurium LT2
cgauuucguucuuucugccauc

SEQ ID NO: 3813055 - RNA, 23 nt, Salmonella typhimurium LT2
cgauuucguucuuucugccaucg

SEQ ID NO: 3813056 - RNA, 13 nt, Salmonella typhimurium LT2
cgauuuggucagu

SEQ ID NO: 3813057 - RNA, 22 nt, Salmonella typhimurium LT2
cgauuuugacaaugaugguuaa

SEQ ID NO: 3813058 - RNA, 12 nt, Salmonella typhimurium LT2
cgcaaaaaauau

SEQ ID NO: 3813059 - RNA, 17 nt, Salmonella typhimurium LT2
cgcaaaaucgcaaacgc

SEQ ID NO: 3813060 - RNA, 20 nt, Salmonella typhimurium LT2
cgcaaaaucgcaaacgccag

SEQ ID NO: 3813061 - RNA, 16 nt, Salmonella typhimurium LT2
cgcaaaauucacacca

SEQ ID NO: 3813062 - RNA, 18 nt, Salmonella typhimurium LT2
cgcaaacgccgaagccaa

SEQ ID NO: 3813063 - RNA, 21 nt, Salmonella typhimurium LT2
cgcaaacgccgugaacgccaa

SEQ ID NO: 3813064 - RNA, 18 nt, Salmonella typhimurium LT2
cgcaaacgccugcuccgu

SEQ ID NO: 3813065 - RNA, 22 nt, Salmonella typhimurium LT2
cgcaaacuuugcgccauuucaa

SEQ ID NO: 3813066 - RNA, 16 nt, Salmonella typhimurium LT2
cgcaaagcccaucagc

SEQ ID NO: 3813067 - RNA, 22 nt, Salmonella typhimurium LT2
cgcaaaguuuucuuccgugccg

SEQ ID NO: 3813068 - RNA, 22 nt, Salmonella typhimurium LT2
cgcaaauccguugccgaagaaa

SEQ ID NO: 3813069 - RNA, 19 nt, Salmonella typhimurium LT2
cgcaaauucaucgccgccg

SEQ ID NO: 3813070 - RNA, 23 nt, Salmonella typhimurium LT2
cgcaacaauggucgcgccgucgc

SEQ ID NO: 3813071 - RNA, 21 nt, Salmonella typhimurium LT2
cgcaacauuuuuguuaauauu

SEQ ID NO: 3813072 - RNA, 19 nt, Salmonella typhimurium LT2
cgcaaccauuaccgccaac

SEQ ID NO: 3813073 - RNA, 16 nt, Salmonella typhimurium LT2
cgcaaccgacacauuc

SEQ ID NO: 3813074 - RNA, 17 nt, Salmonella typhimurium LT2
cgcaacgcgcaucaacg

SEQ ID NO: 3813075 - RNA, 12 nt, Salmonella typhimurium LT2
cgcaacgugcag

SEQ ID NO: 3813076 - RNA, 16 nt, Salmonella typhimurium LT2
cgcaacguuucuuuca

SEQ ID NO: 3813077 - RNA, 21 nt, Salmonella typhimurium LT2
cgcaacguuucuuucaucaga

SEQ ID NO: 3813078 - RNA, 23 nt, Salmonella typhimurium LT2
cgcaacguuucuuucaucagauc

SEQ ID NO: 3813079 - RNA, 19 nt, Salmonella typhimurium LT2
cgcaacugggaaugcuaug

SEQ ID NO: 3813080 - RNA, 19 nt, Salmonella typhimurium LT2
cgcaacuuagcguccacuc

SEQ ID NO: 3813081 - RNA, 11 nt, Salmonella typhimurium LT2
cgcaagaaaag

SEQ ID NO: 3813082 - RNA, 16 nt, Salmonella typhimurium LT2
cgcaagaaacaggcug

SEQ ID NO: 3813083 - RNA, 23 nt, Salmonella typhimurium LT2
cgcaagcauaaaaaacaucaugc

SEQ ID NO: 3813084 - RNA, 14 nt, Salmonella typhimurium LT2
cgcaagcgccaccc

SEQ ID NO: 3813085 - RNA, 22 nt, Salmonella typhimurium LT2
cgcaaggcggcguuuuuuuauc

SEQ ID NO: 3813086 - RNA, 16 nt, Salmonella typhimurium LT2
cgcaauaacgccgaua

SEQ ID NO: 3813087 - RNA, 14 nt, Salmonella typhimurium LT2
cgcaaucacauaca

SEQ ID NO: 3813088 - RNA, 21 nt, Salmonella typhimurium LT2
cgcaaucacauacagcacuuc

SEQ ID NO: 3813089 - RNA, 21 nt, Salmonella typhimurium LT2
cgcaaucacgcguuauacgca

SEQ ID NO: 3813090 - RNA, 22 nt, Salmonella typhimurium LT2
cgcaaucauacauagcaggcca

SEQ ID NO: 3813091 - RNA, 16 nt, Salmonella typhimurium LT2
cgcaaucauuaccgga

SEQ ID NO: 3813092 - RNA, 13 nt, Salmonella typhimurium LT2
cgcaaucgguaaa

SEQ ID NO: 3813093 - RNA, 15 nt, Salmonella typhimurium LT2
cgcaaucuggcgcaa

SEQ ID NO: 3813094 - RNA, 21 nt, Salmonella typhimurium LT2
cgcaaucuuugccgcaaacgc

SEQ ID NO: 3813095 - RNA, 13 nt, Salmonella typhimurium LT2
cgcaauuaauuua

SEQ ID NO: 3813096 - RNA, 17 nt, Salmonella typhimurium LT2
cgcaauuacucuuugug

SEQ ID NO: 3813097 - RNA, 22 nt, Salmonella typhimurium LT2
cgcacaaucgccgugaucccaa

SEQ ID NO: 3813098 - RNA, 15 nt, Salmonella typhimurium LT2
cgcacacgccgugca

SEQ ID NO: 3813099 - RNA, 15 nt, Salmonella typhimurium LT2
cgcacacuugcuccc

SEQ ID NO: 3813100 - RNA, 14 nt, Salmonella typhimurium LT2
cgcacagaaucacc

SEQ ID NO: 3813101 - RNA, 12 nt, Salmonella typhimurium LT2
cgcacaggccug

SEQ ID NO: 3813102 - RNA, 13 nt, Salmonella typhimurium LT2
cgcacaggccuga

SEQ ID NO: 3813103 - RNA, 18 nt, Salmonella typhimurium LT2
cgcacaguagcucauagc

SEQ ID NO: 3813104 - RNA, 20 nt, Salmonella typhimurium LT2
cgcaccaaaguuaaucagcg

SEQ ID NO: 3813105 - RNA, 14 nt, Salmonella typhimurium LT2
cgcaccaaccguga

SEQ ID NO: 3813106 - RNA, 15 nt, Salmonella typhimurium LT2
cgcaccacgccgaag

SEQ ID NO: 3813107 - RNA, 23 nt, Salmonella typhimurium LT2
cgcaccagccggugcucgccguu

SEQ ID NO: 3813108 - RNA, 19 nt, Salmonella typhimurium LT2
cgcaccgccagucaauaaa

SEQ ID NO: 3813109 - RNA, 17 nt, Salmonella typhimurium LT2
cgcaccguugccauacg

SEQ ID NO: 3813110 - RNA, 21 nt, Salmonella typhimurium LT2
cgcaccuucaacagcucgcca

SEQ ID NO: 3813111 - RNA, 19 nt, Salmonella typhimurium LT2
cgcacgacaacgcgccgcg

SEQ ID NO: 3813112 - RNA, 12 nt, Salmonella typhimurium LT2
cgcacgccagcg

SEQ ID NO: 3813113 - RNA, 14 nt, Salmonella typhimurium LT2
cgcacgccagcggu

SEQ ID NO: 3813114 - RNA, 18 nt, Salmonella typhimurium LT2
cgcacgcccaucggcaca

SEQ ID NO: 3813115 - RNA, 12 nt, Salmonella typhimurium LT2
cgcacgccgcuc

SEQ ID NO: 3813116 - RNA, 20 nt, Salmonella typhimurium LT2
cgcacgccggccccgcuucc

SEQ ID NO: 3813117 - RNA, 12 nt, Salmonella typhimurium LT2
cgcacgcgcgcc

SEQ ID NO: 3813118 - RNA, 19 nt, Salmonella typhimurium LT2
cgcacgcguucacaacggc

SEQ ID NO: 3813119 - RNA, 16 nt, Salmonella typhimurium LT2
cgcacgcugucgccgg

SEQ ID NO: 3813120 - RNA, 11 nt, Salmonella typhimurium LT2
cgcacguucag

SEQ ID NO: 3813121 - RNA, 18 nt, Salmonella typhimurium LT2
cgcacguucagcucagcg

SEQ ID NO: 3813122 - RNA, 14 nt, Salmonella typhimurium LT2
cgcacuacaucauu

SEQ ID NO: 3813123 - RNA, 15 nt, Salmonella typhimurium LT2
cgcacuacaucauuc

SEQ ID NO: 3813124 - RNA, 14 nt, Salmonella typhimurium LT2
cgcacuccagaugc

SEQ ID NO: 3813125 - RNA, 14 nt, Salmonella typhimurium LT2
cgcacucgccgcca

SEQ ID NO: 3813126 - RNA, 18 nt, Salmonella typhimurium LT2
cgcacugauagccgccag

SEQ ID NO: 3813127 - RNA, 22 nt, Salmonella typhimurium LT2
cgcacuggucgggcaggcuucc

SEQ ID NO: 3813128 - RNA, 16 nt, Salmonella typhimurium LT2
cgcacuuuucccgcca

SEQ ID NO: 3813129 - RNA, 14 nt, Salmonella typhimurium LT2
cgcagaaccgccgc

SEQ ID NO: 3813130 - RNA, 13 nt, Salmonella typhimurium LT2
cgcagaaucagcg

SEQ ID NO: 3813131 - RNA, 14 nt, Salmonella typhimurium LT2
cgcagacacugcca

SEQ ID NO: 3813132 - RNA, 14 nt, Salmonella typhimurium LT2
cgcagacaguggcc

SEQ ID NO: 3813133 - RNA, 20 nt, Salmonella typhimurium LT2
cgcagacgucaacaccucca

SEQ ID NO: 3813134 - RNA, 21 nt, Salmonella typhimurium LT2
cgcagacgucaacaccuccag

SEQ ID NO: 3813135 - RNA, 20 nt, Salmonella typhimurium LT2
cgcagacuugaaucugucaa

SEQ ID NO: 3813136 - RNA, 18 nt, Salmonella typhimurium LT2
cgcagagauagccagcga

SEQ ID NO: 3813137 - RNA, 14 nt, Salmonella typhimurium LT2
cgcagagcccagcg

SEQ ID NO: 3813138 - RNA, 15 nt, Salmonella typhimurium LT2
cgcagagcccagcgc

SEQ ID NO: 3813139 - RNA, 21 nt, Salmonella typhimurium LT2
cgcagaguaaaaaaaccggcg

SEQ ID NO: 3813140 - RNA, 16 nt, Salmonella typhimurium LT2
cgcagaguacgucgcc

SEQ ID NO: 3813141 - RNA, 21 nt, Salmonella typhimurium LT2
cgcagauaccggcgcagcauc

SEQ ID NO: 3813142 - RNA, 18 nt, Salmonella typhimurium LT2
cgcagauaucuuccagcg

SEQ ID NO: 3813143 - RNA, 18 nt, Salmonella typhimurium LT2
cgcagauauuuccggcaa

SEQ ID NO: 3813144 - RNA, 16 nt, Salmonella typhimurium LT2
cgcauuuaaucgccug

SEQ ID NO: 3813145 - RNA, 15 nt, Salmonella typhimurium LT2
cgcauuugcuuucau

SEQ ID NO: 3813146 - RNA, 16 nt, Salmonella typhimurium LT2
cgccaaaaaaggcagc

SEQ ID NO: 3813147 - RNA, 20 nt, Salmonella typhimurium LT2
cgccaaaaaaggcagccagg

SEQ ID NO: 3813148 - RNA, 21 nt, Salmonella typhimurium LT2
cgccaaaaaaggcagccagga

SEQ ID NO: 3813149 - RNA, 21 nt, Salmonella typhimurium LT2
cgccaaaacccagaaucagca

SEQ ID NO: 3813150 - RNA, 21 nt, Salmonella typhimurium LT2
cgccaaaagaggcagcaaagc

SEQ ID NO: 3813151 - RNA, 16 nt, Salmonella typhimurium LT2
cgccaaaccagacccg

SEQ ID NO: 3813152 - RNA, 22 nt, Salmonella typhimurium LT2
cgccaaaccagacccgcugcgu

SEQ ID NO: 3813153 - RNA, 13 nt, Salmonella typhimurium LT2
cgccaaacccgcc

SEQ ID NO: 3813154 - RNA, 19 nt, Salmonella typhimurium LT2
cgccaaacccgccacaggc

SEQ ID NO: 3813155 - RNA, 14 nt, Salmonella typhimurium LT2
cgccaaaccggcga

SEQ ID NO: 3813156 - RNA, 13 nt, Salmonella typhimurium LT2
cgccaaacgccgc

SEQ ID NO: 3813157 - RNA, 19 nt, Salmonella typhimurium LT2
cgccaaacugcgcgccgcc

SEQ ID NO: 3813158 - RNA, 18 nt, Salmonella typhimurium LT2
cgccaaagaaacgcugau

SEQ ID NO: 3813159 - RNA, 19 nt, Salmonella typhimurium LT2
cgccaaagcgguccggcau

SEQ ID NO: 3813160 - RNA, 16 nt, Salmonella typhimurium LT2
cgccaaagcguaaaca

SEQ ID NO: 3813161 - RNA, 19 nt, Salmonella typhimurium LT2
cgccaaaucuguucugucc

SEQ ID NO: 3813162 - RNA, 20 nt, Salmonella typhimurium LT2
cgccaaaucuguucugucca

SEQ ID NO: 3813163 - RNA, 13 nt, Salmonella typhimurium LT2
cgccaaccgccau

SEQ ID NO: 3813164 - RNA, 12 nt, Salmonella typhimurium LT2
cgccaaccggcu

SEQ ID NO: 3813165 - RNA, 14 nt, Salmonella typhimurium LT2
cgccaaccucccaa

SEQ ID NO: 3813166 - RNA, 15 nt, Salmonella typhimurium LT2
cgccaaccugcuggu

SEQ ID NO: 3813167 - RNA, 12 nt, Salmonella typhimurium LT2
cgccaacgccaa

SEQ ID NO: 3813168 - RNA, 18 nt, Salmonella typhimurium LT2
cgccaacgccacugccau

SEQ ID NO: 3813169 - RNA, 19 nt, Salmonella typhimurium LT2
cgccaacgccacugccaua

SEQ ID NO: 3813170 - RNA, 12 nt, Salmonella typhimurium LT2
cgccaacgcccg

SEQ ID NO: 3813171 - RNA, 15 nt, Salmonella typhimurium LT2
cgccaacgucgacag

SEQ ID NO: 3813172 - RNA, 16 nt, Salmonella typhimurium LT2
cgccaacuuuuugcgc

SEQ ID NO: 3813173 - RNA, 20 nt, Salmonella typhimurium LT2
cgccaagaccgccuaacagc

SEQ ID NO: 3813174 - RNA, 12 nt, Salmonella typhimurium LT2
cgccaagcgcgg

SEQ ID NO: 3813175 - RNA, 15 nt, Salmonella typhimurium LT2
cgccaauccaugccg

SEQ ID NO: 3813176 - RNA, 16 nt, Salmonella typhimurium LT2
cgccaauuaaauaucc

SEQ ID NO: 3813177 - RNA, 15 nt, Salmonella typhimurium LT2
cgccaauugaugaac

SEQ ID NO: 3813178 - RNA, 22 nt, Salmonella typhimurium LT2
cgccacaaaggaucauuggcca

SEQ ID NO: 3813179 - RNA, 23 nt, Salmonella typhimurium LT2
cgccacaccgagacagagaaccu

SEQ ID NO: 3813180 - RNA, 22 nt, Salmonella typhimurium LT2
cgccacagcggaauagacggcc

SEQ ID NO: 3813181 - RNA, 15 nt, Salmonella typhimurium LT2
cgccacaugcggcag

SEQ ID NO: 3813182 - RNA, 12 nt, Salmonella typhimurium LT2
cgccaccaaaaa

SEQ ID NO: 3813183 - RNA, 22 nt, Salmonella typhimurium LT2
cgccaccacagucaucgcgcca

SEQ ID NO: 3813184 - RNA, 13 nt, Salmonella typhimurium LT2
cgccaccacgccg

SEQ ID NO: 3813185 - RNA, 15 nt, Salmonella typhimurium LT2
cgccaccagcgcagu

SEQ ID NO: 3813186 - RNA, 19 nt, Salmonella typhimurium LT2
cgccaccaggaacgagcug

SEQ ID NO: 3813187 - RNA, 17 nt, Salmonella typhimurium LT2
cgccaccauccggcgcu

SEQ ID NO: 3813188 - RNA, 20 nt, Salmonella typhimurium LT2
cgccaccaugaucaccugaa

SEQ ID NO: 3813189 - RNA, 13 nt, Salmonella typhimurium LT2
cgccaccgccgcu

SEQ ID NO: 3813190 - RNA, 14 nt, Salmonella typhimurium LT2
cgccaccgcgcgcu

SEQ ID NO: 3813191 - RNA, 15 nt, Salmonella typhimurium LT2
cgccaccgcgcgcuu

SEQ ID NO: 3813192 - RNA, 18 nt, Salmonella typhimurium LT2
cgccaccgcugcgcucac

SEQ ID NO: 3813193 - RNA, 19 nt, Salmonella typhimurium LT2
cgccaccgggcaacacacg

SEQ ID NO: 3813194 - RNA, 22 nt, Salmonella typhimurium LT2
cgccaccgggccgucagggucu

SEQ ID NO: 3813195 - RNA, 22 nt, Salmonella typhimurium LT2
cgccaccugaauaacccgcagc

SEQ ID NO: 3813196 - RNA, 20 nt, Salmonella typhimurium LT2
cgccaccugcguggucaucc

SEQ ID NO: 3813197 - RNA, 21 nt, Salmonella typhimurium LT2
cgccaccugcguggucauccg

SEQ ID NO: 3813198 - RNA, 18 nt, Salmonella typhimurium LT2
cgccaccuuaaucgacuu

SEQ ID NO: 3813199 - RNA, 19 nt, Salmonella typhimurium LT2
cgccacgcccaacauaaac

SEQ ID NO: 3813200 - RNA, 16 nt, Salmonella typhimurium LT2
cgccacgcccagcgag

SEQ ID NO: 3813201 - RNA, 17 nt, Salmonella typhimurium LT2
cgccacgcgacgccagc

SEQ ID NO: 3813202 - RNA, 20 nt, Salmonella typhimurium LT2
cgccacgcgacgccagccga

SEQ ID NO: 3813203 - RNA, 17 nt, Salmonella typhimurium LT2
cgccacgcgccagccgu

SEQ ID NO: 3813204 - RNA, 17 nt, Salmonella typhimurium LT2
cgccacgcgccaggucu

SEQ ID NO: 3813205 - RNA, 14 nt, Salmonella typhimurium LT2
cgccacgcuccagc

SEQ ID NO: 3813206 - RNA, 17 nt, Salmonella typhimurium LT2
cgccacggauggccucu

SEQ ID NO: 3813207 - RNA, 16 nt, Salmonella typhimurium LT2
cgccacggccagcagc

SEQ ID NO: 3813208 - RNA, 15 nt, Salmonella typhimurium LT2
cgccacggucggcaa

SEQ ID NO: 3813209 - RNA, 15 nt, Salmonella typhimurium LT2
cgccacgguugucaa

SEQ ID NO: 3813210 - RNA, 14 nt, Salmonella typhimurium LT2
cgccacgucggcga

SEQ ID NO: 3813211 - RNA, 15 nt, Salmonella typhimurium LT2
cgccacguucgcacc

SEQ ID NO: 3813212 - RNA, 19 nt, Salmonella typhimurium LT2
cgccacuacgccgaugacg

SEQ ID NO: 3813213 - RNA, 20 nt, Salmonella typhimurium LT2
cgccacuguccugacggcga

SEQ ID NO: 3813214 - RNA, 21 nt, Salmonella typhimurium LT2
cgccacugugauacacgccgu

SEQ ID NO: 3813215 - RNA, 13 nt, Salmonella typhimurium LT2
cgccacuuccagc

SEQ ID NO: 3813216 - RNA, 14 nt, Salmonella typhimurium LT2
cgccacuuccagcg

SEQ ID NO: 3813217 - RNA, 19 nt, Salmonella typhimurium LT2
cgccacuuccagcgcgccg

SEQ ID NO: 3813218 - RNA, 15 nt, Salmonella typhimurium LT2
cgccacuuccgcuac

SEQ ID NO: 3813219 - RNA, 17 nt, Salmonella typhimurium LT2
cgccacuuuuccggcac

SEQ ID NO: 3813220 - RNA, 19 nt, Salmonella typhimurium LT2
cgccagaaaaaaaagcgcc

SEQ ID NO: 3813221 - RNA, 14 nt, Salmonella typhimurium LT2
cgccagaaacugug

SEQ ID NO: 3813222 - RNA, 23 nt, Salmonella typhimurium LT2
cgccagacacuggaaacagccaa

SEQ ID NO: 3813223 - RNA, 15 nt, Salmonella typhimurium LT2
cgccagacccagcgc

SEQ ID NO: 3813224 - RNA, 20 nt, Salmonella typhimurium LT2
cgccagacgaacggccugau

SEQ ID NO: 3813225 - RNA, 17 nt, Salmonella typhimurium LT2
cgccagacgcugauagc

SEQ ID NO: 3813226 - RNA, 13 nt, Salmonella typhimurium LT2
cgccagaggcggc

SEQ ID NO: 3813227 - RNA, 17 nt, Salmonella typhimurium LT2
cgccagaggcggcgcca

SEQ ID NO: 3813228 - RNA, 20 nt, Salmonella typhimurium LT2
cgccagauaaucgccgccag

SEQ ID NO: 3813229 - RNA, 17 nt, Salmonella typhimurium LT2
cgccagauccggcguca

SEQ ID NO: 3813230 - RNA, 13 nt, Salmonella typhimurium LT2
cgccagauccugg

SEQ ID NO: 3813231 - RNA, 18 nt, Salmonella typhimurium LT2
cgccagauccuggcugua

SEQ ID NO: 3813232 - RNA, 20 nt, Salmonella typhimurium LT2
cgccagaucgaacagcggca

SEQ ID NO: 3813233 - RNA, 22 nt, Salmonella typhimurium LT2
cgccagaucgaacagcggcaga

SEQ ID NO: 3813234 - RNA, 15 nt, Salmonella typhimurium LT2
cgccagauggcguca

SEQ ID NO: 3813235 - RNA, 23 nt, Salmonella typhimurium LT2
cgccagauguaggccugauaagc

SEQ ID NO: 3813236 - RNA, 23 nt, Salmonella typhimurium LT2
cgccagauuaucggccagcgcca

SEQ ID NO: 3813237 - RNA, 17 nt, Salmonella typhimurium LT2
cgccagauucaugauuu

SEQ ID NO: 3813238 - RNA, 21 nt, Salmonella typhimurium LT2
cgccagcaaaauuuugcgcag

SEQ ID NO: 3813239 - RNA, 23 nt, Salmonella typhimurium LT2
cgccagcaauacccagaacuucc

SEQ ID NO: 3813240 - RNA, 20 nt, Salmonella typhimurium LT2
cgccagcaaugccgccgcca

SEQ ID NO: 3813241 - RNA, 16 nt, Salmonella typhimurium LT2
cgccagcaccaggcuc

SEQ ID NO: 3813242 - RNA, 13 nt, Salmonella typhimurium LT2
cgccagcacgccu

SEQ ID NO: 3813243 - RNA, 14 nt, Salmonella typhimurium LT2
cgccagcacgccua

SEQ ID NO: 3813244 - RNA, 13 nt, Salmonella typhimurium LT2
cgccagcacuucc

SEQ ID NO: 3813245 - RNA, 17 nt, Salmonella typhimurium LT2
cgccagcagcagcuugc

SEQ ID NO: 3813246 - RNA, 16 nt, Salmonella typhimurium LT2
cgccagcaguugcagc

SEQ ID NO: 3813247 - RNA, 14 nt, Salmonella typhimurium LT2
cgccagcauaucca

SEQ ID NO: 3813248 - RNA, 18 nt, Salmonella typhimurium LT2
cgccauccggcgaugccg

SEQ ID NO: 3813249 - RNA, 16 nt, Salmonella typhimurium LT2
cgccaucgacagcagc

SEQ ID NO: 3813250 - RNA, 14 nt, Salmonella typhimurium LT2
cgccaucgccagua

SEQ ID NO: 3813251 - RNA, 14 nt, Salmonella typhimurium LT2
cgccaucgccgccu

SEQ ID NO: 3813252 - RNA, 17 nt, Salmonella typhimurium LT2
cgccaucgccgccucgc

SEQ ID NO: 3813253 - RNA, 15 nt, Salmonella typhimurium LT2
cgccaucguccagcc

SEQ ID NO: 3813254 - RNA, 17 nt, Salmonella typhimurium LT2
cgccaucguccagccau

SEQ ID NO: 3813255 - RNA, 18 nt, Salmonella typhimurium LT2
cgccaucguuccgguucu

SEQ ID NO: 3813256 - RNA, 22 nt, Salmonella typhimurium LT2
cgccaucuaaauuucaguauua

SEQ ID NO: 3813257 - RNA, 17 nt, Salmonella typhimurium LT2
cgccaucuccggcagcg

SEQ ID NO: 3813258 - RNA, 17 nt, Salmonella typhimurium LT2
cgccaucuccuccucau

SEQ ID NO: 3813259 - RNA, 19 nt, Salmonella typhimurium LT2
cgccaucuccuccucauuc

SEQ ID NO: 3813260 - RNA, 15 nt, Salmonella typhimurium LT2
cgccaucuucacgca

SEQ ID NO: 3813261 - RNA, 16 nt, Salmonella typhimurium LT2
cgccaucuuucaccca

SEQ ID NO: 3813262 - RNA, 19 nt, Salmonella typhimurium LT2
cgccaugacgcaccgugga

SEQ ID NO: 3813263 - RNA, 20 nt, Salmonella typhimurium LT2
cgccaugacgccaagcugca

SEQ ID NO: 3813264 - RNA, 15 nt, Salmonella typhimurium LT2
cgccaugauccagcg

SEQ ID NO: 3813265 - RNA, 16 nt, Salmonella typhimurium LT2
cgccaugaucgauagc

SEQ ID NO: 3813266 - RNA, 21 nt, Salmonella typhimurium LT2
cgccaugcaucaauggcguca

SEQ ID NO: 3813267 - RNA, 17 nt, Salmonella typhimurium LT2
cgccaugcggaaucacg

SEQ ID NO: 3813268 - RNA, 19 nt, Salmonella typhimurium LT2
cgccaugcggaaucacgca

SEQ ID NO: 3813269 - RNA, 19 nt, Salmonella typhimurium LT2
cgccaugcuuuccgggccu

SEQ ID NO: 3813270 - RNA, 15 nt, Salmonella typhimurium LT2
cgccauggccgcagc

SEQ ID NO: 3813271 - RNA, 18 nt, Salmonella typhimurium LT2
cgccaugucuucgcgcgu

SEQ ID NO: 3813272 - RNA, 21 nt, Salmonella typhimurium LT2
cgccauuaucgaacucauagc

SEQ ID NO: 3813273 - RNA, 17 nt, Salmonella typhimurium LT2
cgccauucccgcgacgu

SEQ ID NO: 3813274 - RNA, 18 nt, Salmonella typhimurium LT2
cgccauuccugccgccgc

SEQ ID NO: 3813275 - RNA, 19 nt, Salmonella typhimurium LT2
cgccauucggauaauccag

SEQ ID NO: 3813276 - RNA, 13 nt, Salmonella typhimurium LT2
cgccauuuccagc

SEQ ID NO: 3813277 - RNA, 16 nt, Salmonella typhimurium LT2
cgccauuugcgcggcu

SEQ ID NO: 3813278 - RNA, 20 nt, Salmonella typhimurium LT2
cgcccaaaaugcggcauccg

SEQ ID NO: 3813279 - RNA, 22 nt, Salmonella typhimurium LT2
cgcccaaauaguccagcagcca

SEQ ID NO: 3813280 - RNA, 18 nt, Salmonella typhimurium LT2
cgcccaaccagcccaggu

SEQ ID NO: 3813281 - RNA, 18 nt, Salmonella typhimurium LT2
cgcccaacggaugcgcca

SEQ ID NO: 3813282 - RNA, 11 nt, Salmonella typhimurium LT2
cgcccaaugcg

SEQ ID NO: 3813283 - RNA, 17 nt, Salmonella typhimurium LT2
cgcccacaaugacagaa

SEQ ID NO: 3813284 - RNA, 13 nt, Salmonella typhimurium LT2
cgcccaccagucc

SEQ ID NO: 3813285 - RNA, 18 nt, Salmonella typhimurium LT2
cgcccaccugcagcagcu

SEQ ID NO: 3813286 - RNA, 23 nt, Salmonella typhimurium LT2
cgcccacuuguaccaacugcugc

SEQ ID NO: 3813287 - RNA, 18 nt, Salmonella typhimurium LT2
cgcccagauauccgcgcu

SEQ ID NO: 3813288 - RNA, 21 nt, Salmonella typhimurium LT2
cgcccagcacuaacagcagca

SEQ ID NO: 3813289 - RNA, 11 nt, Salmonella typhimurium LT2
cgcccagcagc

SEQ ID NO: 3813290 - RNA, 20 nt, Salmonella typhimurium LT2
cgcccagccugcccgccuga

SEQ ID NO: 3813291 - RNA, 12 nt, Salmonella typhimurium LT2
cgcccagcgccg

SEQ ID NO: 3813292 - RNA, 21 nt, Salmonella typhimurium LT2
cgcccagcguacguaacuucu

SEQ ID NO: 3813293 - RNA, 19 nt, Salmonella typhimurium LT2
cgcccaggauacagccgaa

SEQ ID NO: 3813294 - RNA, 17 nt, Salmonella typhimurium LT2
cgcccaggccagugcca

SEQ ID NO: 3813295 - RNA, 12 nt, Salmonella typhimurium LT2
cgcccaggccug

SEQ ID NO: 3813296 - RNA, 13 nt, Salmonella typhimurium LT2
cgcccaggccuga

SEQ ID NO: 3813297 - RNA, 16 nt, Salmonella typhimurium LT2
cgcccaggucgcccag

SEQ ID NO: 3813298 - RNA, 12 nt, Salmonella typhimurium LT2
cgcccaggucug

SEQ ID NO: 3813299 - RNA, 12 nt, Salmonella typhimurium LT2
cgcccagucacg

SEQ ID NO: 3813300 - RNA, 17 nt, Salmonella typhimurium LT2
cgcccaguccuuccggc

SEQ ID NO: 3813301 - RNA, 20 nt, Salmonella typhimurium LT2
cgcccaguuucuucaggcca

SEQ ID NO: 3813302 - RNA, 18 nt, Salmonella typhimurium LT2
cgcccauacacaccagca

SEQ ID NO: 3813303 - RNA, 19 nt, Salmonella typhimurium LT2
cgcccauacacaccagcag

SEQ ID NO: 3813304 - RNA, 12 nt, Salmonella typhimurium LT2
cgcccauaucca

SEQ ID NO: 3813305 - RNA, 15 nt, Salmonella typhimurium LT2
cgcccaucacaugua

SEQ ID NO: 3813306 - RNA, 15 nt, Salmonella typhimurium LT2
cgcccaucgccacag

SEQ ID NO: 3813307 - RNA, 16 nt, Salmonella typhimurium LT2
cgcccaucgccacagc

SEQ ID NO: 3813308 - RNA, 18 nt, Salmonella typhimurium LT2
cgcccaucgccgccuccg

SEQ ID NO: 3813309 - RNA, 21 nt, Salmonella typhimurium LT2
cgcccauuagcauuccgcccg

SEQ ID NO: 3813310 - RNA, 17 nt, Salmonella typhimurium LT2
cgcccauuccgccugcc

SEQ ID NO: 3813311 - RNA, 21 nt, Salmonella typhimurium LT2
cgcccauuccgccugccgcgc

SEQ ID NO: 3813312 - RNA, 15 nt, Salmonella typhimurium LT2
cgccccaaucgccag

SEQ ID NO: 3813313 - RNA, 16 nt, Salmonella typhimurium LT2
cgccccaaucgccagu

SEQ ID NO: 3813314 - RNA, 20 nt, Salmonella typhimurium LT2
cgccccagaagagcgagucu

SEQ ID NO: 3813315 - RNA, 21 nt, Salmonella typhimurium LT2
cgccccagcaugagccagccc

SEQ ID NO: 3813316 - RNA, 23 nt, Salmonella typhimurium LT2
cgccccagcaugagccagcccuc

SEQ ID NO: 3813317 - RNA, 21 nt, Salmonella typhimurium LT2
cgccccagcgguaccaccagc

SEQ ID NO: 3813318 - RNA, 14 nt, Salmonella typhimurium LT2
cgcccccaacugag

SEQ ID NO: 3813319 - RNA, 13 nt, Salmonella typhimurium LT2
cgcccccagcaaa

SEQ ID NO: 3813320 - RNA, 13 nt, Salmonella typhimurium LT2
cgccccgaccagg

SEQ ID NO: 3813321 - RNA, 12 nt, Salmonella typhimurium LT2
cgccccggcggc

SEQ ID NO: 3813322 - RNA, 13 nt, Salmonella typhimurium LT2
cgccccugcgggu

SEQ ID NO: 3813323 - RNA, 20 nt, Salmonella typhimurium LT2
cgcccgaucguccgccuccg

SEQ ID NO: 3813324 - RNA, 14 nt, Salmonella typhimurium LT2
cgcccgcaaaagcg

SEQ ID NO: 3813325 - RNA, 14 nt, Salmonella typhimurium LT2
cgcccgccaccagc

SEQ ID NO: 3813326 - RNA, 15 nt, Salmonella typhimurium LT2
cgcccgccaccagca

SEQ ID NO: 3813327 - RNA, 13 nt, Salmonella typhimurium LT2
cgcccgccgccag

SEQ ID NO: 3813328 - RNA, 16 nt, Salmonella typhimurium LT2
cgcccgccucgcugau

SEQ ID NO: 3813329 - RNA, 18 nt, Salmonella typhimurium LT2
cgcccgcgaucgcuucca

SEQ ID NO: 3813330 - RNA, 15 nt, Salmonella typhimurium LT2
cgcccgcgcgccagc

SEQ ID NO: 3813331 - RNA, 16 nt, Salmonella typhimurium LT2
cgcccgcgcgccagcg

SEQ ID NO: 3813332 - RNA, 20 nt, Salmonella typhimurium LT2
cgcccgcguuggcggcuuua

SEQ ID NO: 3813333 - RNA, 11 nt, Salmonella typhimurium LT2
cgcccgcuuca

SEQ ID NO: 3813334 - RNA, 23 nt, Salmonella typhimurium LT2
cgcccgcuucaaggaagagaucg

SEQ ID NO: 3813335 - RNA, 20 nt, Salmonella typhimurium LT2
cgcccggcaugacaucagaa

SEQ ID NO: 3813336 - RNA, 14 nt, Salmonella typhimurium LT2
cgcccggcgccagc

SEQ ID NO: 3813337 - RNA, 12 nt, Salmonella typhimurium LT2
cgcccgguaauu

SEQ ID NO: 3813338 - RNA, 22 nt, Salmonella typhimurium LT2
cgcccgguugcaauuccgccau

SEQ ID NO: 3813339 - RNA, 18 nt, Salmonella typhimurium LT2
cgcccguaccgcggcgcu

SEQ ID NO: 3813340 - RNA, 17 nt, Salmonella typhimurium LT2
cgcccguuguccgccag

SEQ ID NO: 3813341 - RNA, 18 nt, Salmonella typhimurium LT2
cgcccguuguccgccagc

SEQ ID NO: 3813342 - RNA, 21 nt, Salmonella typhimurium LT2
cgcccuauuuggccugcagaa

SEQ ID NO: 3813343 - RNA, 17 nt, Salmonella typhimurium LT2
cgcccucauuccccauu

SEQ ID NO: 3813344 - RNA, 15 nt, Salmonella typhimurium LT2
cgcccucgccacggu

SEQ ID NO: 3813345 - RNA, 17 nt, Salmonella typhimurium LT2
cgcccucucuccgccug

SEQ ID NO: 3813346 - RNA, 16 nt, Salmonella typhimurium LT2
cgcccugaagggcggc

SEQ ID NO: 3813347 - RNA, 14 nt, Salmonella typhimurium LT2
cgcccugcgccagc

SEQ ID NO: 3813348 - RNA, 21 nt, Salmonella typhimurium LT2
cgcccugcgccagcauggcgu

SEQ ID NO: 3813349 - RNA, 19 nt, Salmonella typhimurium LT2
cgcccugcgguagcgccga

SEQ ID NO: 3813350 - RNA, 13 nt, Salmonella typhimurium LT2
cgcccugcuccca

SEQ ID NO: 3813351 - RNA, 18 nt, Salmonella typhimurium LT2
cgcccugcucccacagcu

SEQ ID NO: 3813352 - RNA, 23 nt, Salmonella typhimurium LT2
cgcccuuucaguucaaccugcgc

SEQ ID NO: 3813353 - RNA, 12 nt, Salmonella typhimurium LT2
cgccggacggcg

SEQ ID NO: 3813354 - RNA, 14 nt, Salmonella typhimurium LT2
cgccggacggcgca

SEQ ID NO: 3813355 - RNA, 19 nt, Salmonella typhimurium LT2
cgccggaucgggcuuccag

SEQ ID NO: 3813356 - RNA, 15 nt, Salmonella typhimurium LT2
cgccggaugaccaga

SEQ ID NO: 3813357 - RNA, 13 nt, Salmonella typhimurium LT2
cgccggcaaagcc

SEQ ID NO: 3813358 - RNA, 22 nt, Salmonella typhimurium LT2
cgccggcaacagguaccccgcc

SEQ ID NO: 3813359 - RNA, 21 nt, Salmonella typhimurium LT2
cgccggcagacgauagcgggu

SEQ ID NO: 3813360 - RNA, 22 nt, Salmonella typhimurium LT2
cgccggcaguccuugcagccag

SEQ ID NO: 3813361 - RNA, 14 nt, Salmonella typhimurium LT2
cgccggccccgcuu

SEQ ID NO: 3813362 - RNA, 16 nt, Salmonella typhimurium LT2
cgccggccccgcuucc

SEQ ID NO: 3813363 - RNA, 13 nt, Salmonella typhimurium LT2
cgccggccuguua

SEQ ID NO: 3813364 - RNA, 15 nt, Salmonella typhimurium LT2
cgccgggcacgcuga

SEQ ID NO: 3813365 - RNA, 23 nt, Salmonella typhimurium LT2
cgccgggcgucacccgccggcag

SEQ ID NO: 3813366 - RNA, 16 nt, Salmonella typhimurium LT2
cgccgggcuauccggc

SEQ ID NO: 3813367 - RNA, 12 nt, Salmonella typhimurium LT2
cgccggguuuug

SEQ ID NO: 3813368 - RNA, 15 nt, Salmonella typhimurium LT2
cgccgguacgcagca

SEQ ID NO: 3813369 - RNA, 17 nt, Salmonella typhimurium LT2
cgccgguagccagccaa

SEQ ID NO: 3813370 - RNA, 20 nt, Salmonella typhimurium LT2
cgccggucaugccaucccgc

SEQ ID NO: 3813371 - RNA, 19 nt, Salmonella typhimurium LT2
cgccggugccugccgccuc

SEQ ID NO: 3813372 - RNA, 21 nt, Salmonella typhimurium LT2
cgccgguguuuagccugauac

SEQ ID NO: 3813373 - RNA, 17 nt, Salmonella typhimurium LT2
cgccgguuagcgccgcg

SEQ ID NO: 3813374 - RNA, 19 nt, Salmonella typhimurium LT2
cgccgguuguccacugacc

SEQ ID NO: 3813375 - RNA, 14 nt, Salmonella typhimurium LT2
cgccguaaaacaac

SEQ ID NO: 3813376 - RNA, 22 nt, Salmonella typhimurium LT2
cgccguaaaacaacagcggcgu

SEQ ID NO: 3813377 - RNA, 15 nt, Salmonella typhimurium LT2
cgccguaaccgccug

SEQ ID NO: 3813378 - RNA, 21 nt, Salmonella typhimurium LT2
cgccguaacgugcuccagcgc

SEQ ID NO: 3813379 - RNA, 17 nt, Salmonella typhimurium LT2
cgccguacuccagccca

SEQ ID NO: 3813380 - RNA, 20 nt, Salmonella typhimurium LT2
cgccgucacaaagcccaccg

SEQ ID NO: 3813381 - RNA, 18 nt, Salmonella typhimurium LT2
cgccgucacguucgguac

SEQ ID NO: 3813382 - RNA, 13 nt, Salmonella typhimurium LT2
cgccgucaggcua

SEQ ID NO: 3813383 - RNA, 14 nt, Salmonella typhimurium LT2
cgccgucauaaaac

SEQ ID NO: 3813384 - RNA, 14 nt, Salmonella typhimurium LT2
cgccgucauccgcg

SEQ ID NO: 3813385 - RNA, 18 nt, Salmonella typhimurium LT2
cgccguccagcaccaccu

SEQ ID NO: 3813386 - RNA, 15 nt, Salmonella typhimurium LT2
cgccguccaggccug

SEQ ID NO: 3813387 - RNA, 19 nt, Salmonella typhimurium LT2
cgccguccauuucaaugca

SEQ ID NO: 3813388 - RNA, 13 nt, Salmonella typhimurium LT2
cgccgucgcgcuu

SEQ ID NO: 3813389 - RNA, 17 nt, Salmonella typhimurium LT2
cgccgucggcagccaga

SEQ ID NO: 3813390 - RNA, 17 nt, Salmonella typhimurium LT2
cgccgucguucagccag

SEQ ID NO: 3813391 - RNA, 23 nt, Salmonella typhimurium LT2
cgccgugacuguucacauccagc

SEQ ID NO: 3813392 - RNA, 16 nt, Salmonella typhimurium LT2
cgccgugcacuucugc

SEQ ID NO: 3813393 - RNA, 19 nt, Salmonella typhimurium LT2
cgccgugcacuucugcggu

SEQ ID NO: 3813394 - RNA, 20 nt, Salmonella typhimurium LT2
cgccguggcggugacuuccu

SEQ ID NO: 3813395 - RNA, 21 nt, Salmonella typhimurium LT2
cgccguggcggugacuuccug

SEQ ID NO: 3813396 - RNA, 17 nt, Salmonella typhimurium LT2
cgccguguaagagcugg

SEQ ID NO: 3813397 - RNA, 18 nt, Salmonella typhimurium LT2
cgccguguaagagcuggu

SEQ ID NO: 3813398 - RNA, 21 nt, Salmonella typhimurium LT2
cgccguguaagagcuggucgg

SEQ ID NO: 3813399 - RNA, 21 nt, Salmonella typhimurium LT2
cgccguguugugugccgcgcu

SEQ ID NO: 3813400 - RNA, 21 nt, Salmonella typhimurium LT2
cgccguuaaccgucuggcugc

SEQ ID NO: 3813401 - RNA, 20 nt, Salmonella typhimurium LT2
cgccguuaacgcgggcguaa

SEQ ID NO: 3813402 - RNA, 16 nt, Salmonella typhimurium LT2
cgccguuaccagcauc

SEQ ID NO: 3813403 - RNA, 20 nt, Salmonella typhimurium LT2
cgccguugauuuucaggcag

SEQ ID NO: 3813404 - RNA, 14 nt, Salmonella typhimurium LT2
cgccguuuuaacca

SEQ ID NO: 3813405 - RNA, 21 nt, Salmonella typhimurium LT2
cgccuaacagcgccgcgccga

SEQ ID NO: 3813406 - RNA, 14 nt, Salmonella typhimurium LT2
cgccuaccgccaua

SEQ ID NO: 3813407 - RNA, 21 nt, Salmonella typhimurium LT2
cgccuaucgccagcaggguca

SEQ ID NO: 3813408 - RNA, 17 nt, Salmonella typhimurium LT2
cgccuauguuaugcaca

SEQ ID NO: 3813409 - RNA, 15 nt, Salmonella typhimurium LT2
cgccucaucugcuuc

SEQ ID NO: 3813410 - RNA, 18 nt, Salmonella typhimurium LT2
cgccuccccugccggcgg

SEQ ID NO: 3813411 - RNA, 16 nt, Salmonella typhimurium LT2
cgccuccgacaacaag

SEQ ID NO: 3813412 - RNA, 17 nt, Salmonella typhimurium LT2
cgccuccggccugccug

SEQ ID NO: 3813413 - RNA, 18 nt, Salmonella typhimurium LT2
cgccuccggccugccugg

SEQ ID NO: 3813414 - RNA, 19 nt, Salmonella typhimurium LT2
cgccuccggccugccuggu

SEQ ID NO: 3813415 - RNA, 15 nt, Salmonella typhimurium LT2
cgccucgaucuccuc

SEQ ID NO: 3813416 - RNA, 17 nt, Salmonella typhimurium LT2
cgccucgcaaaacaugg

SEQ ID NO: 3813417 - RNA, 18 nt, Salmonella typhimurium LT2
cgccucgcgcaccauaau

SEQ ID NO: 3813418 - RNA, 20 nt, Salmonella typhimurium LT2
cgccucgcgcaccauaauau

SEQ ID NO: 3813419 - RNA, 19 nt, Salmonella typhimurium LT2
cgccucgcgcaccccggcc

SEQ ID NO: 3813420 - RNA, 14 nt, Salmonella typhimurium LT2
cgccucgcucucuu

SEQ ID NO: 3813421 - RNA, 19 nt, Salmonella typhimurium LT2
cgccucgcugacgccagcc

SEQ ID NO: 3813422 - RNA, 21 nt, Salmonella typhimurium LT2
cgccucguuugcugagcagcc

SEQ ID NO: 3813423 - RNA, 23 nt, Salmonella typhimurium LT2
cgccucguuugcugagcagccag

SEQ ID NO: 3813424 - RNA, 12 nt, Salmonella typhimurium LT2
cgccucugucuu

SEQ ID NO: 3813425 - RNA, 23 nt, Salmonella typhimurium LT2
cgccugaacgcgugguugcguaa

SEQ ID NO: 3813426 - RNA, 17 nt, Salmonella typhimurium LT2
cgccugaagauacgcca

SEQ ID NO: 3813427 - RNA, 17 nt, Salmonella typhimurium LT2
cgccugaauaaucggcg

SEQ ID NO: 3813428 - RNA, 21 nt, Salmonella typhimurium LT2
cgccugaaugcacugcugaua

SEQ ID NO: 3813429 - RNA, 24 nt, Salmonella typhimurium LT2
cgccugacgcggacgccaccacag

SEQ ID NO: 3813430 - RNA, 22 nt, Salmonella typhimurium LT2
cgccugacugguuaaaccgucg

SEQ ID NO: 3813431 - RNA, 19 nt, Salmonella typhimurium LT2
cgccugauaaaacgcaggc

SEQ ID NO: 3813432 - RNA, 20 nt, Salmonella typhimurium LT2
cgccugaugaaaggccauca

SEQ ID NO: 3813433 - RNA, 17 nt, Salmonella typhimurium LT2
cgccugaugcugcgcau

SEQ ID NO: 3813434 - RNA, 19 nt, Salmonella typhimurium LT2
cgccugaugcugcgcaucu

SEQ ID NO: 3813435 - RNA, 16 nt, Salmonella typhimurium LT2
cgccugaugcuggcag

SEQ ID NO: 3813436 - RNA, 15 nt, Salmonella typhimurium LT2
cgccugauucauucc

SEQ ID NO: 3813437 - RNA, 24 nt, Salmonella typhimurium LT2
cgccugcaauguugaaucccacgc

SEQ ID NO: 3813438 - RNA, 20 nt, Salmonella typhimurium LT2
cgccugcauaaacgcggcca

SEQ ID NO: 3813439 - RNA, 13 nt, Salmonella typhimurium LT2
cgccugccagaua

SEQ ID NO: 3813440 - RNA, 18 nt, Salmonella typhimurium LT2
cgccugccaggauccguu

SEQ ID NO: 3813441 - RNA, 14 nt, Salmonella typhimurium LT2
cgccugccgcaugu

SEQ ID NO: 3813442 - RNA, 15 nt, Salmonella typhimurium LT2
cgccugccgcgccca

SEQ ID NO: 3813443 - RNA, 15 nt, Salmonella typhimurium LT2
cgccugccgcgccgc

SEQ ID NO: 3813444 - RNA, 23 nt, Salmonella typhimurium LT2
cgccugccggacggcggcugcga

SEQ ID NO: 3813445 - RNA, 16 nt, Salmonella typhimurium LT2
cgccugcgccagcgcc

SEQ ID NO: 3813446 - RNA, 23 nt, Salmonella typhimurium LT2
cgccugcgccuugacgauaugcu

SEQ ID NO: 3813447 - RNA, 13 nt, Salmonella typhimurium LT2
cgccugcgcgccu

SEQ ID NO: 3813448 - RNA, 22 nt, Salmonella typhimurium LT2
cgccugcgcucauauacccugc

SEQ ID NO: 3813449 - RNA, 17 nt, Salmonella typhimurium LT2
cgccugcgcugcaauac

SEQ ID NO: 3813450 - RNA, 21 nt, Salmonella typhimurium LT2
cgccugcggauuuuucgccag

SEQ ID NO: 3813451 - RNA, 17 nt, Salmonella typhimurium LT2
cgccugcuccgggcggu

SEQ ID NO: 3813452 - RNA, 22 nt, Salmonella typhimurium LT2
cgccugcuccguccacgcgagc

SEQ ID NO: 3813453 - RNA, 22 nt, Salmonella typhimurium LT2
cgccugcugcaacgucgcgccc

SEQ ID NO: 3813454 - RNA, 23 nt, Salmonella typhimurium LT2
cgccugcugcaacgucgcgcccu

SEQ ID NO: 3813455 - RNA, 19 nt, Salmonella typhimurium LT2
cgccugcugcuggacagga

SEQ ID NO: 3813456 - RNA, 14 nt, Salmonella typhimurium LT2
cgcgaucacagaca

SEQ ID NO: 3813457 - RNA, 19 nt, Salmonella typhimurium LT2
cgcgaucacagacagaugc

SEQ ID NO: 3813458 - RNA, 22 nt, Salmonella typhimurium LT2
cgcgaucaguucuugcaggcag

SEQ ID NO: 3813459 - RNA, 22 nt, Salmonella typhimurium LT2
cgcgauccagccccagcgccag

SEQ ID NO: 3813460 - RNA, 19 nt, Salmonella typhimurium LT2
cgcgaucgaugugauaaau

SEQ ID NO: 3813461 - RNA, 13 nt, Salmonella typhimurium LT2
cgcgaucgcgcca

SEQ ID NO: 3813462 - RNA, 14 nt, Salmonella typhimurium LT2
cgcgaugacggcgc

SEQ ID NO: 3813463 - RNA, 18 nt, Salmonella typhimurium LT2
cgcgaugagcugcgguaa

SEQ ID NO: 3813464 - RNA, 14 nt, Salmonella typhimurium LT2
cgcgaugcaucuug

SEQ ID NO: 3813465 - RNA, 21 nt, Salmonella typhimurium LT2
cgcgauggucuucuuucaggu

SEQ ID NO: 3813466 - RNA, 18 nt, Salmonella typhimurium LT2
cgcgaugugcuggggagc

SEQ ID NO: 3813467 - RNA, 14 nt, Salmonella typhimurium LT2
cgcgauuucaucgu

SEQ ID NO: 3813468 - RNA, 23 nt, Salmonella typhimurium LT2
cgcgcaaaacucugagcauacac

SEQ ID NO: 3813469 - RNA, 19 nt, Salmonella typhimurium LT2
cgcgcaaagggugaaauca

SEQ ID NO: 3813470 - RNA, 22 nt, Salmonella typhimurium LT2
cgcgcaaagggugaaaucacgc

SEQ ID NO: 3813471 - RNA, 15 nt, Salmonella typhimurium LT2
cgcgcaaccgcauca

SEQ ID NO: 3813472 - RNA, 19 nt, Salmonella typhimurium LT2
cgcgcaaucgggccugcuc

SEQ ID NO: 3813473 - RNA, 15 nt, Salmonella typhimurium LT2
cgcgcaauuacucuu

SEQ ID NO: 3813474 - RNA, 22 nt, Salmonella typhimurium LT2
cgcgcaccauaauauaaggauc

SEQ ID NO: 3813475 - RNA, 14 nt, Salmonella typhimurium LT2
cgcgcaccccggcc

SEQ ID NO: 3813476 - RNA, 11 nt, Salmonella typhimurium LT2
cgcgcacgccc

SEQ ID NO: 3813477 - RNA, 16 nt, Salmonella typhimurium LT2
cgcgcacgccgcucga

SEQ ID NO: 3813478 - RNA, 14 nt, Salmonella typhimurium LT2
cgcgcacgcgcgcg

SEQ ID NO: 3813479 - RNA, 15 nt, Salmonella typhimurium LT2
cgcgcagacuugaau

SEQ ID NO: 3813480 - RNA, 21 nt, Salmonella typhimurium LT2
cgcgcagagauagccagcgau

SEQ ID NO: 3813481 - RNA, 13 nt, Salmonella typhimurium LT2
cgcgcagcaggcc

SEQ ID NO: 3813482 - RNA, 18 nt, Salmonella typhimurium LT2
cgcgcaguucaauauuca

SEQ ID NO: 3813483 - RNA, 18 nt, Salmonella typhimurium LT2
cgcgcaguucauccacgc

SEQ ID NO: 3813484 - RNA, 19 nt, Salmonella typhimurium LT2
cgcgcaucaggaucuucau

SEQ ID NO: 3813485 - RNA, 11 nt, Salmonella typhimurium LT2
cgcgcauggca

SEQ ID NO: 3813486 - RNA, 18 nt, Salmonella typhimurium LT2
cgcgcauggcagggcgau

SEQ ID NO: 3813487 - RNA, 23 nt, Salmonella typhimurium LT2
cgcgcauggcagggcgauaucca

SEQ ID NO: 3813488 - RNA, 16 nt, Salmonella typhimurium LT2
cgcgcauuucugcugc

SEQ ID NO: 3813489 - RNA, 19 nt, Salmonella typhimurium LT2
cgcgccaaaagaggcagca

SEQ ID NO: 3813490 - RNA, 20 nt, Salmonella typhimurium LT2
cgcgccaaaagaggcagcaa

SEQ ID NO: 3813491 - RNA, 21 nt, Salmonella typhimurium LT2
cgcgccaaaagaggcagcaaa

SEQ ID NO: 3813492 - RNA, 21 nt, Salmonella typhimurium LT2
cgcgccaauccaugccggcuu

SEQ ID NO: 3813493 - RNA, 18 nt, Salmonella typhimurium LT2
cgcgccaauggccgcccc

SEQ ID NO: 3813494 - RNA, 21 nt, Salmonella typhimurium LT2
cgcgccaccaucgucgccaga

SEQ ID NO: 3813495 - RNA, 13 nt, Salmonella typhimurium LT2
cgcgccacgcaug

SEQ ID NO: 3813496 - RNA, 15 nt, Salmonella typhimurium LT2
cgcgccacgcccagc

SEQ ID NO: 3813497 - RNA, 17 nt, Salmonella typhimurium LT2
cgcgccacuucuuugac

SEQ ID NO: 3813498 - RNA, 12 nt, Salmonella typhimurium LT2
cgcgccagcaaa

SEQ ID NO: 3813499 - RNA, 15 nt, Salmonella typhimurium LT2
cgcgccagcaggucg

SEQ ID NO: 3813500 - RNA, 16 nt, Salmonella typhimurium LT2
cgcgccagccaauguc

SEQ ID NO: 3813501 - RNA, 13 nt, Salmonella typhimurium LT2
cgcgccagcgaca

SEQ ID NO: 3813502 - RNA, 18 nt, Salmonella typhimurium LT2
cgcgccagcggacuccac

SEQ ID NO: 3813503 - RNA, 13 nt, Salmonella typhimurium LT2
cgcgccagcggau

SEQ ID NO: 3813504 - RNA, 14 nt, Salmonella typhimurium LT2
cgcgccagcucggu

SEQ ID NO: 3813505 - RNA, 22 nt, Salmonella typhimurium LT2
cgcgccaggucucauagcgccc

SEQ ID NO: 3813506 - RNA, 17 nt, Salmonella typhimurium LT2
cgcgccaucgucaccgg

SEQ ID NO: 3813507 - RNA, 13 nt, Salmonella typhimurium LT2
cgcgccaucuuuc

SEQ ID NO: 3813508 - RNA, 13 nt, Salmonella typhimurium LT2
cgcgccaugauuc

SEQ ID NO: 3813509 - RNA, 14 nt, Salmonella typhimurium LT2
cgcgcccagcgccg

SEQ ID NO: 3813510 - RNA, 17 nt, Salmonella typhimurium LT2
cgcgcccgccaccagca

SEQ ID NO: 3813511 - RNA, 14 nt, Salmonella typhimurium LT2
cgcgcccgccgcca

SEQ ID NO: 3813512 - RNA, 18 nt, Salmonella typhimurium LT2
cgcgcccgcuuccgucac

SEQ ID NO: 3813513 - RNA, 16 nt, Salmonella typhimurium LT2
cgcgcccuccuccagc

SEQ ID NO: 3813514 - RNA, 22 nt, Salmonella typhimurium LT2
cgcgcccugcguuccgcucagc

SEQ ID NO: 3813515 - RNA, 19 nt, Salmonella typhimurium LT2
cgcgccgacaaucggcgga

SEQ ID NO: 3813516 - RNA, 14 nt, Salmonella typhimurium LT2
cgcgccgcagcgcc

SEQ ID NO: 3813517 - RNA, 15 nt, Salmonella typhimurium LT2
cgcgccgcagcgccg

SEQ ID NO: 3813518 - RNA, 15 nt, Salmonella typhimurium LT2
cgcgccgccaacgau

SEQ ID NO: 3813519 - RNA, 13 nt, Salmonella typhimurium LT2
cgcgccgccgccu

SEQ ID NO: 3813520 - RNA, 14 nt, Salmonella typhimurium LT2
cgcgccgcgcagca

SEQ ID NO: 3813521 - RNA, 21 nt, Salmonella typhimurium LT2
cgcgccgcuggcgaccagccu

SEQ ID NO: 3813522 - RNA, 16 nt, Salmonella typhimurium LT2
cgcgccgcuuccggca

SEQ ID NO: 3813523 - RNA, 23 nt, Salmonella typhimurium LT2
cgcgccggggcggggaaaccguc

SEQ ID NO: 3813524 - RNA, 16 nt, Salmonella typhimurium LT2
cgcgccggucgccagc

SEQ ID NO: 3813525 - RNA, 18 nt, Salmonella typhimurium LT2
cgcgccggucgccagcau

SEQ ID NO: 3813526 - RNA, 15 nt, Salmonella typhimurium LT2
cgcgccgugcccagc

SEQ ID NO: 3813527 - RNA, 20 nt, Salmonella typhimurium LT2
cgcgccguugaaaucgguaa

SEQ ID NO: 3813528 - RNA, 13 nt, Salmonella typhimurium LT2
cgcgccuccggcc

SEQ ID NO: 3813529 - RNA, 15 nt, Salmonella typhimurium LT2
cgcgccugacgcgga

SEQ ID NO: 3813530 - RNA, 23 nt, Salmonella typhimurium LT2
cgcgccugccauagcaucaccag

SEQ ID NO: 3813531 - RNA, 16 nt, Salmonella typhimurium LT2
cgcgccugccgccagc

SEQ ID NO: 3813532 - RNA, 15 nt, Salmonella typhimurium LT2
cgcgccugcugccug

SEQ ID NO: 3813533 - RNA, 20 nt, Salmonella typhimurium LT2
cgcgccuggaucugcgcauu

SEQ ID NO: 3813534 - RNA, 23 nt, Salmonella typhimurium LT2
cgcgccuuccgggauagcacuac

SEQ ID NO: 3813535 - RNA, 20 nt, Salmonella typhimurium LT2
cgcgcgaaacgcacccgcgc

SEQ ID NO: 3813536 - RNA, 21 nt, Salmonella typhimurium LT2
cgcgcgaauaucgcugccggu

SEQ ID NO: 3813537 - RNA, 11 nt, Salmonella typhimurium LT2
cgcgcgaccca

SEQ ID NO: 3813538 - RNA, 13 nt, Salmonella typhimurium LT2
cgcgcgccagcgg

SEQ ID NO: 3813539 - RNA, 12 nt, Salmonella typhimurium LT2
cgcgcgccaguc

SEQ ID NO: 3813540 - RNA, 13 nt, Salmonella typhimurium LT2
cgcgcgccgccuc

SEQ ID NO: 3813541 - RNA, 19 nt, Salmonella typhimurium LT2
cgcgcgccgcuuccggcag

SEQ ID NO: 3813542 - RNA, 21 nt, Salmonella typhimurium LT2
cgcgcgccgcuuccggcaggu

SEQ ID NO: 3813543 - RNA, 13 nt, Salmonella typhimurium LT2
cgcgcgcgcguca

SEQ ID NO: 3813544 - RNA, 19 nt, Salmonella typhimurium LT2
cgcgcgcuuucaccgccuc

SEQ ID NO: 3813545 - RNA, 20 nt, Salmonella typhimurium LT2
cgcgcggauauggcggcggc

SEQ ID NO: 3813546 - RNA, 17 nt, Salmonella typhimurium LT2
cgcgcggauucuccagg

SEQ ID NO: 3813547 - RNA, 20 nt, Salmonella typhimurium LT2
cgcgcggcauuucccuuccc

SEQ ID NO: 3813548 - RNA, 15 nt, Salmonella typhimurium LT2
cgcgcgucaacgcca

SEQ ID NO: 3813549 - RNA, 20 nt, Salmonella typhimurium LT2
cgcgcgugguaucgcggcag

SEQ ID NO: 3813550 - RNA, 22 nt, Salmonella typhimurium LT2
cgcgcguuugcaauaucgaugc

SEQ ID NO: 3813551 - RNA, 19 nt, Salmonella typhimurium LT2
cgcgcuaauuuucagggug

SEQ ID NO: 3813552 - RNA, 19 nt, Salmonella typhimurium LT2
cgcgcuagcuucagguguu

SEQ ID NO: 3813553 - RNA, 16 nt, Salmonella typhimurium LT2
cgcgcuagugccgcca

SEQ ID NO: 3813554 - RNA, 21 nt, Salmonella typhimurium LT2
cgcgcuagugccgccaggcaa

SEQ ID NO: 3813555 - RNA, 15 nt, Salmonella typhimurium LT2
cgcgcucaccuccgc

SEQ ID NO: 3813556 - RNA, 18 nt, Salmonella typhimurium LT2
cgcgcucaccuccgccac

SEQ ID NO: 3813557 - RNA, 21 nt, Salmonella typhimurium LT2
cgcgcucaccuccgccaccag

SEQ ID NO: 3813558 - RNA, 15 nt, Salmonella typhimurium LT2
cgcgcucacgauaag

SEQ ID NO: 3813559 - RNA, 13 nt, Salmonella typhimurium LT2
cgcgcucagcguc

SEQ ID NO: 3813560 - RNA, 16 nt, Salmonella typhimurium LT2
cgcgucgggaucguaa

SEQ ID NO: 3813561 - RNA, 21 nt, Salmonella typhimurium LT2
cgcgucguucacgucgcgaag

SEQ ID NO: 3813562 - RNA, 22 nt, Salmonella typhimurium LT2
cgcgucguucacgucgcgaagc

SEQ ID NO: 3813563 - RNA, 19 nt, Salmonella typhimurium LT2
cgcgucguugaugcaacag

SEQ ID NO: 3813564 - RNA, 14 nt, Salmonella typhimurium LT2
cgcgucucccagau

SEQ ID NO: 3813565 - RNA, 21 nt, Salmonella typhimurium LT2
cgcgucugaaugacgccgucu

SEQ ID NO: 3813566 - RNA, 20 nt, Salmonella typhimurium LT2
cgcgucuuaucaggccuaca

SEQ ID NO: 3813567 - RNA, 13 nt, Salmonella typhimurium LT2
cgcgugaccaucg

SEQ ID NO: 3813568 - RNA, 18 nt, Salmonella typhimurium LT2
cgcgugacgcaguaauac

SEQ ID NO: 3813569 - RNA, 17 nt, Salmonella typhimurium LT2
cgcgugcucgcggcgga

SEQ ID NO: 3813570 - RNA, 15 nt, Salmonella typhimurium LT2
cgcguggguucacag

SEQ ID NO: 3813571 - RNA, 13 nt, Salmonella typhimurium LT2
cgcguuagccggg

SEQ ID NO: 3813572 - RNA, 21 nt, Salmonella typhimurium LT2
cgcguucacaacggcgaauaa

SEQ ID NO: 3813573 - RNA, 18 nt, Salmonella typhimurium LT2
cgcguucagcaucgggaa

SEQ ID NO: 3813574 - RNA, 14 nt, Salmonella typhimurium LT2
cgcguucagcgccg

SEQ ID NO: 3813575 - RNA, 15 nt, Salmonella typhimurium LT2
cgcguucauccagcg

SEQ ID NO: 3813576 - RNA, 17 nt, Salmonella typhimurium LT2
cgcguucauccagcgcg

SEQ ID NO: 3813577 - RNA, 17 nt, Salmonella typhimurium LT2
cgcguuccaucgcuuua

SEQ ID NO: 3813578 - RNA, 23 nt, Salmonella typhimurium LT2
cgcguucgaccguuuccgccagu

SEQ ID NO: 3813579 - RNA, 14 nt, Salmonella typhimurium LT2
cgcguucgcgcagu

SEQ ID NO: 3813580 - RNA, 12 nt, Salmonella typhimurium LT2
cgcguugccgcc

SEQ ID NO: 3813581 - RNA, 13 nt, Salmonella typhimurium LT2
cgcguugccgccg

SEQ ID NO: 3813582 - RNA, 19 nt, Salmonella typhimurium LT2
cgcguugccugaaaagggg

SEQ ID NO: 3813583 - RNA, 17 nt, Salmonella typhimurium LT2
cgcguuguugaucauaa

SEQ ID NO: 3813584 - RNA, 17 nt, Salmonella typhimurium LT2
cgcguuuaccgccgccg

SEQ ID NO: 3813585 - RNA, 21 nt, Salmonella typhimurium LT2
cgcguuuaccuucgauaacgg

SEQ ID NO: 3813586 - RNA, 19 nt, Salmonella typhimurium LT2
cgcguuuuagcaaccagcu

SEQ ID NO: 3813587 - RNA, 13 nt, Salmonella typhimurium LT2
cgcguuuuccauu

SEQ ID NO: 3813588 - RNA, 16 nt, Salmonella typhimurium LT2
cgcguuuuccauuuua

SEQ ID NO: 3813589 - RNA, 23 nt, Salmonella typhimurium LT2
cgcguuuuccucgucgcgcgccg

SEQ ID NO: 3813590 - RNA, 16 nt, Salmonella typhimurium LT2
cgcguuuuuucaugaa

SEQ ID NO: 3813591 - RNA, 23 nt, Salmonella typhimurium LT2
cgcguuuuuucaugaaucaucac

SEQ ID NO: 3813592 - RNA, 20 nt, Salmonella typhimurium LT2
cgcuaaacagcgccgcgaau

SEQ ID NO: 3813593 - RNA, 15 nt, Salmonella typhimurium LT2
cgcuaaagucagcau

SEQ ID NO: 3813594 - RNA, 14 nt, Salmonella typhimurium LT2
cgcuaaaugcauag

SEQ ID NO: 3813595 - RNA, 18 nt, Salmonella typhimurium LT2
cgcuaaaugggcaggaga

SEQ ID NO: 3813596 - RNA, 20 nt, Salmonella typhimurium LT2
cgcuaaaugggcaggagaug

SEQ ID NO: 3813597 - RNA, 22 nt, Salmonella typhimurium LT2
cgcuaaccagcgcuucgccugc

SEQ ID NO: 3813598 - RNA, 16 nt, Salmonella typhimurium LT2
cgcuaaccggcggcgu

SEQ ID NO: 3813599 - RNA, 16 nt, Salmonella typhimurium LT2
cgcuaacguccgccgu

SEQ ID NO: 3813600 - RNA, 21 nt, Salmonella typhimurium LT2
cgcuaacgucgccaucaggcg

SEQ ID NO: 3813601 - RNA, 20 nt, Salmonella typhimurium LT2
cgcuaagggcaccagcaaca

SEQ ID NO: 3813602 - RNA, 13 nt, Salmonella typhimurium LT2
cgcuaaucaucag

SEQ ID NO: 3813603 - RNA, 14 nt, Salmonella typhimurium LT2
cgcuaaucaucagc

SEQ ID NO: 3813604 - RNA, 21 nt, Salmonella typhimurium LT2
cgcuaaucccgcucgccaggu

SEQ ID NO: 3813605 - RNA, 21 nt, Salmonella typhimurium LT2
cgcuaaugcccggcgcggcau

SEQ ID NO: 3813606 - RNA, 23 nt, Salmonella typhimurium LT2
cgcuaaugcccggcgcggcauca

SEQ ID NO: 3813607 - RNA, 16 nt, Salmonella typhimurium LT2
cgcuaauucucccugc

SEQ ID NO: 3813608 - RNA, 17 nt, Salmonella typhimurium LT2
cgcuaauuuuuaaauga

SEQ ID NO: 3813609 - RNA, 19 nt, Salmonella typhimurium LT2
cgcuacauuaaugucauga

SEQ ID NO: 3813610 - RNA, 17 nt, Salmonella typhimurium LT2
cgcuaccuucuucccau

SEQ ID NO: 3813611 - RNA, 14 nt, Salmonella typhimurium LT2
cgcuacgcaggcca

SEQ ID NO: 3813612 - RNA, 16 nt, Salmonella typhimurium LT2
cgcuacgcuuaucagg

SEQ ID NO: 3813613 - RNA, 20 nt, Salmonella typhimurium LT2
cgcuacgcuuaucaggccug

SEQ ID NO: 3813614 - RNA, 24 nt, Salmonella typhimurium LT2
cgcuacggcgcacaguagcucaua

SEQ ID NO: 3813615 - RNA, 21 nt, Salmonella typhimurium LT2
cgcuacucagcgucaucacag

SEQ ID NO: 3813616 - RNA, 14 nt, Salmonella typhimurium LT2
cgcuagccgcaucc

SEQ ID NO: 3813617 - RNA, 15 nt, Salmonella typhimurium LT2
cgcuagcuggcaggg

SEQ ID NO: 3813618 - RNA, 14 nt, Salmonella typhimurium LT2
cgcuagcuucaggu

SEQ ID NO: 3813619 - RNA, 16 nt, Salmonella typhimurium LT2
cgcuagugccgccagg

SEQ ID NO: 3813620 - RNA, 15 nt, Salmonella typhimurium LT2
cgcuauaagcggcgu

SEQ ID NO: 3813621 - RNA, 22 nt, Salmonella typhimurium LT2
cgcuauaagcggcgucauccgg

SEQ ID NO: 3813622 - RNA, 15 nt, Salmonella typhimurium LT2
cgcuauaggcgaccg

SEQ ID NO: 3813623 - RNA, 13 nt, Salmonella typhimurium LT2
cgcuaucaaaaug

SEQ ID NO: 3813624 - RNA, 17 nt, Salmonella typhimurium LT2
cgcuaucagacugaucg

SEQ ID NO: 3813625 - RNA, 23 nt, Salmonella typhimurium LT2
cgcuauccgcgcucgccagcaua

SEQ ID NO: 3813626 - RNA, 13 nt, Salmonella typhimurium LT2
cgcuaucggcaua

SEQ ID NO: 3813627 - RNA, 20 nt, Salmonella typhimurium LT2
cgcuaucucuuccagcgucu

SEQ ID NO: 3813628 - RNA, 18 nt, Salmonella typhimurium LT2
cgcuaucugcuccgccag

SEQ ID NO: 3813629 - RNA, 19 nt, Salmonella typhimurium LT2
cgcuaucugcuccgccagc

SEQ ID NO: 3813630 - RNA, 22 nt, Salmonella typhimurium LT2
cgcuauggugcgggguuuccgg

SEQ ID NO: 3813631 - RNA, 20 nt, Salmonella typhimurium LT2
cgcuauuccagagaguuuuc

SEQ ID NO: 3813632 - RNA, 18 nt, Salmonella typhimurium LT2
cgcuauuccagcuaccuc

SEQ ID NO: 3813633 - RNA, 21 nt, Salmonella typhimurium LT2
cgcuauuguugaugcgcucac

SEQ ID NO: 3813634 - RNA, 12 nt, Salmonella typhimurium LT2
cgcuauuugcag

SEQ ID NO: 3813635 - RNA, 13 nt, Salmonella typhimurium LT2
cgcuauuugcgca

SEQ ID NO: 3813636 - RNA, 16 nt, Salmonella typhimurium LT2
cgcucaacagccagaa

SEQ ID NO: 3813637 - RNA, 21 nt, Salmonella typhimurium LT2
cgcucaagcgaaaaaauaauc

SEQ ID NO: 3813638 - RNA, 18 nt, Salmonella typhimurium LT2
cgcucaagcugggcguua

SEQ ID NO: 3813639 - RNA, 17 nt, Salmonella typhimurium LT2
cgcucaauggcgcgcca

SEQ ID NO: 3813640 - RNA, 15 nt, Salmonella typhimurium LT2
cgcucaccgggcagg

SEQ ID NO: 3813641 - RNA, 16 nt, Salmonella typhimurium LT2
cgcucacgauaacgca

SEQ ID NO: 3813642 - RNA, 14 nt, Salmonella typhimurium LT2
cgcucacgcggcgc

SEQ ID NO: 3813643 - RNA, 16 nt, Salmonella typhimurium LT2
cgcucacuaccgcgau

SEQ ID NO: 3813644 - RNA, 21 nt, Salmonella typhimurium LT2
cgcucacugguugcccauggc

SEQ ID NO: 3813645 - RNA, 12 nt, Salmonella typhimurium LT2
cgcucagcaucg

SEQ ID NO: 3813646 - RNA, 16 nt, Salmonella typhimurium LT2
cgcucagccagaaacg

SEQ ID NO: 3813647 - RNA, 16 nt, Salmonella typhimurium LT2
cgcucaggaucgccgg

SEQ ID NO: 3813648 - RNA, 18 nt, Salmonella typhimurium LT2
cgcucagguuguccagca

SEQ ID NO: 3813649 - RNA, 19 nt, Salmonella typhimurium LT2
cgcucauacgaucgcgcac

SEQ ID NO: 3813650 - RNA, 14 nt, Salmonella typhimurium LT2
cgcucaucggcggc

SEQ ID NO: 3813651 - RNA, 14 nt, Salmonella typhimurium LT2
cgcucaugccacgc

SEQ ID NO: 3813652 - RNA, 20 nt, Salmonella typhimurium LT2
cgcucauuaaaccgcgcggc

SEQ ID NO: 3813653 - RNA, 24 nt, Salmonella typhimurium LT2
cgcucauuaaaccgcgcggcauaa

SEQ ID NO: 3813654 - RNA, 14 nt, Salmonella typhimurium LT2
cgcuccaccgccgg

SEQ ID NO: 3813655 - RNA, 15 nt, Salmonella typhimurium LT2
cgcuccacuggcccc

SEQ ID NO: 3813656 - RNA, 19 nt, Salmonella typhimurium LT2
cgcuccacuggcccccugu

SEQ ID NO: 3813657 - RNA, 16 nt, Salmonella typhimurium LT2
cgcuccagaccaccag

SEQ ID NO: 3813658 - RNA, 17 nt, Salmonella typhimurium LT2
cgcuccagaccaccagc

SEQ ID NO: 3813659 - RNA, 13 nt, Salmonella typhimurium LT2
cgcuccagcaguu

SEQ ID NO: 3813660 - RNA, 16 nt, Salmonella typhimurium LT2
cgcuccagcaguucua

SEQ ID NO: 3813661 - RNA, 14 nt, Salmonella typhimurium LT2
cgcuccagcuggcu

SEQ ID NO: 3813662 - RNA, 15 nt, Salmonella typhimurium LT2
cgcuccagcuggcug

SEQ ID NO: 3813663 - RNA, 12 nt, Salmonella typhimurium LT2
cgcuccagggcu

SEQ ID NO: 3813664 - RNA, 23 nt, Salmonella typhimurium LT2
cgcugucugccggcguuccgcac

SEQ ID NO: 3813665 - RNA, 19 nt, Salmonella typhimurium LT2
cgcugugauccauguugcc

SEQ ID NO: 3813666 - RNA, 21 nt, Salmonella typhimurium LT2
cgcugugcggcgugcagauca

SEQ ID NO: 3813667 - RNA, 22 nt, Salmonella typhimurium LT2
cgcuguucuuucucuauggugg

SEQ ID NO: 3813668 - RNA, 13 nt, Salmonella typhimurium LT2
cgcuguuguugac

SEQ ID NO: 3813669 - RNA, 19 nt, Salmonella typhimurium LT2
cgcuguuuuuccgcuuuuu

SEQ ID NO: 3813670 - RNA, 19 nt, Salmonella typhimurium LT2
cgcuuaacuccggcgacca

SEQ ID NO: 3813671 - RNA, 23 nt, Salmonella typhimurium LT2
cgcuuaaucaguugcaggaaggu

SEQ ID NO: 3813672 - RNA, 21 nt, Salmonella typhimurium LT2
cgcuuacacauuuuauccggc

SEQ ID NO: 3813673 - RNA, 17 nt, Salmonella typhimurium LT2
cgcuuacaguuuaucug

SEQ ID NO: 3813674 - RNA, 18 nt, Salmonella typhimurium LT2
cgcuuacaguuuaucugc

SEQ ID NO: 3813675 - RNA, 14 nt, Salmonella typhimurium LT2
cgcuuaccaggccu

SEQ ID NO: 3813676 - RNA, 19 nt, Salmonella typhimurium LT2
cgcuuaccgggcuuacagc

SEQ ID NO: 3813677 - RNA, 14 nt, Salmonella typhimurium LT2
cgcuuacgcggcgc

SEQ ID NO: 3813678 - RNA, 16 nt, Salmonella typhimurium LT2
cgcuuacgcuccugcg

SEQ ID NO: 3813679 - RNA, 18 nt, Salmonella typhimurium LT2
cgcuuacucagccagaua

SEQ ID NO: 3813680 - RNA, 19 nt, Salmonella typhimurium LT2
cgcuuacucagccagauac

SEQ ID NO: 3813681 - RNA, 12 nt, Salmonella typhimurium LT2
cgcuuagcggca

SEQ ID NO: 3813682 - RNA, 17 nt, Salmonella typhimurium LT2
cgcuuagcuucccgcau

SEQ ID NO: 3813683 - RNA, 12 nt, Salmonella typhimurium LT2
cgcuuaucaggc

SEQ ID NO: 3813684 - RNA, 13 nt, Salmonella typhimurium LT2
cgcuuaucaggcc

SEQ ID NO: 3813685 - RNA, 14 nt, Salmonella typhimurium LT2
cgcuuaucaggccu

SEQ ID NO: 3813686 - RNA, 17 nt, Salmonella typhimurium LT2
cgcuuaucaggccuaca

SEQ ID NO: 3813687 - RNA, 18 nt, Salmonella typhimurium LT2
cgcuuaucaggccuacaa

SEQ ID NO: 3813688 - RNA, 19 nt, Salmonella typhimurium LT2
cgcuuaucaggccuacaag

SEQ ID NO: 3813689 - RNA, 17 nt, Salmonella typhimurium LT2
cgcuuaucaggccuacg

SEQ ID NO: 3813690 - RNA, 19 nt, Salmonella typhimurium LT2
cgcuuaucccagccgcgau

SEQ ID NO: 3813691 - RNA, 13 nt, Salmonella typhimurium LT2
cgcuuauccggcc

SEQ ID NO: 3813692 - RNA, 21 nt, Salmonella typhimurium LT2
cgcuuauccggcuuauccggc

SEQ ID NO: 3813693 - RNA, 13 nt, Salmonella typhimurium LT2
cgcuuaucgggcc

SEQ ID NO: 3813694 - RNA, 19 nt, Salmonella typhimurium LT2
cgcuuauuccuccgccgau

SEQ ID NO: 3813695 - RNA, 18 nt, Salmonella typhimurium LT2
cgcuuauucggccuacag

SEQ ID NO: 3813696 - RNA, 23 nt, Salmonella typhimurium LT2
cgcuucaaaacagaaccccaucg

SEQ ID NO: 3813697 - RNA, 20 nt, Salmonella typhimurium LT2
cgcuucaccggcgugcgcuu

SEQ ID NO: 3813698 - RNA, 22 nt, Salmonella typhimurium LT2
cgcuucaccuuucgccgccaga

SEQ ID NO: 3813699 - RNA, 14 nt, Salmonella typhimurium LT2
cgcuuccagcgccg

SEQ ID NO: 3813700 - RNA, 14 nt, Salmonella typhimurium LT2
cgcuucccacaguc

SEQ ID NO: 3813701 - RNA, 20 nt, Salmonella typhimurium LT2
cgcuuccuggauguccgacg

SEQ ID NO: 3813702 - RNA, 11 nt, Salmonella typhimurium LT2
cgcuuccuggg

SEQ ID NO: 3813703 - RNA, 23 nt, Salmonella typhimurium LT2
cgcuucgcagcgauauuucuccg

SEQ ID NO: 3813704 - RNA, 14 nt, Salmonella typhimurium LT2
cgcuucggcaauuu

SEQ ID NO: 3813705 - RNA, 19 nt, Salmonella typhimurium LT2
cgcuucggugaucuccucg

SEQ ID NO: 3813706 - RNA, 15 nt, Salmonella typhimurium LT2
cgcuucguauuucuu

SEQ ID NO: 3813707 - RNA, 19 nt, Salmonella typhimurium LT2
cgcuucgucagcuccucgc

SEQ ID NO: 3813708 - RNA, 16 nt, Salmonella typhimurium LT2
cgcuucgugaaaaccu

SEQ ID NO: 3813709 - RNA, 19 nt, Salmonella typhimurium LT2
cgcuucgugaaaaccuaaa

SEQ ID NO: 3813710 - RNA, 18 nt, Salmonella typhimurium LT2
cgcuucuaccugcacauc

SEQ ID NO: 3813711 - RNA, 18 nt, Salmonella typhimurium LT2
cgcuucuauuucuuuauu

SEQ ID NO: 3813712 - RNA, 18 nt, Salmonella typhimurium LT2
cgcuucucccagccguca

SEQ ID NO: 3813713 - RNA, 23 nt, Salmonella typhimurium LT2
cgcuucugguugucacggaucuu

SEQ ID NO: 3813714 - RNA, 21 nt, Salmonella typhimurium LT2
cgcuucuuccuuacguuuauu

SEQ ID NO: 3813715 - RNA, 14 nt, Salmonella typhimurium LT2
cgcuucuucuacca

SEQ ID NO: 3813716 - RNA, 18 nt, Salmonella typhimurium LT2
cgcuucuucuaccaccuu

SEQ ID NO: 3813717 - RNA, 15 nt, Salmonella typhimurium LT2
cgcuugcaccauggc

SEQ ID NO: 3813718 - RNA, 18 nt, Salmonella typhimurium LT2
cgcuugcaugaccaucca

SEQ ID NO: 3813719 - RNA, 13 nt, Salmonella typhimurium LT2
cgcuugcauggca

SEQ ID NO: 3813720 - RNA, 14 nt, Salmonella typhimurium LT2
cgcuugcgccgcca

SEQ ID NO: 3813721 - RNA, 14 nt, Salmonella typhimurium LT2
cgcuugcuccgcag

SEQ ID NO: 3813722 - RNA, 20 nt, Salmonella typhimurium LT2
cgcuuuaauggcuuucaccg

SEQ ID NO: 3813723 - RNA, 20 nt, Salmonella typhimurium LT2
cgcuuuacaugccgcucucc

SEQ ID NO: 3813724 - RNA, 17 nt, Salmonella typhimurium LT2
cgcuuuaccgccuuccu

SEQ ID NO: 3813725 - RNA, 14 nt, Salmonella typhimurium LT2
cgcuuuagcgauaa

SEQ ID NO: 3813726 - RNA, 12 nt, Salmonella typhimurium LT2
cgcuuucaaucg

SEQ ID NO: 3813727 - RNA, 13 nt, Salmonella typhimurium LT2
cgcuuucaccauc

SEQ ID NO: 3813728 - RNA, 22 nt, Salmonella typhimurium LT2
cgcuuucagcgcaucgagauaa

SEQ ID NO: 3813729 - RNA, 14 nt, Salmonella typhimurium LT2
cgcuuucauacgac

SEQ ID NO: 3813730 - RNA, 14 nt, Salmonella typhimurium LT2
cgcuuuccagcggu

SEQ ID NO: 3813731 - RNA, 12 nt, Salmonella typhimurium LT2
cgcuuuccaggc

SEQ ID NO: 3813732 - RNA, 22 nt, Salmonella typhimurium LT2
cgcuuuccagguggugcaggcu

SEQ ID NO: 3813733 - RNA, 14 nt, Salmonella typhimurium LT2
cgcuuucccggcau

SEQ ID NO: 3813734 - RNA, 23 nt, Salmonella typhimurium LT2
cgcuuucuggggugaauuuuuug

SEQ ID NO: 3813735 - RNA, 15 nt, Salmonella typhimurium LT2
cgcuuugacaacaaa

SEQ ID NO: 3813736 - RNA, 19 nt, Salmonella typhimurium LT2
cgcuuugacauugucauaa

SEQ ID NO: 3813737 - RNA, 17 nt, Salmonella typhimurium LT2
cgcuuugagcugcugcu

SEQ ID NO: 3813738 - RNA, 22 nt, Salmonella typhimurium LT2
cgcuuugaggaucaauuuuucg

SEQ ID NO: 3813739 - RNA, 9 nt, Salmonella typhimurium LT2
cgcuuugcc

SEQ ID NO: 3813740 - RNA, 18 nt, Salmonella typhimurium LT2
cgcuuugcuuauccggcc

SEQ ID NO: 3813741 - RNA, 15 nt, Salmonella typhimurium LT2
cgcuuuggaggucau

SEQ ID NO: 3813742 - RNA, 15 nt, Salmonella typhimurium LT2
cgcuuuucagcgcca

SEQ ID NO: 3813743 - RNA, 18 nt, Salmonella typhimurium LT2
cgcuuuuccaggcgacca

SEQ ID NO: 3813744 - RNA, 15 nt, Salmonella typhimurium LT2
cgcuuuuccccgcag

SEQ ID NO: 3813745 - RNA, 17 nt, Salmonella typhimurium LT2
cgcuuuugguuuuucaa

SEQ ID NO: 3813746 - RNA, 13 nt, Salmonella typhimurium LT2
cgcuuuuucaaag

SEQ ID NO: 3813747 - RNA, 21 nt, Salmonella typhimurium LT2
cgcuuuuucacgaccagccaa

SEQ ID NO: 3813748 - RNA, 18 nt, Salmonella typhimurium LT2
cgcuuuuugcgccagcgc

SEQ ID NO: 3813749 - RNA, 17 nt, Salmonella typhimurium LT2
cgcuuuuugcuucgcca

SEQ ID NO: 3813750 - RNA, 15 nt, Salmonella typhimurium LT2
cgcuuuuuuugcccu

SEQ ID NO: 3813751 - RNA, 20 nt, Salmonella typhimurium LT2
cggaaaaauaguggcuggcg

SEQ ID NO: 3813752 - RNA, 12 nt, Salmonella typhimurium LT2
cggaaaacguga

SEQ ID NO: 3813753 - RNA, 14 nt, Salmonella typhimurium LT2
cggaaaagcgccca

SEQ ID NO: 3813754 - RNA, 14 nt, Salmonella typhimurium LT2
cggaaaccccaggu

SEQ ID NO: 3813755 - RNA, 21 nt, Salmonella typhimurium LT2
cggaaaccuguucccggcaga

SEQ ID NO: 3813756 - RNA, 17 nt, Salmonella typhimurium LT2
cggaaacuauccuggcc

SEQ ID NO: 3813757 - RNA, 21 nt, Salmonella typhimurium LT2
cggaaagaagaauaagccgga

SEQ ID NO: 3813758 - RNA, 14 nt, Salmonella typhimurium LT2
cggaaagagguucc

SEQ ID NO: 3813759 - RNA, 17 nt, Salmonella typhimurium LT2
cggaaagcaacagcaag

SEQ ID NO: 3813760 - RNA, 12 nt, Salmonella typhimurium LT2
cggaaauggucg

SEQ ID NO: 3813761 - RNA, 17 nt, Salmonella typhimurium LT2
cggaaauuugcagcgcu

SEQ ID NO: 3813762 - RNA, 19 nt, Salmonella typhimurium LT2
cggaacaacgcaacacagg

SEQ ID NO: 3813763 - RNA, 16 nt, Salmonella typhimurium LT2
cggaacaggcuuuuca

SEQ ID NO: 3813764 - RNA, 16 nt, Salmonella typhimurium LT2
cggaacagggccgcau

SEQ ID NO: 3813765 - RNA, 18 nt, Salmonella typhimurium LT2
cggaacaguaaagcgcaa

SEQ ID NO: 3813766 - RNA, 17 nt, Salmonella typhimurium LT2
cggaaccaaaugcccag

SEQ ID NO: 3813767 - RNA, 18 nt, Salmonella typhimurium LT2
cggaaccaaaugcccagc

SEQ ID NO: 3813768 - RNA, 17 nt, Salmonella typhimurium LT2
cggaucaugguugaaaa

SEQ ID NO: 3813769 - RNA, 13 nt, Salmonella typhimurium LT2
cggauccagaacu

SEQ ID NO: 3813770 - RNA, 14 nt, Salmonella typhimurium LT2
cggaucggauuuac

SEQ ID NO: 3813771 - RNA, 21 nt, Salmonella typhimurium LT2
cggaugaaacaguccggcgaa

SEQ ID NO: 3813772 - RNA, 13 nt, Salmonella typhimurium LT2
cggaugaccagaa

SEQ ID NO: 3813773 - RNA, 13 nt, Salmonella typhimurium LT2
cggaugacgcuuc

SEQ ID NO: 3813774 - RNA, 18 nt, Salmonella typhimurium LT2
cggaugacuucuucuacc

SEQ ID NO: 3813775 - RNA, 17 nt, Salmonella typhimurium LT2
cggaugauccucauaaa

SEQ ID NO: 3813776 - RNA, 16 nt, Salmonella typhimurium LT2
cggaugauucaguaaa

SEQ ID NO: 3813777 - RNA, 20 nt, Salmonella typhimurium LT2
cggaugcgacuccaggaaca

SEQ ID NO: 3813778 - RNA, 17 nt, Salmonella typhimurium LT2
cggaugcgccaucccau

SEQ ID NO: 3813779 - RNA, 20 nt, Salmonella typhimurium LT2
cggaugcugcgccagccaua

SEQ ID NO: 3813780 - RNA, 16 nt, Salmonella typhimurium LT2
cggauggcaacgccag

SEQ ID NO: 3813781 - RNA, 21 nt, Salmonella typhimurium LT2
cggauggcaacgccagagcgu

SEQ ID NO: 3813782 - RNA, 20 nt, Salmonella typhimurium LT2
cggauggcaguacagggcga

SEQ ID NO: 3813783 - RNA, 17 nt, Salmonella typhimurium LT2
cggauggccugcucgau

SEQ ID NO: 3813784 - RNA, 17 nt, Salmonella typhimurium LT2
cggauggcgacgcguag

SEQ ID NO: 3813785 - RNA, 14 nt, Salmonella typhimurium LT2
cggauggcggcgga

SEQ ID NO: 3813786 - RNA, 23 nt, Salmonella typhimurium LT2
cggauggcgguauaacugccuua

SEQ ID NO: 3813787 - RNA, 22 nt, Salmonella typhimurium LT2
cggauggcguuuagcuggcggg

SEQ ID NO: 3813788 - RNA, 17 nt, Salmonella typhimurium LT2
cggaugggguaucgcca

SEQ ID NO: 3813789 - RNA, 16 nt, Salmonella typhimurium LT2
cggaugugagcgcauc

SEQ ID NO: 3813790 - RNA, 19 nt, Salmonella typhimurium LT2
cggauuaucguccggcauc

SEQ ID NO: 3813791 - RNA, 20 nt, Salmonella typhimurium LT2
cggauuauuggucagcaggc

SEQ ID NO: 3813792 - RNA, 18 nt, Salmonella typhimurium LT2
cggauucucgaugauaaa

SEQ ID NO: 3813793 - RNA, 22 nt, Salmonella typhimurium LT2
cggauugagcgaauccagcgcc

SEQ ID NO: 3813794 - RNA, 14 nt, Salmonella typhimurium LT2
cggauugccuucuc

SEQ ID NO: 3813795 - RNA, 17 nt, Salmonella typhimurium LT2
cggauuggucugauuca

SEQ ID NO: 3813796 - RNA, 19 nt, Salmonella typhimurium LT2
cggauuuaccagcgcuucu

SEQ ID NO: 3813797 - RNA, 18 nt, Salmonella typhimurium LT2
cggauuuuaaauugguua

SEQ ID NO: 3813798 - RNA, 16 nt, Salmonella typhimurium LT2
cggcaaaaacgccggu

SEQ ID NO: 3813799 - RNA, 16 nt, Salmonella typhimurium LT2
cggcaaaauacucagc

SEQ ID NO: 3813800 - RNA, 24 nt, Salmonella typhimurium LT2
cggcaaaccaugaucgucaggcgc

SEQ ID NO: 3813801 - RNA, 18 nt, Salmonella typhimurium LT2
cggcaaaccuaccggcau

SEQ ID NO: 3813802 - RNA, 22 nt, Salmonella typhimurium LT2
cggcaaagaagcuuacaaggcu

SEQ ID NO: 3813803 - RNA, 21 nt, Salmonella typhimurium LT2
cggcaaaucccggacacauaa

SEQ ID NO: 3813804 - RNA, 12 nt, Salmonella typhimurium LT2
cggcaacaaaug

SEQ ID NO: 3813805 - RNA, 14 nt, Salmonella typhimurium LT2
cggcaacaugacau

SEQ ID NO: 3813806 - RNA, 14 nt, Salmonella typhimurium LT2
cggcaaccagccca

SEQ ID NO: 3813807 - RNA, 13 nt, Salmonella typhimurium LT2
cggcaacccgacu

SEQ ID NO: 3813808 - RNA, 20 nt, Salmonella typhimurium LT2
cggcaacccgacugccacca

SEQ ID NO: 3813809 - RNA, 23 nt, Salmonella typhimurium LT2
cggcaacccuuuggccaccagcu

SEQ ID NO: 3813810 - RNA, 19 nt, Salmonella typhimurium LT2
cggcaaccuacuccggguu

SEQ ID NO: 3813811 - RNA, 11 nt, Salmonella typhimurium LT2
cggcaaccuga

SEQ ID NO: 3813812 - RNA, 21 nt, Salmonella typhimurium LT2
cggcaaccugagcgcgaacgc

SEQ ID NO: 3813813 - RNA, 21 nt, Salmonella typhimurium LT2
cggcaacgccuuccugccagc

SEQ ID NO: 3813814 - RNA, 21 nt, Salmonella typhimurium LT2
cggcaacgcguuuuuaucgcu

SEQ ID NO: 3813815 - RNA, 20 nt, Salmonella typhimurium LT2
cggcaacgucacgugacgca

SEQ ID NO: 3813816 - RNA, 17 nt, Salmonella typhimurium LT2
cggcaagcaucugauau

SEQ ID NO: 3813817 - RNA, 14 nt, Salmonella typhimurium LT2
cggcaagcgcgcca

SEQ ID NO: 3813818 - RNA, 18 nt, Salmonella typhimurium LT2
cggcaagcgggcguugcu

SEQ ID NO: 3813819 - RNA, 22 nt, Salmonella typhimurium LT2
cggcaagcguaagguauuuagc

SEQ ID NO: 3813820 - RNA, 17 nt, Salmonella typhimurium LT2
cggcaaggaaaaccagu

SEQ ID NO: 3813821 - RNA, 18 nt, Salmonella typhimurium LT2
cggcaaggucugcgccca

SEQ ID NO: 3813822 - RNA, 21 nt, Salmonella typhimurium LT2
cggcaaggucugcgcccaccg

SEQ ID NO: 3813823 - RNA, 17 nt, Salmonella typhimurium LT2
cggcaagucagaccagu

SEQ ID NO: 3813824 - RNA, 20 nt, Salmonella typhimurium LT2
cggcaauaauguuuacgcca

SEQ ID NO: 3813825 - RNA, 12 nt, Salmonella typhimurium LT2
cggcaauauccc

SEQ ID NO: 3813826 - RNA, 22 nt, Salmonella typhimurium LT2
cggcaaucgccugcaacgcuuu

SEQ ID NO: 3813827 - RNA, 21 nt, Salmonella typhimurium LT2
cggcaaucgcgugcaacaguu

SEQ ID NO: 3813828 - RNA, 13 nt, Salmonella typhimurium LT2
cggcaaucucacu

SEQ ID NO: 3813829 - RNA, 18 nt, Salmonella typhimurium LT2
cggcaaugagcggccagc

SEQ ID NO: 3813830 - RNA, 20 nt, Salmonella typhimurium LT2
cggcaaugccucuuccggua

SEQ ID NO: 3813831 - RNA, 20 nt, Salmonella typhimurium LT2
cggcaaugcucugcagguca

SEQ ID NO: 3813832 - RNA, 22 nt, Salmonella typhimurium LT2
cggcaauggccgcagcgccaua

SEQ ID NO: 3813833 - RNA, 17 nt, Salmonella typhimurium LT2
cggcaauucagguaaua

SEQ ID NO: 3813834 - RNA, 15 nt, Salmonella typhimurium LT2
cggcacacgcggcgc

SEQ ID NO: 3813835 - RNA, 21 nt, Salmonella typhimurium LT2
cggcacauauuccggcgcugg

SEQ ID NO: 3813836 - RNA, 22 nt, Salmonella typhimurium LT2
cggcacauauuccggcgcuggc

SEQ ID NO: 3813837 - RNA, 17 nt, Salmonella typhimurium LT2
cggcacaucgcgcguga

SEQ ID NO: 3813838 - RNA, 23 nt, Salmonella typhimurium LT2
cggcaccagaauccacucggcgc

SEQ ID NO: 3813839 - RNA, 11 nt, Salmonella typhimurium LT2
cggcaccagca

SEQ ID NO: 3813840 - RNA, 14 nt, Salmonella typhimurium LT2
cggcaccagcaaug

SEQ ID NO: 3813841 - RNA, 17 nt, Salmonella typhimurium LT2
cggcaccccuucaggcg

SEQ ID NO: 3813842 - RNA, 22 nt, Salmonella typhimurium LT2
cggcaccccuucaggcgugacg

SEQ ID NO: 3813843 - RNA, 15 nt, Salmonella typhimurium LT2
cggcacgccagcgcc

SEQ ID NO: 3813844 - RNA, 18 nt, Salmonella typhimurium LT2
cggcacgguuaaugaaau

SEQ ID NO: 3813845 - RNA, 16 nt, Salmonella typhimurium LT2
cggcacguacugcacc

SEQ ID NO: 3813846 - RNA, 21 nt, Salmonella typhimurium LT2
cggcacguugucccaggccag

SEQ ID NO: 3813847 - RNA, 21 nt, Salmonella typhimurium LT2
cggcacucaccucuuccgcca

SEQ ID NO: 3813848 - RNA, 18 nt, Salmonella typhimurium LT2
cggcacugcuuccugccg

SEQ ID NO: 3813849 - RNA, 19 nt, Salmonella typhimurium LT2
cggcagaaauuaaaucauc

SEQ ID NO: 3813850 - RNA, 22 nt, Salmonella typhimurium LT2
cggcagaaauuaaaucaucuug

SEQ ID NO: 3813851 - RNA, 19 nt, Salmonella typhimurium LT2
cggcagacgauagcgggug

SEQ ID NO: 3813852 - RNA, 15 nt, Salmonella typhimurium LT2
cggcagacggcuggg

SEQ ID NO: 3813853 - RNA, 20 nt, Salmonella typhimurium LT2
cggcagacguuuaucggcca

SEQ ID NO: 3813854 - RNA, 17 nt, Salmonella typhimurium LT2
cggcagauccuggcgcu

SEQ ID NO: 3813855 - RNA, 20 nt, Salmonella typhimurium LT2
cggcagcaauacgcccgccc

SEQ ID NO: 3813856 - RNA, 13 nt, Salmonella typhimurium LT2
cggcagcagcgcg

SEQ ID NO: 3813857 - RNA, 16 nt, Salmonella typhimurium LT2
cggcagcagcgcgccg

SEQ ID NO: 3813858 - RNA, 13 nt, Salmonella typhimurium LT2
cggcagccagacc

SEQ ID NO: 3813859 - RNA, 13 nt, Salmonella typhimurium LT2
cggcagccgccac

SEQ ID NO: 3813860 - RNA, 20 nt, Salmonella typhimurium LT2
cggcagccgccaccacaaag

SEQ ID NO: 3813861 - RNA, 12 nt, Salmonella typhimurium LT2
cggcagcgcgaa

SEQ ID NO: 3813862 - RNA, 19 nt, Salmonella typhimurium LT2
cggcagcgcgacauagagc

SEQ ID NO: 3813863 - RNA, 13 nt, Salmonella typhimurium LT2
cggcagcgcgcac

SEQ ID NO: 3813864 - RNA, 12 nt, Salmonella typhimurium LT2
cggcagcgcugc

SEQ ID NO: 3813865 - RNA, 16 nt, Salmonella typhimurium LT2
cggcagcucgagggug

SEQ ID NO: 3813866 - RNA, 15 nt, Salmonella typhimurium LT2
cggcagcucgugcag

SEQ ID NO: 3813867 - RNA, 23 nt, Salmonella typhimurium LT2
cggcaggacaaucauaauaaacu

SEQ ID NO: 3813868 - RNA, 19 nt, Salmonella typhimurium LT2
cggcaggaugaaugacugu

SEQ ID NO: 3813869 - RNA, 22 nt, Salmonella typhimurium LT2
cggcaggaugaaugacugucca

SEQ ID NO: 3813870 - RNA, 15 nt, Salmonella typhimurium LT2
cggcaggcagcgcca

SEQ ID NO: 3813871 - RNA, 15 nt, Salmonella typhimurium LT2
cggcgacgcccgcca

SEQ ID NO: 3813872 - RNA, 14 nt, Salmonella typhimurium LT2
cggcgacuggaaca

SEQ ID NO: 3813873 - RNA, 15 nt, Salmonella typhimurium LT2
cggcgagaucggcgc

SEQ ID NO: 3813874 - RNA, 13 nt, Salmonella typhimurium LT2
cggcgaucaccac

SEQ ID NO: 3813875 - RNA, 15 nt, Salmonella typhimurium LT2
cggcgaugccggccu

SEQ ID NO: 3813876 - RNA, 20 nt, Salmonella typhimurium LT2
cggcgcaaacacggcugucg

SEQ ID NO: 3813877 - RNA, 15 nt, Salmonella typhimurium LT2
cggcgcaaaucgcca

SEQ ID NO: 3813878 - RNA, 16 nt, Salmonella typhimurium LT2
cggcgcaaaucgccau

SEQ ID NO: 3813879 - RNA, 12 nt, Salmonella typhimurium LT2
cggcgcacaccc

SEQ ID NO: 3813880 - RNA, 18 nt, Salmonella typhimurium LT2
cggcgcacacccugcaga

SEQ ID NO: 3813881 - RNA, 21 nt, Salmonella typhimurium LT2
cggcgcacacccugcagaccu

SEQ ID NO: 3813882 - RNA, 14 nt, Salmonella typhimurium LT2
cggcgcagacacug

SEQ ID NO: 3813883 - RNA, 15 nt, Salmonella typhimurium LT2
cggcgcagcgcgcga

SEQ ID NO: 3813884 - RNA, 22 nt, Salmonella typhimurium LT2
cggcgcaggggcauuuuccggc

SEQ ID NO: 3813885 - RNA, 22 nt, Salmonella typhimurium LT2
cggcgcaucgccgcaagcggca

SEQ ID NO: 3813886 - RNA, 14 nt, Salmonella typhimurium LT2
cggcgccaacaauc

SEQ ID NO: 3813887 - RNA, 20 nt, Salmonella typhimurium LT2
cggcgccaacaaucgggaac

SEQ ID NO: 3813888 - RNA, 21 nt, Salmonella typhimurium LT2
cggcgccaacaaucgggaaca

SEQ ID NO: 3813889 - RNA, 16 nt, Salmonella typhimurium LT2
cggcgccaaucaccgc

SEQ ID NO: 3813890 - RNA, 18 nt, Salmonella typhimurium LT2
cggcgccaaucaccgcca

SEQ ID NO: 3813891 - RNA, 13 nt, Salmonella typhimurium LT2
cggcgccagccac

SEQ ID NO: 3813892 - RNA, 21 nt, Salmonella typhimurium LT2
cggcgccaggacaacgccggu

SEQ ID NO: 3813893 - RNA, 16 nt, Salmonella typhimurium LT2
cggcgccauccggcau

SEQ ID NO: 3813894 - RNA, 15 nt, Salmonella typhimurium LT2
cggcgcccagcgugc

SEQ ID NO: 3813895 - RNA, 15 nt, Salmonella typhimurium LT2
cggcgcccauccgcc

SEQ ID NO: 3813896 - RNA, 14 nt, Salmonella typhimurium LT2
cggcgcccggaggg

SEQ ID NO: 3813897 - RNA, 20 nt, Salmonella typhimurium LT2
cggcgccgcaaugccgccug

SEQ ID NO: 3813898 - RNA, 20 nt, Salmonella typhimurium LT2
cggcgccggggaagcgacga

SEQ ID NO: 3813899 - RNA, 14 nt, Salmonella typhimurium LT2
cggcgccuuccggc

SEQ ID NO: 3813900 - RNA, 18 nt, Salmonella typhimurium LT2
cggcgcgaccauaaugac

SEQ ID NO: 3813901 - RNA, 17 nt, Salmonella typhimurium LT2
cggcgcgauauccacca

SEQ ID NO: 3813902 - RNA, 15 nt, Salmonella typhimurium LT2
cggcgcgccagcgca

SEQ ID NO: 3813903 - RNA, 10 nt, Salmonella typhimurium LT2
cggcgcgccc

SEQ ID NO: 3813904 - RNA, 14 nt, Salmonella typhimurium LT2
cggcgcgcgccagc

SEQ ID NO: 3813905 - RNA, 15 nt, Salmonella typhimurium LT2
cggcgcgcgccagcu

SEQ ID NO: 3813906 - RNA, 17 nt, Salmonella typhimurium LT2
cggcgcgcucuuuuucu

SEQ ID NO: 3813907 - RNA, 16 nt, Salmonella typhimurium LT2
cggcgcgcugccgccc

SEQ ID NO: 3813908 - RNA, 15 nt, Salmonella typhimurium LT2
cggcgcggggaacac

SEQ ID NO: 3813909 - RNA, 16 nt, Salmonella typhimurium LT2
cggcgcggggaacaca

SEQ ID NO: 3813910 - RNA, 20 nt, Salmonella typhimurium LT2
cggcgcgggugaugacgcgc

SEQ ID NO: 3813911 - RNA, 23 nt, Salmonella typhimurium LT2
cggcgcgggugaugacgcgcagg

SEQ ID NO: 3813912 - RNA, 22 nt, Salmonella typhimurium LT2
cggcgcgguauuucgccgccgc

SEQ ID NO: 3813913 - RNA, 20 nt, Salmonella typhimurium LT2
cggcgcguaaccguggcacc

SEQ ID NO: 3813914 - RNA, 18 nt, Salmonella typhimurium LT2
cggcgcguaauucagcau

SEQ ID NO: 3813915 - RNA, 19 nt, Salmonella typhimurium LT2
cggcgcguuuuggcagaca

SEQ ID NO: 3813916 - RNA, 14 nt, Salmonella typhimurium LT2
cggcgcuaaccagc

SEQ ID NO: 3813917 - RNA, 19 nt, Salmonella typhimurium LT2
cggcgcuaaccagcgcuuc

SEQ ID NO: 3813918 - RNA, 15 nt, Salmonella typhimurium LT2
cggcgcuacggcgca

SEQ ID NO: 3813919 - RNA, 21 nt, Salmonella typhimurium LT2
cggcgcuaucgccuccagacu

SEQ ID NO: 3813920 - RNA, 14 nt, Salmonella typhimurium LT2
cggcgcucaaugug

SEQ ID NO: 3813921 - RNA, 17 nt, Salmonella typhimurium LT2
cggcgcugaugacgcgc

SEQ ID NO: 3813922 - RNA, 15 nt, Salmonella typhimurium LT2
cggcgcuggcgcgcu

SEQ ID NO: 3813923 - RNA, 22 nt, Salmonella typhimurium LT2
cggcgcugucacuccggcugca

SEQ ID NO: 3813924 - RNA, 16 nt, Salmonella typhimurium LT2
cggcgcuucggcgcca

SEQ ID NO: 3813925 - RNA, 16 nt, Salmonella typhimurium LT2
cggcgcuuuuaaaaua

SEQ ID NO: 3813926 - RNA, 15 nt, Salmonella typhimurium LT2
cggcggacagcggca

SEQ ID NO: 3813927 - RNA, 22 nt, Salmonella typhimurium LT2
cggcggauaaucuugauccggc

SEQ ID NO: 3813928 - RNA, 13 nt, Salmonella typhimurium LT2
cggcggcaguccc

SEQ ID NO: 3813929 - RNA, 15 nt, Salmonella typhimurium LT2
cggcggcuagcgcag

SEQ ID NO: 3813930 - RNA, 16 nt, Salmonella typhimurium LT2
cggcgggagcucuacc

SEQ ID NO: 3813931 - RNA, 18 nt, Salmonella typhimurium LT2
cggcgggauuggucgcgc

SEQ ID NO: 3813932 - RNA, 22 nt, Salmonella typhimurium LT2
cggcgggauuggucgcgccgcg

SEQ ID NO: 3813933 - RNA, 17 nt, Salmonella typhimurium LT2
cggcggguuaauggcag

SEQ ID NO: 3813934 - RNA, 22 nt, Salmonella typhimurium LT2
cggcgguaauuuacccggcggg

SEQ ID NO: 3813935 - RNA, 18 nt, Salmonella typhimurium LT2
cggcgguuauccgccagc

SEQ ID NO: 3813936 - RNA, 22 nt, Salmonella typhimurium LT2
cggcguaaaccccuucaccacu

SEQ ID NO: 3813937 - RNA, 15 nt, Salmonella typhimurium LT2
cggcguaccgcgcgc

SEQ ID NO: 3813938 - RNA, 15 nt, Salmonella typhimurium LT2
cggcguagccgccga

SEQ ID NO: 3813939 - RNA, 21 nt, Salmonella typhimurium LT2
cggcguagccgccgagcgccg

SEQ ID NO: 3813940 - RNA, 22 nt, Salmonella typhimurium LT2
cggcgucaaauccaccgccagc

SEQ ID NO: 3813941 - RNA, 21 nt, Salmonella typhimurium LT2
cggcgucaccaccgcaggcag

SEQ ID NO: 3813942 - RNA, 22 nt, Salmonella typhimurium LT2
cggcgucauaguuuuccagccc

SEQ ID NO: 3813943 - RNA, 12 nt, Salmonella typhimurium LT2
cggcgucauccc

SEQ ID NO: 3813944 - RNA, 17 nt, Salmonella typhimurium LT2
cggcgucccggcaaccg

SEQ ID NO: 3813945 - RNA, 14 nt, Salmonella typhimurium LT2
cggcguccgccagc

SEQ ID NO: 3813946 - RNA, 15 nt, Salmonella typhimurium LT2
cggcgucgccugucc

SEQ ID NO: 3813947 - RNA, 16 nt, Salmonella typhimurium LT2
cggcguggaaccgccg

SEQ ID NO: 3813948 - RNA, 18 nt, Salmonella typhimurium LT2
cggcguguaaaccgccag

SEQ ID NO: 3813949 - RNA, 19 nt, Salmonella typhimurium LT2
cggcguguaaaccgccaga

SEQ ID NO: 3813950 - RNA, 21 nt, Salmonella typhimurium LT2
cggcguguagccaaucagccc

SEQ ID NO: 3813951 - RNA, 16 nt, Salmonella typhimurium LT2
cggcgugucagggcgg

SEQ ID NO: 3813952 - RNA, 16 nt, Salmonella typhimurium LT2
cggcguuaacgucgcc

SEQ ID NO: 3813953 - RNA, 19 nt, Salmonella typhimurium LT2
cggcguuuauccaaauccu

SEQ ID NO: 3813954 - RNA, 16 nt, Salmonella typhimurium LT2
cggcguuucguuuagc

SEQ ID NO: 3813955 - RNA, 15 nt, Salmonella typhimurium LT2
cggcguuugcuguuu

SEQ ID NO: 3813956 - RNA, 17 nt, Salmonella typhimurium LT2
cggcguuuugcgcgcca

SEQ ID NO: 3813957 - RNA, 19 nt, Salmonella typhimurium LT2
cggcguuuuuuuaucaggc

SEQ ID NO: 3813958 - RNA, 17 nt, Salmonella typhimurium LT2
cggcuaaucaccaccuc

SEQ ID NO: 3813959 - RNA, 16 nt, Salmonella typhimurium LT2
cggcuaccgaaggcgc

SEQ ID NO: 3813960 - RNA, 15 nt, Salmonella typhimurium LT2
cggcuacgccuuacc

SEQ ID NO: 3813961 - RNA, 18 nt, Salmonella typhimurium LT2
cggcuacgcucacgcgca

SEQ ID NO: 3813962 - RNA, 14 nt, Salmonella typhimurium LT2
cggcuacgggcggu

SEQ ID NO: 3813963 - RNA, 20 nt, Salmonella typhimurium LT2
cggcuauguagcgcugaagc

SEQ ID NO: 3813964 - RNA, 21 nt, Salmonella typhimurium LT2
cggcuauguagcgcugaagcc

SEQ ID NO: 3813965 - RNA, 22 nt, Salmonella typhimurium LT2
cggcuauuagcguuuuuaccgg

SEQ ID NO: 3813966 - RNA, 24 nt, Salmonella typhimurium LT2
cggcucaccagcugacgcagcagc

SEQ ID NO: 3813967 - RNA, 21 nt, Salmonella typhimurium LT2
cggcucagacaguagcggcga

SEQ ID NO: 3813968 - RNA, 13 nt, Salmonella typhimurium LT2
cggcucauccagc

SEQ ID NO: 3813969 - RNA, 16 nt, Salmonella typhimurium LT2
cggcucauccagcaac

SEQ ID NO: 3813970 - RNA, 17 nt, Salmonella typhimurium LT2
cggcucauccagcaaca

SEQ ID NO: 3813971 - RNA, 17 nt, Salmonella typhimurium LT2
cggcuccagauugcuca

SEQ ID NO: 3813972 - RNA, 22 nt, Salmonella typhimurium LT2
cggcuccagauugcucagguua

SEQ ID NO: 3813973 - RNA, 14 nt, Salmonella typhimurium LT2
cggcuccagcgccu

SEQ ID NO: 3813974 - RNA, 12 nt, Salmonella typhimurium LT2
cggcucccauuu

SEQ ID NO: 3813975 - RNA, 13 nt, Salmonella typhimurium LT2
cgggccugccagg

SEQ ID NO: 3813976 - RNA, 14 nt, Salmonella typhimurium LT2
cgggccugccaggu

SEQ ID NO: 3813977 - RNA, 18 nt, Salmonella typhimurium LT2
cgggccugccuguuuacg

SEQ ID NO: 3813978 - RNA, 14 nt, Salmonella typhimurium LT2
cgggccugcggcga

SEQ ID NO: 3813979 - RNA, 15 nt, Salmonella typhimurium LT2
cgggcgaccacccgc

SEQ ID NO: 3813980 - RNA, 14 nt, Salmonella typhimurium LT2
cgggcgaggccucg

SEQ ID NO: 3813981 - RNA, 15 nt, Salmonella typhimurium LT2
cgggcgauaaaccag

SEQ ID NO: 3813982 - RNA, 23 nt, Salmonella typhimurium LT2
cgggcgauaaccucucaccgccc

SEQ ID NO: 3813983 - RNA, 23 nt, Salmonella typhimurium LT2
cgggcgcaaucaucaccacccgc

SEQ ID NO: 3813984 - RNA, 16 nt, Salmonella typhimurium LT2
cgggcgcgcgcgcaga

SEQ ID NO: 3813985 - RNA, 22 nt, Salmonella typhimurium LT2
cgggcggguguucccugcccgu

SEQ ID NO: 3813986 - RNA, 20 nt, Salmonella typhimurium LT2
cgggcgguaaguuccggcuc

SEQ ID NO: 3813987 - RNA, 22 nt, Salmonella typhimurium LT2
cgggcgguauuauccgccgcaa

SEQ ID NO: 3813988 - RNA, 16 nt, Salmonella typhimurium LT2
cgggcgguugccacuc

SEQ ID NO: 3813989 - RNA, 22 nt, Salmonella typhimurium LT2
cgggcuaaaccacucguucccg

SEQ ID NO: 3813990 - RNA, 19 nt, Salmonella typhimurium LT2
cgggcuaaaugcccacggc

SEQ ID NO: 3813991 - RNA, 13 nt, Salmonella typhimurium LT2
cgggcuauaggcc

SEQ ID NO: 3813992 - RNA, 22 nt, Salmonella typhimurium LT2
cgggcuccauagggcagggugc

SEQ ID NO: 3813993 - RNA, 12 nt, Salmonella typhimurium LT2
cgggcugaccgc

SEQ ID NO: 3813994 - RNA, 15 nt, Salmonella typhimurium LT2
cgggcuggcgcguca

SEQ ID NO: 3813995 - RNA, 22 nt, Salmonella typhimurium LT2
cgggcuggcuggcgcaauguuc

SEQ ID NO: 3813996 - RNA, 21 nt, Salmonella typhimurium LT2
cgggcuuaacccaacgccugu

SEQ ID NO: 3813997 - RNA, 12 nt, Salmonella typhimurium LT2
cgggcuucauac

SEQ ID NO: 3813998 - RNA, 20 nt, Salmonella typhimurium LT2
cggggaacacaauuaaagcc

SEQ ID NO: 3813999 - RNA, 14 nt, Salmonella typhimurium LT2
cggggaagggugag

SEQ ID NO: 3814000 - RNA, 16 nt, Salmonella typhimurium LT2
cggggagacgggcgga

SEQ ID NO: 3814001 - RNA, 16 nt, Salmonella typhimurium LT2
cggggauaaucagcag

SEQ ID NO: 3814002 - RNA, 14 nt, Salmonella typhimurium LT2
cggggccagcgcca

SEQ ID NO: 3814003 - RNA, 13 nt, Salmonella typhimurium LT2
cggggcgcaaaau

SEQ ID NO: 3814004 - RNA, 22 nt, Salmonella typhimurium LT2
cggggcucccacucuuccagca

SEQ ID NO: 3814005 - RNA, 24 nt, Salmonella typhimurium LT2
cggggcuuuugagucgcauccagu

SEQ ID NO: 3814006 - RNA, 15 nt, Salmonella typhimurium LT2
cgggggccggccgcg

SEQ ID NO: 3814007 - RNA, 21 nt, Salmonella typhimurium LT2
cgggggcgacaaacagcgccc

SEQ ID NO: 3814008 - RNA, 17 nt, Salmonella typhimurium LT2
cgggggcgaucagcagg

SEQ ID NO: 3814009 - RNA, 17 nt, Salmonella typhimurium LT2
cggggguaacaauaggc

SEQ ID NO: 3814010 - RNA, 17 nt, Salmonella typhimurium LT2
cggggguguugcaauaa

SEQ ID NO: 3814011 - RNA, 15 nt, Salmonella typhimurium LT2
cgggguaaaauggac

SEQ ID NO: 3814012 - RNA, 15 nt, Salmonella typhimurium LT2
cggggugucggagca

SEQ ID NO: 3814013 - RNA, 14 nt, Salmonella typhimurium LT2
cgggguuugcagau

SEQ ID NO: 3814014 - RNA, 18 nt, Salmonella typhimurium LT2
cgggguuugcagaugugc

SEQ ID NO: 3814015 - RNA, 21 nt, Salmonella typhimurium LT2
cggguaauguuuacuccauuc

SEQ ID NO: 3814016 - RNA, 17 nt, Salmonella typhimurium LT2
cggguaauucaaucuca

SEQ ID NO: 3814017 - RNA, 23 nt, Salmonella typhimurium LT2
cggguaauuuugccaucgcgcac

SEQ ID NO: 3814018 - RNA, 17 nt, Salmonella typhimurium LT2
cggguagaaauuccuuc

SEQ ID NO: 3814019 - RNA, 22 nt, Salmonella typhimurium LT2
cggguaggcugcuugagccagu

SEQ ID NO: 3814020 - RNA, 22 nt, Salmonella typhimurium LT2
cggguaggugauggugccgccg

SEQ ID NO: 3814021 - RNA, 19 nt, Salmonella typhimurium LT2
cggguauccauugccagau

SEQ ID NO: 3814022 - RNA, 13 nt, Salmonella typhimurium LT2
cgggucagcgucu

SEQ ID NO: 3814023 - RNA, 19 nt, Salmonella typhimurium LT2
cgggucagcgucugcccca

SEQ ID NO: 3814024 - RNA, 23 nt, Salmonella typhimurium LT2
cgggucaugguaggccugauaag

SEQ ID NO: 3814025 - RNA, 15 nt, Salmonella typhimurium LT2
cggguccugaucggc

SEQ ID NO: 3814026 - RNA, 21 nt, Salmonella typhimurium LT2
cgggugacgcuaacgcgcacc

SEQ ID NO: 3814027 - RNA, 17 nt, Salmonella typhimurium LT2
cgggugaucuuuauaaa

SEQ ID NO: 3814028 - RNA, 16 nt, Salmonella typhimurium LT2
cgggugauuucacgca

SEQ ID NO: 3814029 - RNA, 14 nt, Salmonella typhimurium LT2
cgggugcgcagcaa

SEQ ID NO: 3814030 - RNA, 21 nt, Salmonella typhimurium LT2
cgggugcgcagccccagcgcc

SEQ ID NO: 3814031 - RNA, 19 nt, Salmonella typhimurium LT2
cggguguucaccgcuacau

SEQ ID NO: 3814032 - RNA, 16 nt, Salmonella typhimurium LT2
cggguucacaucauua

SEQ ID NO: 3814033 - RNA, 22 nt, Salmonella typhimurium LT2
cggguucagcgacaggcugucg

SEQ ID NO: 3814034 - RNA, 17 nt, Salmonella typhimurium LT2
cggguugccccggcuua

SEQ ID NO: 3814035 - RNA, 21 nt, Salmonella typhimurium LT2
cggguuguuguucauggucag

SEQ ID NO: 3814036 - RNA, 16 nt, Salmonella typhimurium LT2
cgguaaaaacagccau

SEQ ID NO: 3814037 - RNA, 16 nt, Salmonella typhimurium LT2
cgguaaaccaggccag

SEQ ID NO: 3814038 - RNA, 17 nt, Salmonella typhimurium LT2
cgguaaaccaggccagc

SEQ ID NO: 3814039 - RNA, 18 nt, Salmonella typhimurium LT2
cgguaaaccaggccagcg

SEQ ID NO: 3814040 - RNA, 13 nt, Salmonella typhimurium LT2
cgguaaacgucga

SEQ ID NO: 3814041 - RNA, 23 nt, Salmonella typhimurium LT2
cgguaaagguaauaucauccggu

SEQ ID NO: 3814042 - RNA, 19 nt, Salmonella typhimurium LT2
cgguaaaggucgccgcauc

SEQ ID NO: 3814043 - RNA, 23 nt, Salmonella typhimurium LT2
cgguaaaucaacaaccggcuggc

SEQ ID NO: 3814044 - RNA, 22 nt, Salmonella typhimurium LT2
cgguaaaugcuuaucugaugaa

SEQ ID NO: 3814045 - RNA, 16 nt, Salmonella typhimurium LT2
cgguaaccauccauuc

SEQ ID NO: 3814046 - RNA, 17 nt, Salmonella typhimurium LT2
cgguaacgcaacucauc

SEQ ID NO: 3814047 - RNA, 15 nt, Salmonella typhimurium LT2
cgguaacguaacugg

SEQ ID NO: 3814048 - RNA, 21 nt, Salmonella typhimurium LT2
cgguaacguaacuggauuccu

SEQ ID NO: 3814049 - RNA, 23 nt, Salmonella typhimurium LT2
cgguaagaaugcgcgucaggcca

SEQ ID NO: 3814050 - RNA, 14 nt, Salmonella typhimurium LT2
cgguaagcacaacg

SEQ ID NO: 3814051 - RNA, 17 nt, Salmonella typhimurium LT2
cgguaagcacaacgcau

SEQ ID NO: 3814052 - RNA, 13 nt, Salmonella typhimurium LT2
cgguaagccgaaa

SEQ ID NO: 3814053 - RNA, 20 nt, Salmonella typhimurium LT2
cgguaagcuguuccggcuuc

SEQ ID NO: 3814054 - RNA, 16 nt, Salmonella typhimurium LT2
cgguaaggccaaucaa

SEQ ID NO: 3814055 - RNA, 23 nt, Salmonella typhimurium LT2
cgguaauagagauccuggcgaaa

SEQ ID NO: 3814056 - RNA, 23 nt, Salmonella typhimurium LT2
cgguaauauauuucacuucauca

SEQ ID NO: 3814057 - RNA, 19 nt, Salmonella typhimurium LT2
cgguaaucacgucauuaaa

SEQ ID NO: 3814058 - RNA, 16 nt, Salmonella typhimurium LT2
cgguaaucccuucacg

SEQ ID NO: 3814059 - RNA, 22 nt, Salmonella typhimurium LT2
cgguaaucgaucccgccgcauc

SEQ ID NO: 3814060 - RNA, 15 nt, Salmonella typhimurium LT2
cgguaauugcgccgu

SEQ ID NO: 3814061 - RNA, 16 nt, Salmonella typhimurium LT2
cgguacacgcagucca

SEQ ID NO: 3814062 - RNA, 14 nt, Salmonella typhimurium LT2
cgguaccaccagcg

SEQ ID NO: 3814063 - RNA, 17 nt, Salmonella typhimurium LT2
cgguacgacugacuuca

SEQ ID NO: 3814064 - RNA, 17 nt, Salmonella typhimurium LT2
cgguacgcaucaccagg

SEQ ID NO: 3814065 - RNA, 18 nt, Salmonella typhimurium LT2
cgguacgcuccagggcug

SEQ ID NO: 3814066 - RNA, 16 nt, Salmonella typhimurium LT2
cgguacggaacgucca

SEQ ID NO: 3814067 - RNA, 19 nt, Salmonella typhimurium LT2
cgguacggcgcugcucuuc

SEQ ID NO: 3814068 - RNA, 14 nt, Salmonella typhimurium LT2
cgguacuccccuuu

SEQ ID NO: 3814069 - RNA, 15 nt, Salmonella typhimurium LT2
cgguacuccccuuuu

SEQ ID NO: 3814070 - RNA, 20 nt, Salmonella typhimurium LT2
cgguagaaaguacaucauug

SEQ ID NO: 3814071 - RNA, 17 nt, Salmonella typhimurium LT2
cgguagcacuuuaaaca

SEQ ID NO: 3814072 - RNA, 14 nt, Salmonella typhimurium LT2
cgguagcgccgaug

SEQ ID NO: 3814073 - RNA, 20 nt, Salmonella typhimurium LT2
cgguaggccggauaaggcau

SEQ ID NO: 3814074 - RNA, 13 nt, Salmonella typhimurium LT2
cgguagguuuaaa

SEQ ID NO: 3814075 - RNA, 20 nt, Salmonella typhimurium LT2
cgguauaaauuuccgcagcc

SEQ ID NO: 3814076 - RNA, 14 nt, Salmonella typhimurium LT2
cgguauaacugccu

SEQ ID NO: 3814077 - RNA, 15 nt, Salmonella typhimurium LT2
cgguauauuucucaa

SEQ ID NO: 3814078 - RNA, 18 nt, Salmonella typhimurium LT2
cguaaacacguuaucuga

SEQ ID NO: 3814079 - RNA, 16 nt, Salmonella typhimurium LT2
cguaaagcgcauccag

SEQ ID NO: 3814080 - RNA, 12 nt, Salmonella typhimurium LT2
cguaaagcuggc

SEQ ID NO: 3814081 - RNA, 15 nt, Salmonella typhimurium LT2
cguaaagggaagguc

SEQ ID NO: 3814082 - RNA, 21 nt, Salmonella typhimurium LT2
cguaaauaccaccugccaaag

SEQ ID NO: 3814083 - RNA, 14 nt, Salmonella typhimurium LT2
cguaaauacccagg

SEQ ID NO: 3814084 - RNA, 17 nt, Salmonella typhimurium LT2
cguaaauacccaggcca

SEQ ID NO: 3814085 - RNA, 17 nt, Salmonella typhimurium LT2
cguaaauaccuuccggc

SEQ ID NO: 3814086 - RNA, 17 nt, Salmonella typhimurium LT2
cguaaaucugaaauaaa

SEQ ID NO: 3814087 - RNA, 20 nt, Salmonella typhimurium LT2
cguaaauuccuuguuuuaac

SEQ ID NO: 3814088 - RNA, 14 nt, Salmonella typhimurium LT2
cguaaauucugauu

SEQ ID NO: 3814089 - RNA, 23 nt, Salmonella typhimurium LT2
cguaacagacgcaucuuuuuccc

SEQ ID NO: 3814090 - RNA, 19 nt, Salmonella typhimurium LT2
cguaaccccugcccgcgau

SEQ ID NO: 3814091 - RNA, 13 nt, Salmonella typhimurium LT2
cguaacgccgucg

SEQ ID NO: 3814092 - RNA, 19 nt, Salmonella typhimurium LT2
cguaacgccgucggcagcc

SEQ ID NO: 3814093 - RNA, 15 nt, Salmonella typhimurium LT2
cguaacgguucggua

SEQ ID NO: 3814094 - RNA, 15 nt, Salmonella typhimurium LT2
cguaacguagcaauc

SEQ ID NO: 3814095 - RNA, 17 nt, Salmonella typhimurium LT2
cguaacgugcuccagcg

SEQ ID NO: 3814096 - RNA, 15 nt, Salmonella typhimurium LT2
cguaacuaaaauacu

SEQ ID NO: 3814097 - RNA, 19 nt, Salmonella typhimurium LT2
cguaacuggauuccuggcu

SEQ ID NO: 3814098 - RNA, 16 nt, Salmonella typhimurium LT2
cguaacuuauccacgc

SEQ ID NO: 3814099 - RNA, 14 nt, Salmonella typhimurium LT2
cguaagaucccagg

SEQ ID NO: 3814100 - RNA, 19 nt, Salmonella typhimurium LT2
cguaagaucgcgaggcaac

SEQ ID NO: 3814101 - RNA, 17 nt, Salmonella typhimurium LT2
cguaagccacugcccag

SEQ ID NO: 3814102 - RNA, 22 nt, Salmonella typhimurium LT2
cguaagccacugcccagagaau

SEQ ID NO: 3814103 - RNA, 17 nt, Salmonella typhimurium LT2
cguaaggaauccagcgc

SEQ ID NO: 3814104 - RNA, 19 nt, Salmonella typhimurium LT2
cguaauacguaaaccgcuc

SEQ ID NO: 3814105 - RNA, 14 nt, Salmonella typhimurium LT2
cguaauaugcacac

SEQ ID NO: 3814106 - RNA, 13 nt, Salmonella typhimurium LT2
cguaaucaucgcg

SEQ ID NO: 3814107 - RNA, 19 nt, Salmonella typhimurium LT2
cguaaucaucgcgaucgcc

SEQ ID NO: 3814108 - RNA, 21 nt, Salmonella typhimurium LT2
cguaaucaucgcgaucgccaa

SEQ ID NO: 3814109 - RNA, 14 nt, Salmonella typhimurium LT2
cguaaucggccugu

SEQ ID NO: 3814110 - RNA, 22 nt, Salmonella typhimurium LT2
cguaaucuuuucauauuauuug

SEQ ID NO: 3814111 - RNA, 21 nt, Salmonella typhimurium LT2
cguaaugaucaugcugcaccg

SEQ ID NO: 3814112 - RNA, 16 nt, Salmonella typhimurium LT2
cguaauggccaccagc

SEQ ID NO: 3814113 - RNA, 19 nt, Salmonella typhimurium LT2
cguaauuaaccgcgccgcu

SEQ ID NO: 3814114 - RNA, 17 nt, Salmonella typhimurium LT2
cguaauuaagcaacaua

SEQ ID NO: 3814115 - RNA, 15 nt, Salmonella typhimurium LT2
cguaauuaagccggg

SEQ ID NO: 3814116 - RNA, 19 nt, Salmonella typhimurium LT2
cguaauucaugcaacuuca

SEQ ID NO: 3814117 - RNA, 15 nt, Salmonella typhimurium LT2
cguaauugcgccugg

SEQ ID NO: 3814118 - RNA, 18 nt, Salmonella typhimurium LT2
cguaauuugcgacauggc

SEQ ID NO: 3814119 - RNA, 21 nt, Salmonella typhimurium LT2
cguacaaaggggccacaggcg

SEQ ID NO: 3814120 - RNA, 18 nt, Salmonella typhimurium LT2
cguacauaacagcagcag

SEQ ID NO: 3814121 - RNA, 23 nt, Salmonella typhimurium LT2
cguaccaauacccagcgccaacg

SEQ ID NO: 3814122 - RNA, 16 nt, Salmonella typhimurium LT2
cguaccauauucaacu

SEQ ID NO: 3814123 - RNA, 14 nt, Salmonella typhimurium LT2
cguaccgcgcgccc

SEQ ID NO: 3814124 - RNA, 18 nt, Salmonella typhimurium LT2
cguaccgcggcgcugcag

SEQ ID NO: 3814125 - RNA, 16 nt, Salmonella typhimurium LT2
cguaccgcuaucgcca

SEQ ID NO: 3814126 - RNA, 23 nt, Salmonella typhimurium LT2
cguaccguauccuuccagcccgu

SEQ ID NO: 3814127 - RNA, 20 nt, Salmonella typhimurium LT2
cguaccgucuggcgaggcgc

SEQ ID NO: 3814128 - RNA, 15 nt, Salmonella typhimurium LT2
cguaccuccagcgac

SEQ ID NO: 3814129 - RNA, 18 nt, Salmonella typhimurium LT2
cguaccuguaggccuggu

SEQ ID NO: 3814130 - RNA, 16 nt, Salmonella typhimurium LT2
cguacgcggcuugcca

SEQ ID NO: 3814131 - RNA, 14 nt, Salmonella typhimurium LT2
cguacggcgucgug

SEQ ID NO: 3814132 - RNA, 15 nt, Salmonella typhimurium LT2
cguacggcugccuuu

SEQ ID NO: 3814133 - RNA, 18 nt, Salmonella typhimurium LT2
cguacgggcaaagcgacg

SEQ ID NO: 3814134 - RNA, 15 nt, Salmonella typhimurium LT2
cguacgguuacaacc

SEQ ID NO: 3814135 - RNA, 22 nt, Salmonella typhimurium LT2
cguacucagaucggcagacagu

SEQ ID NO: 3814136 - RNA, 14 nt, Salmonella typhimurium LT2
cguacucagcagac

SEQ ID NO: 3814137 - RNA, 15 nt, Salmonella typhimurium LT2
cguacucagcagacc

SEQ ID NO: 3814138 - RNA, 21 nt, Salmonella typhimurium LT2
cguacuccaggcgcugcuggc

SEQ ID NO: 3814139 - RNA, 19 nt, Salmonella typhimurium LT2
cguacucggauagcuacga

SEQ ID NO: 3814140 - RNA, 19 nt, Salmonella typhimurium LT2
cguacugaguucgcucagu

SEQ ID NO: 3814141 - RNA, 17 nt, Salmonella typhimurium LT2
cguacugcaacgcgcau

SEQ ID NO: 3814142 - RNA, 13 nt, Salmonella typhimurium LT2
cguacuuucaaac

SEQ ID NO: 3814143 - RNA, 20 nt, Salmonella typhimurium LT2
cguacuuucaaacagcuggc

SEQ ID NO: 3814144 - RNA, 14 nt, Salmonella typhimurium LT2
cguacuuucgccag

SEQ ID NO: 3814145 - RNA, 13 nt, Salmonella typhimurium LT2
cguagaucgccag

SEQ ID NO: 3814146 - RNA, 20 nt, Salmonella typhimurium LT2
cguagaucucuaucggcaaa

SEQ ID NO: 3814147 - RNA, 15 nt, Salmonella typhimurium LT2
cguagaucuuuugcg

SEQ ID NO: 3814148 - RNA, 18 nt, Salmonella typhimurium LT2
cguagauuuucaucauau

SEQ ID NO: 3814149 - RNA, 24 nt, Salmonella typhimurium LT2
cguagcaucucuucgacaucuuca

SEQ ID NO: 3814150 - RNA, 16 nt, Salmonella typhimurium LT2
cguagccaacacauca

SEQ ID NO: 3814151 - RNA, 21 nt, Salmonella typhimurium LT2
cguagccgaccaccauccggc

SEQ ID NO: 3814152 - RNA, 15 nt, Salmonella typhimurium LT2
cguagccgcgccaga

SEQ ID NO: 3814153 - RNA, 12 nt, Salmonella typhimurium LT2
cguagccgcgcg

SEQ ID NO: 3814154 - RNA, 14 nt, Salmonella typhimurium LT2
cguagccgcgcgcc

SEQ ID NO: 3814155 - RNA, 22 nt, Salmonella typhimurium LT2
cguagccgcuuacucagccaga

SEQ ID NO: 3814156 - RNA, 19 nt, Salmonella typhimurium LT2
cguagcgaauaaucccggc

SEQ ID NO: 3814157 - RNA, 23 nt, Salmonella typhimurium LT2
cguagcgaauaaucccggcgcca

SEQ ID NO: 3814158 - RNA, 18 nt, Salmonella typhimurium LT2
cguagcgagaaggcuuuu

SEQ ID NO: 3814159 - RNA, 15 nt, Salmonella typhimurium LT2
cguagcgcauccggc

SEQ ID NO: 3814160 - RNA, 16 nt, Salmonella typhimurium LT2
cguagcgccaucaggc

SEQ ID NO: 3814161 - RNA, 18 nt, Salmonella typhimurium LT2
cguagcgccaucaggcau

SEQ ID NO: 3814162 - RNA, 14 nt, Salmonella typhimurium LT2
cguagcgccauccg

SEQ ID NO: 3814163 - RNA, 19 nt, Salmonella typhimurium LT2
cguagcgccauccggcaau

SEQ ID NO: 3814164 - RNA, 20 nt, Salmonella typhimurium LT2
cguagcguacugcagcgucu

SEQ ID NO: 3814165 - RNA, 13 nt, Salmonella typhimurium LT2
cguagcuccagac

SEQ ID NO: 3814166 - RNA, 20 nt, Salmonella typhimurium LT2
cguaggccccgccauccggc

SEQ ID NO: 3814167 - RNA, 13 nt, Salmonella typhimurium LT2
cguaggccggaua

SEQ ID NO: 3814168 - RNA, 20 nt, Salmonella typhimurium LT2
cguaggccggauaagacgcg

SEQ ID NO: 3814169 - RNA, 23 nt, Salmonella typhimurium LT2
cguaggccggauaagacgcgcag

SEQ ID NO: 3814170 - RNA, 19 nt, Salmonella typhimurium LT2
cguaggccggauaagcgug

SEQ ID NO: 3814171 - RNA, 19 nt, Salmonella typhimurium LT2
cguaggccggauaaggcau

SEQ ID NO: 3814172 - RNA, 19 nt, Salmonella typhimurium LT2
cguaggccugauaagcgca

SEQ ID NO: 3814173 - RNA, 20 nt, Salmonella typhimurium LT2
cguaggccugauaagcgcag

SEQ ID NO: 3814174 - RNA, 22 nt, Salmonella typhimurium LT2
cguaggccugauaagcgcagcg

SEQ ID NO: 3814175 - RNA, 13 nt, Salmonella typhimurium LT2
cguaggcggcgga

SEQ ID NO: 3814176 - RNA, 13 nt, Salmonella typhimurium LT2
cguaguaagcgga

SEQ ID NO: 3814177 - RNA, 13 nt, Salmonella typhimurium LT2
cguaguacgcgcg

SEQ ID NO: 3814178 - RNA, 20 nt, Salmonella typhimurium LT2
cguaguagguauccagcaga

SEQ ID NO: 3814179 - RNA, 15 nt, Salmonella typhimurium LT2
cguagucagcgacgc

SEQ ID NO: 3814180 - RNA, 15 nt, Salmonella typhimurium LT2
cguagucaggcagca

SEQ ID NO: 3814181 - RNA, 17 nt, Salmonella typhimurium LT2
cguagucguuguaggcc

SEQ ID NO: 3814182 - RNA, 23 nt, Salmonella typhimurium LT2
cgucccaccacgcagccauguaa

SEQ ID NO: 3814183 - RNA, 13 nt, Salmonella typhimurium LT2
cgucccacgucag

SEQ ID NO: 3814184 - RNA, 21 nt, Salmonella typhimurium LT2
cgucccagcacaaucccggca

SEQ ID NO: 3814185 - RNA, 16 nt, Salmonella typhimurium LT2
cgucccagcggauguc

SEQ ID NO: 3814186 - RNA, 13 nt, Salmonella typhimurium LT2
cguccccagccag

SEQ ID NO: 3814187 - RNA, 14 nt, Salmonella typhimurium LT2
cguccccagccaga

SEQ ID NO: 3814188 - RNA, 18 nt, Salmonella typhimurium LT2
cguccccagccagagauc

SEQ ID NO: 3814189 - RNA, 21 nt, Salmonella typhimurium LT2
cgucccgacgaacgaagagcc

SEQ ID NO: 3814190 - RNA, 20 nt, Salmonella typhimurium LT2
cgucccggucggcgcauggc

SEQ ID NO: 3814191 - RNA, 13 nt, Salmonella typhimurium LT2
cgucccucgccgg

SEQ ID NO: 3814192 - RNA, 13 nt, Salmonella typhimurium LT2
cgucccugcuggc

SEQ ID NO: 3814193 - RNA, 15 nt, Salmonella typhimurium LT2
cgucccuuccgccac

SEQ ID NO: 3814194 - RNA, 14 nt, Salmonella typhimurium LT2
cgucccuuucccuu

SEQ ID NO: 3814195 - RNA, 21 nt, Salmonella typhimurium LT2
cgucccuuucccuuccagcga

SEQ ID NO: 3814196 - RNA, 14 nt, Salmonella typhimurium LT2
cguccgccaacagc

SEQ ID NO: 3814197 - RNA, 12 nt, Salmonella typhimurium LT2
cguccgccaggc

SEQ ID NO: 3814198 - RNA, 22 nt, Salmonella typhimurium LT2
cguccggggccagcgccaguac

SEQ ID NO: 3814199 - RNA, 17 nt, Salmonella typhimurium LT2
cguccgguagagaacga

SEQ ID NO: 3814200 - RNA, 18 nt, Salmonella typhimurium LT2
cguccgucaggaugggcu

SEQ ID NO: 3814201 - RNA, 15 nt, Salmonella typhimurium LT2
cguccuaggacgaaa

SEQ ID NO: 3814202 - RNA, 21 nt, Salmonella typhimurium LT2
cguccuaggacgaaaaaugaa

SEQ ID NO: 3814203 - RNA, 14 nt, Salmonella typhimurium LT2
cguccuccagcgug

SEQ ID NO: 3814204 - RNA, 15 nt, Salmonella typhimurium LT2
cguccugcccgccac

SEQ ID NO: 3814205 - RNA, 20 nt, Salmonella typhimurium LT2
cguccuucacguuauucgga

SEQ ID NO: 3814206 - RNA, 14 nt, Salmonella typhimurium LT2
cguccuuuaucaga

SEQ ID NO: 3814207 - RNA, 17 nt, Salmonella typhimurium LT2
cgucgacaaagccaacg

SEQ ID NO: 3814208 - RNA, 14 nt, Salmonella typhimurium LT2
cgucgacccgcccc

SEQ ID NO: 3814209 - RNA, 16 nt, Salmonella typhimurium LT2
cgucgacguuuuucag

SEQ ID NO: 3814210 - RNA, 18 nt, Salmonella typhimurium LT2
cgucgagaaaccgcucgc

SEQ ID NO: 3814211 - RNA, 14 nt, Salmonella typhimurium LT2
cgucgagacggugu

SEQ ID NO: 3814212 - RNA, 14 nt, Salmonella typhimurium LT2
cgucgagcagcagg

SEQ ID NO: 3814213 - RNA, 13 nt, Salmonella typhimurium LT2
cgucgagcgccgu

SEQ ID NO: 3814214 - RNA, 15 nt, Salmonella typhimurium LT2
cgucgagcgccguca

SEQ ID NO: 3814215 - RNA, 20 nt, Salmonella typhimurium LT2
cgucgaggaucaucuccgac

SEQ ID NO: 3814216 - RNA, 17 nt, Salmonella typhimurium LT2
cgucgaucucaggcuua

SEQ ID NO: 3814217 - RNA, 15 nt, Salmonella typhimurium LT2
cgucgaugugaaucc

SEQ ID NO: 3814218 - RNA, 20 nt, Salmonella typhimurium LT2
cgucgccaaagcagcugcug

SEQ ID NO: 3814219 - RNA, 13 nt, Salmonella typhimurium LT2
cgucgccagcguu

SEQ ID NO: 3814220 - RNA, 14 nt, Salmonella typhimurium LT2
cgucgccagggcgg

SEQ ID NO: 3814221 - RNA, 21 nt, Salmonella typhimurium LT2
cgucgccauccaccaggacau

SEQ ID NO: 3814222 - RNA, 16 nt, Salmonella typhimurium LT2
cgucgccauccggcga

SEQ ID NO: 3814223 - RNA, 17 nt, Salmonella typhimurium LT2
cgucgccggaaugcgaa

SEQ ID NO: 3814224 - RNA, 18 nt, Salmonella typhimurium LT2
cgucgccuguccggccug

SEQ ID NO: 3814225 - RNA, 15 nt, Salmonella typhimurium LT2
cgucgcgaagcugug

SEQ ID NO: 3814226 - RNA, 15 nt, Salmonella typhimurium LT2
cgucgcgaucacaga

SEQ ID NO: 3814227 - RNA, 14 nt, Salmonella typhimurium LT2
cgucgcgcgccgcc

SEQ ID NO: 3814228 - RNA, 16 nt, Salmonella typhimurium LT2
cgucgcgcgccgccug

SEQ ID NO: 3814229 - RNA, 20 nt, Salmonella typhimurium LT2
cgucgcgcgccgccugcgcu

SEQ ID NO: 3814230 - RNA, 23 nt, Salmonella typhimurium LT2
cgucgcgcucguaggccagcgcu

SEQ ID NO: 3814231 - RNA, 15 nt, Salmonella typhimurium LT2
cgucgcuaaucagca

SEQ ID NO: 3814232 - RNA, 15 nt, Salmonella typhimurium LT2
cgucgcuacaggcaa

SEQ ID NO: 3814233 - RNA, 16 nt, Salmonella typhimurium LT2
cgucgcuacgggcgcg

SEQ ID NO: 3814234 - RNA, 11 nt, Salmonella typhimurium LT2
cgucggacagg

SEQ ID NO: 3814235 - RNA, 23 nt, Salmonella typhimurium LT2
cgucggcaauuaacauuucacga

SEQ ID NO: 3814236 - RNA, 14 nt, Salmonella typhimurium LT2
cgucggcaccauuc

SEQ ID NO: 3814237 - RNA, 20 nt, Salmonella typhimurium LT2
cgucggcauggucagcauaa

SEQ ID NO: 3814238 - RNA, 15 nt, Salmonella typhimurium LT2
cgucggccagcgccg

SEQ ID NO: 3814239 - RNA, 17 nt, Salmonella typhimurium LT2
cgucggcgccagccaca

SEQ ID NO: 3814240 - RNA, 16 nt, Salmonella typhimurium LT2
cgucgggccauucccc

SEQ ID NO: 3814241 - RNA, 23 nt, Salmonella typhimurium LT2
cgucgggccgcgcugcgccugcu

SEQ ID NO: 3814242 - RNA, 13 nt, Salmonella typhimurium LT2
cgucgguaaaaau

SEQ ID NO: 3814243 - RNA, 22 nt, Salmonella typhimurium LT2
cgucgguaaaaaugcaaugucu

SEQ ID NO: 3814244 - RNA, 14 nt, Salmonella typhimurium LT2
cgucggucgcguag

SEQ ID NO: 3814245 - RNA, 23 nt, Salmonella typhimurium LT2
cgucggugguuuuaacccccagc

SEQ ID NO: 3814246 - RNA, 21 nt, Salmonella typhimurium LT2
cgucgguucgucgagcagcag

SEQ ID NO: 3814247 - RNA, 14 nt, Salmonella typhimurium LT2
cgucguaaaaccug

SEQ ID NO: 3814248 - RNA, 17 nt, Salmonella typhimurium LT2
cgucgugaguggcggca

SEQ ID NO: 3814249 - RNA, 21 nt, Salmonella typhimurium LT2
cgucgugaguggcggcacgca

SEQ ID NO: 3814250 - RNA, 16 nt, Salmonella typhimurium LT2
cgucguuaaucagcgc

SEQ ID NO: 3814251 - RNA, 17 nt, Salmonella typhimurium LT2
cgucguuucguguuguc

SEQ ID NO: 3814252 - RNA, 15 nt, Salmonella typhimurium LT2
cgucuacgucaggaa

SEQ ID NO: 3814253 - RNA, 23 nt, Salmonella typhimurium LT2
cgucucgccgcggugauccuccu

SEQ ID NO: 3814254 - RNA, 14 nt, Salmonella typhimurium LT2
cgucucggccuggc

SEQ ID NO: 3814255 - RNA, 18 nt, Salmonella typhimurium LT2
cgucucugagaucaaaca

SEQ ID NO: 3814256 - RNA, 16 nt, Salmonella typhimurium LT2
cgucucuuucauggaa

SEQ ID NO: 3814257 - RNA, 17 nt, Salmonella typhimurium LT2
cgucugcgucuucuucc

SEQ ID NO: 3814258 - RNA, 23 nt, Salmonella typhimurium LT2
cgucugcugaccaaacugcggaa

SEQ ID NO: 3814259 - RNA, 22 nt, Salmonella typhimurium LT2
cgucuguuucaacacauccagc

SEQ ID NO: 3814260 - RNA, 17 nt, Salmonella typhimurium LT2
cgucuuaaugcucucca

SEQ ID NO: 3814261 - RNA, 13 nt, Salmonella typhimurium LT2
cgucuucauccca

SEQ ID NO: 3814262 - RNA, 14 nt, Salmonella typhimurium LT2
cgucuucaucccag

SEQ ID NO: 3814263 - RNA, 13 nt, Salmonella typhimurium LT2
cgucuucaucuuc

SEQ ID NO: 3814264 - RNA, 14 nt, Salmonella typhimurium LT2
cgucuuccuuccac

SEQ ID NO: 3814265 - RNA, 23 nt, Salmonella typhimurium LT2
cgucuuuauucaucaucuugucc

SEQ ID NO: 3814266 - RNA, 22 nt, Salmonella typhimurium LT2
cgucuuuggcucuuagcagcau

SEQ ID NO: 3814267 - RNA, 24 nt, Salmonella typhimurium LT2
cgucuuuuagucacuccaggcguu

SEQ ID NO: 3814268 - RNA, 13 nt, Salmonella typhimurium LT2
cgucuuuuuccag

SEQ ID NO: 3814269 - RNA, 21 nt, Salmonella typhimurium LT2
cgugaaacuccccgccgcuga

SEQ ID NO: 3814270 - RNA, 13 nt, Salmonella typhimurium LT2
cgugaacacaccc

SEQ ID NO: 3814271 - RNA, 19 nt, Salmonella typhimurium LT2
cgugaacacacccuucuca

SEQ ID NO: 3814272 - RNA, 22 nt, Salmonella typhimurium LT2
cgugaacacacccuucucaggg

SEQ ID NO: 3814273 - RNA, 15 nt, Salmonella typhimurium LT2
cgugaaccagcaucc

SEQ ID NO: 3814274 - RNA, 19 nt, Salmonella typhimurium LT2
cgugaaccagcaucccacg

SEQ ID NO: 3814275 - RNA, 21 nt, Salmonella typhimurium LT2
cgugaaccagcaucccacgaa

SEQ ID NO: 3814276 - RNA, 21 nt, Salmonella typhimurium LT2
cgugaaccgaaauccaccagc

SEQ ID NO: 3814277 - RNA, 22 nt, Salmonella typhimurium LT2
cgugaaccgaaauccaccagcg

SEQ ID NO: 3814278 - RNA, 20 nt, Salmonella typhimurium LT2
cgugaaccuguuaucaggau

SEQ ID NO: 3814279 - RNA, 15 nt, Salmonella typhimurium LT2
cgugaagaucagcag

SEQ ID NO: 3814280 - RNA, 23 nt, Salmonella typhimurium LT2
cgugaauggucacauucugaccg

SEQ ID NO: 3814281 - RNA, 16 nt, Salmonella typhimurium LT2
cgugaccauuccggua

SEQ ID NO: 3814282 - RNA, 14 nt, Salmonella typhimurium LT2
cgugaccugcugac

SEQ ID NO: 3814283 - RNA, 18 nt, Salmonella typhimurium LT2
cgugaccuucaccugaau

SEQ ID NO: 3814284 - RNA, 23 nt, Salmonella typhimurium LT2
cgugacgccuuccuccaguaauu

SEQ ID NO: 3814285 - RNA, 14 nt, Salmonella typhimurium LT2
cgugacgcgccagc

SEQ ID NO: 3814286 - RNA, 17 nt, Salmonella typhimurium LT2
cgugacgcgccagcgga

SEQ ID NO: 3814287 - RNA, 23 nt, Salmonella typhimurium LT2
cgugacguucaucauuuucccac

SEQ ID NO: 3814288 - RNA, 22 nt, Salmonella typhimurium LT2
cgugagccacuauccagucagc

SEQ ID NO: 3814289 - RNA, 16 nt, Salmonella typhimurium LT2
cgugagcgaagcgccg

SEQ ID NO: 3814290 - RNA, 13 nt, Salmonella typhimurium LT2
cgugagcgcaucc

SEQ ID NO: 3814291 - RNA, 17 nt, Salmonella typhimurium LT2
cgugagcgcauccggca

SEQ ID NO: 3814292 - RNA, 21 nt, Salmonella typhimurium LT2
cgugagugguagaaacuggca

SEQ ID NO: 3814293 - RNA, 22 nt, Salmonella typhimurium LT2
cgugauaaacgguucagucagc

SEQ ID NO: 3814294 - RNA, 22 nt, Salmonella typhimurium LT2
cgugauaggagagcagaagcac

SEQ ID NO: 3814295 - RNA, 14 nt, Salmonella typhimurium LT2
cgugaucgaggcgc

SEQ ID NO: 3814296 - RNA, 16 nt, Salmonella typhimurium LT2
cgugaucgccaaagcg

SEQ ID NO: 3814297 - RNA, 19 nt, Salmonella typhimurium LT2
cgugaucgccaaagcguaa

SEQ ID NO: 3814298 - RNA, 22 nt, Salmonella typhimurium LT2
cgugaugauaggucagcgauuc

SEQ ID NO: 3814299 - RNA, 19 nt, Salmonella typhimurium LT2
cgugaugcgacgcgcucac

SEQ ID NO: 3814300 - RNA, 19 nt, Salmonella typhimurium LT2
cgugaugggcgaucgccgc

SEQ ID NO: 3814301 - RNA, 14 nt, Salmonella typhimurium LT2
cgugaugugguugu

SEQ ID NO: 3814302 - RNA, 14 nt, Salmonella typhimurium LT2
cgugauugagcaga

SEQ ID NO: 3814303 - RNA, 21 nt, Salmonella typhimurium LT2
cgugauugagcagaucagcac

SEQ ID NO: 3814304 - RNA, 22 nt, Salmonella typhimurium LT2
cgugauugagcagaucagcacg

SEQ ID NO: 3814305 - RNA, 20 nt, Salmonella typhimurium LT2
cgugauugauucgcgccagc

SEQ ID NO: 3814306 - RNA, 13 nt, Salmonella typhimurium LT2
cgugauugcugac

SEQ ID NO: 3814307 - RNA, 15 nt, Salmonella typhimurium LT2
cgugauuucaugcgg

SEQ ID NO: 3814308 - RNA, 21 nt, Salmonella typhimurium LT2
cgugauuuuggccucauccgc

SEQ ID NO: 3814309 - RNA, 18 nt, Salmonella typhimurium LT2
cgugcaacgucaugaccg

SEQ ID NO: 3814310 - RNA, 13 nt, Salmonella typhimurium LT2
cgugcacgcugcg

SEQ ID NO: 3814311 - RNA, 13 nt, Salmonella typhimurium LT2
cgugcagcgccgc

SEQ ID NO: 3814312 - RNA, 16 nt, Salmonella typhimurium LT2
cgugcagcgccgccug

SEQ ID NO: 3814313 - RNA, 23 nt, Salmonella typhimurium LT2
cgugcaggccggauaagccggau

SEQ ID NO: 3814314 - RNA, 17 nt, Salmonella typhimurium LT2
cgugcaguuuugcuuca

SEQ ID NO: 3814315 - RNA, 22 nt, Salmonella typhimurium LT2
cgugcaguuuugcuucaugcac

SEQ ID NO: 3814316 - RNA, 16 nt, Salmonella typhimurium LT2
cgugcauaaagcgguu

SEQ ID NO: 3814317 - RNA, 22 nt, Salmonella typhimurium LT2
cgugcaugggauacgccagcag

SEQ ID NO: 3814318 - RNA, 20 nt, Salmonella typhimurium LT2
cgugcccgguaagaaugcgc

SEQ ID NO: 3814319 - RNA, 14 nt, Salmonella typhimurium LT2
cgugccgaccagcg

SEQ ID NO: 3814320 - RNA, 16 nt, Salmonella typhimurium LT2
cgugccgaccagcggu

SEQ ID NO: 3814321 - RNA, 15 nt, Salmonella typhimurium LT2
cgugccugccgcaga

SEQ ID NO: 3814322 - RNA, 17 nt, Salmonella typhimurium LT2
cgugccugccgcagaag

SEQ ID NO: 3814323 - RNA, 21 nt, Salmonella typhimurium LT2
cgugcgaauuucggcaaugac

SEQ ID NO: 3814324 - RNA, 23 nt, Salmonella typhimurium LT2
cgugcgaauuucggcaaugacgg

SEQ ID NO: 3814325 - RNA, 23 nt, Salmonella typhimurium LT2
cgugcgagauaaccaucgcgcag

SEQ ID NO: 3814326 - RNA, 20 nt, Salmonella typhimurium LT2
cgugcgcuacggcuuccggc

SEQ ID NO: 3814327 - RNA, 19 nt, Salmonella typhimurium LT2
cgugcgcucagggucagaa

SEQ ID NO: 3814328 - RNA, 13 nt, Salmonella typhimurium LT2
cgugcgcuuccac

SEQ ID NO: 3814329 - RNA, 19 nt, Salmonella typhimurium LT2
cgugcggacguagggcugc

SEQ ID NO: 3814330 - RNA, 12 nt, Salmonella typhimurium LT2
cgugcggcgaag

SEQ ID NO: 3814331 - RNA, 21 nt, Salmonella typhimurium LT2
cgugcggcgaagcaucuuucc

SEQ ID NO: 3814332 - RNA, 17 nt, Salmonella typhimurium LT2
cgugcggcggacgccgg

SEQ ID NO: 3814333 - RNA, 15 nt, Salmonella typhimurium LT2
cgugcucauccaacu

SEQ ID NO: 3814334 - RNA, 15 nt, Salmonella typhimurium LT2
cgugcuguggaaaau

SEQ ID NO: 3814335 - RNA, 14 nt, Salmonella typhimurium LT2
cguggaagcggaac

SEQ ID NO: 3814336 - RNA, 18 nt, Salmonella typhimurium LT2
cguggacgcuuuuauccg

SEQ ID NO: 3814337 - RNA, 20 nt, Salmonella typhimurium LT2
cguggaucucgucgccggug

SEQ ID NO: 3814338 - RNA, 22 nt, Salmonella typhimurium LT2
cguggaugauguuucuucgccc

SEQ ID NO: 3814339 - RNA, 17 nt, Salmonella typhimurium LT2
cguggcauucgcuugcc

SEQ ID NO: 3814340 - RNA, 21 nt, Salmonella typhimurium LT2
cguggcgagcuucucgccgga

SEQ ID NO: 3814341 - RNA, 16 nt, Salmonella typhimurium LT2
cguggcgcaaccgaua

SEQ ID NO: 3814342 - RNA, 22 nt, Salmonella typhimurium LT2
cguggcgcguagguuggcugag

SEQ ID NO: 3814343 - RNA, 15 nt, Salmonella typhimurium LT2
cguggcguaucggca

SEQ ID NO: 3814344 - RNA, 11 nt, Salmonella typhimurium LT2
cgugggaacag

SEQ ID NO: 3814345 - RNA, 13 nt, Salmonella typhimurium LT2
cgugggaagcagc

SEQ ID NO: 3814346 - RNA, 15 nt, Salmonella typhimurium LT2
cgugggaagcagcag

SEQ ID NO: 3814347 - RNA, 19 nt, Salmonella typhimurium LT2
cgugggcuacggcucccuc

SEQ ID NO: 3814348 - RNA, 13 nt, Salmonella typhimurium LT2
cguggggguucaa

SEQ ID NO: 3814349 - RNA, 13 nt, Salmonella typhimurium LT2
cgugguaaaaagc

SEQ ID NO: 3814350 - RNA, 14 nt, Salmonella typhimurium LT2
cgugguaucgaaaa

SEQ ID NO: 3814351 - RNA, 21 nt, Salmonella typhimurium LT2
cgugguaucgcggcagcgcug

SEQ ID NO: 3814352 - RNA, 17 nt, Salmonella typhimurium LT2
cguggugcuuagcuggc

SEQ ID NO: 3814353 - RNA, 17 nt, Salmonella typhimurium LT2
cgugguuuccggcagcu

SEQ ID NO: 3814354 - RNA, 13 nt, Salmonella typhimurium LT2
cguguaaaugacg

SEQ ID NO: 3814355 - RNA, 21 nt, Salmonella typhimurium LT2
cguguaagagcuggucggauc

SEQ ID NO: 3814356 - RNA, 14 nt, Salmonella typhimurium LT2
cguguaaucgccgu

SEQ ID NO: 3814357 - RNA, 14 nt, Salmonella typhimurium LT2
cguguaccgucacu

SEQ ID NO: 3814358 - RNA, 15 nt, Salmonella typhimurium LT2
cguguagguaagaua

SEQ ID NO: 3814359 - RNA, 21 nt, Salmonella typhimurium LT2
cguguccggguucgcggcaaa

SEQ ID NO: 3814360 - RNA, 16 nt, Salmonella typhimurium LT2
cguguccucugcugcg

SEQ ID NO: 3814361 - RNA, 14 nt, Salmonella typhimurium LT2
cguguccuugccag

SEQ ID NO: 3814362 - RNA, 21 nt, Salmonella typhimurium LT2
cguguggucgcggcucaccag

SEQ ID NO: 3814363 - RNA, 17 nt, Salmonella typhimurium LT2
cguguuaccagcaacug

SEQ ID NO: 3814364 - RNA, 13 nt, Salmonella typhimurium LT2
cguguuguccggc

SEQ ID NO: 3814365 - RNA, 19 nt, Salmonella typhimurium LT2
cguuaaaacggaacggcuc

SEQ ID NO: 3814366 - RNA, 22 nt, Salmonella typhimurium LT2
cguuaaaacggaucagccugag

SEQ ID NO: 3814367 - RNA, 16 nt, Salmonella typhimurium LT2
cguuaaauaccagcac

SEQ ID NO: 3814368 - RNA, 22 nt, Salmonella typhimurium LT2
cguuaaauaccagcaccugaau

SEQ ID NO: 3814369 - RNA, 15 nt, Salmonella typhimurium LT2
cguuaaaucaacggc

SEQ ID NO: 3814370 - RNA, 20 nt, Salmonella typhimurium LT2
cguuaacccgcuuacaguuu

SEQ ID NO: 3814371 - RNA, 15 nt, Salmonella typhimurium LT2
cguuaacgccgccau

SEQ ID NO: 3814372 - RNA, 21 nt, Salmonella typhimurium LT2
cguuaacgcgggcguaauaca

SEQ ID NO: 3814373 - RNA, 15 nt, Salmonella typhimurium LT2
cguuaauaccgugca

SEQ ID NO: 3814374 - RNA, 12 nt, Salmonella typhimurium LT2
cguuaauuauuc

SEQ ID NO: 3814375 - RNA, 21 nt, Salmonella typhimurium LT2
cguuaauuuuuagcuaacucu

SEQ ID NO: 3814376 - RNA, 18 nt, Salmonella typhimurium LT2
cguuaccagcaucaauag

SEQ ID NO: 3814377 - RNA, 19 nt, Salmonella typhimurium LT2
cguuaccagcaucaauagc

SEQ ID NO: 3814378 - RNA, 23 nt, Salmonella typhimurium LT2
cguuaccccgcagcgaaaaucca

SEQ ID NO: 3814379 - RNA, 17 nt, Salmonella typhimurium LT2
cguuaccccuuuuucaa

SEQ ID NO: 3814380 - RNA, 20 nt, Salmonella typhimurium LT2
cguuacccgauaccgccagc

SEQ ID NO: 3814381 - RNA, 15 nt, Salmonella typhimurium LT2
cguuacccggccagc

SEQ ID NO: 3814382 - RNA, 18 nt, Salmonella typhimurium LT2
cguuacccggccagccgu

SEQ ID NO: 3814383 - RNA, 18 nt, Salmonella typhimurium LT2
cguuacccgugcgcgucg

SEQ ID NO: 3814384 - RNA, 16 nt, Salmonella typhimurium LT2
cguuaccguucaggca

SEQ ID NO: 3814385 - RNA, 17 nt, Salmonella typhimurium LT2
cguuaccguucaggcaa

SEQ ID NO: 3814386 - RNA, 22 nt, Salmonella typhimurium LT2
cguuacgcgccacgccauugcu

SEQ ID NO: 3814387 - RNA, 21 nt, Salmonella typhimurium LT2
cguuagcgagguucccgccgc

SEQ ID NO: 3814388 - RNA, 15 nt, Salmonella typhimurium LT2
cguuaggccacuuca

SEQ ID NO: 3814389 - RNA, 20 nt, Salmonella typhimurium LT2
cguuagugauuucgaacucu

SEQ ID NO: 3814390 - RNA, 13 nt, Salmonella typhimurium LT2
cuaccgccauacg

SEQ ID NO: 3814391 - RNA, 13 nt, Salmonella typhimurium LT2
cuaccgcuuccca

SEQ ID NO: 3814392 - RNA, 14 nt, Salmonella typhimurium LT2
cuaccggaaaacag

SEQ ID NO: 3814393 - RNA, 23 nt, Salmonella typhimurium LT2
cuaccggaccgguauuaccaaua

SEQ ID NO: 3814394 - RNA, 15 nt, Salmonella typhimurium LT2
cuaccggcaccagca

SEQ ID NO: 3814395 - RNA, 23 nt, Salmonella typhimurium LT2
cuaccggcgguucuuuugcuaac

SEQ ID NO: 3814396 - RNA, 19 nt, Salmonella typhimurium LT2
cuaccgucgacgucuuucu

SEQ ID NO: 3814397 - RNA, 22 nt, Salmonella typhimurium LT2
cuaccgucgacgucuuucuuaa

SEQ ID NO: 3814398 - RNA, 18 nt, Salmonella typhimurium LT2
cuaccguuucgaccguga

SEQ ID NO: 3814399 - RNA, 15 nt, Salmonella typhimurium LT2
cuaccuacguucccg

SEQ ID NO: 3814400 - RNA, 16 nt, Salmonella typhimurium LT2
cuaccugcgagcugua

SEQ ID NO: 3814401 - RNA, 15 nt, Salmonella typhimurium LT2
cuaccuucacacagu

SEQ ID NO: 3814402 - RNA, 17 nt, Salmonella typhimurium LT2
cuaccuucacccccauc

SEQ ID NO: 3814403 - RNA, 16 nt, Salmonella typhimurium LT2
cuaccuucuucccaua

SEQ ID NO: 3814404 - RNA, 17 nt, Salmonella typhimurium LT2
cuacgaacgcgaaggcc

SEQ ID NO: 3814405 - RNA, 13 nt, Salmonella typhimurium LT2
cuacgccaucauu

SEQ ID NO: 3814406 - RNA, 14 nt, Salmonella typhimurium LT2
cuacgccaucauug

SEQ ID NO: 3814407 - RNA, 13 nt, Salmonella typhimurium LT2
cuacgccauggca

SEQ ID NO: 3814408 - RNA, 19 nt, Salmonella typhimurium LT2
cuacgcgauaaaaaacgcc

SEQ ID NO: 3814409 - RNA, 15 nt, Salmonella typhimurium LT2
cuacgcucauaaaaa

SEQ ID NO: 3814410 - RNA, 15 nt, Salmonella typhimurium LT2
cuacgcuuaucaggc

SEQ ID NO: 3814411 - RNA, 17 nt, Salmonella typhimurium LT2
cuacgcuuauccggcuu

SEQ ID NO: 3814412 - RNA, 18 nt, Salmonella typhimurium LT2
cuacgcuucguauuucuu

SEQ ID NO: 3814413 - RNA, 19 nt, Salmonella typhimurium LT2
cuacggauuaugucugcug

SEQ ID NO: 3814414 - RNA, 22 nt, Salmonella typhimurium LT2
cuacgggucaugguaggccuga

SEQ ID NO: 3814415 - RNA, 15 nt, Salmonella typhimurium LT2
cuacgguaaacugga

SEQ ID NO: 3814416 - RNA, 14 nt, Salmonella typhimurium LT2
cuacggugugccug

SEQ ID NO: 3814417 - RNA, 20 nt, Salmonella typhimurium LT2
cuacgguuagcgaacgucca

SEQ ID NO: 3814418 - RNA, 13 nt, Salmonella typhimurium LT2
cuacguucaucag

SEQ ID NO: 3814419 - RNA, 15 nt, Salmonella typhimurium LT2
cuacguucaucaggc

SEQ ID NO: 3814420 - RNA, 14 nt, Salmonella typhimurium LT2
cuacguuccaugcg

SEQ ID NO: 3814421 - RNA, 20 nt, Salmonella typhimurium LT2
cuacguuggagaggaauugu

SEQ ID NO: 3814422 - RNA, 15 nt, Salmonella typhimurium LT2
cuacuaaauccuuga

SEQ ID NO: 3814423 - RNA, 24 nt, Salmonella typhimurium LT2
cuacuaucaucugacuaacacgua

SEQ ID NO: 3814424 - RNA, 14 nt, Salmonella typhimurium LT2
cuacucccgucgcc

SEQ ID NO: 3814425 - RNA, 15 nt, Salmonella typhimurium LT2
cuacucccgucgccu

SEQ ID NO: 3814426 - RNA, 22 nt, Salmonella typhimurium LT2
cuacucccgucgccuguuucug

SEQ ID NO: 3814427 - RNA, 14 nt, Salmonella typhimurium LT2
cuacucuugcgcca

SEQ ID NO: 3814428 - RNA, 14 nt, Salmonella typhimurium LT2
cuacuuccaccacc

SEQ ID NO: 3814429 - RNA, 15 nt, Salmonella typhimurium LT2
cuacuuccaccaccu

SEQ ID NO: 3814430 - RNA, 18 nt, Salmonella typhimurium LT2
cuacuuccaccaccuccu

SEQ ID NO: 3814431 - RNA, 15 nt, Salmonella typhimurium LT2
cuacuuuauuuuucg

SEQ ID NO: 3814432 - RNA, 18 nt, Salmonella typhimurium LT2
cuacuuuuucccgcagcu

SEQ ID NO: 3814433 - RNA, 16 nt, Salmonella typhimurium LT2
cuagaugaaugacugu

SEQ ID NO: 3814434 - RNA, 21 nt, Salmonella typhimurium LT2
cuagaugaugauuuaugaaua

SEQ ID NO: 3814435 - RNA, 15 nt, Salmonella typhimurium LT2
cuagcauaagcacag

SEQ ID NO: 3814436 - RNA, 16 nt, Salmonella typhimurium LT2
cuagcgccuuauccgg

SEQ ID NO: 3814437 - RNA, 21 nt, Salmonella typhimurium LT2
cuagcuuaucgccaaagauau

SEQ ID NO: 3814438 - RNA, 15 nt, Salmonella typhimurium LT2
cuagcuucagguguu

SEQ ID NO: 3814439 - RNA, 17 nt, Salmonella typhimurium LT2
cuaggacgaaaaaugaa

SEQ ID NO: 3814440 - RNA, 13 nt, Salmonella typhimurium LT2
cuaguauauuaaa

SEQ ID NO: 3814441 - RNA, 18 nt, Salmonella typhimurium LT2
cuaguaugucuaugauuu

SEQ ID NO: 3814442 - RNA, 15 nt, Salmonella typhimurium LT2
cuagucaauaaagac

SEQ ID NO: 3814443 - RNA, 16 nt, Salmonella typhimurium LT2
cuagugccgccaggca

SEQ ID NO: 3814444 - RNA, 12 nt, Salmonella typhimurium LT2
cuaguucugcgc

SEQ ID NO: 3814445 - RNA, 22 nt, Salmonella typhimurium LT2
cuauaaaaauaccggcaucacg

SEQ ID NO: 3814446 - RNA, 11 nt, Salmonella typhimurium LT2
cuauaaaaauc

SEQ ID NO: 3814447 - RNA, 16 nt, Salmonella typhimurium LT2
cuauaauugcuuuuuu

SEQ ID NO: 3814448 - RNA, 18 nt, Salmonella typhimurium LT2
cuauacccgcguuuucuc

SEQ ID NO: 3814449 - RNA, 14 nt, Salmonella typhimurium LT2
cuauaccgcuuuau

SEQ ID NO: 3814450 - RNA, 23 nt, Salmonella typhimurium LT2
cuauagaggugagauauggcacu

SEQ ID NO: 3814451 - RNA, 16 nt, Salmonella typhimurium LT2
cuauagccugcugggu

SEQ ID NO: 3814452 - RNA, 15 nt, Salmonella typhimurium LT2
cuauaggaaaauaau

SEQ ID NO: 3814453 - RNA, 19 nt, Salmonella typhimurium LT2
cuauaguucucgucugcug

SEQ ID NO: 3814454 - RNA, 22 nt, Salmonella typhimurium LT2
cuauaugaaccuuguaacgggu

SEQ ID NO: 3814455 - RNA, 15 nt, Salmonella typhimurium LT2
cuauaugcaggcaua

SEQ ID NO: 3814456 - RNA, 16 nt, Salmonella typhimurium LT2
cuauauuccagccagg

SEQ ID NO: 3814457 - RNA, 11 nt, Salmonella typhimurium LT2
cuaucaauauu

SEQ ID NO: 3814458 - RNA, 23 nt, Salmonella typhimurium LT2
cuaucaauauucaugcuuucaau

SEQ ID NO: 3814459 - RNA, 19 nt, Salmonella typhimurium LT2
cuaucacacugacaauaaa

SEQ ID NO: 3814460 - RNA, 15 nt, Salmonella typhimurium LT2
cuaucacagcggcau

SEQ ID NO: 3814461 - RNA, 13 nt, Salmonella typhimurium LT2
cuaucaccgccuc

SEQ ID NO: 3814462 - RNA, 16 nt, Salmonella typhimurium LT2
cuaucagaaaaaauua

SEQ ID NO: 3814463 - RNA, 19 nt, Salmonella typhimurium LT2
cuaucaguagcuuuuccgc

SEQ ID NO: 3814464 - RNA, 13 nt, Salmonella typhimurium LT2
cuaucauagccuc

SEQ ID NO: 3814465 - RNA, 12 nt, Salmonella typhimurium LT2
cuauccagcagu

SEQ ID NO: 3814466 - RNA, 17 nt, Salmonella typhimurium LT2
cuauccagcaguaaaua

SEQ ID NO: 3814467 - RNA, 20 nt, Salmonella typhimurium LT2
cuauccaugcgucgagcgcc

SEQ ID NO: 3814468 - RNA, 21 nt, Salmonella typhimurium LT2
cuauccaugcgucgagcgccg

SEQ ID NO: 3814469 - RNA, 21 nt, Salmonella typhimurium LT2
cuaucccauuuuuuguaucca

SEQ ID NO: 3814470 - RNA, 15 nt, Salmonella typhimurium LT2
cuauccgccgccagc

SEQ ID NO: 3814471 - RNA, 22 nt, Salmonella typhimurium LT2
cuauccggaggccuucuuguuu

SEQ ID NO: 3814472 - RNA, 22 nt, Salmonella typhimurium LT2
cuauccggcaacaugacauuaa

SEQ ID NO: 3814473 - RNA, 18 nt, Salmonella typhimurium LT2
cuauccguccucuuuccc

SEQ ID NO: 3814474 - RNA, 22 nt, Salmonella typhimurium LT2
cuauccguccucuuucccuuuu

SEQ ID NO: 3814475 - RNA, 16 nt, Salmonella typhimurium LT2
cuaucgaccagcaccu

SEQ ID NO: 3814476 - RNA, 15 nt, Salmonella typhimurium LT2
cuaucgcaucagaua

SEQ ID NO: 3814477 - RNA, 16 nt, Salmonella typhimurium LT2
cuaucgccaaacuggu

SEQ ID NO: 3814478 - RNA, 20 nt, Salmonella typhimurium LT2
cuaucgcgacggaccggcag

SEQ ID NO: 3814479 - RNA, 23 nt, Salmonella typhimurium LT2
cuaucggaagaaaacgcaauaac

SEQ ID NO: 3814480 - RNA, 22 nt, Salmonella typhimurium LT2
cuaucgggucugcgcgccggaa

SEQ ID NO: 3814481 - RNA, 22 nt, Salmonella typhimurium LT2
cuaucugacagccaaacugcug

SEQ ID NO: 3814482 - RNA, 15 nt, Salmonella typhimurium LT2
cuaucugcccuggcu

SEQ ID NO: 3814483 - RNA, 20 nt, Salmonella typhimurium LT2
cuaucugcuccgccagcaau

SEQ ID NO: 3814484 - RNA, 23 nt, Salmonella typhimurium LT2
cuaucuguauaucuuucuuaucc

SEQ ID NO: 3814485 - RNA, 15 nt, Salmonella typhimurium LT2
cuaucuuucagaccu

SEQ ID NO: 3814486 - RNA, 12 nt, Salmonella typhimurium LT2
cuaucuuuuuaa

SEQ ID NO: 3814487 - RNA, 12 nt, Salmonella typhimurium LT2
cuaugacaaguc

SEQ ID NO: 3814488 - RNA, 13 nt, Salmonella typhimurium LT2
cuaugcaaaacgu

SEQ ID NO: 3814489 - RNA, 13 nt, Salmonella typhimurium LT2
cuaugccuggaug

SEQ ID NO: 3814490 - RNA, 13 nt, Salmonella typhimurium LT2
cuaugcucccccc

SEQ ID NO: 3814491 - RNA, 21 nt, Salmonella typhimurium LT2
cuauguacucugauccuaccc

SEQ ID NO: 3814492 - RNA, 18 nt, Salmonella typhimurium LT2
cuauguagcgcugaagcc

SEQ ID NO: 3814493 - RNA, 12 nt, Salmonella typhimurium LT2
cuaugugcgcca

SEQ ID NO: 3814494 - RNA, 16 nt, Salmonella typhimurium LT2
cuauguuugcugagaa

SEQ ID NO: 3814495 - RNA, 17 nt, Salmonella typhimurium LT2
cucauaacccuccugcc

SEQ ID NO: 3814496 - RNA, 23 nt, Salmonella typhimurium LT2
cucauaagacgcauuaacggcaa

SEQ ID NO: 3814497 - RNA, 20 nt, Salmonella typhimurium LT2
cucauaccgccgcccagcac

SEQ ID NO: 3814498 - RNA, 23 nt, Salmonella typhimurium LT2
cucauaccuggcuugauguaguc

SEQ ID NO: 3814499 - RNA, 14 nt, Salmonella typhimurium LT2
cucauagccgcuuu

SEQ ID NO: 3814500 - RNA, 15 nt, Salmonella typhimurium LT2
cucaucaauacguua

SEQ ID NO: 3814501 - RNA, 13 nt, Salmonella typhimurium LT2
cucaucacagcca

SEQ ID NO: 3814502 - RNA, 22 nt, Salmonella typhimurium LT2
cucaucagccugaaagauuauu

SEQ ID NO: 3814503 - RNA, 24 nt, Salmonella typhimurium LT2
cucauccaacugcgccugaagaua

SEQ ID NO: 3814504 - RNA, 15 nt, Salmonella typhimurium LT2
cucauccgcugacac

SEQ ID NO: 3814505 - RNA, 14 nt, Salmonella typhimurium LT2
cucaucgacgauaa

SEQ ID NO: 3814506 - RNA, 16 nt, Salmonella typhimurium LT2
cucaucggaaaaauag

SEQ ID NO: 3814507 - RNA, 18 nt, Salmonella typhimurium LT2
cucaucugaugauuaauu

SEQ ID NO: 3814508 - RNA, 18 nt, Salmonella typhimurium LT2
cucaucugcuucaacagc

SEQ ID NO: 3814509 - RNA, 18 nt, Salmonella typhimurium LT2
cucaucuuuuacaggccg

SEQ ID NO: 3814510 - RNA, 18 nt, Salmonella typhimurium LT2
cucaugcguaaaucgcga

SEQ ID NO: 3814511 - RNA, 21 nt, Salmonella typhimurium LT2
cucaugcuuaucgccaaacca

SEQ ID NO: 3814512 - RNA, 23 nt, Salmonella typhimurium LT2
cucauggcgaacucuuccagauc

SEQ ID NO: 3814513 - RNA, 21 nt, Salmonella typhimurium LT2
cucaugugcagcauccagcuc

SEQ ID NO: 3814514 - RNA, 15 nt, Salmonella typhimurium LT2
cucauguucaagcug

SEQ ID NO: 3814515 - RNA, 14 nt, Salmonella typhimurium LT2
cucauuaaaaaaac

SEQ ID NO: 3814516 - RNA, 18 nt, Salmonella typhimurium LT2
cucauuaauaacccaggu

SEQ ID NO: 3814517 - RNA, 14 nt, Salmonella typhimurium LT2
cucauuacgccacg

SEQ ID NO: 3814518 - RNA, 18 nt, Salmonella typhimurium LT2
cucauuaugccucccguu

SEQ ID NO: 3814519 - RNA, 21 nt, Salmonella typhimurium LT2
cucauucgggcacuccggcuc

SEQ ID NO: 3814520 - RNA, 15 nt, Salmonella typhimurium LT2
cucauuucaacauau

SEQ ID NO: 3814521 - RNA, 16 nt, Salmonella typhimurium LT2
cucauuucacuauaaa

SEQ ID NO: 3814522 - RNA, 16 nt, Salmonella typhimurium LT2
cucauuuuauccaaca

SEQ ID NO: 3814523 - RNA, 22 nt, Salmonella typhimurium LT2
cucauuuugccguugcuguucc

SEQ ID NO: 3814524 - RNA, 20 nt, Salmonella typhimurium LT2
cucauuuuguugcuccagca

SEQ ID NO: 3814525 - RNA, 18 nt, Salmonella typhimurium LT2
cuccacauauugagcuga

SEQ ID NO: 3814526 - RNA, 22 nt, Salmonella typhimurium LT2
cuccacauauugagcugauaac

SEQ ID NO: 3814527 - RNA, 19 nt, Salmonella typhimurium LT2
cuccaccaaaucccccaac

SEQ ID NO: 3814528 - RNA, 13 nt, Salmonella typhimurium LT2
cuccaccaaccag

SEQ ID NO: 3814529 - RNA, 16 nt, Salmonella typhimurium LT2
cuccaccauaucgcag

SEQ ID NO: 3814530 - RNA, 21 nt, Salmonella typhimurium LT2
cuccaccauaucgcagaccau

SEQ ID NO: 3814531 - RNA, 15 nt, Salmonella typhimurium LT2
cuccacgccauagcg

SEQ ID NO: 3814532 - RNA, 21 nt, Salmonella typhimurium LT2
cuccacgccauagcgcaguaa

SEQ ID NO: 3814533 - RNA, 17 nt, Salmonella typhimurium LT2
cuccacgcccagcgccg

SEQ ID NO: 3814534 - RNA, 19 nt, Salmonella typhimurium LT2
cuccagaagcacuucucca

SEQ ID NO: 3814535 - RNA, 22 nt, Salmonella typhimurium LT2
cuccagaauauugacaucgccg

SEQ ID NO: 3814536 - RNA, 15 nt, Salmonella typhimurium LT2
cuccagaccaccagc

SEQ ID NO: 3814537 - RNA, 14 nt, Salmonella typhimurium LT2
cuccagagcgccgu

SEQ ID NO: 3814538 - RNA, 19 nt, Salmonella typhimurium LT2
cuccagagcgccguggaaa

SEQ ID NO: 3814539 - RNA, 20 nt, Salmonella typhimurium LT2
cuccagcaacagcgcgucca

SEQ ID NO: 3814540 - RNA, 14 nt, Salmonella typhimurium LT2
cuccagcaacgccg

SEQ ID NO: 3814541 - RNA, 16 nt, Salmonella typhimurium LT2
cuccagcacauccuca

SEQ ID NO: 3814542 - RNA, 20 nt, Salmonella typhimurium LT2
cuccagcacgcgcugcgccg

SEQ ID NO: 3814543 - RNA, 13 nt, Salmonella typhimurium LT2
cuccagcagacga

SEQ ID NO: 3814544 - RNA, 13 nt, Salmonella typhimurium LT2
cuccagcaucaca

SEQ ID NO: 3814545 - RNA, 14 nt, Salmonella typhimurium LT2
cuccagcauccugc

SEQ ID NO: 3814546 - RNA, 15 nt, Salmonella typhimurium LT2
cuccagccagcgcca

SEQ ID NO: 3814547 - RNA, 17 nt, Salmonella typhimurium LT2
cuccagcccgaaaggac

SEQ ID NO: 3814548 - RNA, 15 nt, Salmonella typhimurium LT2
cuccagcgaggccuc

SEQ ID NO: 3814549 - RNA, 20 nt, Salmonella typhimurium LT2
cuccagcgcauugcccuucg

SEQ ID NO: 3814550 - RNA, 17 nt, Salmonella typhimurium LT2
cuccagcgccagcucca

SEQ ID NO: 3814551 - RNA, 18 nt, Salmonella typhimurium LT2
cuccagcgccagcuccau

SEQ ID NO: 3814552 - RNA, 20 nt, Salmonella typhimurium LT2
cuccagcgccucggcgccca

SEQ ID NO: 3814553 - RNA, 12 nt, Salmonella typhimurium LT2
cuccagcguacu

SEQ ID NO: 3814554 - RNA, 19 nt, Salmonella typhimurium LT2
cuccagcguggcagugagc

SEQ ID NO: 3814555 - RNA, 12 nt, Salmonella typhimurium LT2
cuccagcuggcu

SEQ ID NO: 3814556 - RNA, 16 nt, Salmonella typhimurium LT2
cuccagcuggcuggca

SEQ ID NO: 3814557 - RNA, 16 nt, Salmonella typhimurium LT2
cuccagcuucaucauc

SEQ ID NO: 3814558 - RNA, 17 nt, Salmonella typhimurium LT2
cuccagcuucaucauca

SEQ ID NO: 3814559 - RNA, 20 nt, Salmonella typhimurium LT2
cuccaggaacaggcccgcca

SEQ ID NO: 3814560 - RNA, 19 nt, Salmonella typhimurium LT2
cuccaggccaagcgccugu

SEQ ID NO: 3814561 - RNA, 16 nt, Salmonella typhimurium LT2
cuccaggcgaaucccc

SEQ ID NO: 3814562 - RNA, 19 nt, Salmonella typhimurium LT2
cuccaggcgaauccccauc

SEQ ID NO: 3814563 - RNA, 21 nt, Salmonella typhimurium LT2
cuccagggcaacggccagcgc

SEQ ID NO: 3814564 - RNA, 17 nt, Salmonella typhimurium LT2
cuccaguaauucccggc

SEQ ID NO: 3814565 - RNA, 18 nt, Salmonella typhimurium LT2
cuccaguucccgacaggc

SEQ ID NO: 3814566 - RNA, 12 nt, Salmonella typhimurium LT2
cuccaguugaua

SEQ ID NO: 3814567 - RNA, 21 nt, Salmonella typhimurium LT2
cuccaguuucgccagcggcag

SEQ ID NO: 3814568 - RNA, 15 nt, Salmonella typhimurium LT2
cuccaguuugcguuc

SEQ ID NO: 3814569 - RNA, 13 nt, Salmonella typhimurium LT2
cuccauaauuuga

SEQ ID NO: 3814570 - RNA, 23 nt, Salmonella typhimurium LT2
cuccauaauuugaaucgccuggc

SEQ ID NO: 3814571 - RNA, 20 nt, Salmonella typhimurium LT2
cuccauacccuauuuacaga

SEQ ID NO: 3814572 - RNA, 14 nt, Salmonella typhimurium LT2
cuccauagggcagg

SEQ ID NO: 3814573 - RNA, 16 nt, Salmonella typhimurium LT2
cuccaucauuuccggc

SEQ ID NO: 3814574 - RNA, 15 nt, Salmonella typhimurium LT2
cuccauuaaauuacu

SEQ ID NO: 3814575 - RNA, 23 nt, Salmonella typhimurium LT2
cucccaacagacgaucuacggua

SEQ ID NO: 3814576 - RNA, 21 nt, Salmonella typhimurium LT2
cucccagaaaccgccccuggc

SEQ ID NO: 3814577 - RNA, 19 nt, Salmonella typhimurium LT2
cucccagccgggcaggaaa

SEQ ID NO: 3814578 - RNA, 13 nt, Salmonella typhimurium LT2
cucccagcugagc

SEQ ID NO: 3814579 - RNA, 18 nt, Salmonella typhimurium LT2
cucccaggccgccaccgc

SEQ ID NO: 3814580 - RNA, 23 nt, Salmonella typhimurium LT2
cucccaggccgccaccgccucgc

SEQ ID NO: 3814581 - RNA, 15 nt, Salmonella typhimurium LT2
cucccauacccaggu

SEQ ID NO: 3814582 - RNA, 20 nt, Salmonella typhimurium LT2
cuccccacaaucccgccaga

SEQ ID NO: 3814583 - RNA, 20 nt, Salmonella typhimurium LT2
cuccccagaaugauaaugcc

SEQ ID NO: 3814584 - RNA, 21 nt, Salmonella typhimurium LT2
cuccccaggcgcuauucccag

SEQ ID NO: 3814585 - RNA, 22 nt, Salmonella typhimurium LT2
cuccccaggcgcuauucccagg

SEQ ID NO: 3814586 - RNA, 23 nt, Salmonella typhimurium LT2
cuccccaggcgcuauucccaggc

SEQ ID NO: 3814587 - RNA, 13 nt, Salmonella typhimurium LT2
cuccccgcgcgau

SEQ ID NO: 3814588 - RNA, 15 nt, Salmonella typhimurium LT2
cuccccuuuuuucug

SEQ ID NO: 3814589 - RNA, 16 nt, Salmonella typhimurium LT2
cucccgcagccacucc

SEQ ID NO: 3814590 - RNA, 21 nt, Salmonella typhimurium LT2
cucccgcgucacgaccggcga

SEQ ID NO: 3814591 - RNA, 16 nt, Salmonella typhimurium LT2
cucccggaaccgaccg

SEQ ID NO: 3814592 - RNA, 17 nt, Salmonella typhimurium LT2
cucccggcauguaggcc

SEQ ID NO: 3814593 - RNA, 16 nt, Salmonella typhimurium LT2
cucccgguucgccgcu

SEQ ID NO: 3814594 - RNA, 20 nt, Salmonella typhimurium LT2
cucccguuucgacgggaggu

SEQ ID NO: 3814595 - RNA, 13 nt, Salmonella typhimurium LT2
cucccucaaccag

SEQ ID NO: 3814596 - RNA, 16 nt, Salmonella typhimurium LT2
cucccucaaccagggu

SEQ ID NO: 3814597 - RNA, 15 nt, Salmonella typhimurium LT2
cucccugccaggcca

SEQ ID NO: 3814598 - RNA, 12 nt, Salmonella typhimurium LT2
cucccuggcagu

SEQ ID NO: 3814599 - RNA, 21 nt, Salmonella typhimurium LT2
cucgcugccggaaagccccag

SEQ ID NO: 3814600 - RNA, 21 nt, Salmonella typhimurium LT2
cucgcuggugccaaucuccag

SEQ ID NO: 3814601 - RNA, 19 nt, Salmonella typhimurium LT2
cucgcuguacuucccucuc

SEQ ID NO: 3814602 - RNA, 19 nt, Salmonella typhimurium LT2
cucgcuuaaugaggccacc

SEQ ID NO: 3814603 - RNA, 17 nt, Salmonella typhimurium LT2
cucgcuuugccgccauc

SEQ ID NO: 3814604 - RNA, 17 nt, Salmonella typhimurium LT2
cucggacgaaaaaugaa

SEQ ID NO: 3814605 - RNA, 16 nt, Salmonella typhimurium LT2
cucggcaccauuggcg

SEQ ID NO: 3814606 - RNA, 12 nt, Salmonella typhimurium LT2
cucggcagcagc

SEQ ID NO: 3814607 - RNA, 18 nt, Salmonella typhimurium LT2
cucggcauacaccgccag

SEQ ID NO: 3814608 - RNA, 22 nt, Salmonella typhimurium LT2
cucggcauacaccgccagcguc

SEQ ID NO: 3814609 - RNA, 13 nt, Salmonella typhimurium LT2
cucggccuauaga

SEQ ID NO: 3814610 - RNA, 18 nt, Salmonella typhimurium LT2
cucgguauccagcucguc

SEQ ID NO: 3814611 - RNA, 16 nt, Salmonella typhimurium LT2
cucgguauguccugcc

SEQ ID NO: 3814612 - RNA, 15 nt, Salmonella typhimurium LT2
cucggucaacauucc

SEQ ID NO: 3814613 - RNA, 14 nt, Salmonella typhimurium LT2
cucggugccgcugc

SEQ ID NO: 3814614 - RNA, 15 nt, Salmonella typhimurium LT2
cucggugccgcugcu

SEQ ID NO: 3814615 - RNA, 22 nt, Salmonella typhimurium LT2
cucguacacgcgcccgccgcca

SEQ ID NO: 3814616 - RNA, 15 nt, Salmonella typhimurium LT2
cucguaggccagcgc

SEQ ID NO: 3814617 - RNA, 20 nt, Salmonella typhimurium LT2
cucguaggccggauaagacg

SEQ ID NO: 3814618 - RNA, 15 nt, Salmonella typhimurium LT2
cucguccugcaauuu

SEQ ID NO: 3814619 - RNA, 13 nt, Salmonella typhimurium LT2
cucgucgcgcgcc

SEQ ID NO: 3814620 - RNA, 21 nt, Salmonella typhimurium LT2
cucgucggcaagaauuucaau

SEQ ID NO: 3814621 - RNA, 13 nt, Salmonella typhimurium LT2
cucgugcaaauca

SEQ ID NO: 3814622 - RNA, 17 nt, Salmonella typhimurium LT2
cucgugcaaaucacugg

SEQ ID NO: 3814623 - RNA, 13 nt, Salmonella typhimurium LT2
cucuaaaaaggaa

SEQ ID NO: 3814624 - RNA, 22 nt, Salmonella typhimurium LT2
cucuaacgucagcgccacccau

SEQ ID NO: 3814625 - RNA, 12 nt, Salmonella typhimurium LT2
cucuacauuucg

SEQ ID NO: 3814626 - RNA, 14 nt, Salmonella typhimurium LT2
cucuaccggauaaa

SEQ ID NO: 3814627 - RNA, 15 nt, Salmonella typhimurium LT2
cucuaccggauaaau

SEQ ID NO: 3814628 - RNA, 19 nt, Salmonella typhimurium LT2
cucuacgccggcgcguaau

SEQ ID NO: 3814629 - RNA, 17 nt, Salmonella typhimurium LT2
cucuacgcgcugaccuu

SEQ ID NO: 3814630 - RNA, 21 nt, Salmonella typhimurium LT2
cucuauaccauaaaugaaacc

SEQ ID NO: 3814631 - RNA, 22 nt, Salmonella typhimurium LT2
cucuauagcggucaaaauauaa

SEQ ID NO: 3814632 - RNA, 21 nt, Salmonella typhimurium LT2
cucuauccggaggccuucuug

SEQ ID NO: 3814633 - RNA, 15 nt, Salmonella typhimurium LT2
cucuauuaaaauaaa

SEQ ID NO: 3814634 - RNA, 16 nt, Salmonella typhimurium LT2
cucuauuugcauagaa

SEQ ID NO: 3814635 - RNA, 20 nt, Salmonella typhimurium LT2
cucuauuuuuucaaucaggu

SEQ ID NO: 3814636 - RNA, 12 nt, Salmonella typhimurium LT2
cucucaccgccc

SEQ ID NO: 3814637 - RNA, 17 nt, Salmonella typhimurium LT2
cucuccagcaggguauu

SEQ ID NO: 3814638 - RNA, 13 nt, Salmonella typhimurium LT2
cucuccaguucug

SEQ ID NO: 3814639 - RNA, 14 nt, Salmonella typhimurium LT2
cucucccagcugag

SEQ ID NO: 3814640 - RNA, 22 nt, Salmonella typhimurium LT2
cucuccgccgcgggcagcagca

SEQ ID NO: 3814641 - RNA, 23 nt, Salmonella typhimurium LT2
cucuccgccgcgggcagcagcag

SEQ ID NO: 3814642 - RNA, 14 nt, Salmonella typhimurium LT2
cucuccggcucguc

SEQ ID NO: 3814643 - RNA, 23 nt, Salmonella typhimurium LT2
cucuccggcucgucccgcagcau

SEQ ID NO: 3814644 - RNA, 15 nt, Salmonella typhimurium LT2
cucuccuacaccacc

SEQ ID NO: 3814645 - RNA, 21 nt, Salmonella typhimurium LT2
cucuccuacaccaccagcccg

SEQ ID NO: 3814646 - RNA, 12 nt, Salmonella typhimurium LT2
cucuccugaagc

SEQ ID NO: 3814647 - RNA, 14 nt, Salmonella typhimurium LT2
cucuccugaagcca

SEQ ID NO: 3814648 - RNA, 17 nt, Salmonella typhimurium LT2
cucucgcggucggcgca

SEQ ID NO: 3814649 - RNA, 12 nt, Salmonella typhimurium LT2
cucucucuguaa

SEQ ID NO: 3814650 - RNA, 14 nt, Salmonella typhimurium LT2
cucucuuccuccug

SEQ ID NO: 3814651 - RNA, 20 nt, Salmonella typhimurium LT2
cucucuuucaccagcgccag

SEQ ID NO: 3814652 - RNA, 21 nt, Salmonella typhimurium LT2
cucucuuucgguagccacaga

SEQ ID NO: 3814653 - RNA, 22 nt, Salmonella typhimurium LT2
cucucuuuuggcgacagacgcu

SEQ ID NO: 3814654 - RNA, 21 nt, Salmonella typhimurium LT2
cucugaaaaauuuuccuggaa

SEQ ID NO: 3814655 - RNA, 21 nt, Salmonella typhimurium LT2
cucugagcauacacauucagg

SEQ ID NO: 3814656 - RNA, 22 nt, Salmonella typhimurium LT2
cucugaggguguucaugcgacu

SEQ ID NO: 3814657 - RNA, 21 nt, Salmonella typhimurium LT2
cucugcaaagaaauugggcuu

SEQ ID NO: 3814658 - RNA, 18 nt, Salmonella typhimurium LT2
cucugcccccgagccaga

SEQ ID NO: 3814659 - RNA, 22 nt, Salmonella typhimurium LT2
cucugcuuuuaucggcaucugu

SEQ ID NO: 3814660 - RNA, 18 nt, Salmonella typhimurium LT2
cucuggcggcgugauccc

SEQ ID NO: 3814661 - RNA, 22 nt, Salmonella typhimurium LT2
cucugguaguuguaauaaacag

SEQ ID NO: 3814662 - RNA, 20 nt, Salmonella typhimurium LT2
cucuucaacggucucaggcu

SEQ ID NO: 3814663 - RNA, 17 nt, Salmonella typhimurium LT2
cucuucacccuucuucu

SEQ ID NO: 3814664 - RNA, 18 nt, Salmonella typhimurium LT2
cucuucacccuucuucug

SEQ ID NO: 3814665 - RNA, 14 nt, Salmonella typhimurium LT2
cucuucaguaacca

SEQ ID NO: 3814666 - RNA, 22 nt, Salmonella typhimurium LT2
cucuucaguaagaguaccauuc

SEQ ID NO: 3814667 - RNA, 14 nt, Salmonella typhimurium LT2
cucuuccagcgcca

SEQ ID NO: 3814668 - RNA, 15 nt, Salmonella typhimurium LT2
cucuuccagcgccaa

SEQ ID NO: 3814669 - RNA, 13 nt, Salmonella typhimurium LT2
cucuuccagcguc

SEQ ID NO: 3814670 - RNA, 15 nt, Salmonella typhimurium LT2
cucuuccaucagcca

SEQ ID NO: 3814671 - RNA, 19 nt, Salmonella typhimurium LT2
cucuuccccggucagucca

SEQ ID NO: 3814672 - RNA, 13 nt, Salmonella typhimurium LT2
cucuuccgccagc

SEQ ID NO: 3814673 - RNA, 20 nt, Salmonella typhimurium LT2
cucuuccgcgguccagccgg

SEQ ID NO: 3814674 - RNA, 18 nt, Salmonella typhimurium LT2
cucuuccgguacacgcag

SEQ ID NO: 3814675 - RNA, 14 nt, Salmonella typhimurium LT2
cucuuccuccugau

SEQ ID NO: 3814676 - RNA, 14 nt, Salmonella typhimurium LT2
cucuucgacacauu

SEQ ID NO: 3814677 - RNA, 16 nt, Salmonella typhimurium LT2
cucuucgacaucuuca

SEQ ID NO: 3814678 - RNA, 13 nt, Salmonella typhimurium LT2
cucuucgaugacc

SEQ ID NO: 3814679 - RNA, 12 nt, Salmonella typhimurium LT2
cucuucgccaau

SEQ ID NO: 3814680 - RNA, 22 nt, Salmonella typhimurium LT2
cucuucgcuccagucgucgcua

SEQ ID NO: 3814681 - RNA, 13 nt, Salmonella typhimurium LT2
cucuucggaggcc

SEQ ID NO: 3814682 - RNA, 11 nt, Salmonella typhimurium LT2
cucuucugcug

SEQ ID NO: 3814683 - RNA, 20 nt, Salmonella typhimurium LT2
cucuucuuugagcucccggu

SEQ ID NO: 3814684 - RNA, 22 nt, Salmonella typhimurium LT2
cucuucuuuuaauugccaggcg

SEQ ID NO: 3814685 - RNA, 14 nt, Salmonella typhimurium LT2
cucuugcggcugca

SEQ ID NO: 3814686 - RNA, 13 nt, Salmonella typhimurium LT2
cucuugucaggca

SEQ ID NO: 3814687 - RNA, 15 nt, Salmonella typhimurium LT2
cucuuuaucaaacaa

SEQ ID NO: 3814688 - RNA, 23 nt, Salmonella typhimurium LT2
cucuuucagccggcuaucuucuu

SEQ ID NO: 3814689 - RNA, 23 nt, Salmonella typhimurium LT2
cucuuucgcuguaggccggauaa

SEQ ID NO: 3814690 - RNA, 14 nt, Salmonella typhimurium LT2
cucuuugaacagcc

SEQ ID NO: 3814691 - RNA, 18 nt, Salmonella typhimurium LT2
cucuuuuaacgaacgcgc

SEQ ID NO: 3814692 - RNA, 14 nt, Salmonella typhimurium LT2
cucuuuugcagcaa

SEQ ID NO: 3814693 - RNA, 11 nt, Salmonella typhimurium LT2
cucuuuuucau

SEQ ID NO: 3814694 - RNA, 20 nt, Salmonella typhimurium LT2
cucuuuuucauagaaccacu

SEQ ID NO: 3814695 - RNA, 20 nt, Salmonella typhimurium LT2
cucuuuuuccgccugaucuu

SEQ ID NO: 3814696 - RNA, 12 nt, Salmonella typhimurium LT2
cugaaaaauccc

SEQ ID NO: 3814697 - RNA, 22 nt, Salmonella typhimurium LT2
cugaaaaauuuuccuggaauua

SEQ ID NO: 3814698 - RNA, 22 nt, Salmonella typhimurium LT2
cugaaaaccgcaucaagcccau

SEQ ID NO: 3814699 - RNA, 22 nt, Salmonella typhimurium LT2
cugaaaaguagcaagguaugua

SEQ ID NO: 3814700 - RNA, 15 nt, Salmonella typhimurium LT2
cugaaaauagcgcca

SEQ ID NO: 3814701 - RNA, 14 nt, Salmonella typhimurium LT2
cugaaaaucaaaaa

SEQ ID NO: 3814702 - RNA, 13 nt, Salmonella typhimurium LT2
cugaaaaugcccg

SEQ ID NO: 3814703 - RNA, 13 nt, Salmonella typhimurium LT2
cugagcagccagc

SEQ ID NO: 3814704 - RNA, 22 nt, Salmonella typhimurium LT2
cugagcauacacauucaggcug

SEQ ID NO: 3814705 - RNA, 14 nt, Salmonella typhimurium LT2
cugagcgccagcgu

SEQ ID NO: 3814706 - RNA, 22 nt, Salmonella typhimurium LT2
cugagcgcgcaaucgggccugc

SEQ ID NO: 3814707 - RNA, 23 nt, Salmonella typhimurium LT2
cugagcgcgcaaucgggccugcu

SEQ ID NO: 3814708 - RNA, 16 nt, Salmonella typhimurium LT2
cugagcggcucaucca

SEQ ID NO: 3814709 - RNA, 14 nt, Salmonella typhimurium LT2
cugagcuaacgacc

SEQ ID NO: 3814710 - RNA, 16 nt, Salmonella typhimurium LT2
cugagcucacuuuuug

SEQ ID NO: 3814711 - RNA, 16 nt, Salmonella typhimurium LT2
cugagcuuuccugaca

SEQ ID NO: 3814712 - RNA, 19 nt, Salmonella typhimurium LT2
cugaggaccacacagcgga

SEQ ID NO: 3814713 - RNA, 16 nt, Salmonella typhimurium LT2
cugaggcgccgucaau

SEQ ID NO: 3814714 - RNA, 17 nt, Salmonella typhimurium LT2
cugaggcguugcuccag

SEQ ID NO: 3814715 - RNA, 20 nt, Salmonella typhimurium LT2
cugaggcguugcuccagcag

SEQ ID NO: 3814716 - RNA, 18 nt, Salmonella typhimurium LT2
cugaguauacagacagca

SEQ ID NO: 3814717 - RNA, 15 nt, Salmonella typhimurium LT2
cugaguuucucccgc

SEQ ID NO: 3814718 - RNA, 19 nt, Salmonella typhimurium LT2
cugaguuucucccgccaga

SEQ ID NO: 3814719 - RNA, 13 nt, Salmonella typhimurium LT2
cugauaaaaacuc

SEQ ID NO: 3814720 - RNA, 19 nt, Salmonella typhimurium LT2
cugauaaaaacucagcagu

SEQ ID NO: 3814721 - RNA, 18 nt, Salmonella typhimurium LT2
cugauaaaacgcaggcag

SEQ ID NO: 3814722 - RNA, 13 nt, Salmonella typhimurium LT2
cugauaaaagccc

SEQ ID NO: 3814723 - RNA, 14 nt, Salmonella typhimurium LT2
cugauaaagagcag

SEQ ID NO: 3814724 - RNA, 19 nt, Salmonella typhimurium LT2
cugauaaagagcaggccaa

SEQ ID NO: 3814725 - RNA, 22 nt, Salmonella typhimurium LT2
cugauaaagagcaggccaaaaa

SEQ ID NO: 3814726 - RNA, 20 nt, Salmonella typhimurium LT2
cugauaaagcuuucaucuuu

SEQ ID NO: 3814727 - RNA, 20 nt, Salmonella typhimurium LT2
cugauaaauaugccggccgc

SEQ ID NO: 3814728 - RNA, 18 nt, Salmonella typhimurium LT2
cugauaacgauaagugaa

SEQ ID NO: 3814729 - RNA, 15 nt, Salmonella typhimurium LT2
cugauaagcacaggc

SEQ ID NO: 3814730 - RNA, 20 nt, Salmonella typhimurium LT2
cugauaagcgaagcgccauc

SEQ ID NO: 3814731 - RNA, 12 nt, Salmonella typhimurium LT2
cugauaagcgca

SEQ ID NO: 3814732 - RNA, 17 nt, Salmonella typhimurium LT2
cugauaagcgcagcgcc

SEQ ID NO: 3814733 - RNA, 20 nt, Salmonella typhimurium LT2
cugauaagcgcagcgccauc

SEQ ID NO: 3814734 - RNA, 14 nt, Salmonella typhimurium LT2
cugauaagcguagc

SEQ ID NO: 3814735 - RNA, 19 nt, Salmonella typhimurium LT2
cugauaagguaaagccgcc

SEQ ID NO: 3814736 - RNA, 12 nt, Salmonella typhimurium LT2
cugauaauaaga

SEQ ID NO: 3814737 - RNA, 17 nt, Salmonella typhimurium LT2
cugauaccccagcgauc

SEQ ID NO: 3814738 - RNA, 22 nt, Salmonella typhimurium LT2
cugauaccgcguuugcgcaaca

SEQ ID NO: 3814739 - RNA, 20 nt, Salmonella typhimurium LT2
cugauaccgucuuccuucca

SEQ ID NO: 3814740 - RNA, 20 nt, Salmonella typhimurium LT2
cugauacgcaccagcucuac

SEQ ID NO: 3814741 - RNA, 19 nt, Salmonella typhimurium LT2
cugauacggcguuggcugc

SEQ ID NO: 3814742 - RNA, 16 nt, Salmonella typhimurium LT2
cugauacucguagcca

SEQ ID NO: 3814743 - RNA, 13 nt, Salmonella typhimurium LT2
cugauacugcucc

SEQ ID NO: 3814744 - RNA, 14 nt, Salmonella typhimurium LT2
cugauacugcuccg

SEQ ID NO: 3814745 - RNA, 12 nt, Salmonella typhimurium LT2
cugauagcccau

SEQ ID NO: 3814746 - RNA, 14 nt, Salmonella typhimurium LT2
cugauagccgccag

SEQ ID NO: 3814747 - RNA, 13 nt, Salmonella typhimurium LT2
cugauagcgggua

SEQ ID NO: 3814748 - RNA, 20 nt, Salmonella typhimurium LT2
cugauagcuaaccagcgagc

SEQ ID NO: 3814749 - RNA, 19 nt, Salmonella typhimurium LT2
cugauagggacacauuucu

SEQ ID NO: 3814750 - RNA, 20 nt, Salmonella typhimurium LT2
cugauagggacacauuucuu

SEQ ID NO: 3814751 - RNA, 22 nt, Salmonella typhimurium LT2
cugauauacgaagcgccauccg

SEQ ID NO: 3814752 - RNA, 21 nt, Salmonella typhimurium LT2
cugauaucggcugcuguaaca

SEQ ID NO: 3814753 - RNA, 21 nt, Salmonella typhimurium LT2
cugauaucuaugguaauuuaa

SEQ ID NO: 3814754 - RNA, 21 nt, Salmonella typhimurium LT2
cugauauugcguaagcagcug

SEQ ID NO: 3814755 - RNA, 19 nt, Salmonella typhimurium LT2
cugaucgauucucuucuuc

SEQ ID NO: 3814756 - RNA, 22 nt, Salmonella typhimurium LT2
cugaucgccacgccuaaacuga

SEQ ID NO: 3814757 - RNA, 19 nt, Salmonella typhimurium LT2
cugaucgccgacgaccggc

SEQ ID NO: 3814758 - RNA, 17 nt, Salmonella typhimurium LT2
cugaucgcugagcgcca

SEQ ID NO: 3814759 - RNA, 18 nt, Salmonella typhimurium LT2
cugaucggcguuuagccc

SEQ ID NO: 3814760 - RNA, 22 nt, Salmonella typhimurium LT2
cugaucuggcugcguaaaauca

SEQ ID NO: 3814761 - RNA, 17 nt, Salmonella typhimurium LT2
cugaugaaaaguauaua

SEQ ID NO: 3814762 - RNA, 16 nt, Salmonella typhimurium LT2
cugaugaaaggccauc

SEQ ID NO: 3814763 - RNA, 22 nt, Salmonella typhimurium LT2
cugaugaccgccgucauagcag

SEQ ID NO: 3814764 - RNA, 16 nt, Salmonella typhimurium LT2
cugaugacgcgccgga

SEQ ID NO: 3814765 - RNA, 18 nt, Salmonella typhimurium LT2
cugaugagcaauaccuga

SEQ ID NO: 3814766 - RNA, 17 nt, Salmonella typhimurium LT2
cugaugagcgcagcgac

SEQ ID NO: 3814767 - RNA, 21 nt, Salmonella typhimurium LT2
cugaugauggaacagacgccu

SEQ ID NO: 3814768 - RNA, 18 nt, Salmonella typhimurium LT2
cugaugauuuaaaaguac

SEQ ID NO: 3814769 - RNA, 14 nt, Salmonella typhimurium LT2
cugaugccugaagg

SEQ ID NO: 3814770 - RNA, 15 nt, Salmonella typhimurium LT2
cugaugcgccuccac

SEQ ID NO: 3814771 - RNA, 24 nt, Salmonella typhimurium LT2
cugaugcgcguuuagcgccagcag

SEQ ID NO: 3814772 - RNA, 17 nt, Salmonella typhimurium LT2
cugaugcgcuauaaaaa

SEQ ID NO: 3814773 - RNA, 19 nt, Salmonella typhimurium LT2
cugaugcguuguaccguuu

SEQ ID NO: 3814774 - RNA, 22 nt, Salmonella typhimurium LT2
cugaugcguuguaccguuuucc

SEQ ID NO: 3814775 - RNA, 13 nt, Salmonella typhimurium LT2
cugaugcugcgca

SEQ ID NO: 3814776 - RNA, 17 nt, Salmonella typhimurium LT2
cugaugcugcgcaucug

SEQ ID NO: 3814777 - RNA, 21 nt, Salmonella typhimurium LT2
cugauggcgaaaaugguuuug

SEQ ID NO: 3814778 - RNA, 14 nt, Salmonella typhimurium LT2
cugauggcgcagcg

SEQ ID NO: 3814779 - RNA, 18 nt, Salmonella typhimurium LT2
cugauggcgcagcgccau

SEQ ID NO: 3814780 - RNA, 17 nt, Salmonella typhimurium LT2
cugauggcgcugcgcca

SEQ ID NO: 3814781 - RNA, 23 nt, Salmonella typhimurium LT2
cugauggcgcugcgcuuaucagg

SEQ ID NO: 3814782 - RNA, 14 nt, Salmonella typhimurium LT2
cugauggcguucca

SEQ ID NO: 3814783 - RNA, 16 nt, Salmonella typhimurium LT2
cugauguccgcagccg

SEQ ID NO: 3814784 - RNA, 16 nt, Salmonella typhimurium LT2
cugaugugacauuuuc

SEQ ID NO: 3814785 - RNA, 14 nt, Salmonella typhimurium LT2
cugaugugcuccau

SEQ ID NO: 3814786 - RNA, 19 nt, Salmonella typhimurium LT2
cugauuaaguuuuuuuaaa

SEQ ID NO: 3814787 - RNA, 17 nt, Salmonella typhimurium LT2
cugauuaaucagcucag

SEQ ID NO: 3814788 - RNA, 22 nt, Salmonella typhimurium LT2
cugauuaccuaccagcgcgcca

SEQ ID NO: 3814789 - RNA, 17 nt, Salmonella typhimurium LT2
cugauuauucaguaccg

SEQ ID NO: 3814790 - RNA, 15 nt, Salmonella typhimurium LT2
cugauucaggucaug

SEQ ID NO: 3814791 - RNA, 15 nt, Salmonella typhimurium LT2
cugauuccagagcga

SEQ ID NO: 3814792 - RNA, 17 nt, Salmonella typhimurium LT2
cugauucuacucugcuc

SEQ ID NO: 3814793 - RNA, 21 nt, Salmonella typhimurium LT2
cugauugcgcccuccggcaag

SEQ ID NO: 3814794 - RNA, 19 nt, Salmonella typhimurium LT2
cugauuggcuccccgcucg

SEQ ID NO: 3814795 - RNA, 14 nt, Salmonella typhimurium LT2
cugauuuucuccag

SEQ ID NO: 3814796 - RNA, 14 nt, Salmonella typhimurium LT2
cugcaaaaaaagaa

SEQ ID NO: 3814797 - RNA, 16 nt, Salmonella typhimurium LT2
cugcaaaaagccuugc

SEQ ID NO: 3814798 - RNA, 13 nt, Salmonella typhimurium LT2
cugcaaaagagga

SEQ ID NO: 3814799 - RNA, 16 nt, Salmonella typhimurium LT2
cugcaaaauauauaau

SEQ ID NO: 3814800 - RNA, 13 nt, Salmonella typhimurium LT2
cugcaaaaugaug

SEQ ID NO: 3814801 - RNA, 16 nt, Salmonella typhimurium LT2
cugcaaauacugcuuu

SEQ ID NO: 3814802 - RNA, 18 nt, Salmonella typhimurium LT2
cugcaaaucuucggcaaa

SEQ ID NO: 3814803 - RNA, 14 nt, Salmonella typhimurium LT2
cugcaacagaagag

SEQ ID NO: 3814804 - RNA, 14 nt, Salmonella typhimurium LT2
cugcaacagcacca

SEQ ID NO: 3814805 - RNA, 16 nt, Salmonella typhimurium LT2
cugcaacagcaccagc

SEQ ID NO: 3814806 - RNA, 18 nt, Salmonella typhimurium LT2
cugcaacagcaccagcag

SEQ ID NO: 3814807 - RNA, 17 nt, Salmonella typhimurium LT2
cugccggauggagcggc

SEQ ID NO: 3814808 - RNA, 15 nt, Salmonella typhimurium LT2
cugccggauggcggc

SEQ ID NO: 3814809 - RNA, 18 nt, Salmonella typhimurium LT2
cugccggauggcggcgcu

SEQ ID NO: 3814810 - RNA, 15 nt, Salmonella typhimurium LT2
cugccggcaaaacca

SEQ ID NO: 3814811 - RNA, 16 nt, Salmonella typhimurium LT2
cugccgggacuuuaaa

SEQ ID NO: 3814812 - RNA, 15 nt, Salmonella typhimurium LT2
cugccgggagcagau

SEQ ID NO: 3814813 - RNA, 18 nt, Salmonella typhimurium LT2
cugccgggguaucauaaa

SEQ ID NO: 3814814 - RNA, 13 nt, Salmonella typhimurium LT2
cugccgguucggc

SEQ ID NO: 3814815 - RNA, 12 nt, Salmonella typhimurium LT2
cugccguaaaca

SEQ ID NO: 3814816 - RNA, 17 nt, Salmonella typhimurium LT2
cugccguaccguugccg

SEQ ID NO: 3814817 - RNA, 18 nt, Salmonella typhimurium LT2
cugccguagcgcauuauu

SEQ ID NO: 3814818 - RNA, 20 nt, Salmonella typhimurium LT2
cugccguagcguacuuucaa

SEQ ID NO: 3814819 - RNA, 12 nt, Salmonella typhimurium LT2
cugccguccuga

SEQ ID NO: 3814820 - RNA, 14 nt, Salmonella typhimurium LT2
cugccgucgcggcu

SEQ ID NO: 3814821 - RNA, 15 nt, Salmonella typhimurium LT2
cugccucgcugaguu

SEQ ID NO: 3814822 - RNA, 17 nt, Salmonella typhimurium LT2
cugccugauggcgcuuc

SEQ ID NO: 3814823 - RNA, 13 nt, Salmonella typhimurium LT2
cugccugcagacc

SEQ ID NO: 3814824 - RNA, 13 nt, Salmonella typhimurium LT2
cugccugcuucag

SEQ ID NO: 3814825 - RNA, 22 nt, Salmonella typhimurium LT2
cugccuggcucauucuccggga

SEQ ID NO: 3814826 - RNA, 13 nt, Salmonella typhimurium LT2
cugccugucuuuu

SEQ ID NO: 3814827 - RNA, 18 nt, Salmonella typhimurium LT2
cugccuguuuacggcagg

SEQ ID NO: 3814828 - RNA, 15 nt, Salmonella typhimurium LT2
cugccuuauccggcc

SEQ ID NO: 3814829 - RNA, 21 nt, Salmonella typhimurium LT2
cugccuuuaauugccugacga

SEQ ID NO: 3814830 - RNA, 15 nt, Salmonella typhimurium LT2
cugcgaaaagcgugc

SEQ ID NO: 3814831 - RNA, 15 nt, Salmonella typhimurium LT2
cugcgaacagcgcuc

SEQ ID NO: 3814832 - RNA, 17 nt, Salmonella typhimurium LT2
cugcgaacagcgcucca

SEQ ID NO: 3814833 - RNA, 19 nt, Salmonella typhimurium LT2
cugcgaagguuaagagggu

SEQ ID NO: 3814834 - RNA, 19 nt, Salmonella typhimurium LT2
cugcgacgcaugaaacgcc

SEQ ID NO: 3814835 - RNA, 23 nt, Salmonella typhimurium LT2
cugcgaggucaccgggcgaaagc

SEQ ID NO: 3814836 - RNA, 16 nt, Salmonella typhimurium LT2
cugcgauguuauaacc

SEQ ID NO: 3814837 - RNA, 14 nt, Salmonella typhimurium LT2
cugcgcaaucauga

SEQ ID NO: 3814838 - RNA, 13 nt, Salmonella typhimurium LT2
cugcgcaccugca

SEQ ID NO: 3814839 - RNA, 14 nt, Salmonella typhimurium LT2
cugcgcacggcaau

SEQ ID NO: 3814840 - RNA, 17 nt, Salmonella typhimurium LT2
cugcgcacggcaauccg

SEQ ID NO: 3814841 - RNA, 19 nt, Salmonella typhimurium LT2
cugcgcauacgucaugccu

SEQ ID NO: 3814842 - RNA, 15 nt, Salmonella typhimurium LT2
cugcgcauccucuuu

SEQ ID NO: 3814843 - RNA, 18 nt, Salmonella typhimurium LT2
cugcgcaucuggggcgcu

SEQ ID NO: 3814844 - RNA, 17 nt, Salmonella typhimurium LT2
cugcgcauuaacgccgu

SEQ ID NO: 3814845 - RNA, 12 nt, Salmonella typhimurium LT2
cugcgccaccag

SEQ ID NO: 3814846 - RNA, 14 nt, Salmonella typhimurium LT2
cugcgccaccagcg

SEQ ID NO: 3814847 - RNA, 13 nt, Salmonella typhimurium LT2
cugcgccagcacc

SEQ ID NO: 3814848 - RNA, 16 nt, Salmonella typhimurium LT2
cugcgccagcauggcg

SEQ ID NO: 3814849 - RNA, 17 nt, Salmonella typhimurium LT2
cugcgccagcauggcgu

SEQ ID NO: 3814850 - RNA, 14 nt, Salmonella typhimurium LT2
cugcgccagccaga

SEQ ID NO: 3814851 - RNA, 12 nt, Salmonella typhimurium LT2
cugcgccagccg

SEQ ID NO: 3814852 - RNA, 14 nt, Salmonella typhimurium LT2
cugcgccagcgccg

SEQ ID NO: 3814853 - RNA, 16 nt, Salmonella typhimurium LT2
cugcgcccgcaagcug

SEQ ID NO: 3814854 - RNA, 15 nt, Salmonella typhimurium LT2
cugcgccgcaaagcg

SEQ ID NO: 3814855 - RNA, 19 nt, Salmonella typhimurium LT2
cugcgccgcaaagcgggcg

SEQ ID NO: 3814856 - RNA, 17 nt, Salmonella typhimurium LT2
cugcgccgccagcgaca

SEQ ID NO: 3814857 - RNA, 13 nt, Salmonella typhimurium LT2
cugcgccgcuugu

SEQ ID NO: 3814858 - RNA, 23 nt, Salmonella typhimurium LT2
cugcgccugaaaggcacgcuccu

SEQ ID NO: 3814859 - RNA, 19 nt, Salmonella typhimurium LT2
cugcgccuuacccggccua

SEQ ID NO: 3814860 - RNA, 16 nt, Salmonella typhimurium LT2
cugcgccuuauccgac

SEQ ID NO: 3814861 - RNA, 17 nt, Salmonella typhimurium LT2
cugcgccuuauccggcc

SEQ ID NO: 3814862 - RNA, 18 nt, Salmonella typhimurium LT2
cugcgcgacgcccaccag

SEQ ID NO: 3814863 - RNA, 12 nt, Salmonella typhimurium LT2
cugcgcgccgga

SEQ ID NO: 3814864 - RNA, 18 nt, Salmonella typhimurium LT2
cugcgcgccgggcuucau

SEQ ID NO: 3814865 - RNA, 15 nt, Salmonella typhimurium LT2
cugcgcgccugcgcu

SEQ ID NO: 3814866 - RNA, 13 nt, Salmonella typhimurium LT2
cugcgcgccugcu

SEQ ID NO: 3814867 - RNA, 21 nt, Salmonella typhimurium LT2
cugcgcggcaauuuccgcuga

SEQ ID NO: 3814868 - RNA, 20 nt, Salmonella typhimurium LT2
cugcgcggccagaaccugcu

SEQ ID NO: 3814869 - RNA, 22 nt, Salmonella typhimurium LT2
cugcgcggccagaaccugcucg

SEQ ID NO: 3814870 - RNA, 13 nt, Salmonella typhimurium LT2
cugcgcguggcuc

SEQ ID NO: 3814871 - RNA, 23 nt, Salmonella typhimurium LT2
cugcgcucaucagaccugggcga

SEQ ID NO: 3814872 - RNA, 13 nt, Salmonella typhimurium LT2
cugcgcucgcccu

SEQ ID NO: 3814873 - RNA, 17 nt, Salmonella typhimurium LT2
cugcgcugcggucaggg

SEQ ID NO: 3814874 - RNA, 17 nt, Salmonella typhimurium LT2
cugcgcugucaccagca

SEQ ID NO: 3814875 - RNA, 19 nt, Salmonella typhimurium LT2
cugcgcuuaucaggccuac

SEQ ID NO: 3814876 - RNA, 24 nt, Salmonella typhimurium LT2
cugcgcuuaucaggccuaccagcc

SEQ ID NO: 3814877 - RNA, 16 nt, Salmonella typhimurium LT2
cugcgcuucgaugcgu

SEQ ID NO: 3814878 - RNA, 21 nt, Salmonella typhimurium LT2
cugcgcuucgaugcguucaaa

SEQ ID NO: 3814879 - RNA, 18 nt, Salmonella typhimurium LT2
cugcgcuucuauccacug

SEQ ID NO: 3814880 - RNA, 16 nt, Salmonella typhimurium LT2
cugcgcuuuccaggcc

SEQ ID NO: 3814881 - RNA, 16 nt, Salmonella typhimurium LT2
cugcgcuuuggguuaa

SEQ ID NO: 3814882 - RNA, 11 nt, Salmonella typhimurium LT2
cugcgcuuugu

SEQ ID NO: 3814883 - RNA, 17 nt, Salmonella typhimurium LT2
cugcgcuuugugcucca

SEQ ID NO: 3814884 - RNA, 13 nt, Salmonella typhimurium LT2
cugcgcuuuuuca

SEQ ID NO: 3814885 - RNA, 19 nt, Salmonella typhimurium LT2
cugcgcuuuuucaucaucu

SEQ ID NO: 3814886 - RNA, 14 nt, Salmonella typhimurium LT2
cugcggacacggcg

SEQ ID NO: 3814887 - RNA, 14 nt, Salmonella typhimurium LT2
cugcggacauuuuc

SEQ ID NO: 3814888 - RNA, 17 nt, Salmonella typhimurium LT2
cugcggauguuaaugaa

SEQ ID NO: 3814889 - RNA, 18 nt, Salmonella typhimurium LT2
cugcggcagaaucacggc

SEQ ID NO: 3814890 - RNA, 12 nt, Salmonella typhimurium LT2
cugcggcaggca

SEQ ID NO: 3814891 - RNA, 22 nt, Salmonella typhimurium LT2
cugcggcauacuuucgcgcggc

SEQ ID NO: 3814892 - RNA, 21 nt, Salmonella typhimurium LT2
cugcggcauuacgcgccucuu

SEQ ID NO: 3814893 - RNA, 21 nt, Salmonella typhimurium LT2
cugcggccaugaucgccgcca

SEQ ID NO: 3814894 - RNA, 23 nt, Salmonella typhimurium LT2
cugcggcgcuuugcgcucaggcg

SEQ ID NO: 3814895 - RNA, 20 nt, Salmonella typhimurium LT2
cugcggcuauauaaaaucgg

SEQ ID NO: 3814896 - RNA, 17 nt, Salmonella typhimurium LT2
cugcgggaguucuaaca

SEQ ID NO: 3814897 - RNA, 23 nt, Salmonella typhimurium LT2
cugcggggcgggauagccuucca

SEQ ID NO: 3814898 - RNA, 16 nt, Salmonella typhimurium LT2
cugcggucaggaauga

SEQ ID NO: 3814899 - RNA, 23 nt, Salmonella typhimurium LT2
cugcggucuccugaacgcccggc

SEQ ID NO: 3814900 - RNA, 15 nt, Salmonella typhimurium LT2
cugcguaaaagcguu

SEQ ID NO: 3814901 - RNA, 23 nt, Salmonella typhimurium LT2
cugcguaaaccauuucuccugca

SEQ ID NO: 3814902 - RNA, 23 nt, Salmonella typhimurium LT2
cugcguaaccgccagaacgcugu

SEQ ID NO: 3814903 - RNA, 13 nt, Salmonella typhimurium LT2
cugcguaacgcuu

SEQ ID NO: 3814904 - RNA, 23 nt, Salmonella typhimurium LT2
cugcgucaacgcacuguaacgca

SEQ ID NO: 3814905 - RNA, 18 nt, Salmonella typhimurium LT2
cugcguccauuuccccuc

SEQ ID NO: 3814906 - RNA, 14 nt, Salmonella typhimurium LT2
cugcguccugcuua

SEQ ID NO: 3814907 - RNA, 16 nt, Salmonella typhimurium LT2
cugcgucgcuuccugu

SEQ ID NO: 3814908 - RNA, 16 nt, Salmonella typhimurium LT2
cugcgugaacgaccgc

SEQ ID NO: 3814909 - RNA, 17 nt, Salmonella typhimurium LT2
cugcgugcgcgccaccg

SEQ ID NO: 3814910 - RNA, 20 nt, Salmonella typhimurium LT2
cugcguuaacgacccaucaa

SEQ ID NO: 3814911 - RNA, 20 nt, Salmonella typhimurium LT2
cugcguuccgcucagcguca

SEQ ID NO: 3814912 - RNA, 20 nt, Salmonella typhimurium LT2
cuggcaauaaagcagggcgg

SEQ ID NO: 3814913 - RNA, 13 nt, Salmonella typhimurium LT2
cuggcacaggaug

SEQ ID NO: 3814914 - RNA, 14 nt, Salmonella typhimurium LT2
cuggcacugcggac

SEQ ID NO: 3814915 - RNA, 14 nt, Salmonella typhimurium LT2
cuggcacuggcagc

SEQ ID NO: 3814916 - RNA, 15 nt, Salmonella typhimurium LT2
cuggcagaaggcaug

SEQ ID NO: 3814917 - RNA, 22 nt, Salmonella typhimurium LT2
cuggcagccucguccugcaauu

SEQ ID NO: 3814918 - RNA, 20 nt, Salmonella typhimurium LT2
cuggcagcggaaaucagaua

SEQ ID NO: 3814919 - RNA, 16 nt, Salmonella typhimurium LT2
cuggcagcggcaguaa

SEQ ID NO: 3814920 - RNA, 21 nt, Salmonella typhimurium LT2
cuggcagguauuaauccugcg

SEQ ID NO: 3814921 - RNA, 14 nt, Salmonella typhimurium LT2
cuggcauaacauug

SEQ ID NO: 3814922 - RNA, 15 nt, Salmonella typhimurium LT2
cuggcauuacgcugg

SEQ ID NO: 3814923 - RNA, 16 nt, Salmonella typhimurium LT2
cuggcauuacgcuggc

SEQ ID NO: 3814924 - RNA, 21 nt, Salmonella typhimurium LT2
cuggcauuaucguccgucaga

SEQ ID NO: 3814925 - RNA, 17 nt, Salmonella typhimurium LT2
cuggcauuccccaucgc

SEQ ID NO: 3814926 - RNA, 22 nt, Salmonella typhimurium LT2
cuggccaauuuuucacaugcaa

SEQ ID NO: 3814927 - RNA, 23 nt, Salmonella typhimurium LT2
cuggccacgccgaggcauucagc

SEQ ID NO: 3814928 - RNA, 20 nt, Salmonella typhimurium LT2
cuggccacuggauuaucgaa

SEQ ID NO: 3814929 - RNA, 14 nt, Salmonella typhimurium LT2
cuggccaguuucaa

SEQ ID NO: 3814930 - RNA, 21 nt, Salmonella typhimurium LT2
cuggccgguuuuaaaaauaac

SEQ ID NO: 3814931 - RNA, 17 nt, Salmonella typhimurium LT2
cuggccguuuucccggc

SEQ ID NO: 3814932 - RNA, 18 nt, Salmonella typhimurium LT2
cuggccguuuucccggca

SEQ ID NO: 3814933 - RNA, 23 nt, Salmonella typhimurium LT2
cuggccuagaugaaugacugucc

SEQ ID NO: 3814934 - RNA, 16 nt, Salmonella typhimurium LT2
cuggccucccaguucc

SEQ ID NO: 3814935 - RNA, 17 nt, Salmonella typhimurium LT2
cuggccucccaguuccc

SEQ ID NO: 3814936 - RNA, 16 nt, Salmonella typhimurium LT2
cuggccugauaagcgc

SEQ ID NO: 3814937 - RNA, 22 nt, Salmonella typhimurium LT2
cuggccugauaagcgcagcgcc

SEQ ID NO: 3814938 - RNA, 23 nt, Salmonella typhimurium LT2
cuggccugauaagcgcagcgcca

SEQ ID NO: 3814939 - RNA, 17 nt, Salmonella typhimurium LT2
cuggcgaaccaccagcc

SEQ ID NO: 3814940 - RNA, 20 nt, Salmonella typhimurium LT2
cuggcgaauaaaauucagcg

SEQ ID NO: 3814941 - RNA, 22 nt, Salmonella typhimurium LT2
cuggcgaauaaaauucagcgca

SEQ ID NO: 3814942 - RNA, 16 nt, Salmonella typhimurium LT2
cuggcgacaucuggcu

SEQ ID NO: 3814943 - RNA, 19 nt, Salmonella typhimurium LT2
cuggcgaccagccugccgu

SEQ ID NO: 3814944 - RNA, 22 nt, Salmonella typhimurium LT2
cuggcgaccgccaccauccggc

SEQ ID NO: 3814945 - RNA, 18 nt, Salmonella typhimurium LT2
cuggcgacggcaucggca

SEQ ID NO: 3814946 - RNA, 18 nt, Salmonella typhimurium LT2
cuggcgagaaaguggugg

SEQ ID NO: 3814947 - RNA, 21 nt, Salmonella typhimurium LT2
cuggcgcaacguuugccagcg

SEQ ID NO: 3814948 - RNA, 15 nt, Salmonella typhimurium LT2
cuggcgcagccgcuu

SEQ ID NO: 3814949 - RNA, 13 nt, Salmonella typhimurium LT2
cuggcgcagcgcu

SEQ ID NO: 3814950 - RNA, 13 nt, Salmonella typhimurium LT2
cuggcgccgcaag

SEQ ID NO: 3814951 - RNA, 18 nt, Salmonella typhimurium LT2
cuggcgccgccagccagg

SEQ ID NO: 3814952 - RNA, 17 nt, Salmonella typhimurium LT2
cuggcgccgucacguuc

SEQ ID NO: 3814953 - RNA, 22 nt, Salmonella typhimurium LT2
cuggcgccuuuuggcagcagcg

SEQ ID NO: 3814954 - RNA, 17 nt, Salmonella typhimurium LT2
cuggcgcgcggguaggu

SEQ ID NO: 3814955 - RNA, 16 nt, Salmonella typhimurium LT2
cuggcgcggggaacac

SEQ ID NO: 3814956 - RNA, 17 nt, Salmonella typhimurium LT2
cuggcgcggggaacaca

SEQ ID NO: 3814957 - RNA, 19 nt, Salmonella typhimurium LT2
cuggcgcggggaacacaau

SEQ ID NO: 3814958 - RNA, 17 nt, Salmonella typhimurium LT2
cuggcgcggggaacacg

SEQ ID NO: 3814959 - RNA, 18 nt, Salmonella typhimurium LT2
cuggcgcuacguuuguca

SEQ ID NO: 3814960 - RNA, 15 nt, Salmonella typhimurium LT2
cuggcgcuggcugcc

SEQ ID NO: 3814961 - RNA, 19 nt, Salmonella typhimurium LT2
cuggcggaauggcgggcgc

SEQ ID NO: 3814962 - RNA, 20 nt, Salmonella typhimurium LT2
cuggcggaauggcgggcgca

SEQ ID NO: 3814963 - RNA, 22 nt, Salmonella typhimurium LT2
cuggcggauaccgaagacggcg

SEQ ID NO: 3814964 - RNA, 14 nt, Salmonella typhimurium LT2
cuggcggcaaaaac

SEQ ID NO: 3814965 - RNA, 13 nt, Salmonella typhimurium LT2
cuggcggccccuc

SEQ ID NO: 3814966 - RNA, 21 nt, Salmonella typhimurium LT2
cuggcggucaauacguaacgc

SEQ ID NO: 3814967 - RNA, 14 nt, Salmonella typhimurium LT2
cuggcgucgccaaa

SEQ ID NO: 3814968 - RNA, 18 nt, Salmonella typhimurium LT2
cuggcgucgccaaagcag

SEQ ID NO: 3814969 - RNA, 20 nt, Salmonella typhimurium LT2
cuggcgugaaaagugccgcu

SEQ ID NO: 3814970 - RNA, 15 nt, Salmonella typhimurium LT2
cuggcguugcagguu

SEQ ID NO: 3814971 - RNA, 15 nt, Salmonella typhimurium LT2
cuggcuacguacaca

SEQ ID NO: 3814972 - RNA, 22 nt, Salmonella typhimurium LT2
cuggcuaucccgaugcucaggg

SEQ ID NO: 3814973 - RNA, 19 nt, Salmonella typhimurium LT2
cuggcucacugacuaucca

SEQ ID NO: 3814974 - RNA, 12 nt, Salmonella typhimurium LT2
cuggcucauucu

SEQ ID NO: 3814975 - RNA, 16 nt, Salmonella typhimurium LT2
cuggcugaaccccugu

SEQ ID NO: 3814976 - RNA, 20 nt, Salmonella typhimurium LT2
cuggcugccgccauuugcgc

SEQ ID NO: 3814977 - RNA, 14 nt, Salmonella typhimurium LT2
cuggcugcgccgcu

SEQ ID NO: 3814978 - RNA, 17 nt, Salmonella typhimurium LT2
cuggcugcugauggucu

SEQ ID NO: 3814979 - RNA, 17 nt, Salmonella typhimurium LT2
cuggcuggcgcugacga

SEQ ID NO: 3814980 - RNA, 17 nt, Salmonella typhimurium LT2
cuggcuggucagcguac

SEQ ID NO: 3814981 - RNA, 15 nt, Salmonella typhimurium LT2
cuggcuuacucgccc

SEQ ID NO: 3814982 - RNA, 22 nt, Salmonella typhimurium LT2
cuggcuucaaccuccugcaauc

SEQ ID NO: 3814983 - RNA, 20 nt, Salmonella typhimurium LT2
cuggcuucuuaaaauagcca

SEQ ID NO: 3814984 - RNA, 13 nt, Salmonella typhimurium LT2
cuggcuugccaga

SEQ ID NO: 3814985 - RNA, 11 nt, Salmonella typhimurium LT2
cuggcuuuaua

SEQ ID NO: 3814986 - RNA, 14 nt, Salmonella typhimurium LT2
cuggcuuuccugau

SEQ ID NO: 3814987 - RNA, 23 nt, Salmonella typhimurium LT2
cugggauagccaaucacgucgcc

SEQ ID NO: 3814988 - RNA, 21 nt, Salmonella typhimurium LT2
cugggauucggcaacacccac

SEQ ID NO: 3814989 - RNA, 19 nt, Salmonella typhimurium LT2
cugggcauuaccccagcau

SEQ ID NO: 3814990 - RNA, 21 nt, Salmonella typhimurium LT2
cugggcauuaccccagcaucu

SEQ ID NO: 3814991 - RNA, 21 nt, Salmonella typhimurium LT2
cugggccgccacgaccugcag

SEQ ID NO: 3814992 - RNA, 15 nt, Salmonella typhimurium LT2
cugggccggugcgau

SEQ ID NO: 3814993 - RNA, 17 nt, Salmonella typhimurium LT2
cugggcugacaaaaauu

SEQ ID NO: 3814994 - RNA, 21 nt, Salmonella typhimurium LT2
cugggcuuuauccugaccgcu

SEQ ID NO: 3814995 - RNA, 17 nt, Salmonella typhimurium LT2
cuggggcuggcggcgau

SEQ ID NO: 3814996 - RNA, 14 nt, Salmonella typhimurium LT2
cugggucaggaacu

SEQ ID NO: 3814997 - RNA, 14 nt, Salmonella typhimurium LT2
cugggucaggacag

SEQ ID NO: 3814998 - RNA, 18 nt, Salmonella typhimurium LT2
cuggguuccgggcgcacc

SEQ ID NO: 3814999 - RNA, 16 nt, Salmonella typhimurium LT2
cuggguugauaccgga

SEQ ID NO: 3815000 - RNA, 23 nt, Salmonella typhimurium LT2
cugguaaauaacgggcgcgcgcg

SEQ ID NO: 3815001 - RNA, 16 nt, Salmonella typhimurium LT2
cugguaacggcacugc

SEQ ID NO: 3815002 - RNA, 22 nt, Salmonella typhimurium LT2
cugguaacggcacugcuuuucg

SEQ ID NO: 3815003 - RNA, 17 nt, Salmonella typhimurium LT2
cugguaagagagccuua

SEQ ID NO: 3815004 - RNA, 18 nt, Salmonella typhimurium LT2
cugguaagcgcagcgcca

SEQ ID NO: 3815005 - RNA, 20 nt, Salmonella typhimurium LT2
cugguaaguguuagcucuua

SEQ ID NO: 3815006 - RNA, 14 nt, Salmonella typhimurium LT2
cugguacggcguaa

SEQ ID NO: 3815007 - RNA, 14 nt, Salmonella typhimurium LT2
cugguacguccauc

SEQ ID NO: 3815008 - RNA, 16 nt, Salmonella typhimurium LT2
cugguacguccauccg

SEQ ID NO: 3815009 - RNA, 21 nt, Salmonella typhimurium LT2
cugguagcccucgcaaagcug

SEQ ID NO: 3815010 - RNA, 16 nt, Salmonella typhimurium LT2
cugguaggcauccaga

SEQ ID NO: 3815011 - RNA, 15 nt, Salmonella typhimurium LT2
cugguaggccugaua

SEQ ID NO: 3815012 - RNA, 23 nt, Salmonella typhimurium LT2
cugguaggucaacccuauugcca

SEQ ID NO: 3815013 - RNA, 12 nt, Salmonella typhimurium LT2
cugguaguccuc

SEQ ID NO: 3815014 - RNA, 19 nt, Salmonella typhimurium LT2
cuggucaacacgcggucgu

SEQ ID NO: 3815015 - RNA, 19 nt, Salmonella typhimurium LT2
cugugccgccggugucucc

SEQ ID NO: 3815016 - RNA, 12 nt, Salmonella typhimurium LT2
cugugccgcugg

SEQ ID NO: 3815017 - RNA, 21 nt, Salmonella typhimurium LT2
cugugccgcuggugcuacggg

SEQ ID NO: 3815018 - RNA, 16 nt, Salmonella typhimurium LT2
cugugccguugagcac

SEQ ID NO: 3815019 - RNA, 17 nt, Salmonella typhimurium LT2
cugugccguugagcaca

SEQ ID NO: 3815020 - RNA, 20 nt, Salmonella typhimurium LT2
cugugccugacagcaaugag

SEQ ID NO: 3815021 - RNA, 14 nt, Salmonella typhimurium LT2
cugugcgccgcugg

SEQ ID NO: 3815022 - RNA, 22 nt, Salmonella typhimurium LT2
cugugcgguuugcgcuccggca

SEQ ID NO: 3815023 - RNA, 14 nt, Salmonella typhimurium LT2
cugugcgugaccca

SEQ ID NO: 3815024 - RNA, 17 nt, Salmonella typhimurium LT2
cugugcuuucgccacca

SEQ ID NO: 3815025 - RNA, 15 nt, Salmonella typhimurium LT2
cuguggaaaaucugg

SEQ ID NO: 3815026 - RNA, 22 nt, Salmonella typhimurium LT2
cuguggaaacuccagcggcagg

SEQ ID NO: 3815027 - RNA, 17 nt, Salmonella typhimurium LT2
cuguggaggguaagaaa

SEQ ID NO: 3815028 - RNA, 17 nt, Salmonella typhimurium LT2
cuguggguucaucgcca

SEQ ID NO: 3815029 - RNA, 19 nt, Salmonella typhimurium LT2
cuguggguugccauauuuu

SEQ ID NO: 3815030 - RNA, 17 nt, Salmonella typhimurium LT2
cugugguugcccgcagg

SEQ ID NO: 3815031 - RNA, 20 nt, Salmonella typhimurium LT2
cuguguacgcguucugaaua

SEQ ID NO: 3815032 - RNA, 16 nt, Salmonella typhimurium LT2
cugugugggcacucga

SEQ ID NO: 3815033 - RNA, 17 nt, Salmonella typhimurium LT2
cugugugggcacucgaa

SEQ ID NO: 3815034 - RNA, 17 nt, Salmonella typhimurium LT2
cuguguugcucaaaaaa

SEQ ID NO: 3815035 - RNA, 12 nt, Salmonella typhimurium LT2
cuguuaaaaaau

SEQ ID NO: 3815036 - RNA, 15 nt, Salmonella typhimurium LT2
cuguuaaaaccggcu

SEQ ID NO: 3815037 - RNA, 17 nt, Salmonella typhimurium LT2
cuguuaaaaccggcugc

SEQ ID NO: 3815038 - RNA, 14 nt, Salmonella typhimurium LT2
cuguuaauaccgug

SEQ ID NO: 3815039 - RNA, 14 nt, Salmonella typhimurium LT2
cuguuaauuucccg

SEQ ID NO: 3815040 - RNA, 22 nt, Salmonella typhimurium LT2
cuguuacgcggucuuuuaaaag

SEQ ID NO: 3815041 - RNA, 13 nt, Salmonella typhimurium LT2
cuguuaguaaaca

SEQ ID NO: 3815042 - RNA, 15 nt, Salmonella typhimurium LT2
cuguuaucacgguau

SEQ ID NO: 3815043 - RNA, 14 nt, Salmonella typhimurium LT2
cuguuaucaggaua

SEQ ID NO: 3815044 - RNA, 15 nt, Salmonella typhimurium LT2
cuguuaugaaacccg

SEQ ID NO: 3815045 - RNA, 15 nt, Salmonella typhimurium LT2
cuguuaugccuuuuu

SEQ ID NO: 3815046 - RNA, 15 nt, Salmonella typhimurium LT2
cuguucaaaagccug

SEQ ID NO: 3815047 - RNA, 13 nt, Salmonella typhimurium LT2
cuguucacaucca

SEQ ID NO: 3815048 - RNA, 17 nt, Salmonella typhimurium LT2
cuguucagccagcaagg

SEQ ID NO: 3815049 - RNA, 17 nt, Salmonella typhimurium LT2
cuguucaucaaagaaaa

SEQ ID NO: 3815050 - RNA, 15 nt, Salmonella typhimurium LT2
cuguuccagccgcca

SEQ ID NO: 3815051 - RNA, 14 nt, Salmonella typhimurium LT2
cuguuccaggcgaa

SEQ ID NO: 3815052 - RNA, 18 nt, Salmonella typhimurium LT2
cuguuccagguucaagcu

SEQ ID NO: 3815053 - RNA, 19 nt, Salmonella typhimurium LT2
cuguuccagugggcggaua

SEQ ID NO: 3815054 - RNA, 21 nt, Salmonella typhimurium LT2
cuguuccugcgggaacagaua

SEQ ID NO: 3815055 - RNA, 17 nt, Salmonella typhimurium LT2
cuguuccuuacagcuuc

SEQ ID NO: 3815056 - RNA, 13 nt, Salmonella typhimurium LT2
cuguucgccuucg

SEQ ID NO: 3815057 - RNA, 15 nt, Salmonella typhimurium LT2
cuguucgcuuauucc

SEQ ID NO: 3815058 - RNA, 20 nt, Salmonella typhimurium LT2
cuguucggggaauucaaaga

SEQ ID NO: 3815059 - RNA, 16 nt, Salmonella typhimurium LT2
cuguucuucuuucauc

SEQ ID NO: 3815060 - RNA, 20 nt, Salmonella typhimurium LT2
cuguugaugauaaccgccgc

SEQ ID NO: 3815061 - RNA, 21 nt, Salmonella typhimurium LT2
cuguugaugauaaccgccgcc

SEQ ID NO: 3815062 - RNA, 18 nt, Salmonella typhimurium LT2
cuguugcugugcauaucu

SEQ ID NO: 3815063 - RNA, 13 nt, Salmonella typhimurium LT2
cuguuggcauccu

SEQ ID NO: 3815064 - RNA, 20 nt, Salmonella typhimurium LT2
cuguuguagaaugaauuucu

SEQ ID NO: 3815065 - RNA, 17 nt, Salmonella typhimurium LT2
cuguuuaagcgccucca

SEQ ID NO: 3815066 - RNA, 19 nt, Salmonella typhimurium LT2
cuguuuaagcgccuccaca

SEQ ID NO: 3815067 - RNA, 21 nt, Salmonella typhimurium LT2
cuguuuaagcgccuccacaaa

SEQ ID NO: 3815068 - RNA, 14 nt, Salmonella typhimurium LT2
cuguuuaauccggu

SEQ ID NO: 3815069 - RNA, 22 nt, Salmonella typhimurium LT2
cuguuuaaugcuuucaauacuc

SEQ ID NO: 3815070 - RNA, 19 nt, Salmonella typhimurium LT2
cuguuuacccacuucuucc

SEQ ID NO: 3815071 - RNA, 22 nt, Salmonella typhimurium LT2
cuguuucaacacauccagcguc

SEQ ID NO: 3815072 - RNA, 23 nt, Salmonella typhimurium LT2
cuguuucaacacauccagcguca

SEQ ID NO: 3815073 - RNA, 14 nt, Salmonella typhimurium LT2
cuguuuccaguuac

SEQ ID NO: 3815074 - RNA, 15 nt, Salmonella typhimurium LT2
cuguuucgccaggcc

SEQ ID NO: 3815075 - RNA, 22 nt, Salmonella typhimurium LT2
cuguuugcugacaaucugcugg

SEQ ID NO: 3815076 - RNA, 13 nt, Salmonella typhimurium LT2
cuguuuuaauucc

SEQ ID NO: 3815077 - RNA, 21 nt, Salmonella typhimurium LT2
cuguuuuucacuaauccccau

SEQ ID NO: 3815078 - RNA, 21 nt, Salmonella typhimurium LT2
cuguuuuucguuccuucagcu

SEQ ID NO: 3815079 - RNA, 14 nt, Salmonella typhimurium LT2
cuuaaaaaauccug

SEQ ID NO: 3815080 - RNA, 23 nt, Salmonella typhimurium LT2
cuuaaaaaauccugcacuuccag

SEQ ID NO: 3815081 - RNA, 11 nt, Salmonella typhimurium LT2
cuuaaaaacaa

SEQ ID NO: 3815082 - RNA, 20 nt, Salmonella typhimurium LT2
cuuaaacagcgaucacgccg

SEQ ID NO: 3815083 - RNA, 13 nt, Salmonella typhimurium LT2
cuuaaacgccgga

SEQ ID NO: 3815084 - RNA, 20 nt, Salmonella typhimurium LT2
cuuaaacgccggauuccaga

SEQ ID NO: 3815085 - RNA, 11 nt, Salmonella typhimurium LT2
cuuaaauccgg

SEQ ID NO: 3815086 - RNA, 18 nt, Salmonella typhimurium LT2
cuuaaauugcgcgcggcc

SEQ ID NO: 3815087 - RNA, 15 nt, Salmonella typhimurium LT2
cuuaacagaauugcg

SEQ ID NO: 3815088 - RNA, 14 nt, Salmonella typhimurium LT2
cuuaacccauggcu

SEQ ID NO: 3815089 - RNA, 21 nt, Salmonella typhimurium LT2
cuuaaccgggaucgggacaug

SEQ ID NO: 3815090 - RNA, 16 nt, Salmonella typhimurium LT2
cuuaacgcccgcgucu

SEQ ID NO: 3815091 - RNA, 19 nt, Salmonella typhimurium LT2
cuuaacgcguagccaaaag

SEQ ID NO: 3815092 - RNA, 15 nt, Salmonella typhimurium LT2
cuuaacguuaccuuu

SEQ ID NO: 3815093 - RNA, 16 nt, Salmonella typhimurium LT2
cuuaagggccauguuu

SEQ ID NO: 3815094 - RNA, 13 nt, Salmonella typhimurium LT2
cuuaauaacagcg

SEQ ID NO: 3815095 - RNA, 18 nt, Salmonella typhimurium LT2
cuuaauacccauuucuuc

SEQ ID NO: 3815096 - RNA, 21 nt, Salmonella typhimurium LT2
cuuaauacccauuucuucuuc

SEQ ID NO: 3815097 - RNA, 21 nt, Salmonella typhimurium LT2
cuuaaugaguacggguauucc

SEQ ID NO: 3815098 - RNA, 22 nt, Salmonella typhimurium LT2
cuuaaugcauggcagauaaacc

SEQ ID NO: 3815099 - RNA, 23 nt, Salmonella typhimurium LT2
cuuaauguuaacgucgucauuca

SEQ ID NO: 3815100 - RNA, 16 nt, Salmonella typhimurium LT2
cuuaauuuuguugaaa

SEQ ID NO: 3815101 - RNA, 11 nt, Salmonella typhimurium LT2
cuuacaaaaau

SEQ ID NO: 3815102 - RNA, 15 nt, Salmonella typhimurium LT2
cuuacacauuuuauc

SEQ ID NO: 3815103 - RNA, 17 nt, Salmonella typhimurium LT2
cuuacagggcaaugccu

SEQ ID NO: 3815104 - RNA, 21 nt, Salmonella typhimurium LT2
cuuaccaccuuaaacuugccg

SEQ ID NO: 3815105 - RNA, 22 nt, Salmonella typhimurium LT2
cuuacccgcuuuuaaacggcua

SEQ ID NO: 3815106 - RNA, 17 nt, Salmonella typhimurium LT2
cuuaccgcgucuuauca

SEQ ID NO: 3815107 - RNA, 20 nt, Salmonella typhimurium LT2
cuuaccgcugauucuacucu

SEQ ID NO: 3815108 - RNA, 18 nt, Salmonella typhimurium LT2
cuuaccgggcuuacagcg

SEQ ID NO: 3815109 - RNA, 13 nt, Salmonella typhimurium LT2
cuuaccuucaucc

SEQ ID NO: 3815110 - RNA, 18 nt, Salmonella typhimurium LT2
cuuacgaauuuuaucuuc

SEQ ID NO: 3815111 - RNA, 20 nt, Salmonella typhimurium LT2
cuuacgaguggcgaucaggc

SEQ ID NO: 3815112 - RNA, 16 nt, Salmonella typhimurium LT2
cuuacgcacuguuggc

SEQ ID NO: 3815113 - RNA, 23 nt, Salmonella typhimurium LT2
cuuacgcaguugggcgcgcgacu

SEQ ID NO: 3815114 - RNA, 14 nt, Salmonella typhimurium LT2
cuuacgcuccugcg

SEQ ID NO: 3815115 - RNA, 20 nt, Salmonella typhimurium LT2
cuuacggaaaaaugucgcuu

SEQ ID NO: 3815116 - RNA, 14 nt, Salmonella typhimurium LT2
cuuacguaccggcg

SEQ ID NO: 3815117 - RNA, 22 nt, Salmonella typhimurium LT2
cuuacguuucucacuaauuuga

SEQ ID NO: 3815118 - RNA, 22 nt, Salmonella typhimurium LT2
cuuacuuauguaagcucccggg

SEQ ID NO: 3815119 - RNA, 19 nt, Salmonella typhimurium LT2
cuuccagaauggaacaaua

SEQ ID NO: 3815120 - RNA, 21 nt, Salmonella typhimurium LT2
cuuccagauacauggcuauuc

SEQ ID NO: 3815121 - RNA, 15 nt, Salmonella typhimurium LT2
cuuccagcaauucgu

SEQ ID NO: 3815122 - RNA, 14 nt, Salmonella typhimurium LT2
cuuccagcaccgcg

SEQ ID NO: 3815123 - RNA, 14 nt, Salmonella typhimurium LT2
cuuccagcagaucc

SEQ ID NO: 3815124 - RNA, 19 nt, Salmonella typhimurium LT2
cuuccagcauucuauuguu

SEQ ID NO: 3815125 - RNA, 17 nt, Salmonella typhimurium LT2
cuuccagcgacuccgga

SEQ ID NO: 3815126 - RNA, 12 nt, Salmonella typhimurium LT2
cuuccagcgcca

SEQ ID NO: 3815127 - RNA, 24 nt, Salmonella typhimurium LT2
cuuccagcgcgccgucaucgcuca

SEQ ID NO: 3815128 - RNA, 18 nt, Salmonella typhimurium LT2
cuuccagcgcguccagcc

SEQ ID NO: 3815129 - RNA, 15 nt, Salmonella typhimurium LT2
cuuccagcuccaucc

SEQ ID NO: 3815130 - RNA, 19 nt, Salmonella typhimurium LT2
cuuccaggguagcgguggc

SEQ ID NO: 3815131 - RNA, 10 nt, Salmonella typhimurium LT2
cuuccaguac

SEQ ID NO: 3815132 - RNA, 22 nt, Salmonella typhimurium LT2
cuuccaguucgcugaggcguug

SEQ ID NO: 3815133 - RNA, 14 nt, Salmonella typhimurium LT2
cuuccaguugaaaa

SEQ ID NO: 3815134 - RNA, 16 nt, Salmonella typhimurium LT2
cuuccaguugaaaacc

SEQ ID NO: 3815135 - RNA, 16 nt, Salmonella typhimurium LT2
cuuccaguuuugccag

SEQ ID NO: 3815136 - RNA, 17 nt, Salmonella typhimurium LT2
cuuccaugccuucauaa

SEQ ID NO: 3815137 - RNA, 16 nt, Salmonella typhimurium LT2
cuucccacuguaaauu

SEQ ID NO: 3815138 - RNA, 22 nt, Salmonella typhimurium LT2
cuucccauauuuuuucugccag

SEQ ID NO: 3815139 - RNA, 17 nt, Salmonella typhimurium LT2
cuuccccaucaaaacug

SEQ ID NO: 3815140 - RNA, 15 nt, Salmonella typhimurium LT2
cuucccccaccacca

SEQ ID NO: 3815141 - RNA, 16 nt, Salmonella typhimurium LT2
cuucccccaccaccau

SEQ ID NO: 3815142 - RNA, 17 nt, Salmonella typhimurium LT2
cuuccccggcagcccca

SEQ ID NO: 3815143 - RNA, 23 nt, Salmonella typhimurium LT2
cuuccccggcagccccaggccug

SEQ ID NO: 3815144 - RNA, 19 nt, Salmonella typhimurium LT2
cuuccccuuucaccagaau

SEQ ID NO: 3815145 - RNA, 20 nt, Salmonella typhimurium LT2
cuuccccuuucaccagaaug

SEQ ID NO: 3815146 - RNA, 14 nt, Salmonella typhimurium LT2
cuucccgcgauaaa

SEQ ID NO: 3815147 - RNA, 14 nt, Salmonella typhimurium LT2
cuucccgcucauua

SEQ ID NO: 3815148 - RNA, 22 nt, Salmonella typhimurium LT2
cuuccgaaucaauuccuacaau

SEQ ID NO: 3815149 - RNA, 22 nt, Salmonella typhimurium LT2
cuuccgcaauacagcccgccag

SEQ ID NO: 3815150 - RNA, 15 nt, Salmonella typhimurium LT2
cuuccgcaccgccag

SEQ ID NO: 3815151 - RNA, 20 nt, Salmonella typhimurium LT2
cuuccgcacgcgcgcccugc

SEQ ID NO: 3815152 - RNA, 17 nt, Salmonella typhimurium LT2
cuuccgccaccacgccc

SEQ ID NO: 3815153 - RNA, 22 nt, Salmonella typhimurium LT2
cuuccgccauacccggcuccca

SEQ ID NO: 3815154 - RNA, 20 nt, Salmonella typhimurium LT2
cuuccgccgcaaacuggaag

SEQ ID NO: 3815155 - RNA, 16 nt, Salmonella typhimurium LT2
cuuccgccuucucgau

SEQ ID NO: 3815156 - RNA, 16 nt, Salmonella typhimurium LT2
cuuccgcuucgguuuu

SEQ ID NO: 3815157 - RNA, 19 nt, Salmonella typhimurium LT2
cuuccgcuuuaagcgcugc

SEQ ID NO: 3815158 - RNA, 19 nt, Salmonella typhimurium LT2
cuuccggaguaaugaaacc

SEQ ID NO: 3815159 - RNA, 20 nt, Salmonella typhimurium LT2
cuuccggcacugcgccuugc

SEQ ID NO: 3815160 - RNA, 14 nt, Salmonella typhimurium LT2
cuuccggcaucaca

SEQ ID NO: 3815161 - RNA, 20 nt, Salmonella typhimurium LT2
cuuccggcaucacaucgccg

SEQ ID NO: 3815162 - RNA, 15 nt, Salmonella typhimurium LT2
cuuccggcgccucca

SEQ ID NO: 3815163 - RNA, 15 nt, Salmonella typhimurium LT2
cuuccgggccggaga

SEQ ID NO: 3815164 - RNA, 17 nt, Salmonella typhimurium LT2
cuuccgguaucccaaac

SEQ ID NO: 3815165 - RNA, 23 nt, Salmonella typhimurium LT2
cuuccgucaaaaaaucgaccaac

SEQ ID NO: 3815166 - RNA, 14 nt, Salmonella typhimurium LT2
cuuccguccccagc

SEQ ID NO: 3815167 - RNA, 18 nt, Salmonella typhimurium LT2
cuuccguccccagcccau

SEQ ID NO: 3815168 - RNA, 20 nt, Salmonella typhimurium LT2
cuuccguuuuguugccgccc

SEQ ID NO: 3815169 - RNA, 19 nt, Salmonella typhimurium LT2
cuuccucaccguagcucca

SEQ ID NO: 3815170 - RNA, 21 nt, Salmonella typhimurium LT2
cuuccuccccaggcgcuauuc

SEQ ID NO: 3815171 - RNA, 15 nt, Salmonella typhimurium LT2
cuuccugaaucacca

SEQ ID NO: 3815172 - RNA, 19 nt, Salmonella typhimurium LT2
cuuccugaaucaccagccg

SEQ ID NO: 3815173 - RNA, 16 nt, Salmonella typhimurium LT2
cuuccugagcagacau

SEQ ID NO: 3815174 - RNA, 15 nt, Salmonella typhimurium LT2
cuuccugccaggccg

SEQ ID NO: 3815175 - RNA, 18 nt, Salmonella typhimurium LT2
cuuccugcgcugucacca

SEQ ID NO: 3815176 - RNA, 15 nt, Salmonella typhimurium LT2
cuuccugcugcgcuu

SEQ ID NO: 3815177 - RNA, 19 nt, Salmonella typhimurium LT2
cuuccuguacgccugcuuc

SEQ ID NO: 3815178 - RNA, 17 nt, Salmonella typhimurium LT2
cuucgacaaacagcugu

SEQ ID NO: 3815179 - RNA, 14 nt, Salmonella typhimurium LT2
cuucgacaauauuu

SEQ ID NO: 3815180 - RNA, 22 nt, Salmonella typhimurium LT2
cuucgaggauaaaaucgccaaa

SEQ ID NO: 3815181 - RNA, 17 nt, Salmonella typhimurium LT2
cuucgauaauaaaauau

SEQ ID NO: 3815182 - RNA, 19 nt, Salmonella typhimurium LT2
cuucgauaauaaaauauua

SEQ ID NO: 3815183 - RNA, 12 nt, Salmonella typhimurium LT2
cuucgaucgccu

SEQ ID NO: 3815184 - RNA, 14 nt, Salmonella typhimurium LT2
cuucgaucgccugg

SEQ ID NO: 3815185 - RNA, 15 nt, Salmonella typhimurium LT2
cuucgaucgccuggc

SEQ ID NO: 3815186 - RNA, 15 nt, Salmonella typhimurium LT2
cuucgaugcgcucau

SEQ ID NO: 3815187 - RNA, 15 nt, Salmonella typhimurium LT2
cuucgauggauuuga

SEQ ID NO: 3815188 - RNA, 20 nt, Salmonella typhimurium LT2
cuucgauggccucaucauga

SEQ ID NO: 3815189 - RNA, 22 nt, Salmonella typhimurium LT2
cuucgcaauagggggugacauc

SEQ ID NO: 3815190 - RNA, 13 nt, Salmonella typhimurium LT2
cuucgcaaucucc

SEQ ID NO: 3815191 - RNA, 18 nt, Salmonella typhimurium LT2
cuucgcagaucgccugga

SEQ ID NO: 3815192 - RNA, 19 nt, Salmonella typhimurium LT2
cuucgcagcgauauuucuc

SEQ ID NO: 3815193 - RNA, 23 nt, Salmonella typhimurium LT2
cuucgcauauuguaccugccgcu

SEQ ID NO: 3815194 - RNA, 20 nt, Salmonella typhimurium LT2
cuucgcauuuuuaucggcua

SEQ ID NO: 3815195 - RNA, 23 nt, Salmonella typhimurium LT2
cuucgccaaucgccgccgccagg

SEQ ID NO: 3815196 - RNA, 20 nt, Salmonella typhimurium LT2
cuucgcccaucgccgccucc

SEQ ID NO: 3815197 - RNA, 21 nt, Salmonella typhimurium LT2
cuucgccuucgcccauaucca

SEQ ID NO: 3815198 - RNA, 15 nt, Salmonella typhimurium LT2
cuucgccuucgccgg

SEQ ID NO: 3815199 - RNA, 16 nt, Salmonella typhimurium LT2
cuucgcggaauuucag

SEQ ID NO: 3815200 - RNA, 13 nt, Salmonella typhimurium LT2
cuucgcggccgcu

SEQ ID NO: 3815201 - RNA, 18 nt, Salmonella typhimurium LT2
cuucgcguuuaucaccaa

SEQ ID NO: 3815202 - RNA, 18 nt, Salmonella typhimurium LT2
cuucgcucucgccacgcu

SEQ ID NO: 3815203 - RNA, 15 nt, Salmonella typhimurium LT2
cuucgcuguccauuu

SEQ ID NO: 3815204 - RNA, 22 nt, Salmonella typhimurium LT2
cuucggaaugacaaacgccacc

SEQ ID NO: 3815205 - RNA, 22 nt, Salmonella typhimurium LT2
cuucggcaaaauacucagcgaa

SEQ ID NO: 3815206 - RNA, 16 nt, Salmonella typhimurium LT2
cuucggcgaucgcuuu

SEQ ID NO: 3815207 - RNA, 12 nt, Salmonella typhimurium LT2
cuucggcggccc

SEQ ID NO: 3815208 - RNA, 15 nt, Salmonella typhimurium LT2
cuucggcuccagcgc

SEQ ID NO: 3815209 - RNA, 18 nt, Salmonella typhimurium LT2
cuucgguaaaaacagcca

SEQ ID NO: 3815210 - RNA, 21 nt, Salmonella typhimurium LT2
cuucgguuucguuaaucggca

SEQ ID NO: 3815211 - RNA, 17 nt, Salmonella typhimurium LT2
cuucguagacucaggcg

SEQ ID NO: 3815212 - RNA, 22 nt, Salmonella typhimurium LT2
cuucgucacgcgcaaagcugcg

SEQ ID NO: 3815213 - RNA, 17 nt, Salmonella typhimurium LT2
cuucgucgaacgcgccg

SEQ ID NO: 3815214 - RNA, 19 nt, Salmonella typhimurium LT2
cuucgucgucuucauccca

SEQ ID NO: 3815215 - RNA, 13 nt, Salmonella typhimurium LT2
cuucgugaaaacc

SEQ ID NO: 3815216 - RNA, 15 nt, Salmonella typhimurium LT2
cuucguuaagcgguu

SEQ ID NO: 3815217 - RNA, 17 nt, Salmonella typhimurium LT2
cuucguuagcggcguug

SEQ ID NO: 3815218 - RNA, 15 nt, Salmonella typhimurium LT2
cuucguuauaaggcc

SEQ ID NO: 3815219 - RNA, 18 nt, Salmonella typhimurium LT2
cuucguuauaaggccugc

SEQ ID NO: 3815220 - RNA, 14 nt, Salmonella typhimurium LT2
cuucguucuguauc

SEQ ID NO: 3815221 - RNA, 21 nt, Salmonella typhimurium LT2
cuucguuuccugucucuauua

SEQ ID NO: 3815222 - RNA, 13 nt, Salmonella typhimurium LT2
cuucuaauuuuuc

SEQ ID NO: 3815223 - RNA, 17 nt, Salmonella typhimurium LT2
cuuuaccggcccuuccg

SEQ ID NO: 3815224 - RNA, 23 nt, Salmonella typhimurium LT2
cuuuacgcagauaacuuccuuug

SEQ ID NO: 3815225 - RNA, 21 nt, Salmonella typhimurium LT2
cuuuacuuaguaucauauuuu

SEQ ID NO: 3815226 - RNA, 14 nt, Salmonella typhimurium LT2
cuuuaggcaggaaa

SEQ ID NO: 3815227 - RNA, 12 nt, Salmonella typhimurium LT2
cuuuagggcgcu

SEQ ID NO: 3815228 - RNA, 14 nt, Salmonella typhimurium LT2
cuuuauaaauggca

SEQ ID NO: 3815229 - RNA, 16 nt, Salmonella typhimurium LT2
cuuuauauaaaaaaug

SEQ ID NO: 3815230 - RNA, 17 nt, Salmonella typhimurium LT2
cuuuauauaaaaaaugg

SEQ ID NO: 3815231 - RNA, 20 nt, Salmonella typhimurium LT2
cuuuaucaaacaaaccaaac

SEQ ID NO: 3815232 - RNA, 12 nt, Salmonella typhimurium LT2
cuuuaucagaug

SEQ ID NO: 3815233 - RNA, 22 nt, Salmonella typhimurium LT2
cuuuaucagaugugguauuuuc

SEQ ID NO: 3815234 - RNA, 23 nt, Salmonella typhimurium LT2
cuuuaucagaugugguauuuucu

SEQ ID NO: 3815235 - RNA, 18 nt, Salmonella typhimurium LT2
cuuuauccgccagccagu

SEQ ID NO: 3815236 - RNA, 14 nt, Salmonella typhimurium LT2
cuuuauccugaagg

SEQ ID NO: 3815237 - RNA, 17 nt, Salmonella typhimurium LT2
cuuuaucgcacggcgau

SEQ ID NO: 3815238 - RNA, 23 nt, Salmonella typhimurium LT2
cuuuaucgcgcagcagauuaaca

SEQ ID NO: 3815239 - RNA, 14 nt, Salmonella typhimurium LT2
cuuuaucguaaccg

SEQ ID NO: 3815240 - RNA, 20 nt, Salmonella typhimurium LT2
cuuuaucuucugcugcuccc

SEQ ID NO: 3815241 - RNA, 14 nt, Salmonella typhimurium LT2
cuuuaugggcauuu

SEQ ID NO: 3815242 - RNA, 13 nt, Salmonella typhimurium LT2
cuuuauucauuuc

SEQ ID NO: 3815243 - RNA, 19 nt, Salmonella typhimurium LT2
cuuuauucauuucaaugua

SEQ ID NO: 3815244 - RNA, 13 nt, Salmonella typhimurium LT2
cuuuauucucuga

SEQ ID NO: 3815245 - RNA, 21 nt, Salmonella typhimurium LT2
cuuuauucugaaagaaaagau

SEQ ID NO: 3815246 - RNA, 21 nt, Salmonella typhimurium LT2
cuuuauucuggccguuuucaa

SEQ ID NO: 3815247 - RNA, 23 nt, Salmonella typhimurium LT2
cuuuauugacuaguccugauaua

SEQ ID NO: 3815248 - RNA, 23 nt, Salmonella typhimurium LT2
cuuucaacauauuuuucacacau

SEQ ID NO: 3815249 - RNA, 12 nt, Salmonella typhimurium LT2
cuuucaauaagc

SEQ ID NO: 3815250 - RNA, 18 nt, Salmonella typhimurium LT2
cuuucaauccuucuucug

SEQ ID NO: 3815251 - RNA, 16 nt, Salmonella typhimurium LT2
cuuucaauuuccgcac

SEQ ID NO: 3815252 - RNA, 14 nt, Salmonella typhimurium LT2
cuuucacccauuga

SEQ ID NO: 3815253 - RNA, 16 nt, Salmonella typhimurium LT2
cuuucacccccagcug

SEQ ID NO: 3815254 - RNA, 14 nt, Salmonella typhimurium LT2
cuuucacccgcgcu

SEQ ID NO: 3815255 - RNA, 13 nt, Salmonella typhimurium LT2
cuuucaccgccuc

SEQ ID NO: 3815256 - RNA, 15 nt, Salmonella typhimurium LT2
cuuucagauaccaaa

SEQ ID NO: 3815257 - RNA, 20 nt, Salmonella typhimurium LT2
cuuucagccggcuaucuucu

SEQ ID NO: 3815258 - RNA, 13 nt, Salmonella typhimurium LT2
cuuucagcuuuuu

SEQ ID NO: 3815259 - RNA, 17 nt, Salmonella typhimurium LT2
cuuucaggaauuuauca

SEQ ID NO: 3815260 - RNA, 18 nt, Salmonella typhimurium LT2
cuuucauuacgcuuccug

SEQ ID NO: 3815261 - RNA, 18 nt, Salmonella typhimurium LT2
cuuuccaaaauccaggga

SEQ ID NO: 3815262 - RNA, 16 nt, Salmonella typhimurium LT2
cuuuccaaagcgaagu

SEQ ID NO: 3815263 - RNA, 13 nt, Salmonella typhimurium LT2
cuuuccagaccaa

SEQ ID NO: 3815264 - RNA, 13 nt, Salmonella typhimurium LT2
cuuuccagcagcc

SEQ ID NO: 3815265 - RNA, 14 nt, Salmonella typhimurium LT2
cuuuccagcagcca

SEQ ID NO: 3815266 - RNA, 13 nt, Salmonella typhimurium LT2
cuuuccagcgaca

SEQ ID NO: 3815267 - RNA, 14 nt, Salmonella typhimurium LT2
cuuuccagcuccag

SEQ ID NO: 3815268 - RNA, 19 nt, Salmonella typhimurium LT2
cuuuccagcuccagccgcu

SEQ ID NO: 3815269 - RNA, 18 nt, Salmonella typhimurium LT2
cuuucccuuuuuaaaaug

SEQ ID NO: 3815270 - RNA, 19 nt, Salmonella typhimurium LT2
cuuuccguuagcccuuuca

SEQ ID NO: 3815271 - RNA, 21 nt, Salmonella typhimurium LT2
cuuuccugaucaaucaacucu

SEQ ID NO: 3815272 - RNA, 18 nt, Salmonella typhimurium LT2
cuuuccuuuuucaggcac

SEQ ID NO: 3815273 - RNA, 12 nt, Salmonella typhimurium LT2
cuuucgacugga

SEQ ID NO: 3815274 - RNA, 21 nt, Salmonella typhimurium LT2
cuuucgccagccgcagcucau

SEQ ID NO: 3815275 - RNA, 22 nt, Salmonella typhimurium LT2
cuuucgccgcuuuaaucaccau

SEQ ID NO: 3815276 - RNA, 20 nt, Salmonella typhimurium LT2
cuuucggggagacgggcgga

SEQ ID NO: 3815277 - RNA, 21 nt, Salmonella typhimurium LT2
cuuucgguucgccgcagccua

SEQ ID NO: 3815278 - RNA, 12 nt, Salmonella typhimurium LT2
cuuucgucggua

SEQ ID NO: 3815279 - RNA, 19 nt, Salmonella typhimurium LT2
cuuucuccgcuuuuuuaau

SEQ ID NO: 3815280 - RNA, 21 nt, Salmonella typhimurium LT2
cuuucuccugggauaccggaa

SEQ ID NO: 3815281 - RNA, 19 nt, Salmonella typhimurium LT2
cuuucucggcuuuccagcu

SEQ ID NO: 3815282 - RNA, 21 nt, Salmonella typhimurium LT2
cuuucugggcaacucacacua

SEQ ID NO: 3815283 - RNA, 20 nt, Salmonella typhimurium LT2
cuuucuucccuccccugcgc

SEQ ID NO: 3815284 - RNA, 13 nt, Salmonella typhimurium LT2
cuuucuucucaac

SEQ ID NO: 3815285 - RNA, 12 nt, Salmonella typhimurium LT2
cuuucuugccac

SEQ ID NO: 3815286 - RNA, 14 nt, Salmonella typhimurium LT2
cuuucuuuuuuugu

SEQ ID NO: 3815287 - RNA, 19 nt, Salmonella typhimurium LT2
cuuugaaaaucacaucgcc

SEQ ID NO: 3815288 - RNA, 16 nt, Salmonella typhimurium LT2
cuuugaacagccagaa

SEQ ID NO: 3815289 - RNA, 20 nt, Salmonella typhimurium LT2
cuuugaacagccagaagccc

SEQ ID NO: 3815290 - RNA, 18 nt, Salmonella typhimurium LT2
cuuugaccagcaucgccg

SEQ ID NO: 3815291 - RNA, 22 nt, Salmonella typhimurium LT2
cuuugaccagcaucgccgguag

SEQ ID NO: 3815292 - RNA, 18 nt, Salmonella typhimurium LT2
cuuugacgacccgcuucc

SEQ ID NO: 3815293 - RNA, 19 nt, Salmonella typhimurium LT2
cuuugacgaccgcggccuu

SEQ ID NO: 3815294 - RNA, 16 nt, Salmonella typhimurium LT2
cuuugacgccgggaaa

SEQ ID NO: 3815295 - RNA, 20 nt, Salmonella typhimurium LT2
cuuugacgccgggaaauuuu

SEQ ID NO: 3815296 - RNA, 15 nt, Salmonella typhimurium LT2
cuuugaggaucaauu

SEQ ID NO: 3815297 - RNA, 20 nt, Salmonella typhimurium LT2
cuuugcacagucugcagacc

SEQ ID NO: 3815298 - RNA, 18 nt, Salmonella typhimurium LT2
cuuugcacguucugcugg

SEQ ID NO: 3815299 - RNA, 16 nt, Salmonella typhimurium LT2
cuuugcagaccuuucc

SEQ ID NO: 3815300 - RNA, 18 nt, Salmonella typhimurium LT2
cuuugcauuacggcgaau

SEQ ID NO: 3815301 - RNA, 16 nt, Salmonella typhimurium LT2
cuuugccaagaaacgc

SEQ ID NO: 3815302 - RNA, 19 nt, Salmonella typhimurium LT2
cuuugcccggccaccgccu

SEQ ID NO: 3815303 - RNA, 15 nt, Salmonella typhimurium LT2
cuuugcccucaaaga

SEQ ID NO: 3815304 - RNA, 21 nt, Salmonella typhimurium LT2
cuuugcccucaaagacccgga

SEQ ID NO: 3815305 - RNA, 23 nt, Salmonella typhimurium LT2
cuuugccgcaaacgccgaagcca

SEQ ID NO: 3815306 - RNA, 21 nt, Salmonella typhimurium LT2
cuuugccgcugcugccuucca

SEQ ID NO: 3815307 - RNA, 23 nt, Salmonella typhimurium LT2
cuuugccggaugguggucggcua

SEQ ID NO: 3815308 - RNA, 22 nt, Salmonella typhimurium LT2
cuuugccguucucugacaaaau

SEQ ID NO: 3815309 - RNA, 21 nt, Salmonella typhimurium LT2
cuuugccuuuuucccacugcg

SEQ ID NO: 3815310 - RNA, 17 nt, Salmonella typhimurium LT2
cuuugcgaaaaagugau

SEQ ID NO: 3815311 - RNA, 19 nt, Salmonella typhimurium LT2
cuuugcgauagcccggcau

SEQ ID NO: 3815312 - RNA, 12 nt, Salmonella typhimurium LT2
cuuugcgccauc

SEQ ID NO: 3815313 - RNA, 20 nt, Salmonella typhimurium LT2
cuuugcgccggcaguuuaag

SEQ ID NO: 3815314 - RNA, 18 nt, Salmonella typhimurium LT2
cuuugcguaaaaaaacau

SEQ ID NO: 3815315 - RNA, 22 nt, Salmonella typhimurium LT2
cuuugcucuggcuuguucaucg

SEQ ID NO: 3815316 - RNA, 20 nt, Salmonella typhimurium LT2
cuuugcuuuguaaagcgcca

SEQ ID NO: 3815317 - RNA, 19 nt, Salmonella typhimurium LT2
cuuuggacggcaucaggaa

SEQ ID NO: 3815318 - RNA, 23 nt, Salmonella typhimurium LT2
cuuuggagauuucggcauuuuua

SEQ ID NO: 3815319 - RNA, 18 nt, Salmonella typhimurium LT2
cuuuggcaaacggcgcca

SEQ ID NO: 3815320 - RNA, 20 nt, Salmonella typhimurium LT2
cuuuggcaccguuagugauu

SEQ ID NO: 3815321 - RNA, 23 nt, Salmonella typhimurium LT2
cuuuggccuggagaucagcaugg

SEQ ID NO: 3815322 - RNA, 19 nt, Salmonella typhimurium LT2
cuuuggcuuuaugaauauc

SEQ ID NO: 3815323 - RNA, 19 nt, Salmonella typhimurium LT2
cuuugugcuccaccagccc

SEQ ID NO: 3815324 - RNA, 16 nt, Salmonella typhimurium LT2
cuuuguggcaggucgg

SEQ ID NO: 3815325 - RNA, 23 nt, Salmonella typhimurium LT2
cuuuuaaacgugcggcggccucu

SEQ ID NO: 3815326 - RNA, 12 nt, Salmonella typhimurium LT2
gaaaagugaacg

SEQ ID NO: 3815327 - RNA, 18 nt, Salmonella typhimurium LT2
gaaaaguuacaggcucca

SEQ ID NO: 3815328 - RNA, 18 nt, Salmonella typhimurium LT2
gaaaaguuucgcucacac

SEQ ID NO: 3815329 - RNA, 14 nt, Salmonella typhimurium LT2
gaaaauaaaugcuu

SEQ ID NO: 3815330 - RNA, 16 nt, Salmonella typhimurium LT2
gaaaauaaaugcuuug

SEQ ID NO: 3815331 - RNA, 17 nt, Salmonella typhimurium LT2
gaaaauaccgcacauca

SEQ ID NO: 3815332 - RNA, 23 nt, Salmonella typhimurium LT2
gaaaauacugauuaauugcgaca

SEQ ID NO: 3815333 - RNA, 13 nt, Salmonella typhimurium LT2
gaaaauauaaucu

SEQ ID NO: 3815334 - RNA, 15 nt, Salmonella typhimurium LT2
gaaaauauacaccug

SEQ ID NO: 3815335 - RNA, 13 nt, Salmonella typhimurium LT2
gaaaauauauucu

SEQ ID NO: 3815336 - RNA, 13 nt, Salmonella typhimurium LT2
gaaaauaucggcc

SEQ ID NO: 3815337 - RNA, 18 nt, Salmonella typhimurium LT2
gaaaauaugaugcuaucu

SEQ ID NO: 3815338 - RNA, 18 nt, Salmonella typhimurium LT2
gaaaaucacaucgccgga

SEQ ID NO: 3815339 - RNA, 20 nt, Salmonella typhimurium LT2
gaaaaucagcgacuggucau

SEQ ID NO: 3815340 - RNA, 18 nt, Salmonella typhimurium LT2
gaaaaucgcugcgcccga

SEQ ID NO: 3815341 - RNA, 13 nt, Salmonella typhimurium LT2
gaaaaucugguuu

SEQ ID NO: 3815342 - RNA, 13 nt, Salmonella typhimurium LT2
gaaaaugaaaaau

SEQ ID NO: 3815343 - RNA, 19 nt, Salmonella typhimurium LT2
gaaaaugacuucaucgcca

SEQ ID NO: 3815344 - RNA, 18 nt, Salmonella typhimurium LT2
gaaaaugcgccaggaaac

SEQ ID NO: 3815345 - RNA, 19 nt, Salmonella typhimurium LT2
gaaaaugcguccagaggau

SEQ ID NO: 3815346 - RNA, 16 nt, Salmonella typhimurium LT2
gaaaaugguuuugccc

SEQ ID NO: 3815347 - RNA, 23 nt, Salmonella typhimurium LT2
gaaaauuaaucccaacccgacca

SEQ ID NO: 3815348 - RNA, 15 nt, Salmonella typhimurium LT2
gaaaauuccuggauu

SEQ ID NO: 3815349 - RNA, 21 nt, Salmonella typhimurium LT2
gaaaauuguccacggggcggc

SEQ ID NO: 3815350 - RNA, 20 nt, Salmonella typhimurium LT2
gaaaauuugcgggaacauau

SEQ ID NO: 3815351 - RNA, 23 nt, Salmonella typhimurium LT2
gaaacaacacaaaucgggcgggc

SEQ ID NO: 3815352 - RNA, 22 nt, Salmonella typhimurium LT2
gaaacaacacgaucgaugcccu

SEQ ID NO: 3815353 - RNA, 13 nt, Salmonella typhimurium LT2
gaaacagaauaaa

SEQ ID NO: 3815354 - RNA, 14 nt, Salmonella typhimurium LT2
gaaacagccaauca

SEQ ID NO: 3815355 - RNA, 13 nt, Salmonella typhimurium LT2
gaaacagggcaag

SEQ ID NO: 3815356 - RNA, 11 nt, Salmonella typhimurium LT2
gaaaccagcau

SEQ ID NO: 3815357 - RNA, 13 nt, Salmonella typhimurium LT2
gaaaccaggcgcg

SEQ ID NO: 3815358 - RNA, 14 nt, Salmonella typhimurium LT2
gaaacccaaauaac

SEQ ID NO: 3815359 - RNA, 21 nt, Salmonella typhimurium LT2
gaaacccgccaccgccagcca

SEQ ID NO: 3815360 - RNA, 16 nt, Salmonella typhimurium LT2
gaaaccgaauccuuug

SEQ ID NO: 3815361 - RNA, 19 nt, Salmonella typhimurium LT2
gaaaccgagguucaccagc

SEQ ID NO: 3815362 - RNA, 16 nt, Salmonella typhimurium LT2
gaaaccgcagaaaaag

SEQ ID NO: 3815363 - RNA, 21 nt, Salmonella typhimurium LT2
gaaaccggcgcgccuuccagc

SEQ ID NO: 3815364 - RNA, 13 nt, Salmonella typhimurium LT2
gaaacgacgucca

SEQ ID NO: 3815365 - RNA, 19 nt, Salmonella typhimurium LT2
gaaacgacguccacaccuu

SEQ ID NO: 3815366 - RNA, 13 nt, Salmonella typhimurium LT2
gaaacgaucgaua

SEQ ID NO: 3815367 - RNA, 19 nt, Salmonella typhimurium LT2
gaaacgcauacgcagcacu

SEQ ID NO: 3815368 - RNA, 19 nt, Salmonella typhimurium LT2
gaaacgccgaccacuucaa

SEQ ID NO: 3815369 - RNA, 21 nt, Salmonella typhimurium LT2
gaaacgcgccacgcgccagcc

SEQ ID NO: 3815370 - RNA, 17 nt, Salmonella typhimurium LT2
gaaacgcgccggaaggc

SEQ ID NO: 3815371 - RNA, 22 nt, Salmonella typhimurium LT2
gaaacgcggcccugaaaccgcc

SEQ ID NO: 3815372 - RNA, 17 nt, Salmonella typhimurium LT2
gaaacgcggcguagccg

SEQ ID NO: 3815373 - RNA, 16 nt, Salmonella typhimurium LT2
gaaacggaucaaaaag

SEQ ID NO: 3815374 - RNA, 20 nt, Salmonella typhimurium LT2
gaaacggcucgguuuauccc

SEQ ID NO: 3815375 - RNA, 22 nt, Salmonella typhimurium LT2
gaaacgguccugguccggaaua

SEQ ID NO: 3815376 - RNA, 15 nt, Salmonella typhimurium LT2
gaaacuccagcggca

SEQ ID NO: 3815377 - RNA, 18 nt, Salmonella typhimurium LT2
gaaacuccagcggcagga

SEQ ID NO: 3815378 - RNA, 21 nt, Salmonella typhimurium LT2
gaaacucgacgggaaucuccg

SEQ ID NO: 3815379 - RNA, 14 nt, Salmonella typhimurium LT2
gaaacucgccgcca

SEQ ID NO: 3815380 - RNA, 14 nt, Salmonella typhimurium LT2
gaaacucgcguagc

SEQ ID NO: 3815381 - RNA, 15 nt, Salmonella typhimurium LT2
gaaacugccuaaauu

SEQ ID NO: 3815382 - RNA, 15 nt, Salmonella typhimurium LT2
gaaacugcugccgca

SEQ ID NO: 3815383 - RNA, 17 nt, Salmonella typhimurium LT2
gaaacuggcgucauguu

SEQ ID NO: 3815384 - RNA, 11 nt, Salmonella typhimurium LT2
gaaagaaaauu

SEQ ID NO: 3815385 - RNA, 16 nt, Salmonella typhimurium LT2
gaaagaaggcuugguu

SEQ ID NO: 3815386 - RNA, 17 nt, Salmonella typhimurium LT2
gaaagaauaaucgccgc

SEQ ID NO: 3815387 - RNA, 18 nt, Salmonella typhimurium LT2
gaaagaauuacugaauac

SEQ ID NO: 3815388 - RNA, 23 nt, Salmonella typhimurium LT2
gaaagacgcgcucggcagcagcg

SEQ ID NO: 3815389 - RNA, 17 nt, Salmonella typhimurium LT2
gaaagaguacgccgaua

SEQ ID NO: 3815390 - RNA, 13 nt, Salmonella typhimurium LT2
gaaagauaaaaua

SEQ ID NO: 3815391 - RNA, 23 nt, Salmonella typhimurium LT2
gaaagaucagcagaacaaaggcu

SEQ ID NO: 3815392 - RNA, 14 nt, Salmonella typhimurium LT2
gaaagcaacagcaa

SEQ ID NO: 3815393 - RNA, 19 nt, Salmonella typhimurium LT2
gaaagccaguacagcacgc

SEQ ID NO: 3815394 - RNA, 18 nt, Salmonella typhimurium LT2
gaaagccccggcucaagc

SEQ ID NO: 3815395 - RNA, 15 nt, Salmonella typhimurium LT2
gaaagccucuuccgc

SEQ ID NO: 3815396 - RNA, 17 nt, Salmonella typhimurium LT2
gaaagccuucaucauca

SEQ ID NO: 3815397 - RNA, 18 nt, Salmonella typhimurium LT2
gaaagcgaccggcacuca

SEQ ID NO: 3815398 - RNA, 17 nt, Salmonella typhimurium LT2
gaaagcggcgaauauag

SEQ ID NO: 3815399 - RNA, 16 nt, Salmonella typhimurium LT2
gaaagcguaauauacg

SEQ ID NO: 3815400 - RNA, 20 nt, Salmonella typhimurium LT2
gaaagcucaggccuuauuua

SEQ ID NO: 3815401 - RNA, 15 nt, Salmonella typhimurium LT2
gaaagcugcaccagg

SEQ ID NO: 3815402 - RNA, 19 nt, Salmonella typhimurium LT2
gaaaggcgucagccgccau

SEQ ID NO: 3815403 - RNA, 15 nt, Salmonella typhimurium LT2
gaaaggcgugcagcg

SEQ ID NO: 3815404 - RNA, 16 nt, Salmonella typhimurium LT2
gaaaggcgugcagcgu

SEQ ID NO: 3815405 - RNA, 20 nt, Salmonella typhimurium LT2
gaaagguuaugcagcaagaa

SEQ ID NO: 3815406 - RNA, 18 nt, Salmonella typhimurium LT2
gaaagucaaaauaaaauu

SEQ ID NO: 3815407 - RNA, 21 nt, Salmonella typhimurium LT2
gaaagucuucccgcaaacugg

SEQ ID NO: 3815408 - RNA, 22 nt, Salmonella typhimurium LT2
gaaagugauuucaugugcuuuu

SEQ ID NO: 3815409 - RNA, 13 nt, Salmonella typhimurium LT2
gaaaguggugggu

SEQ ID NO: 3815410 - RNA, 16 nt, Salmonella typhimurium LT2
gaaaguggugggugau

SEQ ID NO: 3815411 - RNA, 14 nt, Salmonella typhimurium LT2
gaaauaaaagcaau

SEQ ID NO: 3815412 - RNA, 21 nt, Salmonella typhimurium LT2
gaaauaaaucgauagcgauuu

SEQ ID NO: 3815413 - RNA, 17 nt, Salmonella typhimurium LT2
gaaauaagagucaggau

SEQ ID NO: 3815414 - RNA, 23 nt, Salmonella typhimurium LT2
gaaauaccaggcggcuuuuucau

SEQ ID NO: 3815415 - RNA, 19 nt, Salmonella typhimurium LT2
gaaauagacgagcgaaaaa

SEQ ID NO: 3815416 - RNA, 23 nt, Salmonella typhimurium LT2
gaaauagacgagcgaaaaacugu

SEQ ID NO: 3815417 - RNA, 18 nt, Salmonella typhimurium LT2
gaaauauuauuccgguuc

SEQ ID NO: 3815418 - RNA, 12 nt, Salmonella typhimurium LT2
gaaaucaacgug

SEQ ID NO: 3815419 - RNA, 15 nt, Salmonella typhimurium LT2
gaaaucaagcgguuu

SEQ ID NO: 3815420 - RNA, 15 nt, Salmonella typhimurium LT2
gaaaucacgccacag

SEQ ID NO: 3815421 - RNA, 19 nt, Salmonella typhimurium LT2
gaaaucagagacaaauaca

SEQ ID NO: 3815422 - RNA, 16 nt, Salmonella typhimurium LT2
gaaaucagcacaaagu

SEQ ID NO: 3815423 - RNA, 20 nt, Salmonella typhimurium LT2
gaaaucaucaauggcgauuu

SEQ ID NO: 3815424 - RNA, 21 nt, Salmonella typhimurium LT2
gaaaucaucaauggcgauuuu

SEQ ID NO: 3815425 - RNA, 14 nt, Salmonella typhimurium LT2
gaaauccagcagaa

SEQ ID NO: 3815426 - RNA, 14 nt, Salmonella typhimurium LT2
gaaaucccggaggc

SEQ ID NO: 3815427 - RNA, 16 nt, Salmonella typhimurium LT2
gaaaucccggcguagc

SEQ ID NO: 3815428 - RNA, 23 nt, Salmonella typhimurium LT2
gaaauccgcgaauaccuucccgc

SEQ ID NO: 3815429 - RNA, 11 nt, Salmonella typhimurium LT2
gaaauccggcu

SEQ ID NO: 3815430 - RNA, 22 nt, Salmonella typhimurium LT2
gaaaucgccgggcuauccggcu

SEQ ID NO: 3815431 - RNA, 18 nt, Salmonella typhimurium LT2
gaaaucgguacgcgucug

SEQ ID NO: 3815432 - RNA, 22 nt, Salmonella typhimurium LT2
gaaaucgucagacggcuccagc

SEQ ID NO: 3815433 - RNA, 17 nt, Salmonella typhimurium LT2
gaaaucucccuggcagu

SEQ ID NO: 3815434 - RNA, 15 nt, Salmonella typhimurium LT2
gaaaugaauacgaua

SEQ ID NO: 3815435 - RNA, 11 nt, Salmonella typhimurium LT2
gaaaugagaaa

SEQ ID NO: 3815436 - RNA, 15 nt, Salmonella typhimurium LT2
gaaaugagaaaagga

SEQ ID NO: 3815437 - RNA, 22 nt, Salmonella typhimurium LT2
gaaaugcccauccacgccagcu

SEQ ID NO: 3815438 - RNA, 12 nt, Salmonella typhimurium LT2
gaaaugcgaauc

SEQ ID NO: 3815439 - RNA, 17 nt, Salmonella typhimurium LT2
gaaaugcgaauccggcg

SEQ ID NO: 3815440 - RNA, 17 nt, Salmonella typhimurium LT2
gaaaugcgacaucucag

SEQ ID NO: 3815441 - RNA, 19 nt, Salmonella typhimurium LT2
gaaauggaucggcuugccu

SEQ ID NO: 3815442 - RNA, 21 nt, Salmonella typhimurium LT2
gaaauggccauccauugcgcc

SEQ ID NO: 3815443 - RNA, 19 nt, Salmonella typhimurium LT2
gaaaugguuccaggcgcgc

SEQ ID NO: 3815444 - RNA, 13 nt, Salmonella typhimurium LT2
gaaauuagagcca

SEQ ID NO: 3815445 - RNA, 17 nt, Salmonella typhimurium LT2
gaaauuagagccaauau

SEQ ID NO: 3815446 - RNA, 13 nt, Salmonella typhimurium LT2
gaaauucgcgcca

SEQ ID NO: 3815447 - RNA, 17 nt, Salmonella typhimurium LT2
gaaauucucagaaacaa

SEQ ID NO: 3815448 - RNA, 16 nt, Salmonella typhimurium LT2
gaaauucugcaggcca

SEQ ID NO: 3815449 - RNA, 22 nt, Salmonella typhimurium LT2
gaaauucuggcgcagcuucuga

SEQ ID NO: 3815450 - RNA, 13 nt, Salmonella typhimurium LT2
gaaauuuauucau

SEQ ID NO: 3815451 - RNA, 13 nt, Salmonella typhimurium LT2
gaacaaaauagug

SEQ ID NO: 3815452 - RNA, 16 nt, Salmonella typhimurium LT2
gaacaaacuccagcac

SEQ ID NO: 3815453 - RNA, 15 nt, Salmonella typhimurium LT2
gaacaacgcaacaca

SEQ ID NO: 3815454 - RNA, 14 nt, Salmonella typhimurium LT2
gaacaacgccaggu

SEQ ID NO: 3815455 - RNA, 21 nt, Salmonella typhimurium LT2
gaacaaguucuucgaagcacu

SEQ ID NO: 3815456 - RNA, 16 nt, Salmonella typhimurium LT2
gaacagaaaaaaugca

SEQ ID NO: 3815457 - RNA, 21 nt, Salmonella typhimurium LT2
gaacagaaaaaaugcaccgcc

SEQ ID NO: 3815458 - RNA, 21 nt, Salmonella typhimurium LT2
gaacagaacagugaguuaaga

SEQ ID NO: 3815459 - RNA, 17 nt, Salmonella typhimurium LT2
gaacagacggcaaacaa

SEQ ID NO: 3815460 - RNA, 15 nt, Salmonella typhimurium LT2
gaacagauaaauguc

SEQ ID NO: 3815461 - RNA, 13 nt, Salmonella typhimurium LT2
gaacagccaggcu

SEQ ID NO: 3815462 - RNA, 13 nt, Salmonella typhimurium LT2
gaacagcgacggc

SEQ ID NO: 3815463 - RNA, 14 nt, Salmonella typhimurium LT2
gaacagcggcggca

SEQ ID NO: 3815464 - RNA, 18 nt, Salmonella typhimurium LT2
gaacaggccaaacccugc

SEQ ID NO: 3815465 - RNA, 17 nt, Salmonella typhimurium LT2
gaacaggcucagcgcca

SEQ ID NO: 3815466 - RNA, 18 nt, Salmonella typhimurium LT2
gaacaggcuucccaauac

SEQ ID NO: 3815467 - RNA, 15 nt, Salmonella typhimurium LT2
gaacagggccgcauc

SEQ ID NO: 3815468 - RNA, 15 nt, Salmonella typhimurium LT2
gaacagggcgggcga

SEQ ID NO: 3815469 - RNA, 21 nt, Salmonella typhimurium LT2
gaacagggcgggcgauagaga

SEQ ID NO: 3815470 - RNA, 23 nt, Salmonella typhimurium LT2
gaacagugaguuaagacgcuuca

SEQ ID NO: 3815471 - RNA, 23 nt, Salmonella typhimurium LT2
gaacaguguaaacgccagauaau

SEQ ID NO: 3815472 - RNA, 13 nt, Salmonella typhimurium LT2
gaacaguuucgcc

SEQ ID NO: 3815473 - RNA, 16 nt, Salmonella typhimurium LT2
gaacaguuucgccagc

SEQ ID NO: 3815474 - RNA, 23 nt, Salmonella typhimurium LT2
gaacaguuuugcgccuaaucguu

SEQ ID NO: 3815475 - RNA, 17 nt, Salmonella typhimurium LT2
gaacauaaaaacgcgcu

SEQ ID NO: 3815476 - RNA, 23 nt, Salmonella typhimurium LT2
gaacauacuuucucuccuucacg

SEQ ID NO: 3815477 - RNA, 15 nt, Salmonella typhimurium LT2
gaacaucagccagca

SEQ ID NO: 3815478 - RNA, 18 nt, Salmonella typhimurium LT2
gaacaucagccagcagcu

SEQ ID NO: 3815479 - RNA, 20 nt, Salmonella typhimurium LT2
gaacaucuaccgcauacuga

SEQ ID NO: 3815480 - RNA, 17 nt, Salmonella typhimurium LT2
gaacauuuuuucagccu

SEQ ID NO: 3815481 - RNA, 19 nt, Salmonella typhimurium LT2
gaaccaaaugcccagcuca

SEQ ID NO: 3815482 - RNA, 19 nt, Salmonella typhimurium LT2
gaaccaacgacccccacca

SEQ ID NO: 3815483 - RNA, 18 nt, Salmonella typhimurium LT2
gaaccaacugccaaacca

SEQ ID NO: 3815484 - RNA, 21 nt, Salmonella typhimurium LT2
gaaccaaucgagaagccauca

SEQ ID NO: 3815485 - RNA, 15 nt, Salmonella typhimurium LT2
gaaccagcaucccac

SEQ ID NO: 3815486 - RNA, 15 nt, Salmonella typhimurium LT2
gaaccagguuuccag

SEQ ID NO: 3815487 - RNA, 13 nt, Salmonella typhimurium LT2
gaaccauaauaaa

SEQ ID NO: 3815488 - RNA, 16 nt, Salmonella typhimurium LT2
gaaccaucauuaauau

SEQ ID NO: 3815489 - RNA, 22 nt, Salmonella typhimurium LT2
gaaccaucauuaauauaauccu

SEQ ID NO: 3815490 - RNA, 17 nt, Salmonella typhimurium LT2
gaaccaucgacccccac

SEQ ID NO: 3815491 - RNA, 13 nt, Salmonella typhimurium LT2
gaaccaugauauc

SEQ ID NO: 3815492 - RNA, 16 nt, Salmonella typhimurium LT2
gaaccauuuuccccag

SEQ ID NO: 3815493 - RNA, 13 nt, Salmonella typhimurium LT2
gaacccacuauac

SEQ ID NO: 3815494 - RNA, 13 nt, Salmonella typhimurium LT2
gaacccaggcacc

SEQ ID NO: 3815495 - RNA, 18 nt, Salmonella typhimurium LT2
gaaccccagacacagaug

SEQ ID NO: 3815496 - RNA, 13 nt, Salmonella typhimurium LT2
gaaccgacggugc

SEQ ID NO: 3815497 - RNA, 13 nt, Salmonella typhimurium LT2
gaaccgagauaca

SEQ ID NO: 3815498 - RNA, 13 nt, Salmonella typhimurium LT2
gaaccgccgaccc

SEQ ID NO: 3815499 - RNA, 18 nt, Salmonella typhimurium LT2
gaaccgccgacccccucc

SEQ ID NO: 3815500 - RNA, 19 nt, Salmonella typhimurium LT2
gaaccggcaucggcagcgu

SEQ ID NO: 3815501 - RNA, 22 nt, Salmonella typhimurium LT2
gaaccgggugcacgaacugcug

SEQ ID NO: 3815502 - RNA, 22 nt, Salmonella typhimurium LT2
gaaccggguugcggaagcuuuu

SEQ ID NO: 3815503 - RNA, 21 nt, Salmonella typhimurium LT2
gaaccguugcgcccaucauca

SEQ ID NO: 3815504 - RNA, 17 nt, Salmonella typhimurium LT2
gaaccucacggagaaaa

SEQ ID NO: 3815505 - RNA, 18 nt, Salmonella typhimurium LT2
gaaccucacggagaaaag

SEQ ID NO: 3815506 - RNA, 19 nt, Salmonella typhimurium LT2
gaaccuggcgguaaauacg

SEQ ID NO: 3815507 - RNA, 22 nt, Salmonella typhimurium LT2
gaacgaauuuacucgccaauau

SEQ ID NO: 3815508 - RNA, 15 nt, Salmonella typhimurium LT2
gaacgacucggcgau

SEQ ID NO: 3815509 - RNA, 17 nt, Salmonella typhimurium LT2
gaacgauaauaucguca

SEQ ID NO: 3815510 - RNA, 16 nt, Salmonella typhimurium LT2
gaacgauguaucgcgc

SEQ ID NO: 3815511 - RNA, 14 nt, Salmonella typhimurium LT2
gaacgcaauacugu

SEQ ID NO: 3815512 - RNA, 15 nt, Salmonella typhimurium LT2
gaacgcaauacugua

SEQ ID NO: 3815513 - RNA, 18 nt, Salmonella typhimurium LT2
gaacgccaaauacgucgc

SEQ ID NO: 3815514 - RNA, 14 nt, Salmonella typhimurium LT2
gaacgccaggccaa

SEQ ID NO: 3815515 - RNA, 16 nt, Salmonella typhimurium LT2
gaacgccuuauccggc

SEQ ID NO: 3815516 - RNA, 17 nt, Salmonella typhimurium LT2
gaacgccuuauccggcc

SEQ ID NO: 3815517 - RNA, 15 nt, Salmonella typhimurium LT2
gaacgcgaaggccag

SEQ ID NO: 3815518 - RNA, 15 nt, Salmonella typhimurium LT2
gaacgcgagaagccc

SEQ ID NO: 3815519 - RNA, 15 nt, Salmonella typhimurium LT2
gaacgcgcgcgcugu

SEQ ID NO: 3815520 - RNA, 19 nt, Salmonella typhimurium LT2
gaacgcguccaugaccacc

SEQ ID NO: 3815521 - RNA, 23 nt, Salmonella typhimurium LT2
gaacgcguccaugaccaccagcg

SEQ ID NO: 3815522 - RNA, 14 nt, Salmonella typhimurium LT2
gaacgcuaucaggu

SEQ ID NO: 3815523 - RNA, 18 nt, Salmonella typhimurium LT2
gaacgcuggcggcaggcc

SEQ ID NO: 3815524 - RNA, 18 nt, Salmonella typhimurium LT2
gaacggauaaacggcgca

SEQ ID NO: 3815525 - RNA, 19 nt, Salmonella typhimurium LT2
gaacggaucaugguugaaa

SEQ ID NO: 3815526 - RNA, 14 nt, Salmonella typhimurium LT2
gaacggcggauugc

SEQ ID NO: 3815527 - RNA, 18 nt, Salmonella typhimurium LT2
gaacggcgucauccggcg

SEQ ID NO: 3815528 - RNA, 19 nt, Salmonella typhimurium LT2
gaacggcuuuccagcagcc

SEQ ID NO: 3815529 - RNA, 21 nt, Salmonella typhimurium LT2
gaacgggaaccaugauaucgc

SEQ ID NO: 3815530 - RNA, 19 nt, Salmonella typhimurium LT2
gaacgggcuuuugaauaau

SEQ ID NO: 3815531 - RNA, 22 nt, Salmonella typhimurium LT2
gaacggguaaaugcgcgcggcu

SEQ ID NO: 3815532 - RNA, 14 nt, Salmonella typhimurium LT2
gaacgggugguuuc

SEQ ID NO: 3815533 - RNA, 14 nt, Salmonella typhimurium LT2
gaacguaauggcau

SEQ ID NO: 3815534 - RNA, 14 nt, Salmonella typhimurium LT2
gaaggggauuuucc

SEQ ID NO: 3815535 - RNA, 15 nt, Salmonella typhimurium LT2
gaaggggauuuuccg

SEQ ID NO: 3815536 - RNA, 21 nt, Salmonella typhimurium LT2
gaaggucgcauccgcguuagc

SEQ ID NO: 3815537 - RNA, 16 nt, Salmonella typhimurium LT2
gaagguuagcgucugc

SEQ ID NO: 3815538 - RNA, 15 nt, Salmonella typhimurium LT2
gaaguaagcgccagc

SEQ ID NO: 3815539 - RNA, 21 nt, Salmonella typhimurium LT2
gaaguagcagagaaaagguug

SEQ ID NO: 3815540 - RNA, 17 nt, Salmonella typhimurium LT2
gaaguccucuauuuuuu

SEQ ID NO: 3815541 - RNA, 19 nt, Salmonella typhimurium LT2
gaagucgaaacccaacauc

SEQ ID NO: 3815542 - RNA, 17 nt, Salmonella typhimurium LT2
gaagucuaucuguaacu

SEQ ID NO: 3815543 - RNA, 18 nt, Salmonella typhimurium LT2
gaagucugugaggaaagc

SEQ ID NO: 3815544 - RNA, 15 nt, Salmonella typhimurium LT2
gaaguggugggugau

SEQ ID NO: 3815545 - RNA, 20 nt, Salmonella typhimurium LT2
gaaguggugggugaugacgg

SEQ ID NO: 3815546 - RNA, 19 nt, Salmonella typhimurium LT2
gaaguuaccgcgccaggcg

SEQ ID NO: 3815547 - RNA, 16 nt, Salmonella typhimurium LT2
gaaguuuugcuggaau

SEQ ID NO: 3815548 - RNA, 14 nt, Salmonella typhimurium LT2
gaauaaaaaacaag

SEQ ID NO: 3815549 - RNA, 13 nt, Salmonella typhimurium LT2
gaauaaacgguaa

SEQ ID NO: 3815550 - RNA, 13 nt, Salmonella typhimurium LT2
gaauaaacucccg

SEQ ID NO: 3815551 - RNA, 16 nt, Salmonella typhimurium LT2
gaauaaagacaaugcu

SEQ ID NO: 3815552 - RNA, 11 nt, Salmonella typhimurium LT2
gaauaaauccu

SEQ ID NO: 3815553 - RNA, 14 nt, Salmonella typhimurium LT2
gaauaacaaaauga

SEQ ID NO: 3815554 - RNA, 16 nt, Salmonella typhimurium LT2
gaauaacaaaaugaga

SEQ ID NO: 3815555 - RNA, 17 nt, Salmonella typhimurium LT2
gaauaacaucguaaauc

SEQ ID NO: 3815556 - RNA, 19 nt, Salmonella typhimurium LT2
gaauaacaucguaaaucaa

SEQ ID NO: 3815557 - RNA, 16 nt, Salmonella typhimurium LT2
gaauaaccacugaugg

SEQ ID NO: 3815558 - RNA, 12 nt, Salmonella typhimurium LT2
gaauaaggcacc

SEQ ID NO: 3815559 - RNA, 19 nt, Salmonella typhimurium LT2
gaauaaggcaccgaugaca

SEQ ID NO: 3815560 - RNA, 17 nt, Salmonella typhimurium LT2
gaauaaucauccgcuuc

SEQ ID NO: 3815561 - RNA, 23 nt, Salmonella typhimurium LT2
gaauaauccuuccuccaccacca

SEQ ID NO: 3815562 - RNA, 15 nt, Salmonella typhimurium LT2
gaauaaucgccgccg

SEQ ID NO: 3815563 - RNA, 22 nt, Salmonella typhimurium LT2
gaauaaugcccaccgauuucag

SEQ ID NO: 3815564 - RNA, 16 nt, Salmonella typhimurium LT2
gaauaauguaaaaaaa

SEQ ID NO: 3815565 - RNA, 17 nt, Salmonella typhimurium LT2
gaauaauguaaaaaaau

SEQ ID NO: 3815566 - RNA, 18 nt, Salmonella typhimurium LT2
gaauacaaacccaggcaa

SEQ ID NO: 3815567 - RNA, 19 nt, Salmonella typhimurium LT2
gaauacaaacccaggcaau

SEQ ID NO: 3815568 - RNA, 13 nt, Salmonella typhimurium LT2
gaauacagcgccu

SEQ ID NO: 3815569 - RNA, 14 nt, Salmonella typhimurium LT2
gaauacccuccgcc

SEQ ID NO: 3815570 - RNA, 13 nt, Salmonella typhimurium LT2
gaauaccuucccg

SEQ ID NO: 3815571 - RNA, 11 nt, Salmonella typhimurium LT2
gaauacgauag

SEQ ID NO: 3815572 - RNA, 15 nt, Salmonella typhimurium LT2
gaauacgcaagccaa

SEQ ID NO: 3815573 - RNA, 22 nt, Salmonella typhimurium LT2
gaauacgcuccagcuggcuggc

SEQ ID NO: 3815574 - RNA, 19 nt, Salmonella typhimurium LT2
gaauacggaaggauagccg

SEQ ID NO: 3815575 - RNA, 19 nt, Salmonella typhimurium LT2
gaauacgguccguuuucgc

SEQ ID NO: 3815576 - RNA, 15 nt, Salmonella typhimurium LT2
gaauagacuggcgcc

SEQ ID NO: 3815577 - RNA, 16 nt, Salmonella typhimurium LT2
gaauagaggcgcuggc

SEQ ID NO: 3815578 - RNA, 19 nt, Salmonella typhimurium LT2
gaauagaguaauacaucca

SEQ ID NO: 3815579 - RNA, 17 nt, Salmonella typhimurium LT2
gaauagcaggcaaaaaa

SEQ ID NO: 3815580 - RNA, 15 nt, Salmonella typhimurium LT2
gaauagccagccccc

SEQ ID NO: 3815581 - RNA, 20 nt, Salmonella typhimurium LT2
gaauagccagcccccugcca

SEQ ID NO: 3815582 - RNA, 23 nt, Salmonella typhimurium LT2
gaauagccccucaauuauguauu

SEQ ID NO: 3815583 - RNA, 15 nt, Salmonella typhimurium LT2
gaauagcgcagaccc

SEQ ID NO: 3815584 - RNA, 19 nt, Salmonella typhimurium LT2
gaauagcgccuacgggcau

SEQ ID NO: 3815585 - RNA, 22 nt, Salmonella typhimurium LT2
gaauagcguauuuuuguacuuu

SEQ ID NO: 3815586 - RNA, 16 nt, Salmonella typhimurium LT2
gaauagugauaccagc

SEQ ID NO: 3815587 - RNA, 13 nt, Salmonella typhimurium LT2
gaauauaccauca

SEQ ID NO: 3815588 - RNA, 18 nt, Salmonella typhimurium LT2
gaauauagcuaaugcaau

SEQ ID NO: 3815589 - RNA, 15 nt, Salmonella typhimurium LT2
gaauaucuuuauccu

SEQ ID NO: 3815590 - RNA, 17 nt, Salmonella typhimurium LT2
gaauauguucuggcggu

SEQ ID NO: 3815591 - RNA, 19 nt, Salmonella typhimurium LT2
gaauauugcgccacgcugu

SEQ ID NO: 3815592 - RNA, 16 nt, Salmonella typhimurium LT2
gaaucaaugcaucuuc

SEQ ID NO: 3815593 - RNA, 15 nt, Salmonella typhimurium LT2
gaaucacauccgcca

SEQ ID NO: 3815594 - RNA, 21 nt, Salmonella typhimurium LT2
gaaucacauccgccagcgccu

SEQ ID NO: 3815595 - RNA, 15 nt, Salmonella typhimurium LT2
gaaucaccgacagca

SEQ ID NO: 3815596 - RNA, 18 nt, Salmonella typhimurium LT2
gaaucagcgauugcgcca

SEQ ID NO: 3815597 - RNA, 14 nt, Salmonella typhimurium LT2
gaaucaucacaauu

SEQ ID NO: 3815598 - RNA, 19 nt, Salmonella typhimurium LT2
gaauccagacuuuuuugcc

SEQ ID NO: 3815599 - RNA, 21 nt, Salmonella typhimurium LT2
gaaucccccugccacaaccgc

SEQ ID NO: 3815600 - RNA, 20 nt, Salmonella typhimurium LT2
gaaucccgccaucguccagc

SEQ ID NO: 3815601 - RNA, 14 nt, Salmonella typhimurium LT2
gaauccgucagguu

SEQ ID NO: 3815602 - RNA, 11 nt, Salmonella typhimurium LT2
gaauccuuccc

SEQ ID NO: 3815603 - RNA, 13 nt, Salmonella typhimurium LT2
gaaucgccaggcg

SEQ ID NO: 3815604 - RNA, 15 nt, Salmonella typhimurium LT2
gaaucgcgcgcgcca

SEQ ID NO: 3815605 - RNA, 14 nt, Salmonella typhimurium LT2
gaaucgcugcgcca

SEQ ID NO: 3815606 - RNA, 17 nt, Salmonella typhimurium LT2
gaaucgcugcgccagca

SEQ ID NO: 3815607 - RNA, 14 nt, Salmonella typhimurium LT2
gaaucgcuuccugg

SEQ ID NO: 3815608 - RNA, 15 nt, Salmonella typhimurium LT2
gaaucgcuuccuggg

SEQ ID NO: 3815609 - RNA, 18 nt, Salmonella typhimurium LT2
gaaucgcuuccuggguua

SEQ ID NO: 3815610 - RNA, 19 nt, Salmonella typhimurium LT2
gaaucguucgccagugaca

SEQ ID NO: 3815611 - RNA, 18 nt, Salmonella typhimurium LT2
gaaucuauuauuaaucug

SEQ ID NO: 3815612 - RNA, 17 nt, Salmonella typhimurium LT2
gaaucucccgauaaccu

SEQ ID NO: 3815613 - RNA, 22 nt, Salmonella typhimurium LT2
gaaucucgaaacaauagcugug

SEQ ID NO: 3815614 - RNA, 20 nt, Salmonella typhimurium LT2
gaaucucgugaucgccaaag

SEQ ID NO: 3815615 - RNA, 23 nt, Salmonella typhimurium LT2
gaaucugcggcugcgugauuuug

SEQ ID NO: 3815616 - RNA, 17 nt, Salmonella typhimurium LT2
gaaugaaaaaaaauuac

SEQ ID NO: 3815617 - RNA, 22 nt, Salmonella typhimurium LT2
gaaugaagccuuagcgggaggc

SEQ ID NO: 3815618 - RNA, 15 nt, Salmonella typhimurium LT2
gaaugaauagcggca

SEQ ID NO: 3815619 - RNA, 14 nt, Salmonella typhimurium LT2
gaaugagcaucuac

SEQ ID NO: 3815620 - RNA, 14 nt, Salmonella typhimurium LT2
gaaugagggcgcga

SEQ ID NO: 3815621 - RNA, 20 nt, Salmonella typhimurium LT2
gaaugagggcgcgaauacuc

SEQ ID NO: 3815622 - RNA, 19 nt, Salmonella typhimurium LT2
gaaugaguaaccagaccgu

SEQ ID NO: 3815623 - RNA, 23 nt, Salmonella typhimurium LT2
gaaugccauacuuuuccagcgcc

SEQ ID NO: 3815624 - RNA, 16 nt, Salmonella typhimurium LT2
gaaugccauccagcac

SEQ ID NO: 3815625 - RNA, 20 nt, Salmonella typhimurium LT2
gaaugccaucccuuccugac

SEQ ID NO: 3815626 - RNA, 22 nt, Salmonella typhimurium LT2
gaaugcccacgcuucccagcgu

SEQ ID NO: 3815627 - RNA, 23 nt, Salmonella typhimurium LT2
gaaugcccacgcuucccagcguc

SEQ ID NO: 3815628 - RNA, 21 nt, Salmonella typhimurium LT2
gaaugccguauaccagcguca

SEQ ID NO: 3815629 - RNA, 15 nt, Salmonella typhimurium LT2
gaaugccguugacca

SEQ ID NO: 3815630 - RNA, 11 nt, Salmonella typhimurium LT2
gaaugcgaaua

SEQ ID NO: 3815631 - RNA, 24 nt, Salmonella typhimurium LT2
gaaugcgaauaaucgccggacggc

SEQ ID NO: 3815632 - RNA, 23 nt, Salmonella typhimurium LT2
gaaugcgcgcgugaccccaggca

SEQ ID NO: 3815633 - RNA, 14 nt, Salmonella typhimurium LT2
gaaugcuauaugca

SEQ ID NO: 3815634 - RNA, 17 nt, Salmonella typhimurium LT2
gaaugcuauaugcaggc

SEQ ID NO: 3815635 - RNA, 20 nt, Salmonella typhimurium LT2
gaaugcugacgcguuuuuuc

SEQ ID NO: 3815636 - RNA, 17 nt, Salmonella typhimurium LT2
gaaugcuggggcggcgc

SEQ ID NO: 3815637 - RNA, 12 nt, Salmonella typhimurium LT2
gaauggagaagc

SEQ ID NO: 3815638 - RNA, 20 nt, Salmonella typhimurium LT2
gacauagugcaagaugccgu

SEQ ID NO: 3815639 - RNA, 22 nt, Salmonella typhimurium LT2
gacauauuuucgaugcacgcca

SEQ ID NO: 3815640 - RNA, 20 nt, Salmonella typhimurium LT2
gacaucaauagcaagggcaa

SEQ ID NO: 3815641 - RNA, 23 nt, Salmonella typhimurium LT2
gacaucagaaaauagugaauggc

SEQ ID NO: 3815642 - RNA, 11 nt, Salmonella typhimurium LT2
gacaucagcca

SEQ ID NO: 3815643 - RNA, 17 nt, Salmonella typhimurium LT2
gacaucagccagccgcc

SEQ ID NO: 3815644 - RNA, 19 nt, Salmonella typhimurium LT2
gacaucagccagccgccaa

SEQ ID NO: 3815645 - RNA, 21 nt, Salmonella typhimurium LT2
gacauccaugauaaucagcac

SEQ ID NO: 3815646 - RNA, 11 nt, Salmonella typhimurium LT2
gacauccgcca

SEQ ID NO: 3815647 - RNA, 13 nt, Salmonella typhimurium LT2
gacauccgccauc

SEQ ID NO: 3815648 - RNA, 15 nt, Salmonella typhimurium LT2
gacauccgccaucca

SEQ ID NO: 3815649 - RNA, 15 nt, Salmonella typhimurium LT2
gacauccggauccag

SEQ ID NO: 3815650 - RNA, 23 nt, Salmonella typhimurium LT2
gacauccucuucauaacgacauu

SEQ ID NO: 3815651 - RNA, 18 nt, Salmonella typhimurium LT2
gacaucgccaaccgcgac

SEQ ID NO: 3815652 - RNA, 23 nt, Salmonella typhimurium LT2
gacaucgccaacgccaaccggcu

SEQ ID NO: 3815653 - RNA, 20 nt, Salmonella typhimurium LT2
gacaucggagauuucauccu

SEQ ID NO: 3815654 - RNA, 16 nt, Salmonella typhimurium LT2
gacaucgucacaauau

SEQ ID NO: 3815655 - RNA, 15 nt, Salmonella typhimurium LT2
gacaucucaggcaag

SEQ ID NO: 3815656 - RNA, 22 nt, Salmonella typhimurium LT2
gacaugcuccgccccgccuucc

SEQ ID NO: 3815657 - RNA, 15 nt, Salmonella typhimurium LT2
gacauggcgaccggg

SEQ ID NO: 3815658 - RNA, 14 nt, Salmonella typhimurium LT2
gacauuaauucagu

SEQ ID NO: 3815659 - RNA, 17 nt, Salmonella typhimurium LT2
gacauugguuucaugca

SEQ ID NO: 3815660 - RNA, 23 nt, Salmonella typhimurium LT2
gacauugguuucaugcaucauug

SEQ ID NO: 3815661 - RNA, 19 nt, Salmonella typhimurium LT2
gacauuuggggcuggcgac

SEQ ID NO: 3815662 - RNA, 12 nt, Salmonella typhimurium LT2
gacauuuuugcc

SEQ ID NO: 3815663 - RNA, 15 nt, Salmonella typhimurium LT2
gaccaaaaucaaacu

SEQ ID NO: 3815664 - RNA, 18 nt, Salmonella typhimurium LT2
gaccaaaaucaaacugau

SEQ ID NO: 3815665 - RNA, 23 nt, Salmonella typhimurium LT2
gaccaaaauggcaaguaaaauaa

SEQ ID NO: 3815666 - RNA, 20 nt, Salmonella typhimurium LT2
gaccaaaugguugguauugc

SEQ ID NO: 3815667 - RNA, 13 nt, Salmonella typhimurium LT2
gaccaacagcauc

SEQ ID NO: 3815668 - RNA, 15 nt, Salmonella typhimurium LT2
gaccaacagcaucac

SEQ ID NO: 3815669 - RNA, 18 nt, Salmonella typhimurium LT2
gaccaacuuuuguagaga

SEQ ID NO: 3815670 - RNA, 17 nt, Salmonella typhimurium LT2
gaccaagcgucagcaug

SEQ ID NO: 3815671 - RNA, 21 nt, Salmonella typhimurium LT2
gaccaauacugagacgcgaaa

SEQ ID NO: 3815672 - RNA, 12 nt, Salmonella typhimurium LT2
gaccaauauccg

SEQ ID NO: 3815673 - RNA, 13 nt, Salmonella typhimurium LT2
gaccacaacccac

SEQ ID NO: 3815674 - RNA, 15 nt, Salmonella typhimurium LT2
gaccaccauauucgc

SEQ ID NO: 3815675 - RNA, 18 nt, Salmonella typhimurium LT2
gaccacccgcggccaggu

SEQ ID NO: 3815676 - RNA, 16 nt, Salmonella typhimurium LT2
gaccaccgcaucggca

SEQ ID NO: 3815677 - RNA, 16 nt, Salmonella typhimurium LT2
gaccacgaaucaggau

SEQ ID NO: 3815678 - RNA, 15 nt, Salmonella typhimurium LT2
gaccacgccaccgcc

SEQ ID NO: 3815679 - RNA, 23 nt, Salmonella typhimurium LT2
gaccacgccaucaacagcggaga

SEQ ID NO: 3815680 - RNA, 15 nt, Salmonella typhimurium LT2
gaccagaccgauuug

SEQ ID NO: 3815681 - RNA, 21 nt, Salmonella typhimurium LT2
gaccagaccgauuuggucagu

SEQ ID NO: 3815682 - RNA, 13 nt, Salmonella typhimurium LT2
gaccagauauccc

SEQ ID NO: 3815683 - RNA, 21 nt, Salmonella typhimurium LT2
gaccagcaaaaagaaucgcca

SEQ ID NO: 3815684 - RNA, 22 nt, Salmonella typhimurium LT2
gaccagcaaaaagaaucgccag

SEQ ID NO: 3815685 - RNA, 23 nt, Salmonella typhimurium LT2
gaccagcaaaaagaaucgccagg

SEQ ID NO: 3815686 - RNA, 18 nt, Salmonella typhimurium LT2
gaccagcaauaaaccacu

SEQ ID NO: 3815687 - RNA, 14 nt, Salmonella typhimurium LT2
gaccagcaccaucu

SEQ ID NO: 3815688 - RNA, 23 nt, Salmonella typhimurium LT2
gaccagcaccaucuuuuccggca

SEQ ID NO: 3815689 - RNA, 11 nt, Salmonella typhimurium LT2
gaccagcaccu

SEQ ID NO: 3815690 - RNA, 13 nt, Salmonella typhimurium LT2
gaccagcaucagc

SEQ ID NO: 3815691 - RNA, 21 nt, Salmonella typhimurium LT2
gaccagccuaccugccgccau

SEQ ID NO: 3815692 - RNA, 18 nt, Salmonella typhimurium LT2
gaccagcgacgaugaaau

SEQ ID NO: 3815693 - RNA, 13 nt, Salmonella typhimurium LT2
gaccagcgccgga

SEQ ID NO: 3815694 - RNA, 15 nt, Salmonella typhimurium LT2
gaccagcgccggagc

SEQ ID NO: 3815695 - RNA, 22 nt, Salmonella typhimurium LT2
gaccagcguaccgucucggccu

SEQ ID NO: 3815696 - RNA, 20 nt, Salmonella typhimurium LT2
gaccagcguuggugccgcca

SEQ ID NO: 3815697 - RNA, 22 nt, Salmonella typhimurium LT2
gaccagcguuggugccgccaga

SEQ ID NO: 3815698 - RNA, 20 nt, Salmonella typhimurium LT2
gaccaggauuuaauggucuc

SEQ ID NO: 3815699 - RNA, 14 nt, Salmonella typhimurium LT2
gaccaggguuaaaa

SEQ ID NO: 3815700 - RNA, 15 nt, Salmonella typhimurium LT2
gaccagguacagcuu

SEQ ID NO: 3815701 - RNA, 15 nt, Salmonella typhimurium LT2
gaccaguaagagaac

SEQ ID NO: 3815702 - RNA, 18 nt, Salmonella typhimurium LT2
gaccagucggacagcgac

SEQ ID NO: 3815703 - RNA, 14 nt, Salmonella typhimurium LT2
gaccaguuaagcaa

SEQ ID NO: 3815704 - RNA, 18 nt, Salmonella typhimurium LT2
gaccaguucaccggcggc

SEQ ID NO: 3815705 - RNA, 20 nt, Salmonella typhimurium LT2
gaccaguuguaaucggcgcc

SEQ ID NO: 3815706 - RNA, 22 nt, Salmonella typhimurium LT2
gaccauaauuuccggcgcaucg

SEQ ID NO: 3815707 - RNA, 19 nt, Salmonella typhimurium LT2
gaccauaguccaugcccaa

SEQ ID NO: 3815708 - RNA, 22 nt, Salmonella typhimurium LT2
gaccauauugaagggaccgcga

SEQ ID NO: 3815709 - RNA, 15 nt, Salmonella typhimurium LT2
gaccaucaauccggg

SEQ ID NO: 3815710 - RNA, 23 nt, Salmonella typhimurium LT2
gaccaucaauccgggugccguag

SEQ ID NO: 3815711 - RNA, 12 nt, Salmonella typhimurium LT2
gaccauccacca

SEQ ID NO: 3815712 - RNA, 16 nt, Salmonella typhimurium LT2
gaccauccaccagaac

SEQ ID NO: 3815713 - RNA, 20 nt, Salmonella typhimurium LT2
gaccaucgcgccgcuggcgu

SEQ ID NO: 3815714 - RNA, 14 nt, Salmonella typhimurium LT2
gaccaucggccgcu

SEQ ID NO: 3815715 - RNA, 15 nt, Salmonella typhimurium LT2
gaccaucucuuccgc

SEQ ID NO: 3815716 - RNA, 22 nt, Salmonella typhimurium LT2
gaccaugcauauaagagacgcc

SEQ ID NO: 3815717 - RNA, 21 nt, Salmonella typhimurium LT2
gaccaugcgugguaaagaagc

SEQ ID NO: 3815718 - RNA, 22 nt, Salmonella typhimurium LT2
gaccaugcgugguaaagaagcc

SEQ ID NO: 3815719 - RNA, 17 nt, Salmonella typhimurium LT2
gaccauugcguauuuca

SEQ ID NO: 3815720 - RNA, 23 nt, Salmonella typhimurium LT2
gacccagacaaccgggcaucacc

SEQ ID NO: 3815721 - RNA, 21 nt, Salmonella typhimurium LT2
gacccagauugccgauauaca

SEQ ID NO: 3815722 - RNA, 19 nt, Salmonella typhimurium LT2
gacccagcgcgaauuugcc

SEQ ID NO: 3815723 - RNA, 16 nt, Salmonella typhimurium LT2
gacccaguacaaacaa

SEQ ID NO: 3815724 - RNA, 20 nt, Salmonella typhimurium LT2
gacccauacucuuucccggc

SEQ ID NO: 3815725 - RNA, 16 nt, Salmonella typhimurium LT2
gacccaucaauaacga

SEQ ID NO: 3815726 - RNA, 12 nt, Salmonella typhimurium LT2
gacccauuuuaa

SEQ ID NO: 3815727 - RNA, 16 nt, Salmonella typhimurium LT2
gaccccaguaauccgg

SEQ ID NO: 3815728 - RNA, 18 nt, Salmonella typhimurium LT2
gaccccaguaauccggca

SEQ ID NO: 3815729 - RNA, 16 nt, Salmonella typhimurium LT2
gacccccaccauguca

SEQ ID NO: 3815730 - RNA, 12 nt, Salmonella typhimurium LT2
gacccccuccuu

SEQ ID NO: 3815731 - RNA, 22 nt, Salmonella typhimurium LT2
gaccccgccaucagacaggcau

SEQ ID NO: 3815732 - RNA, 18 nt, Salmonella typhimurium LT2
gaccccggccucgcccgc

SEQ ID NO: 3815733 - RNA, 23 nt, Salmonella typhimurium LT2
gaccccuggguagaguaacccuu

SEQ ID NO: 3815734 - RNA, 14 nt, Salmonella typhimurium LT2
gacccgaaccugcg

SEQ ID NO: 3815735 - RNA, 14 nt, Salmonella typhimurium LT2
gacccgaaguggug

SEQ ID NO: 3815736 - RNA, 15 nt, Salmonella typhimurium LT2
gacccgcaauaacgc

SEQ ID NO: 3815737 - RNA, 18 nt, Salmonella typhimurium LT2
gacccgcaauaacgccga

SEQ ID NO: 3815738 - RNA, 19 nt, Salmonella typhimurium LT2
gacccgcuuccaguuuugc

SEQ ID NO: 3815739 - RNA, 21 nt, Salmonella typhimurium LT2
gacccguggcugcgccugcgc

SEQ ID NO: 3815740 - RNA, 19 nt, Salmonella typhimurium LT2
gacccugagcucaaacgua

SEQ ID NO: 3815741 - RNA, 19 nt, Salmonella typhimurium LT2
gaccgacaagccccccgca

SEQ ID NO: 3815742 - RNA, 14 nt, Salmonella typhimurium LT2
gaccgacgccaacc

SEQ ID NO: 3815743 - RNA, 17 nt, Salmonella typhimurium LT2
gaccgagacccagcgcg

SEQ ID NO: 3815744 - RNA, 18 nt, Salmonella typhimurium LT2
gaccgagacccagcgcga

SEQ ID NO: 3815745 - RNA, 14 nt, Salmonella typhimurium LT2
gaccgauaauaaug

SEQ ID NO: 3815746 - RNA, 13 nt, Salmonella typhimurium LT2
gaccgauagagac

SEQ ID NO: 3815747 - RNA, 22 nt, Salmonella typhimurium LT2
gaccgauagagacugccgccgu

SEQ ID NO: 3815748 - RNA, 16 nt, Salmonella typhimurium LT2
gaccgauauagccacu

SEQ ID NO: 3815749 - RNA, 18 nt, Salmonella typhimurium LT2
gaccgauauagccacuca

SEQ ID NO: 3815750 - RNA, 22 nt, Salmonella typhimurium LT2
gaccgaucucaugcaacuggca

SEQ ID NO: 3815751 - RNA, 23 nt, Salmonella typhimurium LT2
gaccgcaaaccgaauucguccac

SEQ ID NO: 3815752 - RNA, 15 nt, Salmonella typhimurium LT2
gaccgcacagcagac

SEQ ID NO: 3815753 - RNA, 23 nt, Salmonella typhimurium LT2
gaccgccacaucguuggccgcca

SEQ ID NO: 3815754 - RNA, 13 nt, Salmonella typhimurium LT2
gaccgccagaggc

SEQ ID NO: 3815755 - RNA, 21 nt, Salmonella typhimurium LT2
gaccgccaugcggcgccauca

SEQ ID NO: 3815756 - RNA, 18 nt, Salmonella typhimurium LT2
gaccgccgauaaagaacu

SEQ ID NO: 3815757 - RNA, 21 nt, Salmonella typhimurium LT2
gaccgccgaugcugaauagcc

SEQ ID NO: 3815758 - RNA, 22 nt, Salmonella typhimurium LT2
gaccgccgaugcugaauagcca

SEQ ID NO: 3815759 - RNA, 22 nt, Salmonella typhimurium LT2
gaccgccgucauagcaggagau

SEQ ID NO: 3815760 - RNA, 16 nt, Salmonella typhimurium LT2
gaccgcgcucaccgcc

SEQ ID NO: 3815761 - RNA, 17 nt, Salmonella typhimurium LT2
gaccgcuuaacuccggc

SEQ ID NO: 3815762 - RNA, 21 nt, Salmonella typhimurium LT2
gaccgcuuaacuccggcgacc

SEQ ID NO: 3815763 - RNA, 17 nt, Salmonella typhimurium LT2
gaccgcuuucgccuggu

SEQ ID NO: 3815764 - RNA, 19 nt, Salmonella typhimurium LT2
gaccggcagccguuuuccg

SEQ ID NO: 3815765 - RNA, 18 nt, Salmonella typhimurium LT2
gaccggcgaacgcuggcu

SEQ ID NO: 3815766 - RNA, 19 nt, Salmonella typhimurium LT2
gaccggcguuuuuauaaga

SEQ ID NO: 3815767 - RNA, 22 nt, Salmonella typhimurium LT2
gaccggcugauugaccuggucg

SEQ ID NO: 3815768 - RNA, 22 nt, Salmonella typhimurium LT2
gaccgguuuuucgccgaccauc

SEQ ID NO: 3815769 - RNA, 17 nt, Salmonella typhimurium LT2
gaccguaauaucgcggg

SEQ ID NO: 3815770 - RNA, 16 nt, Salmonella typhimurium LT2
gaccgucgcgcccucc

SEQ ID NO: 3815771 - RNA, 19 nt, Salmonella typhimurium LT2
gaccgucuuugucaagcac

SEQ ID NO: 3815772 - RNA, 23 nt, Salmonella typhimurium LT2
gaccuacaaauuacacaauauca

SEQ ID NO: 3815773 - RNA, 12 nt, Salmonella typhimurium LT2
gaccucaagaau

SEQ ID NO: 3815774 - RNA, 21 nt, Salmonella typhimurium LT2
gaccucauccaucagcgcggg

SEQ ID NO: 3815775 - RNA, 21 nt, Salmonella typhimurium LT2
gaccucuucuuugagcucccg

SEQ ID NO: 3815776 - RNA, 23 nt, Salmonella typhimurium LT2
gaccugcagcuccacaaauagca

SEQ ID NO: 3815777 - RNA, 20 nt, Salmonella typhimurium LT2
gaccugcagcuccgcaauuu

SEQ ID NO: 3815778 - RNA, 22 nt, Salmonella typhimurium LT2
gaccugcugguuauuauccauc

SEQ ID NO: 3815779 - RNA, 17 nt, Salmonella typhimurium LT2
gaccuguaccgcgacaa

SEQ ID NO: 3815780 - RNA, 22 nt, Salmonella typhimurium LT2
gaccuguucuguaggcugugca

SEQ ID NO: 3815781 - RNA, 15 nt, Salmonella typhimurium LT2
gaccuuaauccagcc

SEQ ID NO: 3815782 - RNA, 14 nt, Salmonella typhimurium LT2
gaccuuaauuucuu

SEQ ID NO: 3815783 - RNA, 17 nt, Salmonella typhimurium LT2
gaccuucaucucuuugc

SEQ ID NO: 3815784 - RNA, 18 nt, Salmonella typhimurium LT2
gaccuuuuacuucacgua

SEQ ID NO: 3815785 - RNA, 16 nt, Salmonella typhimurium LT2
gacgaaaaaucuggcg

SEQ ID NO: 3815786 - RNA, 20 nt, Salmonella typhimurium LT2
gacgaaauagcguucugguu

SEQ ID NO: 3815787 - RNA, 15 nt, Salmonella typhimurium LT2
gacgaacggccugau

SEQ ID NO: 3815788 - RNA, 13 nt, Salmonella typhimurium LT2
gacgaaucagcga

SEQ ID NO: 3815789 - RNA, 21 nt, Salmonella typhimurium LT2
gacgaaucagcgauugcgcca

SEQ ID NO: 3815790 - RNA, 14 nt, Salmonella typhimurium LT2
gacgacacggcgca

SEQ ID NO: 3815791 - RNA, 18 nt, Salmonella typhimurium LT2
gacgacaucgcucaaaac

SEQ ID NO: 3815792 - RNA, 16 nt, Salmonella typhimurium LT2
gacgacccuguguagu

SEQ ID NO: 3815793 - RNA, 17 nt, Salmonella typhimurium LT2
gacgacgccaggcgguc

SEQ ID NO: 3815794 - RNA, 19 nt, Salmonella typhimurium LT2
gacgacggcaggggcguga

SEQ ID NO: 3815795 - RNA, 18 nt, Salmonella typhimurium LT2
gacgacuucacccgcggg

SEQ ID NO: 3815796 - RNA, 21 nt, Salmonella typhimurium LT2
gacgagcgcgucagcgccucc

SEQ ID NO: 3815797 - RNA, 18 nt, Salmonella typhimurium LT2
gacgagguuuccggcggg

SEQ ID NO: 3815798 - RNA, 13 nt, Salmonella typhimurium LT2
gacgauaaccgga

SEQ ID NO: 3815799 - RNA, 13 nt, Salmonella typhimurium LT2
gacgauacaccuu

SEQ ID NO: 3815800 - RNA, 20 nt, Salmonella typhimurium LT2
gacgauacggcccagacccc

SEQ ID NO: 3815801 - RNA, 19 nt, Salmonella typhimurium LT2
gacgauacucaaaccugcg

SEQ ID NO: 3815802 - RNA, 21 nt, Salmonella typhimurium LT2
gacgauacucagccccaggcc

SEQ ID NO: 3815803 - RNA, 13 nt, Salmonella typhimurium LT2
gacgauagucagc

SEQ ID NO: 3815804 - RNA, 15 nt, Salmonella typhimurium LT2
gacgauagucagcgc

SEQ ID NO: 3815805 - RNA, 13 nt, Salmonella typhimurium LT2
gacgaucagcgca

SEQ ID NO: 3815806 - RNA, 14 nt, Salmonella typhimurium LT2
gacgaucagcgcca

SEQ ID NO: 3815807 - RNA, 15 nt, Salmonella typhimurium LT2
gacgaucagcgccac

SEQ ID NO: 3815808 - RNA, 14 nt, Salmonella typhimurium LT2
gacgaucgauccag

SEQ ID NO: 3815809 - RNA, 13 nt, Salmonella typhimurium LT2
gacgaugauaaua

SEQ ID NO: 3815810 - RNA, 20 nt, Salmonella typhimurium LT2
gacgauuugcgcucgcgcca

SEQ ID NO: 3815811 - RNA, 14 nt, Salmonella typhimurium LT2
gacgcaacucacgc

SEQ ID NO: 3815812 - RNA, 20 nt, Salmonella typhimurium LT2
gacgcaauagaguaaugaca

SEQ ID NO: 3815813 - RNA, 15 nt, Salmonella typhimurium LT2
gacgcacaaucgccg

SEQ ID NO: 3815814 - RNA, 15 nt, Salmonella typhimurium LT2
gacgcagacaauaaa

SEQ ID NO: 3815815 - RNA, 16 nt, Salmonella typhimurium LT2
gacgcagaccaaaauc

SEQ ID NO: 3815816 - RNA, 21 nt, Salmonella typhimurium LT2
gacgcagacgucaacaccucc

SEQ ID NO: 3815817 - RNA, 12 nt, Salmonella typhimurium LT2
gacgcagcagcu

SEQ ID NO: 3815818 - RNA, 15 nt, Salmonella typhimurium LT2
gacgcagcucauacc

SEQ ID NO: 3815819 - RNA, 20 nt, Salmonella typhimurium LT2
gacgcaggcgccuuauccgg

SEQ ID NO: 3815820 - RNA, 19 nt, Salmonella typhimurium LT2
gacgcauaaugacguccag

SEQ ID NO: 3815821 - RNA, 14 nt, Salmonella typhimurium LT2
gacgcaugaaacgc

SEQ ID NO: 3815822 - RNA, 20 nt, Salmonella typhimurium LT2
gacgcauuuuuccguauugc

SEQ ID NO: 3815823 - RNA, 16 nt, Salmonella typhimurium LT2
gacgccaaacccgcca

SEQ ID NO: 3815824 - RNA, 17 nt, Salmonella typhimurium LT2
gacgccaagcugcagaa

SEQ ID NO: 3815825 - RNA, 19 nt, Shigella flexneri 2a str. 2457T
caggcuuuuuuauugccau

SEQ ID NO: 3815826 - RNA, 18 nt, Shigella flexneri 2a str. 2457T
cagggaaaaaagccccgu

SEQ ID NO: 3815827 - RNA, 13 nt, Shigella flexneri 2a str. 2457T
cagggaaaaauug

SEQ ID NO: 3815828 - RNA, 15 nt, Shigella flexneri 2a str. 2457T
cagggaaugaggauc

SEQ ID NO: 3815829 - RNA, 17 nt, Shigella flexneri 2a str. 2457T
cagggaaugugaugaaa

SEQ ID NO: 3815830 - RNA, 23 nt, Shigella flexneri 2a str. 2457T
cagggacgagucgucgauaucga

SEQ ID NO: 3815831 - RNA, 20 nt, Shigella flexneri 2a str. 2457T
cagggagucuugcuggaugc

SEQ ID NO: 3815832 - RNA, 18 nt, Shigella flexneri 2a str. 2457T
cagggauauuucaccgcc

SEQ ID NO: 3815833 - RNA, 17 nt, Shigella flexneri 2a str. 2457T
cagggaucauccacccg

SEQ ID NO: 3815834 - RNA, 15 nt, Shigella flexneri 2a str. 2457T
cagggaugaagugaa

SEQ ID NO: 3815835 - RNA, 19 nt, Shigella flexneri 2a str. 2457T
cagggaugaagugaagaug

SEQ ID NO: 3815836 - RNA, 17 nt, Shigella flexneri 2a str. 2457T
cagggcaaaauuucccc

SEQ ID NO: 3815837 - RNA, 13 nt, Shigella flexneri 2a str. 2457T
cagggcaagcgcc

SEQ ID NO: 3815838 - RNA, 22 nt, Shigella flexneri 2a str. 2457T
cagggcaauuaaaaauuucccc

SEQ ID NO: 3815839 - RNA, 17 nt, Shigella flexneri 2a str. 2457T
cagggccaacuggcaaa

SEQ ID NO: 3815840 - RNA, 12 nt, Shigella flexneri 2a str. 2457T
cagggccaggaa

SEQ ID NO: 3815841 - RNA, 21 nt, Shigella flexneri 2a str. 2457T
cagggccaucgcgguuaaucg

SEQ ID NO: 3815842 - RNA, 16 nt, Shigella flexneri 2a str. 2457T
cagggccgaucaacga

SEQ ID NO: 3815843 - RNA, 21 nt, Shigella flexneri 2a str. 2457T
cagggccgcgaaucuccagau

SEQ ID NO: 3815844 - RNA, 16 nt, Shigella flexneri 2a str. 2457T
cagggccuccugcagc

SEQ ID NO: 3815845 - RNA, 20 nt, Shigella flexneri 2a str. 2457T
cagggccucuccuuuaccac

SEQ ID NO: 3815846 - RNA, 13 nt, Shigella flexneri 2a str. 2457T
cagggccugaagg

SEQ ID NO: 3815847 - RNA, 14 nt, Shigella flexneri 2a str. 2457T
cagggccugaagga

SEQ ID NO: 3815848 - RNA, 18 nt, Shigella flexneri 2a str. 2457T
cagggcgaauucuugccu

SEQ ID NO: 3815849 - RNA, 18 nt, Shigella flexneri 2a str. 2457T
cagggcgcgggcaacaga

SEQ ID NO: 3815850 - RNA, 21 nt, Shigella flexneri 2a str. 2457T
cagggcgcgggcaacagaauu

SEQ ID NO: 3815851 - RNA, 12 nt, Shigella flexneri 2a str. 2457T
cagggcggcagg

SEQ ID NO: 3815852 - RNA, 14 nt, Shigella flexneri 2a str. 2457T
cagggcgucaccgg

SEQ ID NO: 3815853 - RNA, 22 nt, Shigella flexneri 2a str. 2457T
cagggcuuucgcaauaaucauc

SEQ ID NO: 3815854 - RNA, 16 nt, Shigella flexneri 2a str. 2457T
cagggcuuucgcgucg

SEQ ID NO: 3815855 - RNA, 17 nt, Shigella flexneri 2a str. 2457T
caggggcagcaccauca

SEQ ID NO: 3815856 - RNA, 23 nt, Shigella flexneri 2a str. 2457T
caggguaauuuguaacugucggg

SEQ ID NO: 3815857 - RNA, 18 nt, Shigella flexneri 2a str. 2457T
caggguaccgauagauuu

SEQ ID NO: 3815858 - RNA, 20 nt, Shigella flexneri 2a str. 2457T
caggguagacuuggcuuucu

SEQ ID NO: 3815859 - RNA, 19 nt, Shigella flexneri 2a str. 2457T
caggguauggaucccucuu

SEQ ID NO: 3815860 - RNA, 16 nt, Shigella flexneri 2a str. 2457T
cagggucuuccagcaa

SEQ ID NO: 3815861 - RNA, 22 nt, Shigella flexneri 2a str. 2457T
cagggugacaaauuugugcucu

SEQ ID NO: 3815862 - RNA, 17 nt, Shigella flexneri 2a str. 2457T
cagggugcuggcgcuca

SEQ ID NO: 3815863 - RNA, 17 nt, Shigella flexneri 2a str. 2457T
caggguggugacaccau

SEQ ID NO: 3815864 - RNA, 17 nt, Shigella flexneri 2a str. 2457T
caggguguauucaugcc

SEQ ID NO: 3815865 - RNA, 15 nt, Shigella flexneri 2a str. 2457T
caggguugcagaccc

SEQ ID NO: 3815866 - RNA, 13 nt, Shigella flexneri 2a str. 2457T
cagguaaacaccu

SEQ ID NO: 3815867 - RNA, 20 nt, Shigella flexneri 2a str. 2457T
cagguaaacaccuucaucca

SEQ ID NO: 3815868 - RNA, 13 nt, Shigella flexneri 2a str. 2457T
cagguaaagacca

SEQ ID NO: 3815869 - RNA, 18 nt, Shigella flexneri 2a str. 2457T
cagguaagaguuucaaca

SEQ ID NO: 3815870 - RNA, 21 nt, Shigella flexneri 2a str. 2457T
cagguaagaguuucaacauca

SEQ ID NO: 3815871 - RNA, 15 nt, Shigella flexneri 2a str. 2457T
cagguaaucugccau

SEQ ID NO: 3815872 - RNA, 23 nt, Shigella flexneri 2a str. 2457T
cagguaaucugucuuuuacauca

SEQ ID NO: 3815873 - RNA, 21 nt, Shigella flexneri 2a str. 2457T
cagguaauuaacauucauuuu

SEQ ID NO: 3815874 - RNA, 20 nt, Shigella flexneri 2a str. 2457T
cagguaauuugaucaaauac

SEQ ID NO: 3815875 - RNA, 19 nt, Shigella flexneri 2a str. 2457T
cagguaccgagauaacguu

SEQ ID NO: 3815876 - RNA, 15 nt, Shigella flexneri 2a str. 2457T
cagguacgggaaacc

SEQ ID NO: 3815877 - RNA, 16 nt, Shigella flexneri 2a str. 2457T
cagguagguuggugaa

SEQ ID NO: 3815878 - RNA, 21 nt, Shigella flexneri 2a str. 2457T
cagguaguguuggaucugauc

SEQ ID NO: 3815879 - RNA, 20 nt, Shigella flexneri 2a str. 2457T
cagguauaccgaaaucgcca

SEQ ID NO: 3815880 - RNA, 19 nt, Shigella flexneri 2a str. 2457T
cagguauaccggaccaaua

SEQ ID NO: 3815881 - RNA, 18 nt, Shigella flexneri 2a str. 2457T
caggucaaaaaaugaaac

SEQ ID NO: 3815882 - RNA, 23 nt, Shigella flexneri 2a str. 2457T
caggucaaaaaaugaaacuggaa

SEQ ID NO: 3815883 - RNA, 20 nt, Shigella flexneri 2a str. 2457T
caggucaaaagauugaauua

SEQ ID NO: 3815884 - RNA, 17 nt, Shigella flexneri 2a str. 2457T
caggucagcaggagcag

SEQ ID NO: 3815885 - RNA, 18 nt, Shigella flexneri 2a str. 2457T
caggucagcaggagcagc

SEQ ID NO: 3815886 - RNA, 14 nt, Shigella flexneri 2a str. 2457T
caggucaucauugc

SEQ ID NO: 3815887 - RNA, 22 nt, Shigella flexneri 2a str. 2457T
caggucgucuuuuacagcgcca

SEQ ID NO: 3815888 - RNA, 17 nt, Shigella flexneri 2a str. 2457T
caggugaaaaauaaaag

SEQ ID NO: 3815889 - RNA, 17 nt, Shigella flexneri 2a str. 2457T
caggugacgcgggcagc

SEQ ID NO: 3815890 - RNA, 14 nt, Shigella flexneri 2a str. 2457T
caggugcaaaaaaa

SEQ ID NO: 3815891 - RNA, 21 nt, Shigella flexneri 2a str. 2457T
caggugcagcccguaagcaaa

SEQ ID NO: 3815892 - RNA, 15 nt, Shigella flexneri 2a str. 2457T
caggugcgccagcga

SEQ ID NO: 3815893 - RNA, 20 nt, Shigella flexneri 2a str. 2457T
caggugcucgcauaucuuca

SEQ ID NO: 3815894 - RNA, 23 nt, Shigella flexneri 2a str. 2457T
cagguuaacucccccuuucugag

SEQ ID NO: 3815895 - RNA, 18 nt, Shigella flexneri 2a str. 2457T
cagguuacgcaccagaua

SEQ ID NO: 3815896 - RNA, 21 nt, Shigella flexneri 2a str. 2457T
cagguuauugacguuccccug

SEQ ID NO: 3815897 - RNA, 18 nt, Shigella flexneri 2a str. 2457T
cagguuccccccacaauc

SEQ ID NO: 3815898 - RNA, 19 nt, Shigella flexneri 2a str. 2457T
cagguuccgcauaccccuu

SEQ ID NO: 3815899 - RNA, 13 nt, Shigella flexneri 2a str. 2457T
cagguugcucaua

SEQ ID NO: 3815900 - RNA, 19 nt, Shigella flexneri 2a str. 2457T
cagguugcucauaaaauga

SEQ ID NO: 3815901 - RNA, 16 nt, Shigella flexneri 2a str. 2457T
cagguuguugccuuca

SEQ ID NO: 3815902 - RNA, 17 nt, Shigella flexneri 2a str. 2457T
cagguuuaaacagagau

SEQ ID NO: 3815903 - RNA, 14 nt, Shigella flexneri 2a str. 2457T
cagguuuaccagca

SEQ ID NO: 3815904 - RNA, 14 nt, Shigella flexneri 2a str. 2457T
cagguuuugaccag

SEQ ID NO: 3815905 - RNA, 21 nt, Shigella flexneri 2a str. 2457T
cagguuuugacgugucugaua

SEQ ID NO: 3815906 - RNA, 17 nt, Shigella flexneri 2a str. 2457T
cagguuuuucagcugcc

SEQ ID NO: 3815907 - RNA, 17 nt, Shigella flexneri 2a str. 2457T
caguaaaccgucagcac

SEQ ID NO: 3815908 - RNA, 13 nt, Shigella flexneri 2a str. 2457T
caguaaacgcuuu

SEQ ID NO: 3815909 - RNA, 16 nt, Shigella flexneri 2a str. 2457T
caguaaacgcuuuuuu

SEQ ID NO: 3815910 - RNA, 15 nt, Shigella flexneri 2a str. 2457T
caguaaagcagcgaa

SEQ ID NO: 3815911 - RNA, 23 nt, Shigella flexneri 2a str. 2457T
caguaaagcgcaaaauaccagca

SEQ ID NO: 3815912 - RNA, 22 nt, Shigella flexneri 2a str. 2457T
caguaaauucucgcuaauuuau

SEQ ID NO: 3815913 - RNA, 15 nt, Shigella flexneri 2a str. 2457T
caguaaauuuaucaa

SEQ ID NO: 3815914 - RNA, 13 nt, Shigella flexneri 2a str. 2457T
caguaaccgcuuu

SEQ ID NO: 3815915 - RNA, 17 nt, Shigella flexneri 2a str. 2457T
caguaacucauugccag

SEQ ID NO: 3815916 - RNA, 22 nt, Shigella flexneri 2a str. 2457T
caguaagacaccccacagcucu

SEQ ID NO: 3815917 - RNA, 18 nt, Shigella flexneri 2a str. 2457T
caguaagcaguccagcgc

SEQ ID NO: 3815918 - RNA, 21 nt, Shigella flexneri 2a str. 2457T
caguaagcugugcgauagcaa

SEQ ID NO: 3815919 - RNA, 20 nt, Shigella flexneri 2a str. 2457T
caguaaggucaucaaucauu

SEQ ID NO: 3815920 - RNA, 14 nt, Shigella flexneri 2a str. 2457T
caguaauaccagac

SEQ ID NO: 3815921 - RNA, 16 nt, Shigella flexneri 2a str. 2457T
caguaauaccagaccu

SEQ ID NO: 3815922 - RNA, 17 nt, Shigella flexneri 2a str. 2457T
caguaauaccagaccuu

SEQ ID NO: 3815923 - RNA, 20 nt, Shigella flexneri 2a str. 2457T
caguaauaugggucggcgau

SEQ ID NO: 3815924 - RNA, 14 nt, Shigella flexneri 2a str. 2457T
caguaauccuuucu

SEQ ID NO: 3815925 - RNA, 14 nt, Shigella flexneri 2a str. 2457T
caguaaugaucggc

SEQ ID NO: 3815926 - RNA, 20 nt, Shigella flexneri 2a str. 2457T
caguaaugaucggcgcgaaa

SEQ ID NO: 3815927 - RNA, 13 nt, Shigella flexneri 2a str. 2457T
caguaauucagcc

SEQ ID NO: 3815928 - RNA, 14 nt, Shigella flexneri 2a str. 2457T
caguacauagccau

SEQ ID NO: 3815929 - RNA, 13 nt, Shigella flexneri 2a str. 2457T
caguaccagcaac

SEQ ID NO: 3815930 - RNA, 13 nt, Shigella flexneri 2a str. 2457T
caguaccagcagc

SEQ ID NO: 3815931 - RNA, 14 nt, Shigella flexneri 2a str. 2457T
caguaccagcagcg

SEQ ID NO: 3815932 - RNA, 13 nt, Shigella flexneri 2a str. 2457T
caguaccagcagu

SEQ ID NO: 3815933 - RNA, 19 nt, Shigella flexneri 2a str. 2457T
caguaccgccaccaccaga

SEQ ID NO: 3815934 - RNA, 22 nt, Shigella flexneri 2a str. 2457T
caguaccgccgccauaaacagc

SEQ ID NO: 3815935 - RNA, 16 nt, Shigella flexneri 2a str. 2457T
caguaccuccuucaca

SEQ ID NO: 3815936 - RNA, 20 nt, Shigella flexneri 2a str. 2457T
caguacgaaauaacugaaua

SEQ ID NO: 3815937 - RNA, 19 nt, Shigella flexneri 2a str. 2457T
caguacgccaaucugcaaa

SEQ ID NO: 3815938 - RNA, 20 nt, Shigella flexneri 2a str. 2457T
caguacgcccacgccagccu

SEQ ID NO: 3815939 - RNA, 22 nt, Shigella flexneri 2a str. 2457T
caguacgcccacgccagccugc

SEQ ID NO: 3815940 - RNA, 13 nt, Shigella flexneri 2a str. 2457T
caguacgccgccg

SEQ ID NO: 3815941 - RNA, 12 nt, Shigella flexneri 2a str. 2457T
caguacggcagc

SEQ ID NO: 3815942 - RNA, 21 nt, Shigella flexneri 2a str. 2457T
caguacggcagcaaucgacca

SEQ ID NO: 3815943 - RNA, 20 nt, Shigella flexneri 2a str. 2457T
caguacgguaaagccgugcu

SEQ ID NO: 3815944 - RNA, 22 nt, Shigella flexneri 2a str. 2457T
caguacugggccgccuguuuug

SEQ ID NO: 3815945 - RNA, 15 nt, Shigella flexneri 2a str. 2457T
caguagacagcaaag

SEQ ID NO: 3815946 - RNA, 23 nt, Shigella flexneri 2a str. 2457T
caguagacagcaaagugccccca

SEQ ID NO: 3815947 - RNA, 19 nt, Shigella flexneri 2a str. 2457T
caguagcauccccggcaac

SEQ ID NO: 3815948 - RNA, 16 nt, Shigella flexneri 2a str. 2457T
caguagccaugcauaa

SEQ ID NO: 3815949 - RNA, 15 nt, Shigella flexneri 2a str. 2457T
caguagccuuuaucu

SEQ ID NO: 3815950 - RNA, 20 nt, Shigella flexneri 2a str. 2457T
caguagcgcaaucaccacca

SEQ ID NO: 3815951 - RNA, 17 nt, Shigella flexneri 2a str. 2457T
caguagcgccucuucca

SEQ ID NO: 3815952 - RNA, 18 nt, Shigella flexneri 2a str. 2457T
caguagcgucgccagcag

SEQ ID NO: 3815953 - RNA, 22 nt, Shigella flexneri 2a str. 2457T
caguagcgucgccagcaguuuc

SEQ ID NO: 3815954 - RNA, 20 nt, Shigella flexneri 2a str. 2457T
caguagcuauaaaccugcug

SEQ ID NO: 3815955 - RNA, 14 nt, Shigella flexneri 2a str. 2457T
caguagugguaacg

SEQ ID NO: 3815956 - RNA, 19 nt, Shigella flexneri 2a str. 2457T
caguaguucgagaaucgca

SEQ ID NO: 3815957 - RNA, 20 nt, Shigella flexneri 2a str. 2457T
caguaucgagaaguuacagg

SEQ ID NO: 3815958 - RNA, 14 nt, Shigella flexneri 2a str. 2457T
caguaugcucagaa

SEQ ID NO: 3815959 - RNA, 18 nt, Shigella flexneri 2a str. 2457T
caguauugggaugccgaa

SEQ ID NO: 3815960 - RNA, 20 nt, Shigella flexneri 2a str. 2457T
cagucacaccgcgcgucccu

SEQ ID NO: 3815961 - RNA, 15 nt, Shigella flexneri 2a str. 2457T
cagucaccugcccuc

SEQ ID NO: 3815962 - RNA, 20 nt, Shigella flexneri 2a str. 2457T
cagucaccugcggugcagcc

SEQ ID NO: 3815963 - RNA, 16 nt, Shigella flexneri 2a str. 2457T
cagucacgacaaagac

SEQ ID NO: 3815964 - RNA, 17 nt, Shigella flexneri 2a str. 2457T
cagucagcgaacaccag

SEQ ID NO: 3815965 - RNA, 23 nt, Shigella flexneri 2a str. 2457T
cagucaggcgauuguuuagaucc

SEQ ID NO: 3815966 - RNA, 12 nt, Shigella flexneri 2a str. 2457T
cagucaggcugu

SEQ ID NO: 3815967 - RNA, 17 nt, Shigella flexneri 2a str. 2457T
cagucaguuaagcaacu

SEQ ID NO: 3815968 - RNA, 20 nt, Shigella flexneri 2a str. 2457T
cagucauaaccaguccauua

SEQ ID NO: 3815969 - RNA, 20 nt, Shigella flexneri 2a str. 2457T
cagucaucacuuucagaccg

SEQ ID NO: 3815970 - RNA, 15 nt, Shigella flexneri 2a str. 2457T
cagucaugcgagaag

SEQ ID NO: 3815971 - RNA, 18 nt, Shigella flexneri 2a str. 2457T
cagucaugcgagaagcaa

SEQ ID NO: 3815972 - RNA, 18 nt, Shigella flexneri 2a str. 2457T
caguccagacuccgagaa

SEQ ID NO: 3815973 - RNA, 15 nt, Shigella flexneri 2a str. 2457T
caguccagcgccuga

SEQ ID NO: 3815974 - RNA, 16 nt, Shigella flexneri 2a str. 2457T
caguccccacaucacu

SEQ ID NO: 3815975 - RNA, 23 nt, Shigella flexneri 2a str. 2457T
caguccccacaucacuccaucca

SEQ ID NO: 3815976 - RNA, 14 nt, Shigella flexneri 2a str. 2457T
caguccccacgcca

SEQ ID NO: 3815977 - RNA, 18 nt, Shigella flexneri 2a str. 2457T
caguccccucgccccucc

SEQ ID NO: 3815978 - RNA, 19 nt, Shigella flexneri 2a str. 2457T
caguccccucgccccuccg

SEQ ID NO: 3815979 - RNA, 23 nt, Shigella flexneri 2a str. 2457T
cagucccguacccagcaagaccg

SEQ ID NO: 3815980 - RNA, 17 nt, Shigella flexneri 2a str. 2457T
cagucgauggucgcguu

SEQ ID NO: 3815981 - RNA, 15 nt, Shigella flexneri 2a str. 2457T
cagucgcacgccugg

SEQ ID NO: 3815982 - RNA, 16 nt, Shigella flexneri 2a str. 2457T
cagucgcgacgcugac

SEQ ID NO: 3815983 - RNA, 17 nt, Shigella flexneri 2a str. 2457T
cagucgcgcaauugcca

SEQ ID NO: 3815984 - RNA, 23 nt, Shigella flexneri 2a str. 2457T
cagucgcguagguaaucauauug

SEQ ID NO: 3815985 - RNA, 17 nt, Shigella flexneri 2a str. 2457T
cagucgggauauucagc

SEQ ID NO: 3815986 - RNA, 15 nt, Shigella flexneri 2a str. 2457T
cagucgucaucccag

SEQ ID NO: 3815987 - RNA, 22 nt, Shigella flexneri 2a str. 2457T
cagucuggacaaagagcuuuca

SEQ ID NO: 3815988 - RNA, 17 nt, Shigella flexneri 2a str. 2457T
cagucuggcuucgcugu

SEQ ID NO: 3815989 - RNA, 21 nt, Shigella flexneri 2a str. 2457T
cagucuuaaaggggugaaaaa

SEQ ID NO: 3815990 - RNA, 22 nt, Shigella flexneri 2a str. 2457T
cagucuuaaaggggugaaaaaa

SEQ ID NO: 3815991 - RNA, 14 nt, Shigella flexneri 2a str. 2457T
cagucuucaucauc

SEQ ID NO: 3815992 - RNA, 23 nt, Shigella flexneri 2a str. 2457T
cagucuucaucauccucuucagc

SEQ ID NO: 3815993 - RNA, 14 nt, Shigella flexneri 2a str. 2457T
cagucuucccagcc

SEQ ID NO: 3815994 - RNA, 16 nt, Shigella flexneri 2a str. 2457T
cagucuucccagcccc

SEQ ID NO: 3815995 - RNA, 13 nt, Shigella flexneri 2a str. 2457T
cagucuuccugcg

SEQ ID NO: 3815996 - RNA, 15 nt, Shigella flexneri 2a str. 2457T
cagucuuccugcggc

SEQ ID NO: 3815997 - RNA, 23 nt, Shigella flexneri 2a str. 2457T
cagugaaaccgaaggcaccauua

SEQ ID NO: 3815998 - RNA, 13 nt, Shigella flexneri 2a str. 2457T
cagugaaaguuuu

SEQ ID NO: 3815999 - RNA, 18 nt, Shigella flexneri 2a str. 2457T
cagugaaaguuuucaccg

SEQ ID NO: 3816000 - RNA, 16 nt, Shigella flexneri 2a str. 2457T
cagugaaauacaguua

SEQ ID NO: 3816001 - RNA, 22 nt, Shigella flexneri 2a str. 2457T
cagugacagguugcucauaaaa

SEQ ID NO: 3816002 - RNA, 21 nt, Shigella flexneri 2a str. 2457T
cagugacaguguuauucccaa

SEQ ID NO: 3816003 - RNA, 19 nt, Shigella flexneri 2a str. 2457T
cagugacugccccaguucc

SEQ ID NO: 3816004 - RNA, 23 nt, Shigella flexneri 2a str. 2457T
cagugagauaccaguugaucaaa

SEQ ID NO: 3816005 - RNA, 15 nt, Shigella flexneri 2a str. 2457T
cagugaggaugcggg

SEQ ID NO: 3816006 - RNA, 14 nt, Shigella flexneri 2a str. 2457T
cagugauaacucaa

SEQ ID NO: 3816007 - RNA, 14 nt, Shigella flexneri 2a str. 2457T
cagugauauauuuu

SEQ ID NO: 3816008 - RNA, 20 nt, Shigella flexneri 2a str. 2457T
cagugauauauuuuuaaaua

SEQ ID NO: 3816009 - RNA, 20 nt, Shigella flexneri 2a str. 2457T
cagugaucgugugccaccag

SEQ ID NO: 3816010 - RNA, 23 nt, Shigella flexneri 2a str. 2457T
cagugaugaaaacgaaggccgga

SEQ ID NO: 3816011 - RNA, 18 nt, Shigella flexneri 2a str. 2457T
cagugauggugauaauca

SEQ ID NO: 3816012 - RNA, 19 nt, Shigella flexneri 2a str. 2457T
cagugauuucuucauuaaa

SEQ ID NO: 3816013 - RNA, 17 nt, Shigella flexneri 2a str. 2457T
cagugcaaaugccagau

SEQ ID NO: 3816014 - RNA, 18 nt, Shigella flexneri 2a str. 2457T
cagugcaauaccauggcu

SEQ ID NO: 3816015 - RNA, 17 nt, Shigella flexneri 2a str. 2457T
cagugcaggcaccagcc

SEQ ID NO: 3816016 - RNA, 18 nt, Shigella flexneri 2a str. 2457T
cagugcaggcaccagccc

SEQ ID NO: 3816017 - RNA, 22 nt, Shigella flexneri 2a str. 2457T
cagugcaggcaccagccccugg

SEQ ID NO: 3816018 - RNA, 17 nt, Shigella flexneri 2a str. 2457T
cagugcauccagcagcc

SEQ ID NO: 3816019 - RNA, 16 nt, Shigella flexneri 2a str. 2457T
cagugccagcaccacu

SEQ ID NO: 3816020 - RNA, 22 nt, Shigella flexneri 2a str. 2457T
cagugccagguagucacgguag

SEQ ID NO: 3816021 - RNA, 13 nt, Shigella flexneri 2a str. 2457T
cagugccaguucu

SEQ ID NO: 3816022 - RNA, 14 nt, Shigella flexneri 2a str. 2457T
cagugccccgagcg

SEQ ID NO: 3816023 - RNA, 18 nt, Shigella flexneri 2a str. 2457T
cagugcccgaccacuuca

SEQ ID NO: 3816024 - RNA, 22 nt, Shigella flexneri 2a str. 2457T
cagugccgcacauagcaccacc

SEQ ID NO: 3816025 - RNA, 15 nt, Shigella flexneri 2a str. 2457T
cagugccgcauugac

SEQ ID NO: 3816026 - RNA, 12 nt, Shigella flexneri 2a str. 2457T
cagugccgcgcc

SEQ ID NO: 3816027 - RNA, 18 nt, Shigella flexneri 2a str. 2457T
cagugccggaugauucac

SEQ ID NO: 3816028 - RNA, 17 nt, Shigella flexneri 2a str. 2457T
cagugccgguggaaggg

SEQ ID NO: 3816029 - RNA, 16 nt, Shigella flexneri 2a str. 2457T
cagugccguuccagcc

SEQ ID NO: 3816030 - RNA, 20 nt, Shigella flexneri 2a str. 2457T
cagugccugcgccaccguuu

SEQ ID NO: 3816031 - RNA, 14 nt, Shigella flexneri 2a str. 2457T
cagugcguaagcgc

SEQ ID NO: 3816032 - RNA, 16 nt, Shigella flexneri 2a str. 2457T
cagugcguccgguuua

SEQ ID NO: 3816033 - RNA, 20 nt, Shigella flexneri 2a str. 2457T
cagugcgucgcugcucuuca

SEQ ID NO: 3816034 - RNA, 20 nt, Shigella flexneri 2a str. 2457T
cagugcuccaccuugcggaa

SEQ ID NO: 3816035 - RNA, 12 nt, Shigella flexneri 2a str. 2457T
cagugcugaagg

SEQ ID NO: 3816036 - RNA, 22 nt, Shigella flexneri 2a str. 2457T
cagugcugaagguucaagacga

SEQ ID NO: 3816037 - RNA, 20 nt, Shigella flexneri 2a str. 2457T
cagugcugauuuugcaacaa

SEQ ID NO: 3816038 - RNA, 22 nt, Shigella flexneri 2a str. 2457T
cagugcuucgcggacaucgucc

SEQ ID NO: 3816039 - RNA, 12 nt, Shigella flexneri 2a str. 2457T
cagugcuuuauc

SEQ ID NO: 3816040 - RNA, 19 nt, Shigella flexneri 2a str. 2457T
caguggacgauaagcaccg

SEQ ID NO: 3816041 - RNA, 18 nt, Shigella flexneri 2a str. 2457T
caguggcgagcuuccugu

SEQ ID NO: 3816042 - RNA, 23 nt, Shigella flexneri 2a str. 2457T
caguggcuaagcaggcuggcuac

SEQ ID NO: 3816043 - RNA, 17 nt, Shigella flexneri 2a str. 2457T
caguggcugauuggcau

SEQ ID NO: 3816044 - RNA, 16 nt, Shigella flexneri 2a str. 2457T
cagugggccagaaaaa

SEQ ID NO: 3816045 - RNA, 17 nt, Shigella flexneri 2a str. 2457T
cagugggcguuggucag

SEQ ID NO: 3816046 - RNA, 23 nt, Shigella flexneri 2a str. 2457T
caguggguaaugcugugaagaug

SEQ ID NO: 3816047 - RNA, 15 nt, Shigella flexneri 2a str. 2457T
caguguaaaacagca

SEQ ID NO: 3816048 - RNA, 20 nt, Shigella flexneri 2a str. 2457T
caguguacuuaucuuuuaca

SEQ ID NO: 3816049 - RNA, 15 nt, Shigella flexneri 2a str. 2457T
caguguaucggcggc

SEQ ID NO: 3816050 - RNA, 16 nt, Shigella flexneri 2a str. 2457T
caguguccagcggcau

SEQ ID NO: 3816051 - RNA, 20 nt, Shigella flexneri 2a str. 2457T
cagugugcuacggucugccg

SEQ ID NO: 3816052 - RNA, 22 nt, Shigella flexneri 2a str. 2457T
caguguuaaacgcagcuccggg

SEQ ID NO: 3816053 - RNA, 18 nt, Shigella flexneri 2a str. 2457T
caguuaaccugcuccuca

SEQ ID NO: 3816054 - RNA, 22 nt, Shigella flexneri 2a str. 2457T
caguuaaccugcuccucaguuu

SEQ ID NO: 3816055 - RNA, 13 nt, Shigella flexneri 2a str. 2457T
caguuaagcaacu

SEQ ID NO: 3816056 - RNA, 22 nt, Shigella flexneri 2a str. 2457T
caguuaagcaauaccgcgaauc

SEQ ID NO: 3816057 - RNA, 14 nt, Shigella flexneri 2a str. 2457T
caguuacgcagacg

SEQ ID NO: 3816058 - RNA, 17 nt, Shigella flexneri 2a str. 2457T
caguuacugccaccauc

SEQ ID NO: 3816059 - RNA, 19 nt, Shigella flexneri 2a str. 2457T
caguuaucaaauucauugc

SEQ ID NO: 3816060 - RNA, 22 nt, Shigella flexneri 2a str. 2457T
caguucaaaguuaccggaagcg

SEQ ID NO: 3816061 - RNA, 21 nt, Shigella flexneri 2a str. 2457T
caguucaaauucauugucggg

SEQ ID NO: 3816062 - RNA, 19 nt, Shigella flexneri 2a str. 2457T
caguucacgaauauuuccc

SEQ ID NO: 3816063 - RNA, 12 nt, Shigella flexneri 2a str. 2457T
caguucagaagc

SEQ ID NO: 3816064 - RNA, 18 nt, Shigella flexneri 2a str. 2457T
caguucagaagcugaagc

SEQ ID NO: 3816065 - RNA, 21 nt, Shigella flexneri 2a str. 2457T
caguucagcagcacuacaccc

SEQ ID NO: 3816066 - RNA, 19 nt, Shigella flexneri 2a str. 2457T
caguucagucagcaguguc

SEQ ID NO: 3816067 - RNA, 21 nt, Shigella flexneri 2a str. 2457T
caguucaucaacgcccauaaa

SEQ ID NO: 3816068 - RNA, 18 nt, Shigella flexneri 2a str. 2457T
caguucauuuuucucaac

SEQ ID NO: 3816069 - RNA, 19 nt, Shigella flexneri 2a str. 2457T
caguuccacuucugcacgg

SEQ ID NO: 3816070 - RNA, 13 nt, Shigella flexneri 2a str. 2457T
caguuccagcagc

SEQ ID NO: 3816071 - RNA, 19 nt, Shigella flexneri 2a str. 2457T
caguuccagcagcgcaauu

SEQ ID NO: 3816072 - RNA, 15 nt, Shigella flexneri 2a str. 2457T
caguucccccugcca

SEQ ID NO: 3816073 - RNA, 19 nt, Shigella flexneri 2a str. 2457T
caguuccgcaaagcccauc

SEQ ID NO: 3816074 - RNA, 17 nt, Shigella flexneri 2a str. 2457T
caguuccgcugcaaguu

SEQ ID NO: 3816075 - RNA, 22 nt, Shigella flexneri 2a str. 2457T
caguuccggcaucgacaguuuc

SEQ ID NO: 3816076 - RNA, 23 nt, Shigella flexneri 2a str. 2457T
caguuccggcaucgacaguuuca

SEQ ID NO: 3816077 - RNA, 12 nt, Shigella flexneri 2a str. 2457T
caguuccgggau

SEQ ID NO: 3816078 - RNA, 14 nt, Shigella flexneri 2a str. 2457T
caguuccugcaacu

SEQ ID NO: 3816079 - RNA, 17 nt, Shigella flexneri 2a str. 2457T
caguuccugcaacuucu

SEQ ID NO: 3816080 - RNA, 18 nt, Shigella flexneri 2a str. 2457T
caguuccugccagauuug

SEQ ID NO: 3816081 - RNA, 21 nt, Shigella flexneri 2a str. 2457T
caguuccuuaacuucaucagc

SEQ ID NO: 3816082 - RNA, 23 nt, Shigella flexneri 2a str. 2457T
caguucgaucucuucgccugccu

SEQ ID NO: 3816083 - RNA, 22 nt, Shigella flexneri 2a str. 2457T
caguucgcgauccugauacaga

SEQ ID NO: 3816084 - RNA, 13 nt, Shigella flexneri 2a str. 2457T
caguucgcggaua

SEQ ID NO: 3816085 - RNA, 17 nt, Shigella flexneri 2a str. 2457T
caguucggaaacagugc

SEQ ID NO: 3816086 - RNA, 16 nt, Shigella flexneri 2a str. 2457T
caguucggcaucaucg

SEQ ID NO: 3816087 - RNA, 22 nt, Shigella flexneri 2a str. 2457T
caguucguuuuacgcacuucuu

SEQ ID NO: 3816088 - RNA, 16 nt, Shigella flexneri 2a str. 2457T
caguucuacuggaauu

SEQ ID NO: 3816089 - RNA, 16 nt, Shigella flexneri 2a str. 2457T
caguucugcuucaaca

SEQ ID NO: 3816090 - RNA, 16 nt, Shigella flexneri 2a str. 2457T
caguucuggcaccgga

SEQ ID NO: 3816091 - RNA, 18 nt, Shigella flexneri 2a str. 2457T
caguucuggcaccggacg

SEQ ID NO: 3816092 - RNA, 20 nt, Shigella flexneri 2a str. 2457T
caguucuggcaccggacgcu

SEQ ID NO: 3816093 - RNA, 22 nt, Shigella flexneri 2a str. 2457T
caguucuggcaccggacgcuug

SEQ ID NO: 3816094 - RNA, 15 nt, Shigella flexneri 2a str. 2457T
caguucuucaaaaau

SEQ ID NO: 3816095 - RNA, 17 nt, Shigella flexneri 2a str. 2457T
caguucuucaaaaauaa

SEQ ID NO: 3816096 - RNA, 13 nt, Shigella flexneri 2a str. 2457T
caguucuuuuauu

SEQ ID NO: 3816097 - RNA, 12 nt, Shigella flexneri 2a str. 2457T
caguugaucacc

SEQ ID NO: 3816098 - RNA, 20 nt, Shigella flexneri 2a str. 2457T
caguugaucaccagugcgga

SEQ ID NO: 3816099 - RNA, 22 nt, Shigella flexneri 2a str. 2457T
caguugaucaccagugcggaua

SEQ ID NO: 3816100 - RNA, 16 nt, Shigella flexneri 2a str. 2457T
caguugaucagccagg

SEQ ID NO: 3816101 - RNA, 19 nt, Shigella flexneri 2a str. 2457T
caguugaucuauaccaccg

SEQ ID NO: 3816102 - RNA, 14 nt, Shigella flexneri 2a str. 2457T
caguugcacgccac

SEQ ID NO: 3816103 - RNA, 14 nt, Shigella flexneri 2a str. 2457T
caguugcauaauuu

SEQ ID NO: 3816104 - RNA, 18 nt, Shigella flexneri 2a str. 2457T
caguugcauaauuucuuc

SEQ ID NO: 3816105 - RNA, 16 nt, Shigella flexneri 2a str. 2457T
caguugcgcgcgcacc

SEQ ID NO: 3816106 - RNA, 21 nt, Shigella flexneri 2a str. 2457T
caguugcggcuuauucauuac

SEQ ID NO: 3816107 - RNA, 12 nt, Shigella flexneri 2a str. 2457T
caguugcuucau

SEQ ID NO: 3816108 - RNA, 14 nt, Shigella flexneri 2a str. 2457T
caguugcuucaucu

SEQ ID NO: 3816109 - RNA, 14 nt, Shigella flexneri 2a str. 2457T
caguugcuuuacuc

SEQ ID NO: 3816110 - RNA, 13 nt, Shigella flexneri 2a str. 2457T
caguuggcugugg

SEQ ID NO: 3816111 - RNA, 16 nt, Shigella flexneri 2a str. 2457T
caguuggcugugguac

SEQ ID NO: 3816112 - RNA, 20 nt, Shigella flexneri 2a str. 2457T
caguugguagguccagccgc

SEQ ID NO: 3816113 - RNA, 21 nt, Shigella flexneri 2a str. 2457T
caguugguagguccagccgcc

SEQ ID NO: 3816114 - RNA, 23 nt, Shigella flexneri 2a str. 2457T
caguugguuagagcacaucacuc

SEQ ID NO: 3816115 - RNA, 12 nt, Shigella flexneri 2a str. 2457T
caguugucggua

SEQ ID NO: 3816116 - RNA, 16 nt, Shigella flexneri 2a str. 2457T
caguugucgguaauug

SEQ ID NO: 3816117 - RNA, 20 nt, Shigella flexneri 2a str. 2457T
caguuguucagaaugcccac

SEQ ID NO: 3816118 - RNA, 18 nt, Shigella flexneri 2a str. 2457T
caguuguugauaagcccc

SEQ ID NO: 3816119 - RNA, 15 nt, Shigella flexneri 2a str. 2457T
caguuuauccagcca

SEQ ID NO: 3816120 - RNA, 13 nt, Shigella flexneri 2a str. 2457T
caguuuauuuucu

SEQ ID NO: 3816121 - RNA, 14 nt, Shigella flexneri 2a str. 2457T
caguuuauuuucug

SEQ ID NO: 3816122 - RNA, 14 nt, Shigella flexneri 2a str. 2457T
caguuucaccagca

SEQ ID NO: 3816123 - RNA, 12 nt, Shigella flexneri 2a str. 2457T
caguuucaccug

SEQ ID NO: 3816124 - RNA, 19 nt, Shigella flexneri 2a str. 2457T
caguuucagccccaucaac

SEQ ID NO: 3816125 - RNA, 13 nt, Shigella flexneri 2a str. 2457T
caguuucauagug

SEQ ID NO: 3816126 - RNA, 22 nt, Shigella flexneri 2a str. 2457T
caguuucaugauauguuuuaaa

SEQ ID NO: 3816127 - RNA, 21 nt, Shigella flexneri 2a str. 2457T
caguuucgacgccuucagcga

SEQ ID NO: 3816128 - RNA, 21 nt, Shigella flexneri 2a str. 2457T
caguuucgcgucgucaaccug

SEQ ID NO: 3816129 - RNA, 18 nt, Shigella flexneri 2a str. 2457T
caguuucggaccagccgc

SEQ ID NO: 3816130 - RNA, 17 nt, Shigella flexneri 2a str. 2457T
caguuugagauugaaaa

SEQ ID NO: 3816131 - RNA, 17 nt, Shigella flexneri 2a str. 2457T
caguuugaugccugcau

SEQ ID NO: 3816132 - RNA, 22 nt, Shigella flexneri 2a str. 2457T
caguuuggucuggcaaaaauaa

SEQ ID NO: 3816133 - RNA, 16 nt, Shigella flexneri 2a str. 2457T
caguuugucuucaaug

SEQ ID NO: 3816134 - RNA, 21 nt, Shigella flexneri 2a str. 2457T
caguuuucauauaccgcauca

SEQ ID NO: 3816135 - RNA, 13 nt, Shigella flexneri 2a str. 2457T
caguuuugugccc

SEQ ID NO: 3816136 - RNA, 17 nt, Shigella flexneri 2a str. 2457T
caguuuuuaauuuucgu

SEQ ID NO: 3816137 - RNA, 13 nt, Shigella flexneri 2a str. 2457T
cauaaaacgcuua

SEQ ID NO: 3816138 - RNA, 20 nt, Shigella flexneri 2a str. 2457T
cauaaaauaaccaaauaaaa

SEQ ID NO: 3816139 - RNA, 22 nt, Shigella flexneri 2a str. 2457T
cauaaaauaaccaaauaaaaua

SEQ ID NO: 3816140 - RNA, 20 nt, Shigella flexneri 2a str. 2457T
cauaaacaacgagcuucagc

SEQ ID NO: 3816141 - RNA, 14 nt, Shigella flexneri 2a str. 2457T
cauaaacacgguuu

SEQ ID NO: 3816142 - RNA, 21 nt, Shigella flexneri 2a str. 2457T
cauaaacgccgucaucacacc

SEQ ID NO: 3816143 - RNA, 17 nt, Shigella flexneri 2a str. 2457T
cauaaacugagccaaac

SEQ ID NO: 3816144 - RNA, 23 nt, Shigella flexneri 2a str. 2457T
cauaaagaaaucaccugccggag

SEQ ID NO: 3816145 - RNA, 15 nt, Shigella flexneri 2a str. 2457T
cauaaagccugcuuc

SEQ ID NO: 3816146 - RNA, 22 nt, Shigella flexneri 2a str. 2457T
cauaaagcugcggauccugagc

SEQ ID NO: 3816147 - RNA, 15 nt, Shigella flexneri 2a str. 2457T
cauaaauacagagca

SEQ ID NO: 3816148 - RNA, 22 nt, Shigella flexneri 2a str. 2457T
cauaaaucucagcccgaugaua

SEQ ID NO: 3816149 - RNA, 16 nt, Shigella flexneri 2a str. 2457T
cauaaauugcuguaaa

SEQ ID NO: 3816150 - RNA, 21 nt, Shigella flexneri 2a str. 2457T
cauaacacaauaccuucugcg

SEQ ID NO: 3816151 - RNA, 18 nt, Shigella flexneri 2a str. 2457T
cauaacacagguaacuua

SEQ ID NO: 3816152 - RNA, 11 nt, Shigella flexneri 2a str. 2457T
cauaacagaau

SEQ ID NO: 3816153 - RNA, 18 nt, Shigella flexneri 2a str. 2457T
cauaacagaggccacccu

SEQ ID NO: 3816154 - RNA, 16 nt, Shigella flexneri 2a str. 2457T
cauaaccaacaauugu

SEQ ID NO: 3816155 - RNA, 13 nt, Shigella flexneri 2a str. 2457T
cauaaccacucac

SEQ ID NO: 3816156 - RNA, 17 nt, Shigella flexneri 2a str. 2457T
cauaaccacucaccgcc

SEQ ID NO: 3816157 - RNA, 18 nt, Shigella flexneri 2a str. 2457T
cauaaccacucaccgccg

SEQ ID NO: 3816158 - RNA, 15 nt, Shigella flexneri 2a str. 2457T
cauaaccagagagcu

SEQ ID NO: 3816159 - RNA, 13 nt, Shigella flexneri 2a str. 2457T
cauaaccagucca

SEQ ID NO: 3816160 - RNA, 17 nt, Shigella flexneri 2a str. 2457T
cauaaccggaucgccaa

SEQ ID NO: 3816161 - RNA, 15 nt, Shigella flexneri 2a str. 2457T
cauaaccugcucugc

SEQ ID NO: 3816162 - RNA, 17 nt, Shigella flexneri 2a str. 2457T
cauaaccugcucugcca

SEQ ID NO: 3816163 - RNA, 22 nt, Shigella flexneri 2a str. 2457T
cauaacgcaucggcuaaaccau

SEQ ID NO: 3816164 - RNA, 19 nt, Shigella flexneri 2a str. 2457T
cauaacgcugauauuucgg

SEQ ID NO: 3816165 - RNA, 15 nt, Shigella flexneri 2a str. 2457T
cauaacggacgaucu

SEQ ID NO: 3816166 - RNA, 13 nt, Shigella flexneri 2a str. 2457T
cauaacucaccau

SEQ ID NO: 3816167 - RNA, 15 nt, Shigella flexneri 2a str. 2457T
cauaacucaccauca

SEQ ID NO: 3816168 - RNA, 22 nt, Shigella flexneri 2a str. 2457T
cauaacuccccgagaaauacug

SEQ ID NO: 3816169 - RNA, 19 nt, Shigella flexneri 2a str. 2457T
cauaacucuccuguuuaau

SEQ ID NO: 3816170 - RNA, 14 nt, Shigella flexneri 2a str. 2457T
cauaacugccggau

SEQ ID NO: 3816171 - RNA, 17 nt, Shigella flexneri 2a str. 2457T
cauaacuggucaucaaa

SEQ ID NO: 3816172 - RNA, 18 nt, Shigella flexneri 2a str. 2457T
cauaacuggucaucaaau

SEQ ID NO: 3816173 - RNA, 13 nt, Shigella flexneri 2a str. 2457T
cauaagagaugga

SEQ ID NO: 3816174 - RNA, 21 nt, Shigella flexneri 2a str. 2457T
cauaagagauggaaugagcau

SEQ ID NO: 3816175 - RNA, 19 nt, Shigella flexneri 2a str. 2457T
cauaagcccagaacaaaua

SEQ ID NO: 3816176 - RNA, 18 nt, Shigella flexneri 2a str. 2457T
cauaaggaaacuccagcc

SEQ ID NO: 3816177 - RNA, 19 nt, Shigella flexneri 2a str. 2457T
cauaagguccuccagcucc

SEQ ID NO: 3816178 - RNA, 14 nt, Shigella flexneri 2a str. 2457T
cauaaggugggagg

SEQ ID NO: 3816179 - RNA, 22 nt, Shigella flexneri 2a str. 2457T
cauaauaagcgccauaucggca

SEQ ID NO: 3816180 - RNA, 23 nt, Shigella flexneri 2a str. 2457T
cauaauauucauuacaccaauac

SEQ ID NO: 3816181 - RNA, 13 nt, Shigella flexneri 2a str. 2457T
cauaaucaauaaa

SEQ ID NO: 3816182 - RNA, 14 nt, Shigella flexneri 2a str. 2457T
cauaaucaauaaaa

SEQ ID NO: 3816183 - RNA, 17 nt, Shigella flexneri 2a str. 2457T
cauaaucaauaaaaaua

SEQ ID NO: 3816184 - RNA, 18 nt, Shigella flexneri 2a str. 2457T
cauaaucaauaaaaauac

SEQ ID NO: 3816185 - RNA, 12 nt, Shigella flexneri 2a str. 2457T
cauaaucaauac

SEQ ID NO: 3816186 - RNA, 20 nt, Shigella flexneri 2a str. 2457T
cauaaucaccaucagcagca

SEQ ID NO: 3816187 - RNA, 20 nt, Shigella flexneri 2a str. 2457T
cauaaucauuacaaccgcug

SEQ ID NO: 3816188 - RNA, 16 nt, Shigella flexneri 2a str. 2457T
cauaauccacuuucuu

SEQ ID NO: 3816189 - RNA, 13 nt, Shigella flexneri 2a str. 2457T
cauaauccagguu

SEQ ID NO: 3816190 - RNA, 17 nt, Shigella flexneri 2a str. 2457T
cauaauccccagaacca

SEQ ID NO: 3816191 - RNA, 21 nt, Shigella flexneri 2a str. 2457T
cauaaucgcaacgccuuccgu

SEQ ID NO: 3816192 - RNA, 16 nt, Shigella flexneri 2a str. 2457T
cauaaucggcgcggcg

SEQ ID NO: 3816193 - RNA, 21 nt, Shigella flexneri 2a str. 2457T
cauaaucgggaugcguaacag

SEQ ID NO: 3816194 - RNA, 17 nt, Shigella flexneri 2a str. 2457T
cauaaucuguuucaucu

SEQ ID NO: 3816195 - RNA, 22 nt, Shigella flexneri 2a str. 2457T
cauaaugauggggucacagguu

SEQ ID NO: 3816196 - RNA, 14 nt, Shigella flexneri 2a str. 2457T
cauaaugcaaaaug

SEQ ID NO: 3816197 - RNA, 16 nt, Shigella flexneri 2a str. 2457T
cauaaugcccagcguu

SEQ ID NO: 3816198 - RNA, 13 nt, Shigella flexneri 2a str. 2457T
cauaaugcugaca

SEQ ID NO: 3816199 - RNA, 20 nt, Shigella flexneri 2a str. 2457T
cauaauguccugcggacagu

SEQ ID NO: 3816200 - RNA, 15 nt, Shigella flexneri 2a str. 2457T
cauaaugugcgcaca

SEQ ID NO: 3816201 - RNA, 18 nt, Shigella flexneri 2a str. 2457T
cauaauguugcugccuug

SEQ ID NO: 3816202 - RNA, 17 nt, Shigella flexneri 2a str. 2457T
cauaauuuccagcagug

SEQ ID NO: 3816203 - RNA, 14 nt, Shigella flexneri 2a str. 2457T
cauacaaaaacaca

SEQ ID NO: 3816204 - RNA, 12 nt, Shigella flexneri 2a str. 2457T
cauacaaauaag

SEQ ID NO: 3816205 - RNA, 15 nt, Shigella flexneri 2a str. 2457T
cauacaacgccauga

SEQ ID NO: 3816206 - RNA, 13 nt, Shigella flexneri 2a str. 2457T
cauacaccagcgg

SEQ ID NO: 3816207 - RNA, 15 nt, Shigella flexneri 2a str. 2457T
cauacagcggacagc

SEQ ID NO: 3816208 - RNA, 17 nt, Shigella flexneri 2a str. 2457T
cauacagcggacagcca

SEQ ID NO: 3816209 - RNA, 21 nt, Shigella flexneri 2a str. 2457T
cauacauccucucuuuccuua

SEQ ID NO: 3816210 - RNA, 20 nt, Shigella flexneri 2a str. 2457T
cauacaugguuugaucgcua

SEQ ID NO: 3816211 - RNA, 22 nt, Shigella flexneri 2a str. 2457T
cauacaugguuugaucgcuaag

SEQ ID NO: 3816212 - RNA, 17 nt, Shigella flexneri 2a str. 2457T
cauacauugcguaacca

SEQ ID NO: 3816213 - RNA, 21 nt, Shigella flexneri 2a str. 2457T
cauacauugcguaaccaauca

SEQ ID NO: 3816214 - RNA, 13 nt, Shigella flexneri 2a str. 2457T
cauaccaccgacg

SEQ ID NO: 3816215 - RNA, 21 nt, Shigella flexneri 2a str. 2457T
cauacccaacguaacaaaacu

SEQ ID NO: 3816216 - RNA, 21 nt, Shigella flexneri 2a str. 2457T
cauacccgccagugcugaagg

SEQ ID NO: 3816217 - RNA, 20 nt, Shigella flexneri 2a str. 2457T
cauaccuaaaagcacgccag

SEQ ID NO: 3816218 - RNA, 21 nt, Shigella flexneri 2a str. 2457T
cauaccuaaaagcacgccaga

SEQ ID NO: 3816219 - RNA, 16 nt, Shigella flexneri 2a str. 2457T
cauaccuaccugcagu

SEQ ID NO: 3816220 - RNA, 15 nt, Shigella flexneri 2a str. 2457T
cauacgaacgccugc

SEQ ID NO: 3816221 - RNA, 18 nt, Shigella flexneri 2a str. 2457T
cauacgcaaaaaacauug

SEQ ID NO: 3816222 - RNA, 20 nt, Shigella flexneri 2a str. 2457T
cauacgcggcagaaugguuu

SEQ ID NO: 3816223 - RNA, 18 nt, Shigella flexneri 2a str. 2457T
cauacgcguaaaacagcc

SEQ ID NO: 3816224 - RNA, 20 nt, Shigella flexneri 2a str. 2457T
cauacggaaaaucucauuug

SEQ ID NO: 3816225 - RNA, 20 nt, Shigella flexneri 2a str. 2457T
cauacggaauagcuuaccgg

SEQ ID NO: 3816226 - RNA, 18 nt, Shigella flexneri 2a str. 2457T
cauacggguuuuccccuu

SEQ ID NO: 3816227 - RNA, 15 nt, Shigella flexneri 2a str. 2457T
cauacgguuuaccga

SEQ ID NO: 3816228 - RNA, 16 nt, Shigella flexneri 2a str. 2457T
cauacgguuuaccgag

SEQ ID NO: 3816229 - RNA, 21 nt, Shigella flexneri 2a str. 2457T
cauacguacaaacgcuuuacu

SEQ ID NO: 3816230 - RNA, 22 nt, Shigella flexneri 2a str. 2457T
cauacguacaaacgcuuuacuc

SEQ ID NO: 3816231 - RNA, 17 nt, Shigella flexneri 2a str. 2457T
cauacguuucaccagca

SEQ ID NO: 3816232 - RNA, 16 nt, Shigella flexneri 2a str. 2457T
cauacucagcgccugc

SEQ ID NO: 3816233 - RNA, 14 nt, Shigella flexneri 2a str. 2457T
cauacucuccucca

SEQ ID NO: 3816234 - RNA, 15 nt, Shigella flexneri 2a str. 2457T
cauacucuccuccag

SEQ ID NO: 3816235 - RNA, 19 nt, Shigella flexneri 2a str. 2457T
cauacucuuucccggcaau

SEQ ID NO: 3816236 - RNA, 19 nt, Shigella flexneri 2a str. 2457T
cauacucuuugacaacauc

SEQ ID NO: 3816237 - RNA, 12 nt, Shigella flexneri 2a str. 2457T
cauacugacgga

SEQ ID NO: 3816238 - RNA, 17 nt, Shigella flexneri 2a str. 2457T
cauacugcaucagcgcc

SEQ ID NO: 3816239 - RNA, 14 nt, Shigella flexneri 2a str. 2457T
cauacugcuccaua

SEQ ID NO: 3816240 - RNA, 17 nt, Shigella flexneri 2a str. 2457T
cauacuuaaauaaugcu

SEQ ID NO: 3816241 - RNA, 18 nt, Shigella flexneri 2a str. 2457T
cauacuuauuaugaauga

SEQ ID NO: 3816242 - RNA, 21 nt, Shigella flexneri 2a str. 2457T
cauagaaacucauaugcagca

SEQ ID NO: 3816243 - RNA, 14 nt, Shigella flexneri 2a str. 2457T
cauagaccauugca

SEQ ID NO: 3816244 - RNA, 15 nt, Shigella flexneri 2a str. 2457T
cauagaccauugcau

SEQ ID NO: 3816245 - RNA, 17 nt, Shigella flexneri 2a str. 2457T
cauagacuggaaacuca

SEQ ID NO: 3816246 - RNA, 12 nt, Shigella flexneri 2a str. 2457T
cauagacuuccc

SEQ ID NO: 3816247 - RNA, 20 nt, Shigella flexneri 2a str. 2457T
cauagagcgcauccaguucc

SEQ ID NO: 3816248 - RNA, 15 nt, Shigella flexneri 2a str. 2457T
cauagauaccuucuu

SEQ ID NO: 3816249 - RNA, 14 nt, Shigella flexneri 2a str. 2457T
cauagcacacuuuc

SEQ ID NO: 3816250 - RNA, 19 nt, Shigella flexneri 2a str. 2457T
cauagcacacuuucgccac

SEQ ID NO: 3816251 - RNA, 12 nt, Shigella flexneri 2a str. 2457T
cauagcauccca

SEQ ID NO: 3816252 - RNA, 21 nt, Shigella flexneri 2a str. 2457T
cauagcaucccaauacccgca

SEQ ID NO: 3816253 - RNA, 15 nt, Shigella flexneri 2a str. 2457T
cauagcgacaggcuu

SEQ ID NO: 3816254 - RNA, 20 nt, Shigella flexneri 2a str. 2457T
cauagcgacaggcuuucuuc

SEQ ID NO: 3816255 - RNA, 14 nt, Shigella flexneri 2a str. 2457T
cauagcgauaagaa

SEQ ID NO: 3816256 - RNA, 16 nt, Shigella flexneri 2a str. 2457T
cauagcgauaagaacu

SEQ ID NO: 3816257 - RNA, 22 nt, Shigella flexneri 2a str. 2457T
cauagcgccucuuuauaaauau

SEQ ID NO: 3816258 - RNA, 16 nt, Shigella flexneri 2a str. 2457T
cauagcgugacaccag

SEQ ID NO: 3816259 - RNA, 20 nt, Shigella flexneri 2a str. 2457T
cauagcuaauccccuccagc

SEQ ID NO: 3816260 - RNA, 13 nt, Shigella flexneri 2a str. 2457T
cauagcucgcuuc

SEQ ID NO: 3816261 - RNA, 15 nt, Shigella flexneri 2a str. 2457T
cauaggcauuaaaca

SEQ ID NO: 3816262 - RNA, 15 nt, Shigella flexneri 2a str. 2457T
cauaggcggcaaaca

SEQ ID NO: 3816263 - RNA, 14 nt, Shigella flexneri 2a str. 2457T
cauaguauuuaucc

SEQ ID NO: 3816264 - RNA, 22 nt, Shigella flexneri 2a str. 2457T
cauaguauuuauccauaauuug

SEQ ID NO: 3816265 - RNA, 20 nt, Shigella flexneri 2a str. 2457T
cauagucuuugcgaggcgcg

SEQ ID NO: 3816266 - RNA, 18 nt, Shigella flexneri 2a str. 2457T
cauagugcaaauccacuc

SEQ ID NO: 3816267 - RNA, 19 nt, Shigella flexneri 2a str. 2457T
cauaguguguuccucugcu

SEQ ID NO: 3816268 - RNA, 20 nt, Shigella flexneri 2a str. 2457T
cauaguguguuccucugcuc

SEQ ID NO: 3816269 - RNA, 20 nt, Shigella flexneri 2a str. 2457T
cauauaaccggcaacagaac

SEQ ID NO: 3816270 - RNA, 15 nt, Shigella flexneri 2a str. 2457T
cauauaccgcaucag

SEQ ID NO: 3816271 - RNA, 18 nt, Shigella flexneri 2a str. 2457T
cauauaccgcaucagcau

SEQ ID NO: 3816272 - RNA, 20 nt, Shigella flexneri 2a str. 2457T
cauauaccgcaucagcaucg

SEQ ID NO: 3816273 - RNA, 10 nt, Shigella flexneri 2a str. 2457T
cauauaccuc

SEQ ID NO: 3816274 - RNA, 17 nt, Shigella flexneri 2a str. 2457T
cauauaccucagcagac

SEQ ID NO: 3816275 - RNA, 20 nt, Shigella flexneri 2a str. 2457T
cauauagccgccuuguugua

SEQ ID NO: 3816276 - RNA, 23 nt, Shigella flexneri 2a str. 2457T
cauauagccgccuuguuguaaug

SEQ ID NO: 3816277 - RNA, 19 nt, Shigella flexneri 2a str. 2457T
cauauagccgcgcaguuuc

SEQ ID NO: 3816278 - RNA, 16 nt, Shigella flexneri 2a str. 2457T
cauauaggaggccucg

SEQ ID NO: 3816279 - RNA, 17 nt, Shigella flexneri 2a str. 2457T
cauaucaaaaagcugua

SEQ ID NO: 3816280 - RNA, 18 nt, Shigella flexneri 2a str. 2457T
cauaucaccguucacugc

SEQ ID NO: 3816281 - RNA, 15 nt, Shigella flexneri 2a str. 2457T
cauaucagcaacucu

SEQ ID NO: 3816282 - RNA, 21 nt, Shigella flexneri 2a str. 2457T
cauaucauucgacaacugcug

SEQ ID NO: 3816283 - RNA, 18 nt, Shigella flexneri 2a str. 2457T
cauaucauuuugcugcca

SEQ ID NO: 3816284 - RNA, 20 nt, Shigella flexneri 2a str. 2457T
cauauccccgggcggccucu

SEQ ID NO: 3816285 - RNA, 14 nt, Shigella flexneri 2a str. 2457T
cauauccgaugagu

SEQ ID NO: 3816286 - RNA, 13 nt, Shigella flexneri 2a str. 2457T
cauauccgcaaug

SEQ ID NO: 3816287 - RNA, 18 nt, Shigella flexneri 2a str. 2457T
cauaucguagccccaguc

SEQ ID NO: 3816288 - RNA, 16 nt, Shigella flexneri 2a str. 2457T
cauaugcacaugauga

SEQ ID NO: 3816289 - RNA, 21 nt, Shigella flexneri 2a str. 2457T
cauaugcgccagacugaucau

SEQ ID NO: 3816290 - RNA, 15 nt, Shigella flexneri 2a str. 2457T
cauaugcgcuggcag

SEQ ID NO: 3816291 - RNA, 23 nt, Shigella flexneri 2a str. 2457T
cauauguguuugugccgcgacag

SEQ ID NO: 3816292 - RNA, 14 nt, Shigella flexneri 2a str. 2457T
cauauuaaauuuuu

SEQ ID NO: 3816293 - RNA, 20 nt, Shigella flexneri 2a str. 2457T
cauauuauucauaaugccca

SEQ ID NO: 3816294 - RNA, 12 nt, Shigella flexneri 2a str. 2457T
cauauucaccac

SEQ ID NO: 3816295 - RNA, 14 nt, Shigella flexneri 2a str. 2457T
cauauucagcagca

SEQ ID NO: 3816296 - RNA, 13 nt, Shigella flexneri 2a str. 2457T
cauauuccccugg

SEQ ID NO: 3816297 - RNA, 12 nt, Shigella flexneri 2a str. 2457T
cauauuguuuca

SEQ ID NO: 3816298 - RNA, 20 nt, Shigella flexneri 2a str. 2457T
cauauuuccuuccuuggaua

SEQ ID NO: 3816299 - RNA, 16 nt, Shigella flexneri 2a str. 2457T
cauauuugugagcuac

SEQ ID NO: 3816300 - RNA, 12 nt, Shigella flexneri 2a str. 2457T
caucaaaaaaug

SEQ ID NO: 3816301 - RNA, 13 nt, Shigella flexneri 2a str. 2457T
caucaaaaaauga

SEQ ID NO: 3816302 - RNA, 14 nt, Shigella flexneri 2a str. 2457T
caucaaacccuucc

SEQ ID NO: 3816303 - RNA, 15 nt, Shigella flexneri 2a str. 2457T
caucaaaguuuuuau

SEQ ID NO: 3816304 - RNA, 21 nt, Shigella flexneri 2a str. 2457T
caucaaaguuuuuaugaguuu

SEQ ID NO: 3816305 - RNA, 23 nt, Shigella flexneri 2a str. 2457T
caucaaauguugcguucaucagu

SEQ ID NO: 3816306 - RNA, 19 nt, Shigella flexneri 2a str. 2457T
caucaaauuugucgccaac

SEQ ID NO: 3816307 - RNA, 14 nt, Shigella flexneri 2a str. 2457T
caucaacacuuugg

SEQ ID NO: 3816308 - RNA, 14 nt, Shigella flexneri 2a str. 2457T
caucaaccaacacc

SEQ ID NO: 3816309 - RNA, 12 nt, Shigella flexneri 2a str. 2457T
caucaaccagca

SEQ ID NO: 3816310 - RNA, 15 nt, Shigella flexneri 2a str. 2457T
caucaacgccauacg

SEQ ID NO: 3816311 - RNA, 17 nt, Shigella flexneri 2a str. 2457T
caucaacgccaucgcca

SEQ ID NO: 3816312 - RNA, 21 nt, Shigella flexneri 2a str. 2457T
caucaacgcccauaaauacgu

SEQ ID NO: 3816313 - RNA, 15 nt, Shigella flexneri 2a str. 2457T
caucaacguuuuuuu

SEQ ID NO: 3816314 - RNA, 13 nt, Shigella flexneri 2a str. 2457T
caucaacugacua

SEQ ID NO: 3816315 - RNA, 19 nt, Shigella flexneri 2a str. 2457T
caucaagauuagcgacgaa

SEQ ID NO: 3816316 - RNA, 22 nt, Shigella flexneri 2a str. 2457T
caucaagcuaacgaacgcagug

SEQ ID NO: 3816317 - RNA, 15 nt, Shigella flexneri 2a str. 2457T
caucaagcuguucuu

SEQ ID NO: 3816318 - RNA, 22 nt, Shigella flexneri 2a str. 2457T
caucaaguagcgcuuguaggaa

SEQ ID NO: 3816319 - RNA, 17 nt, Shigella flexneri 2a str. 2457T
caucaagucauugauuc

SEQ ID NO: 3816320 - RNA, 21 nt, Shigella flexneri 2a str. 2457T
caucaaguugauuuuucguuu

SEQ ID NO: 3816321 - RNA, 22 nt, Shigella flexneri 2a str. 2457T
caucaaguugauuuuucguuuu

SEQ ID NO: 3816322 - RNA, 12 nt, Shigella flexneri 2a str. 2457T
caucaauaccau

SEQ ID NO: 3816323 - RNA, 23 nt, Shigella flexneri 2a str. 2457T
caucaauaccauuaucauugaga

SEQ ID NO: 3816324 - RNA, 13 nt, Shigella flexneri 2a str. 2457T
caucaauauuaag

SEQ ID NO: 3816325 - RNA, 13 nt, Shigella flexneri 2a str. 2457T
caucaaucacuuu

SEQ ID NO: 3816326 - RNA, 13 nt, Shigella flexneri 2a str. 2457T
caucaaucauuuu

SEQ ID NO: 3816327 - RNA, 17 nt, Shigella flexneri 2a str. 2457T
caucaaucgcaaucugg

SEQ ID NO: 3816328 - RNA, 12 nt, Shigella flexneri 2a str. 2457T
caucaaugccag

SEQ ID NO: 3816329 - RNA, 22 nt, Shigella flexneri 2a str. 2457T
caucaauggcugcaaagcauuu

SEQ ID NO: 3816330 - RNA, 20 nt, Shigella flexneri 2a str. 2457T
caucaauugcucacucccgg

SEQ ID NO: 3816331 - RNA, 13 nt, Shigella flexneri 2a str. 2457T
caucaauuugccc

SEQ ID NO: 3816332 - RNA, 23 nt, Shigella flexneri 2a str. 2457T
caucacaaucauccuaccgccag

SEQ ID NO: 3816333 - RNA, 22 nt, Shigella flexneri 2a str. 2457T
caucacauauucgccgcccugc

SEQ ID NO: 3816334 - RNA, 14 nt, Shigella flexneri 2a str. 2457T
caucacaucccagc

SEQ ID NO: 3816335 - RNA, 13 nt, Shigella flexneri 2a str. 2457T
caucaccaacacc

SEQ ID NO: 3816336 - RNA, 22 nt, Shigella flexneri 2a str. 2457T
caucaccaauacgcauaugcau

SEQ ID NO: 3816337 - RNA, 13 nt, Shigella flexneri 2a str. 2457T
caucaccacgcug

SEQ ID NO: 3816338 - RNA, 20 nt, Shigella flexneri 2a str. 2457T
caucaccacgcugagagaag

SEQ ID NO: 3816339 - RNA, 17 nt, Shigella flexneri 2a str. 2457T
caucaccaguaccgcca

SEQ ID NO: 3816340 - RNA, 14 nt, Shigella flexneri 2a str. 2457T
caucaccauccacg

SEQ ID NO: 3816341 - RNA, 14 nt, Shigella flexneri 2a str. 2457T
caucaccccgcgcu

SEQ ID NO: 3816342 - RNA, 20 nt, Shigella flexneri 2a str. 2457T
caucaccgaugcccucaaua

SEQ ID NO: 3816343 - RNA, 13 nt, Shigella flexneri 2a str. 2457T
caucaccggcuuc

SEQ ID NO: 3816344 - RNA, 17 nt, Shigella flexneri 2a str. 2457T
caucaccuuccacauau

SEQ ID NO: 3816345 - RNA, 21 nt, Shigella flexneri 2a str. 2457T
caucacgaaaucccacauccu

SEQ ID NO: 3816346 - RNA, 22 nt, Shigella flexneri 2a str. 2457T
caucacgaucgcuucggucugc

SEQ ID NO: 3816347 - RNA, 17 nt, Shigella flexneri 2a str. 2457T
caucacgcagcgucagc

SEQ ID NO: 3816348 - RNA, 22 nt, Shigella flexneri 2a str. 2457T
caucacgccaauaauggccuuu

SEQ ID NO: 3816349 - RNA, 15 nt, Shigella flexneri 2a str. 2457T
caucacgcccgcuuu

SEQ ID NO: 3816350 - RNA, 20 nt, Shigella flexneri 2a str. 2457T
caucacgcgguuacgcaccg

SEQ ID NO: 3816351 - RNA, 23 nt, Shigella flexneri 2a str. 2457T
caucacgguugagggcaaacacc

SEQ ID NO: 3816352 - RNA, 14 nt, Shigella flexneri 2a str. 2457T
caucacuccacacc

SEQ ID NO: 3816353 - RNA, 19 nt, Shigella flexneri 2a str. 2457T
caucacuccauccagcaac

SEQ ID NO: 3816354 - RNA, 23 nt, Shigella flexneri 2a str. 2457T
caucacuccauccagcaacaaca

SEQ ID NO: 3816355 - RNA, 17 nt, Shigella flexneri 2a str. 2457T
caucacucccuuucugc

SEQ ID NO: 3816356 - RNA, 14 nt, Shigella flexneri 2a str. 2457T
caucacuuccagua

SEQ ID NO: 3816357 - RNA, 18 nt, Shigella flexneri 2a str. 2457T
caucacuuucaaaagccc

SEQ ID NO: 3816358 - RNA, 21 nt, Shigella flexneri 2a str. 2457T
caucacuuucggugacagaaa

SEQ ID NO: 3816359 - RNA, 19 nt, Shigella flexneri 2a str. 2457T
caucagaaacacacuuucc

SEQ ID NO: 3816360 - RNA, 21 nt, Shigella flexneri 2a str. 2457T
caucagaaacacacuuuccag

SEQ ID NO: 3816361 - RNA, 22 nt, Shigella flexneri 2a str. 2457T
caucagaacguaaacgcagcau

SEQ ID NO: 3816362 - RNA, 21 nt, Shigella flexneri 2a str. 2457T
caucagacaaaugucacugcu

SEQ ID NO: 3816363 - RNA, 14 nt, Shigella flexneri 2a str. 2457T
caucagacauuauu

SEQ ID NO: 3816364 - RNA, 21 nt, Shigella flexneri 2a str. 2457T
caucagaccuucgcuaucaaa

SEQ ID NO: 3816365 - RNA, 18 nt, Shigella flexneri 2a str. 2457T
caucagacuuugcgccau

SEQ ID NO: 3816366 - RNA, 17 nt, Shigella flexneri 2a str. 2457T
caucagauaaucgccau

SEQ ID NO: 3816367 - RNA, 14 nt, Shigella flexneri 2a str. 2457T
caucagcaacacgc

SEQ ID NO: 3816368 - RNA, 11 nt, Shigella flexneri 2a str. 2457T
caucagcagca

SEQ ID NO: 3816369 - RNA, 12 nt, Shigella flexneri 2a str. 2457T
caucagcagcaa

SEQ ID NO: 3816370 - RNA, 19 nt, Shigella flexneri 2a str. 2457T
caucagcauaaucaccagu

SEQ ID NO: 3816371 - RNA, 16 nt, Shigella flexneri 2a str. 2457T
caucagcaucccaccu

SEQ ID NO: 3816372 - RNA, 13 nt, Shigella flexneri 2a str. 2457T
caucagcauucuc

SEQ ID NO: 3816373 - RNA, 14 nt, Shigella flexneri 2a str. 2457T
caucagccagaugc

SEQ ID NO: 3816374 - RNA, 17 nt, Shigella flexneri 2a str. 2457T
caucagccagaugcacc

SEQ ID NO: 3816375 - RNA, 20 nt, Shigella flexneri 2a str. 2457T
caucagcgccugauggacau

SEQ ID NO: 3816376 - RNA, 12 nt, Shigella flexneri 2a str. 2457T
caucagcggcac

SEQ ID NO: 3816377 - RNA, 19 nt, Shigella flexneri 2a str. 2457T
caucagcggcgaagccuaa

SEQ ID NO: 3816378 - RNA, 20 nt, Shigella flexneri 2a str. 2457T
caucagcgguaaaacgccca

SEQ ID NO: 3816379 - RNA, 18 nt, Shigella flexneri 2a str. 2457T
caucagcgguacucgcgc

SEQ ID NO: 3816380 - RNA, 12 nt, Shigella flexneri 2a str. 2457T
caucagcugcca

SEQ ID NO: 3816381 - RNA, 14 nt, Shigella flexneri 2a str. 2457T
caucaggaaacccg

SEQ ID NO: 3816382 - RNA, 17 nt, Shigella flexneri 2a str. 2457T
caucaggaaacccgcca

SEQ ID NO: 3816383 - RNA, 21 nt, Shigella flexneri 2a str. 2457T
caucaggcaacccagaagaaa

SEQ ID NO: 3816384 - RNA, 12 nt, Shigella flexneri 2a str. 2457T
caucaggcaaug

SEQ ID NO: 3816385 - RNA, 21 nt, Shigella flexneri 2a str. 2457T
caucaggcaaugggcaaacgc

SEQ ID NO: 3816386 - RNA, 20 nt, Shigella flexneri 2a str. 2457T
caucaggcagucugcgcccu

SEQ ID NO: 3816387 - RNA, 22 nt, Shigella flexneri 2a str. 2457T
caucaggcaucgugcaccaauu

SEQ ID NO: 3816388 - RNA, 14 nt, Shigella flexneri 2a str. 2457T
caucaggcaucugc

SEQ ID NO: 3816389 - RNA, 19 nt, Shigella flexneri 2a str. 2457T
caucaggcauuuuuaucac

SEQ ID NO: 3816390 - RNA, 21 nt, Shigella flexneri 2a str. 2457T
caucaggcguucgcggcggca

SEQ ID NO: 3816391 - RNA, 12 nt, Shigella flexneri 2a str. 2457T
caucaggggcag

SEQ ID NO: 3816392 - RNA, 16 nt, Shigella flexneri 2a str. 2457T
caucaggggcagcacc

SEQ ID NO: 3816393 - RNA, 18 nt, Shigella flexneri 2a str. 2457T
caucaggggcagcaccau

SEQ ID NO: 3816394 - RNA, 17 nt, Shigella flexneri 2a str. 2457T
caucaguagcauccccg

SEQ ID NO: 3816395 - RNA, 15 nt, Shigella flexneri 2a str. 2457T
caucagucucaaacc

SEQ ID NO: 3816396 - RNA, 20 nt, Shigella flexneri 2a str. 2457T
caucagucucaaaccggcuc

SEQ ID NO: 3816397 - RNA, 15 nt, Shigella flexneri 2a str. 2457T
caucagugaacccau

SEQ ID NO: 3816398 - RNA, 14 nt, Shigella flexneri 2a str. 2457T
caucagugccagua

SEQ ID NO: 3816399 - RNA, 16 nt, Shigella flexneri 2a str. 2457T
caucaguuccaguuca

SEQ ID NO: 3816400 - RNA, 12 nt, Shigella flexneri 2a str. 2457T
caucaguuucaa

SEQ ID NO: 3816401 - RNA, 17 nt, Shigella flexneri 2a str. 2457T
caucaguuucaaauggc

SEQ ID NO: 3816402 - RNA, 14 nt, Shigella flexneri 2a str. 2457T
caucauaaauaaga

SEQ ID NO: 3816403 - RNA, 18 nt, Shigella flexneri 2a str. 2457T
caucauaaccugcucugc

SEQ ID NO: 3816404 - RNA, 12 nt, Shigella flexneri 2a str. 2457T
caucauaagacu

SEQ ID NO: 3816405 - RNA, 19 nt, Shigella flexneri 2a str. 2457T
caucauagacuucccuccc

SEQ ID NO: 3816406 - RNA, 14 nt, Shigella flexneri 2a str. 2457T
caucaucaauauga

SEQ ID NO: 3816407 - RNA, 12 nt, Shigella flexneri 2a str. 2457T
caucaucaccag

SEQ ID NO: 3816408 - RNA, 19 nt, Shigella flexneri 2a str. 2457T
caucaucagaaaugccagu

SEQ ID NO: 3816409 - RNA, 13 nt, Shigella flexneri 2a str. 2457T
caucaucagauuc

SEQ ID NO: 3816410 - RNA, 19 nt, Shigella flexneri 2a str. 2457T
caucauccccguaucuuca

SEQ ID NO: 3816411 - RNA, 19 nt, Shigella flexneri 2a str. 2457T
caucauccggcaccuuuuc

SEQ ID NO: 3816412 - RNA, 20 nt, Shigella flexneri 2a str. 2457T
caucauccggcaccuuuuca

SEQ ID NO: 3816413 - RNA, 16 nt, Shigella flexneri 2a str. 2457T
caucauccucuucagc

SEQ ID NO: 3816414 - RNA, 15 nt, Shigella flexneri 2a str. 2457T
caucaucgauaccaa

SEQ ID NO: 3816415 - RNA, 17 nt, Shigella flexneri 2a str. 2457T
caucaucgcaaugauuu

SEQ ID NO: 3816416 - RNA, 13 nt, Shigella flexneri 2a str. 2457T
caucaucgcuuuc

SEQ ID NO: 3816417 - RNA, 13 nt, Shigella flexneri 2a str. 2457T
caucaucucccac

SEQ ID NO: 3816418 - RNA, 17 nt, Shigella flexneri 2a str. 2457T
caucaugaauauauaau

SEQ ID NO: 3816419 - RNA, 16 nt, Shigella flexneri 2a str. 2457T
caucaugcacuccgcu

SEQ ID NO: 3816420 - RNA, 14 nt, Shigella flexneri 2a str. 2457T
caucaugccaccca

SEQ ID NO: 3816421 - RNA, 20 nt, Shigella flexneri 2a str. 2457T
caucaugcucagaugccuga

SEQ ID NO: 3816422 - RNA, 14 nt, Shigella flexneri 2a str. 2457T
caucauggcauuuc

SEQ ID NO: 3816423 - RNA, 23 nt, Shigella flexneri 2a str. 2457T
caucaugucggcagugauuuucc

SEQ ID NO: 3816424 - RNA, 24 nt, Shigella flexneri 2a str. 2457T
caucauucgccgcuuaccauaacg

SEQ ID NO: 3816425 - RNA, 13 nt, Shigella flexneri 2a str. 2457T
caucauugcaguc

SEQ ID NO: 3816426 - RNA, 22 nt, Shigella flexneri 2a str. 2457T
caucauuucaaucacaucauca

SEQ ID NO: 3816427 - RNA, 13 nt, Shigella flexneri 2a str. 2457T
cauccacugccug

SEQ ID NO: 3816428 - RNA, 20 nt, Shigella flexneri 2a str. 2457T
cauccagaccgcucagcucc

SEQ ID NO: 3816429 - RNA, 20 nt, Shigella flexneri 2a str. 2457T
cauccagacugcucagcucc

SEQ ID NO: 3816430 - RNA, 19 nt, Shigella flexneri 2a str. 2457T
cauccagagaucgcguagc

SEQ ID NO: 3816431 - RNA, 20 nt, Shigella flexneri 2a str. 2457T
cauccagcaacaacagcgcg

SEQ ID NO: 3816432 - RNA, 12 nt, Shigella flexneri 2a str. 2457T
cauccagcacuu

SEQ ID NO: 3816433 - RNA, 22 nt, Shigella flexneri 2a str. 2457T
cauccagcacuugcaggaacag

SEQ ID NO: 3816434 - RNA, 20 nt, Shigella flexneri 2a str. 2457T
cauccagcagacgcuccauu

SEQ ID NO: 3816435 - RNA, 20 nt, Shigella flexneri 2a str. 2457T
cauccagcagcccuugcuuc

SEQ ID NO: 3816436 - RNA, 13 nt, Shigella flexneri 2a str. 2457T
cauccagcagcgg

SEQ ID NO: 3816437 - RNA, 22 nt, Shigella flexneri 2a str. 2457T
cauccagcagcggaucgaacuc

SEQ ID NO: 3816438 - RNA, 15 nt, Shigella flexneri 2a str. 2457T
cauccagcagugacu

SEQ ID NO: 3816439 - RNA, 18 nt, Shigella flexneri 2a str. 2457T
cauccaggaacuccagau

SEQ ID NO: 3816440 - RNA, 21 nt, Shigella flexneri 2a str. 2457T
cauccaggaacuccagaucca

SEQ ID NO: 3816441 - RNA, 16 nt, Shigella flexneri 2a str. 2457T
cauccagugccgccug

SEQ ID NO: 3816442 - RNA, 21 nt, Shigella flexneri 2a str. 2457T
cauccaguggcagaguaauug

SEQ ID NO: 3816443 - RNA, 12 nt, Shigella flexneri 2a str. 2457T
cauccaucaaau

SEQ ID NO: 3816444 - RNA, 14 nt, Shigella flexneri 2a str. 2457T
cauccaucugcuuu

SEQ ID NO: 3816445 - RNA, 14 nt, Shigella flexneri 2a str. 2457T
cauccauucagugc

SEQ ID NO: 3816446 - RNA, 22 nt, Shigella flexneri 2a str. 2457T
cauccauucggcgauuaacaag

SEQ ID NO: 3816447 - RNA, 18 nt, Shigella flexneri 2a str. 2457T
caucccagacaccgccca

SEQ ID NO: 3816448 - RNA, 23 nt, Shigella flexneri 2a str. 2457T
caucccagugcaauaccauggcu

SEQ ID NO: 3816449 - RNA, 17 nt, Shigella flexneri 2a str. 2457T
cauccccgcccuuccag

SEQ ID NO: 3816450 - RNA, 19 nt, Shigella flexneri 2a str. 2457T
cauccccggcaaccacacc

SEQ ID NO: 3816451 - RNA, 20 nt, Shigella flexneri 2a str. 2457T
cauccccggcaaccacaccc

SEQ ID NO: 3816452 - RNA, 21 nt, Shigella flexneri 2a str. 2457T
cauccccggcaaccacaccca

SEQ ID NO: 3816453 - RNA, 13 nt, Shigella flexneri 2a str. 2457T
cauccccucuucc

SEQ ID NO: 3816454 - RNA, 14 nt, Shigella flexneri 2a str. 2457T
cauccccucuucca

SEQ ID NO: 3816455 - RNA, 17 nt, Shigella flexneri 2a str. 2457T
caucccgaccaaugcau

SEQ ID NO: 3816456 - RNA, 18 nt, Shigella flexneri 2a str. 2457T
caucccgagucgcugagc

SEQ ID NO: 3816457 - RNA, 16 nt, Shigella flexneri 2a str. 2457T
caucccggcagagaaa

SEQ ID NO: 3816458 - RNA, 16 nt, Shigella flexneri 2a str. 2457T
caucccggcauaaccg

SEQ ID NO: 3816459 - RNA, 22 nt, Shigella flexneri 2a str. 2457T
caucccgguaucaaagcgccag

SEQ ID NO: 3816460 - RNA, 21 nt, Shigella flexneri 2a str. 2457T
caucccguuaugguuauccac

SEQ ID NO: 3816461 - RNA, 14 nt, Shigella flexneri 2a str. 2457T
caucccuaccgccc

SEQ ID NO: 3816462 - RNA, 22 nt, Shigella flexneri 2a str. 2457T
caucccuaugcauaauccugcc

SEQ ID NO: 3816463 - RNA, 22 nt, Shigella flexneri 2a str. 2457T
caucccugaaauguuugcaaua

SEQ ID NO: 3816464 - RNA, 18 nt, Shigella flexneri 2a str. 2457T
caucccugucguccagac

SEQ ID NO: 3816465 - RNA, 14 nt, Shigella flexneri 2a str. 2457T
cauccgaagaacca

SEQ ID NO: 3816466 - RNA, 15 nt, Shigella flexneri 2a str. 2457T
cauccgacacuggca

SEQ ID NO: 3816467 - RNA, 15 nt, Shigella flexneri 2a str. 2457T
cauccgacaucaacc

SEQ ID NO: 3816468 - RNA, 14 nt, Shigella flexneri 2a str. 2457T
cauccgccauccac

SEQ ID NO: 3816469 - RNA, 17 nt, Shigella flexneri 2a str. 2457T
cauccgcgguaucgccg

SEQ ID NO: 3816470 - RNA, 18 nt, Shigella flexneri 2a str. 2457T
cauccgcgugacgcuggc

SEQ ID NO: 3816471 - RNA, 15 nt, Shigella flexneri 2a str. 2457T
cauccggcaaaaaag

SEQ ID NO: 3816472 - RNA, 17 nt, Shigella flexneri 2a str. 2457T
cauccggcaaaaaagcc

SEQ ID NO: 3816473 - RNA, 22 nt, Shigella flexneri 2a str. 2457T
cauccggcaaaaaagcccgcac

SEQ ID NO: 3816474 - RNA, 19 nt, Shigella flexneri 2a str. 2457T
cauccggcaaguuguauug

SEQ ID NO: 3816475 - RNA, 22 nt, Shigella flexneri 2a str. 2457T
cauccggcaaucggugcaaaug

SEQ ID NO: 3816476 - RNA, 21 nt, Shigella flexneri 2a str. 2457T
cauccggcaauuaaaaaagcg

SEQ ID NO: 3816477 - RNA, 13 nt, Shigella flexneri 2a str. 2457T
cauccggcaccuu

SEQ ID NO: 3816478 - RNA, 15 nt, Shigella flexneri 2a str. 2457T
cauccggcagcaaau

SEQ ID NO: 3816479 - RNA, 17 nt, Shigella flexneri 2a str. 2457T
cauccggcagccgugcc

SEQ ID NO: 3816480 - RNA, 15 nt, Shigella flexneri 2a str. 2457T
cauccggcauaaaca

SEQ ID NO: 3816481 - RNA, 19 nt, Shigella flexneri 2a str. 2457T
cauccggcaugaacaaagc

SEQ ID NO: 3816482 - RNA, 14 nt, Shigella flexneri 2a str. 2457T
cauccggcauucag

SEQ ID NO: 3816483 - RNA, 22 nt, Shigella flexneri 2a str. 2457T
cauccggcauucagugcaaaug

SEQ ID NO: 3816484 - RNA, 16 nt, Shigella flexneri 2a str. 2457T
cauccggcauuuugug

SEQ ID NO: 3816485 - RNA, 16 nt, Shigella flexneri 2a str. 2457T
cauccggcuggucagc

SEQ ID NO: 3816486 - RNA, 23 nt, Shigella flexneri 2a str. 2457T
cauccggcuuuuuuacaucauca

SEQ ID NO: 3816487 - RNA, 22 nt, Shigella flexneri 2a str. 2457T
cauccggucagacaacuucccu

SEQ ID NO: 3816488 - RNA, 20 nt, Shigella flexneri 2a str. 2457T
cauccguggcgacagaggug

SEQ ID NO: 3816489 - RNA, 17 nt, Shigella flexneri 2a str. 2457T
cauccguuucccuguuc

SEQ ID NO: 3816490 - RNA, 22 nt, Shigella flexneri 2a str. 2457T
cauccguuucccuguucagccu

SEQ ID NO: 3816491 - RNA, 16 nt, Shigella flexneri 2a str. 2457T
cauccuaaaggcaaaa

SEQ ID NO: 3816492 - RNA, 14 nt, Shigella flexneri 2a str. 2457T
cauccucuuuacgc

SEQ ID NO: 3816493 - RNA, 16 nt, Shigella flexneri 2a str. 2457T
cauccugauaggauuu

SEQ ID NO: 3816494 - RNA, 12 nt, Shigella flexneri 2a str. 2457T
cauccugccaug

SEQ ID NO: 3816495 - RNA, 18 nt, Shigella flexneri 2a str. 2457T
cauccugcggcagcucca

SEQ ID NO: 3816496 - RNA, 19 nt, Shigella flexneri 2a str. 2457T
cauccugcguuaaucgccg

SEQ ID NO: 3816497 - RNA, 12 nt, Shigella flexneri 2a str. 2457T
cauccugcugca

SEQ ID NO: 3816498 - RNA, 22 nt, Shigella flexneri 2a str. 2457T
cauccuggggguucaucaccac

SEQ ID NO: 3816499 - RNA, 19 nt, Shigella flexneri 2a str. 2457T
cauccuguacgacaaaaga

SEQ ID NO: 3816500 - RNA, 16 nt, Shigella flexneri 2a str. 2457T
cauccuucauuauccu

SEQ ID NO: 3816501 - RNA, 22 nt, Shigella flexneri 2a str. 2457T
cauccuuccccgcuugggcaga

SEQ ID NO: 3816502 - RNA, 15 nt, Shigella flexneri 2a str. 2457T
cauccuugcuaacca

SEQ ID NO: 3816503 - RNA, 16 nt, Shigella flexneri 2a str. 2457T
cauccuuugcuggcaa

SEQ ID NO: 3816504 - RNA, 19 nt, Shigella flexneri 2a str. 2457T
cauccuuugggcauuugca

SEQ ID NO: 3816505 - RNA, 17 nt, Shigella flexneri 2a str. 2457T
caucgaaaacgccaccg

SEQ ID NO: 3816506 - RNA, 18 nt, Shigella flexneri 2a str. 2457T
caucgaaccaucggcuuu

SEQ ID NO: 3816507 - RNA, 16 nt, Shigella flexneri 2a str. 2457T
caucgaauugcgcauc

SEQ ID NO: 3816508 - RNA, 13 nt, Shigella flexneri 2a str. 2457T
caucgacagcaaa

SEQ ID NO: 3816509 - RNA, 15 nt, Shigella flexneri 2a str. 2457T
caucgacaucaacga

SEQ ID NO: 3816510 - RNA, 16 nt, Shigella flexneri 2a str. 2457T
caucgacgccaucauu

SEQ ID NO: 3816511 - RNA, 23 nt, Shigella flexneri 2a str. 2457T
caucgacggcggagucauucucc

SEQ ID NO: 3816512 - RNA, 19 nt, Shigella flexneri 2a str. 2457T
caucgacguagugaaaucg

SEQ ID NO: 3816513 - RNA, 19 nt, Shigella flexneri 2a str. 2457T
caucgauaccaucgcuuca

SEQ ID NO: 3816514 - RNA, 16 nt, Shigella flexneri 2a str. 2457T
caucgauaucaaccag

SEQ ID NO: 3816515 - RNA, 17 nt, Shigella flexneri 2a str. 2457T
caucgauaucaaccagu

SEQ ID NO: 3816516 - RNA, 15 nt, Shigella flexneri 2a str. 2457T
caucgaugagaugac

SEQ ID NO: 3816517 - RNA, 22 nt, Shigella flexneri 2a str. 2457T
caucgaugguugcccugcuggu

SEQ ID NO: 3816518 - RNA, 19 nt, Shigella flexneri 2a str. 2457T
caucgcaaaccagacgcgc

SEQ ID NO: 3816519 - RNA, 21 nt, Shigella flexneri 2a str. 2457T
caucgcaaaccagacgcgcgu

SEQ ID NO: 3816520 - RNA, 21 nt, Shigella flexneri 2a str. 2457T
caucgcauccgacaucaaccg

SEQ ID NO: 3816521 - RNA, 15 nt, Shigella flexneri 2a str. 2457T
caucgcaucuucgcc

SEQ ID NO: 3816522 - RNA, 22 nt, Shigella flexneri 2a str. 2457T
caucgcauguugauuaccuguc

SEQ ID NO: 3816523 - RNA, 23 nt, Shigella flexneri 2a str. 2457T
caucgccaaucugcugauaaucg

SEQ ID NO: 3816524 - RNA, 14 nt, Shigella flexneri 2a str. 2457T
caucgccacaccag

SEQ ID NO: 3816525 - RNA, 17 nt, Shigella flexneri 2a str. 2457T
caucgccacggcaugaa

SEQ ID NO: 3816526 - RNA, 23 nt, Shigella flexneri 2a str. 2457T
caucgccagaacuacccgguucg

SEQ ID NO: 3816527 - RNA, 15 nt, Shigella flexneri 2a str. 2457T
caucgccagcagcca

SEQ ID NO: 3816528 - RNA, 16 nt, Shigella flexneri 2a str. 2457T
caucgccagcagccau

SEQ ID NO: 3816529 - RNA, 21 nt, Shigella flexneri 2a str. 2457T
caucgcccaguugaucaccag

SEQ ID NO: 3816530 - RNA, 22 nt, Shigella flexneri 2a str. 2457T
caucgcccaguugaucaccagu

SEQ ID NO: 3816531 - RNA, 13 nt, Shigella flexneri 2a str. 2457T
caucgcccgcaac

SEQ ID NO: 3816532 - RNA, 16 nt, Shigella flexneri 2a str. 2457T
caucgcccugauggcg

SEQ ID NO: 3816533 - RNA, 23 nt, Shigella flexneri 2a str. 2457T
caucgcccugauggcgcgccacc

SEQ ID NO: 3816534 - RNA, 23 nt, Shigella flexneri 2a str. 2457T
caucgccgguaaaaaugcgcagu

SEQ ID NO: 3816535 - RNA, 20 nt, Shigella flexneri 2a str. 2457T
caucgccggugcgguaaucg

SEQ ID NO: 3816536 - RNA, 19 nt, Shigella flexneri 2a str. 2457T
caucgccugaucgcgcagu

SEQ ID NO: 3816537 - RNA, 16 nt, Shigella flexneri 2a str. 2457T
caucgccuuccagcga

SEQ ID NO: 3816538 - RNA, 15 nt, Shigella flexneri 2a str. 2457T
caucgcgaccaauca

SEQ ID NO: 3816539 - RNA, 19 nt, Shigella flexneri 2a str. 2457T
caucgcgauuaugccgccg

SEQ ID NO: 3816540 - RNA, 15 nt, Shigella flexneri 2a str. 2457T
caucgcgccaacaaa

SEQ ID NO: 3816541 - RNA, 16 nt, Shigella flexneri 2a str. 2457T
caucgcgcccaaacca

SEQ ID NO: 3816542 - RNA, 17 nt, Shigella flexneri 2a str. 2457T
caucgcgcccaaaccac

SEQ ID NO: 3816543 - RNA, 18 nt, Shigella flexneri 2a str. 2457T
caucgcgcuuaucgccag

SEQ ID NO: 3816544 - RNA, 16 nt, Shigella flexneri 2a str. 2457T
caucgcggucagcugc

SEQ ID NO: 3816545 - RNA, 22 nt, Shigella flexneri 2a str. 2457T
caucgcugggauuacaacacgc

SEQ ID NO: 3816546 - RNA, 19 nt, Shigella flexneri 2a str. 2457T
caucggauugcuccugcuc

SEQ ID NO: 3816547 - RNA, 17 nt, Shigella flexneri 2a str. 2457T
caucggcaaucacauca

SEQ ID NO: 3816548 - RNA, 20 nt, Shigella flexneri 2a str. 2457T
caucggcaaucacaucacca

SEQ ID NO: 3816549 - RNA, 16 nt, Shigella flexneri 2a str. 2457T
caucggcagcgccaau

SEQ ID NO: 3816550 - RNA, 20 nt, Shigella flexneri 2a str. 2457T
caucggcagcgccaaucgcu

SEQ ID NO: 3816551 - RNA, 22 nt, Shigella flexneri 2a str. 2457T
caucggcauacagcgacagacg

SEQ ID NO: 3816552 - RNA, 15 nt, Shigella flexneri 2a str. 2457T
caucggcauuaaucu

SEQ ID NO: 3816553 - RNA, 21 nt, Shigella flexneri 2a str. 2457T
caucggcggugaccagcagca

SEQ ID NO: 3816554 - RNA, 20 nt, Shigella flexneri 2a str. 2457T
caucggcuuauucauaucaa

SEQ ID NO: 3816555 - RNA, 22 nt, Shigella flexneri 2a str. 2457T
caucggcuuauucauaucaaac

SEQ ID NO: 3816556 - RNA, 23 nt, Shigella flexneri 2a str. 2457T
caucggcuuuggcaaauggcgcu

SEQ ID NO: 3816557 - RNA, 22 nt, Shigella flexneri 2a str. 2457T
caucgguaucuucccagccaau

SEQ ID NO: 3816558 - RNA, 15 nt, Shigella flexneri 2a str. 2457T
caucguccagcagca

SEQ ID NO: 3816559 - RNA, 13 nt, Shigella flexneri 2a str. 2457T
caucguccagcuu

SEQ ID NO: 3816560 - RNA, 21 nt, Shigella flexneri 2a str. 2457T
caucguccuuuuauuacgugg

SEQ ID NO: 3816561 - RNA, 13 nt, Shigella flexneri 2a str. 2457T
caucgucggccuu

SEQ ID NO: 3816562 - RNA, 14 nt, Shigella flexneri 2a str. 2457T
caucgugcaccaau

SEQ ID NO: 3816563 - RNA, 18 nt, Shigella flexneri 2a str. 2457T
caucguuugcugccuuca

SEQ ID NO: 3816564 - RNA, 19 nt, Shigella flexneri 2a str. 2457T
caucuacccgaugcaaaaa

SEQ ID NO: 3816565 - RNA, 16 nt, Shigella flexneri 2a str. 2457T
caucuauagcacccgc

SEQ ID NO: 3816566 - RNA, 22 nt, Shigella flexneri 2a str. 2457T
caucuauagugaggcuauucca

SEQ ID NO: 3816567 - RNA, 15 nt, Shigella flexneri 2a str. 2457T
caucuauuauuguuu

SEQ ID NO: 3816568 - RNA, 13 nt, Shigella flexneri 2a str. 2457T
caucucaaacacg

SEQ ID NO: 3816569 - RNA, 14 nt, Shigella flexneri 2a str. 2457T
caucucauccauca

SEQ ID NO: 3816570 - RNA, 15 nt, Shigella flexneri 2a str. 2457T
caucucauccaucaa

SEQ ID NO: 3816571 - RNA, 14 nt, Shigella flexneri 2a str. 2457T
caucuccacaguca

SEQ ID NO: 3816572 - RNA, 23 nt, Shigella flexneri 2a str. 2457T
caucuccugcaacagguugcgcu

SEQ ID NO: 3816573 - RNA, 16 nt, Shigella flexneri 2a str. 2457T
caucuccuuacugccc

SEQ ID NO: 3816574 - RNA, 23 nt, Shigella flexneri 2a str. 2457T
caucuccuuacugcccccggcgu

SEQ ID NO: 3816575 - RNA, 17 nt, Shigella flexneri 2a str. 2457T
caucucgcgcucuucuu

SEQ ID NO: 3816576 - RNA, 18 nt, Shigella flexneri 2a str. 2457T
caucucgcgcucuucuuc

SEQ ID NO: 3816577 - RNA, 20 nt, Shigella flexneri 2a str. 2457T
caucucgcgcucuucuucgc

SEQ ID NO: 3816578 - RNA, 16 nt, Shigella flexneri 2a str. 2457T
caucucuacagcgccc

SEQ ID NO: 3816579 - RNA, 17 nt, Shigella flexneri 2a str. 2457T
caucucuucacgcuuug

SEQ ID NO: 3816580 - RNA, 12 nt, Shigella flexneri 2a str. 2457T
caucucuuccca

SEQ ID NO: 3816581 - RNA, 13 nt, Shigella flexneri 2a str. 2457T
caucucuucccau

SEQ ID NO: 3816582 - RNA, 14 nt, Shigella flexneri 2a str. 2457T
caucucuuccggca

SEQ ID NO: 3816583 - RNA, 22 nt, Shigella flexneri 2a str. 2457T
caucucuucuucaagccaggcu

SEQ ID NO: 3816584 - RNA, 20 nt, Shigella flexneri 2a str. 2457T
caucugaccacggccacagc

SEQ ID NO: 3816585 - RNA, 21 nt, Shigella flexneri 2a str. 2457T
caucugaccacggccacagcc

SEQ ID NO: 3816586 - RNA, 20 nt, Shigella flexneri 2a str. 2457T
caucugagcaugaugccuga

SEQ ID NO: 3816587 - RNA, 19 nt, Shigella flexneri 2a str. 2457T
caucugcauuccgguguaa

SEQ ID NO: 3816588 - RNA, 14 nt, Shigella flexneri 2a str. 2457T
caucugccacuucu

SEQ ID NO: 3816589 - RNA, 13 nt, Shigella flexneri 2a str. 2457T
caucugccagcca

SEQ ID NO: 3816590 - RNA, 14 nt, Shigella flexneri 2a str. 2457T
caucugccagccau

SEQ ID NO: 3816591 - RNA, 11 nt, Shigella flexneri 2a str. 2457T
caucugcccca

SEQ ID NO: 3816592 - RNA, 16 nt, Shigella flexneri 2a str. 2457T
caucugccugauccug

SEQ ID NO: 3816593 - RNA, 17 nt, Shigella flexneri 2a str. 2457T
caucugcguggcgcgcg

SEQ ID NO: 3816594 - RNA, 13 nt, Shigella flexneri 2a str. 2457T
caucugcuuuuug

SEQ ID NO: 3816595 - RNA, 20 nt, Shigella flexneri 2a str. 2457T
caucuggaaagucugaauga

SEQ ID NO: 3816596 - RNA, 15 nt, Shigella flexneri 2a str. 2457T
caucuggcauucaga

SEQ ID NO: 3816597 - RNA, 23 nt, Shigella flexneri 2a str. 2457T
caucugucaguggacgauaagca

SEQ ID NO: 3816598 - RNA, 14 nt, Shigella flexneri 2a str. 2457T
caucuguucuuuua

SEQ ID NO: 3816599 - RNA, 23 nt, Shigella flexneri 2a str. 2457T
caucuguucuuuuaacgcaugca

SEQ ID NO: 3816600 - RNA, 19 nt, Shigella flexneri 2a str. 2457T
caucuuaacuucgcagcuu

SEQ ID NO: 3816601 - RNA, 14 nt, Shigella flexneri 2a str. 2457T
caucuuauccggcc

SEQ ID NO: 3816602 - RNA, 19 nt, Shigella flexneri 2a str. 2457T
caucuucaauccacgguuu

SEQ ID NO: 3816603 - RNA, 19 nt, Shigella flexneri 2a str. 2457T
caucuucacacugaugaca

SEQ ID NO: 3816604 - RNA, 19 nt, Shigella flexneri 2a str. 2457T
caucuucacuguccgccag

SEQ ID NO: 3816605 - RNA, 20 nt, Shigella flexneri 2a str. 2457T
caucuucacuguccgccaga

SEQ ID NO: 3816606 - RNA, 13 nt, Shigella flexneri 2a str. 2457T
caucuucacuuca

SEQ ID NO: 3816607 - RNA, 13 nt, Shigella flexneri 2a str. 2457T
caucuuccaccac

SEQ ID NO: 3816608 - RNA, 15 nt, Shigella flexneri 2a str. 2457T
caucuuccaguugca

SEQ ID NO: 3816609 - RNA, 17 nt, Shigella flexneri 2a str. 2457T
caucuucccagguuuca

SEQ ID NO: 3816610 - RNA, 23 nt, Shigella flexneri 2a str. 2457T
caucuuccguagcggcucggaau

SEQ ID NO: 3816611 - RNA, 12 nt, Shigella flexneri 2a str. 2457T
caucuucuccac

SEQ ID NO: 3816612 - RNA, 16 nt, Shigella flexneri 2a str. 2457T
caucuucuccacgcca

SEQ ID NO: 3816613 - RNA, 18 nt, Shigella flexneri 2a str. 2457T
caucuucuucaauuuccg

SEQ ID NO: 3816614 - RNA, 19 nt, Shigella flexneri 2a str. 2457T
caucuucuugcagcuuaau

SEQ ID NO: 3816615 - RNA, 23 nt, Shigella flexneri 2a str. 2457T
caucuucuugcagcuuaaucaua

SEQ ID NO: 3816616 - RNA, 11 nt, Shigella flexneri 2a str. 2457T
caucuuuaacg

SEQ ID NO: 3816617 - RNA, 15 nt, Shigella flexneri 2a str. 2457T
caucuuuauaugcaa

SEQ ID NO: 3816618 - RNA, 15 nt, Shigella flexneri 2a str. 2457T
caucuuucagaauca

SEQ ID NO: 3816619 - RNA, 18 nt, Shigella flexneri 2a str. 2457T
caucuuucagaaucaggu

SEQ ID NO: 3816620 - RNA, 21 nt, Shigella flexneri 2a str. 2457T
caucuuuccaaaccucagagu

SEQ ID NO: 3816621 - RNA, 18 nt, Shigella flexneri 2a str. 2457T
caucuuugaaaucacgca

SEQ ID NO: 3816622 - RNA, 14 nt, Shigella flexneri 2a str. 2457T
caugaaacagaaaa

SEQ ID NO: 3816623 - RNA, 15 nt, Shigella flexneri 2a str. 2457T
caugaaacgccagga

SEQ ID NO: 3816624 - RNA, 12 nt, Shigella flexneri 2a str. 2457T
caugaaaugaaa

SEQ ID NO: 3816625 - RNA, 14 nt, Shigella flexneri 2a str. 2457T
caugaaaugaaaau

SEQ ID NO: 3816626 - RNA, 16 nt, Shigella flexneri 2a str. 2457T
caugaaaugaaaauca

SEQ ID NO: 3816627 - RNA, 18 nt, Shigella flexneri 2a str. 2457T
caugaacaaagcgcaccu

SEQ ID NO: 3816628 - RNA, 24 nt, Shigella flexneri 2a str. 2457T
caugaagauggucuguaccaccag

SEQ ID NO: 3816629 - RNA, 22 nt, Shigella flexneri 2a str. 2457T
caugaagcugacaggcgcugau

SEQ ID NO: 3816630 - RNA, 13 nt, Shigella flexneri 2a str. 2457T
caugaauaucaag

SEQ ID NO: 3816631 - RNA, 17 nt, Shigella flexneri 2a str. 2457T
caugaaucagcaaggaa

SEQ ID NO: 3816632 - RNA, 16 nt, Shigella flexneri 2a str. 2457T
caugacaaaaaagcca

SEQ ID NO: 3816633 - RNA, 14 nt, Shigella flexneri 2a str. 2457T
caugacacagaauc

SEQ ID NO: 3816634 - RNA, 22 nt, Shigella flexneri 2a str. 2457T
caugacagcgcccgacaagauc

SEQ ID NO: 3816635 - RNA, 23 nt, Shigella flexneri 2a str. 2457T
caugaccacucauuacggucaaa

SEQ ID NO: 3816636 - RNA, 23 nt, Shigella flexneri 2a str. 2457T
caugaccagugaggaugcggguc

SEQ ID NO: 3816637 - RNA, 16 nt, Shigella flexneri 2a str. 2457T
caugaccgaucaaggc

SEQ ID NO: 3816638 - RNA, 13 nt, Shigella flexneri 2a str. 2457T
caugaccgccgca

SEQ ID NO: 3816639 - RNA, 16 nt, Shigella flexneri 2a str. 2457T
caugaccgcuccgcca

SEQ ID NO: 3816640 - RNA, 17 nt, Shigella flexneri 2a str. 2457T
caugaccgcuccgccau

SEQ ID NO: 3816641 - RNA, 15 nt, Shigella flexneri 2a str. 2457T
caugaccgugaucgu

SEQ ID NO: 3816642 - RNA, 23 nt, Shigella flexneri 2a str. 2457T
caugaccgugaucguggccauga

SEQ ID NO: 3816643 - RNA, 11 nt, Shigella flexneri 2a str. 2457T
caugaccugcc

SEQ ID NO: 3816644 - RNA, 18 nt, Shigella flexneri 2a str. 2457T
caugaccuuccagcgccg

SEQ ID NO: 3816645 - RNA, 22 nt, Shigella flexneri 2a str. 2457T
caugaccuuucaguuugccgcu

SEQ ID NO: 3816646 - RNA, 19 nt, Shigella flexneri 2a str. 2457T
caugacgcacuuucgcuuu

SEQ ID NO: 3816647 - RNA, 20 nt, Shigella flexneri 2a str. 2457T
caugacgcacuuucgcuuua

SEQ ID NO: 3816648 - RNA, 17 nt, Shigella flexneri 2a str. 2457T
caugacugcggcguggg

SEQ ID NO: 3816649 - RNA, 12 nt, Shigella flexneri 2a str. 2457T
caugaguugcug

SEQ ID NO: 3816650 - RNA, 14 nt, Shigella flexneri 2a str. 2457T
caugaguugcugga

SEQ ID NO: 3816651 - RNA, 22 nt, Shigella flexneri 2a str. 2457T
caugauaccgauuacucagcaa

SEQ ID NO: 3816652 - RNA, 14 nt, Shigella flexneri 2a str. 2457T
caugauagcccgga

SEQ ID NO: 3816653 - RNA, 15 nt, Shigella flexneri 2a str. 2457T
caugauccugcaaua

SEQ ID NO: 3816654 - RNA, 14 nt, Shigella flexneri 2a str. 2457T
caugauccuggauu

SEQ ID NO: 3816655 - RNA, 14 nt, Shigella flexneri 2a str. 2457T
caugaucuuuuuug

SEQ ID NO: 3816656 - RNA, 22 nt, Shigella flexneri 2a str. 2457T
caugaugacuugccuccagcga

SEQ ID NO: 3816657 - RNA, 18 nt, Shigella flexneri 2a str. 2457T
caugaugauaucacuggu

SEQ ID NO: 3816658 - RNA, 20 nt, Shigella flexneri 2a str. 2457T
caugaugauaucacugguga

SEQ ID NO: 3816659 - RNA, 20 nt, Shigella flexneri 2a str. 2457T
caugaugccggguuuacuuc

SEQ ID NO: 3816660 - RNA, 23 nt, Shigella flexneri 2a str. 2457T
caugaugcgcggcuccagaauau

SEQ ID NO: 3816661 - RNA, 20 nt, Shigella flexneri 2a str. 2457T
caugauguggugcaaggaaa

SEQ ID NO: 3816662 - RNA, 16 nt, Shigella flexneri 2a str. 2457T
caugauucugagaaac

SEQ ID NO: 3816663 - RNA, 14 nt, Shigella flexneri 2a str. 2457T
caugauuucauaac

SEQ ID NO: 3816664 - RNA, 21 nt, Shigella flexneri 2a str. 2457T
caugauuuuguaggccggaua

SEQ ID NO: 3816665 - RNA, 15 nt, Shigella flexneri 2a str. 2457T
caugcaacgucauca

SEQ ID NO: 3816666 - RNA, 15 nt, Shigella flexneri 2a str. 2457T
caugcaauacaaccc

SEQ ID NO: 3816667 - RNA, 19 nt, Shigella flexneri 2a str. 2457T
caugcaauuaccgccacca

SEQ ID NO: 3816668 - RNA, 12 nt, Shigella flexneri 2a str. 2457T
caugcacccuca

SEQ ID NO: 3816669 - RNA, 20 nt, Shigella flexneri 2a str. 2457T
caugcacccucaacaacagc

SEQ ID NO: 3816670 - RNA, 20 nt, Shigella flexneri 2a str. 2457T
caugcacgauauaccgugcu

SEQ ID NO: 3816671 - RNA, 22 nt, Shigella flexneri 2a str. 2457T
caugcagaucguuuuccugcau

SEQ ID NO: 3816672 - RNA, 16 nt, Shigella flexneri 2a str. 2457T
caugcaguaccagaua

SEQ ID NO: 3816673 - RNA, 14 nt, Shigella flexneri 2a str. 2457T
caugccaaaaggga

SEQ ID NO: 3816674 - RNA, 20 nt, Shigella flexneri 2a str. 2457T
caugccaacaaaaucuucua

SEQ ID NO: 3816675 - RNA, 22 nt, Shigella flexneri 2a str. 2457T
caugccaacgcggaugaggcgu

SEQ ID NO: 3816676 - RNA, 17 nt, Shigella flexneri 2a str. 2457T
caugccaaucagcagaa

SEQ ID NO: 3816677 - RNA, 18 nt, Shigella flexneri 2a str. 2457T
caugccagugaugggcag

SEQ ID NO: 3816678 - RNA, 13 nt, Shigella flexneri 2a str. 2457T
caugccauccgca

SEQ ID NO: 3816679 - RNA, 23 nt, Shigella flexneri 2a str. 2457T
caugcccgcgcaaaccaccuggc

SEQ ID NO: 3816680 - RNA, 18 nt, Shigella flexneri 2a str. 2457T
caugccgaugccgacgau

SEQ ID NO: 3816681 - RNA, 14 nt, Shigella flexneri 2a str. 2457T
caugccggucgcgc

SEQ ID NO: 3816682 - RNA, 12 nt, Shigella flexneri 2a str. 2457T
caugccggugau

SEQ ID NO: 3816683 - RNA, 17 nt, Shigella flexneri 2a str. 2457T
caugccugcauaaagga

SEQ ID NO: 3816684 - RNA, 15 nt, Shigella flexneri 2a str. 2457T
caugcgaagaccgca

SEQ ID NO: 3816685 - RNA, 16 nt, Shigella flexneri 2a str. 2457T
caugcgaauacacccu

SEQ ID NO: 3816686 - RNA, 23 nt, Shigella flexneri 2a str. 2457T
caugcgaauacacccugaacuga

SEQ ID NO: 3816687 - RNA, 20 nt, Shigella flexneri 2a str. 2457T
caugcguugucgccauccag

SEQ ID NO: 3816688 - RNA, 13 nt, Shigella flexneri 2a str. 2457T
caugcuauuccuu

SEQ ID NO: 3816689 - RNA, 18 nt, Shigella flexneri 2a str. 2457T
caugcuauugcgccagcc

SEQ ID NO: 3816690 - RNA, 14 nt, Shigella flexneri 2a str. 2457T
caugcucacagagu

SEQ ID NO: 3816691 - RNA, 15 nt, Shigella flexneri 2a str. 2457T
caugcucacagagua

SEQ ID NO: 3816692 - RNA, 18 nt, Shigella flexneri 2a str. 2457T
caugcucagaugccugau

SEQ ID NO: 3816693 - RNA, 17 nt, Shigella flexneri 2a str. 2457T
caugcucagucacuuca

SEQ ID NO: 3816694 - RNA, 21 nt, Shigella flexneri 2a str. 2457T
caugcuccagcagauggcagu

SEQ ID NO: 3816695 - RNA, 14 nt, Shigella flexneri 2a str. 2457T
caugcuggcugcgc

SEQ ID NO: 3816696 - RNA, 20 nt, Shigella flexneri 2a str. 2457T
caugcuuaccaaaaugcugc

SEQ ID NO: 3816697 - RNA, 13 nt, Shigella flexneri 2a str. 2457T
caugcuuagcaca

SEQ ID NO: 3816698 - RNA, 17 nt, Shigella flexneri 2a str. 2457T
cauggacauacgcaccu

SEQ ID NO: 3816699 - RNA, 15 nt, Shigella flexneri 2a str. 2457T
cauggacgcgucagu

SEQ ID NO: 3816700 - RNA, 16 nt, Shigella flexneri 2a str. 2457T
cauggagaacgccugu

SEQ ID NO: 3816701 - RNA, 15 nt, Shigella flexneri 2a str. 2457T
cauggauucgaugau

SEQ ID NO: 3816702 - RNA, 21 nt, Shigella flexneri 2a str. 2457T
cauggcauuggccguugccau

SEQ ID NO: 3816703 - RNA, 13 nt, Shigella flexneri 2a str. 2457T
cauggcauuuucu

SEQ ID NO: 3816704 - RNA, 19 nt, Shigella flexneri 2a str. 2457T
cauggccgggguuucagau

SEQ ID NO: 3816705 - RNA, 16 nt, Shigella flexneri 2a str. 2457T
cauggcgaauggcacg

SEQ ID NO: 3816706 - RNA, 16 nt, Shigella flexneri 2a str. 2457T
cauggcgcagcgauuc

SEQ ID NO: 3816707 - RNA, 19 nt, Shigella flexneri 2a str. 2457T
cauggggaugcugaaaaga

SEQ ID NO: 3816708 - RNA, 14 nt, Shigella flexneri 2a str. 2457T
caugggguuuuucg

SEQ ID NO: 3816709 - RNA, 16 nt, Shigella flexneri 2a str. 2457T
caugggguuuuucgag

SEQ ID NO: 3816710 - RNA, 22 nt, Shigella flexneri 2a str. 2457T
caugggucugcggaucauggua

SEQ ID NO: 3816711 - RNA, 16 nt, Shigella flexneri 2a str. 2457T
caugggugaacugcuu

SEQ ID NO: 3816712 - RNA, 20 nt, Shigella flexneri 2a str. 2457T
caugguaaaaccgacuuaaa

SEQ ID NO: 3816713 - RNA, 15 nt, Shigella flexneri 2a str. 2457T
caugguaaugaucgc

SEQ ID NO: 3816714 - RNA, 17 nt, Shigella flexneri 2a str. 2457T
cauggugucugaugagg

SEQ ID NO: 3816715 - RNA, 19 nt, Shigella flexneri 2a str. 2457T
cauggugucugaugaggca

SEQ ID NO: 3816716 - RNA, 21 nt, Shigella flexneri 2a str. 2457T
caugguguucagauggccaau

SEQ ID NO: 3816717 - RNA, 18 nt, Shigella flexneri 2a str. 2457T
caugguuuauuucccaga

SEQ ID NO: 3816718 - RNA, 21 nt, Shigella flexneri 2a str. 2457T
caugguuuggaucuguugcug

SEQ ID NO: 3816719 - RNA, 14 nt, Shigella flexneri 2a str. 2457T
cauguaacgaugca

SEQ ID NO: 3816720 - RNA, 15 nt, Shigella flexneri 2a str. 2457T
cauguaacgaugcau

SEQ ID NO: 3816721 - RNA, 19 nt, Shigella flexneri 2a str. 2457T
cauguaacgaugcaugaca

SEQ ID NO: 3816722 - RNA, 17 nt, Shigella flexneri 2a str. 2457T
cauguagccgcuuuuuc

SEQ ID NO: 3816723 - RNA, 11 nt, Shigella flexneri 2a str. 2457T
caugucaucaa

SEQ ID NO: 3816724 - RNA, 17 nt, Shigella flexneri 2a str. 2457T
cauguccuucuucugcc

SEQ ID NO: 3816725 - RNA, 17 nt, Shigella flexneri 2a str. 2457T
caugugcgacgggccaa

SEQ ID NO: 3816726 - RNA, 19 nt, Shigella flexneri 2a str. 2457T
caugugggcugccccagcc

SEQ ID NO: 3816727 - RNA, 16 nt, Shigella flexneri 2a str. 2457T
cauguuaaauuccggc

SEQ ID NO: 3816728 - RNA, 18 nt, Shigella flexneri 2a str. 2457T
cauguuaaauuccggcuc

SEQ ID NO: 3816729 - RNA, 19 nt, Shigella flexneri 2a str. 2457T
cauguucauuuauuaccuu

SEQ ID NO: 3816730 - RNA, 21 nt, Shigella flexneri 2a str. 2457T
cauguugaaauucgccagaca

SEQ ID NO: 3816731 - RNA, 16 nt, Shigella flexneri 2a str. 2457T
cauguugaucccggcu

SEQ ID NO: 3816732 - RNA, 19 nt, Shigella flexneri 2a str. 2457T
cauguugauuaccugucgc

SEQ ID NO: 3816733 - RNA, 13 nt, Shigella flexneri 2a str. 2457T
cauguugccuggg

SEQ ID NO: 3816734 - RNA, 15 nt, Shigella flexneri 2a str. 2457T
cauguuugaaucaac

SEQ ID NO: 3816735 - RNA, 19 nt, Shigella flexneri 2a str. 2457T
cauguuuguauuaauuaac

SEQ ID NO: 3816736 - RNA, 12 nt, Shigella flexneri 2a str. 2457T
cauuaaaauucu

SEQ ID NO: 3816737 - RNA, 16 nt, Shigella flexneri 2a str. 2457T
cauuaaaauucuuacg

SEQ ID NO: 3816738 - RNA, 14 nt, Shigella flexneri 2a str. 2457T
cauuaaauccugaa

SEQ ID NO: 3816739 - RNA, 20 nt, Shigella flexneri 2a str. 2457T
cauuaaauccugaaaccaua

SEQ ID NO: 3816740 - RNA, 21 nt, Shigella flexneri 2a str. 2457T
cauuaacaggccaaaugcgga

SEQ ID NO: 3816741 - RNA, 17 nt, Shigella flexneri 2a str. 2457T
cauuaacgccccaauca

SEQ ID NO: 3816742 - RNA, 18 nt, Shigella flexneri 2a str. 2457T
cauuaagaacuccagccc

SEQ ID NO: 3816743 - RNA, 13 nt, Shigella flexneri 2a str. 2457T
cauuaagaugcau

SEQ ID NO: 3816744 - RNA, 17 nt, Shigella flexneri 2a str. 2457T
cauuaaggcaagaaaau

SEQ ID NO: 3816745 - RNA, 22 nt, Shigella flexneri 2a str. 2457T
cauuaaugcgcccagcgucagc

SEQ ID NO: 3816746 - RNA, 19 nt, Shigella flexneri 2a str. 2457T
cauuaaugucggaugcggc

SEQ ID NO: 3816747 - RNA, 14 nt, Shigella flexneri 2a str. 2457T
cauuaccacgauuu

SEQ ID NO: 3816748 - RNA, 18 nt, Shigella flexneri 2a str. 2457T
cauuaccacgauuuugac

SEQ ID NO: 3816749 - RNA, 21 nt, Shigella flexneri 2a str. 2457T
cauuacccaggaagaccugca

SEQ ID NO: 3816750 - RNA, 19 nt, Shigella flexneri 2a str. 2457T
cauuaccuucaacacuggc

SEQ ID NO: 3816751 - RNA, 15 nt, Shigella flexneri 2a str. 2457T
cauuacgccaguaaa

SEQ ID NO: 3816752 - RNA, 17 nt, Shigella flexneri 2a str. 2457T
cauuacgccagucacgg

SEQ ID NO: 3816753 - RNA, 14 nt, Shigella flexneri 2a str. 2457T
cauuacgcgccccu

SEQ ID NO: 3816754 - RNA, 23 nt, Shigella flexneri 2a str. 2457T
cauuacgcucacugcaaaacagg

SEQ ID NO: 3816755 - RNA, 24 nt, Shigella flexneri 2a str. 2457T
cauuacuacgguaauacaaccugc

SEQ ID NO: 3816756 - RNA, 15 nt, Shigella flexneri 2a str. 2457T
cauuagauaaaaaug

SEQ ID NO: 3816757 - RNA, 22 nt, Shigella flexneri 2a str. 2457T
cauuaggaauaaugucuuuaau

SEQ ID NO: 3816758 - RNA, 15 nt, Shigella flexneri 2a str. 2457T
cauuaggccauuuga

SEQ ID NO: 3816759 - RNA, 13 nt, Shigella flexneri 2a str. 2457T
cauuagucacaaa

SEQ ID NO: 3816760 - RNA, 14 nt, Shigella flexneri 2a str. 2457T
cauuaucaaacgug

SEQ ID NO: 3816761 - RNA, 14 nt, Shigella flexneri 2a str. 2457T
cauuaucacaucag

SEQ ID NO: 3816762 - RNA, 23 nt, Shigella flexneri 2a str. 2457T
cauuaucacaucagcgcauuuac

SEQ ID NO: 3816763 - RNA, 20 nt, Shigella flexneri 2a str. 2457T
cauuaucagagauucuuuuc

SEQ ID NO: 3816764 - RNA, 13 nt, Shigella flexneri 2a str. 2457T
cauuauccagcga

SEQ ID NO: 3816765 - RNA, 18 nt, Shigella flexneri 2a str. 2457T
cauuaucggcucgaucug

SEQ ID NO: 3816766 - RNA, 21 nt, Shigella flexneri 2a str. 2457T
cauuaucucuugccaggcuua

SEQ ID NO: 3816767 - RNA, 19 nt, Shigella flexneri 2a str. 2457T
cauuaugagauugagcgau

SEQ ID NO: 3816768 - RNA, 16 nt, Shigella flexneri 2a str. 2457T
cauuauuaaauuuaau

SEQ ID NO: 3816769 - RNA, 21 nt, Shigella flexneri 2a str. 2457T
cauuauuaaauuuaauaauaa

SEQ ID NO: 3816770 - RNA, 21 nt, Shigella flexneri 2a str. 2457T
cauuauuagcuuucuuuuucu

SEQ ID NO: 3816771 - RNA, 13 nt, Shigella flexneri 2a str. 2457T
cauuauucagcga

SEQ ID NO: 3816772 - RNA, 15 nt, Shigella flexneri 2a str. 2457T
cauuauucaggcacu

SEQ ID NO: 3816773 - RNA, 14 nt, Shigella flexneri 2a str. 2457T
cauuauucaucugg

SEQ ID NO: 3816774 - RNA, 18 nt, Shigella flexneri 2a str. 2457T
cauuauucauuguucucc

SEQ ID NO: 3816775 - RNA, 22 nt, Shigella flexneri 2a str. 2457T
cauuauucauuguucucccaua

SEQ ID NO: 3816776 - RNA, 19 nt, Shigella flexneri 2a str. 2457T
cauuauugcgcacaucaau

SEQ ID NO: 3816777 - RNA, 19 nt, Shigella flexneri 2a str. 2457T
cauucaacgucuugcugau

SEQ ID NO: 3816778 - RNA, 19 nt, Shigella flexneri 2a str. 2457T
cauucaacuuaagucucca

SEQ ID NO: 3816779 - RNA, 16 nt, Shigella flexneri 2a str. 2457T
cauucacacuccaguc

SEQ ID NO: 3816780 - RNA, 15 nt, Shigella flexneri 2a str. 2457T
cauucaccauuuuuu

SEQ ID NO: 3816781 - RNA, 18 nt, Shigella flexneri 2a str. 2457T
cauucaccgacgugauga

SEQ ID NO: 3816782 - RNA, 23 nt, Shigella flexneri 2a str. 2457T
cauucagacacgccgccagacca

SEQ ID NO: 3816783 - RNA, 14 nt, Shigella flexneri 2a str. 2457T
cauucagacaggcg

SEQ ID NO: 3816784 - RNA, 18 nt, Shigella flexneri 2a str. 2457T
cauucagcagcagcaaga

SEQ ID NO: 3816785 - RNA, 16 nt, Shigella flexneri 2a str. 2457T
cauucagccaguucuu

SEQ ID NO: 3816786 - RNA, 18 nt, Shigella flexneri 2a str. 2457T
cauucagugcaaaugcca

SEQ ID NO: 3816787 - RNA, 22 nt, Shigella flexneri 2a str. 2457T
cauucagugcaaaugccagaua

SEQ ID NO: 3816788 - RNA, 16 nt, Shigella flexneri 2a str. 2457T
cauucaguuaccugaa

SEQ ID NO: 3816789 - RNA, 21 nt, Shigella flexneri 2a str. 2457T
cauucaugcgaauacacccug

SEQ ID NO: 3816790 - RNA, 23 nt, Shigella flexneri 2a str. 2457T
cauucaugcgaauacacccugaa

SEQ ID NO: 3816791 - RNA, 12 nt, Shigella flexneri 2a str. 2457T
cauucauuuuuu

SEQ ID NO: 3816792 - RNA, 22 nt, Shigella flexneri 2a str. 2457T
cauuccagauacgaccguucca

SEQ ID NO: 3816793 - RNA, 22 nt, Shigella flexneri 2a str. 2457T
cauuccagaugugccaguugca

SEQ ID NO: 3816794 - RNA, 13 nt, Shigella flexneri 2a str. 2457T
cauuccaguccac

SEQ ID NO: 3816795 - RNA, 21 nt, Shigella flexneri 2a str. 2457T
cauuccaguccacaucaacca

SEQ ID NO: 3816796 - RNA, 22 nt, Shigella flexneri 2a str. 2457T
cauucccggucaguagaauaau

SEQ ID NO: 3816797 - RNA, 23 nt, Shigella flexneri 2a str. 2457T
cauucccugcagucaccugcccu

SEQ ID NO: 3816798 - RNA, 20 nt, Shigella flexneri 2a str. 2457T
cauuccgggaaacgaaccau

SEQ ID NO: 3816799 - RNA, 16 nt, Shigella flexneri 2a str. 2457T
cauuccugcugacggc

SEQ ID NO: 3816800 - RNA, 16 nt, Shigella flexneri 2a str. 2457T
cauucgacaacugcug

SEQ ID NO: 3816801 - RNA, 18 nt, Shigella flexneri 2a str. 2457T
cauucgagaagcccauac

SEQ ID NO: 3816802 - RNA, 13 nt, Shigella flexneri 2a str. 2457T
cauucgagccaag

SEQ ID NO: 3816803 - RNA, 15 nt, Shigella flexneri 2a str. 2457T
cauucgccaguccuu

SEQ ID NO: 3816804 - RNA, 20 nt, Shigella flexneri 2a str. 2457T
cauucgccgcuuaccauaac

SEQ ID NO: 3816805 - RNA, 14 nt, Shigella flexneri 2a str. 2457T
cauucgccgguucc

SEQ ID NO: 3816806 - RNA, 20 nt, Shigella flexneri 2a str. 2457T
cauucgccgguuccagcuuc

SEQ ID NO: 3816807 - RNA, 22 nt, Shigella flexneri 2a str. 2457T
cauucgcuguguaaacccagcc

SEQ ID NO: 3816808 - RNA, 19 nt, Shigella flexneri 2a str. 2457T
cauucggcgcagguuuaau

SEQ ID NO: 3816809 - RNA, 13 nt, Shigella flexneri 2a str. 2457T
cauucggugcuca

SEQ ID NO: 3816810 - RNA, 19 nt, Shigella flexneri 2a str. 2457T
cauucgguugccagcgcca

SEQ ID NO: 3816811 - RNA, 23 nt, Shigella flexneri 2a str. 2457T
cauucgucguauagaucacuuug

SEQ ID NO: 3816812 - RNA, 22 nt, Shigella flexneri 2a str. 2457T
cauucuacuuugcgagucugcu

SEQ ID NO: 3816813 - RNA, 18 nt, Shigella flexneri 2a str. 2457T
cauucucaucaccauucc

SEQ ID NO: 3816814 - RNA, 18 nt, Shigella flexneri 2a str. 2457T
cauucucgcgacccauga

SEQ ID NO: 3816815 - RNA, 15 nt, Shigella flexneri 2a str. 2457T
cauucugacuggguc

SEQ ID NO: 3816816 - RNA, 15 nt, Shigella flexneri 2a str. 2457T
cauucugcgcugacu

SEQ ID NO: 3816817 - RNA, 22 nt, Shigella flexneri 2a str. 2457T
cauucugcgcugacucuacuga

SEQ ID NO: 3816818 - RNA, 22 nt, Shigella flexneri 2a str. 2457T
cauucuggagcuggacggucug

SEQ ID NO: 3816819 - RNA, 17 nt, Shigella flexneri 2a str. 2457T
cauucuuccuccagcgg

SEQ ID NO: 3816820 - RNA, 19 nt, Shigella flexneri 2a str. 2457T
cauugaacgggugauuucc

SEQ ID NO: 3816821 - RNA, 15 nt, Shigella flexneri 2a str. 2457T
cauugaagaauuuuu

SEQ ID NO: 3816822 - RNA, 23 nt, Shigella flexneri 2a str. 2457T
cauugaauuuuauguuucgcauc

SEQ ID NO: 3816823 - RNA, 15 nt, Shigella flexneri 2a str. 2457T
cauugaccagcugcc

SEQ ID NO: 3816824 - RNA, 14 nt, Shigella flexneri 2a str. 2457T
cauugacgcaucgc

SEQ ID NO: 3816825 - RNA, 14 nt, Shigella flexneri 2a str. 2457T
cauugacgcuggcu

SEQ ID NO: 3816826 - RNA, 23 nt, Shigella flexneri 2a str. 2457T
cauugagcuugcguguuuuauau

SEQ ID NO: 3816827 - RNA, 15 nt, Shigella flexneri 2a str. 2457T
cauugagguugaucu

SEQ ID NO: 3816828 - RNA, 14 nt, Shigella flexneri 2a str. 2457T
cauugaguuuacgc

SEQ ID NO: 3816829 - RNA, 23 nt, Shigella flexneri 2a str. 2457T
cauugaguuugaugaccagauca

SEQ ID NO: 3816830 - RNA, 23 nt, Shigella flexneri 2a str. 2457T
cauugauaauccaucacuucauc

SEQ ID NO: 3816831 - RNA, 20 nt, Shigella flexneri 2a str. 2457T
cauugauguuuucacaaccg

SEQ ID NO: 3816832 - RNA, 18 nt, Shigella flexneri 2a str. 2457T
cauugcaaccacacaggc

SEQ ID NO: 3816833 - RNA, 14 nt, Shigella flexneri 2a str. 2457T
cauugcaacguggu

SEQ ID NO: 3816834 - RNA, 14 nt, Shigella flexneri 2a str. 2457T
cauugccauguuga

SEQ ID NO: 3816835 - RNA, 20 nt, Shigella flexneri 2a str. 2457T
cauugcccgcccgacaaagc

SEQ ID NO: 3816836 - RNA, 15 nt, Shigella flexneri 2a str. 2457T
cauugccgccucugc

SEQ ID NO: 3816837 - RNA, 22 nt, Shigella flexneri 2a str. 2457T
cauugccggaugacgcgucagg

SEQ ID NO: 3816838 - RNA, 20 nt, Shigella flexneri 2a str. 2457T
cauugccggugauugcaaag

SEQ ID NO: 3816839 - RNA, 12 nt, Shigella flexneri 2a str. 2457T
cauugccugaug

SEQ ID NO: 3816840 - RNA, 15 nt, Shigella flexneri 2a str. 2457T
cauugcgccugcagg

SEQ ID NO: 3816841 - RNA, 17 nt, Shigella flexneri 2a str. 2457T
cauugcggcaacaaugc

SEQ ID NO: 3816842 - RNA, 13 nt, Shigella flexneri 2a str. 2457T
cauugcuauuucc

SEQ ID NO: 3816843 - RNA, 17 nt, Shigella flexneri 2a str. 2457T
cauugcucuggcaaacu

SEQ ID NO: 3816844 - RNA, 21 nt, Shigella flexneri 2a str. 2457T
cauugcugaugcaccuucaac

SEQ ID NO: 3816845 - RNA, 20 nt, Shigella flexneri 2a str. 2457T
cauugcugccgccaguucuu

SEQ ID NO: 3816846 - RNA, 21 nt, Shigella flexneri 2a str. 2457T
cauugcugcugaagcaacagu

SEQ ID NO: 3816847 - RNA, 17 nt, Shigella flexneri 2a str. 2457T
cauuggagacugaugac

SEQ ID NO: 3816848 - RNA, 18 nt, Shigella flexneri 2a str. 2457T
cauuggagaguugaaagc

SEQ ID NO: 3816849 - RNA, 14 nt, Shigella flexneri 2a str. 2457T
cauuggcaggcucu

SEQ ID NO: 3816850 - RNA, 16 nt, Shigella flexneri 2a str. 2457T
cauuggccguugccau

SEQ ID NO: 3816851 - RNA, 23 nt, Shigella flexneri 2a str. 2457T
cauuggguauucauugccugaug

SEQ ID NO: 3816852 - RNA, 20 nt, Shigella flexneri 2a str. 2457T
cauuggguucaucugauagc

SEQ ID NO: 3816853 - RNA, 17 nt, Shigella flexneri 2a str. 2457T
cauugugugaaaucagc

SEQ ID NO: 3816854 - RNA, 17 nt, Shigella flexneri 2a str. 2457T
cauuguguuaucccgau

SEQ ID NO: 3816855 - RNA, 19 nt, Shigella flexneri 2a str. 2457T
cauuguuguuggauccccu

SEQ ID NO: 3816856 - RNA, 15 nt, Shigella flexneri 2a str. 2457T
cauuguuucucugac

SEQ ID NO: 3816857 - RNA, 15 nt, Shigella flexneri 2a str. 2457T
cauuuaaaaagaaaa

SEQ ID NO: 3816858 - RNA, 17 nt, Shigella flexneri 2a str. 2457T
cauuuaacccuucaaga

SEQ ID NO: 3816859 - RNA, 16 nt, Shigella flexneri 2a str. 2457T
cauuuaagaaaaaaga

SEQ ID NO: 3816860 - RNA, 13 nt, Shigella flexneri 2a str. 2457T
cauuuacagaaac

SEQ ID NO: 3816861 - RNA, 15 nt, Shigella flexneri 2a str. 2457T
cauuuacgccgcauc

SEQ ID NO: 3816862 - RNA, 22 nt, Shigella flexneri 2a str. 2457T
cauuuacgccgcauccggcaau

SEQ ID NO: 3816863 - RNA, 22 nt, Shigella flexneri 2a str. 2457T
cauuuagcgccggguuuuuuau

SEQ ID NO: 3816864 - RNA, 21 nt, Shigella flexneri 2a str. 2457T
cauuuauggugcuaguuaucu

SEQ ID NO: 3816865 - RNA, 20 nt, Shigella flexneri 2a str. 2457T
cauuuauuuuuccuccauug

SEQ ID NO: 3816866 - RNA, 23 nt, Shigella flexneri 2a str. 2457T
cauuucaaucaucucucgcauca

SEQ ID NO: 3816867 - RNA, 16 nt, Shigella flexneri 2a str. 2457T
cauuucacguucacgu

SEQ ID NO: 3816868 - RNA, 20 nt, Shigella flexneri 2a str. 2457T
cauuucagaaaguauauaaa

SEQ ID NO: 3816869 - RNA, 21 nt, Shigella flexneri 2a str. 2457T
cauuucagaaaguauauaaaa

SEQ ID NO: 3816870 - RNA, 22 nt, Shigella flexneri 2a str. 2457T
cauuucagaaaguauauaaaaa

SEQ ID NO: 3816871 - RNA, 15 nt, Shigella flexneri 2a str. 2457T
cauuucagggaugaa

SEQ ID NO: 3816872 - RNA, 17 nt, Shigella flexneri 2a str. 2457T
cauuucaucggcuagua

SEQ ID NO: 3816873 - RNA, 12 nt, Shigella flexneri 2a str. 2457T
cauuuccauaaa

SEQ ID NO: 3816874 - RNA, 15 nt, Shigella flexneri 2a str. 2457T
cauuuccauaaauug

SEQ ID NO: 3816875 - RNA, 15 nt, Shigella flexneri 2a str. 2457T
cauuucccagcaaga

SEQ ID NO: 3816876 - RNA, 16 nt, Shigella flexneri 2a str. 2457T
cauuucccccuuccug

SEQ ID NO: 3816877 - RNA, 17 nt, Shigella flexneri 2a str. 2457T
cauuucccccuuccugc

SEQ ID NO: 3816878 - RNA, 17 nt, Shigella flexneri 2a str. 2457T
cauuuccgcugauucaa

SEQ ID NO: 3816879 - RNA, 14 nt, Shigella flexneri 2a str. 2457T
cauuucgaagaaac

SEQ ID NO: 3816880 - RNA, 12 nt, Shigella flexneri 2a str. 2457T
cauuucgucguc

SEQ ID NO: 3816881 - RNA, 19 nt, Shigella flexneri 2a str. 2457T
cauuucuggcgucaaagcu

SEQ ID NO: 3816882 - RNA, 16 nt, Shigella flexneri 2a str. 2457T
cauuucuggugucaca

SEQ ID NO: 3816883 - RNA, 16 nt, Shigella flexneri 2a str. 2457T
cauuucuuuugagcgu

SEQ ID NO: 3816884 - RNA, 14 nt, Shigella flexneri 2a str. 2457T
cauuugaaacguua

SEQ ID NO: 3816885 - RNA, 19 nt, Shigella flexneri 2a str. 2457T
cauuugacacgaacuuuau

SEQ ID NO: 3816886 - RNA, 20 nt, Shigella flexneri 2a str. 2457T
cauuugagcaggaugccuga

SEQ ID NO: 3816887 - RNA, 16 nt, Shigella flexneri 2a str. 2457T
cauuugcacaagaugc

SEQ ID NO: 3816888 - RNA, 18 nt, Shigella flexneri 2a str. 2457T
cauuugcauacccagaac

SEQ ID NO: 3816889 - RNA, 22 nt, Shigella flexneri 2a str. 2457T
cauuugccacuuugcaguuccu

SEQ ID NO: 3816890 - RNA, 16 nt, Shigella flexneri 2a str. 2457T
cauuugcuccagacgc

SEQ ID NO: 3816891 - RNA, 19 nt, Shigella flexneri 2a str. 2457T
cauuugcuugccggaagca

SEQ ID NO: 3816892 - RNA, 21 nt, Shigella flexneri 2a str. 2457T
cauuuggauugauaauuguua

SEQ ID NO: 3816893 - RNA, 16 nt, Shigella flexneri 2a str. 2457T
cauuugugacauuaac

SEQ ID NO: 3816894 - RNA, 16 nt, Shigella flexneri 2a str. 2457T
cauuugugcauagcac

SEQ ID NO: 3816895 - RNA, 13 nt, Shigella flexneri 2a str. 2457T
cauuuguucuuuu

SEQ ID NO: 3816896 - RNA, 16 nt, Shigella flexneri 2a str. 2457T
cauuuuacauccugau

SEQ ID NO: 3816897 - RNA, 19 nt, Shigella flexneri 2a str. 2457T
cauuuuacguugcauuucc

SEQ ID NO: 3816898 - RNA, 18 nt, Shigella flexneri 2a str. 2457T
cauuuuacuuacuucagc

SEQ ID NO: 3816899 - RNA, 21 nt, Shigella flexneri 2a str. 2457T
cauuuucucgcgaaccgccug

SEQ ID NO: 3816900 - RNA, 18 nt, Shigella flexneri 2a str. 2457T
cauuuucucuuucagcgu

SEQ ID NO: 3816901 - RNA, 21 nt, Shigella flexneri 2a str. 2457T
cauuuugaccacacggucuau

SEQ ID NO: 3816902 - RNA, 15 nt, Shigella flexneri 2a str. 2457T
cauuuuucacugcgg

SEQ ID NO: 3816903 - RNA, 20 nt, Shigella flexneri 2a str. 2457T
cauuuuucagcguuccccag

SEQ ID NO: 3816904 - RNA, 14 nt, Shigella flexneri 2a str. 2457T
cauuuuucaugauc

SEQ ID NO: 3816905 - RNA, 20 nt, Shigella flexneri 2a str. 2457T
cauuuuucggcgucagaacu

SEQ ID NO: 3816906 - RNA, 19 nt, Shigella flexneri 2a str. 2457T
cauuuuuuguggcuucuau

SEQ ID NO: 3816907 - RNA, 18 nt, Shigella flexneri 2a str. 2457T
cauuuuuuugucugcuau

SEQ ID NO: 3816908 - RNA, 23 nt, Shigella flexneri 2a str. 2457T
ccaaaaaagcgaaucuuuaucgg

SEQ ID NO: 3816909 - RNA, 11 nt, Shigella flexneri 2a str. 2457T
ccaaaaacauu

SEQ ID NO: 3816910 - RNA, 13 nt, Shigella flexneri 2a str. 2457T
ccaaaaacgccau

SEQ ID NO: 3816911 - RNA, 20 nt, Shigella flexneri 2a str. 2457T
ccaaaaagaaccugaacgcc

SEQ ID NO: 3816912 - RNA, 17 nt, Shigella flexneri 2a str. 2457T
ccaaaaagauuaaaaaa

SEQ ID NO: 3816913 - RNA, 16 nt, Shigella flexneri 2a str. 2457T
ccaaaacagcgacacc

SEQ ID NO: 3816914 - RNA, 20 nt, Shigella flexneri 2a str. 2457T
ccaaaacagcgacaccagcc

SEQ ID NO: 3816915 - RNA, 12 nt, Shigella flexneri 2a str. 2457T
ccaaaaccgcuc

SEQ ID NO: 3816916 - RNA, 11 nt, Shigella flexneri 2a str. 2457T
ccaaaacugga

SEQ ID NO: 3816917 - RNA, 21 nt, Shigella flexneri 2a str. 2457T
ccaaaauaauaaauuaacugc

SEQ ID NO: 3816918 - RNA, 16 nt, Shigella flexneri 2a str. 2457T
ccaaaaugccugaugc

SEQ ID NO: 3816919 - RNA, 23 nt, Shigella flexneri 2a str. 2457T
ccaaaauugguuucagccggauc

SEQ ID NO: 3816920 - RNA, 14 nt, Shigella flexneri 2a str. 2457T
ccaaacagaccaau

SEQ ID NO: 3816921 - RNA, 11 nt, Shigella flexneri 2a str. 2457T
ccaaacagcag

SEQ ID NO: 3816922 - RNA, 14 nt, Shigella flexneri 2a str. 2457T
ccaaacagcagaac

SEQ ID NO: 3816923 - RNA, 14 nt, Shigella flexneri 2a str. 2457T
ccaaacagcgccag

SEQ ID NO: 3816924 - RNA, 15 nt, Shigella flexneri 2a str. 2457T
ccaaacagcgccaga

SEQ ID NO: 3816925 - RNA, 15 nt, Shigella flexneri 2a str. 2457T
ccaaaccucagaguu

SEQ ID NO: 3816926 - RNA, 15 nt, Shigella flexneri 2a str. 2457T
ccaaacgccuagaug

SEQ ID NO: 3816927 - RNA, 17 nt, Shigella flexneri 2a str. 2457T
ccaaacgcucccugcca

SEQ ID NO: 3816928 - RNA, 17 nt, Shigella flexneri 2a str. 2457T
ccaaacguggucgccag

SEQ ID NO: 3816929 - RNA, 19 nt, Shigella flexneri 2a str. 2457T
ccaaacguggucgccagca

SEQ ID NO: 3816930 - RNA, 23 nt, Shigella flexneri 2a str. 2457T
ccaaacugauuuagcaucagcgc

SEQ ID NO: 3816931 - RNA, 17 nt, Shigella flexneri 2a str. 2457T
ccaaagaaaucaguaaa

SEQ ID NO: 3816932 - RNA, 21 nt, Shigella flexneri 2a str. 2457T
ccaaagaccaggaaacccaac

SEQ ID NO: 3816933 - RNA, 19 nt, Shigella flexneri 2a str. 2457T
ccaaagcaccacuccucaa

SEQ ID NO: 3816934 - RNA, 16 nt, Shigella flexneri 2a str. 2457T
ccaaagcagaguugcu

SEQ ID NO: 3816935 - RNA, 22 nt, Shigella flexneri 2a str. 2457T
ccaaaggcgaguucaaucaacu

SEQ ID NO: 3816936 - RNA, 15 nt, Shigella flexneri 2a str. 2457T
ccaaagucaucaauc

SEQ ID NO: 3816937 - RNA, 16 nt, Shigella flexneri 2a str. 2457T
ccaaagucaucaaucg

SEQ ID NO: 3816938 - RNA, 21 nt, Shigella flexneri 2a str. 2457T
ccaaagugacacaaucaaauc

SEQ ID NO: 3816939 - RNA, 17 nt, Shigella flexneri 2a str. 2457T
ccaaauacauugauaua

SEQ ID NO: 3816940 - RNA, 20 nt, Shigella flexneri 2a str. 2457T
ccaaaucauccagaccgcuc

SEQ ID NO: 3816941 - RNA, 21 nt, Shigella flexneri 2a str. 2457T
ccaaaucauccagacugcuca

SEQ ID NO: 3816942 - RNA, 21 nt, Shigella flexneri 2a str. 2457T
ccaaaucgauaaaacuucccg

SEQ ID NO: 3816943 - RNA, 18 nt, Shigella flexneri 2a str. 2457T
ccaaaucgcugcugcuca

SEQ ID NO: 3816944 - RNA, 20 nt, Shigella flexneri 2a str. 2457T
ccaaauuuggugcucaguuu

SEQ ID NO: 3816945 - RNA, 17 nt, Shigella flexneri 2a str. 2457T
ccaacaaaagcaacaaa

SEQ ID NO: 3816946 - RNA, 13 nt, Shigella flexneri 2a str. 2457T
ccaacaaacagua

SEQ ID NO: 3816947 - RNA, 20 nt, Shigella flexneri 2a str. 2457T
ccaacaaacaguacacagac

SEQ ID NO: 3816948 - RNA, 14 nt, Shigella flexneri 2a str. 2457T
ccaacaaauagaga

SEQ ID NO: 3816949 - RNA, 14 nt, Shigella flexneri 2a str. 2457T
ccaacaacagcgcg

SEQ ID NO: 3816950 - RNA, 17 nt, Shigella flexneri 2a str. 2457T
ccaacaauagugccgca

SEQ ID NO: 3816951 - RNA, 15 nt, Shigella flexneri 2a str. 2457T
ccaacaaucucuucc

SEQ ID NO: 3816952 - RNA, 16 nt, Shigella flexneri 2a str. 2457T
ccaacaaucucuucca

SEQ ID NO: 3816953 - RNA, 17 nt, Shigella flexneri 2a str. 2457T
ccaacaaugcaaaauag

SEQ ID NO: 3816954 - RNA, 16 nt, Shigella flexneri 2a str. 2457T
ccaacaauugucgcca

SEQ ID NO: 3816955 - RNA, 13 nt, Shigella flexneri 2a str. 2457T
ccaacagcagcca

SEQ ID NO: 3816956 - RNA, 15 nt, Shigella flexneri 2a str. 2457T
ccaacagcgacauca

SEQ ID NO: 3816957 - RNA, 12 nt, Shigella flexneri 2a str. 2457T
ccaacaggcgag

SEQ ID NO: 3816958 - RNA, 13 nt, Shigella flexneri 2a str. 2457T
ccaacagguuuug

SEQ ID NO: 3816959 - RNA, 15 nt, Shigella flexneri 2a str. 2457T
ccaacaucaugccag

SEQ ID NO: 3816960 - RNA, 17 nt, Shigella flexneri 2a str. 2457T
ccaacaucgaaaacgcc

SEQ ID NO: 3816961 - RNA, 20 nt, Shigella flexneri 2a str. 2457T
ccaacaucgaaaacgccacc

SEQ ID NO: 3816962 - RNA, 14 nt, Shigella flexneri 2a str. 2457T
ccaacaucuaacgc

SEQ ID NO: 3816963 - RNA, 13 nt, Shigella flexneri 2a str. 2457T
ccaaccaaggaag

SEQ ID NO: 3816964 - RNA, 21 nt, Shigella flexneri 2a str. 2457T
ccaaccacggaguugaccagc

SEQ ID NO: 3816965 - RNA, 13 nt, Shigella flexneri 2a str. 2457T
ccaaccagcugac

SEQ ID NO: 3816966 - RNA, 21 nt, Shigella flexneri 2a str. 2457T
ccaaccgauaucuuuccggca

SEQ ID NO: 3816967 - RNA, 13 nt, Shigella flexneri 2a str. 2457T
ccaaccgccaccg

SEQ ID NO: 3816968 - RNA, 23 nt, Shigella flexneri 2a str. 2457T
ccaaccguggcguaaaucaucgg

SEQ ID NO: 3816969 - RNA, 23 nt, Shigella flexneri 2a str. 2457T
ccaaccuaaaaaguuauaaauaa

SEQ ID NO: 3816970 - RNA, 13 nt, Shigella flexneri 2a str. 2457T
ccaacgacggcca

SEQ ID NO: 3816971 - RNA, 13 nt, Shigella flexneri 2a str. 2457T
ccaacgauaauuc

SEQ ID NO: 3816972 - RNA, 15 nt, Shigella flexneri 2a str. 2457T
ccaacgauaauucag

SEQ ID NO: 3816973 - RNA, 17 nt, Shigella flexneri 2a str. 2457T
ccaacgauaauucagca

SEQ ID NO: 3816974 - RNA, 19 nt, Shigella flexneri 2a str. 2457T
ccaacgauaauucagcaau

SEQ ID NO: 3816975 - RNA, 22 nt, Shigella flexneri 2a str. 2457T
ccaacgccccguaaaucgucag

SEQ ID NO: 3816976 - RNA, 19 nt, Shigella flexneri 2a str. 2457T
ccaacgcccuuaccgccag

SEQ ID NO: 3816977 - RNA, 14 nt, Shigella flexneri 2a str. 2457T
ccaacgcgccaccg

SEQ ID NO: 3816978 - RNA, 18 nt, Shigella flexneri 2a str. 2457T
ccaacggugaaaaaccaa

SEQ ID NO: 3816979 - RNA, 15 nt, Shigella flexneri 2a str. 2457T
ccaacguaacaaaac

SEQ ID NO: 3816980 - RNA, 19 nt, Shigella flexneri 2a str. 2457T
ccaacguucguacugcccu

SEQ ID NO: 3816981 - RNA, 14 nt, Shigella flexneri 2a str. 2457T
ccaacuccagcggc

SEQ ID NO: 3816982 - RNA, 14 nt, Shigella flexneri 2a str. 2457T
ccaacuguaccagc

SEQ ID NO: 3816983 - RNA, 23 nt, Shigella flexneri 2a str. 2457T
ccaacuguagugaucaaacacaa

SEQ ID NO: 3816984 - RNA, 14 nt, Shigella flexneri 2a str. 2457T
ccaacuguugaucc

SEQ ID NO: 3816985 - RNA, 18 nt, Shigella flexneri 2a str. 2457T
ccaacuguugauccagga

SEQ ID NO: 3816986 - RNA, 19 nt, Shigella flexneri 2a str. 2457T
ccaacuguugauccaggag

SEQ ID NO: 3816987 - RNA, 13 nt, Shigella flexneri 2a str. 2457T
ccaacuucaugac

SEQ ID NO: 3816988 - RNA, 15 nt, Shigella flexneri 2a str. 2457T
ccaacuugcccaggu

SEQ ID NO: 3816989 - RNA, 20 nt, Shigella flexneri 2a str. 2457T
ccaagauuaaaggcaccaau

SEQ ID NO: 3816990 - RNA, 12 nt, Shigella flexneri 2a str. 2457T
ccaagccugaua

SEQ ID NO: 3816991 - RNA, 18 nt, Shigella flexneri 2a str. 2457T
ccaaggucuccgcccagc

SEQ ID NO: 3816992 - RNA, 18 nt, Shigella flexneri 2a str. 2457T
ccaaguugugauugagau

SEQ ID NO: 3816993 - RNA, 13 nt, Shigella flexneri 2a str. 2457T
ccaauaaaaauac

SEQ ID NO: 3816994 - RNA, 18 nt, Shigella flexneri 2a str. 2457T
ccaauaauccccaauacg

SEQ ID NO: 3816995 - RNA, 16 nt, Shigella flexneri 2a str. 2457T
ccaauacaaaauuuaa

SEQ ID NO: 3816996 - RNA, 16 nt, Shigella flexneri 2a str. 2457T
ccaauaccgcccacca

SEQ ID NO: 3816997 - RNA, 23 nt, Shigella flexneri 2a str. 2457T
ccaauagaaagugacagcccggc

SEQ ID NO: 3816998 - RNA, 14 nt, Shigella flexneri 2a str. 2457T
ccaauaucaaauaa

SEQ ID NO: 3816999 - RNA, 14 nt, Shigella flexneri 2a str. 2457T
ccaauauucagaaa

SEQ ID NO: 3817000 - RNA, 23 nt, Shigella flexneri 2a str. 2457T
ccaaucaaauacccuugcagaua

SEQ ID NO: 3817001 - RNA, 22 nt, Shigella flexneri 2a str. 2457T
ccaaucacacaaccaugcagga

SEQ ID NO: 3817002 - RNA, 16 nt, Shigella flexneri 2a str. 2457T
ccaaucagcaauaaac

SEQ ID NO: 3817003 - RNA, 17 nt, Shigella flexneri 2a str. 2457T
ccaaucagcaauaaacg

SEQ ID NO: 3817004 - RNA, 14 nt, Shigella flexneri 2a str. 2457T
ccaaucagcacaca

SEQ ID NO: 3817005 - RNA, 14 nt, Shigella flexneri 2a str. 2457T
ccaaucaucgcggc

SEQ ID NO: 3817006 - RNA, 15 nt, Shigella flexneri 2a str. 2457T
ccaaucaucgcggca

SEQ ID NO: 3817007 - RNA, 16 nt, Shigella flexneri 2a str. 2457T
ccaaucaucgcggcac

SEQ ID NO: 3817008 - RNA, 14 nt, Shigella flexneri 2a str. 2457T
ccaauccgccagcc

SEQ ID NO: 3817009 - RNA, 15 nt, Shigella flexneri 2a str. 2457T
ccaauccgccagcca

SEQ ID NO: 3817010 - RNA, 13 nt, Shigella flexneri 2a str. 2457T
ccaaucugcaaaa

SEQ ID NO: 3817011 - RNA, 18 nt, Shigella flexneri 2a str. 2457T
ccaaucuucacaucauca

SEQ ID NO: 3817012 - RNA, 17 nt, Shigella flexneri 2a str. 2457T
ccaaucuucucuuccgg

SEQ ID NO: 3817013 - RNA, 19 nt, Shigella flexneri 2a str. 2457T
ccaaugaaagccccaccag

SEQ ID NO: 3817014 - RNA, 18 nt, Shigella flexneri 2a str. 2457T
ccaaugaaguggcauccg

SEQ ID NO: 3817015 - RNA, 16 nt, Shigella flexneri 2a str. 2457T
ccaaugacuauuugcg

SEQ ID NO: 3817016 - RNA, 22 nt, Shigella flexneri 2a str. 2457T
ccaaugauugggucauuuccca

SEQ ID NO: 3817017 - RNA, 19 nt, Shigella flexneri 2a str. 2457T
ccaaugcaggcaucgguga

SEQ ID NO: 3817018 - RNA, 22 nt, Shigella flexneri 2a str. 2457T
ccaaugccaccagggauaaagc

SEQ ID NO: 3817019 - RNA, 14 nt, Shigella flexneri 2a str. 2457T
ccaaugccugaugc

SEQ ID NO: 3817020 - RNA, 19 nt, Shigella flexneri 2a str. 2457T
ccaauggcaauaaagacau

SEQ ID NO: 3817021 - RNA, 23 nt, Shigella flexneri 2a str. 2457T
ccaauguagccgcacgcuggcgu

SEQ ID NO: 3817022 - RNA, 22 nt, Shigella flexneri 2a str. 2457T
ccaauuaaugcaccaacaaaua

SEQ ID NO: 3817023 - RNA, 14 nt, Shigella flexneri 2a str. 2457T
ccaauuccgcagcg

SEQ ID NO: 3817024 - RNA, 23 nt, Shigella flexneri 2a str. 2457T
ccaauucguaaguacauuaaaau

SEQ ID NO: 3817025 - RNA, 10 nt, Shigella flexneri 2a str. 2457T
ccaauugccu

SEQ ID NO: 3817026 - RNA, 11 nt, Shigella flexneri 2a str. 2457T
ccaauugcugu

SEQ ID NO: 3817027 - RNA, 23 nt, Shigella flexneri 2a str. 2457T
ccacaaaacggauguuucuucaa

SEQ ID NO: 3817028 - RNA, 22 nt, Shigella flexneri 2a str. 2457T
ccacaaaagcggugauaaaccc

SEQ ID NO: 3817029 - RNA, 21 nt, Shigella flexneri 2a str. 2457T
ccacaaacccgccagaccagc

SEQ ID NO: 3817030 - RNA, 16 nt, Shigella flexneri 2a str. 2457T
ccacaaacucuuuucc

SEQ ID NO: 3817031 - RNA, 23 nt, Shigella flexneri 2a str. 2457T
ccacaaagcagacaacccacaca

SEQ ID NO: 3817032 - RNA, 20 nt, Shigella flexneri 2a str. 2457T
ccacaaccgccguugccuuu

SEQ ID NO: 3817033 - RNA, 20 nt, Shigella flexneri 2a str. 2457T
ccacaaccggcgggaaaaau

SEQ ID NO: 3817034 - RNA, 13 nt, Shigella flexneri 2a str. 2457T
ccacaacuucaac

SEQ ID NO: 3817035 - RNA, 15 nt, Shigella flexneri 2a str. 2457T
ccacaagaaugccug

SEQ ID NO: 3817036 - RNA, 14 nt, Shigella flexneri 2a str. 2457T
ccacaaucagccag

SEQ ID NO: 3817037 - RNA, 17 nt, Shigella flexneri 2a str. 2457T
ccacaaucagccagaac

SEQ ID NO: 3817038 - RNA, 12 nt, Shigella flexneri 2a str. 2457T
ccacaaucucac

SEQ ID NO: 3817039 - RNA, 21 nt, Shigella flexneri 2a str. 2457T
ccacaauggcauauuccgcca

SEQ ID NO: 3817040 - RNA, 16 nt, Shigella flexneri 2a str. 2457T
ccacaaugucacaaau

SEQ ID NO: 3817041 - RNA, 15 nt, Shigella flexneri 2a str. 2457T
ccacaauugaccagu

SEQ ID NO: 3817042 - RNA, 17 nt, Shigella flexneri 2a str. 2457T
ccacacacgauccugca

SEQ ID NO: 3817043 - RNA, 17 nt, Shigella flexneri 2a str. 2457T
ccacaccaagccggaau

SEQ ID NO: 3817044 - RNA, 16 nt, Shigella flexneri 2a str. 2457T
ccacaccaaucaacaa

SEQ ID NO: 3817045 - RNA, 23 nt, Shigella flexneri 2a str. 2457T
ccacaccaaucaacaauugcggg

SEQ ID NO: 3817046 - RNA, 19 nt, Shigella flexneri 2a str. 2457T
ccacaccaccguuuucccg

SEQ ID NO: 3817047 - RNA, 14 nt, Shigella flexneri 2a str. 2457T
ccacacccgcaaga

SEQ ID NO: 3817048 - RNA, 17 nt, Shigella flexneri 2a str. 2457T
ccacaccguugccgcgu

SEQ ID NO: 3817049 - RNA, 15 nt, Shigella flexneri 2a str. 2457T
ccacacgaauuccaa

SEQ ID NO: 3817050 - RNA, 19 nt, Shigella flexneri 2a str. 2457T
ccacacggaguaaugccag

SEQ ID NO: 3817051 - RNA, 20 nt, Shigella flexneri 2a str. 2457T
ccacacggucuaucaucagc

SEQ ID NO: 3817052 - RNA, 18 nt, Shigella flexneri 2a str. 2457T
ccacacucucgcgcagcg

SEQ ID NO: 3817053 - RNA, 22 nt, Shigella flexneri 2a str. 2457T
ccacagacauaaagccugcuuc

SEQ ID NO: 3817054 - RNA, 17 nt, Shigella flexneri 2a str. 2457T
ccacagaccggacugac

SEQ ID NO: 3817055 - RNA, 13 nt, Shigella flexneri 2a str. 2457T
ccacagauccgga

SEQ ID NO: 3817056 - RNA, 14 nt, Shigella flexneri 2a str. 2457T
ccacagcaaaacac

SEQ ID NO: 3817057 - RNA, 15 nt, Shigella flexneri 2a str. 2457T
ccacagcaaugcauu

SEQ ID NO: 3817058 - RNA, 18 nt, Shigella flexneri 2a str. 2457T
ccacagcagccuucgcca

SEQ ID NO: 3817059 - RNA, 19 nt, Shigella flexneri 2a str. 2457T
ccacagcagccuucgccac

SEQ ID NO: 3817060 - RNA, 22 nt, Shigella flexneri 2a str. 2457T
ccacagcauucucggcccggcc

SEQ ID NO: 3817061 - RNA, 14 nt, Shigella flexneri 2a str. 2457T
ccacagccaacaca

SEQ ID NO: 3817062 - RNA, 13 nt, Shigella flexneri 2a str. 2457T
ccacagcgccaga

SEQ ID NO: 3817063 - RNA, 17 nt, Shigella flexneri 2a str. 2457T
ccacaggaccacguucc

SEQ ID NO: 3817064 - RNA, 16 nt, Shigella flexneri 2a str. 2457T
ccacagggugaucacc

SEQ ID NO: 3817065 - RNA, 18 nt, Shigella flexneri 2a str. 2457T
ccacagggugaucaccag

SEQ ID NO: 3817066 - RNA, 17 nt, Shigella flexneri 2a str. 2457T
ccacaguuucagcccca

SEQ ID NO: 3817067 - RNA, 14 nt, Shigella flexneri 2a str. 2457T
ccacaguuucauau

SEQ ID NO: 3817068 - RNA, 15 nt, Shigella flexneri 2a str. 2457T
ccacaucaaucccuu

SEQ ID NO: 3817069 - RNA, 23 nt, Shigella flexneri 2a str. 2457T
ccacaucacuccauccagcaaca

SEQ ID NO: 3817070 - RNA, 14 nt, Shigella flexneri 2a str. 2457T
ccacaucagacuca

SEQ ID NO: 3817071 - RNA, 23 nt, Shigella flexneri 2a str. 2457T
ccacauccagcuuuuuaaucgcc

SEQ ID NO: 3817072 - RNA, 19 nt, Shigella flexneri 2a str. 2457T
ccacauccggcaaaaacaa

SEQ ID NO: 3817073 - RNA, 13 nt, Shigella flexneri 2a str. 2457T
ccacauccggccu

SEQ ID NO: 3817074 - RNA, 16 nt, Shigella flexneri 2a str. 2457T
ccacauccggccuaua

SEQ ID NO: 3817075 - RNA, 21 nt, Shigella flexneri 2a str. 2457T
ccacaugaucauucaccagcc

SEQ ID NO: 3817076 - RNA, 23 nt, Shigella flexneri 2a str. 2457T
ccacaugaucauucaccagccca

SEQ ID NO: 3817077 - RNA, 20 nt, Shigella flexneri 2a str. 2457T
ccacaugccugcauaaagga

SEQ ID NO: 3817078 - RNA, 23 nt, Shigella flexneri 2a str. 2457T
ccacaugcuggucacugacacca

SEQ ID NO: 3817079 - RNA, 16 nt, Shigella flexneri 2a str. 2457T
ccacauuagauaaaaa

SEQ ID NO: 3817080 - RNA, 17 nt, Shigella flexneri 2a str. 2457T
ccacauuagauaaaaau

SEQ ID NO: 3817081 - RNA, 21 nt, Shigella flexneri 2a str. 2457T
ccacauuagauaaaaaugaag

SEQ ID NO: 3817082 - RNA, 15 nt, Shigella flexneri 2a str. 2457T
ccacauugcaucuga

SEQ ID NO: 3817083 - RNA, 21 nt, Shigella flexneri 2a str. 2457T
ccacauugugggauuccagcg

SEQ ID NO: 3817084 - RNA, 14 nt, Shigella flexneri 2a str. 2457T
ccacauuuuccauc

SEQ ID NO: 3817085 - RNA, 18 nt, Shigella flexneri 2a str. 2457T
ccaccaaaaacgccaugu

SEQ ID NO: 3817086 - RNA, 21 nt, Shigella flexneri 2a str. 2457T
ccaccaaugacguuaauaaaa

SEQ ID NO: 3817087 - RNA, 19 nt, Shigella flexneri 2a str. 2457T
ccaccacaacauucccauc

SEQ ID NO: 3817088 - RNA, 20 nt, Shigella flexneri 2a str. 2457T
ccaccacagacaaucgccag

SEQ ID NO: 3817089 - RNA, 12 nt, Shigella flexneri 2a str. 2457T
ccaccaccagac

SEQ ID NO: 3817090 - RNA, 13 nt, Shigella flexneri 2a str. 2457T
ccaccacgccaag

SEQ ID NO: 3817091 - RNA, 14 nt, Shigella flexneri 2a str. 2457T
ccaccacgccaaga

SEQ ID NO: 3817092 - RNA, 13 nt, Shigella flexneri 2a str. 2457T
ccaccacgcugua

SEQ ID NO: 3817093 - RNA, 17 nt, Shigella flexneri 2a str. 2457T
ccaccacguccagagug

SEQ ID NO: 3817094 - RNA, 16 nt, Shigella flexneri 2a str. 2457T
ccaccagaaucgccag

SEQ ID NO: 3817095 - RNA, 17 nt, Shigella flexneri 2a str. 2457T
ccaccagaaucgccagc

SEQ ID NO: 3817096 - RNA, 21 nt, Shigella flexneri 2a str. 2457T
ccaccagaaucgccagcaucg

SEQ ID NO: 3817097 - RNA, 19 nt, Shigella flexneri 2a str. 2457T
ccaccagauggcuuuccac

SEQ ID NO: 3817098 - RNA, 12 nt, Shigella flexneri 2a str. 2457T
ccaccagcagcu

SEQ ID NO: 3817099 - RNA, 15 nt, Shigella flexneri 2a str. 2457T
ccaccagcagcugcu

SEQ ID NO: 3817100 - RNA, 23 nt, Shigella flexneri 2a str. 2457T
ccaccagcaugaaacgccaggau

SEQ ID NO: 3817101 - RNA, 13 nt, Shigella flexneri 2a str. 2457T
ccaccagcgcaau

SEQ ID NO: 3817102 - RNA, 19 nt, Shigella flexneri 2a str. 2457T
ccaccagcggaauaucaga

SEQ ID NO: 3817103 - RNA, 16 nt, Shigella flexneri 2a str. 2457T
ccaccagcgucagaaa

SEQ ID NO: 3817104 - RNA, 19 nt, Shigella flexneri 2a str. 2457T
ccaccaggaacgcgccaag

SEQ ID NO: 3817105 - RNA, 20 nt, Shigella flexneri 2a str. 2457T
ccaccagggauaaagccccc

SEQ ID NO: 3817106 - RNA, 9 nt, Shigella flexneri 2a str. 2457T
ccaccaguc

SEQ ID NO: 3817107 - RNA, 13 nt, Shigella flexneri 2a str. 2457T
ccaccaguccuuc

SEQ ID NO: 3817108 - RNA, 17 nt, Shigella flexneri 2a str. 2457T
ccaccaguccuucuacc

SEQ ID NO: 3817109 - RNA, 21 nt, Shigella flexneri 2a str. 2457T
ccaccagugcaggcaccagcc

SEQ ID NO: 3817110 - RNA, 17 nt, Shigella flexneri 2a str. 2457T
ccaccaguggacggcug

SEQ ID NO: 3817111 - RNA, 21 nt, Shigella flexneri 2a str. 2457T
ccaccauauucgccaccgcgc

SEQ ID NO: 3817112 - RNA, 18 nt, Shigella flexneri 2a str. 2457T
ccacccaccgcagcccag

SEQ ID NO: 3817113 - RNA, 22 nt, Shigella flexneri 2a str. 2457T
ccacccagucccguacccagca

SEQ ID NO: 3817114 - RNA, 20 nt, Shigella flexneri 2a str. 2457T
ccacccauguugaucgccac

SEQ ID NO: 3817115 - RNA, 14 nt, Shigella flexneri 2a str. 2457T
ccacccauuuuaau

SEQ ID NO: 3817116 - RNA, 17 nt, Shigella flexneri 2a str. 2457T
ccacccgcagcaagcgu

SEQ ID NO: 3817117 - RNA, 14 nt, Shigella flexneri 2a str. 2457T
ccacccgcagccau

SEQ ID NO: 3817118 - RNA, 14 nt, Shigella flexneri 2a str. 2457T
ccacccgucgggca

SEQ ID NO: 3817119 - RNA, 13 nt, Shigella flexneri 2a str. 2457T
ccacccuggcaac

SEQ ID NO: 3817120 - RNA, 17 nt, Shigella flexneri 2a str. 2457T
ccaccgacgcagucaug

SEQ ID NO: 3817121 - RNA, 16 nt, Shigella flexneri 2a str. 2457T
ccaccgaugaucaaca

SEQ ID NO: 3817122 - RNA, 14 nt, Shigella flexneri 2a str. 2457T
ccaccgcaaaaggc

SEQ ID NO: 3817123 - RNA, 21 nt, Shigella flexneri 2a str. 2457T
ccaccgcaauaaccaucagcu

SEQ ID NO: 3817124 - RNA, 17 nt, Shigella flexneri 2a str. 2457T
ccaccgcaaucgccagu

SEQ ID NO: 3817125 - RNA, 14 nt, Shigella flexneri 2a str. 2457T
ccaccgcagcccag

SEQ ID NO: 3817126 - RNA, 13 nt, Shigella flexneri 2a str. 2457T
ccaccgcucugcg

SEQ ID NO: 3817127 - RNA, 13 nt, Shigella flexneri 2a str. 2457T
ccaccggauaaag

SEQ ID NO: 3817128 - RNA, 23 nt, Shigella flexneri 2a str. 2457T
ccaccggauaaaggcggcccagu

SEQ ID NO: 3817129 - RNA, 17 nt, Shigella flexneri 2a str. 2457T
ccaccgggguaaaucca

SEQ ID NO: 3817130 - RNA, 16 nt, Shigella flexneri 2a str. 2457T
ccaccgguacaaacau

SEQ ID NO: 3817131 - RNA, 14 nt, Shigella flexneri 2a str. 2457T
ccaccguuucuuuu

SEQ ID NO: 3817132 - RNA, 21 nt, Shigella flexneri 2a str. 2457T
ccaccucaguacccgcguucu

SEQ ID NO: 3817133 - RNA, 20 nt, Shigella flexneri 2a str. 2457T
ccaccuccacgcccagcgca

SEQ ID NO: 3817134 - RNA, 20 nt, Shigella flexneri 2a str. 2457T
ccaccugcgaacuguaauga

SEQ ID NO: 3817135 - RNA, 16 nt, Shigella flexneri 2a str. 2457T
ccaccuggaaccaggc

SEQ ID NO: 3817136 - RNA, 14 nt, Shigella flexneri 2a str. 2457T
ccaccuucaacguu

SEQ ID NO: 3817137 - RNA, 21 nt, Shigella flexneri 2a str. 2457T
ccaccuugcggaaacugucaa

SEQ ID NO: 3817138 - RNA, 14 nt, Shigella flexneri 2a str. 2457T
ccaccuuucucggc

SEQ ID NO: 3817139 - RNA, 15 nt, Shigella flexneri 2a str. 2457T
ccacgauacgcugca

SEQ ID NO: 3817140 - RNA, 21 nt, Shigella flexneri 2a str. 2457T
ccacgauagagagcagucagg

SEQ ID NO: 3817141 - RNA, 19 nt, Shigella flexneri 2a str. 2457T
ccacgauauguucaggaua

SEQ ID NO: 3817142 - RNA, 17 nt, Shigella flexneri 2a str. 2457T
ccacgcaaaggcguuau

SEQ ID NO: 3817143 - RNA, 15 nt, Shigella flexneri 2a str. 2457T
ccacgcaacagacca

SEQ ID NO: 3817144 - RNA, 18 nt, Shigella flexneri 2a str. 2457T
ccacgcacgccugcaucu

SEQ ID NO: 3817145 - RNA, 18 nt, Shigella flexneri 2a str. 2457T
ccacgccaauguguuuau

SEQ ID NO: 3817146 - RNA, 12 nt, Shigella flexneri 2a str. 2457T
ccacgccacagc

SEQ ID NO: 3817147 - RNA, 15 nt, Shigella flexneri 2a str. 2457T
ccacgccacgcugcc

SEQ ID NO: 3817148 - RNA, 22 nt, Shigella flexneri 2a str. 2457T
ccacgccgaaccaugucaucaa

SEQ ID NO: 3817149 - RNA, 24 nt, Shigella flexneri 2a str. 2457T
ccacgccgauaaucaacgcgccgc

SEQ ID NO: 3817150 - RNA, 18 nt, Shigella flexneri 2a str. 2457T
ccacgccugcauccgcca

SEQ ID NO: 3817151 - RNA, 21 nt, Shigella flexneri 2a str. 2457T
ccacgccuuaugccacgugag

SEQ ID NO: 3817152 - RNA, 17 nt, Shigella flexneri 2a str. 2457T
ccacgcgggaagucacu

SEQ ID NO: 3817153 - RNA, 12 nt, Shigella flexneri 2a str. 2457T
ccacgcucagca

SEQ ID NO: 3817154 - RNA, 19 nt, Shigella flexneri 2a str. 2457T
ccacgcugagagaagcacg

SEQ ID NO: 3817155 - RNA, 17 nt, Shigella flexneri 2a str. 2457T
ccacgcugcaucgccaa

SEQ ID NO: 3817156 - RNA, 15 nt, Shigella flexneri 2a str. 2457T
ccacgcugccgcgca

SEQ ID NO: 3817157 - RNA, 18 nt, Shigella flexneri 2a str. 2457T
ccacgcuugcuaacgccc

SEQ ID NO: 3817158 - RNA, 15 nt, Shigella flexneri 2a str. 2457T
ccacgcuuuuuugcu

SEQ ID NO: 3817159 - RNA, 17 nt, Shigella flexneri 2a str. 2457T
ccacggaagcaguucgc

SEQ ID NO: 3817160 - RNA, 16 nt, Shigella flexneri 2a str. 2457T
ccacggcaugaaagcg

SEQ ID NO: 3817161 - RNA, 15 nt, Shigella flexneri 2a str. 2457T
ccacggccacagcca

SEQ ID NO: 3817162 - RNA, 20 nt, Shigella flexneri 2a str. 2457T
ccacggccacagccagccaa

SEQ ID NO: 3817163 - RNA, 21 nt, Shigella flexneri 2a str. 2457T
ccacgguacgccagaguggau

SEQ ID NO: 3817164 - RNA, 15 nt, Shigella flexneri 2a str. 2457T
ccacgguauuugcca

SEQ ID NO: 3817165 - RNA, 19 nt, Shigella flexneri 2a str. 2457T
ccacgguugguuuuaucca

SEQ ID NO: 3817166 - RNA, 18 nt, Shigella flexneri 2a str. 2457T
ccacgucaucagcaauuu

SEQ ID NO: 3817167 - RNA, 23 nt, Shigella flexneri 2a str. 2457T
ccacgucguuccccauuaccuga

SEQ ID NO: 3817168 - RNA, 13 nt, Shigella flexneri 2a str. 2457T
ccacgucugaagu

SEQ ID NO: 3817169 - RNA, 13 nt, Shigella flexneri 2a str. 2457T
ccacguucauuuc

SEQ ID NO: 3817170 - RNA, 14 nt, Shigella flexneri 2a str. 2457T
ccacguucugaucu

SEQ ID NO: 3817171 - RNA, 18 nt, Shigella flexneri 2a str. 2457T
ccacguucugaucuuucu

SEQ ID NO: 3817172 - RNA, 17 nt, Shigella flexneri 2a str. 2457T
ccacguugacaaacugc

SEQ ID NO: 3817173 - RNA, 21 nt, Shigella flexneri 2a str. 2457T
ccacuacaucaagucauugau

SEQ ID NO: 3817174 - RNA, 13 nt, Shigella flexneri 2a str. 2457T
ccacuacccauau

SEQ ID NO: 3817175 - RNA, 23 nt, Shigella flexneri 2a str. 2457T
ccacuacgugaucgucuucaacc

SEQ ID NO: 3817176 - RNA, 21 nt, Shigella flexneri 2a str. 2457T
ccacucaacgguucgccauca

SEQ ID NO: 3817177 - RNA, 14 nt, Shigella flexneri 2a str. 2457T
ccacucaccgccgu

SEQ ID NO: 3817178 - RNA, 21 nt, Shigella flexneri 2a str. 2457T
ccacucaccgccguuaccuuc

SEQ ID NO: 3817179 - RNA, 23 nt, Shigella flexneri 2a str. 2457T
ccacuccacuggagacgacggaa

SEQ ID NO: 3817180 - RNA, 11 nt, Shigella flexneri 2a str. 2457T
ccacuccagcu

SEQ ID NO: 3817181 - RNA, 14 nt, Shigella flexneri 2a str. 2457T
ccacuccggcauga

SEQ ID NO: 3817182 - RNA, 23 nt, Shigella flexneri 2a str. 2457T
ccacucggcacaucgacggugac

SEQ ID NO: 3817183 - RNA, 15 nt, Shigella flexneri 2a str. 2457T
ccacugacacggaac

SEQ ID NO: 3817184 - RNA, 22 nt, Shigella flexneri 2a str. 2457T
ccacugacgggaaacucugcug

SEQ ID NO: 3817185 - RNA, 23 nt, Shigella flexneri 2a str. 2457T
ccacugacgggaaacucugcugg

SEQ ID NO: 3817186 - RNA, 17 nt, Shigella flexneri 2a str. 2457T
ccacugcaacagcuguu

SEQ ID NO: 3817187 - RNA, 12 nt, Shigella flexneri 2a str. 2457T
ccacugcaauga

SEQ ID NO: 3817188 - RNA, 13 nt, Shigella flexneri 2a str. 2457T
ccacugccagauu

SEQ ID NO: 3817189 - RNA, 14 nt, Shigella flexneri 2a str. 2457T
ccacugcgccagcg

SEQ ID NO: 3817190 - RNA, 15 nt, Shigella flexneri 2a str. 2457T
ccacugcgccaucaa

SEQ ID NO: 3817191 - RNA, 20 nt, Shigella flexneri 2a str. 2457T
ccacuggcgcgaauagcuuc

SEQ ID NO: 3817192 - RNA, 16 nt, Shigella flexneri 2a str. 2457T
ccacuggucgcccugg

SEQ ID NO: 3817193 - RNA, 21 nt, Shigella flexneri 2a str. 2457T
ccacugguuccgguuuaucca

SEQ ID NO: 3817194 - RNA, 16 nt, Shigella flexneri 2a str. 2457T
ccacugugcgcgccag

SEQ ID NO: 3817195 - RNA, 21 nt, Shigella flexneri 2a str. 2457T
ccacuucacggcugcuaauau

SEQ ID NO: 3817196 - RNA, 15 nt, Shigella flexneri 2a str. 2457T
ccacuucaucaagca

SEQ ID NO: 3817197 - RNA, 14 nt, Shigella flexneri 2a str. 2457T
ccacuuccaccagc

SEQ ID NO: 3817198 - RNA, 16 nt, Shigella flexneri 2a str. 2457T
ccacuuccaccagcgg

SEQ ID NO: 3817199 - RNA, 14 nt, Shigella flexneri 2a str. 2457T
ccacuuccccucau

SEQ ID NO: 3817200 - RNA, 15 nt, Shigella flexneri 2a str. 2457T
ccacuuccgcgucaa

SEQ ID NO: 3817201 - RNA, 16 nt, Shigella flexneri 2a str. 2457T
ccacuuccugcucggu

SEQ ID NO: 3817202 - RNA, 20 nt, Shigella flexneri 2a str. 2457T
caccacgccugccgccagca

SEQ ID NO: 3817203 - RNA, 18 nt, Shigella flexneri 2a str. 2457T
caccacgcugcaugggga

SEQ ID NO: 3817204 - RNA, 18 nt, Shigella flexneri 2a str. 2457T
caccacgguaagcggcgu

SEQ ID NO: 3817205 - RNA, 15 nt, Shigella flexneri 2a str. 2457T
caccacuccucaaca

SEQ ID NO: 3817206 - RNA, 13 nt, Shigella flexneri 2a str. 2457T
caccacugcaaug

SEQ ID NO: 3817207 - RNA, 14 nt, Shigella flexneri 2a str. 2457T
caccacugccagau

SEQ ID NO: 3817208 - RNA, 22 nt, Shigella flexneri 2a str. 2457T
caccacuggcgauauugccgcg

SEQ ID NO: 3817209 - RNA, 15 nt, Shigella flexneri 2a str. 2457T
caccacuucacccgc

SEQ ID NO: 3817210 - RNA, 22 nt, Shigella flexneri 2a str. 2457T
caccacuugcagcucauauucc

SEQ ID NO: 3817211 - RNA, 22 nt, Shigella flexneri 2a str. 2457T
caccacuuuacgggcaaucucc

SEQ ID NO: 3817212 - RNA, 19 nt, Shigella flexneri 2a str. 2457T
caccacuuuuuucaccgag

SEQ ID NO: 3817213 - RNA, 22 nt, Shigella flexneri 2a str. 2457T
caccagaaaguuuuucaacacc

SEQ ID NO: 3817214 - RNA, 22 nt, Shigella flexneri 2a str. 2457T
caccagaauaccuugcugcucc

SEQ ID NO: 3817215 - RNA, 15 nt, Shigella flexneri 2a str. 2457T
caccagaaucaaucc

SEQ ID NO: 3817216 - RNA, 15 nt, Shigella flexneri 2a str. 2457T
caccagaaucgccag

SEQ ID NO: 3817217 - RNA, 19 nt, Shigella flexneri 2a str. 2457T
caccagaaucgccagcauc

SEQ ID NO: 3817218 - RNA, 14 nt, Shigella flexneri 2a str. 2457T
caccagaccugaaa

SEQ ID NO: 3817219 - RNA, 20 nt, Shigella flexneri 2a str. 2457T
caccagacgagcacgccgcc

SEQ ID NO: 3817220 - RNA, 14 nt, Shigella flexneri 2a str. 2457T
caccagagaacuga

SEQ ID NO: 3817221 - RNA, 15 nt, Shigella flexneri 2a str. 2457T
caccagagugaccgc

SEQ ID NO: 3817222 - RNA, 16 nt, Shigella flexneri 2a str. 2457T
caccagauaaugagaa

SEQ ID NO: 3817223 - RNA, 14 nt, Shigella flexneri 2a str. 2457T
caccagauggcuuu

SEQ ID NO: 3817224 - RNA, 19 nt, Shigella flexneri 2a str. 2457T
caccagaugucccaucuga

SEQ ID NO: 3817225 - RNA, 19 nt, Shigella flexneri 2a str. 2457T
caccagauuauaagccagu

SEQ ID NO: 3817226 - RNA, 13 nt, Shigella flexneri 2a str. 2457T
caccagcaaauau

SEQ ID NO: 3817227 - RNA, 17 nt, Shigella flexneri 2a str. 2457T
caccagcaacaagccag

SEQ ID NO: 3817228 - RNA, 20 nt, Shigella flexneri 2a str. 2457T
caccagcaacaagccagucc

SEQ ID NO: 3817229 - RNA, 20 nt, Shigella flexneri 2a str. 2457T
caccagcaauaacaacacgc

SEQ ID NO: 3817230 - RNA, 18 nt, Shigella flexneri 2a str. 2457T
caccagcaauaaugccag

SEQ ID NO: 3817231 - RNA, 22 nt, Shigella flexneri 2a str. 2457T
caccagcacaucaucaaagcca

SEQ ID NO: 3817232 - RNA, 13 nt, Shigella flexneri 2a str. 2457T
caccagcaccgcg

SEQ ID NO: 3817233 - RNA, 15 nt, Shigella flexneri 2a str. 2457T
caccagcaucaacaa

SEQ ID NO: 3817234 - RNA, 17 nt, Shigella flexneri 2a str. 2457T
caccagcaucaacaaca

SEQ ID NO: 3817235 - RNA, 19 nt, Shigella flexneri 2a str. 2457T
caccagcaucaacaacaau

SEQ ID NO: 3817236 - RNA, 11 nt, Shigella flexneri 2a str. 2457T
caccagcaucg

SEQ ID NO: 3817237 - RNA, 12 nt, Shigella flexneri 2a str. 2457T
caccagccagaa

SEQ ID NO: 3817238 - RNA, 20 nt, Shigella flexneri 2a str. 2457T
caccagccagaauuaccccg

SEQ ID NO: 3817239 - RNA, 23 nt, Shigella flexneri 2a str. 2457T
caccagcccacaugccugcauaa

SEQ ID NO: 3817240 - RNA, 19 nt, Shigella flexneri 2a str. 2457T
caccagccccagaauucac

SEQ ID NO: 3817241 - RNA, 16 nt, Shigella flexneri 2a str. 2457T
caccagccgaucauug

SEQ ID NO: 3817242 - RNA, 15 nt, Shigella flexneri 2a str. 2457T
caccagccgcgacau

SEQ ID NO: 3817243 - RNA, 13 nt, Shigella flexneri 2a str. 2457T
caccagccugcaa

SEQ ID NO: 3817244 - RNA, 22 nt, Shigella flexneri 2a str. 2457T
caccagcgaaaucaccgccacc

SEQ ID NO: 3817245 - RNA, 19 nt, Shigella flexneri 2a str. 2457T
caccagcgauguaacccac

SEQ ID NO: 3817246 - RNA, 13 nt, Shigella flexneri 2a str. 2457T
caccagcggaaug

SEQ ID NO: 3817247 - RNA, 22 nt, Shigella flexneri 2a str. 2457T
caccagcggaaugcagucacgc

SEQ ID NO: 3817248 - RNA, 16 nt, Shigella flexneri 2a str. 2457T
caccagcggcacgcca

SEQ ID NO: 3817249 - RNA, 17 nt, Shigella flexneri 2a str. 2457T
caccagcgucagaaaca

SEQ ID NO: 3817250 - RNA, 18 nt, Shigella flexneri 2a str. 2457T
caccagcucagugaccga

SEQ ID NO: 3817251 - RNA, 20 nt, Shigella flexneri 2a str. 2457T
caccaggcaguuuauccagc

SEQ ID NO: 3817252 - RNA, 23 nt, Shigella flexneri 2a str. 2457T
caccaggcguucauaucuacacg

SEQ ID NO: 3817253 - RNA, 12 nt, Shigella flexneri 2a str. 2457T
caccaguaaauu

SEQ ID NO: 3817254 - RNA, 17 nt, Shigella flexneri 2a str. 2457T
caccagugcggauacca

SEQ ID NO: 3817255 - RNA, 19 nt, Shigella flexneri 2a str. 2457T
caccaguuacaucggugcc

SEQ ID NO: 3817256 - RNA, 20 nt, Shigella flexneri 2a str. 2457T
caccaguucacccucauuca

SEQ ID NO: 3817257 - RNA, 13 nt, Shigella flexneri 2a str. 2457T
caccaguucacgc

SEQ ID NO: 3817258 - RNA, 15 nt, Shigella flexneri 2a str. 2457T
caccaguucgcgcag

SEQ ID NO: 3817259 - RNA, 23 nt, Shigella flexneri 2a str. 2457T
caccaguugguagguccagccgc

SEQ ID NO: 3817260 - RNA, 21 nt, Shigella flexneri 2a str. 2457T
caccauauucagcagcagaca

SEQ ID NO: 3817261 - RNA, 20 nt, Shigella flexneri 2a str. 2457T
caccaucaaaguuuuuauga

SEQ ID NO: 3817262 - RNA, 19 nt, Shigella flexneri 2a str. 2457T
caccaucaacaaacgccag

SEQ ID NO: 3817263 - RNA, 14 nt, Shigella flexneri 2a str. 2457T
caccaucagcagca

SEQ ID NO: 3817264 - RNA, 19 nt, Shigella flexneri 2a str. 2457T
caccauccccaccaaaaca

SEQ ID NO: 3817265 - RNA, 18 nt, Shigella flexneri 2a str. 2457T
caccaucggacggaagac

SEQ ID NO: 3817266 - RNA, 21 nt, Shigella flexneri 2a str. 2457T
caccaucguugcuaacggcca

SEQ ID NO: 3817267 - RNA, 17 nt, Shigella flexneri 2a str. 2457T
caccaucucuuacuuga

SEQ ID NO: 3817268 - RNA, 15 nt, Shigella flexneri 2a str. 2457T
caccaugccgauggc

SEQ ID NO: 3817269 - RNA, 16 nt, Shigella flexneri 2a str. 2457T
caccauguucacugcc

SEQ ID NO: 3817270 - RNA, 17 nt, Shigella flexneri 2a str. 2457T
caccauguucacugccg

SEQ ID NO: 3817271 - RNA, 17 nt, Shigella flexneri 2a str. 2457T
caccauuacgcaaugcg

SEQ ID NO: 3817272 - RNA, 17 nt, Shigella flexneri 2a str. 2457T
caccauucugcgcugac

SEQ ID NO: 3817273 - RNA, 14 nt, Shigella flexneri 2a str. 2457T
caccauugcugccg

SEQ ID NO: 3817274 - RNA, 16 nt, Shigella flexneri 2a str. 2457T
caccauuggcauuggu

SEQ ID NO: 3817275 - RNA, 14 nt, Shigella flexneri 2a str. 2457T
cacccaauccagua

SEQ ID NO: 3817276 - RNA, 15 nt, Shigella flexneri 2a str. 2457T
cacccaccagcgccg

SEQ ID NO: 3817277 - RNA, 16 nt, Shigella flexneri 2a str. 2457T
cacccaccagcgccga

SEQ ID NO: 3817278 - RNA, 19 nt, Shigella flexneri 2a str. 2457T
cacccacguuaguguggcc

SEQ ID NO: 3817279 - RNA, 16 nt, Shigella flexneri 2a str. 2457T
cacccacuaaucgucc

SEQ ID NO: 3817280 - RNA, 17 nt, Shigella flexneri 2a str. 2457T
cacccagaacgccgaau

SEQ ID NO: 3817281 - RNA, 20 nt, Shigella flexneri 2a str. 2457T
cacccagcagcgccgcgccu

SEQ ID NO: 3817282 - RNA, 11 nt, Shigella flexneri 2a str. 2457T
cacccagcccc

SEQ ID NO: 3817283 - RNA, 15 nt, Shigella flexneri 2a str. 2457T
cacccagcgaagcaa

SEQ ID NO: 3817284 - RNA, 21 nt, Shigella flexneri 2a str. 2457T
cacccaguacgggcagcgcau

SEQ ID NO: 3817285 - RNA, 21 nt, Shigella flexneri 2a str. 2457T
cacccagucccguacccagca

SEQ ID NO: 3817286 - RNA, 18 nt, Shigella flexneri 2a str. 2457T
cacccauagauaccuucu

SEQ ID NO: 3817287 - RNA, 20 nt, Shigella flexneri 2a str. 2457T
cacccauguuuaauucacgc

SEQ ID NO: 3817288 - RNA, 16 nt, Shigella flexneri 2a str. 2457T
cacccauugccgccuc

SEQ ID NO: 3817289 - RNA, 19 nt, Shigella flexneri 2a str. 2457T
cacccauuuauccagcggc

SEQ ID NO: 3817290 - RNA, 22 nt, Shigella flexneri 2a str. 2457T
cacccauuuauccagcggcagc

SEQ ID NO: 3817291 - RNA, 16 nt, Shigella flexneri 2a str. 2457T
caccccaccuuaccug

SEQ ID NO: 3817292 - RNA, 11 nt, Shigella flexneri 2a str. 2457T
caccccagcag

SEQ ID NO: 3817293 - RNA, 11 nt, Shigella flexneri 2a str. 2457T
cacccccaccc

SEQ ID NO: 3817294 - RNA, 19 nt, Shigella flexneri 2a str. 2457T
caccccgaaaugcccgcuu

SEQ ID NO: 3817295 - RNA, 21 nt, Shigella flexneri 2a str. 2457T
cacccgcaagacgaaccggca

SEQ ID NO: 3817296 - RNA, 16 nt, Shigella flexneri 2a str. 2457T
cacccgcagcaagcgu

SEQ ID NO: 3817297 - RNA, 22 nt, Shigella flexneri 2a str. 2457T
cacccgcagcaagcguuugagc

SEQ ID NO: 3817298 - RNA, 22 nt, Shigella flexneri 2a str. 2457T
cacccgccgcuauuauaucgcu

SEQ ID NO: 3817299 - RNA, 22 nt, Shigella flexneri 2a str. 2457T
cacccgccguuagccagcgcac

SEQ ID NO: 3817300 - RNA, 16 nt, Shigella flexneri 2a str. 2457T
cacccgcuucagugac

SEQ ID NO: 3817301 - RNA, 14 nt, Shigella flexneri 2a str. 2457T
cacccgcuucauaa

SEQ ID NO: 3817302 - RNA, 19 nt, Shigella flexneri 2a str. 2457T
cacccggaggaaagcaccu

SEQ ID NO: 3817303 - RNA, 18 nt, Shigella flexneri 2a str. 2457T
cacccggaucucagcuca

SEQ ID NO: 3817304 - RNA, 17 nt, Shigella flexneri 2a str. 2457T
cacccggggugauaacg

SEQ ID NO: 3817305 - RNA, 19 nt, Shigella flexneri 2a str. 2457T
cacccgguaucaaacccuu

SEQ ID NO: 3817306 - RNA, 21 nt, Shigella flexneri 2a str. 2457T
cacccgguaucaaacccuucc

SEQ ID NO: 3817307 - RNA, 20 nt, Shigella flexneri 2a str. 2457T
cacccguaacauggcgguaa

SEQ ID NO: 3817308 - RNA, 22 nt, Shigella flexneri 2a str. 2457T
cacccguacagggugagggcaa

SEQ ID NO: 3817309 - RNA, 15 nt, Shigella flexneri 2a str. 2457T
cacccgucguugcaa

SEQ ID NO: 3817310 - RNA, 21 nt, Shigella flexneri 2a str. 2457T
cacccgucguugcaaucagcg

SEQ ID NO: 3817311 - RNA, 19 nt, Shigella flexneri 2a str. 2457T
cacccguuuucuccaugcg

SEQ ID NO: 3817312 - RNA, 20 nt, Shigella flexneri 2a str. 2457T
cacccuaacccucuccccga

SEQ ID NO: 3817313 - RNA, 22 nt, Shigella flexneri 2a str. 2457T
cacccuauuuuuacccaggccu

SEQ ID NO: 3817314 - RNA, 20 nt, Shigella flexneri 2a str. 2457T
cacccucaaaauuucuccuu

SEQ ID NO: 3817315 - RNA, 17 nt, Shigella flexneri 2a str. 2457T
cacccugugcgccaccg

SEQ ID NO: 3817316 - RNA, 18 nt, Shigella flexneri 2a str. 2457T
cacccugugcgccaccgc

SEQ ID NO: 3817317 - RNA, 15 nt, Shigella flexneri 2a str. 2457T
cacccuugaugcaga

SEQ ID NO: 3817318 - RNA, 18 nt, Shigella flexneri 2a str. 2457T
caccgaagcuuucuugca

SEQ ID NO: 3817319 - RNA, 17 nt, Shigella flexneri 2a str. 2457T
caccgacauugccagcu

SEQ ID NO: 3817320 - RNA, 14 nt, Shigella flexneri 2a str. 2457T
caccgacgcaguca

SEQ ID NO: 3817321 - RNA, 18 nt, Shigella flexneri 2a str. 2457T
caccgacgcagucaugcg

SEQ ID NO: 3817322 - RNA, 21 nt, Shigella flexneri 2a str. 2457T
caccgacgucgauauaauuga

SEQ ID NO: 3817323 - RNA, 19 nt, Shigella flexneri 2a str. 2457T
caccgacuggcuccgggaa

SEQ ID NO: 3817324 - RNA, 23 nt, Shigella flexneri 2a str. 2457T
caccgagauaaugguuuccagca

SEQ ID NO: 3817325 - RNA, 17 nt, Shigella flexneri 2a str. 2457T
caccgaggcauucagcc

SEQ ID NO: 3817326 - RNA, 20 nt, Shigella flexneri 2a str. 2457T
caccgaggcauucagccagu

SEQ ID NO: 3817327 - RNA, 22 nt, Shigella flexneri 2a str. 2457T
caccgagucgucugucgggaac

SEQ ID NO: 3817328 - RNA, 20 nt, Shigella flexneri 2a str. 2457T
caccgauacaaucauucccu

SEQ ID NO: 3817329 - RNA, 17 nt, Shigella flexneri 2a str. 2457T
caccgaugaucaacagc

SEQ ID NO: 3817330 - RNA, 23 nt, Shigella flexneri 2a str. 2457T
caccgauucccgggcacacuuag

SEQ ID NO: 3817331 - RNA, 15 nt, Shigella flexneri 2a str. 2457T
caccgauugcaggaa

SEQ ID NO: 3817332 - RNA, 23 nt, Shigella flexneri 2a str. 2457T
caccgcaaaauagguaucguaau

SEQ ID NO: 3817333 - RNA, 14 nt, Shigella flexneri 2a str. 2457T
caccgcaaacugcc

SEQ ID NO: 3817334 - RNA, 20 nt, Shigella flexneri 2a str. 2457T
caccgcaagccaaauacauu

SEQ ID NO: 3817335 - RNA, 17 nt, Shigella flexneri 2a str. 2457T
caccgcaauaaccauca

SEQ ID NO: 3817336 - RNA, 17 nt, Shigella flexneri 2a str. 2457T
caccgcacagaccauca

SEQ ID NO: 3817337 - RNA, 12 nt, Shigella flexneri 2a str. 2457T
caccgcagaagc

SEQ ID NO: 3817338 - RNA, 17 nt, Shigella flexneri 2a str. 2457T
caccgcagaucagacca

SEQ ID NO: 3817339 - RNA, 15 nt, Shigella flexneri 2a str. 2457T
caccgcagccgccac

SEQ ID NO: 3817340 - RNA, 19 nt, Shigella flexneri 2a str. 2457T
caccgcagccgccacaaua

SEQ ID NO: 3817341 - RNA, 18 nt, Shigella flexneri 2a str. 2457T
caccgcaucaauauuaag

SEQ ID NO: 3817342 - RNA, 17 nt, Shigella flexneri 2a str. 2457T
caccgccaaagauaaaa

SEQ ID NO: 3817343 - RNA, 13 nt, Shigella flexneri 2a str. 2457T
caccgccaccacc

SEQ ID NO: 3817344 - RNA, 14 nt, Shigella flexneri 2a str. 2457T
caccgccaccaccg

SEQ ID NO: 3817345 - RNA, 17 nt, Shigella flexneri 2a str. 2457T
caccgccacgcccuccu

SEQ ID NO: 3817346 - RNA, 17 nt, Shigella flexneri 2a str. 2457T
caccgccagcaucggcg

SEQ ID NO: 3817347 - RNA, 14 nt, Shigella flexneri 2a str. 2457T
caccgcccagagaa

SEQ ID NO: 3817348 - RNA, 16 nt, Shigella flexneri 2a str. 2457T
caccgcccagugcagu

SEQ ID NO: 3817349 - RNA, 15 nt, Shigella flexneri 2a str. 2457T
caccgccgacuguca

SEQ ID NO: 3817350 - RNA, 14 nt, Shigella flexneri 2a str. 2457T
caccgccgccgcca

SEQ ID NO: 3817351 - RNA, 15 nt, Shigella flexneri 2a str. 2457T
caccgccggauagcu

SEQ ID NO: 3817352 - RNA, 15 nt, Shigella flexneri 2a str. 2457T
caccgccugcgaugg

SEQ ID NO: 3817353 - RNA, 18 nt, Shigella flexneri 2a str. 2457T
caccgcgaggccuaacac

SEQ ID NO: 3817354 - RNA, 15 nt, Shigella flexneri 2a str. 2457T
caccgcgaucuucca

SEQ ID NO: 3817355 - RNA, 16 nt, Shigella flexneri 2a str. 2457T
caccgcgaucuuccac

SEQ ID NO: 3817356 - RNA, 20 nt, Shigella flexneri 2a str. 2457T
caccgcgaucuuccacgccu

SEQ ID NO: 3817357 - RNA, 22 nt, Shigella flexneri 2a str. 2457T
caccgcgaucuuccacgccugc

SEQ ID NO: 3817358 - RNA, 16 nt, Shigella flexneri 2a str. 2457T
caccgcgccgggcaga

SEQ ID NO: 3817359 - RNA, 16 nt, Shigella flexneri 2a str. 2457T
caccgcggaacgcacu

SEQ ID NO: 3817360 - RNA, 14 nt, Shigella flexneri 2a str. 2457T
caccgcguuuucca

SEQ ID NO: 3817361 - RNA, 13 nt, Shigella flexneri 2a str. 2457T
caccgcuccaucg

SEQ ID NO: 3817362 - RNA, 20 nt, Shigella flexneri 2a str. 2457T
caccgcucuucauacgcggc

SEQ ID NO: 3817363 - RNA, 21 nt, Shigella flexneri 2a str. 2457T
caccgcuggcugcgaacgcaa

SEQ ID NO: 3817364 - RNA, 18 nt, Shigella flexneri 2a str. 2457T
caccgcuucaacagcggc

SEQ ID NO: 3817365 - RNA, 13 nt, Shigella flexneri 2a str. 2457T
caccggacgcaca

SEQ ID NO: 3817366 - RNA, 18 nt, Shigella flexneri 2a str. 2457T
caccggacuauccgccgc

SEQ ID NO: 3817367 - RNA, 20 nt, Shigella flexneri 2a str. 2457T
caccggacuauccgccgcuu

SEQ ID NO: 3817368 - RNA, 23 nt, Shigella flexneri 2a str. 2457T
caccggaugcguucgcaccaccg

SEQ ID NO: 3817369 - RNA, 19 nt, Shigella flexneri 2a str. 2457T
caccggauguagcaacgga

SEQ ID NO: 3817370 - RNA, 16 nt, Shigella flexneri 2a str. 2457T
caccggcaaucugcug

SEQ ID NO: 3817371 - RNA, 14 nt, Shigella flexneri 2a str. 2457T
caccggcaccacuu

SEQ ID NO: 3817372 - RNA, 16 nt, Shigella flexneri 2a str. 2457T
caccggcgacauccca

SEQ ID NO: 3817373 - RNA, 21 nt, Shigella flexneri 2a str. 2457T
caccggcuuucgcuucaacca

SEQ ID NO: 3817374 - RNA, 20 nt, Shigella flexneri 2a str. 2457T
caccgguacggaugcgaaug

SEQ ID NO: 3817375 - RNA, 16 nt, Shigella flexneri 2a str. 2457T
caccgucacuucuucg

SEQ ID NO: 3817376 - RNA, 15 nt, Shigella flexneri 2a str. 2457T
caccgucgccuucau

SEQ ID NO: 3817377 - RNA, 17 nt, Shigella flexneri 2a str. 2457T
caccgugauucacguuc

SEQ ID NO: 3817378 - RNA, 20 nt, Shigella flexneri 2a str. 2457T
caccgugcauuucucacuuu

SEQ ID NO: 3817379 - RNA, 16 nt, Shigella flexneri 2a str. 2457T
caccguguucaugacc

SEQ ID NO: 3817380 - RNA, 15 nt, Shigella flexneri 2a str. 2457T
caccguuaaauaacu

SEQ ID NO: 3817381 - RNA, 14 nt, Shigella flexneri 2a str. 2457T
caccguuauccuga

SEQ ID NO: 3817382 - RNA, 17 nt, Shigella flexneri 2a str. 2457T
caccguuucuacaagca

SEQ ID NO: 3817383 - RNA, 23 nt, Shigella flexneri 2a str. 2457T
caccguuuuuucugccucugcca

SEQ ID NO: 3817384 - RNA, 12 nt, Shigella flexneri 2a str. 2457T
caccuacagcca

SEQ ID NO: 3817385 - RNA, 13 nt, Shigella flexneri 2a str. 2457T
caccucagcaagu

SEQ ID NO: 3817386 - RNA, 18 nt, Shigella flexneri 2a str. 2457T
caccuccacgcccagcgc

SEQ ID NO: 3817387 - RNA, 15 nt, Shigella flexneri 2a str. 2457T
caccucccagcgcgg

SEQ ID NO: 3817388 - RNA, 15 nt, Shigella flexneri 2a str. 2457T
caccucuuucaccaa

SEQ ID NO: 3817389 - RNA, 19 nt, Shigella flexneri 2a str. 2457T
caccugaaauggucgcccc

SEQ ID NO: 3817390 - RNA, 20 nt, Shigella flexneri 2a str. 2457T
caccugaaauggucgccccg

SEQ ID NO: 3817391 - RNA, 14 nt, Shigella flexneri 2a str. 2457T
caccugagcuggca

SEQ ID NO: 3817392 - RNA, 18 nt, Shigella flexneri 2a str. 2457T
caccugauacgcgccaau

SEQ ID NO: 3817393 - RNA, 20 nt, Shigella flexneri 2a str. 2457T
caccugauccagcucuucuu

SEQ ID NO: 3817394 - RNA, 23 nt, Shigella flexneri 2a str. 2457T
caccugauccagcucuucuucac

SEQ ID NO: 3817395 - RNA, 22 nt, Shigella flexneri 2a str. 2457T
caccugcaacgguugauggcag

SEQ ID NO: 3817396 - RNA, 19 nt, Shigella flexneri 2a str. 2457T
caccugcauucgagccaag

SEQ ID NO: 3817397 - RNA, 14 nt, Shigella flexneri 2a str. 2457T
caccugccagcgcc

SEQ ID NO: 3817398 - RNA, 15 nt, Shigella flexneri 2a str. 2457T
caccugccagcgccg

SEQ ID NO: 3817399 - RNA, 22 nt, Shigella flexneri 2a str. 2457T
caccugccagcgccgacagcag

SEQ ID NO: 3817400 - RNA, 13 nt, Shigella flexneri 2a str. 2457T
caccugccaggga

SEQ ID NO: 3817401 - RNA, 19 nt, Shigella flexneri 2a str. 2457T
caccugccagggugcuggc

SEQ ID NO: 3817402 - RNA, 20 nt, Shigella flexneri 2a str. 2457T
caccugcggugcagccggag

SEQ ID NO: 3817403 - RNA, 22 nt, Shigella flexneri 2a str. 2457T
caccugcugauuaucggcauca

SEQ ID NO: 3817404 - RNA, 21 nt, Shigella flexneri 2a str. 2457T
caccugggcaauggugaacug

SEQ ID NO: 3817405 - RNA, 14 nt, Shigella flexneri 2a str. 2457T
caccuguuccauga

SEQ ID NO: 3817406 - RNA, 17 nt, Shigella flexneri 2a str. 2457T
caccuguuccaugacgu

SEQ ID NO: 3817407 - RNA, 23 nt, Shigella flexneri 2a str. 2457T
caccuguugccauuucugcugcc

SEQ ID NO: 3817408 - RNA, 18 nt, Shigella flexneri 2a str. 2457T
caccuuacggcacuccuc

SEQ ID NO: 3817409 - RNA, 20 nt, Shigella flexneri 2a str. 2457T
caccuuacggcacuccucuu

SEQ ID NO: 3817410 - RNA, 23 nt, Shigella flexneri 2a str. 2457T
caccuucaacguuaggugggaac

SEQ ID NO: 3817411 - RNA, 20 nt, Shigella flexneri 2a str. 2457T
caccuucaaguaauucauuc

SEQ ID NO: 3817412 - RNA, 22 nt, Shigella flexneri 2a str. 2457T
caccuucagcgaagcccacgcc

SEQ ID NO: 3817413 - RNA, 15 nt, Shigella flexneri 2a str. 2457T
caccuucauccagca

SEQ ID NO: 3817414 - RNA, 18 nt, Shigella flexneri 2a str. 2457T
caccuucauccagcauca

SEQ ID NO: 3817415 - RNA, 16 nt, Shigella flexneri 2a str. 2457T
caccuucuguaacugg

SEQ ID NO: 3817416 - RNA, 17 nt, Shigella flexneri 2a str. 2457T
caccuucuuuacugccc

SEQ ID NO: 3817417 - RNA, 20 nt, Shigella flexneri 2a str. 2457T
caccuucuuuacugcccgcu

SEQ ID NO: 3817418 - RNA, 13 nt, Shigella flexneri 2a str. 2457T
caccuuuuuucug

SEQ ID NO: 3817419 - RNA, 16 nt, Shigella flexneri 2a str. 2457T
caccuuuuuuuaugcu

SEQ ID NO: 3817420 - RNA, 17 nt, Shigella flexneri 2a str. 2457T
caccuuuuuuuaugcuu

SEQ ID NO: 3817421 - RNA, 22 nt, Shigella flexneri 2a str. 2457T
caccuuuuuuuaugcuuccuuc

SEQ ID NO: 3817422 - RNA, 18 nt, Shigella flexneri 2a str. 2457T
cacgaaaccacugcaaca

SEQ ID NO: 3817423 - RNA, 14 nt, Shigella flexneri 2a str. 2457T
cacgaaacugcugg

SEQ ID NO: 3817424 - RNA, 19 nt, Shigella flexneri 2a str. 2457T
cacgaaccguaaaagccug

SEQ ID NO: 3817425 - RNA, 14 nt, Shigella flexneri 2a str. 2457T
cacgaagcaauggc

SEQ ID NO: 3817426 - RNA, 18 nt, Shigella flexneri 2a str. 2457T
cacgaaucgucaguucac

SEQ ID NO: 3817427 - RNA, 16 nt, Shigella flexneri 2a str. 2457T
cacgaauuccaagcag

SEQ ID NO: 3817428 - RNA, 18 nt, Shigella flexneri 2a str. 2457T
cacgacaaaugcgccgcc

SEQ ID NO: 3817429 - RNA, 12 nt, Shigella flexneri 2a str. 2457T
cacgacacugcu

SEQ ID NO: 3817430 - RNA, 13 nt, Shigella flexneri 2a str. 2457T
cacgaccgcagca

SEQ ID NO: 3817431 - RNA, 16 nt, Shigella flexneri 2a str. 2457T
cacgaccgcagcauug

SEQ ID NO: 3817432 - RNA, 17 nt, Shigella flexneri 2a str. 2457T
cacgaccggguuuucaa

SEQ ID NO: 3817433 - RNA, 16 nt, Shigella flexneri 2a str. 2457T
cacgaccuacgcgccc

SEQ ID NO: 3817434 - RNA, 20 nt, Shigella flexneri 2a str. 2457T
cacgaccuguaccuucagcg

SEQ ID NO: 3817435 - RNA, 21 nt, Shigella flexneri 2a str. 2457T
cacgaccuguaccuucagcgg

SEQ ID NO: 3817436 - RNA, 21 nt, Shigella flexneri 2a str. 2457T
cacgacgucuccaucaauaca

SEQ ID NO: 3817437 - RNA, 15 nt, Shigella flexneri 2a str. 2457T
cacgaggaagauuac

SEQ ID NO: 3817438 - RNA, 21 nt, Shigella flexneri 2a str. 2457T
cacgaggaagauuacgcugca

SEQ ID NO: 3817439 - RNA, 18 nt, Shigella flexneri 2a str. 2457T
cacgaguagguagaauau

SEQ ID NO: 3817440 - RNA, 16 nt, Shigella flexneri 2a str. 2457T
cacgaucccuugcagu

SEQ ID NO: 3817441 - RNA, 19 nt, Shigella flexneri 2a str. 2457T
cacgaucgaugugauaaau

SEQ ID NO: 3817442 - RNA, 19 nt, Shigella flexneri 2a str. 2457T
cacgaucgcuucggucugc

SEQ ID NO: 3817443 - RNA, 18 nt, Shigella flexneri 2a str. 2457T
cacgaugacugaacaggc

SEQ ID NO: 3817444 - RNA, 14 nt, Shigella flexneri 2a str. 2457T
cacgaugccugaug

SEQ ID NO: 3817445 - RNA, 12 nt, Shigella flexneri 2a str. 2457T
cacgaugcuaaa

SEQ ID NO: 3817446 - RNA, 21 nt, Shigella flexneri 2a str. 2457T
cacgauggaaccguacagcau

SEQ ID NO: 3817447 - RNA, 13 nt, Shigella flexneri 2a str. 2457T
cacgauuuuguag

SEQ ID NO: 3817448 - RNA, 17 nt, Shigella flexneri 2a str. 2457T
cacgcaaacuucgguua

SEQ ID NO: 3817449 - RNA, 22 nt, Shigella flexneri 2a str. 2457T
cacgcaaauguggcggaauacc

SEQ ID NO: 3817450 - RNA, 16 nt, Shigella flexneri 2a str. 2457T
cacgcaaccacaacgc

SEQ ID NO: 3817451 - RNA, 18 nt, Shigella flexneri 2a str. 2457T
cacgcaauaccuggcgca

SEQ ID NO: 3817452 - RNA, 20 nt, Shigella flexneri 2a str. 2457T
cacgcaauaccuggcgcagc

SEQ ID NO: 3817453 - RNA, 20 nt, Shigella flexneri 2a str. 2457T
cacgcaauuuauacugcgau

SEQ ID NO: 3817454 - RNA, 15 nt, Shigella flexneri 2a str. 2457T
cacgcagacacugcu

SEQ ID NO: 3817455 - RNA, 18 nt, Shigella flexneri 2a str. 2457T
cacgcagcguuggcaggu

SEQ ID NO: 3817456 - RNA, 12 nt, Shigella flexneri 2a str. 2457T
cacgcagcucac

SEQ ID NO: 3817457 - RNA, 24 nt, Shigella flexneri 2a str. 2457T
cacgcagcuucucgugaaacucac

SEQ ID NO: 3817458 - RNA, 22 nt, Shigella flexneri 2a str. 2457T
cacgcauaucguagccccaguc

SEQ ID NO: 3817459 - RNA, 14 nt, Shigella flexneri 2a str. 2457T
cacgcauuaauaag

SEQ ID NO: 3817460 - RNA, 18 nt, Shigella flexneri 2a str. 2457T
cacgccagcagcgcaauc

SEQ ID NO: 3817461 - RNA, 22 nt, Shigella flexneri 2a str. 2457T
cacgccauauguguuugugcug

SEQ ID NO: 3817462 - RNA, 12 nt, Shigella flexneri 2a str. 2457T
cacgccaucauc

SEQ ID NO: 3817463 - RNA, 19 nt, Shigella flexneri 2a str. 2457T
cacgccgacaaagaugcag

SEQ ID NO: 3817464 - RNA, 22 nt, Shigella flexneri 2a str. 2457T
cacgccgauaaucaacaaacca

SEQ ID NO: 3817465 - RNA, 19 nt, Shigella flexneri 2a str. 2457T
cacgccgaucgaagagacg

SEQ ID NO: 3817466 - RNA, 12 nt, Shigella flexneri 2a str. 2457T
cacgccgcaucc

SEQ ID NO: 3817467 - RNA, 21 nt, Shigella flexneri 2a str. 2457T
cacgccgcauccggcaaaaaa

SEQ ID NO: 3817468 - RNA, 17 nt, Shigella flexneri 2a str. 2457T
cacgccgcauccggcau

SEQ ID NO: 3817469 - RNA, 16 nt, Shigella flexneri 2a str. 2457T
cacgccgcaucuggca

SEQ ID NO: 3817470 - RNA, 20 nt, Shigella flexneri 2a str. 2457T
cacgccgcugucuaccagca

SEQ ID NO: 3817471 - RNA, 18 nt, Shigella flexneri 2a str. 2457T
cacgccgguucccagacc

SEQ ID NO: 3817472 - RNA, 23 nt, Shigella flexneri 2a str. 2457T
cacgccguuuuuacccagcagca

SEQ ID NO: 3817473 - RNA, 13 nt, Shigella flexneri 2a str. 2457T
cacgccugccgcc

SEQ ID NO: 3817474 - RNA, 16 nt, Shigella flexneri 2a str. 2457T
cacgccugccgccagc

SEQ ID NO: 3817475 - RNA, 12 nt, Shigella flexneri 2a str. 2457T
cacgccuucuuc

SEQ ID NO: 3817476 - RNA, 22 nt, Shigella flexneri 2a str. 2457T
cacgccuuuaaaucccgcuuca

SEQ ID NO: 3817477 - RNA, 23 nt, Shigella flexneri 2a str. 2457T
cacgcgaacaacagaucaacaua

SEQ ID NO: 3817478 - RNA, 23 nt, Shigella flexneri 2a str. 2457T
cacgcgaguggucuccuggaacg

SEQ ID NO: 3817479 - RNA, 17 nt, Shigella flexneri 2a str. 2457T
cacgcgauacuuuuuca

SEQ ID NO: 3817480 - RNA, 14 nt, Shigella flexneri 2a str. 2457T
cacgcgcauauuga

SEQ ID NO: 3817481 - RNA, 15 nt, Shigella flexneri 2a str. 2457T
cacgcgccacgcacg

SEQ ID NO: 3817482 - RNA, 13 nt, Shigella flexneri 2a str. 2457T
cacgcgcuucaca

SEQ ID NO: 3817483 - RNA, 21 nt, Shigella flexneri 2a str. 2457T
cacgcggagcgccugucugca

SEQ ID NO: 3817484 - RNA, 19 nt, Shigella flexneri 2a str. 2457T
cacgcggcuguugccggau

SEQ ID NO: 3817485 - RNA, 17 nt, Shigella flexneri 2a str. 2457T
cacgcgguauccauacc

SEQ ID NO: 3817486 - RNA, 23 nt, Shigella flexneri 2a str. 2457T
cacgcggucaauggucagcgcca

SEQ ID NO: 3817487 - RNA, 16 nt, Shigella flexneri 2a str. 2457T
cacgcucccagcagag

SEQ ID NO: 3817488 - RNA, 19 nt, Shigella flexneri 2a str. 2457T
cacgcucgcgguuggcaau

SEQ ID NO: 3817489 - RNA, 13 nt, Shigella flexneri 2a str. 2457T
cacgcucuguucu

SEQ ID NO: 3817490 - RNA, 16 nt, Shigella flexneri 2a str. 2457T
cacgcugauugcauaa

SEQ ID NO: 3817491 - RNA, 15 nt, Shigella flexneri 2a str. 2457T
cacgcugcaucgcca

SEQ ID NO: 3817492 - RNA, 13 nt, Shigella flexneri 2a str. 2457T
cacgcugccccug

SEQ ID NO: 3817493 - RNA, 18 nt, Shigella flexneri 2a str. 2457T
cacgcuguagccgccguc

SEQ ID NO: 3817494 - RNA, 12 nt, Shigella flexneri 2a str. 2457T
cacgcugucggc

SEQ ID NO: 3817495 - RNA, 13 nt, Shigella flexneri 2a str. 2457T
cacgcugucggca

SEQ ID NO: 3817496 - RNA, 21 nt, Shigella flexneri 2a str. 2457T
cacgcugucuggcgucuccug

SEQ ID NO: 3817497 - RNA, 19 nt, Shigella flexneri 2a str. 2457T
cacgcuuaauugaaccuaa

SEQ ID NO: 3817498 - RNA, 18 nt, Shigella flexneri 2a str. 2457T
cacgcuuugcaggcuggu

SEQ ID NO: 3817499 - RNA, 18 nt, Shigella flexneri 2a str. 2457T
cacggaaaggcaacauga

SEQ ID NO: 3817500 - RNA, 18 nt, Shigella flexneri 2a str. 2457T
cacggaaucaccgccacg

SEQ ID NO: 3817501 - RNA, 19 nt, Shigella flexneri 2a str. 2457T
cacggaguugaccagcucc

SEQ ID NO: 3817502 - RNA, 21 nt, Shigella flexneri 2a str. 2457T
cacggauauauccguggcuuu

SEQ ID NO: 3817503 - RNA, 18 nt, Shigella flexneri 2a str. 2457T
cacggcagcaacuuaauc

SEQ ID NO: 3817504 - RNA, 15 nt, Shigella flexneri 2a str. 2457T
cacggccacagccag

SEQ ID NO: 3817505 - RNA, 20 nt, Shigella flexneri 2a str. 2457T
cacggccacagccagccaac

SEQ ID NO: 3817506 - RNA, 13 nt, Shigella flexneri 2a str. 2457T
cacggcgauacca

SEQ ID NO: 3817507 - RNA, 17 nt, Shigella flexneri 2a str. 2457T
cacggcgcagcuucaca

SEQ ID NO: 3817508 - RNA, 16 nt, Shigella flexneri 2a str. 2457T
cacggcgcaugccuca

SEQ ID NO: 3817509 - RNA, 15 nt, Shigella flexneri 2a str. 2457T
cacggcguggcauca

SEQ ID NO: 3817510 - RNA, 18 nt, Shigella flexneri 2a str. 2457T
cacggcuaccguugcggc

SEQ ID NO: 3817511 - RNA, 15 nt, Shigella flexneri 2a str. 2457T
cacggcuccagcaau

SEQ ID NO: 3817512 - RNA, 21 nt, Shigella flexneri 2a str. 2457T
cacgggcaauuuucgccaucu

SEQ ID NO: 3817513 - RNA, 22 nt, Shigella flexneri 2a str. 2457T
cacgggccgagugccuugcuga

SEQ ID NO: 3817514 - RNA, 17 nt, Shigella flexneri 2a str. 2457T
cacgggcgcuuguuauc

SEQ ID NO: 3817515 - RNA, 20 nt, Shigella flexneri 2a str. 2457T
cacggguucgugacgucuca

SEQ ID NO: 3817516 - RNA, 19 nt, Shigella flexneri 2a str. 2457T
cacggugcuccagugcgcu

SEQ ID NO: 3817517 - RNA, 15 nt, Shigella flexneri 2a str. 2457T
cacgguuacgcuacc

SEQ ID NO: 3817518 - RNA, 16 nt, Shigella flexneri 2a str. 2457T
cacgguuuuuccagcu

SEQ ID NO: 3817519 - RNA, 22 nt, Shigella flexneri 2a str. 2457T
cacguaacgacugacuuucggc

SEQ ID NO: 3817520 - RNA, 13 nt, Shigella flexneri 2a str. 2457T
cacguaccagaug

SEQ ID NO: 3817521 - RNA, 22 nt, Shigella flexneri 2a str. 2457T
cacguaccaugcgcaucaucga

SEQ ID NO: 3817522 - RNA, 13 nt, Shigella flexneri 2a str. 2457T
cacguaggccuga

SEQ ID NO: 3817523 - RNA, 13 nt, Shigella flexneri 2a str. 2457T
cacgucauccccc

SEQ ID NO: 3817524 - RNA, 22 nt, Shigella flexneri 2a str. 2457T
cacguccccuggggagugaccu

SEQ ID NO: 3817525 - RNA, 18 nt, Shigella flexneri 2a str. 2457T
cacguccgguggcauccg

SEQ ID NO: 3817526 - RNA, 20 nt, Shigella flexneri 2a str. 2457T
cacgucgucaggcaaccgcu

SEQ ID NO: 3817527 - RNA, 11 nt, Shigella flexneri 2a str. 2457T
cacgucugaag

SEQ ID NO: 3817528 - RNA, 18 nt, Shigella flexneri 2a str. 2457T
cacgucuuaauguaaugc

SEQ ID NO: 3817529 - RNA, 22 nt, Shigella flexneri 2a str. 2457T
cacgucuuccauugccgcuuuc

SEQ ID NO: 3817530 - RNA, 18 nt, Shigella flexneri 2a str. 2457T
cacgucuuugccgcgcuc

SEQ ID NO: 3817531 - RNA, 15 nt, Shigella flexneri 2a str. 2457T
cacgugccagauguu

SEQ ID NO: 3817532 - RNA, 18 nt, Shigella flexneri 2a str. 2457T
cacguuagaaacaaaaaa

SEQ ID NO: 3817533 - RNA, 22 nt, Shigella flexneri 2a str. 2457T
cacguuagaaacaaaaaaaccg

SEQ ID NO: 3817534 - RNA, 21 nt, Shigella flexneri 2a str. 2457T
cacguucaaaacggugaucaa

SEQ ID NO: 3817535 - RNA, 19 nt, Shigella flexneri 2a str. 2457T
cacguuccagaaugcuacg

SEQ ID NO: 3817536 - RNA, 23 nt, Shigella flexneri 2a str. 2457T
cacguuccguauaccgucaggau

SEQ ID NO: 3817537 - RNA, 23 nt, Shigella flexneri 2a str. 2457T
cacguuccuggaaccagugaaua

SEQ ID NO: 3817538 - RNA, 16 nt, Shigella flexneri 2a str. 2457T
cacguugagagguaaa

SEQ ID NO: 3817539 - RNA, 16 nt, Shigella flexneri 2a str. 2457T
cacuaaagccugcuuu

SEQ ID NO: 3817540 - RNA, 19 nt, Shigella flexneri 2a str. 2457T
cacuaacagaacaauaaua

SEQ ID NO: 3817541 - RNA, 11 nt, Shigella flexneri 2a str. 2457T
cacuaacgaca

SEQ ID NO: 3817542 - RNA, 20 nt, Shigella flexneri 2a str. 2457T
cacuaacgcgucuuaucugg

SEQ ID NO: 3817543 - RNA, 18 nt, Shigella flexneri 2a str. 2457T
cacuaaggguaaaacgac

SEQ ID NO: 3817544 - RNA, 12 nt, Shigella flexneri 2a str. 2457T
cacuacacccca

SEQ ID NO: 3817545 - RNA, 20 nt, Shigella flexneri 2a str. 2457T
cacuaccauaaaaaaacaca

SEQ ID NO: 3817546 - RNA, 15 nt, Shigella flexneri 2a str. 2457T
cacuaccuucuuccc

SEQ ID NO: 3817547 - RNA, 20 nt, Shigella flexneri 2a str. 2457T
cacuacgcagggauauuuca

SEQ ID NO: 3817548 - RNA, 16 nt, Shigella flexneri 2a str. 2457T
cacuacggucacgcca

SEQ ID NO: 3817549 - RNA, 14 nt, Shigella flexneri 2a str. 2457T
cacuacgugaucgu

SEQ ID NO: 3817550 - RNA, 15 nt, Shigella flexneri 2a str. 2457T
cacuacucugaccca

SEQ ID NO: 3817551 - RNA, 14 nt, Shigella flexneri 2a str. 2457T
cacuagguuuucgu

SEQ ID NO: 3817552 - RNA, 22 nt, Shigella flexneri 2a str. 2457T
cacuaucccaacaacucuuccu

SEQ ID NO: 3817553 - RNA, 18 nt, Shigella flexneri 2a str. 2457T
cacuauccgacaucccgc

SEQ ID NO: 3817554 - RNA, 18 nt, Shigella flexneri 2a str. 2457T
cacuaucgccaucaggca

SEQ ID NO: 3817555 - RNA, 13 nt, Shigella flexneri 2a str. 2457T
cacuaugacugcc

SEQ ID NO: 3817556 - RNA, 16 nt, Shigella flexneri 2a str. 2457T
cacuauucgccagcac

SEQ ID NO: 3817557 - RNA, 20 nt, Shigella flexneri 2a str. 2457T
cacuauuucaauaugauaaa

SEQ ID NO: 3817558 - RNA, 10 nt, Shigella flexneri 2a str. 2457T
cacuauuucu

SEQ ID NO: 3817559 - RNA, 21 nt, Shigella flexneri 2a str. 2457T
cacucacgauagugacucauu

SEQ ID NO: 3817560 - RNA, 17 nt, Shigella flexneri 2a str. 2457T
cacuccagccagagcca

SEQ ID NO: 3817561 - RNA, 21 nt, Shigella flexneri 2a str. 2457T
cacuccauccagcaacaacag

SEQ ID NO: 3817562 - RNA, 22 nt, Shigella flexneri 2a str. 2457T
cacuccauccagcaacaacagc

SEQ ID NO: 3817563 - RNA, 16 nt, Shigella flexneri 2a str. 2457T
cacucccugccccauc

SEQ ID NO: 3817564 - RNA, 20 nt, Shigella flexneri 2a str. 2457T
cacucccuuucugccacgcc

SEQ ID NO: 3817565 - RNA, 18 nt, Shigella flexneri 2a str. 2457T
cacuccuaucaccagcgg

SEQ ID NO: 3817566 - RNA, 14 nt, Shigella flexneri 2a str. 2457T
cacucgacagcacc

SEQ ID NO: 3817567 - RNA, 13 nt, Shigella flexneri 2a str. 2457T
cacucgcauccuc

SEQ ID NO: 3817568 - RNA, 15 nt, Shigella flexneri 2a str. 2457T
cacucgcauccucuu

SEQ ID NO: 3817569 - RNA, 15 nt, Shigella flexneri 2a str. 2457T
cacucgcugacugau

SEQ ID NO: 3817570 - RNA, 21 nt, Shigella flexneri 2a str. 2457T
cacucucaaucgucaaacgca

SEQ ID NO: 3817571 - RNA, 14 nt, Shigella flexneri 2a str. 2457T
cacucucaccacgc

SEQ ID NO: 3817572 - RNA, 21 nt, Shigella flexneri 2a str. 2457T
cacucucgggaaggcccuucc

SEQ ID NO: 3817573 - RNA, 19 nt, Shigella flexneri 2a str. 2457T
cacucugcugccacauucc

SEQ ID NO: 3817574 - RNA, 12 nt, Shigella flexneri 2a str. 2457T
cacucuuucaau

SEQ ID NO: 3817575 - RNA, 14 nt, Shigella flexneri 2a str. 2457T
cacugaaaaucacc

SEQ ID NO: 3817576 - RNA, 17 nt, Shigella flexneri 2a str. 2457T
cacugaaaaucaccuca

SEQ ID NO: 3817577 - RNA, 15 nt, Shigella flexneri 2a str. 2457T
cacugaaugacgacg

SEQ ID NO: 3817578 - RNA, 18 nt, Shigella flexneri 2a str. 2457T
cacugacacggaacaacg

SEQ ID NO: 3817579 - RNA, 21 nt, Shigella flexneri 2a str. 2457T
cacugaccaccaccaccugca

SEQ ID NO: 3817580 - RNA, 20 nt, Shigella flexneri 2a str. 2457T
cacugacgaggcgucagcgu

SEQ ID NO: 3817581 - RNA, 21 nt, Shigella flexneri 2a str. 2457T
cacugacgcccguuaaccgcu

SEQ ID NO: 3817582 - RNA, 18 nt, Shigella flexneri 2a str. 2457T
cacugacgcgucuuaucu

SEQ ID NO: 3817583 - RNA, 20 nt, Shigella flexneri 2a str. 2457T
cacugacgcgucuuaucugg

SEQ ID NO: 3817584 - RNA, 15 nt, Shigella flexneri 2a str. 2457T
cacugacgggaaacu

SEQ ID NO: 3817585 - RNA, 18 nt, Shigella flexneri 2a str. 2457T
cacugacugccggaugca

SEQ ID NO: 3817586 - RNA, 15 nt, Shigella flexneri 2a str. 2457T
cacugagucagccca

SEQ ID NO: 3817587 - RNA, 22 nt, Shigella flexneri 2a str. 2457T
cacugauaagcugagcacaaaa

SEQ ID NO: 3817588 - RNA, 19 nt, Shigella flexneri 2a str. 2457T
cacugauggaauuucauca

SEQ ID NO: 3817589 - RNA, 13 nt, Shigella flexneri 2a str. 2457T
cacugcaaaacag

SEQ ID NO: 3817590 - RNA, 16 nt, Shigella flexneri 2a str. 2457T
cacugcaaaucaccac

SEQ ID NO: 3817591 - RNA, 22 nt, Shigella flexneri 2a str. 2457T
cacugcaacagcuguugaaaag

SEQ ID NO: 3817592 - RNA, 15 nt, Shigella flexneri 2a str. 2457T
cacugcaacgccuuu

SEQ ID NO: 3817593 - RNA, 21 nt, Shigella flexneri 2a str. 2457T
cacugcaaugaccaucauucg

SEQ ID NO: 3817594 - RNA, 13 nt, Shigella flexneri 2a str. 2457T
cacugcaucaugg

SEQ ID NO: 3817595 - RNA, 16 nt, Shigella flexneri 2a str. 2457T
cacugcaucauggcau

SEQ ID NO: 3817596 - RNA, 20 nt, Shigella flexneri 2a str. 2457T
cacugccagauucuccaaca

SEQ ID NO: 3817597 - RNA, 16 nt, Shigella flexneri 2a str. 2457T
cacugcccgagaacag

SEQ ID NO: 3817598 - RNA, 17 nt, Shigella flexneri 2a str. 2457T
cacugccggaagagagc

SEQ ID NO: 3817599 - RNA, 20 nt, Shigella flexneri 2a str. 2457T
cacugccguacaggcagcuu

SEQ ID NO: 3817600 - RNA, 15 nt, Shigella flexneri 2a str. 2457T
cacugcgagaaaaag

SEQ ID NO: 3817601 - RNA, 18 nt, Shigella flexneri 2a str. 2457T
cacugcgagaaaaagccu

SEQ ID NO: 3817602 - RNA, 18 nt, Shigella flexneri 2a str. 2457T
cacugcgcauaauccacu

SEQ ID NO: 3817603 - RNA, 16 nt, Shigella flexneri 2a str. 2457T
cacugcgcccgccagc

SEQ ID NO: 3817604 - RNA, 17 nt, Shigella flexneri 2a str. 2457T
cacugcgcccgccagca

SEQ ID NO: 3817605 - RNA, 14 nt, Shigella flexneri 2a str. 2457T
cacugcgcucuucu

SEQ ID NO: 3817606 - RNA, 15 nt, Shigella flexneri 2a str. 2457T
cacugcggcauuucc

SEQ ID NO: 3817607 - RNA, 19 nt, Shigella flexneri 2a str. 2457T
cacugcugauuuggaaagu

SEQ ID NO: 3817608 - RNA, 22 nt, Shigella flexneri 2a str. 2457T
cacugcuuuggcucuucgcucc

SEQ ID NO: 3817609 - RNA, 14 nt, Shigella flexneri 2a str. 2457T
cacuggcaaugacg

SEQ ID NO: 3817610 - RNA, 17 nt, Shigella flexneri 2a str. 2457T
cacuggcagccaggcgc

SEQ ID NO: 3817611 - RNA, 19 nt, Shigella flexneri 2a str. 2457T
cacuggcgcgaauagcuuc

SEQ ID NO: 3817612 - RNA, 14 nt, Shigella flexneri 2a str. 2457T
cacuggcggcagca

SEQ ID NO: 3817613 - RNA, 16 nt, Shigella flexneri 2a str. 2457T
cacuggcggcagcagg

SEQ ID NO: 3817614 - RNA, 18 nt, Shigella flexneri 2a str. 2457T
cacugggagaacgcugcu

SEQ ID NO: 3817615 - RNA, 23 nt, Shigella flexneri 2a str. 2457T
cacuggguuggguucacuuuccc

SEQ ID NO: 3817616 - RNA, 15 nt, Shigella flexneri 2a str. 2457T
cacuggucgcccugg

SEQ ID NO: 3817617 - RNA, 18 nt, Shigella flexneri 2a str. 2457T
cacuggugccaugaauga

SEQ ID NO: 3817618 - RNA, 19 nt, Shigella flexneri 2a str. 2457T
cacugguucccaacaacag

SEQ ID NO: 3817619 - RNA, 16 nt, Shigella flexneri 2a str. 2457T
cacuguaagccaccga

SEQ ID NO: 3817620 - RNA, 18 nt, Shigella flexneri 2a str. 2457T
cacugucgagaucgcggc

SEQ ID NO: 3817621 - RNA, 20 nt, Shigella flexneri 2a str. 2457T
cacuguuaccgcugcuggcg

SEQ ID NO: 3817622 - RNA, 15 nt, Shigella flexneri 2a str. 2457T
cacuguucacuuuug

SEQ ID NO: 3817623 - RNA, 12 nt, Shigella flexneri 2a str. 2457T
cacuuaacugua

SEQ ID NO: 3817624 - RNA, 21 nt, Shigella flexneri 2a str. 2457T
cacuuaacuguaaaucgccau

SEQ ID NO: 3817625 - RNA, 13 nt, Shigella flexneri 2a str. 2457T
cacuuacuuuccu

SEQ ID NO: 3817626 - RNA, 21 nt, Shigella flexneri 2a str. 2457T
cacuuaucuggaguuauagcu

SEQ ID NO: 3817627 - RNA, 15 nt, Shigella flexneri 2a str. 2457T
cacuucaauauuaau

SEQ ID NO: 3817628 - RNA, 17 nt, Shigella flexneri 2a str. 2457T
cacuucacggcugcuaa

SEQ ID NO: 3817629 - RNA, 17 nt, Shigella flexneri 2a str. 2457T
cacuucacugacauugc

SEQ ID NO: 3817630 - RNA, 20 nt, Shigella flexneri 2a str. 2457T
cacuucauacggcacuuuca

SEQ ID NO: 3817631 - RNA, 19 nt, Shigella flexneri 2a str. 2457T
cacuucauccggauacagc

SEQ ID NO: 3817632 - RNA, 16 nt, Shigella flexneri 2a str. 2457T
cacuucaucgucauaa

SEQ ID NO: 3817633 - RNA, 14 nt, Shigella flexneri 2a str. 2457T
cacuuccaccagcg

SEQ ID NO: 3817634 - RNA, 15 nt, Shigella flexneri 2a str. 2457T
cacuuccaccagcgg

SEQ ID NO: 3817635 - RNA, 22 nt, Shigella flexneri 2a str. 2457T
cacuuccaccagcggcugaaua

SEQ ID NO: 3817636 - RNA, 15 nt, Shigella flexneri 2a str. 2457T
cacuuccagcggcca

SEQ ID NO: 3817637 - RNA, 17 nt, Shigella flexneri 2a str. 2457T
cacuucgccaucugcca

SEQ ID NO: 3817638 - RNA, 23 nt, Shigella flexneri 2a str. 2457T
cacuucgcgcaaccaguccuccg

SEQ ID NO: 3817639 - RNA, 22 nt, Shigella flexneri 2a str. 2457T
cacuucugaguucggcaugggg

SEQ ID NO: 3817640 - RNA, 19 nt, Shigella flexneri 2a str. 2457T
cacuucuguuacuccagcg

SEQ ID NO: 3817641 - RNA, 12 nt, Shigella flexneri 2a str. 2457T
cacuucuucagc

SEQ ID NO: 3817642 - RNA, 14 nt, Shigella flexneri 2a str. 2457T
cacuucuucagcca

SEQ ID NO: 3817643 - RNA, 17 nt, Shigella flexneri 2a str. 2457T
cacuucuucagccaguu

SEQ ID NO: 3817644 - RNA, 12 nt, Shigella flexneri 2a str. 2457T
cacuugcagacc

SEQ ID NO: 3817645 - RNA, 22 nt, Shigella flexneri 2a str. 2457T
cacuugcagucggcuuucucau

SEQ ID NO: 3817646 - RNA, 16 nt, Shigella flexneri 2a str. 2457T
cacuugcgcauaauaa

SEQ ID NO: 3817647 - RNA, 22 nt, Shigella flexneri 2a str. 2457T
cacuugcggcacccauuuaucc

SEQ ID NO: 3817648 - RNA, 14 nt, Shigella flexneri 2a str. 2457T
cacuuucaaaagcc

SEQ ID NO: 3817649 - RNA, 17 nt, Shigella flexneri 2a str. 2457T
cacuuucaaauccggcc

SEQ ID NO: 3817650 - RNA, 20 nt, Shigella flexneri 2a str. 2457T
cacuuucaaauccggccagc

SEQ ID NO: 3817651 - RNA, 17 nt, Shigella flexneri 2a str. 2457T
cacuuucacgcccauaa

SEQ ID NO: 3817652 - RNA, 19 nt, Shigella flexneri 2a str. 2457T
cacuuucaucgcggucagc

SEQ ID NO: 3817653 - RNA, 23 nt, Shigella flexneri 2a str. 2457T
cacuuucaucgcggucagcugcu

SEQ ID NO: 3817654 - RNA, 17 nt, Shigella flexneri 2a str. 2457T
cacuuucucgacaucca

SEQ ID NO: 3817655 - RNA, 12 nt, Shigella flexneri 2a str. 2457T
cacuuucugcgc

SEQ ID NO: 3817656 - RNA, 15 nt, Shigella flexneri 2a str. 2457T
cacuuugaccgccag

SEQ ID NO: 3817657 - RNA, 16 nt, Shigella flexneri 2a str. 2457T
cacuuugaucugcguc

SEQ ID NO: 3817658 - RNA, 15 nt, Shigella flexneri 2a str. 2457T
cacuuugcaguuccu

SEQ ID NO: 3817659 - RNA, 18 nt, Shigella flexneri 2a str. 2457T
cacuuugcaguuccugcc

SEQ ID NO: 3817660 - RNA, 17 nt, Shigella flexneri 2a str. 2457T
cacuuugccagaaaucc

SEQ ID NO: 3817661 - RNA, 20 nt, Shigella flexneri 2a str. 2457T
cacuuuucggcaaccgcauc

SEQ ID NO: 3817662 - RNA, 15 nt, Shigella flexneri 2a str. 2457T
cacuuuugaaaucaa

SEQ ID NO: 3817663 - RNA, 18 nt, Shigella flexneri 2a str. 2457T
cacuuuuggcccgacgau

SEQ ID NO: 3817664 - RNA, 18 nt, Shigella flexneri 2a str. 2457T
cagaaaauggcacaaugg

SEQ ID NO: 3817665 - RNA, 15 nt, Shigella flexneri 2a str. 2457T
cagaaacaaacgcaa

SEQ ID NO: 3817666 - RNA, 16 nt, Shigella flexneri 2a str. 2457T
cagaaacacacuuucc

SEQ ID NO: 3817667 - RNA, 16 nt, Shigella flexneri 2a str. 2457T
cagaaacaguuguaaa

SEQ ID NO: 3817668 - RNA, 16 nt, Shigella flexneri 2a str. 2457T
cagaaacgccaccauu

SEQ ID NO: 3817669 - RNA, 18 nt, Shigella flexneri 2a str. 2457T
cagaaacgccauccagcc

SEQ ID NO: 3817670 - RNA, 16 nt, Shigella flexneri 2a str. 2457T
cagaaacgcucauaaa

SEQ ID NO: 3817671 - RNA, 19 nt, Shigella flexneri 2a str. 2457T
cagaaacggauaaucaugc

SEQ ID NO: 3817672 - RNA, 21 nt, Shigella flexneri 2a str. 2457T
cagaaagcgacuuugccuggc

SEQ ID NO: 3817673 - RNA, 15 nt, Shigella flexneri 2a str. 2457T
cagaaagcgccagca

SEQ ID NO: 3817674 - RNA, 13 nt, Shigella flexneri 2a str. 2457T
cagaaagggaaga

SEQ ID NO: 3817675 - RNA, 16 nt, Shigella flexneri 2a str. 2457T
cagaaagggaagaaca

SEQ ID NO: 3817676 - RNA, 21 nt, Shigella flexneri 2a str. 2457T
cagaaagucaaaagccuccga

SEQ ID NO: 3817677 - RNA, 20 nt, Shigella flexneri 2a str. 2457T
cagaaagucauggcaaacug

SEQ ID NO: 3817678 - RNA, 19 nt, Shigella flexneri 2a str. 2457T
cagaaagugaguuuugcau

SEQ ID NO: 3817679 - RNA, 21 nt, Shigella flexneri 2a str. 2457T
cagaaaguuuuucaacaccau

SEQ ID NO: 3817680 - RNA, 18 nt, Shigella flexneri 2a str. 2457T
cagaaauagaaagugacu

SEQ ID NO: 3817681 - RNA, 23 nt, Shigella flexneri 2a str. 2457T
cagaaauagaaagugacugcugg

SEQ ID NO: 3817682 - RNA, 13 nt, Shigella flexneri 2a str. 2457T
cagaaaugaaaaa

SEQ ID NO: 3817683 - RNA, 16 nt, Shigella flexneri 2a str. 2457T
cagaaaugaaaaaaua

SEQ ID NO: 3817684 - RNA, 14 nt, Shigella flexneri 2a str. 2457T
cagaaaugaugggg

SEQ ID NO: 3817685 - RNA, 18 nt, Shigella flexneri 2a str. 2457T
cagaaauggcccaaaagg

SEQ ID NO: 3817686 - RNA, 20 nt, Shigella flexneri 2a str. 2457T
cagaaauggcccaaaaggca

SEQ ID NO: 3817687 - RNA, 16 nt, Shigella flexneri 2a str. 2457T
cagaaaugguaaagaa

SEQ ID NO: 3817688 - RNA, 18 nt, Shigella flexneri 2a str. 2457T
cagaaaugguaaagaagg

SEQ ID NO: 3817689 - RNA, 19 nt, Shigella flexneri 2a str. 2457T
cagaaauugucuccaccaa

SEQ ID NO: 3817690 - RNA, 16 nt, Shigella flexneri 2a str. 2457T
cagaaauuuccugagc

SEQ ID NO: 3817691 - RNA, 14 nt, Shigella flexneri 2a str. 2457T
cagaacaccauaau

SEQ ID NO: 3817692 - RNA, 14 nt, Shigella flexneri 2a str. 2457T
cagaacagcuacag

SEQ ID NO: 3817693 - RNA, 17 nt, Shigella flexneri 2a str. 2457T
cagaacagcuacagcau

SEQ ID NO: 3817694 - RNA, 20 nt, Shigella flexneri 2a str. 2457T
cagaaccacggaauaaccag

SEQ ID NO: 3817695 - RNA, 14 nt, Shigella flexneri 2a str. 2457T
cagaaccgccauca

SEQ ID NO: 3817696 - RNA, 18 nt, Shigella flexneri 2a str. 2457T
cagaacgccgaauaacgc

SEQ ID NO: 3817697 - RNA, 17 nt, Shigella flexneri 2a str. 2457T
cagaacgcuuucgcaca

SEQ ID NO: 3817698 - RNA, 23 nt, Shigella flexneri 2a str. 2457T
cagaacgguucuugaaaaucaac

SEQ ID NO: 3817699 - RNA, 14 nt, Shigella flexneri 2a str. 2457T
cagaacguaaacgc

SEQ ID NO: 3817700 - RNA, 16 nt, Shigella flexneri 2a str. 2457T
cagaacguaaacgcag

SEQ ID NO: 3817701 - RNA, 16 nt, Shigella flexneri 2a str. 2457T
cagaacuaaaaucggu

SEQ ID NO: 3817702 - RNA, 16 nt, Shigella flexneri 2a str. 2457T
cagaacuucugguaac

SEQ ID NO: 3817703 - RNA, 14 nt, Shigella flexneri 2a str. 2457T
cagaagacgcucca

SEQ ID NO: 3817704 - RNA, 15 nt, Shigella flexneri 2a str. 2457T
cagaagacgcuccag

SEQ ID NO: 3817705 - RNA, 23 nt, Shigella flexneri 2a str. 2457T
cagaagagagauaauucagcagg

SEQ ID NO: 3817706 - RNA, 18 nt, Shigella flexneri 2a str. 2457T
cagaagcaaucaucccag

SEQ ID NO: 3817707 - RNA, 24 nt, Shigella flexneri 2a str. 2457T
cagaagcacugccagaaucaaggu

SEQ ID NO: 3817708 - RNA, 15 nt, Shigella flexneri 2a str. 2457T
cagaagcaugaacau

SEQ ID NO: 3817709 - RNA, 15 nt, Shigella flexneri 2a str. 2457T
cagaagcgacaccag

SEQ ID NO: 3817710 - RNA, 17 nt, Shigella flexneri 2a str. 2457T
cagaagcguaauaucca

SEQ ID NO: 3817711 - RNA, 18 nt, Shigella flexneri 2a str. 2457T
cagaagcugcaggaccau

SEQ ID NO: 3817712 - RNA, 23 nt, Shigella flexneri 2a str. 2457T
cagaaggagcuaauaaugagcag

SEQ ID NO: 3817713 - RNA, 22 nt, Shigella flexneri 2a str. 2457T
cagaaggauaauuaaucuuucu

SEQ ID NO: 3817714 - RNA, 22 nt, Shigella flexneri 2a str. 2457T
cagaagguaaauuguuggcgua

SEQ ID NO: 3817715 - RNA, 17 nt, Shigella flexneri 2a str. 2457T
cagaaggugacccguuu

SEQ ID NO: 3817716 - RNA, 19 nt, Shigella flexneri 2a str. 2457T
cagaaguccggaaagccau

SEQ ID NO: 3817717 - RNA, 14 nt, Shigella flexneri 2a str. 2457T
cagaagugaccguc

SEQ ID NO: 3817718 - RNA, 16 nt, Shigella flexneri 2a str. 2457T
cagaaguugcacccag

SEQ ID NO: 3817719 - RNA, 14 nt, Shigella flexneri 2a str. 2457T
cagaaguugcucaa

SEQ ID NO: 3817720 - RNA, 16 nt, Shigella flexneri 2a str. 2457T
cagaaguugcucaagc

SEQ ID NO: 3817721 - RNA, 19 nt, Shigella flexneri 2a str. 2457T
cagaaguugcucaagcuga

SEQ ID NO: 3817722 - RNA, 19 nt, Shigella flexneri 2a str. 2457T
cagaauaaacaacuguggu

SEQ ID NO: 3817723 - RNA, 15 nt, Shigella flexneri 2a str. 2457T
cagaauaacggcuga

SEQ ID NO: 3817724 - RNA, 20 nt, Shigella flexneri 2a str. 2457T
cagaauagaaaguugccaga

SEQ ID NO: 3817725 - RNA, 15 nt, Shigella flexneri 2a str. 2457T
cagaauagacaaaaa

SEQ ID NO: 3817726 - RNA, 19 nt, Shigella flexneri 2a str. 2457T
cagaauagacaaaaauucu

SEQ ID NO: 3817727 - RNA, 20 nt, Shigella flexneri 2a str. 2457T
cagaauagccgcagccauca

SEQ ID NO: 3817728 - RNA, 19 nt, Shigella flexneri 2a str. 2457T
cagaauauauaaagauuca

SEQ ID NO: 3817729 - RNA, 13 nt, Shigella flexneri 2a str. 2457T
cagaaucaagucu

SEQ ID NO: 3817730 - RNA, 15 nt, Shigella flexneri 2a str. 2457T
cagaaucaccucuuu

SEQ ID NO: 3817731 - RNA, 20 nt, Shigella flexneri 2a str. 2457T
cagaaucaccucuuuuucca

SEQ ID NO: 3817732 - RNA, 15 nt, Shigella flexneri 2a str. 2457T
cagaaucaggccauu

SEQ ID NO: 3817733 - RNA, 19 nt, Shigella flexneri 2a str. 2457T
cagaaucaggccauuacua

SEQ ID NO: 3817734 - RNA, 12 nt, Shigella flexneri 2a str. 2457T
cagaauccagga

SEQ ID NO: 3817735 - RNA, 20 nt, Shigella flexneri 2a str. 2457T
cagaaucgcaaccagcguca

SEQ ID NO: 3817736 - RNA, 14 nt, Shigella flexneri 2a str. 2457T
cagaaucgccagca

SEQ ID NO: 3817737 - RNA, 15 nt, Shigella flexneri 2a str. 2457T
cagaaucgccagcau

SEQ ID NO: 3817738 - RNA, 14 nt, Shigella flexneri 2a str. 2457T
cagaaucgggcuga

SEQ ID NO: 3817739 - RNA, 20 nt, Shigella flexneri 2a str. 2457T
cagaaugagacacuuuaucu

SEQ ID NO: 3817740 - RNA, 16 nt, Shigella flexneri 2a str. 2457T
cagaaugaugccgcca

SEQ ID NO: 3817741 - RNA, 14 nt, Shigella flexneri 2a str. 2457T
cagaaugcgcuuua

SEQ ID NO: 3817742 - RNA, 15 nt, Shigella flexneri 2a str. 2457T
cagaaugcgggcgaa

SEQ ID NO: 3817743 - RNA, 19 nt, Shigella flexneri 2a str. 2457T
cagaaugcgggcgaaaaca

SEQ ID NO: 3817744 - RNA, 20 nt, Shigella flexneri 2a str. 2457T
cagaaugcgggcgaaaacau

SEQ ID NO: 3817745 - RNA, 16 nt, Shigella flexneri 2a str. 2457T
cagaauggcaucugau

SEQ ID NO: 3817746 - RNA, 21 nt, Shigella flexneri 2a str. 2457T
cagaaugguguuaaccgguac

SEQ ID NO: 3817747 - RNA, 15 nt, Shigella flexneri 2a str. 2457T
cagaauuaacgcuga

SEQ ID NO: 3817748 - RNA, 15 nt, Shigella flexneri 2a str. 2457T
cagaauuacuggcag

SEQ ID NO: 3817749 - RNA, 17 nt, Shigella flexneri 2a str. 2457T
cagaauuacuggcagau

SEQ ID NO: 3817750 - RNA, 20 nt, Shigella flexneri 2a str. 2457T
cagaauuugaggaagcugcc

SEQ ID NO: 3817751 - RNA, 16 nt, Shigella flexneri 2a str. 2457T
cagaauuuucucaccc

SEQ ID NO: 3817752 - RNA, 19 nt, Shigella flexneri 2a str. 2457T
cagaauuuucucacccgca

SEQ ID NO: 3817753 - RNA, 17 nt, Shigella flexneri 2a str. 2457T
cagaauuuuucgcuaaa

SEQ ID NO: 3817754 - RNA, 22 nt, Shigella flexneri 2a str. 2457T
cagaauuuuucgcuaaaaaaug

SEQ ID NO: 3817755 - RNA, 14 nt, Shigella flexneri 2a str. 2457T
cagacaaaacauac

SEQ ID NO: 3817756 - RNA, 12 nt, Shigella flexneri 2a str. 2457T
cagacaacauga

SEQ ID NO: 3817757 - RNA, 15 nt, Shigella flexneri 2a str. 2457T
cagacaacaugagaa

SEQ ID NO: 3817758 - RNA, 20 nt, Shigella flexneri 2a str. 2457T
cagacaaccauauuuaugca

SEQ ID NO: 3817759 - RNA, 13 nt, Shigella flexneri 2a str. 2457T
cagacaacuuccc

SEQ ID NO: 3817760 - RNA, 14 nt, Shigella flexneri 2a str. 2457T
cagacaacuucccu

SEQ ID NO: 3817761 - RNA, 17 nt, Shigella flexneri 2a str. 2457T
cagacaaucgccaguga

SEQ ID NO: 3817762 - RNA, 22 nt, Shigella flexneri 2a str. 2457T
cagacaauggccugcgcgaccu

SEQ ID NO: 3817763 - RNA, 15 nt, Shigella flexneri 2a str. 2457T
cagacacaauaauuu

SEQ ID NO: 3817764 - RNA, 19 nt, Shigella flexneri 2a str. 2457T
cagacaccgauugccccug

SEQ ID NO: 3817765 - RNA, 16 nt, Shigella flexneri 2a str. 2457T
cagacacgccgccaga

SEQ ID NO: 3817766 - RNA, 14 nt, Shigella flexneri 2a str. 2457T
cagacacugcugau

SEQ ID NO: 3817767 - RNA, 20 nt, Shigella flexneri 2a str. 2457T
cagacacugcugauaaucca

SEQ ID NO: 3817768 - RNA, 13 nt, Shigella flexneri 2a str. 2457T
cagacacuuuccc

SEQ ID NO: 3817769 - RNA, 15 nt, Shigella flexneri 2a str. 2457T
cagacagcacauuuc

SEQ ID NO: 3817770 - RNA, 21 nt, Shigella flexneri 2a str. 2457T
cagacaggcgaaacccgcugc

SEQ ID NO: 3817771 - RNA, 20 nt, Shigella flexneri 2a str. 2457T
cagacauaaagccugcuuca

SEQ ID NO: 3817772 - RNA, 22 nt, Shigella flexneri 2a str. 2457T
cagaccaauaauccccaauacg

SEQ ID NO: 3817773 - RNA, 11 nt, Shigella flexneri 2a str. 2457T
cagaccaauag

SEQ ID NO: 3817774 - RNA, 17 nt, Shigella flexneri 2a str. 2457T
cagaccaauccagccgg

SEQ ID NO: 3817775 - RNA, 21 nt, Shigella flexneri 2a str. 2457T
cagaccaauccagccggcaaa

SEQ ID NO: 3817776 - RNA, 20 nt, Shigella flexneri 2a str. 2457T
cagaccaaucccgccauaac

SEQ ID NO: 3817777 - RNA, 16 nt, Shigella flexneri 2a str. 2457T
cagaccaauggcgagg

SEQ ID NO: 3817778 - RNA, 13 nt, Shigella flexneri 2a str. 2457T
cagaccaauggcu

SEQ ID NO: 3817779 - RNA, 13 nt, Shigella flexneri 2a str. 2457T
cagaccaauguua

SEQ ID NO: 3817780 - RNA, 22 nt, Shigella flexneri 2a str. 2457T
cagaccacucauuuuuucgguu

SEQ ID NO: 3817781 - RNA, 20 nt, Shigella flexneri 2a str. 2457T
cagaccagaaacgccaccau

SEQ ID NO: 3817782 - RNA, 12 nt, Shigella flexneri 2a str. 2457T
cagaccagcaaa

SEQ ID NO: 3817783 - RNA, 20 nt, Shigella flexneri 2a str. 2457T
cagaccagcuaccacgccga

SEQ ID NO: 3817784 - RNA, 19 nt, Shigella flexneri 2a str. 2457T
cagaccauauuuucauuau

SEQ ID NO: 3817785 - RNA, 19 nt, Shigella flexneri 2a str. 2457T
cagacccacggauagauuu

SEQ ID NO: 3817786 - RNA, 17 nt, Shigella flexneri 2a str. 2457T
cagacccagacgcucag

SEQ ID NO: 3817787 - RNA, 22 nt, Shigella flexneri 2a str. 2457T
cagacccaguuucggcaucagc

SEQ ID NO: 3817788 - RNA, 14 nt, Shigella flexneri 2a str. 2457T
cagacccauaauca

SEQ ID NO: 3817789 - RNA, 18 nt, Shigella flexneri 2a str. 2457T
cagacccauaaucagacg

SEQ ID NO: 3817790 - RNA, 21 nt, Shigella flexneri 2a str. 2457T
cagacccauaaucagacgacg

SEQ ID NO: 3817791 - RNA, 23 nt, Shigella flexneri 2a str. 2457T
cagacccugcucuuucagcaccg

SEQ ID NO: 3817792 - RNA, 21 nt, Shigella flexneri 2a str. 2457T
cagaccgacauuaaugccucg

SEQ ID NO: 3817793 - RNA, 17 nt, Shigella flexneri 2a str. 2457T
cagaccgacuuucaggu

SEQ ID NO: 3817794 - RNA, 16 nt, Shigella flexneri 2a str. 2457T
cagaccgcacaccgag

SEQ ID NO: 3817795 - RNA, 19 nt, Shigella flexneri 2a str. 2457T
cagaccgcugacggcagcg

SEQ ID NO: 3817796 - RNA, 12 nt, Shigella flexneri 2a str. 2457T
cagaccggcaau

SEQ ID NO: 3817797 - RNA, 16 nt, Shigella flexneri 2a str. 2457T
cagaccuaccaucucc

SEQ ID NO: 3817798 - RNA, 21 nt, Shigella flexneri 2a str. 2457T
cagaccugaauuugcuccaga

SEQ ID NO: 3817799 - RNA, 13 nt, Shigella flexneri 2a str. 2457T
cagaccugcguca

SEQ ID NO: 3817800 - RNA, 17 nt, Shigella flexneri 2a str. 2457T
cagaccugcgucaccac

SEQ ID NO: 3817801 - RNA, 22 nt, Shigella flexneri 2a str. 2457T
cagaccugcgucaccacaucca

SEQ ID NO: 3817802 - RNA, 20 nt, Shigella flexneri 2a str. 2457T
cagaccuucgcuaucaaacu

SEQ ID NO: 3817803 - RNA, 21 nt, Shigella flexneri 2a str. 2457T
cagaccuucgcuaucaaacug

SEQ ID NO: 3817804 - RNA, 13 nt, Shigella flexneri 2a str. 2457T
cagaccuuuuaau

SEQ ID NO: 3817805 - RNA, 16 nt, Shigella flexneri 2a str. 2457T
cagacgaagucaacaa

SEQ ID NO: 3817806 - RNA, 13 nt, Shigella flexneri 2a str. 2457T
cagacgagggaaa

SEQ ID NO: 3817807 - RNA, 22 nt, Shigella flexneri 2a str. 2457T
cagacgauuacucgccuuucac

SEQ ID NO: 3817808 - RNA, 18 nt, Shigella flexneri 2a str. 2457T
cagacgcaguacgccacc

SEQ ID NO: 3817809 - RNA, 19 nt, Shigella flexneri 2a str. 2457T
cagacgcaguacgccaccu

SEQ ID NO: 3817810 - RNA, 18 nt, Shigella flexneri 2a str. 2457T
cagacgcgcagcuucacu

SEQ ID NO: 3817811 - RNA, 20 nt, Shigella flexneri 2a str. 2457T
cagacgcgcagcuucacuuc

SEQ ID NO: 3817812 - RNA, 17 nt, Shigella flexneri 2a str. 2457T
cagacgcucguuaaaac

SEQ ID NO: 3817813 - RNA, 19 nt, Shigella flexneri 2a str. 2457T
cagacgcuuacguuuacgc

SEQ ID NO: 3817814 - RNA, 12 nt, Shigella flexneri 2a str. 2457T
cagacggcagaa

SEQ ID NO: 3817815 - RNA, 12 nt, Shigella flexneri 2a str. 2457T
cagacggccaaa

SEQ ID NO: 3817816 - RNA, 20 nt, Shigella flexneri 2a str. 2457T
cagacggcugucauccagca

SEQ ID NO: 3817817 - RNA, 16 nt, Shigella flexneri 2a str. 2457T
cagacggcugucuucc

SEQ ID NO: 3817818 - RNA, 20 nt, Shigella flexneri 2a str. 2457T
cagacgggcaacuucaacgc

SEQ ID NO: 3817819 - RNA, 16 nt, Shigella flexneri 2a str. 2457T
cagacggucagcgaga

SEQ ID NO: 3817820 - RNA, 18 nt, Shigella flexneri 2a str. 2457T
cagacgguuuuucaaguc

SEQ ID NO: 3817821 - RNA, 18 nt, Shigella flexneri 2a str. 2457T
cagacguccggcgcugca

SEQ ID NO: 3817822 - RNA, 14 nt, Shigella flexneri 2a str. 2457T
cagacguucuuccu

SEQ ID NO: 3817823 - RNA, 11 nt, Shigella flexneri 2a str. 2457T
cagacguugca

SEQ ID NO: 3817824 - RNA, 16 nt, Shigella flexneri 2a str. 2457T
cagacguuuuuucugc

SEQ ID NO: 3817825 - RNA, 20 nt, Shigella flexneri 2a str. 2457T
cagacguuuuuucugcccca

SEQ ID NO: 3817826 - RNA, 15 nt, Shigella flexneri 2a str. 2457T
cagacuauaucgcuc

SEQ ID NO: 3817827 - RNA, 16 nt, Shigella flexneri 2a str. 2457T
cagacuauucagcucu

SEQ ID NO: 3817828 - RNA, 17 nt, Shigella flexneri 2a str. 2457T
cagacuauucagcucuu

SEQ ID NO: 3817829 - RNA, 14 nt, Shigella flexneri 2a str. 2457T
cagacucagucgcc

SEQ ID NO: 3817830 - RNA, 14 nt, Shigella flexneri 2a str. 2457T
cagacuccgcuucg

SEQ ID NO: 3817831 - RNA, 21 nt, Shigella flexneri 2a str. 2457T
cagacucuuuuucgaaccaca

SEQ ID NO: 3817832 - RNA, 15 nt, Shigella flexneri 2a str. 2457T
cagacugaauacgcu

SEQ ID NO: 3817833 - RNA, 22 nt, Shigella flexneri 2a str. 2457T
cagacugaugugauccaucagg

SEQ ID NO: 3817834 - RNA, 16 nt, Shigella flexneri 2a str. 2457T
cagacugcucagcucc

SEQ ID NO: 3817835 - RNA, 16 nt, Shigella flexneri 2a str. 2457T
cagacuggauugccag

SEQ ID NO: 3817836 - RNA, 23 nt, Shigella flexneri 2a str. 2457T
cagacugggcaagaucuggcgaa

SEQ ID NO: 3817837 - RNA, 14 nt, Shigella flexneri 2a str. 2457T
cagacuguagauga

SEQ ID NO: 3817838 - RNA, 11 nt, Shigella flexneri 2a str. 2457T
cagacuuugcg

SEQ ID NO: 3817839 - RNA, 15 nt, Shigella flexneri 2a str. 2457T
cagacuuuuugcggc

SEQ ID NO: 3817840 - RNA, 19 nt, Shigella flexneri 2a str. 2457T
cagagaaaaugccgcacau

SEQ ID NO: 3817841 - RNA, 20 nt, Shigella flexneri 2a str. 2457T
cagagaaaccacaucaaucc

SEQ ID NO: 3817842 - RNA, 18 nt, Shigella flexneri 2a str. 2457T
cagagaaacgccagcagc

SEQ ID NO: 3817843 - RNA, 19 nt, Shigella flexneri 2a str. 2457T
cagagaaagcaaaaauaaa

SEQ ID NO: 3817844 - RNA, 22 nt, Shigella flexneri 2a str. 2457T
cagagaaagcaaaaauaaaugc

SEQ ID NO: 3817845 - RNA, 20 nt, Shigella flexneri 2a str. 2457T
cagagaacaucaauccaaac

SEQ ID NO: 3817846 - RNA, 19 nt, Shigella flexneri 2a str. 2457T
cagagaacgaccaucagcu

SEQ ID NO: 3817847 - RNA, 14 nt, Shigella flexneri 2a str. 2457T
cagagaagcaccgc

SEQ ID NO: 3817848 - RNA, 22 nt, Shigella flexneri 2a str. 2457T
cagagaaucgggaaauaacauc

SEQ ID NO: 3817849 - RNA, 21 nt, Shigella flexneri 2a str. 2457T
cagagaauuuagcaaccaaaa

SEQ ID NO: 3817850 - RNA, 22 nt, Shigella flexneri 2a str. 2457T
cagagagaaccucaacaggcua

SEQ ID NO: 3817851 - RNA, 23 nt, Shigella flexneri 2a str. 2457T
cagagagacguucgcguacugcu

SEQ ID NO: 3817852 - RNA, 18 nt, Shigella flexneri 2a str. 2457T
cagagagcgaauaucauu

SEQ ID NO: 3817853 - RNA, 18 nt, Shigella flexneri 2a str. 2457T
cagagauaaccacguuca

SEQ ID NO: 3817854 - RNA, 21 nt, Shigella flexneri 2a str. 2457T
cagagauaaccacguucauuu

SEQ ID NO: 3817855 - RNA, 20 nt, Shigella flexneri 2a str. 2457T
cagagauagaacugcauugu

SEQ ID NO: 3817856 - RNA, 23 nt, Shigella flexneri 2a str. 2457T
cagagaucgccccggcaagaaau

SEQ ID NO: 3817857 - RNA, 13 nt, Shigella flexneri 2a str. 2457T
cagagaucuuuca

SEQ ID NO: 3817858 - RNA, 13 nt, Shigella flexneri 2a str. 2457T
cagagauuacuuu

SEQ ID NO: 3817859 - RNA, 16 nt, Shigella flexneri 2a str. 2457T
cagagauucgguaacc

SEQ ID NO: 3817860 - RNA, 15 nt, Shigella flexneri 2a str. 2457T
cagagauucuuuucc

SEQ ID NO: 3817861 - RNA, 17 nt, Shigella flexneri 2a str. 2457T
cagagauuugcuccagc

SEQ ID NO: 3817862 - RNA, 23 nt, Shigella flexneri 2a str. 2457T
cagagcaaaaaucgacagcagga

SEQ ID NO: 3817863 - RNA, 12 nt, Shigella flexneri 2a str. 2457T
cagagcagcuua

SEQ ID NO: 3817864 - RNA, 14 nt, Shigella flexneri 2a str. 2457T
cagagcaucgguau

SEQ ID NO: 3817865 - RNA, 12 nt, Shigella flexneri 2a str. 2457T
cagagccugaau

SEQ ID NO: 3817866 - RNA, 15 nt, Shigella flexneri 2a str. 2457T
cagagccugaauaaa

SEQ ID NO: 3817867 - RNA, 13 nt, Shigella flexneri 2a str. 2457T
cagagccugccaa

SEQ ID NO: 3817868 - RNA, 22 nt, Shigella flexneri 2a str. 2457T
cagagcgauauccagugccaga

SEQ ID NO: 3817869 - RNA, 16 nt, Shigella flexneri 2a str. 2457T
cagagcgaucaaccca

SEQ ID NO: 3817870 - RNA, 15 nt, Shigella flexneri 2a str. 2457T
cagagcugaauauca

SEQ ID NO: 3817871 - RNA, 20 nt, Shigella flexneri 2a str. 2457T
cagagcugaauaucacgggc

SEQ ID NO: 3817872 - RNA, 22 nt, Shigella flexneri 2a str. 2457T
cagagcuuuguugcgcugaagu

SEQ ID NO: 3817873 - RNA, 14 nt, Shigella flexneri 2a str. 2457T
cagaggcccgcccc

SEQ ID NO: 3817874 - RNA, 14 nt, Shigella flexneri 2a str. 2457T
cagaggucuuuucu

SEQ ID NO: 3817875 - RNA, 21 nt, Shigella flexneri 2a str. 2457T
cagaguaauugauucacaucc

SEQ ID NO: 3817876 - RNA, 14 nt, Shigella flexneri 2a str. 2457T
cagaguaucgccau

SEQ ID NO: 3817877 - RNA, 18 nt, Shigella flexneri 2a str. 2457T
cagagucauuucugccuu

SEQ ID NO: 3817878 - RNA, 12 nt, Shigella flexneri 2a str. 2457T
cagagugaaaau

SEQ ID NO: 3817879 - RNA, 18 nt, Shigella flexneri 2a str. 2457T
cagaguggauuaucuuca

SEQ ID NO: 3817880 - RNA, 15 nt, Shigella flexneri 2a str. 2457T
cagaguugaaaaaca

SEQ ID NO: 3817881 - RNA, 20 nt, Shigella flexneri 2a str. 2457T
cagaguugagcaguccccac

SEQ ID NO: 3817882 - RNA, 20 nt, Shigella flexneri 2a str. 2457T
cagaguuguaccagcaauuu

SEQ ID NO: 3817883 - RNA, 22 nt, Shigella flexneri 2a str. 2457T
cagauaaaauacacuuuaaugc

SEQ ID NO: 3817884 - RNA, 13 nt, Shigella flexneri 2a str. 2457T
cagauaagacacu

SEQ ID NO: 3817885 - RNA, 23 nt, Shigella flexneri 2a str. 2457T
cagauaagacgcgucagugucuu

SEQ ID NO: 3817886 - RNA, 19 nt, Shigella flexneri 2a str. 2457T
cagauaagccugcgcgccc

SEQ ID NO: 3817887 - RNA, 18 nt, Shigella flexneri 2a str. 2457T
cagauaaggcguuuacgc

SEQ ID NO: 3817888 - RNA, 23 nt, Shigella flexneri 2a str. 2457T
cagauaaggugccaauccuucuu

SEQ ID NO: 3817889 - RNA, 14 nt, Shigella flexneri 2a str. 2457T
cagauaauagguaa

SEQ ID NO: 3817890 - RNA, 22 nt, Shigella flexneri 2a str. 2457T
cagauaauauuuaucuucccag

SEQ ID NO: 3817891 - RNA, 18 nt, Shigella flexneri 2a str. 2457T
cagauaaucaccugccuu

SEQ ID NO: 3817892 - RNA, 20 nt, Shigella flexneri 2a str. 2457T
cagauacaguuuuugcgcuu

SEQ ID NO: 3817893 - RNA, 19 nt, Shigella flexneri 2a str. 2457T
cagauaccaaaaucggcaa

SEQ ID NO: 3817894 - RNA, 17 nt, Shigella flexneri 2a str. 2457T
cagauaccacaucaacc

SEQ ID NO: 3817895 - RNA, 17 nt, Shigella flexneri 2a str. 2457T
cagauacgaccguucca

SEQ ID NO: 3817896 - RNA, 21 nt, Shigella flexneri 2a str. 2457T
cagauacgaccguuccauuca

SEQ ID NO: 3817897 - RNA, 20 nt, Shigella flexneri 2a str. 2457T
cagauaggcaucagcaauug

SEQ ID NO: 3817898 - RNA, 14 nt, Shigella flexneri 2a str. 2457T
cagauaguuagucu

SEQ ID NO: 3817899 - RNA, 17 nt, Shigella flexneri 2a str. 2457T
cagauaucgcggauaug

SEQ ID NO: 3817900 - RNA, 15 nt, Shigella flexneri 2a str. 2457T
cagaucaacauacuu

SEQ ID NO: 3817901 - RNA, 17 nt, Shigella flexneri 2a str. 2457T
cagaucacgcaucaccc

SEQ ID NO: 3817902 - RNA, 13 nt, Shigella flexneri 2a str. 2457T
cagaucagaccaa

SEQ ID NO: 3817903 - RNA, 16 nt, Shigella flexneri 2a str. 2457T
cagaucagaccaaucc

SEQ ID NO: 3817904 - RNA, 16 nt, Shigella flexneri 2a str. 2457T
cagaucauccugcggc

SEQ ID NO: 3817905 - RNA, 21 nt, Shigella flexneri 2a str. 2457T
cagauccaaaccgacugccug

SEQ ID NO: 3817906 - RNA, 14 nt, Shigella flexneri 2a str. 2457T
cagauccagcaccu

SEQ ID NO: 3817907 - RNA, 14 nt, Shigella flexneri 2a str. 2457T
cagauccagugcuc

SEQ ID NO: 3817908 - RNA, 23 nt, Shigella flexneri 2a str. 2457T
cagauccagugcucauccuucag

SEQ ID NO: 3817909 - RNA, 23 nt, Shigella flexneri 2a str. 2457T
cagauccauaagguccuccagcu

SEQ ID NO: 3817910 - RNA, 21 nt, Shigella flexneri 2a str. 2457T
cagaucccaauucauuccugg

SEQ ID NO: 3817911 - RNA, 15 nt, Shigella flexneri 2a str. 2457T
cagauccgcacccgc

SEQ ID NO: 3817912 - RNA, 13 nt, Shigella flexneri 2a str. 2457T
cagauccgccauu

SEQ ID NO: 3817913 - RNA, 21 nt, Shigella flexneri 2a str. 2457T
cagaucgaucauauuuccuuc

SEQ ID NO: 3817914 - RNA, 14 nt, Shigella flexneri 2a str. 2457T
cagaucgccaauau

SEQ ID NO: 3817915 - RNA, 17 nt, Shigella flexneri 2a str. 2457T
cagaucgccaauaucaa

SEQ ID NO: 3817916 - RNA, 16 nt, Shigella flexneri 2a str. 2457T
cagaucgcucaucugc

SEQ ID NO: 3817917 - RNA, 21 nt, Shigella flexneri 2a str. 2457T
cagaucggacuucaugcgcag

SEQ ID NO: 3817918 - RNA, 21 nt, Shigella flexneri 2a str. 2457T
cagaucgguaauugaucucac

SEQ ID NO: 3817919 - RNA, 16 nt, Shigella flexneri 2a str. 2457T
cagaucguugaccuga

SEQ ID NO: 3817920 - RNA, 23 nt, Shigella flexneri 2a str. 2457T
cagaucugaauauucggcuccag

SEQ ID NO: 3817921 - RNA, 20 nt, Shigella flexneri 2a str. 2457T
cagaucuggcgauuauuuuc

SEQ ID NO: 3817922 - RNA, 21 nt, Shigella flexneri 2a str. 2457T
cagaucuggcgauuauuuucc

SEQ ID NO: 3817923 - RNA, 14 nt, Shigella flexneri 2a str. 2457T
cagaucuucaucac

SEQ ID NO: 3817924 - RNA, 22 nt, Shigella flexneri 2a str. 2457T
cagaucuuucacgaacacagug

SEQ ID NO: 3817925 - RNA, 17 nt, Shigella flexneri 2a str. 2457T
cagaugaaaacgccgga

SEQ ID NO: 3817926 - RNA, 18 nt, Shigella flexneri 2a str. 2457T
cagaugaagauuuaaaca

SEQ ID NO: 3817927 - RNA, 24 nt, Shigella flexneri 2a str. 2457T
cagaugaauagcgcaaaauuaugu

SEQ ID NO: 3817928 - RNA, 14 nt, Shigella flexneri 2a str. 2457T
cagaugacgaucag

SEQ ID NO: 3817929 - RNA, 20 nt, Shigella flexneri 2a str. 2457T
cagaugauuagucuuuaucu

SEQ ID NO: 3817930 - RNA, 21 nt, Shigella flexneri 2a str. 2457T
cagaugauuagucuuuaucug

SEQ ID NO: 3817931 - RNA, 23 nt, Shigella flexneri 2a str. 2457T
cagaugcaggauuucuucaccag

SEQ ID NO: 3817932 - RNA, 15 nt, Shigella flexneri 2a str. 2457T
cagaugccaggaaca

SEQ ID NO: 3817933 - RNA, 15 nt, Shigella flexneri 2a str. 2457T
cagaugccuugccaa

SEQ ID NO: 3817934 - RNA, 23 nt, Shigella flexneri 2a str. 2457T
cagaugcgacggcaccacauucu

SEQ ID NO: 3817935 - RNA, 19 nt, Shigella flexneri 2a str. 2457T
cagaugcggcuucgcuuca

SEQ ID NO: 3817936 - RNA, 19 nt, Shigella flexneri 2a str. 2457T
cagaugcucuuuucugaag

SEQ ID NO: 3817937 - RNA, 15 nt, Shigella flexneri 2a str. 2457T
cagauggcuuuccac

SEQ ID NO: 3817938 - RNA, 15 nt, Shigella flexneri 2a str. 2457T
cagauguaaugagaa

SEQ ID NO: 3817939 - RNA, 17 nt, Shigella flexneri 2a str. 2457T
cagauguagcucaccuu

SEQ ID NO: 3817940 - RNA, 17 nt, Shigella flexneri 2a str. 2457T
cagaugugccaguugca

SEQ ID NO: 3817941 - RNA, 20 nt, Shigella flexneri 2a str. 2457T
cagaugugccaguugcauaa

SEQ ID NO: 3817942 - RNA, 19 nt, Shigella flexneri 2a str. 2457T
cagauguugucucagauuc

SEQ ID NO: 3817943 - RNA, 21 nt, Shigella flexneri 2a str. 2457T
cagauuaugucgcucaaugcg

SEQ ID NO: 3817944 - RNA, 23 nt, Shigella flexneri 2a str. 2457T
cagauuauugacaaagugcgcuu

SEQ ID NO: 3817945 - RNA, 17 nt, Shigella flexneri 2a str. 2457T
cagauucaaauuauguc

SEQ ID NO: 3817946 - RNA, 21 nt, Shigella flexneri 2a str. 2457T
cagauucagauuaugucgcuc

SEQ ID NO: 3817947 - RNA, 14 nt, Shigella flexneri 2a str. 2457T
cagauucagcagcg

SEQ ID NO: 3817948 - RNA, 12 nt, Shigella flexneri 2a str. 2457T
cagauucaggcg

SEQ ID NO: 3817949 - RNA, 20 nt, Shigella flexneri 2a str. 2457T
cagauucaggcgcagcaagu

SEQ ID NO: 3817950 - RNA, 18 nt, Shigella flexneri 2a str. 2457T
cagauuccucucauuuaa

SEQ ID NO: 3817951 - RNA, 23 nt, Shigella flexneri 2a str. 2457T
cagauucucauauaucccuucca

SEQ ID NO: 3817952 - RNA, 18 nt, Shigella flexneri 2a str. 2457T
cagauugagcauuggcau

SEQ ID NO: 3817953 - RNA, 16 nt, Shigella flexneri 2a str. 2457T
cagauugauaaaaaua

SEQ ID NO: 3817954 - RNA, 18 nt, Shigella flexneri 2a str. 2457T
cagauugcagacaaagug

SEQ ID NO: 3817955 - RNA, 13 nt, Shigella flexneri 2a str. 2457T
cagauuguugauu

SEQ ID NO: 3817956 - RNA, 20 nt, Shigella flexneri 2a str. 2457T
cagauuguugauuaacaggc

SEQ ID NO: 3817957 - RNA, 20 nt, Shigella flexneri 2a str. 2457T
cagauuuaacggcagcaagg

SEQ ID NO: 3817958 - RNA, 19 nt, Shigella flexneri 2a str. 2457T
cagauuuauaaaagaaaaa

SEQ ID NO: 3817959 - RNA, 20 nt, Shigella flexneri 2a str. 2457T
cagauuucaaucuggccuga

SEQ ID NO: 3817960 - RNA, 17 nt, Shigella flexneri 2a str. 2457T
cagcaaaaucaccauca

SEQ ID NO: 3817961 - RNA, 14 nt, Shigella flexneri 2a str. 2457T
cagcaaacaggugc

SEQ ID NO: 3817962 - RNA, 16 nt, Shigella flexneri 2a str. 2457T
cagcaaagugccccca

SEQ ID NO: 3817963 - RNA, 23 nt, Shigella flexneri 2a str. 2457T
cagcaaauaccccuugccacccg

SEQ ID NO: 3817964 - RNA, 12 nt, Shigella flexneri 2a str. 2457T
cagcaaauacgu

SEQ ID NO: 3817965 - RNA, 22 nt, Shigella flexneri 2a str. 2457T
cagcaaauagauaaaauauggc

SEQ ID NO: 3817966 - RNA, 16 nt, Shigella flexneri 2a str. 2457T
cagcaaauagccgagc

SEQ ID NO: 3817967 - RNA, 14 nt, Shigella flexneri 2a str. 2457T
cagcaaauccagcg

SEQ ID NO: 3817968 - RNA, 17 nt, Shigella flexneri 2a str. 2457T
cagcaaauccagcgguu

SEQ ID NO: 3817969 - RNA, 17 nt, Shigella flexneri 2a str. 2457T
cagcaacaaauaaccgc

SEQ ID NO: 3817970 - RNA, 13 nt, Shigella flexneri 2a str. 2457T
cagcaacaacagc

SEQ ID NO: 3817971 - RNA, 22 nt, Shigella flexneri 2a str. 2457T
cagcaacaagccaguccagaaa

SEQ ID NO: 3817972 - RNA, 21 nt, Shigella flexneri 2a str. 2457T
cagcaacacaaucagacgcag

SEQ ID NO: 3817973 - RNA, 20 nt, Shigella flexneri 2a str. 2457T
cagcaaccaaugccaccagg

SEQ ID NO: 3817974 - RNA, 10 nt, Shigella flexneri 2a str. 2457T
cagcaaccag

SEQ ID NO: 3817975 - RNA, 14 nt, Shigella flexneri 2a str. 2457T
cagcaaccagguaa

SEQ ID NO: 3817976 - RNA, 14 nt, Shigella flexneri 2a str. 2457T
cagcaaccgcuucc

SEQ ID NO: 3817977 - RNA, 15 nt, Shigella flexneri 2a str. 2457T
cagcaacgcuucaac

SEQ ID NO: 3817978 - RNA, 22 nt, Shigella flexneri 2a str. 2457T
cagcaacgcuucguagaagcca

SEQ ID NO: 3817979 - RNA, 14 nt, Shigella flexneri 2a str. 2457T
cagcaacggccaaa

SEQ ID NO: 3817980 - RNA, 21 nt, Shigella flexneri 2a str. 2457T
cagcaacgggcugaagaagua

SEQ ID NO: 3817981 - RNA, 18 nt, Shigella flexneri 2a str. 2457T
cagcaacucuuuuuccug

SEQ ID NO: 3817982 - RNA, 24 nt, Shigella flexneri 2a str. 2457T
cagcaacucuuuuuccugcugcau

SEQ ID NO: 3817983 - RNA, 17 nt, Shigella flexneri 2a str. 2457T
cagcaacugacugacuu

SEQ ID NO: 3817984 - RNA, 13 nt, Shigella flexneri 2a str. 2457T
cagcaacuggcaa

SEQ ID NO: 3817985 - RNA, 17 nt, Shigella flexneri 2a str. 2457T
cagcaagaccgcgacca

SEQ ID NO: 3817986 - RNA, 16 nt, Shigella flexneri 2a str. 2457T
cagcaagagcaaauaa

SEQ ID NO: 3817987 - RNA, 18 nt, Shigella flexneri 2a str. 2457T
cagcaagagcaaauaaaa

SEQ ID NO: 3817988 - RNA, 23 nt, Shigella flexneri 2a str. 2457T
cagcaagauauugauaacggaac

SEQ ID NO: 3817989 - RNA, 15 nt, Shigella flexneri 2a str. 2457T
cagcaaggaaaacca

SEQ ID NO: 3817990 - RNA, 19 nt, Shigella flexneri 2a str. 2457T
cagcaaggcgcuaaaagca

SEQ ID NO: 3817991 - RNA, 16 nt, Shigella flexneri 2a str. 2457T
cagcaagggcaucgua

SEQ ID NO: 3817992 - RNA, 19 nt, Shigella flexneri 2a str. 2457T
cagcaaggguucaccggug

SEQ ID NO: 3817993 - RNA, 20 nt, Shigella flexneri 2a str. 2457T
cagcaaggguucaccgguga

SEQ ID NO: 3817994 - RNA, 22 nt, Shigella flexneri 2a str. 2457T
cagcaaggguucaccggugagc

SEQ ID NO: 3817995 - RNA, 20 nt, Shigella flexneri 2a str. 2457T
cagcaagucggcaucgccac

SEQ ID NO: 3817996 - RNA, 18 nt, Shigella flexneri 2a str. 2457T
cagcaauaaucagauggc

SEQ ID NO: 3817997 - RNA, 22 nt, Shigella flexneri 2a str. 2457T
cagcaauaaucagauggcggcu

SEQ ID NO: 3817998 - RNA, 18 nt, Shigella flexneri 2a str. 2457T
cagcaauacguuucauau

SEQ ID NO: 3817999 - RNA, 12 nt, Shigella flexneri 2a str. 2457T
cagcaaucacug

SEQ ID NO: 3818000 - RNA, 16 nt, Shigella flexneri 2a str. 2457T
cagcaaucacugccag

SEQ ID NO: 3818001 - RNA, 12 nt, Shigella flexneri 2a str. 2457T
cagcaaucccaa

SEQ ID NO: 3818002 - RNA, 14 nt, Shigella flexneri 2a str. 2457T
cagcaaucccaaaa

SEQ ID NO: 3818003 - RNA, 17 nt, Shigella flexneri 2a str. 2457T
cagcaaucccaaaauaa

SEQ ID NO: 3818004 - RNA, 19 nt, Shigella flexneri 2a str. 2457T
cagcaauccccagacaaaa

SEQ ID NO: 3818005 - RNA, 15 nt, Shigella flexneri 2a str. 2457T
cagcaauccugcaug

SEQ ID NO: 3818006 - RNA, 23 nt, Shigella flexneri 2a str. 2457T
cagcaaucgaccaggccaucagc

SEQ ID NO: 3818007 - RNA, 16 nt, Shigella flexneri 2a str. 2457T
cagcaaucgcgccagc

SEQ ID NO: 3818008 - RNA, 18 nt, Shigella flexneri 2a str. 2457T
cagcaaucgcgccagccg

SEQ ID NO: 3818009 - RNA, 21 nt, Shigella flexneri 2a str. 2457T
cagcaaucgcgccagccguuu

SEQ ID NO: 3818010 - RNA, 21 nt, Shigella flexneri 2a str. 2457T
cagcaaucugaagccgcaccu

SEQ ID NO: 3818011 - RNA, 21 nt, Shigella flexneri 2a str. 2457T
cagcaaucugauugacaucau

SEQ ID NO: 3818012 - RNA, 17 nt, Shigella flexneri 2a str. 2457T
cagcaaugcaggcaccu

SEQ ID NO: 3818013 - RNA, 13 nt, Shigella flexneri 2a str. 2457T
cagcaauggaaaa

SEQ ID NO: 3818014 - RNA, 14 nt, Shigella flexneri 2a str. 2457T
cagcaauguuucuc

SEQ ID NO: 3818015 - RNA, 15 nt, Shigella flexneri 2a str. 2457T
cagcaauguuucucu

SEQ ID NO: 3818016 - RNA, 19 nt, Shigella flexneri 2a str. 2457T
cagcaauuguaaaucuuug

SEQ ID NO: 3818017 - RNA, 21 nt, Shigella flexneri 2a str. 2457T
cagcaauuuacgcuuuucuuc

SEQ ID NO: 3818018 - RNA, 16 nt, Shigella flexneri 2a str. 2457T
cagcaauuuaucuuug

SEQ ID NO: 3818019 - RNA, 22 nt, Shigella flexneri 2a str. 2457T
cagcaauuuaugaggaugcaga

SEQ ID NO: 3818020 - RNA, 13 nt, Shigella flexneri 2a str. 2457T
cagcacaaugccg

SEQ ID NO: 3818021 - RNA, 15 nt, Shigella flexneri 2a str. 2457T
cagcacacauaagag

SEQ ID NO: 3818022 - RNA, 20 nt, Shigella flexneri 2a str. 2457T
cagcacacuguaagccaccg

SEQ ID NO: 3818023 - RNA, 19 nt, Shigella flexneri 2a str. 2457T
cagcacagcaucaggcuaa

SEQ ID NO: 3818024 - RNA, 19 nt, Shigella flexneri 2a str. 2457T
cagcacaucagccagaugc

SEQ ID NO: 3818025 - RNA, 13 nt, Shigella flexneri 2a str. 2457T
cagcacaucauca

SEQ ID NO: 3818026 - RNA, 21 nt, Shigella flexneri 2a str. 2457T
cagcacaucaucaaagccaau

SEQ ID NO: 3818027 - RNA, 23 nt, Shigella flexneri 2a str. 2457T
cagcacauuucagaaaguauaua

SEQ ID NO: 3818028 - RNA, 14 nt, Shigella flexneri 2a str. 2457T
cagcaccaccgccc

SEQ ID NO: 3818029 - RNA, 14 nt, Shigella flexneri 2a str. 2457T
cagcaccagagaac

SEQ ID NO: 3818030 - RNA, 12 nt, Shigella flexneri 2a str. 2457T
cagcaccagaua

SEQ ID NO: 3818031 - RNA, 13 nt, Shigella flexneri 2a str. 2457T
cagcaccagcaac

SEQ ID NO: 3818032 - RNA, 14 nt, Shigella flexneri 2a str. 2457T
cagcaccagcaacg

SEQ ID NO: 3818033 - RNA, 19 nt, Shigella flexneri 2a str. 2457T
cagcaccagcgauuguuca

SEQ ID NO: 3818034 - RNA, 23 nt, Shigella flexneri 2a str. 2457T
cagcaccaguucacccucauuca

SEQ ID NO: 3818035 - RNA, 12 nt, Shigella flexneri 2a str. 2457T
cagcaccaucau

SEQ ID NO: 3818036 - RNA, 14 nt, Shigella flexneri 2a str. 2457T
cagcacccugaguu

SEQ ID NO: 3818037 - RNA, 19 nt, Shigella flexneri 2a str. 2457T
cagcaccggacuauccgcc

SEQ ID NO: 3818038 - RNA, 19 nt, Shigella flexneri 2a str. 2457T
cagcaccugcuugaacgca

SEQ ID NO: 3818039 - RNA, 20 nt, Shigella flexneri 2a str. 2457T
cagcaccugcuugaacgcac

SEQ ID NO: 3818040 - RNA, 22 nt, Shigella flexneri 2a str. 2457T
cagcaccuuaccucaggcaccu

SEQ ID NO: 3818041 - RNA, 14 nt, Shigella flexneri 2a str. 2457T
cagcaccuuuugcu

SEQ ID NO: 3818042 - RNA, 23 nt, Shigella flexneri 2a str. 2457T
cagcacgaaugucguuuccaugg

SEQ ID NO: 3818043 - RNA, 15 nt, Shigella flexneri 2a str. 2457T
cagcacgaccgccau

SEQ ID NO: 3818044 - RNA, 21 nt, Shigella flexneri 2a str. 2457T
cagcacgcuuuucagugccag

SEQ ID NO: 3818045 - RNA, 23 nt, Shigella flexneri 2a str. 2457T
cagcacgucgccuuuuacggcuu

SEQ ID NO: 3818046 - RNA, 14 nt, Shigella flexneri 2a str. 2457T
cagcacgucuucca

SEQ ID NO: 3818047 - RNA, 20 nt, Shigella flexneri 2a str. 2457T
cagcacgucuuccauugccg

SEQ ID NO: 3818048 - RNA, 15 nt, Shigella flexneri 2a str. 2457T
cagcacguugaacug

SEQ ID NO: 3818049 - RNA, 17 nt, Shigella flexneri 2a str. 2457T
cagcacuccugccacca

SEQ ID NO: 3818050 - RNA, 15 nt, Shigella flexneri 2a str. 2457T
cagcacugcuuaaau

SEQ ID NO: 3818051 - RNA, 22 nt, Shigella flexneri 2a str. 2457T
cagcacuuaucucuuccgcauu

SEQ ID NO: 3818052 - RNA, 15 nt, Shigella flexneri 2a str. 2457T
cagcacuuccagcuc

SEQ ID NO: 3818053 - RNA, 19 nt, Shigella flexneri 2a str. 2457T
cagcagaaccgccaucaug

SEQ ID NO: 3818054 - RNA, 11 nt, Shigella flexneri 2a str. 2457T
cagcagaccag

SEQ ID NO: 3818055 - RNA, 14 nt, Shigella flexneri 2a str. 2457T
cagcagaccagcaa

SEQ ID NO: 3818056 - RNA, 15 nt, Shigella flexneri 2a str. 2457T
cagcagaccagcaaa

SEQ ID NO: 3818057 - RNA, 16 nt, Shigella flexneri 2a str. 2457T
cagcagaccagcaaaa

SEQ ID NO: 3818058 - RNA, 17 nt, Shigella flexneri 2a str. 2457T
cagcagaccuucugcca

SEQ ID NO: 3818059 - RNA, 16 nt, Shigella flexneri 2a str. 2457T
cagcagacugauaucc

SEQ ID NO: 3818060 - RNA, 18 nt, Shigella flexneri 2a str. 2457T
cagcagagcaaucaccag

SEQ ID NO: 3818061 - RNA, 23 nt, Shigella flexneri 2a str. 2457T
cagcagauaucccgccagcacca

SEQ ID NO: 3818062 - RNA, 15 nt, Shigella flexneri 2a str. 2457T
cagcagcaccaccgc

SEQ ID NO: 3818063 - RNA, 14 nt, Shigella flexneri 2a str. 2457T
cagcagcagcaaga

SEQ ID NO: 3818064 - RNA, 23 nt, Shigella flexneri 2a str. 2457T
cagcagccacaccaaucaacaau

SEQ ID NO: 3818065 - RNA, 22 nt, Shigella flexneri 2a str. 2457T
cagcagcccugccggaacgugc

SEQ ID NO: 3818066 - RNA, 19 nt, Shigella flexneri 2a str. 2457T
cagcagccgcgcuuucuuc

SEQ ID NO: 3818067 - RNA, 22 nt, Shigella flexneri 2a str. 2457T
cagcagccgcgcuuucuucuuc

SEQ ID NO: 3818068 - RNA, 18 nt, Shigella flexneri 2a str. 2457T
cagcagcugcguggcgcu

SEQ ID NO: 3818069 - RNA, 17 nt, Shigella flexneri 2a str. 2457T
cagcaggaucuccagcu

SEQ ID NO: 3818070 - RNA, 23 nt, Shigella flexneri 2a str. 2457T
cagcaggcgaugaaaaaccguau

SEQ ID NO: 3818071 - RNA, 15 nt, Shigella flexneri 2a str. 2457T
cagcaggcucagaag

SEQ ID NO: 3818072 - RNA, 19 nt, Shigella flexneri 2a str. 2457T
cagcagggcaaacagcacg

SEQ ID NO: 3818073 - RNA, 13 nt, Shigella flexneri 2a str. 2457T
cagcagggccuga

SEQ ID NO: 3818074 - RNA, 16 nt, Shigella flexneri 2a str. 2457T
cagcagguccccgagc

SEQ ID NO: 3818075 - RNA, 17 nt, Shigella flexneri 2a str. 2457T
cagcaggugcgccagcg

SEQ ID NO: 3818076 - RNA, 16 nt, Shigella flexneri 2a str. 2457T
cagcaguaaaccaccc

SEQ ID NO: 3818077 - RNA, 18 nt, Shigella flexneri 2a str. 2457T
cagcaguaaaccacccac

SEQ ID NO: 3818078 - RNA, 22 nt, Shigella flexneri 2a str. 2457T
cagcaguaaaccacccaccagc

SEQ ID NO: 3818079 - RNA, 15 nt, Shigella flexneri 2a str. 2457T
cagcaguccagcgcg

SEQ ID NO: 3818080 - RNA, 15 nt, Shigella flexneri 2a str. 2457T
cagcagugccgcauc

SEQ ID NO: 3818081 - RNA, 16 nt, Shigella flexneri 2a str. 2457T
cagcaguucacgcagc

SEQ ID NO: 3818082 - RNA, 20 nt, Shigella flexneri 2a str. 2457T
cagcaguucacgcagcuucu

SEQ ID NO: 3818083 - RNA, 17 nt, Shigella flexneri 2a str. 2457T
cagcaguucagcacgag

SEQ ID NO: 3818084 - RNA, 15 nt, Shigella flexneri 2a str. 2457T
cagcaguucagucag

SEQ ID NO: 3818085 - RNA, 18 nt, Shigella flexneri 2a str. 2457T
cagcaguucgcccgcuuc

SEQ ID NO: 3818086 - RNA, 19 nt, Shigella flexneri 2a str. 2457T
cagcaguucgcccgcuuca

SEQ ID NO: 3818087 - RNA, 14 nt, Shigella flexneri 2a str. 2457T
cagcaguucugcca

SEQ ID NO: 3818088 - RNA, 15 nt, Shigella flexneri 2a str. 2457T
cagcaguugccaguc

SEQ ID NO: 3818089 - RNA, 18 nt, Shigella flexneri 2a str. 2457T
cagcauaaucaccaguac

SEQ ID NO: 3818090 - RNA, 16 nt, Shigella flexneri 2a str. 2457T
cagcauaaucaccauc

SEQ ID NO: 3818091 - RNA, 19 nt, Shigella flexneri 2a str. 2457T
cagcauaaucaccaucagc

SEQ ID NO: 3818092 - RNA, 17 nt, Shigella flexneri 2a str. 2457T
cagcauaccgccgagga

SEQ ID NO: 3818093 - RNA, 15 nt, Shigella flexneri 2a str. 2457T
cagcauaccuucaca

SEQ ID NO: 3818094 - RNA, 18 nt, Shigella flexneri 2a str. 2457T
cagcauaccuuccagcgc

SEQ ID NO: 3818095 - RNA, 21 nt, Shigella flexneri 2a str. 2457T
cagcauacugauaucauuaaa

SEQ ID NO: 3818096 - RNA, 18 nt, Shigella flexneri 2a str. 2457T
cagcaucauaccuccgca

SEQ ID NO: 3818097 - RNA, 15 nt, Shigella flexneri 2a str. 2457T
cagcaucaugccgcu

SEQ ID NO: 3818098 - RNA, 16 nt, Shigella flexneri 2a str. 2457T
cagcaucccggcagcc

SEQ ID NO: 3818099 - RNA, 15 nt, Shigella flexneri 2a str. 2457T
cagcaucgaccagga

SEQ ID NO: 3818100 - RNA, 18 nt, Shigella flexneri 2a str. 2457T
cagcaucgaccaggauuu

SEQ ID NO: 3818101 - RNA, 14 nt, Shigella flexneri 2a str. 2457T
cagcaucgcucacc

SEQ ID NO: 3818102 - RNA, 16 nt, Shigella flexneri 2a str. 2457T
cagcaucggcagcgcc

SEQ ID NO: 3818103 - RNA, 15 nt, Shigella flexneri 2a str. 2457T
cagcaucgucaucag

SEQ ID NO: 3818104 - RNA, 16 nt, Shigella flexneri 2a str. 2457T
cagcaucgucaucagc

SEQ ID NO: 3818105 - RNA, 15 nt, Shigella flexneri 2a str. 2457T
cagcaucguccgcca

SEQ ID NO: 3818106 - RNA, 20 nt, Shigella flexneri 2a str. 2457T
cagcaucuccugcaacaggu

SEQ ID NO: 3818107 - RNA, 19 nt, Shigella flexneri 2a str. 2457T
cagcaugcacccucaacaa

SEQ ID NO: 3818108 - RNA, 19 nt, Shigella flexneri 2a str. 2457T
cagcaugcacccucaauaa

SEQ ID NO: 3818109 - RNA, 12 nt, Shigella flexneri 2a str. 2457T
cagcauggcaau

SEQ ID NO: 3818110 - RNA, 18 nt, Shigella flexneri 2a str. 2457T
cagcauguguaaccgcuu

SEQ ID NO: 3818111 - RNA, 17 nt, Shigella flexneri 2a str. 2457T
cagcauguucggugcug

SEQ ID NO: 3818112 - RNA, 14 nt, Shigella flexneri 2a str. 2457T
cagcauguuuauau

SEQ ID NO: 3818113 - RNA, 22 nt, Shigella flexneri 2a str. 2457T
cagcauuacccagauaauagcg

SEQ ID NO: 3818114 - RNA, 18 nt, Shigella flexneri 2a str. 2457T
cagcauuauuuuuaaaca

SEQ ID NO: 3818115 - RNA, 23 nt, Shigella flexneri 2a str. 2457T
cagcauuauuuuuaaacaucaaa

SEQ ID NO: 3818116 - RNA, 16 nt, Shigella flexneri 2a str. 2457T
cagcauuccagauacg

SEQ ID NO: 3818117 - RNA, 20 nt, Shigella flexneri 2a str. 2457T
cagcauuccagauacgaccg

SEQ ID NO: 3818118 - RNA, 19 nt, Shigella flexneri 2a str. 2457T
cagcauucccgccagcggc

SEQ ID NO: 3818119 - RNA, 22 nt, Shigella flexneri 2a str. 2457T
cagcauugcucaccgccagcau

SEQ ID NO: 3818120 - RNA, 23 nt, Shigella flexneri 2a str. 2457T
cagcauugcucaccgccagcauc

SEQ ID NO: 3818121 - RNA, 21 nt, Shigella flexneri 2a str. 2457T
cagcauugucucccacaugcu

SEQ ID NO: 3818122 - RNA, 14 nt, Shigella flexneri 2a str. 2457T
cagcauuuaagcau

SEQ ID NO: 3818123 - RNA, 23 nt, Shigella flexneri 2a str. 2457T
cagcauuucucuacgcccucgau

SEQ ID NO: 3818124 - RNA, 12 nt, Shigella flexneri 2a str. 2457T
cagcauuucuuc

SEQ ID NO: 3818125 - RNA, 21 nt, Shigella flexneri 2a str. 2457T
cagccaaaucccgugaugcgg

SEQ ID NO: 3818126 - RNA, 15 nt, Shigella flexneri 2a str. 2457T
cagccaagcauguca

SEQ ID NO: 3818127 - RNA, 14 nt, Shigella flexneri 2a str. 2457T
cagccaaugcaacg

SEQ ID NO: 3818128 - RNA, 18 nt, Shigella flexneri 2a str. 2457T
cagccacacaccgcaaac

SEQ ID NO: 3818129 - RNA, 16 nt, Shigella flexneri 2a str. 2457T
cagccacaccaaucaa

SEQ ID NO: 3818130 - RNA, 14 nt, Shigella flexneri 2a str. 2457T
cagccaccgccagc

SEQ ID NO: 3818131 - RNA, 15 nt, Shigella flexneri 2a str. 2457T
cagccaccgccagcg

SEQ ID NO: 3818132 - RNA, 20 nt, Shigella flexneri 2a str. 2457T
cagccacgcgaaugugcguu

SEQ ID NO: 3818133 - RNA, 15 nt, Shigella flexneri 2a str. 2457T
cagccacuccacugg

SEQ ID NO: 3818134 - RNA, 17 nt, Shigella flexneri 2a str. 2457T
cagccacucggacaccu

SEQ ID NO: 3818135 - RNA, 22 nt, Shigella flexneri 2a str. 2457T
cagccacuuccugcucgguaaa

SEQ ID NO: 3818136 - RNA, 15 nt, Shigella flexneri 2a str. 2457T
cagccacuucuucca

SEQ ID NO: 3818137 - RNA, 17 nt, Shigella flexneri 2a str. 2457T
cagccacuucuuccagc

SEQ ID NO: 3818138 - RNA, 15 nt, Shigella flexneri 2a str. 2457T
cagccagacgccagc

SEQ ID NO: 3818139 - RNA, 15 nt, Shigella flexneri 2a str. 2457T
cagccagagccacca

SEQ ID NO: 3818140 - RNA, 20 nt, Shigella flexneri 2a str. 2457T
cagccagagccaccaacucu

SEQ ID NO: 3818141 - RNA, 14 nt, Shigella flexneri 2a str. 2457T
cagccagaugccuu

SEQ ID NO: 3818142 - RNA, 15 nt, Shigella flexneri 2a str. 2457T
cagccagcaccaggc

SEQ ID NO: 3818143 - RNA, 15 nt, Shigella flexneri 2a str. 2457T
cagccagcagaggga

SEQ ID NO: 3818144 - RNA, 15 nt, Shigella flexneri 2a str. 2457T
cagccagcagcgaau

SEQ ID NO: 3818145 - RNA, 17 nt, Shigella flexneri 2a str. 2457T
cagccagcagcgaauca

SEQ ID NO: 3818146 - RNA, 19 nt, Shigella flexneri 2a str. 2457T
cagccagcgucgcacccgg

SEQ ID NO: 3818147 - RNA, 14 nt, Shigella flexneri 2a str. 2457T
cagccaggccgcca

SEQ ID NO: 3818148 - RNA, 16 nt, Shigella flexneri 2a str. 2457T
cagccaggcgcgaaug

SEQ ID NO: 3818149 - RNA, 14 nt, Shigella flexneri 2a str. 2457T
cagccagguuuugu

SEQ ID NO: 3818150 - RNA, 20 nt, Shigella flexneri 2a str. 2457T
cagccagucggaaccggcga

SEQ ID NO: 3818151 - RNA, 14 nt, Shigella flexneri 2a str. 2457T
cagccaguugaucu

SEQ ID NO: 3818152 - RNA, 16 nt, Shigella flexneri 2a str. 2457T
cagccaguuuuucagc

SEQ ID NO: 3818153 - RNA, 21 nt, Shigella flexneri 2a str. 2457T
cagccaguuuuucagcgccag

SEQ ID NO: 3818154 - RNA, 22 nt, Shigella flexneri 2a str. 2457T
cagccauaaagaaaucaccugc

SEQ ID NO: 3818155 - RNA, 21 nt, Shigella flexneri 2a str. 2457T
cagccauaaucacucuucccc

SEQ ID NO: 3818156 - RNA, 19 nt, Shigella flexneri 2a str. 2457T
cagccauaccgggaucagg

SEQ ID NO: 3818157 - RNA, 12 nt, Shigella flexneri 2a str. 2457T
cagccaucaucc

SEQ ID NO: 3818158 - RNA, 15 nt, Shigella flexneri 2a str. 2457T
cagccaucauccauu

SEQ ID NO: 3818159 - RNA, 11 nt, Shigella flexneri 2a str. 2457T
cagccaucuga

SEQ ID NO: 3818160 - RNA, 18 nt, Shigella flexneri 2a str. 2457T
cagccaugcgaaugccaa

SEQ ID NO: 3818161 - RNA, 17 nt, Shigella flexneri 2a str. 2457T
cagccaugcggcaucuu

SEQ ID NO: 3818162 - RNA, 21 nt, Shigella flexneri 2a str. 2457T
cagccauuaaccagccacugc

SEQ ID NO: 3818163 - RNA, 22 nt, Shigella flexneri 2a str. 2457T
cagccauucaaucuucgacagc

SEQ ID NO: 3818164 - RNA, 20 nt, Shigella flexneri 2a str. 2457T
cagccauucgaugguuuuau

SEQ ID NO: 3818165 - RNA, 13 nt, Shigella flexneri 2a str. 2457T
cagccauugccau

SEQ ID NO: 3818166 - RNA, 20 nt, Shigella flexneri 2a str. 2457T
cagccauugcuaccgcuucg

SEQ ID NO: 3818167 - RNA, 23 nt, Shigella flexneri 2a str. 2457T
cagccauugugaccuuugacuca

SEQ ID NO: 3818168 - RNA, 12 nt, Shigella flexneri 2a str. 2457T
cagcccaaagca

SEQ ID NO: 3818169 - RNA, 20 nt, Shigella flexneri 2a str. 2457T
cagcccaaagcagaguugcu

SEQ ID NO: 3818170 - RNA, 14 nt, Shigella flexneri 2a str. 2457T
cagcccaaucaucg

SEQ ID NO: 3818171 - RNA, 12 nt, Shigella flexneri 2a str. 2457T
cagcccagcccu

SEQ ID NO: 3818172 - RNA, 18 nt, Shigella flexneri 2a str. 2457T
cagcccagcccugaacca

SEQ ID NO: 3818173 - RNA, 18 nt, Shigella flexneri 2a str. 2457T
cagcccagcggaaauuac

SEQ ID NO: 3818174 - RNA, 12 nt, Shigella flexneri 2a str. 2457T
cagcccaugaau

SEQ ID NO: 3818175 - RNA, 14 nt, Shigella flexneri 2a str. 2457T
cagccccacagcag

SEQ ID NO: 3818176 - RNA, 21 nt, Shigella flexneri 2a str. 2457T
cagccccagaauucacgcacu

SEQ ID NO: 3818177 - RNA, 16 nt, Shigella flexneri 2a str. 2457T
cagccccagagccuga

SEQ ID NO: 3818178 - RNA, 17 nt, Shigella flexneri 2a str. 2457T
cagccccagagccugaa

SEQ ID NO: 3818179 - RNA, 12 nt, Shigella flexneri 2a str. 2457T
cagccccagcac

SEQ ID NO: 3818180 - RNA, 13 nt, Shigella flexneri 2a str. 2457T
cagccccagcacu

SEQ ID NO: 3818181 - RNA, 16 nt, Shigella flexneri 2a str. 2457T
cagccccagcgucagc

SEQ ID NO: 3818182 - RNA, 16 nt, Shigella flexneri 2a str. 2457T
cagccccaggauugau

SEQ ID NO: 3818183 - RNA, 20 nt, Shigella flexneri 2a str. 2457T
cagccccgccgggaucugga

SEQ ID NO: 3818184 - RNA, 15 nt, Shigella flexneri 2a str. 2457T
cagccccgcgcggcg

SEQ ID NO: 3818185 - RNA, 14 nt, Shigella flexneri 2a str. 2457T
cagccccgguuuuu

SEQ ID NO: 3818186 - RNA, 15 nt, Shigella flexneri 2a str. 2457T
cagcccgagguuauu

SEQ ID NO: 3818187 - RNA, 13 nt, Shigella flexneri 2a str. 2457T
cagcccggcaacg

SEQ ID NO: 3818188 - RNA, 12 nt, Shigella flexneri 2a str. 2457T
cagcccggcaau

SEQ ID NO: 3818189 - RNA, 14 nt, Shigella flexneri 2a str. 2457T
cagcccggcaaugg

SEQ ID NO: 3818190 - RNA, 14 nt, Shigella flexneri 2a str. 2457T
cagcccgucucagc

SEQ ID NO: 3818191 - RNA, 13 nt, Shigella flexneri 2a str. 2457T
cagcccugccagg

SEQ ID NO: 3818192 - RNA, 14 nt, Shigella flexneri 2a str. 2457T
cagcccugccaggu

SEQ ID NO: 3818193 - RNA, 21 nt, Shigella flexneri 2a str. 2457T
cagcccugccaggucaucauu

SEQ ID NO: 3818194 - RNA, 19 nt, Shigella flexneri 2a str. 2457T
cagcccuucuuucacuuca

SEQ ID NO: 3818195 - RNA, 16 nt, Shigella flexneri 2a str. 2457T
cagccgaccgcugucc

SEQ ID NO: 3818196 - RNA, 17 nt, Shigella flexneri 2a str. 2457T
cagccgagguagaaccc

SEQ ID NO: 3818197 - RNA, 14 nt, Shigella flexneri 2a str. 2457T
cagccgaucauugg

SEQ ID NO: 3818198 - RNA, 19 nt, Shigella flexneri 2a str. 2457T
cagccgcaaaccuggcaac

SEQ ID NO: 3818199 - RNA, 19 nt, Shigella flexneri 2a str. 2457T
cagccgcacaccugcauuc

SEQ ID NO: 3818200 - RNA, 22 nt, Shigella flexneri 2a str. 2457T
cagccgcauuuuuucuucaguu

SEQ ID NO: 3818201 - RNA, 13 nt, Shigella flexneri 2a str. 2457T
cagccgccagaca

SEQ ID NO: 3818202 - RNA, 13 nt, Shigella flexneri 2a str. 2457T
cagccgcgcgcuu

SEQ ID NO: 3818203 - RNA, 23 nt, Shigella flexneri 2a str. 2457T
cagccgcgcgcuucugguuauau

SEQ ID NO: 3818204 - RNA, 15 nt, Shigella flexneri 2a str. 2457T
cagccgcuaccagcg

SEQ ID NO: 3818205 - RNA, 20 nt, Shigella flexneri 2a str. 2457T
cagccgcuaccagcgcggca

SEQ ID NO: 3818206 - RNA, 18 nt, Shigella flexneri 2a str. 2457T
cagccgcuuuugcgcgua

SEQ ID NO: 3818207 - RNA, 20 nt, Shigella flexneri 2a str. 2457T
cagccggagguguucauaau

SEQ ID NO: 3818208 - RNA, 14 nt, Shigella flexneri 2a str. 2457T
cagccuacagaagu

SEQ ID NO: 3818209 - RNA, 15 nt, Shigella flexneri 2a str. 2457T
cagccuaccagaccg

SEQ ID NO: 3818210 - RNA, 21 nt, Shigella flexneri 2a str. 2457T
cagccucaagcacccgccgcu

SEQ ID NO: 3818211 - RNA, 16 nt, Shigella flexneri 2a str. 2457T
cagccucccagccauu

SEQ ID NO: 3818212 - RNA, 23 nt, Shigella flexneri 2a str. 2457T
cagccucgcuggucagcgccagu

SEQ ID NO: 3818213 - RNA, 19 nt, Shigella flexneri 2a str. 2457T
cagccugacagcacgcccc

SEQ ID NO: 3818214 - RNA, 16 nt, Shigella flexneri 2a str. 2457T
cagccugaccgcacac

SEQ ID NO: 3818215 - RNA, 21 nt, Shigella flexneri 2a str. 2457T
cagccugaccgcacaccccgg

SEQ ID NO: 3818216 - RNA, 15 nt, Shigella flexneri 2a str. 2457T
cagccugcaaacgcu

SEQ ID NO: 3818217 - RNA, 18 nt, Shigella flexneri 2a str. 2457T
cagccugcaaacgcuggu

SEQ ID NO: 3818218 - RNA, 15 nt, Shigella flexneri 2a str. 2457T
cagccugcacgaccg

SEQ ID NO: 3818219 - RNA, 15 nt, Shigella flexneri 2a str. 2457T
cagccugcgcuucuu

SEQ ID NO: 3818220 - RNA, 21 nt, Shigella flexneri 2a str. 2457T
cagccugggucgccaucguua

SEQ ID NO: 3818221 - RNA, 17 nt, Shigella flexneri 2a str. 2457T
cagccugugccugagcc

SEQ ID NO: 3818222 - RNA, 19 nt, Shigella flexneri 2a str. 2457T
cagccuguuccagacgcug

SEQ ID NO: 3818223 - RNA, 14 nt, Shigella flexneri 2a str. 2457T
cagccuuaaacuca

SEQ ID NO: 3818224 - RNA, 15 nt, Shigella flexneri 2a str. 2457T
cagccuuaccggaga

SEQ ID NO: 3818225 - RNA, 19 nt, Shigella flexneri 2a str. 2457T
cagccuucauucaggcauu

SEQ ID NO: 3818226 - RNA, 14 nt, Shigella flexneri 2a str. 2457T
cagccuuucucaga

SEQ ID NO: 3818227 - RNA, 18 nt, Shigella flexneri 2a str. 2457T
cagccuuucucagagacu

SEQ ID NO: 3818228 - RNA, 23 nt, Shigella flexneri 2a str. 2457T
cagcgaacaccagcaguaaacca

SEQ ID NO: 3818229 - RNA, 18 nt, Shigella flexneri 2a str. 2457T
cagcgaacaggaccuuga

SEQ ID NO: 3818230 - RNA, 17 nt, Shigella flexneri 2a str. 2457T
cagcgaagcccacgccg

SEQ ID NO: 3818231 - RNA, 22 nt, Shigella flexneri 2a str. 2457T
cagcgaagcccacgccgcccag

SEQ ID NO: 3818232 - RNA, 21 nt, Shigella flexneri 2a str. 2457T
cagcgaaucagcccagcccug

SEQ ID NO: 3818233 - RNA, 14 nt, Shigella flexneri 2a str. 2457T
cagcgaauccagca

SEQ ID NO: 3818234 - RNA, 14 nt, Shigella flexneri 2a str. 2457T
cagcgacaccagcc

SEQ ID NO: 3818235 - RNA, 17 nt, Shigella flexneri 2a str. 2457T
cagcgacaccagccauc

SEQ ID NO: 3818236 - RNA, 24 nt, Shigella flexneri 2a str. 2457T
cagcgacggaugacacgcaggcgu

SEQ ID NO: 3818237 - RNA, 18 nt, Shigella flexneri 2a str. 2457T
cagcgacguugauuuugu

SEQ ID NO: 3818238 - RNA, 13 nt, Shigella flexneri 2a str. 2457T
cagcgagauaacg

SEQ ID NO: 3818239 - RNA, 17 nt, Shigella flexneri 2a str. 2457T
cagcgagcuggcgcuga

SEQ ID NO: 3818240 - RNA, 17 nt, Shigella flexneri 2a str. 2457T
cagcgaguucaggcgcu

SEQ ID NO: 3818241 - RNA, 15 nt, Shigella flexneri 2a str. 2457T
cagcgaguuugaucu

SEQ ID NO: 3818242 - RNA, 20 nt, Shigella flexneri 2a str. 2457T
cagcgaguuuuucaguccac

SEQ ID NO: 3818243 - RNA, 21 nt, Shigella flexneri 2a str. 2457T
cagcgauaaugaaugaugcgg

SEQ ID NO: 3818244 - RNA, 20 nt, Shigella flexneri 2a str. 2457T
cagcgauauccagcgauacc

SEQ ID NO: 3818245 - RNA, 13 nt, Shigella flexneri 2a str. 2457T
cagcgaucgcuuu

SEQ ID NO: 3818246 - RNA, 23 nt, Shigella flexneri 2a str. 2457T
cagcgauuaccauuucaccguca

SEQ ID NO: 3818247 - RNA, 20 nt, Shigella flexneri 2a str. 2457T
cagcgauuacuguacagauc

SEQ ID NO: 3818248 - RNA, 16 nt, Shigella flexneri 2a str. 2457T
cagcgauuuaucggca

SEQ ID NO: 3818249 - RNA, 15 nt, Shigella flexneri 2a str. 2457T
cagcgcaaucaccgg

SEQ ID NO: 3818250 - RNA, 17 nt, Shigella flexneri 2a str. 2457T
cagcgcaauucgcgucg

SEQ ID NO: 3818251 - RNA, 14 nt, Shigella flexneri 2a str. 2457T
cagcgcaccagaaa

SEQ ID NO: 3818252 - RNA, 16 nt, Shigella flexneri 2a str. 2457T
cagcgcaccagaaaca

SEQ ID NO: 3818253 - RNA, 23 nt, Shigella flexneri 2a str. 2457T
cagcgcaccugugguagcggcuc

SEQ ID NO: 3818254 - RNA, 19 nt, Shigella flexneri 2a str. 2457T
cagcgcacgggcgguuaau

SEQ ID NO: 3818255 - RNA, 13 nt, Shigella flexneri 2a str. 2457T
cagcgcagcaccc

SEQ ID NO: 3818256 - RNA, 12 nt, Shigella flexneri 2a str. 2457T
cagcgcaggaaa

SEQ ID NO: 3818257 - RNA, 19 nt, Shigella flexneri 2a str. 2457T
cagcgcauagcuaaucccc

SEQ ID NO: 3818258 - RNA, 18 nt, Shigella flexneri 2a str. 2457T
cagcgcauccauuacauc

SEQ ID NO: 3818259 - RNA, 19 nt, Shigella flexneri 2a str. 2457T
cagcgcauccauuacauca

SEQ ID NO: 3818260 - RNA, 20 nt, Shigella flexneri 2a str. 2457T
cagcgcauccauuacaucac

SEQ ID NO: 3818261 - RNA, 14 nt, Shigella flexneri 2a str. 2457T
cagcgcauccuggc

SEQ ID NO: 3818262 - RNA, 24 nt, Shigella flexneri 2a str. 2457T
cagcgcauucggcaagauaaaucg

SEQ ID NO: 3818263 - RNA, 15 nt, Shigella flexneri 2a str. 2457T
cagcgcauucguaau

SEQ ID NO: 3818264 - RNA, 20 nt, Shigella flexneri 2a str. 2457T
cagcgcauugcuaaugcugg

SEQ ID NO: 3818265 - RNA, 13 nt, Shigella flexneri 2a str. 2457T
cagcgccaaucgc

SEQ ID NO: 3818266 - RNA, 12 nt, Shigella flexneri 2a str. 2457T
cagcgccaccac

SEQ ID NO: 3818267 - RNA, 16 nt, Shigella flexneri 2a str. 2457T
cagcgccaccacaaaa

SEQ ID NO: 3818268 - RNA, 17 nt, Shigella flexneri 2a str. 2457T
cagcgccaccaccagca

SEQ ID NO: 3818269 - RNA, 18 nt, Shigella flexneri 2a str. 2457T
cagcgccaccagcgccgc

SEQ ID NO: 3818270 - RNA, 16 nt, Shigella flexneri 2a str. 2457T
cagcgccaccgguuua

SEQ ID NO: 3818271 - RNA, 15 nt, Shigella flexneri 2a str. 2457T
cagcgccagacacug

SEQ ID NO: 3818272 - RNA, 23 nt, Shigella flexneri 2a str. 2457T
cagcgccagcgcgaugcaggcca

SEQ ID NO: 3818273 - RNA, 22 nt, Shigella flexneri 2a str. 2457T
cagcgccaggcuuuccgucagc

SEQ ID NO: 3818274 - RNA, 15 nt, Shigella flexneri 2a str. 2457T
cagcgcccaacacuu

SEQ ID NO: 3818275 - RNA, 19 nt, Shigella flexneri 2a str. 2457T
cagcgcccgccagcaccgg

SEQ ID NO: 3818276 - RNA, 23 nt, Shigella flexneri 2a str. 2457T
cagcgcccgcuugcgagacggcg

SEQ ID NO: 3818277 - RNA, 14 nt, Shigella flexneri 2a str. 2457T
cagcgccgcgccua

SEQ ID NO: 3818278 - RNA, 18 nt, Shigella flexneri 2a str. 2457T
cagcgccugacgcggggu

SEQ ID NO: 3818279 - RNA, 12 nt, Shigella flexneri 2a str. 2457T
cagcgccugaua

SEQ ID NO: 3818280 - RNA, 13 nt, Shigella flexneri 2a str. 2457T
cagcgccugauac

SEQ ID NO: 3818281 - RNA, 15 nt, Shigella flexneri 2a str. 2457T
cagcgccugcgcggc

SEQ ID NO: 3818282 - RNA, 16 nt, Shigella flexneri 2a str. 2457T
cagcgccugcgcggca

SEQ ID NO: 3818283 - RNA, 14 nt, Shigella flexneri 2a str. 2457T
cagcgccugcugca

SEQ ID NO: 3818284 - RNA, 18 nt, Shigella flexneri 2a str. 2457T
cagcgccuggcugcaugg

SEQ ID NO: 3818285 - RNA, 19 nt, Shigella flexneri 2a str. 2457T
cagcgccuggcugcauggc

SEQ ID NO: 3818286 - RNA, 12 nt, Shigella flexneri 2a str. 2457T
cagcgcgauacg

SEQ ID NO: 3818287 - RNA, 15 nt, Shigella flexneri 2a str. 2457T
cagcgcgcaguugca

SEQ ID NO: 3818288 - RNA, 16 nt, Shigella flexneri 2a str. 2457T
cagcgcgccgucgaug

SEQ ID NO: 3818289 - RNA, 14 nt, Shigella flexneri 2a str. 2457T
cagcgcgcucgcca

SEQ ID NO: 3818290 - RNA, 20 nt, Shigella flexneri 2a str. 2457T
cagcgcggaagggaugaaau

SEQ ID NO: 3818291 - RNA, 17 nt, Shigella flexneri 2a str. 2457T
cagcgcgggcuggcgua

SEQ ID NO: 3818292 - RNA, 20 nt, Shigella flexneri 2a str. 2457T
cagcgcggugauaaccguuu

SEQ ID NO: 3818293 - RNA, 18 nt, Shigella flexneri 2a str. 2457T
cagcgcguucugguaaac

SEQ ID NO: 3818294 - RNA, 15 nt, Shigella flexneri 2a str. 2457T
cagcgcuaccgccga

SEQ ID NO: 3818295 - RNA, 15 nt, Shigella flexneri 2a str. 2457T
cagcgcugacgugau

SEQ ID NO: 3818296 - RNA, 14 nt, Shigella flexneri 2a str. 2457T
cagcgcuucagcga

SEQ ID NO: 3818297 - RNA, 23 nt, Shigella flexneri 2a str. 2457T
cagcggaaauuaccgcaccacca

SEQ ID NO: 3818298 - RNA, 23 nt, Shigella flexneri 2a str. 2457T
cagcggaaccgcuguugucugaa

SEQ ID NO: 3818299 - RNA, 19 nt, Shigella flexneri 2a str. 2457T
cagcggacaaugccuaccg

SEQ ID NO: 3818300 - RNA, 14 nt, Shigella flexneri 2a str. 2457T
cagcggacagccau

SEQ ID NO: 3818301 - RNA, 14 nt, Shigella flexneri 2a str. 2457T
cagcggacgcugcu

SEQ ID NO: 3818302 - RNA, 20 nt, Shigella flexneri 2a str. 2457T
cagcggauaaagcagagcag

SEQ ID NO: 3818303 - RNA, 17 nt, Shigella flexneri 2a str. 2457T
cagcggauacaggaagc

SEQ ID NO: 3818304 - RNA, 16 nt, Shigella flexneri 2a str. 2457T
cagcggaucgaacucc

SEQ ID NO: 3818305 - RNA, 14 nt, Shigella flexneri 2a str. 2457T
cagcggaugaccca

SEQ ID NO: 3818306 - RNA, 15 nt, Shigella flexneri 2a str. 2457T
cagcggaugacccag

SEQ ID NO: 3818307 - RNA, 23 nt, Shigella flexneri 2a str. 2457T
cagcggcagaucaaauucaauga

SEQ ID NO: 3818308 - RNA, 16 nt, Shigella flexneri 2a str. 2457T
cagcggcaguaaauau

SEQ ID NO: 3818309 - RNA, 18 nt, Shigella flexneri 2a str. 2457T
cagcggcauuacgcgccc

SEQ ID NO: 3818310 - RNA, 21 nt, Shigella flexneri 2a str. 2457T
cagcggcauuacgcgccccuu

SEQ ID NO: 3818311 - RNA, 14 nt, Shigella flexneri 2a str. 2457T
cagcggccagccau

SEQ ID NO: 3818312 - RNA, 23 nt, Shigella flexneri 2a str. 2457T
cagcggcccggagacgccgaggg

SEQ ID NO: 3818313 - RNA, 15 nt, Shigella flexneri 2a str. 2457T
cagcggcggcaaaau

SEQ ID NO: 3818314 - RNA, 15 nt, Shigella flexneri 2a str. 2457T
cagcggcuccuggcg

SEQ ID NO: 3818315 - RNA, 21 nt, Shigella flexneri 2a str. 2457T
cagcgggcgaaucaacuccag

SEQ ID NO: 3818316 - RNA, 21 nt, Shigella flexneri 2a str. 2457T
cagcgggguucuccugagaau

SEQ ID NO: 3818317 - RNA, 14 nt, Shigella flexneri 2a str. 2457T
cagcggucacaugu

SEQ ID NO: 3818318 - RNA, 18 nt, Shigella flexneri 2a str. 2457T
cagcggugccgcgauacc

SEQ ID NO: 3818319 - RNA, 15 nt, Shigella flexneri 2a str. 2457T
cagcgguugagagaa

SEQ ID NO: 3818320 - RNA, 19 nt, Shigella flexneri 2a str. 2457T
cagcgguugggcaucggca

SEQ ID NO: 3818321 - RNA, 16 nt, Shigella flexneri 2a str. 2457T
cagcgguuuacccugc

SEQ ID NO: 3818322 - RNA, 18 nt, Shigella flexneri 2a str. 2457T
cagcgguuucacaggaaa

SEQ ID NO: 3818323 - RNA, 18 nt, Shigella flexneri 2a str. 2457T
cagcgguuuugccagcga

SEQ ID NO: 3818324 - RNA, 22 nt, Shigella flexneri 2a str. 2457T
cagcguaaaggcggcagaacag

SEQ ID NO: 3818325 - RNA, 14 nt, Shigella flexneri 2a str. 2457T
cagcguaacggcuc

SEQ ID NO: 3818326 - RNA, 21 nt, Shigella flexneri 2a str. 2457T
cagcguaauaaccaacggcga

SEQ ID NO: 3818327 - RNA, 17 nt, Shigella flexneri 2a str. 2457T
cagcguacaauagccac

SEQ ID NO: 3818328 - RNA, 19 nt, Shigella flexneri 2a str. 2457T
cagcguaccaugauccugc

SEQ ID NO: 3818329 - RNA, 20 nt, Shigella flexneri 2a str. 2457T
cagcguaccaugauccugca

SEQ ID NO: 3818330 - RNA, 17 nt, Shigella flexneri 2a str. 2457T
cagcguaucccagugcg

SEQ ID NO: 3818331 - RNA, 14 nt, Shigella flexneri 2a str. 2457T
cagcgucacaucag

SEQ ID NO: 3818332 - RNA, 14 nt, Shigella flexneri 2a str. 2457T
cagcgucagaaaca

SEQ ID NO: 3818333 - RNA, 14 nt, Shigella flexneri 2a str. 2457T
cagcgucagcacca

SEQ ID NO: 3818334 - RNA, 16 nt, Shigella flexneri 2a str. 2457T
cagcgucagccagaaa

SEQ ID NO: 3818335 - RNA, 14 nt, Shigella flexneri 2a str. 2457T
cagcgucauuguca

SEQ ID NO: 3818336 - RNA, 16 nt, Shigella flexneri 2a str. 2457T
cagcguccagcccucc

SEQ ID NO: 3818337 - RNA, 21 nt, Shigella flexneri 2a str. 2457T
cagcgucgcaucaggcaaugu

SEQ ID NO: 3818338 - RNA, 15 nt, Shigella flexneri 2a str. 2457T
cagcgucgcaucugg

SEQ ID NO: 3818339 - RNA, 17 nt, Shigella flexneri 2a str. 2457T
cagcgucgcaucuggca

SEQ ID NO: 3818340 - RNA, 20 nt, Shigella flexneri 2a str. 2457T
cagcgucggcgucaucgaca

SEQ ID NO: 3818341 - RNA, 15 nt, Shigella flexneri 2a str. 2457T
cagcgugaacugggc

SEQ ID NO: 3818342 - RNA, 14 nt, Shigella flexneri 2a str. 2457T
cagcgugauccacc

SEQ ID NO: 3818343 - RNA, 22 nt, Shigella flexneri 2a str. 2457T
cagcguuaaugauaucccugcu

SEQ ID NO: 3818344 - RNA, 19 nt, Shigella flexneri 2a str. 2457T
cagcguuaucccaucccac

SEQ ID NO: 3818345 - RNA, 14 nt, Shigella flexneri 2a str. 2457T
cagcguuccccaga

SEQ ID NO: 3818346 - RNA, 21 nt, Shigella flexneri 2a str. 2457T
cagcguuccggcguccaccug

SEQ ID NO: 3818347 - RNA, 18 nt, Shigella flexneri 2a str. 2457T
cagcguucgccaaaccca

SEQ ID NO: 3818348 - RNA, 20 nt, Shigella flexneri 2a str. 2457T
cagcguuuccagcaccaguu

SEQ ID NO: 3818349 - RNA, 21 nt, Shigella flexneri 2a str. 2457T
cagcguuuccagcaccaguuc

SEQ ID NO: 3818350 - RNA, 22 nt, Shigella flexneri 2a str. 2457T
cagcuaucguuauccauauggc

SEQ ID NO: 3818351 - RNA, 19 nt, Shigella flexneri 2a str. 2457T
cagcuauucuuauaaagaa

SEQ ID NO: 3818352 - RNA, 17 nt, Shigella flexneri 2a str. 2457T
cagcucacaaauacgcu

SEQ ID NO: 3818353 - RNA, 17 nt, Shigella flexneri 2a str. 2457T
cagcucauauuccugca

SEQ ID NO: 3818354 - RNA, 23 nt, Shigella flexneri 2a str. 2457T
cagcucauauuccugcauugcuu

SEQ ID NO: 3818355 - RNA, 15 nt, Shigella flexneri 2a str. 2457T
cagcucaucaagcug

SEQ ID NO: 3818356 - RNA, 22 nt, Shigella flexneri 2a str. 2457T
cagcucaucaagcuguucuucc

SEQ ID NO: 3818357 - RNA, 20 nt, Shigella flexneri 2a str. 2457T
cagcucauccauaaauaccu

SEQ ID NO: 3818358 - RNA, 15 nt, Shigella flexneri 2a str. 2457T
cagcucaugggcuuu

SEQ ID NO: 3818359 - RNA, 15 nt, Shigella flexneri 2a str. 2457T
cagcucauuaaaaau

SEQ ID NO: 3818360 - RNA, 19 nt, Shigella flexneri 2a str. 2457T
cagcuccaccgauuuugag

SEQ ID NO: 3818361 - RNA, 13 nt, Shigella flexneri 2a str. 2457T
cagcuccagcaga

SEQ ID NO: 3818362 - RNA, 16 nt, Shigella flexneri 2a str. 2457T
cagcuccagcagaccc

SEQ ID NO: 3818363 - RNA, 11 nt, Shigella flexneri 2a str. 2457T
cagcuccagcc

SEQ ID NO: 3818364 - RNA, 22 nt, Shigella flexneri 2a str. 2457T
cagcucccacaguuucagcccc

SEQ ID NO: 3818365 - RNA, 13 nt, Shigella flexneri 2a str. 2457T
cagcuccggcacc

SEQ ID NO: 3818366 - RNA, 19 nt, Shigella flexneri 2a str. 2457T
cagcuccgggcucaugcug

SEQ ID NO: 3818367 - RNA, 17 nt, Shigella flexneri 2a str. 2457T
cagcuccguccagccac

SEQ ID NO: 3818368 - RNA, 18 nt, Shigella flexneri 2a str. 2457T
cagcuccucuuucaucuc

SEQ ID NO: 3818369 - RNA, 13 nt, Shigella flexneri 2a str. 2457T
cagcucgcugcca

SEQ ID NO: 3818370 - RNA, 16 nt, Shigella flexneri 2a str. 2457T
cagcucgugcagaaca

SEQ ID NO: 3818371 - RNA, 18 nt, Shigella flexneri 2a str. 2457T
cagcucucagccagcugg

SEQ ID NO: 3818372 - RNA, 19 nt, Shigella flexneri 2a str. 2457T
cagcucucagccagcuggc

SEQ ID NO: 3818373 - RNA, 18 nt, Shigella flexneri 2a str. 2457T
cagcucucgcguuacuac

SEQ ID NO: 3818374 - RNA, 12 nt, Shigella flexneri 2a str. 2457T
cagcucugcugu

SEQ ID NO: 3818375 - RNA, 21 nt, Shigella flexneri 2a str. 2457T
cagcucuuccuucagcucccg

SEQ ID NO: 3818376 - RNA, 17 nt, Shigella flexneri 2a str. 2457T
cagcucuugcagcagcu

SEQ ID NO: 3818377 - RNA, 15 nt, Shigella flexneri 2a str. 2457T
cagcucuugcuccac

SEQ ID NO: 3818378 - RNA, 21 nt, Shigella flexneri 2a str. 2457T
cagcucuugcuccacaagcuc

SEQ ID NO: 3818379 - RNA, 16 nt, Shigella flexneri 2a str. 2457T
ccgcuggcgucugggc

SEQ ID NO: 3818380 - RNA, 15 nt, Shigella flexneri 2a str. 2457T
ccgcugggccgucag

SEQ ID NO: 3818381 - RNA, 13 nt, Shigella flexneri 2a str. 2457T
ccgcuggugcguc

SEQ ID NO: 3818382 - RNA, 16 nt, Shigella flexneri 2a str. 2457T
ccgcuguaauaccagc

SEQ ID NO: 3818383 - RNA, 20 nt, Shigella flexneri 2a str. 2457T
ccgcuguaauaccagccuuc

SEQ ID NO: 3818384 - RNA, 21 nt, Shigella flexneri 2a str. 2457T
ccgcugucgcagcgugcucuc

SEQ ID NO: 3818385 - RNA, 17 nt, Shigella flexneri 2a str. 2457T
ccgcugucuaccagcac

SEQ ID NO: 3818386 - RNA, 16 nt, Shigella flexneri 2a str. 2457T
ccgcuucaaaguucug

SEQ ID NO: 3818387 - RNA, 22 nt, Shigella flexneri 2a str. 2457T
ccgcuucaacgaccgcuuuugu

SEQ ID NO: 3818388 - RNA, 22 nt, Shigella flexneri 2a str. 2457T
ccgcuucaucgguuaaccggca

SEQ ID NO: 3818389 - RNA, 16 nt, Shigella flexneri 2a str. 2457T
ccgcuucaucgugcuc

SEQ ID NO: 3818390 - RNA, 16 nt, Shigella flexneri 2a str. 2457T
ccgcuucauugaccuu

SEQ ID NO: 3818391 - RNA, 13 nt, Shigella flexneri 2a str. 2457T
ccgcuuccagcau

SEQ ID NO: 3818392 - RNA, 19 nt, Shigella flexneri 2a str. 2457T
ccgcuuccagcauuucugg

SEQ ID NO: 3818393 - RNA, 16 nt, Shigella flexneri 2a str. 2457T
ccgcuucgcccgccag

SEQ ID NO: 3818394 - RNA, 15 nt, Shigella flexneri 2a str. 2457T
ccgcuucguuuucag

SEQ ID NO: 3818395 - RNA, 12 nt, Shigella flexneri 2a str. 2457T
ccgcuucugcag

SEQ ID NO: 3818396 - RNA, 14 nt, Shigella flexneri 2a str. 2457T
ccgcuucugcagcu

SEQ ID NO: 3818397 - RNA, 16 nt, Shigella flexneri 2a str. 2457T
ccgcuucugcagcuuu

SEQ ID NO: 3818398 - RNA, 16 nt, Shigella flexneri 2a str. 2457T
ccgcuucugcguucug

SEQ ID NO: 3818399 - RNA, 23 nt, Shigella flexneri 2a str. 2457T
ccgcuucugcuuuggcugccgcc

SEQ ID NO: 3818400 - RNA, 14 nt, Shigella flexneri 2a str. 2457T
ccgcuucuucuuca

SEQ ID NO: 3818401 - RNA, 22 nt, Shigella flexneri 2a str. 2457T
ccgcuugaguauuuaccagaau

SEQ ID NO: 3818402 - RNA, 21 nt, Shigella flexneri 2a str. 2457T
ccgcuugggcagaauauuuga

SEQ ID NO: 3818403 - RNA, 16 nt, Shigella flexneri 2a str. 2457T
ccgcuuuccaggcauc

SEQ ID NO: 3818404 - RNA, 14 nt, Shigella flexneri 2a str. 2457T
ccgcuuuuccagca

SEQ ID NO: 3818405 - RNA, 18 nt, Shigella flexneri 2a str. 2457T
ccggaacaggcagggcca

SEQ ID NO: 3818406 - RNA, 17 nt, Shigella flexneri 2a str. 2457T
ccggaacgggaaacgau

SEQ ID NO: 3818407 - RNA, 22 nt, Shigella flexneri 2a str. 2457T
ccggaacgggagaaacccggcc

SEQ ID NO: 3818408 - RNA, 19 nt, Shigella flexneri 2a str. 2457T
ccggaaggaagacgcagca

SEQ ID NO: 3818409 - RNA, 22 nt, Shigella flexneri 2a str. 2457T
ccggaaggaagacgcagcaugc

SEQ ID NO: 3818410 - RNA, 18 nt, Shigella flexneri 2a str. 2457T
ccggaaguaccaauggca

SEQ ID NO: 3818411 - RNA, 21 nt, Shigella flexneri 2a str. 2457T
ccggaauaaaugucacgucau

SEQ ID NO: 3818412 - RNA, 18 nt, Shigella flexneri 2a str. 2457T
ccggaauaauugcgguuu

SEQ ID NO: 3818413 - RNA, 15 nt, Shigella flexneri 2a str. 2457T
ccggaauagcuuuac

SEQ ID NO: 3818414 - RNA, 21 nt, Shigella flexneri 2a str. 2457T
ccggaauuucuuucagcaguu

SEQ ID NO: 3818415 - RNA, 13 nt, Shigella flexneri 2a str. 2457T
ccggacacugcuu

SEQ ID NO: 3818416 - RNA, 22 nt, Shigella flexneri 2a str. 2457T
ccggacacugcuuacaggcugg

SEQ ID NO: 3818417 - RNA, 16 nt, Shigella flexneri 2a str. 2457T
ccggaccagacgaucg

SEQ ID NO: 3818418 - RNA, 20 nt, Shigella flexneri 2a str. 2457T
ccggacccuggucaguuuca

SEQ ID NO: 3818419 - RNA, 13 nt, Shigella flexneri 2a str. 2457T
ccggaccgucauc

SEQ ID NO: 3818420 - RNA, 19 nt, Shigella flexneri 2a str. 2457T
ccggacguaaugauguaaa

SEQ ID NO: 3818421 - RNA, 15 nt, Shigella flexneri 2a str. 2457T
ccggacugaaaguac

SEQ ID NO: 3818422 - RNA, 21 nt, Shigella flexneri 2a str. 2457T
ccggacuguaaacgaugaugc

SEQ ID NO: 3818423 - RNA, 20 nt, Shigella flexneri 2a str. 2457T
ccggagaagaugcgucagca

SEQ ID NO: 3818424 - RNA, 12 nt, Shigella flexneri 2a str. 2457T
ccggagacgacg

SEQ ID NO: 3818425 - RNA, 23 nt, Shigella flexneri 2a str. 2457T
ccggagcagcagucaggcgcgcg

SEQ ID NO: 3818426 - RNA, 13 nt, Shigella flexneri 2a str. 2457T
ccggagccagccg

SEQ ID NO: 3818427 - RNA, 17 nt, Shigella flexneri 2a str. 2457T
ccggaggcaaguuuccu

SEQ ID NO: 3818428 - RNA, 14 nt, Shigella flexneri 2a str. 2457T
ccggauaaacaaug

SEQ ID NO: 3818429 - RNA, 22 nt, Shigella flexneri 2a str. 2457T
ccggauaaggcauuuacgccgc

SEQ ID NO: 3818430 - RNA, 22 nt, Shigella flexneri 2a str. 2457T
ccggauaaggcguucgcgccgc

SEQ ID NO: 3818431 - RNA, 22 nt, Shigella flexneri 2a str. 2457T
ccggauaaggcguuuacgccgc

SEQ ID NO: 3818432 - RNA, 16 nt, Shigella flexneri 2a str. 2457T
ccggauauccacccgc

SEQ ID NO: 3818433 - RNA, 14 nt, Shigella flexneri 2a str. 2457T
ccggauaucccagc

SEQ ID NO: 3818434 - RNA, 16 nt, Shigella flexneri 2a str. 2457T
ccggauaugcggggau

SEQ ID NO: 3818435 - RNA, 18 nt, Shigella flexneri 2a str. 2457T
ccggaugaaaagucaucc

SEQ ID NO: 3818436 - RNA, 20 nt, Shigella flexneri 2a str. 2457T
ccggaugacacaucaccucc

SEQ ID NO: 3818437 - RNA, 20 nt, Shigella flexneri 2a str. 2457T
ccggaugacguuucgcgcca

SEQ ID NO: 3818438 - RNA, 18 nt, Shigella flexneri 2a str. 2457T
ccggaugaucauccggcu

SEQ ID NO: 3818439 - RNA, 16 nt, Shigella flexneri 2a str. 2457T
ccggaugcaccaucuc

SEQ ID NO: 3818440 - RNA, 19 nt, Shigella flexneri 2a str. 2457T
ccggaugcaugauccggca

SEQ ID NO: 3818441 - RNA, 19 nt, Shigella flexneri 2a str. 2457T
ccggaugcgacauagaucu

SEQ ID NO: 3818442 - RNA, 16 nt, Shigella flexneri 2a str. 2457T
ccggaugcgacgccgg

SEQ ID NO: 3818443 - RNA, 22 nt, Shigella flexneri 2a str. 2457T
ccggaugcggcguaaacgcuuu

SEQ ID NO: 3818444 - RNA, 21 nt, Shigella flexneri 2a str. 2457T
ccggaugcgggugaacgcguu

SEQ ID NO: 3818445 - RNA, 13 nt, Shigella flexneri 2a str. 2457T
ccggauggcagag

SEQ ID NO: 3818446 - RNA, 17 nt, Shigella flexneri 2a str. 2457T
ccggauuuucaccaucg

SEQ ID NO: 3818447 - RNA, 16 nt, Shigella flexneri 2a str. 2457T
ccggcaacaaugccac

SEQ ID NO: 3818448 - RNA, 19 nt, Shigella flexneri 2a str. 2457T
ccggcaacaaugccacgcc

SEQ ID NO: 3818449 - RNA, 16 nt, Shigella flexneri 2a str. 2457T
ccggcaaccacaccca

SEQ ID NO: 3818450 - RNA, 14 nt, Shigella flexneri 2a str. 2457T
ccggcaaccagcac

SEQ ID NO: 3818451 - RNA, 14 nt, Shigella flexneri 2a str. 2457T
ccggcaacguugcc

SEQ ID NO: 3818452 - RNA, 19 nt, Shigella flexneri 2a str. 2457T
ccggcaacguugcccguac

SEQ ID NO: 3818453 - RNA, 13 nt, Shigella flexneri 2a str. 2457T
ccggcaagauucc

SEQ ID NO: 3818454 - RNA, 14 nt, Shigella flexneri 2a str. 2457T
ccggcaagauucca

SEQ ID NO: 3818455 - RNA, 19 nt, Shigella flexneri 2a str. 2457T
ccggcaagauuccagugcc

SEQ ID NO: 3818456 - RNA, 16 nt, Shigella flexneri 2a str. 2457T
ccggcaauaaaacagg

SEQ ID NO: 3818457 - RNA, 23 nt, Shigella flexneri 2a str. 2457T
ccggcaauaaaacagggcggaac

SEQ ID NO: 3818458 - RNA, 15 nt, Shigella flexneri 2a str. 2457T
ccggcaaucgccaga

SEQ ID NO: 3818459 - RNA, 16 nt, Shigella flexneri 2a str. 2457T
ccggcaaucgccagau

SEQ ID NO: 3818460 - RNA, 17 nt, Shigella flexneri 2a str. 2457T
ccggcaaucgccagauc

SEQ ID NO: 3818461 - RNA, 17 nt, Shigella flexneri 2a str. 2457T
ccggcaaucgcgccaga

SEQ ID NO: 3818462 - RNA, 23 nt, Shigella flexneri 2a str. 2457T
ccggcaaucggugcaaaugccag

SEQ ID NO: 3818463 - RNA, 14 nt, Shigella flexneri 2a str. 2457T
ccggcaaucugcug

SEQ ID NO: 3818464 - RNA, 20 nt, Shigella flexneri 2a str. 2457T
ccggcaaucugcuggcaaac

SEQ ID NO: 3818465 - RNA, 23 nt, Shigella flexneri 2a str. 2457T
ccggcaauguuaccgaucgccag

SEQ ID NO: 3818466 - RNA, 21 nt, Shigella flexneri 2a str. 2457T
ccggcaauucucucugauuac

SEQ ID NO: 3818467 - RNA, 22 nt, Shigella flexneri 2a str. 2457T
ccggcaauucucugcuccugau

SEQ ID NO: 3818468 - RNA, 22 nt, Shigella flexneri 2a str. 2457T
ccggcacaaagcuguaucccag

SEQ ID NO: 3818469 - RNA, 18 nt, Shigella flexneri 2a str. 2457T
ccggcacacguaggccaa

SEQ ID NO: 3818470 - RNA, 15 nt, Shigella flexneri 2a str. 2457T
ccggcacauuucacu

SEQ ID NO: 3818471 - RNA, 20 nt, Shigella flexneri 2a str. 2457T
ccggcaccaauguaggccug

SEQ ID NO: 3818472 - RNA, 16 nt, Shigella flexneri 2a str. 2457T
ccggcaccugucagac

SEQ ID NO: 3818473 - RNA, 20 nt, Shigella flexneri 2a str. 2457T
ccggcacguuuuggcagaca

SEQ ID NO: 3818474 - RNA, 14 nt, Shigella flexneri 2a str. 2457T
ccggcacuucaacu

SEQ ID NO: 3818475 - RNA, 16 nt, Shigella flexneri 2a str. 2457T
ccggcagaagcaauca

SEQ ID NO: 3818476 - RNA, 18 nt, Shigella flexneri 2a str. 2457T
ccggcagaagcaaucauc

SEQ ID NO: 3818477 - RNA, 18 nt, Shigella flexneri 2a str. 2457T
ccgccaucucuuccagcg

SEQ ID NO: 3818478 - RNA, 21 nt, Shigella flexneri 2a str. 2457T
ccgccaugcuugaagggcugg

SEQ ID NO: 3818479 - RNA, 14 nt, Shigella flexneri 2a str. 2457T
ccgcccacaccagu

SEQ ID NO: 3818480 - RNA, 13 nt, Shigella flexneri 2a str. 2457T
ccgcccaccacca

SEQ ID NO: 3818481 - RNA, 19 nt, Shigella flexneri 2a str. 2457T
ccgcccagaagcacugcca

SEQ ID NO: 3818482 - RNA, 17 nt, Shigella flexneri 2a str. 2457T
ccgcccagugccagcac

SEQ ID NO: 3818483 - RNA, 14 nt, Shigella flexneri 2a str. 2457T
ccgcccccgacucc

SEQ ID NO: 3818484 - RNA, 18 nt, Shigella flexneri 2a str. 2457T
ccgcccccgggccucccc

SEQ ID NO: 3818485 - RNA, 18 nt, Shigella flexneri 2a str. 2457T
ccgccccggguuuccugg

SEQ ID NO: 3818486 - RNA, 11 nt, Shigella flexneri 2a str. 2457T
ccgccccugca

SEQ ID NO: 3818487 - RNA, 18 nt, Shigella flexneri 2a str. 2457T
ccgcccguuuucuccagc

SEQ ID NO: 3818488 - RNA, 17 nt, Shigella flexneri 2a str. 2457T
ccgccgaggauacagcc

SEQ ID NO: 3818489 - RNA, 18 nt, Shigella flexneri 2a str. 2457T
ccgccgauguugcaugau

SEQ ID NO: 3818490 - RNA, 22 nt, Shigella flexneri 2a str. 2457T
ccgccgauuuccugcgucgcua

SEQ ID NO: 3818491 - RNA, 23 nt, Shigella flexneri 2a str. 2457T
ccgccgauuuccugcgucgcuag

SEQ ID NO: 3818492 - RNA, 14 nt, Shigella flexneri 2a str. 2457T
ccgccgcaauccgc

SEQ ID NO: 3818493 - RNA, 13 nt, Shigella flexneri 2a str. 2457T
ccgccgccgccac

SEQ ID NO: 3818494 - RNA, 12 nt, Shigella flexneri 2a str. 2457T
ccgccgcuccuc

SEQ ID NO: 3818495 - RNA, 16 nt, Shigella flexneri 2a str. 2457T
ccgccgcuucaucggu

SEQ ID NO: 3818496 - RNA, 14 nt, Shigella flexneri 2a str. 2457T
ccgccgcuucgccc

SEQ ID NO: 3818497 - RNA, 23 nt, Shigella flexneri 2a str. 2457T
ccgccgguggcguuuccagcagu

SEQ ID NO: 3818498 - RNA, 17 nt, Shigella flexneri 2a str. 2457T
ccgccguaaaucccgcc

SEQ ID NO: 3818499 - RNA, 14 nt, Shigella flexneri 2a str. 2457T
ccgccguaacuggc

SEQ ID NO: 3818500 - RNA, 20 nt, Shigella flexneri 2a str. 2457T
ccgccguccggcgcugaucu

SEQ ID NO: 3818501 - RNA, 19 nt, Shigella flexneri 2a str. 2457T
ccgccgugcugccagcgau

SEQ ID NO: 3818502 - RNA, 19 nt, Shigella flexneri 2a str. 2457T
ccgccguuaccuucggccc

SEQ ID NO: 3818503 - RNA, 19 nt, Shigella flexneri 2a str. 2457T
ccgccguuagcuucagccg

SEQ ID NO: 3818504 - RNA, 16 nt, Shigella flexneri 2a str. 2457T
ccgccguugccgcagc

SEQ ID NO: 3818505 - RNA, 22 nt, Shigella flexneri 2a str. 2457T
ccgccguugccuuuaccgccac

SEQ ID NO: 3818506 - RNA, 13 nt, Shigella flexneri 2a str. 2457T
ccgccguugcucu

SEQ ID NO: 3818507 - RNA, 14 nt, Shigella flexneri 2a str. 2457T
ccgccguugcucuu

SEQ ID NO: 3818508 - RNA, 19 nt, Shigella flexneri 2a str. 2457T
ccgccucacuauccgcccc

SEQ ID NO: 3818509 - RNA, 13 nt, Shigella flexneri 2a str. 2457T
ccgccucagccag

SEQ ID NO: 3818510 - RNA, 15 nt, Shigella flexneri 2a str. 2457T
ccgccucagccagaa

SEQ ID NO: 3818511 - RNA, 14 nt, Shigella flexneri 2a str. 2457T
ccgccucaggcaac

SEQ ID NO: 3818512 - RNA, 18 nt, Shigella flexneri 2a str. 2457T
ccgccucccuucgcugcu

SEQ ID NO: 3818513 - RNA, 17 nt, Shigella flexneri 2a str. 2457T
ccgccugagccagugcc

SEQ ID NO: 3818514 - RNA, 19 nt, Shigella flexneri 2a str. 2457T
ccgccugauagaccggacc

SEQ ID NO: 3818515 - RNA, 21 nt, Shigella flexneri 2a str. 2457T
ccgccugaugggcgaagagaa

SEQ ID NO: 3818516 - RNA, 23 nt, Shigella flexneri 2a str. 2457T
ccgccuggcgcugcucaggcgag

SEQ ID NO: 3818517 - RNA, 14 nt, Shigella flexneri 2a str. 2457T
ccgccuguuccagc

SEQ ID NO: 3818518 - RNA, 17 nt, Shigella flexneri 2a str. 2457T
ccgccuucugcgguacg

SEQ ID NO: 3818519 - RNA, 16 nt, Shigella flexneri 2a str. 2457T
ccgccuugauauaaau

SEQ ID NO: 3818520 - RNA, 12 nt, Shigella flexneri 2a str. 2457T
ccgccuugcugu

SEQ ID NO: 3818521 - RNA, 19 nt, Shigella flexneri 2a str. 2457T
ccgccuuguuguaaugaca

SEQ ID NO: 3818522 - RNA, 16 nt, Shigella flexneri 2a str. 2457T
ccgccuuucacgccgg

SEQ ID NO: 3818523 - RNA, 19 nt, Shigella flexneri 2a str. 2457T
ccgccuuugaucucaaacg

SEQ ID NO: 3818524 - RNA, 17 nt, Shigella flexneri 2a str. 2457T
ccgcgaaccggaccagc

SEQ ID NO: 3818525 - RNA, 18 nt, Shigella flexneri 2a str. 2457T
ccgcgacgacgacaggca

SEQ ID NO: 3818526 - RNA, 19 nt, Shigella flexneri 2a str. 2457T
ccgcgacgacgacaggcaa

SEQ ID NO: 3818527 - RNA, 20 nt, Shigella flexneri 2a str. 2457T
ccgcgacgacgacaggcaag

SEQ ID NO: 3818528 - RNA, 18 nt, Shigella flexneri 2a str. 2457T
ccgcgacguacugggaaa

SEQ ID NO: 3818529 - RNA, 12 nt, Shigella flexneri 2a str. 2457T
ccgcgacuggga

SEQ ID NO: 3818530 - RNA, 18 nt, Shigella flexneri 2a str. 2457T
ccgcgaguaaucacauca

SEQ ID NO: 3818531 - RNA, 15 nt, Shigella flexneri 2a str. 2457T
ccgcgauagcaagcg

SEQ ID NO: 3818532 - RNA, 14 nt, Shigella flexneri 2a str. 2457T
ccgcgauccagcgc

SEQ ID NO: 3818533 - RNA, 20 nt, Shigella flexneri 2a str. 2457T
ccgcgauccagcgcaauacc

SEQ ID NO: 3818534 - RNA, 21 nt, Shigella flexneri 2a str. 2457T
ccgcgaucgccugcagggcuu

SEQ ID NO: 3818535 - RNA, 16 nt, Shigella flexneri 2a str. 2457T
ccgcgcaauggcuggc

SEQ ID NO: 3818536 - RNA, 21 nt, Shigella flexneri 2a str. 2457T
ccgcgcaguaccacuucaucc

SEQ ID NO: 3818537 - RNA, 11 nt, Shigella flexneri 2a str. 2457T
ccgcgccagcg

SEQ ID NO: 3818538 - RNA, 20 nt, Shigella flexneri 2a str. 2457T
ccgcgcccgugcaucuccug

SEQ ID NO: 3818539 - RNA, 15 nt, Shigella flexneri 2a str. 2457T
ccgcgccgcagccgg

SEQ ID NO: 3818540 - RNA, 23 nt, Shigella flexneri 2a str. 2457T
ccgcgccugaccauuaucaaaca

SEQ ID NO: 3818541 - RNA, 17 nt, Shigella flexneri 2a str. 2457T
ccgcgcggcgcaggcgc

SEQ ID NO: 3818542 - RNA, 21 nt, Shigella flexneri 2a str. 2457T
ccgcgcggcgcaggcgcuugu

SEQ ID NO: 3818543 - RNA, 20 nt, Shigella flexneri 2a str. 2457T
ccgcgcggguaauugcucca

SEQ ID NO: 3818544 - RNA, 23 nt, Shigella flexneri 2a str. 2457T
ccgcgcggguggugcguaccagg

SEQ ID NO: 3818545 - RNA, 20 nt, Shigella flexneri 2a str. 2457T
ccgcgcgguaucaccaccca

SEQ ID NO: 3818546 - RNA, 19 nt, Shigella flexneri 2a str. 2457T
ccgcgcuuucuggcgcaga

SEQ ID NO: 3818547 - RNA, 22 nt, Shigella flexneri 2a str. 2457T
ccgcgggcgaauuaucggcagc

SEQ ID NO: 3818548 - RNA, 18 nt, Shigella flexneri 2a str. 2457T
ccgcgucauugacgcugg

SEQ ID NO: 3818549 - RNA, 20 nt, Shigella flexneri 2a str. 2457T
ccgcgucguugaaaugcggc

SEQ ID NO: 3818550 - RNA, 16 nt, Shigella flexneri 2a str. 2457T
ccgcgugaaaugccaa

SEQ ID NO: 3818551 - RNA, 14 nt, Shigella flexneri 2a str. 2457T
ccgcgugacgcugg

SEQ ID NO: 3818552 - RNA, 13 nt, Shigella flexneri 2a str. 2457T
ccgcgugcgcggc

SEQ ID NO: 3818553 - RNA, 14 nt, Shigella flexneri 2a str. 2457T
ccgcgugcgcggca

SEQ ID NO: 3818554 - RNA, 18 nt, Shigella flexneri 2a str. 2457T
ccgcgugcgcuggacgcc

SEQ ID NO: 3818555 - RNA, 20 nt, Shigella flexneri 2a str. 2457T
ccgcguggacggucaacuga

SEQ ID NO: 3818556 - RNA, 15 nt, Shigella flexneri 2a str. 2457T
ccgcguguuuccggg

SEQ ID NO: 3818557 - RNA, 14 nt, Shigella flexneri 2a str. 2457T
ccgcguugcagcau

SEQ ID NO: 3818558 - RNA, 16 nt, Shigella flexneri 2a str. 2457T
ccgcguugcagcauau

SEQ ID NO: 3818559 - RNA, 19 nt, Shigella flexneri 2a str. 2457T
ccgcguuuguugcgcuaag

SEQ ID NO: 3818560 - RNA, 14 nt, Shigella flexneri 2a str. 2457T
ccgcguuuuccagu

SEQ ID NO: 3818561 - RNA, 19 nt, Shigella flexneri 2a str. 2457T
ccgcuaacagcagcagcgc

SEQ ID NO: 3818562 - RNA, 13 nt, Shigella flexneri 2a str. 2457T
ccgcuacuggcaa

SEQ ID NO: 3818563 - RNA, 23 nt, Shigella flexneri 2a str. 2457T
ccgcuaucguccacgucaucaaa

SEQ ID NO: 3818564 - RNA, 11 nt, Shigella flexneri 2a str. 2457T
ccgcucaaaca

SEQ ID NO: 3818565 - RNA, 20 nt, Shigella flexneri 2a str. 2457T
ccgcucacgaugccgccgag

SEQ ID NO: 3818566 - RNA, 12 nt, Shigella flexneri 2a str. 2457T
ccgcucagcucc

SEQ ID NO: 3818567 - RNA, 12 nt, Shigella flexneri 2a str. 2457T
ccgcucccagca

SEQ ID NO: 3818568 - RNA, 12 nt, Shigella flexneri 2a str. 2457T
ccgcucgcuggu

SEQ ID NO: 3818569 - RNA, 14 nt, Shigella flexneri 2a str. 2457T
ccgcucucaaucuc

SEQ ID NO: 3818570 - RNA, 14 nt, Shigella flexneri 2a str. 2457T
ccgcucucauccau

SEQ ID NO: 3818571 - RNA, 22 nt, Shigella flexneri 2a str. 2457T
ccgcucugcgaucugcgcguca

SEQ ID NO: 3818572 - RNA, 15 nt, Shigella flexneri 2a str. 2457T
ccgcucuuccaggca

SEQ ID NO: 3818573 - RNA, 20 nt, Shigella flexneri 2a str. 2457T
ccgcucuuucaccgccgaga

SEQ ID NO: 3818574 - RNA, 11 nt, Shigella flexneri 2a str. 2457T
ccgcugauuca

SEQ ID NO: 3818575 - RNA, 22 nt, Shigella flexneri 2a str. 2457T
ccgcuggcccaucagaauaucg

SEQ ID NO: 3818576 - RNA, 20 nt, Shigella flexneri 2a str. 2457T
cagcucuuuuccagccauca

SEQ ID NO: 3818577 - RNA, 20 nt, Shigella flexneri 2a str. 2457T
cagcugacaaucgcugcggc

SEQ ID NO: 3818578 - RNA, 14 nt, Shigella flexneri 2a str. 2457T
cagcugaccgccgu

SEQ ID NO: 3818579 - RNA, 18 nt, Shigella flexneri 2a str. 2457T
cagcugaccgguugcugg

SEQ ID NO: 3818580 - RNA, 17 nt, Shigella flexneri 2a str. 2457T
cagcugauccuucuguu

SEQ ID NO: 3818581 - RNA, 18 nt, Shigella flexneri 2a str. 2457T
cagcugccagacccggca

SEQ ID NO: 3818582 - RNA, 18 nt, Shigella flexneri 2a str. 2457T
cagcugccgaaccacuga

SEQ ID NO: 3818583 - RNA, 18 nt, Shigella flexneri 2a str. 2457T
cagcugccgccaggcuuc

SEQ ID NO: 3818584 - RNA, 23 nt, Shigella flexneri 2a str. 2457T
cagcugcgcaucaugccacccag

SEQ ID NO: 3818585 - RNA, 22 nt, Shigella flexneri 2a str. 2457T
cagcugcgcgcgaacugucggu

SEQ ID NO: 3818586 - RNA, 12 nt, Shigella flexneri 2a str. 2457T
cagcugcgugcc

SEQ ID NO: 3818587 - RNA, 20 nt, Shigella flexneri 2a str. 2457T
cagcugcgugccuaauuccg

SEQ ID NO: 3818588 - RNA, 17 nt, Shigella flexneri 2a str. 2457T
cagcugcucauuacagu

SEQ ID NO: 3818589 - RNA, 14 nt, Shigella flexneri 2a str. 2457T
cagcugcucccagc

SEQ ID NO: 3818590 - RNA, 21 nt, Shigella flexneri 2a str. 2457T
cagcugguguaacugcgccag

SEQ ID NO: 3818591 - RNA, 16 nt, Shigella flexneri 2a str. 2457T
cagcugguuauuuucu

SEQ ID NO: 3818592 - RNA, 19 nt, Shigella flexneri 2a str. 2457T
cagcugguugaugcgcccu

SEQ ID NO: 3818593 - RNA, 13 nt, Shigella flexneri 2a str. 2457T
cagcuguuucugc

SEQ ID NO: 3818594 - RNA, 15 nt, Shigella flexneri 2a str. 2457T
cagcuguuucugcuu

SEQ ID NO: 3818595 - RNA, 23 nt, Shigella flexneri 2a str. 2457T
cagcuuacgagugcgcucuucaa

SEQ ID NO: 3818596 - RNA, 13 nt, Shigella flexneri 2a str. 2457T
cagcuuacgcuga

SEQ ID NO: 3818597 - RNA, 19 nt, Shigella flexneri 2a str. 2457T
cagcuuaugccuguccucu

SEQ ID NO: 3818598 - RNA, 22 nt, Shigella flexneri 2a str. 2457T
cagcuuauuagggaucaucuua

SEQ ID NO: 3818599 - RNA, 17 nt, Shigella flexneri 2a str. 2457T
cagcuuauucaccgaua

SEQ ID NO: 3818600 - RNA, 16 nt, Shigella flexneri 2a str. 2457T
cagcuuauuucuguga

SEQ ID NO: 3818601 - RNA, 21 nt, Shigella flexneri 2a str. 2457T
cagcuucaaaucauuacaguu

SEQ ID NO: 3818602 - RNA, 22 nt, Shigella flexneri 2a str. 2457T
cagcuucacaaaggcuugcugc

SEQ ID NO: 3818603 - RNA, 15 nt, Shigella flexneri 2a str. 2457T
cagcuucaccuucca

SEQ ID NO: 3818604 - RNA, 18 nt, Shigella flexneri 2a str. 2457T
cagcuucaccuuccagua

SEQ ID NO: 3818605 - RNA, 19 nt, Shigella flexneri 2a str. 2457T
cagcuucacgcgccagcuu

SEQ ID NO: 3818606 - RNA, 17 nt, Shigella flexneri 2a str. 2457T
cagcuucauaaggaaaa

SEQ ID NO: 3818607 - RNA, 22 nt, Shigella flexneri 2a str. 2457T
cagcuuccaggcaaucagcaau

SEQ ID NO: 3818608 - RNA, 16 nt, Shigella flexneri 2a str. 2457T
cagcuucgaggccgga

SEQ ID NO: 3818609 - RNA, 21 nt, Shigella flexneri 2a str. 2457T
cagcuucgcuucccaacgcag

SEQ ID NO: 3818610 - RNA, 23 nt, Shigella flexneri 2a str. 2457T
cagcuugaucaauaacgccauga

SEQ ID NO: 3818611 - RNA, 16 nt, Shigella flexneri 2a str. 2457T
cagcuugcgauccugc

SEQ ID NO: 3818612 - RNA, 16 nt, Shigella flexneri 2a str. 2457T
cagcuuucaccugcgc

SEQ ID NO: 3818613 - RNA, 18 nt, Shigella flexneri 2a str. 2457T
cagcuuucagcagcggcu

SEQ ID NO: 3818614 - RNA, 19 nt, Shigella flexneri 2a str. 2457T
cagcuuucagcagcggcuc

SEQ ID NO: 3818615 - RNA, 14 nt, Shigella flexneri 2a str. 2457T
cagcuuucccuuca

SEQ ID NO: 3818616 - RNA, 13 nt, Shigella flexneri 2a str. 2457T
cagcuuucgcuua

SEQ ID NO: 3818617 - RNA, 20 nt, Shigella flexneri 2a str. 2457T
cagcuuugcccgaucaucaa

SEQ ID NO: 3818618 - RNA, 13 nt, Shigella flexneri 2a str. 2457T
cagcuuuggugaa

SEQ ID NO: 3818619 - RNA, 14 nt, Shigella flexneri 2a str. 2457T
cagcuuuggugaaa

SEQ ID NO: 3818620 - RNA, 13 nt, Shigella flexneri 2a str. 2457T
cagcuuuuacagc

SEQ ID NO: 3818621 - RNA, 21 nt, Shigella flexneri 2a str. 2457T
cagcuuuuccauaucaagcau

SEQ ID NO: 3818622 - RNA, 13 nt, Shigella flexneri 2a str. 2457T
cagcuuuuuccug

SEQ ID NO: 3818623 - RNA, 15 nt, Shigella flexneri 2a str. 2457T
cagcuuuuuccugcg

SEQ ID NO: 3818624 - RNA, 19 nt, Shigella flexneri 2a str. 2457T
caggaaaacuacacacugg

SEQ ID NO: 3818625 - RNA, 23 nt, Shigella flexneri 2a str. 2457T
caggaaaacuacacacuggaucu

SEQ ID NO: 3818626 - RNA, 21 nt, Shigella flexneri 2a str. 2457T
caggaaacccaacgcaaagag

SEQ ID NO: 3818627 - RNA, 17 nt, Shigella flexneri 2a str. 2457T
caggaaaucgucgaggg

SEQ ID NO: 3818628 - RNA, 23 nt, Shigella flexneri 2a str. 2457T
caggaaauuaccgcaaagcccac

SEQ ID NO: 3818629 - RNA, 13 nt, Shigella flexneri 2a str. 2457T
caggaacaccagc

SEQ ID NO: 3818630 - RNA, 14 nt, Shigella flexneri 2a str. 2457T
caggaacaccagca

SEQ ID NO: 3818631 - RNA, 18 nt, Shigella flexneri 2a str. 2457T
caggaacaccgcacgcag

SEQ ID NO: 3818632 - RNA, 22 nt, Shigella flexneri 2a str. 2457T
caggaaccccauaagccugaua

SEQ ID NO: 3818633 - RNA, 19 nt, Shigella flexneri 2a str. 2457T
caggaaccugugacagcag

SEQ ID NO: 3818634 - RNA, 21 nt, Shigella flexneri 2a str. 2457T
caggaaccugugacagcagcg

SEQ ID NO: 3818635 - RNA, 15 nt, Shigella flexneri 2a str. 2457T
caggaacgccgcgcc

SEQ ID NO: 3818636 - RNA, 18 nt, Shigella flexneri 2a str. 2457T
caggaacgggauugccag

SEQ ID NO: 3818637 - RNA, 14 nt, Shigella flexneri 2a str. 2457T
caggaacugcucau

SEQ ID NO: 3818638 - RNA, 17 nt, Shigella flexneri 2a str. 2457T
caggaacuguugcaaaa

SEQ ID NO: 3818639 - RNA, 14 nt, Shigella flexneri 2a str. 2457T
caggaaggccagca

SEQ ID NO: 3818640 - RNA, 16 nt, Shigella flexneri 2a str. 2457T
caggaaggccagcagg

SEQ ID NO: 3818641 - RNA, 15 nt, Shigella flexneri 2a str. 2457T
caggaaguccgagga

SEQ ID NO: 3818642 - RNA, 21 nt, Shigella flexneri 2a str. 2457T
caggaauaaaucuaaaagaug

SEQ ID NO: 3818643 - RNA, 12 nt, Shigella flexneri 2a str. 2457T
caggaauauggu

SEQ ID NO: 3818644 - RNA, 20 nt, Shigella flexneri 2a str. 2457T
caggaaucacguaggccuga

SEQ ID NO: 3818645 - RNA, 15 nt, Shigella flexneri 2a str. 2457T
caggaauggcgaagg

SEQ ID NO: 3818646 - RNA, 17 nt, Shigella flexneri 2a str. 2457T
caggaauucagaaaaau

SEQ ID NO: 3818647 - RNA, 12 nt, Shigella flexneri 2a str. 2457T
caggacagagac

SEQ ID NO: 3818648 - RNA, 20 nt, Shigella flexneri 2a str. 2457T
caggaccauacugacggauc

SEQ ID NO: 3818649 - RNA, 15 nt, Shigella flexneri 2a str. 2457T
caggaccauucacac

SEQ ID NO: 3818650 - RNA, 19 nt, Shigella flexneri 2a str. 2457T
caggaccuugacgaauacu

SEQ ID NO: 3818651 - RNA, 20 nt, Shigella flexneri 2a str. 2457T
caggaccuugacgaauacua

SEQ ID NO: 3818652 - RNA, 16 nt, Shigella flexneri 2a str. 2457T
caggacgaaaaaucac

SEQ ID NO: 3818653 - RNA, 18 nt, Shigella flexneri 2a str. 2457T
caggacgaaaccgggcaa

SEQ ID NO: 3818654 - RNA, 17 nt, Shigella flexneri 2a str. 2457T
caggacgaguacggauu

SEQ ID NO: 3818655 - RNA, 21 nt, Shigella flexneri 2a str. 2457T
caggacgcccgguaucaacga

SEQ ID NO: 3818656 - RNA, 15 nt, Shigella flexneri 2a str. 2457T
caggagaagcaaauu

SEQ ID NO: 3818657 - RNA, 22 nt, Shigella flexneri 2a str. 2457T
caggagcuccagguccuccugu

SEQ ID NO: 3818658 - RNA, 20 nt, Shigella flexneri 2a str. 2457T
caggagcuggaugcccaaca

SEQ ID NO: 3818659 - RNA, 22 nt, Shigella flexneri 2a str. 2457T
caggagcuggaugcccaacagg

SEQ ID NO: 3818660 - RNA, 17 nt, Shigella flexneri 2a str. 2457T
caggaguagcucugggu

SEQ ID NO: 3818661 - RNA, 17 nt, Shigella flexneri 2a str. 2457T
caggauaaccuucaacu

SEQ ID NO: 3818662 - RNA, 16 nt, Shigella flexneri 2a str. 2457T
caggauaagcgccgcu

SEQ ID NO: 3818663 - RNA, 16 nt, Shigella flexneri 2a str. 2457T
caggauauagucgaac

SEQ ID NO: 3818664 - RNA, 22 nt, Shigella flexneri 2a str. 2457T
caggauaucguggcacguacca

SEQ ID NO: 3818665 - RNA, 16 nt, Shigella flexneri 2a str. 2457T
caggauauuuauauuu

SEQ ID NO: 3818666 - RNA, 17 nt, Shigella flexneri 2a str. 2457T
caggauauuuauauuuu

SEQ ID NO: 3818667 - RNA, 17 nt, Shigella flexneri 2a str. 2457T
caggaucagacacaaua

SEQ ID NO: 3818668 - RNA, 16 nt, Shigella flexneri 2a str. 2457T
caggaucugcgcggca

SEQ ID NO: 3818669 - RNA, 21 nt, Shigella flexneri 2a str. 2457T
caggaucuggcuugccagcag

SEQ ID NO: 3818670 - RNA, 23 nt, Shigella flexneri 2a str. 2457T
caggaucuggcuugccagcaggg

SEQ ID NO: 3818671 - RNA, 17 nt, Shigella flexneri 2a str. 2457T
caggaucugguauuaaa

SEQ ID NO: 3818672 - RNA, 16 nt, Shigella flexneri 2a str. 2457T
caggaugcggcuaauu

SEQ ID NO: 3818673 - RNA, 21 nt, Shigella flexneri 2a str. 2457T
caggauggcguucgcaacacc

SEQ ID NO: 3818674 - RNA, 23 nt, Shigella flexneri 2a str. 2457T
caggauggcguucgcaacaccgu

SEQ ID NO: 3818675 - RNA, 21 nt, Shigella flexneri 2a str. 2457T
caggauggcuggccgugcaga

SEQ ID NO: 3818676 - RNA, 12 nt, Shigella flexneri 2a str. 2457T
caggaugggcaa

SEQ ID NO: 3818677 - RNA, 17 nt, Shigella flexneri 2a str. 2457T
caggauggucaacguca

SEQ ID NO: 3818678 - RNA, 13 nt, Shigella flexneri 2a str. 2457T
caggauucacaau

SEQ ID NO: 3818679 - RNA, 21 nt, Shigella flexneri 2a str. 2457T
caggauucacaauauuaauac

SEQ ID NO: 3818680 - RNA, 18 nt, Shigella flexneri 2a str. 2457T
caggauugccguggauuu

SEQ ID NO: 3818681 - RNA, 14 nt, Shigella flexneri 2a str. 2457T
caggcaaaaaaaug

SEQ ID NO: 3818682 - RNA, 21 nt, Shigella flexneri 2a str. 2457T
caggcaaaaaaaugcacauau

SEQ ID NO: 3818683 - RNA, 14 nt, Shigella flexneri 2a str. 2457T
caggcaaaccagua

SEQ ID NO: 3818684 - RNA, 15 nt, Shigella flexneri 2a str. 2457T
caggcaaaccaguac

SEQ ID NO: 3818685 - RNA, 22 nt, Shigella flexneri 2a str. 2457T
caggcaaacuucacgcauuuac

SEQ ID NO: 3818686 - RNA, 14 nt, Shigella flexneri 2a str. 2457T
caggcaaccgcuga

SEQ ID NO: 3818687 - RNA, 18 nt, Shigella flexneri 2a str. 2457T
caggcaacuucaagguca

SEQ ID NO: 3818688 - RNA, 16 nt, Shigella flexneri 2a str. 2457T
caggcaagcauaugac

SEQ ID NO: 3818689 - RNA, 21 nt, Shigella flexneri 2a str. 2457T
caggcaagccgcuaacagcag

SEQ ID NO: 3818690 - RNA, 21 nt, Shigella flexneri 2a str. 2457T
caggcaauagggcaacuggag

SEQ ID NO: 3818691 - RNA, 18 nt, Shigella flexneri 2a str. 2457T
caggcaaucgagcccaga

SEQ ID NO: 3818692 - RNA, 21 nt, Shigella flexneri 2a str. 2457T
caggcaaucgagcccagaugc

SEQ ID NO: 3818693 - RNA, 18 nt, Shigella flexneri 2a str. 2457T
caggcaaugggcaaacgc

SEQ ID NO: 3818694 - RNA, 19 nt, Shigella flexneri 2a str. 2457T
caggcaauguugcguuugu

SEQ ID NO: 3818695 - RNA, 22 nt, Shigella flexneri 2a str. 2457T
caggcacaaguuuuuaggcaug

SEQ ID NO: 3818696 - RNA, 15 nt, Shigella flexneri 2a str. 2457T
caggcacaccgccgc

SEQ ID NO: 3818697 - RNA, 18 nt, Shigella flexneri 2a str. 2457T
caggcacuacguucucac

SEQ ID NO: 3818698 - RNA, 14 nt, Shigella flexneri 2a str. 2457T
caggcagauacaac

SEQ ID NO: 3818699 - RNA, 21 nt, Shigella flexneri 2a str. 2457T
caggcagauacaaccaaucgc

SEQ ID NO: 3818700 - RNA, 18 nt, Shigella flexneri 2a str. 2457T
caggcagauccaguuacc

SEQ ID NO: 3818701 - RNA, 19 nt, Shigella flexneri 2a str. 2457T
caggcagauuuuuuaacug

SEQ ID NO: 3818702 - RNA, 14 nt, Shigella flexneri 2a str. 2457T
caggcagcaaucac

SEQ ID NO: 3818703 - RNA, 16 nt, Shigella flexneri 2a str. 2457T
caggcagcacugcuua

SEQ ID NO: 3818704 - RNA, 14 nt, Shigella flexneri 2a str. 2457T
caggcagcugccag

SEQ ID NO: 3818705 - RNA, 15 nt, Shigella flexneri 2a str. 2457T
caggcaggucuuuca

SEQ ID NO: 3818706 - RNA, 18 nt, Shigella flexneri 2a str. 2457T
caggcaggucuuucaccu

SEQ ID NO: 3818707 - RNA, 14 nt, Shigella flexneri 2a str. 2457T
caggcaucacuuua

SEQ ID NO: 3818708 - RNA, 15 nt, Shigella flexneri 2a str. 2457T
caggcaucagcaaca

SEQ ID NO: 3818709 - RNA, 19 nt, Shigella flexneri 2a str. 2457T
caggcaucagcaacacgcu

SEQ ID NO: 3818710 - RNA, 21 nt, Shigella flexneri 2a str. 2457T
caggcaucguguugaugcucc

SEQ ID NO: 3818711 - RNA, 22 nt, Shigella flexneri 2a str. 2457T
caggcaucuauagugaggcuau

SEQ ID NO: 3818712 - RNA, 19 nt, Shigella flexneri 2a str. 2457T
caggcauuugcuccagacg

SEQ ID NO: 3818713 - RNA, 14 nt, Shigella flexneri 2a str. 2457T
caggccaccaggcc

SEQ ID NO: 3818714 - RNA, 20 nt, Shigella flexneri 2a str. 2457T
caggccacgaaucagcaccg

SEQ ID NO: 3818715 - RNA, 13 nt, Shigella flexneri 2a str. 2457T
caggccagcagca

SEQ ID NO: 3818716 - RNA, 16 nt, Shigella flexneri 2a str. 2457T
caggccagcagcagag

SEQ ID NO: 3818717 - RNA, 14 nt, Shigella flexneri 2a str. 2457T
caggccaucacauc

SEQ ID NO: 3818718 - RNA, 15 nt, Shigella flexneri 2a str. 2457T
caggccaucacaucc

SEQ ID NO: 3818719 - RNA, 15 nt, Shigella flexneri 2a str. 2457T
caggcccgcauuaaa

SEQ ID NO: 3818720 - RNA, 18 nt, Shigella flexneri 2a str. 2457T
caggccgcguaccgcagc

SEQ ID NO: 3818721 - RNA, 14 nt, Shigella flexneri 2a str. 2457T
caggccguggauca

SEQ ID NO: 3818722 - RNA, 14 nt, Shigella flexneri 2a str. 2457T
caggccuacaaaau

SEQ ID NO: 3818723 - RNA, 19 nt, Shigella flexneri 2a str. 2457T
caggccuacaauguuucug

SEQ ID NO: 3818724 - RNA, 22 nt, Shigella flexneri 2a str. 2457T
caggccuacaauguuucugcaa

SEQ ID NO: 3818725 - RNA, 22 nt, Shigella flexneri 2a str. 2457T
caggccuacaggauaucuggca

SEQ ID NO: 3818726 - RNA, 16 nt, Shigella flexneri 2a str. 2457T
caggccuacauuuucu

SEQ ID NO: 3818727 - RNA, 19 nt, Shigella flexneri 2a str. 2457T
caggccuacauuuucuccg

SEQ ID NO: 3818728 - RNA, 21 nt, Shigella flexneri 2a str. 2457T
caggccuacccggugaaucgc

SEQ ID NO: 3818729 - RNA, 14 nt, Shigella flexneri 2a str. 2457T
caggccuaccggug

SEQ ID NO: 3818730 - RNA, 19 nt, Shigella flexneri 2a str. 2457T
caggccugauaagcgcagc

SEQ ID NO: 3818731 - RNA, 16 nt, Shigella flexneri 2a str. 2457T
caggccuggguaaaaa

SEQ ID NO: 3818732 - RNA, 20 nt, Shigella flexneri 2a str. 2457T
caggcgaccguuuucaccag

SEQ ID NO: 3818733 - RNA, 23 nt, Shigella flexneri 2a str. 2457T
caggcgaucucguuuuugucucu

SEQ ID NO: 3818734 - RNA, 15 nt, Shigella flexneri 2a str. 2457T
caggcgaucuucccg

SEQ ID NO: 3818735 - RNA, 16 nt, Shigella flexneri 2a str. 2457T
caggcgcucauaacca

SEQ ID NO: 3818736 - RNA, 13 nt, Shigella flexneri 2a str. 2457T
caggcgcugaaag

SEQ ID NO: 3818737 - RNA, 19 nt, Shigella flexneri 2a str. 2457T
caggcgcugauagguuuca

SEQ ID NO: 3818738 - RNA, 22 nt, Shigella flexneri 2a str. 2457T
caggcgcugaugagcaaaucgc

SEQ ID NO: 3818739 - RNA, 23 nt, Shigella flexneri 2a str. 2457T
caggcgcugcauaucucccagua

SEQ ID NO: 3818740 - RNA, 21 nt, Shigella flexneri 2a str. 2457T
caggcgcuugucgucccaggc

SEQ ID NO: 3818741 - RNA, 22 nt, Shigella flexneri 2a str. 2457T
caggcgcuugucgucccaggca

SEQ ID NO: 3818742 - RNA, 20 nt, Shigella flexneri 2a str. 2457T
caggcggauugcuucugcuu

SEQ ID NO: 3818743 - RNA, 21 nt, Shigella flexneri 2a str. 2457T
caggcggauugcuucugcuuc

SEQ ID NO: 3818744 - RNA, 17 nt, Shigella flexneri 2a str. 2457T
caggcggcccagugagu

SEQ ID NO: 3818745 - RNA, 17 nt, Shigella flexneri 2a str. 2457T
caggcgucgggaagacc

SEQ ID NO: 3818746 - RNA, 22 nt, Shigella flexneri 2a str. 2457T
caggcguucuacauaaaacgcu

SEQ ID NO: 3818747 - RNA, 15 nt, Shigella flexneri 2a str. 2457T
caggcuaaagaaaac

SEQ ID NO: 3818748 - RNA, 17 nt, Shigella flexneri 2a str. 2457T
caggcuaccgcagugaa

SEQ ID NO: 3818749 - RNA, 15 nt, Shigella flexneri 2a str. 2457T
caggcuacucccagu

SEQ ID NO: 3818750 - RNA, 14 nt, Shigella flexneri 2a str. 2457T
caggcuacuuuucc

SEQ ID NO: 3818751 - RNA, 17 nt, Shigella flexneri 2a str. 2457T
caggcucagaagacgcu

SEQ ID NO: 3818752 - RNA, 15 nt, Shigella flexneri 2a str. 2457T
caggcucauaccuuc

SEQ ID NO: 3818753 - RNA, 15 nt, Shigella flexneri 2a str. 2457T
caggcuccuguagcu

SEQ ID NO: 3818754 - RNA, 15 nt, Shigella flexneri 2a str. 2457T
caggcucgccgccgc

SEQ ID NO: 3818755 - RNA, 18 nt, Shigella flexneri 2a str. 2457T
caggcucucauuuuucag

SEQ ID NO: 3818756 - RNA, 13 nt, Shigella flexneri 2a str. 2457T
caggcucuuuaaa

SEQ ID NO: 3818757 - RNA, 15 nt, Shigella flexneri 2a str. 2457T
caggcucuuuaaaca

SEQ ID NO: 3818758 - RNA, 18 nt, Shigella flexneri 2a str. 2457T
caggcugcaaagucuggg

SEQ ID NO: 3818759 - RNA, 12 nt, Shigella flexneri 2a str. 2457T
caggcugguggu

SEQ ID NO: 3818760 - RNA, 22 nt, Shigella flexneri 2a str. 2457T
caggcuguuaaggaaauccugc

SEQ ID NO: 3818761 - RNA, 20 nt, Shigella flexneri 2a str. 2457T
caggcuguuaccccugcggc

SEQ ID NO: 3818762 - RNA, 21 nt, Shigella flexneri 2a str. 2457T
caggcuguuaccccugcggcc

SEQ ID NO: 3818763 - RNA, 14 nt, Shigella flexneri 2a str. 2457T
caggcuuaccagca

SEQ ID NO: 3818764 - RNA, 17 nt, Shigella flexneri 2a str. 2457T
caggcuuacgcagaaga

SEQ ID NO: 3818765 - RNA, 19 nt, Shigella flexneri 2a str. 2457T
caggcuuauggcucgccau

SEQ ID NO: 3818766 - RNA, 12 nt, Shigella flexneri 2a str. 2457T
caggcuucaaca

SEQ ID NO: 3818767 - RNA, 14 nt, Shigella flexneri 2a str. 2457T
caggcuucaacaca

SEQ ID NO: 3818768 - RNA, 21 nt, Shigella flexneri 2a str. 2457T
caggcuucaacacaggccggc

SEQ ID NO: 3818769 - RNA, 15 nt, Shigella flexneri 2a str. 2457T
caggcuuuauucuga

SEQ ID NO: 3818770 - RNA, 23 nt, Shigella flexneri 2a str. 2457T
caggcuuuauucugacgccacca

SEQ ID NO: 3818771 - RNA, 13 nt, Shigella flexneri 2a str. 2457T
caggcuuuccguc

SEQ ID NO: 3818772 - RNA, 20 nt, Shigella flexneri 2a str. 2457T
ccacuucuuccagcggcagg

SEQ ID NO: 3818773 - RNA, 15 nt, Shigella flexneri 2a str. 2457T
ccacuugcagcucau

SEQ ID NO: 3818774 - RNA, 21 nt, Shigella flexneri 2a str. 2457T
ccacuuuacccgguuugugaa

SEQ ID NO: 3818775 - RNA, 22 nt, Shigella flexneri 2a str. 2457T
ccacuuuacgggcaaucuccug

SEQ ID NO: 3818776 - RNA, 17 nt, Shigella flexneri 2a str. 2457T
ccacuuucacgcccaua

SEQ ID NO: 3818777 - RNA, 16 nt, Shigella flexneri 2a str. 2457T
ccacuuucacgccgcc

SEQ ID NO: 3818778 - RNA, 17 nt, Shigella flexneri 2a str. 2457T
ccacuuucacgccgcca

SEQ ID NO: 3818779 - RNA, 20 nt, Shigella flexneri 2a str. 2457T
ccacuuucaggccagcggcu

SEQ ID NO: 3818780 - RNA, 12 nt, Shigella flexneri 2a str. 2457T
ccacuuugcgcu

SEQ ID NO: 3818781 - RNA, 22 nt, Shigella flexneri 2a str. 2457T
ccacuuuuuucaccgagucguc

SEQ ID NO: 3818782 - RNA, 23 nt, Shigella flexneri 2a str. 2457T
ccagaaaaaacguugucgccgcu

SEQ ID NO: 3818783 - RNA, 13 nt, Shigella flexneri 2a str. 2457T
ccagaaaaccugg

SEQ ID NO: 3818784 - RNA, 17 nt, Shigella flexneri 2a str. 2457T
ccagaaaaccuggcgca

SEQ ID NO: 3818785 - RNA, 12 nt, Shigella flexneri 2a str. 2457T
ccagaaacaaua

SEQ ID NO: 3818786 - RNA, 15 nt, Shigella flexneri 2a str. 2457T
ccagaaacgccacca

SEQ ID NO: 3818787 - RNA, 20 nt, Shigella flexneri 2a str. 2457T
ccagaaagcguauccaucac

SEQ ID NO: 3818788 - RNA, 23 nt, Shigella flexneri 2a str. 2457T
ccagaaagcguauccaucacuaa

SEQ ID NO: 3818789 - RNA, 15 nt, Shigella flexneri 2a str. 2457T
ccagaaaguuuuuca

SEQ ID NO: 3818790 - RNA, 11 nt, Shigella flexneri 2a str. 2457T
ccagaaaucag

SEQ ID NO: 3818791 - RNA, 16 nt, Shigella flexneri 2a str. 2457T
ccagaaaucagcagcu

SEQ ID NO: 3818792 - RNA, 15 nt, Shigella flexneri 2a str. 2457T
ccagaacaaauaaau

SEQ ID NO: 3818793 - RNA, 17 nt, Shigella flexneri 2a str. 2457T
ccagaacaccauaauga

SEQ ID NO: 3818794 - RNA, 18 nt, Shigella flexneri 2a str. 2457T
ccagaacacgcucccagc

SEQ ID NO: 3818795 - RNA, 20 nt, Shigella flexneri 2a str. 2457T
ccagaacacgcucccagcag

SEQ ID NO: 3818796 - RNA, 23 nt, Shigella flexneri 2a str. 2457T
ccagaacacuguuaccgcugcug

SEQ ID NO: 3818797 - RNA, 13 nt, Shigella flexneri 2a str. 2457T
ccagaaccgcgua

SEQ ID NO: 3818798 - RNA, 20 nt, Shigella flexneri 2a str. 2457T
ccagaagcacugccagaauc

SEQ ID NO: 3818799 - RNA, 13 nt, Shigella flexneri 2a str. 2457T
ccagaagggcgag

SEQ ID NO: 3818800 - RNA, 18 nt, Shigella flexneri 2a str. 2457T
ccagaauaaacaacugug

SEQ ID NO: 3818801 - RNA, 12 nt, Shigella flexneri 2a str. 2457T
ccagaauaccuu

SEQ ID NO: 3818802 - RNA, 18 nt, Shigella flexneri 2a str. 2457T
ccagaauagccgcagcca

SEQ ID NO: 3818803 - RNA, 23 nt, Shigella flexneri 2a str. 2457T
ccagaauauugccgaagaccaga

SEQ ID NO: 3818804 - RNA, 15 nt, Shigella flexneri 2a str. 2457T
ccagaaucgccagca

SEQ ID NO: 3818805 - RNA, 23 nt, Shigella flexneri 2a str. 2457T
ccagacaaucgaaaaagaaucga

SEQ ID NO: 3818806 - RNA, 15 nt, Shigella flexneri 2a str. 2457T
ccagacacaguucuu

SEQ ID NO: 3818807 - RNA, 22 nt, Shigella flexneri 2a str. 2457T
ccagacacaguucuucaaaaau

SEQ ID NO: 3818808 - RNA, 14 nt, Shigella flexneri 2a str. 2457T
ccagacaccccuuc

SEQ ID NO: 3818809 - RNA, 15 nt, Shigella flexneri 2a str. 2457T
ccagacaccgcugcu

SEQ ID NO: 3818810 - RNA, 19 nt, Shigella flexneri 2a str. 2457T
ccagacaucaccaguaccg

SEQ ID NO: 3818811 - RNA, 23 nt, Shigella flexneri 2a str. 2457T
ccagacaucaccaguaccgccac

SEQ ID NO: 3818812 - RNA, 13 nt, Shigella flexneri 2a str. 2457T
ccagacaucccag

SEQ ID NO: 3818813 - RNA, 16 nt, Shigella flexneri 2a str. 2457T
ccagacaucccagugc

SEQ ID NO: 3818814 - RNA, 17 nt, Shigella flexneri 2a str. 2457T
ccagacaucccagugca

SEQ ID NO: 3818815 - RNA, 19 nt, Shigella flexneri 2a str. 2457T
ccagacauguggauuaaau

SEQ ID NO: 3818816 - RNA, 22 nt, Shigella flexneri 2a str. 2457T
ccagacauuauaaauucuggcc

SEQ ID NO: 3818817 - RNA, 14 nt, Shigella flexneri 2a str. 2457T
ccagaccgcacacc

SEQ ID NO: 3818818 - RNA, 22 nt, Shigella flexneri 2a str. 2457T
ccagaccggcaaucgcgccaga

SEQ ID NO: 3818819 - RNA, 19 nt, Shigella flexneri 2a str. 2457T
ccagaccguggucagaaaa

SEQ ID NO: 3818820 - RNA, 22 nt, Shigella flexneri 2a str. 2457T
ccagaccuaacuuggcaaagcu

SEQ ID NO: 3818821 - RNA, 18 nt, Shigella flexneri 2a str. 2457T
ccagaccugaaaccgccu

SEQ ID NO: 3818822 - RNA, 12 nt, Shigella flexneri 2a str. 2457T
ccagaccugaau

SEQ ID NO: 3818823 - RNA, 16 nt, Shigella flexneri 2a str. 2457T
ccagaccugagcaucg

SEQ ID NO: 3818824 - RNA, 15 nt, Shigella flexneri 2a str. 2457T
ccagaccuuaucaca

SEQ ID NO: 3818825 - RNA, 14 nt, Shigella flexneri 2a str. 2457T
ccagacgaauaaaa

SEQ ID NO: 3818826 - RNA, 16 nt, Shigella flexneri 2a str. 2457T
ccagacgcaacagaaa

SEQ ID NO: 3818827 - RNA, 15 nt, Shigella flexneri 2a str. 2457T
ccagacgcagcaagg

SEQ ID NO: 3818828 - RNA, 20 nt, Shigella flexneri 2a str. 2457T
ccagacgccagaugcggcgu

SEQ ID NO: 3818829 - RNA, 17 nt, Shigella flexneri 2a str. 2457T
ccagacgccagccacag

SEQ ID NO: 3818830 - RNA, 17 nt, Shigella flexneri 2a str. 2457T
ccagacgcgcagcuuca

SEQ ID NO: 3818831 - RNA, 19 nt, Shigella flexneri 2a str. 2457T
ccagacgcgcagcuucacu

SEQ ID NO: 3818832 - RNA, 20 nt, Shigella flexneri 2a str. 2457T
ccagacgcgcagcuucacuu

SEQ ID NO: 3818833 - RNA, 23 nt, Shigella flexneri 2a str. 2457T
ccagacgcucuucaauggucagc

SEQ ID NO: 3818834 - RNA, 14 nt, Shigella flexneri 2a str. 2457T
ccagacgggcauuu

SEQ ID NO: 3818835 - RNA, 17 nt, Shigella flexneri 2a str. 2457T
ccagacgguaaccccuc

SEQ ID NO: 3818836 - RNA, 16 nt, Shigella flexneri 2a str. 2457T
ccagacuacgccaaca

SEQ ID NO: 3818837 - RNA, 18 nt, Shigella flexneri 2a str. 2457T
ccagacuccaggcguuuu

SEQ ID NO: 3818838 - RNA, 23 nt, Shigella flexneri 2a str. 2457T
ccagacugaugugauccaucagg

SEQ ID NO: 3818839 - RNA, 20 nt, Shigella flexneri 2a str. 2457T
ccagacuggagcacugcgcc

SEQ ID NO: 3818840 - RNA, 15 nt, Shigella flexneri 2a str. 2457T
ccagagaauauuaac

SEQ ID NO: 3818841 - RNA, 19 nt, Shigella flexneri 2a str. 2457T
ccagagagcggagcaauga

SEQ ID NO: 3818842 - RNA, 14 nt, Shigella flexneri 2a str. 2457T
ccagagcagcaaca

SEQ ID NO: 3818843 - RNA, 14 nt, Shigella flexneri 2a str. 2457T
ccagagccaccaac

SEQ ID NO: 3818844 - RNA, 16 nt, Shigella flexneri 2a str. 2457T
ccagaggagccaucac

SEQ ID NO: 3818845 - RNA, 20 nt, Shigella flexneri 2a str. 2457T
ccagagugaugcguccgcua

SEQ ID NO: 3818846 - RNA, 21 nt, Shigella flexneri 2a str. 2457T
ccagaguggauuaucuucacc

SEQ ID NO: 3818847 - RNA, 15 nt, Shigella flexneri 2a str. 2457T
ccagauaaauauuau

SEQ ID NO: 3818848 - RNA, 17 nt, Shigella flexneri 2a str. 2457T
ccagauaaauauuauug

SEQ ID NO: 3818849 - RNA, 17 nt, Shigella flexneri 2a str. 2457T
ccagauaaggcguucac

SEQ ID NO: 3818850 - RNA, 22 nt, Shigella flexneri 2a str. 2457T
ccagauaauauugauauccgca

SEQ ID NO: 3818851 - RNA, 16 nt, Shigella flexneri 2a str. 2457T
ccagauaauggcuguu

SEQ ID NO: 3818852 - RNA, 23 nt, Shigella flexneri 2a str. 2457T
ccagauaauggcuguugaaugcc

SEQ ID NO: 3818853 - RNA, 17 nt, Shigella flexneri 2a str. 2457T
ccagauacaaaaaaggc

SEQ ID NO: 3818854 - RNA, 22 nt, Shigella flexneri 2a str. 2457T
ccagauagaacaucucuuccca

SEQ ID NO: 3818855 - RNA, 19 nt, Shigella flexneri 2a str. 2457T
ccagauagagccgguuuug

SEQ ID NO: 3818856 - RNA, 16 nt, Shigella flexneri 2a str. 2457T
ccagauaugaucgaaa

SEQ ID NO: 3818857 - RNA, 20 nt, Shigella flexneri 2a str. 2457T
ccagauauuuuucaauccgc

SEQ ID NO: 3818858 - RNA, 21 nt, Shigella flexneri 2a str. 2457T
ccagauauuuuucaauccgca

SEQ ID NO: 3818859 - RNA, 14 nt, Shigella flexneri 2a str. 2457T
ccagaucacgcagc

SEQ ID NO: 3818860 - RNA, 18 nt, Shigella flexneri 2a str. 2457T
ccagaucacgcagcaagc

SEQ ID NO: 3818861 - RNA, 17 nt, Shigella flexneri 2a str. 2457T
ccagaucccauaaccaa

SEQ ID NO: 3818862 - RNA, 14 nt, Shigella flexneri 2a str. 2457T
ccagaucgccugcc

SEQ ID NO: 3818863 - RNA, 17 nt, Shigella flexneri 2a str. 2457T
ccagaucggacuucaug

SEQ ID NO: 3818864 - RNA, 23 nt, Shigella flexneri 2a str. 2457T
ccagaucugaaucauucagguaa

SEQ ID NO: 3818865 - RNA, 14 nt, Shigella flexneri 2a str. 2457T
ccagaucuucauca

SEQ ID NO: 3818866 - RNA, 15 nt, Shigella flexneri 2a str. 2457T
ccagaugacggcugc

SEQ ID NO: 3818867 - RNA, 15 nt, Shigella flexneri 2a str. 2457T
ccagaugcagcggua

SEQ ID NO: 3818868 - RNA, 17 nt, Shigella flexneri 2a str. 2457T
ccagauggcuuuccacc

SEQ ID NO: 3818869 - RNA, 18 nt, Shigella flexneri 2a str. 2457T
ccagaugucccaucugau

SEQ ID NO: 3818870 - RNA, 18 nt, Shigella flexneri 2a str. 2457T
ccagauguugucucagau

SEQ ID NO: 3818871 - RNA, 16 nt, Shigella flexneri 2a str. 2457T
ccagauuauaagccag

SEQ ID NO: 3818872 - RNA, 15 nt, Shigella flexneri 2a str. 2457T
ccagauuccucucau

SEQ ID NO: 3818873 - RNA, 17 nt, Shigella flexneri 2a str. 2457T
ccagauucuccaacauc

SEQ ID NO: 3818874 - RNA, 20 nt, Shigella flexneri 2a str. 2457T
ccagauugccgauauaaacc

SEQ ID NO: 3818875 - RNA, 22 nt, Shigella flexneri 2a str. 2457T
ccagauugugugauacuucuuc

SEQ ID NO: 3818876 - RNA, 23 nt, Shigella flexneri 2a str. 2457T
ccagauugugugauacuucuucg

SEQ ID NO: 3818877 - RNA, 18 nt, Shigella flexneri 2a str. 2457T
ccagauuuauaaaagaaa

SEQ ID NO: 3818878 - RNA, 20 nt, Shigella flexneri 2a str. 2457T
ccagauuuauuuacuucugc

SEQ ID NO: 3818879 - RNA, 18 nt, Shigella flexneri 2a str. 2457T
ccagauuuuucaguauuu

SEQ ID NO: 3818880 - RNA, 17 nt, Shigella flexneri 2a str. 2457T
ccagcaaaaucaccauc

SEQ ID NO: 3818881 - RNA, 14 nt, Shigella flexneri 2a str. 2457T
ccagcaaacaggug

SEQ ID NO: 3818882 - RNA, 14 nt, Shigella flexneri 2a str. 2457T
ccagcaaauccagc

SEQ ID NO: 3818883 - RNA, 14 nt, Shigella flexneri 2a str. 2457T
ccagcaaaucccag

SEQ ID NO: 3818884 - RNA, 13 nt, Shigella flexneri 2a str. 2457T
ccagcaacaaaua

SEQ ID NO: 3818885 - RNA, 16 nt, Shigella flexneri 2a str. 2457T
ccagcaacaaauaacc

SEQ ID NO: 3818886 - RNA, 16 nt, Shigella flexneri 2a str. 2457T
ccagcaacaacagcgc

SEQ ID NO: 3818887 - RNA, 15 nt, Shigella flexneri 2a str. 2457T
ccagcaacaagccag

SEQ ID NO: 3818888 - RNA, 17 nt, Shigella flexneri 2a str. 2457T
ccagcaacacaaacgaa

SEQ ID NO: 3818889 - RNA, 23 nt, Shigella flexneri 2a str. 2457T
ccagcaaccaacgccagcagcag

SEQ ID NO: 3818890 - RNA, 17 nt, Shigella flexneri 2a str. 2457T
ccagcaaccaaugccac

SEQ ID NO: 3818891 - RNA, 21 nt, Shigella flexneri 2a str. 2457T
ccagcaaccaaugccaccagg

SEQ ID NO: 3818892 - RNA, 15 nt, Shigella flexneri 2a str. 2457T
ccagcaacugauggc

SEQ ID NO: 3818893 - RNA, 16 nt, Shigella flexneri 2a str. 2457T
ccagcaagagcaaaua

SEQ ID NO: 3818894 - RNA, 20 nt, Shigella flexneri 2a str. 2457T
ccagcaagagcaaauaaaac

SEQ ID NO: 3818895 - RNA, 23 nt, Shigella flexneri 2a str. 2457T
ccagcaagagcaaauaaaacauc

SEQ ID NO: 3818896 - RNA, 13 nt, Shigella flexneri 2a str. 2457T
ccagcaagcgcac

SEQ ID NO: 3818897 - RNA, 19 nt, Shigella flexneri 2a str. 2457T
ccagcaaggcgcuaaaagc

SEQ ID NO: 3818898 - RNA, 17 nt, Shigella flexneri 2a str. 2457T
ccagcaauaacaacacg

SEQ ID NO: 3818899 - RNA, 14 nt, Shigella flexneri 2a str. 2457T
ccagcaauccccag

SEQ ID NO: 3818900 - RNA, 15 nt, Shigella flexneri 2a str. 2457T
ccagcaauccccaga

SEQ ID NO: 3818901 - RNA, 20 nt, Shigella flexneri 2a str. 2457T
ccagcaauccccagacaaaa

SEQ ID NO: 3818902 - RNA, 14 nt, Shigella flexneri 2a str. 2457T
ccagcaauccugca

SEQ ID NO: 3818903 - RNA, 18 nt, Shigella flexneri 2a str. 2457T
ccagcaccagcuccggca

SEQ ID NO: 3818904 - RNA, 16 nt, Shigella flexneri 2a str. 2457T
ccagcaccaggcuugc

SEQ ID NO: 3818905 - RNA, 23 nt, Shigella flexneri 2a str. 2457T
ccagcaccgcagagaucgccccg

SEQ ID NO: 3818906 - RNA, 23 nt, Shigella flexneri 2a str. 2457T
ccagcaccggacuauccgccgcu

SEQ ID NO: 3818907 - RNA, 19 nt, Shigella flexneri 2a str. 2457T
ccagcaccgucaaacacag

SEQ ID NO: 3818908 - RNA, 18 nt, Shigella flexneri 2a str. 2457T
ccagcacgaccgccauua

SEQ ID NO: 3818909 - RNA, 15 nt, Shigella flexneri 2a str. 2457T
ccagcacggugaaga

SEQ ID NO: 3818910 - RNA, 13 nt, Shigella flexneri 2a str. 2457T
ccagcacugccgc

SEQ ID NO: 3818911 - RNA, 22 nt, Shigella flexneri 2a str. 2457T
ccagcacuucgccaucugccag

SEQ ID NO: 3818912 - RNA, 15 nt, Shigella flexneri 2a str. 2457T
ccagcacuucgcugg

SEQ ID NO: 3818913 - RNA, 17 nt, Shigella flexneri 2a str. 2457T
ccagcagaccuucugcc

SEQ ID NO: 3818914 - RNA, 20 nt, Shigella flexneri 2a str. 2457T
ccagcagacguaaaaauagc

SEQ ID NO: 3818915 - RNA, 12 nt, Shigella flexneri 2a str. 2457T
ccagcagauggc

SEQ ID NO: 3818916 - RNA, 14 nt, Shigella flexneri 2a str. 2457T
ccagcagcagccgg

SEQ ID NO: 3818917 - RNA, 14 nt, Shigella flexneri 2a str. 2457T
ccagcagcggcaga

SEQ ID NO: 3818918 - RNA, 18 nt, Shigella flexneri 2a str. 2457T
ccagcagcugcguggcgc

SEQ ID NO: 3818919 - RNA, 18 nt, Shigella flexneri 2a str. 2457T
ccagcaguaaaccaccca

SEQ ID NO: 3818920 - RNA, 17 nt, Shigella flexneri 2a str. 2457T
ccagcaguaaaccgcuc

SEQ ID NO: 3818921 - RNA, 17 nt, Shigella flexneri 2a str. 2457T
ccagcaguuccagcaua

SEQ ID NO: 3818922 - RNA, 14 nt, Shigella flexneri 2a str. 2457T
ccagcaguucgccc

SEQ ID NO: 3818923 - RNA, 16 nt, Shigella flexneri 2a str. 2457T
ccagcaguucuacugg

SEQ ID NO: 3818924 - RNA, 20 nt, Shigella flexneri 2a str. 2457T
ccagcauaaccuugcaauag

SEQ ID NO: 3818925 - RNA, 13 nt, Shigella flexneri 2a str. 2457T
ccagcauaaucac

SEQ ID NO: 3818926 - RNA, 15 nt, Shigella flexneri 2a str. 2457T
ccagcauaaucacca

SEQ ID NO: 3818927 - RNA, 23 nt, Shigella flexneri 2a str. 2457T
ccagcauaguacgggcaauuuca

SEQ ID NO: 3818928 - RNA, 18 nt, Shigella flexneri 2a str. 2457T
ccagcauauguuuacgcu

SEQ ID NO: 3818929 - RNA, 13 nt, Shigella flexneri 2a str. 2457T
ccagcaucaacaa

SEQ ID NO: 3818930 - RNA, 18 nt, Shigella flexneri 2a str. 2457T
ccagcaucacgcccgcuu

SEQ ID NO: 3818931 - RNA, 14 nt, Shigella flexneri 2a str. 2457T
ccagcaucccggca

SEQ ID NO: 3818932 - RNA, 13 nt, Shigella flexneri 2a str. 2457T
ccagcaucgacca

SEQ ID NO: 3818933 - RNA, 12 nt, Shigella flexneri 2a str. 2457T
ccagcaucuccu

SEQ ID NO: 3818934 - RNA, 19 nt, Shigella flexneri 2a str. 2457T
ccagcaucuccugcaacag

SEQ ID NO: 3818935 - RNA, 22 nt, Shigella flexneri 2a str. 2457T
ccagcaugacuaccggggacag

SEQ ID NO: 3818936 - RNA, 22 nt, Shigella flexneri 2a str. 2457T
ccagcaugaugcucucccaaau

SEQ ID NO: 3818937 - RNA, 20 nt, Shigella flexneri 2a str. 2457T
ccagcauggcaauaaccgcu

SEQ ID NO: 3818938 - RNA, 17 nt, Shigella flexneri 2a str. 2457T
ccagcaugguaccgugu

SEQ ID NO: 3818939 - RNA, 23 nt, Shigella flexneri 2a str. 2457T
ccagcaugugguuaccaucaacc

SEQ ID NO: 3818940 - RNA, 15 nt, Shigella flexneri 2a str. 2457T
ccagcauucccgcca

SEQ ID NO: 3818941 - RNA, 22 nt, Shigella flexneri 2a str. 2457T
ccagcauuucuggugucacagu

SEQ ID NO: 3818942 - RNA, 22 nt, Shigella flexneri 2a str. 2457T
ccagccaacuugcccaggugug

SEQ ID NO: 3818943 - RNA, 14 nt, Shigella flexneri 2a str. 2457T
ccagccacugcgcc

SEQ ID NO: 3818944 - RNA, 15 nt, Shigella flexneri 2a str. 2457T
ccagccacugcgcca

SEQ ID NO: 3818945 - RNA, 18 nt, Shigella flexneri 2a str. 2457T
ccagccacugcgccauca

SEQ ID NO: 3818946 - RNA, 16 nt, Shigella flexneri 2a str. 2457T
ccagccagaaucauug

SEQ ID NO: 3818947 - RNA, 11 nt, Shigella flexneri 2a str. 2457T
ccagccagcag

SEQ ID NO: 3818948 - RNA, 15 nt, Shigella flexneri 2a str. 2457T
ccagccaguauugcc

SEQ ID NO: 3818949 - RNA, 14 nt, Shigella flexneri 2a str. 2457T
ccagccauccguca

SEQ ID NO: 3818950 - RNA, 18 nt, Shigella flexneri 2a str. 2457T
ccagccauuaaccagcca

SEQ ID NO: 3818951 - RNA, 13 nt, Shigella flexneri 2a str. 2457T
ccagcccacaugc

SEQ ID NO: 3818952 - RNA, 16 nt, Shigella flexneri 2a str. 2457T
ccagccccagaauuca

SEQ ID NO: 3818953 - RNA, 21 nt, Shigella flexneri 2a str. 2457T
ccagcccgacgauaccgccgc

SEQ ID NO: 3818954 - RNA, 17 nt, Shigella flexneri 2a str. 2457T
ccagcccgaucggcugg

SEQ ID NO: 3818955 - RNA, 22 nt, Shigella flexneri 2a str. 2457T
ccagcccgaucggcuggcauuu

SEQ ID NO: 3818956 - RNA, 16 nt, Shigella flexneri 2a str. 2457T
ccagcccgcgcgauga

SEQ ID NO: 3818957 - RNA, 19 nt, Shigella flexneri 2a str. 2457T
ccagcccuuuugacgcgug

SEQ ID NO: 3818958 - RNA, 14 nt, Shigella flexneri 2a str. 2457T
ccagccgaacagcg

SEQ ID NO: 3818959 - RNA, 17 nt, Shigella flexneri 2a str. 2457T
ccagccgaacagcgcca

SEQ ID NO: 3818960 - RNA, 16 nt, Shigella flexneri 2a str. 2457T
ccagccgcgucugaau

SEQ ID NO: 3818961 - RNA, 15 nt, Shigella flexneri 2a str. 2457T
ccagccgugaauggu

SEQ ID NO: 3818962 - RNA, 16 nt, Shigella flexneri 2a str. 2457T
ccagccuacaggaaac

SEQ ID NO: 3818963 - RNA, 14 nt, Shigella flexneri 2a str. 2457T
ccagccugcaaacg

SEQ ID NO: 3818964 - RNA, 16 nt, Shigella flexneri 2a str. 2457T
ccagccugcaaacgcu

SEQ ID NO: 3818965 - RNA, 23 nt, Shigella flexneri 2a str. 2457T
ccagccuggcggaaagccagaau

SEQ ID NO: 3818966 - RNA, 21 nt, Shigella flexneri 2a str. 2457T
ccagccuucuucauccagcgc

SEQ ID NO: 3818967 - RNA, 15 nt, Shigella flexneri 2a str. 2457T
ccagccuuuccggca

SEQ ID NO: 3818968 - RNA, 16 nt, Shigella flexneri 2a str. 2457T
ccagccuuuuucucug

SEQ ID NO: 3818969 - RNA, 22 nt, Shigella flexneri 2a str. 2457T
ccagcgaaaucaccgccaccag

SEQ ID NO: 3818970 - RNA, 14 nt, Shigella flexneri 2a str. 2457T
ccagcgaauuccag

SEQ ID NO: 3818971 - RNA, 19 nt, Shigella flexneri 2a str. 2457T
ccagcgaugcccagugacc

SEQ ID NO: 3818972 - RNA, 19 nt, Shigella flexneri 2a str. 2457T
ccagcgauggacgcagacc

SEQ ID NO: 3818973 - RNA, 22 nt, Shigella flexneri 2a str. 2457T
ccagcgauuacuguacagaucc

SEQ ID NO: 3818974 - RNA, 21 nt, Shigella flexneri 2a str. 2457T
ccagcgauuuaucggcaauuu

SEQ ID NO: 3818975 - RNA, 15 nt, Shigella flexneri 2a str. 2457T
ccagcgcagacacca

SEQ ID NO: 3818976 - RNA, 16 nt, Shigella flexneri 2a str. 2457T
ccagcgcagacggcgc

SEQ ID NO: 3818977 - RNA, 15 nt, Shigella flexneri 2a str. 2457T
ccagcgcaucaggca

SEQ ID NO: 3818978 - RNA, 18 nt, Shigella flexneri 2a str. 2457T
ccagcgcaucaggcaauc

SEQ ID NO: 3818979 - RNA, 17 nt, Shigella flexneri 2a str. 2457T
ccagcgccaguaauucu

SEQ ID NO: 3818980 - RNA, 19 nt, Shigella flexneri 2a str. 2457T
ccagcgccgacagcagccc

SEQ ID NO: 3818981 - RNA, 16 nt, Shigella flexneri 2a str. 2457T
ccagcgccgccagaau

SEQ ID NO: 3818982 - RNA, 18 nt, Shigella flexneri 2a str. 2457T
ccagcgccgccagaauca

SEQ ID NO: 3818983 - RNA, 14 nt, Shigella flexneri 2a str. 2457T
ccagcgccugcgcg

SEQ ID NO: 3818984 - RNA, 13 nt, Shigella flexneri 2a str. 2457T
ccagcgccuggcu

SEQ ID NO: 3818985 - RNA, 19 nt, Shigella flexneri 2a str. 2457T
ccagcgccuggcugauuaa

SEQ ID NO: 3818986 - RNA, 18 nt, Shigella flexneri 2a str. 2457T
ccagcgcgaugcaggcca

SEQ ID NO: 3818987 - RNA, 17 nt, Shigella flexneri 2a str. 2457T
ccagcgcgcaguugcaa

SEQ ID NO: 3818988 - RNA, 15 nt, Shigella flexneri 2a str. 2457T
ccagcgcgcguugcu

SEQ ID NO: 3818989 - RNA, 18 nt, Shigella flexneri 2a str. 2457T
ccagcgcguaaauaccuu

SEQ ID NO: 3818990 - RNA, 20 nt, Shigella flexneri 2a str. 2457T
ccagcgcguaaauaucggca

SEQ ID NO: 3818991 - RNA, 22 nt, Shigella flexneri 2a str. 2457T
ccagcgcguuauguaacaacug

SEQ ID NO: 3818992 - RNA, 12 nt, Shigella flexneri 2a str. 2457T
ccagcgcguucu

SEQ ID NO: 3818993 - RNA, 22 nt, Shigella flexneri 2a str. 2457T
ccagcgcuucagcgaucgcuuu

SEQ ID NO: 3818994 - RNA, 22 nt, Shigella flexneri 2a str. 2457T
ccagcggaauucccgcuucuuc

SEQ ID NO: 3818995 - RNA, 13 nt, Shigella flexneri 2a str. 2457T
ccagcggcagcca

SEQ ID NO: 3818996 - RNA, 13 nt, Shigella flexneri 2a str. 2457T
ccagcggcagcuc

SEQ ID NO: 3818997 - RNA, 20 nt, Shigella flexneri 2a str. 2457T
ccagcggcagcucgcguucg

SEQ ID NO: 3818998 - RNA, 15 nt, Shigella flexneri 2a str. 2457T
ccagcggccagcgca

SEQ ID NO: 3818999 - RNA, 18 nt, Shigella flexneri 2a str. 2457T
ccagcggcgggauuuuuu

SEQ ID NO: 3819000 - RNA, 20 nt, Shigella flexneri 2a str. 2457T
ccagcggguggugacuggca

SEQ ID NO: 3819001 - RNA, 18 nt, Shigella flexneri 2a str. 2457T
ccagcggguugcugagau

SEQ ID NO: 3819002 - RNA, 23 nt, Shigella flexneri 2a str. 2457T
ccagcgguggugacugguuuuuc

SEQ ID NO: 3819003 - RNA, 19 nt, Shigella flexneri 2a str. 2457T
ccagcgguuuaucaauggc

SEQ ID NO: 3819004 - RNA, 21 nt, Shigella flexneri 2a str. 2457T
ccagcguaccaugauccugca

SEQ ID NO: 3819005 - RNA, 20 nt, Shigella flexneri 2a str. 2457T
ccagcguacguaacuucuua

SEQ ID NO: 3819006 - RNA, 23 nt, Shigella flexneri 2a str. 2457T
ccagcguauucgugacaauaucu

SEQ ID NO: 3819007 - RNA, 13 nt, Shigella flexneri 2a str. 2457T
ccagcgucagcau

SEQ ID NO: 3819008 - RNA, 18 nt, Shigella flexneri 2a str. 2457T
ccagcgucagcauaaaaa

SEQ ID NO: 3819009 - RNA, 21 nt, Shigella flexneri 2a str. 2457T
ccagcgucgcacccggcauuu

SEQ ID NO: 3819010 - RNA, 18 nt, Shigella flexneri 2a str. 2457T
ccagcgucgcaucaggca

SEQ ID NO: 3819011 - RNA, 20 nt, Shigella flexneri 2a str. 2457T
ccagcgucgcaucaggcauc

SEQ ID NO: 3819012 - RNA, 13 nt, Shigella flexneri 2a str. 2457T
ccagcguggagag

SEQ ID NO: 3819013 - RNA, 15 nt, Shigella flexneri 2a str. 2457T
ccagcguggcaugac

SEQ ID NO: 3819014 - RNA, 21 nt, Shigella flexneri 2a str. 2457T
ccagcguggcgaacggauagc

SEQ ID NO: 3819015 - RNA, 14 nt, Shigella flexneri 2a str. 2457T
ccagcguguugccg

SEQ ID NO: 3819016 - RNA, 15 nt, Shigella flexneri 2a str. 2457T
ccagcguuaccggcu

SEQ ID NO: 3819017 - RNA, 17 nt, Shigella flexneri 2a str. 2457T
ccagcguuuccagcacc

SEQ ID NO: 3819018 - RNA, 18 nt, Shigella flexneri 2a str. 2457T
ccagcguuuccagcacca

SEQ ID NO: 3819019 - RNA, 19 nt, Shigella flexneri 2a str. 2457T
ccagcguuuccagcaccag

SEQ ID NO: 3819020 - RNA, 17 nt, Shigella flexneri 2a str. 2457T
ccagcuauaacguugcc

SEQ ID NO: 3819021 - RNA, 12 nt, Shigella flexneri 2a str. 2457T
ccagcucaaacg

SEQ ID NO: 3819022 - RNA, 15 nt, Shigella flexneri 2a str. 2457T
ccagcucaaacgaau

SEQ ID NO: 3819023 - RNA, 18 nt, Shigella flexneri 2a str. 2457T
ccagcucaaggcgguaaa

SEQ ID NO: 3819024 - RNA, 14 nt, Shigella flexneri 2a str. 2457T
ccagcucagugacc

SEQ ID NO: 3819025 - RNA, 16 nt, Shigella flexneri 2a str. 2457T
ccagcuccagcagacc

SEQ ID NO: 3819026 - RNA, 19 nt, Shigella flexneri 2a str. 2457T
ccagcuccccacgauugau

SEQ ID NO: 3819027 - RNA, 17 nt, Shigella flexneri 2a str. 2457T
ccagcuccguccagcca

SEQ ID NO: 3819028 - RNA, 18 nt, Shigella flexneri 2a str. 2457T
ccagcucuucuucacucu

SEQ ID NO: 3819029 - RNA, 23 nt, Shigella flexneri 2a str. 2457T
ccagcucuucuucacucucacca

SEQ ID NO: 3819030 - RNA, 22 nt, Shigella flexneri 2a str. 2457T
ccagcugacguagcaguucacc

SEQ ID NO: 3819031 - RNA, 19 nt, Shigella flexneri 2a str. 2457T
ccagcugccgaaccacuga

SEQ ID NO: 3819032 - RNA, 17 nt, Shigella flexneri 2a str. 2457T
ccagcugccgacgccag

SEQ ID NO: 3819033 - RNA, 17 nt, Shigella flexneri 2a str. 2457T
ccagcugccguccccau

SEQ ID NO: 3819034 - RNA, 21 nt, Shigella flexneri 2a str. 2457T
ccagcugcuguggauucagca

SEQ ID NO: 3819035 - RNA, 12 nt, Shigella flexneri 2a str. 2457T
ccagcuggcaga

SEQ ID NO: 3819036 - RNA, 18 nt, Shigella flexneri 2a str. 2457T
ccagcuggcuaccgccgc

SEQ ID NO: 3819037 - RNA, 19 nt, Shigella flexneri 2a str. 2457T
ccagcuggcuaccgccgca

SEQ ID NO: 3819038 - RNA, 15 nt, Shigella flexneri 2a str. 2457T
ccagcuuagcauccc

SEQ ID NO: 3819039 - RNA, 18 nt, Shigella flexneri 2a str. 2457T
ccagcuucaacgauucaa

SEQ ID NO: 3819040 - RNA, 15 nt, Shigella flexneri 2a str. 2457T
ccagcuucagauuca

SEQ ID NO: 3819041 - RNA, 11 nt, Shigella flexneri 2a str. 2457T
ccagcuugaag

SEQ ID NO: 3819042 - RNA, 22 nt, Shigella flexneri 2a str. 2457T
ccagcuugaaggguuuuauaau

SEQ ID NO: 3819043 - RNA, 17 nt, Shigella flexneri 2a str. 2457T
ccagcuugcgacaugcg

SEQ ID NO: 3819044 - RNA, 23 nt, Shigella flexneri 2a str. 2457T
ccagcuuucgcuuaacgcccaug

SEQ ID NO: 3819045 - RNA, 13 nt, Shigella flexneri 2a str. 2457T
ccaggaaacccaa

SEQ ID NO: 3819046 - RNA, 13 nt, Shigella flexneri 2a str. 2457T
ccaggaacagaag

SEQ ID NO: 3819047 - RNA, 16 nt, Shigella flexneri 2a str. 2457T
ccaggaaccugugaca

SEQ ID NO: 3819048 - RNA, 21 nt, Shigella flexneri 2a str. 2457T
ccaggaacgcgccaagauaga

SEQ ID NO: 3819049 - RNA, 23 nt, Shigella flexneri 2a str. 2457T
ccaggaacuccagauccauaagg

SEQ ID NO: 3819050 - RNA, 17 nt, Shigella flexneri 2a str. 2457T
ccaggaaggccagcagg

SEQ ID NO: 3819051 - RNA, 23 nt, Shigella flexneri 2a str. 2457T
ccaggaagggcauaucagcaacu

SEQ ID NO: 3819052 - RNA, 14 nt, Shigella flexneri 2a str. 2457T
ccaggagauuaacg

SEQ ID NO: 3819053 - RNA, 20 nt, Shigella flexneri 2a str. 2457T
ccaggaucagaaugcgcucu

SEQ ID NO: 3819054 - RNA, 20 nt, Shigella flexneri 2a str. 2457T
ccaggaucagacacaauaau

SEQ ID NO: 3819055 - RNA, 20 nt, Shigella flexneri 2a str. 2457T
ccaggauugauagaaauauc

SEQ ID NO: 3819056 - RNA, 13 nt, Shigella flexneri 2a str. 2457T
ccaggcaaaccag

SEQ ID NO: 3819057 - RNA, 14 nt, Shigella flexneri 2a str. 2457T
ccaggcaaaccagu

SEQ ID NO: 3819058 - RNA, 22 nt, Shigella flexneri 2a str. 2457T
ccaggcaacgaaaggugaagug

SEQ ID NO: 3819059 - RNA, 13 nt, Shigella flexneri 2a str. 2457T
ccaggcaccguca

SEQ ID NO: 3819060 - RNA, 20 nt, Shigella flexneri 2a str. 2457T
ccaggcacuuucaguuugac

SEQ ID NO: 3819061 - RNA, 18 nt, Shigella flexneri 2a str. 2457T
ccaggcaucagcaacacg

SEQ ID NO: 3819062 - RNA, 21 nt, Shigella flexneri 2a str. 2457T
ccaggcaucagcaacacgcug

SEQ ID NO: 3819063 - RNA, 16 nt, Shigella flexneri 2a str. 2457T
ccaggccagcgcaacu

SEQ ID NO: 3819064 - RNA, 19 nt, Shigella flexneri 2a str. 2457T
ccaggccgcguaccgcagc

SEQ ID NO: 3819065 - RNA, 18 nt, Shigella flexneri 2a str. 2457T
ccaggccgguaacgcuuu

SEQ ID NO: 3819066 - RNA, 20 nt, Shigella flexneri 2a str. 2457T
ccaggcggaguaaacggcag

SEQ ID NO: 3819067 - RNA, 17 nt, Shigella flexneri 2a str. 2457T
ccaggcguuaauauugc

SEQ ID NO: 3819068 - RNA, 14 nt, Shigella flexneri 2a str. 2457T
ccaggcguucugcc

SEQ ID NO: 3819069 - RNA, 15 nt, Shigella flexneri 2a str. 2457T
ccaggcguucugccu

SEQ ID NO: 3819070 - RNA, 17 nt, Shigella flexneri 2a str. 2457T
ccaggcguucugccugg

SEQ ID NO: 3819071 - RNA, 14 nt, Shigella flexneri 2a str. 2457T
ccaggcucgccgcc

SEQ ID NO: 3819072 - RNA, 16 nt, Shigella flexneri 2a str. 2457T
ccaggcucgccgccgc

SEQ ID NO: 3819073 - RNA, 19 nt, Shigella flexneri 2a str. 2457T
ccaggcugcaaagucuggg

SEQ ID NO: 3819074 - RNA, 22 nt, Shigella flexneri 2a str. 2457T
ccagggaucgggucaccgccga

SEQ ID NO: 3819075 - RNA, 13 nt, Shigella flexneri 2a str. 2457T
ccagggcagcagu

SEQ ID NO: 3819076 - RNA, 20 nt, Shigella flexneri 2a str. 2457T
ccagggcagcaguucaugca

SEQ ID NO: 3819077 - RNA, 14 nt, Shigella flexneri 2a str. 2457T
ccagggccucuccu

SEQ ID NO: 3819078 - RNA, 19 nt, Shigella flexneri 2a str. 2457T
ccagggcuuacaaaaccug

SEQ ID NO: 3819079 - RNA, 20 nt, Shigella flexneri 2a str. 2457T
ccagggcuuuuuuauuucau

SEQ ID NO: 3819080 - RNA, 19 nt, Shigella flexneri 2a str. 2457T
ccaggucagagagccagcc

SEQ ID NO: 3819081 - RNA, 20 nt, Shigella flexneri 2a str. 2457T
ccaggucagagagccagccc

SEQ ID NO: 3819082 - RNA, 17 nt, Shigella flexneri 2a str. 2457T
ccaggucgcauccggca

SEQ ID NO: 3819083 - RNA, 17 nt, Shigella flexneri 2a str. 2457T
ccaggugagauccggga

SEQ ID NO: 3819084 - RNA, 16 nt, Shigella flexneri 2a str. 2457T
ccagguuaaacaguuu

SEQ ID NO: 3819085 - RNA, 19 nt, Shigella flexneri 2a str. 2457T
ccagguucgauauccgcca

SEQ ID NO: 3819086 - RNA, 21 nt, Shigella flexneri 2a str. 2457T
ccagguuguacuuuccagcca

SEQ ID NO: 3819087 - RNA, 17 nt, Shigella flexneri 2a str. 2457T
ccagguuuaccagcagc

SEQ ID NO: 3819088 - RNA, 22 nt, Shigella flexneri 2a str. 2457T
ccagguuuuaguuucgccguuu

SEQ ID NO: 3819089 - RNA, 22 nt, Shigella flexneri 2a str. 2457T
ccagguuuucuuucaccucuuc

SEQ ID NO: 3819090 - RNA, 19 nt, Shigella flexneri 2a str. 2457T
ccaguaaaccaauuucugu

SEQ ID NO: 3819091 - RNA, 18 nt, Shigella flexneri 2a str. 2457T
ccaguaaagcagcgaagc

SEQ ID NO: 3819092 - RNA, 22 nt, Shigella flexneri 2a str. 2457T
ccaguaacgucccccagauccc

SEQ ID NO: 3819093 - RNA, 23 nt, Shigella flexneri 2a str. 2457T
ccaguaagacaccccacagcucu

SEQ ID NO: 3819094 - RNA, 19 nt, Shigella flexneri 2a str. 2457T
ccaguaagcaguccagcgc

SEQ ID NO: 3819095 - RNA, 21 nt, Shigella flexneri 2a str. 2457T
ccaguaagcaguccagcgccu

SEQ ID NO: 3819096 - RNA, 21 nt, Shigella flexneri 2a str. 2457T
ccaguaagcugugcgauagca

SEQ ID NO: 3819097 - RNA, 13 nt, Shigella flexneri 2a str. 2457T
ccaguaaggcugc

SEQ ID NO: 3819098 - RNA, 14 nt, Shigella flexneri 2a str. 2457T
ccaguaauccggcu

SEQ ID NO: 3819099 - RNA, 22 nt, Shigella flexneri 2a str. 2457T
ccaguaaucggcugaacgugcu

SEQ ID NO: 3819100 - RNA, 14 nt, Shigella flexneri 2a str. 2457T
ccaguaaucgggca

SEQ ID NO: 3819101 - RNA, 21 nt, Shigella flexneri 2a str. 2457T
ccaguaaucgggcaacugcug

SEQ ID NO: 3819102 - RNA, 14 nt, Shigella flexneri 2a str. 2457T
ccaguaaucuggcc

SEQ ID NO: 3819103 - RNA, 18 nt, Shigella flexneri 2a str. 2457T
ccaguaaucuggccaaug

SEQ ID NO: 3819104 - RNA, 21 nt, Shigella flexneri 2a str. 2457T
ccaguaauucagccgcgcgcu

SEQ ID NO: 3819105 - RNA, 21 nt, Shigella flexneri 2a str. 2457T
ccaguaauugacgcauccgau

SEQ ID NO: 3819106 - RNA, 11 nt, Shigella flexneri 2a str. 2457T
ccaguaccgau

SEQ ID NO: 3819107 - RNA, 13 nt, Shigella flexneri 2a str. 2457T
ccaguaccgccag

SEQ ID NO: 3819108 - RNA, 18 nt, Shigella flexneri 2a str. 2457T
ccaguaccgccagugcag

SEQ ID NO: 3819109 - RNA, 24 nt, Shigella flexneri 2a str. 2457T
ccaguaccuguauaaacuauccug

SEQ ID NO: 3819110 - RNA, 15 nt, Shigella flexneri 2a str. 2457T
ccaguacgccuucac

SEQ ID NO: 3819111 - RNA, 19 nt, Shigella flexneri 2a str. 2457T
ccaguacgcgcaaccccgc

SEQ ID NO: 3819112 - RNA, 22 nt, Shigella flexneri 2a str. 2457T
ccaguacgcguacacuuuccug

SEQ ID NO: 3819113 - RNA, 23 nt, Shigella flexneri 2a str. 2457T
ccaguacggcuucgaucaggaac

SEQ ID NO: 3819114 - RNA, 21 nt, Shigella flexneri 2a str. 2457T
ccaguagacgagccguuccua

SEQ ID NO: 3819115 - RNA, 13 nt, Shigella flexneri 2a str. 2457T
ccaguaguaacca

SEQ ID NO: 3819116 - RNA, 20 nt, Shigella flexneri 2a str. 2457T
ccaguauccggaugguaagc

SEQ ID NO: 3819117 - RNA, 13 nt, Shigella flexneri 2a str. 2457T
ccaguaucugaca

SEQ ID NO: 3819118 - RNA, 15 nt, Shigella flexneri 2a str. 2457T
ccaguaucugacagc

SEQ ID NO: 3819119 - RNA, 17 nt, Shigella flexneri 2a str. 2457T
ccaguauuucauagauu

SEQ ID NO: 3819120 - RNA, 15 nt, Shigella flexneri 2a str. 2457T
ccagucaaucaucca

SEQ ID NO: 3819121 - RNA, 16 nt, Shigella flexneri 2a str. 2457T
ccagucacaucagcga

SEQ ID NO: 3819122 - RNA, 20 nt, Shigella flexneri 2a str. 2457T
ccagucagcgaacaccagca

SEQ ID NO: 3819123 - RNA, 14 nt, Shigella flexneri 2a str. 2457T
ccagucaggcauga

SEQ ID NO: 3819124 - RNA, 14 nt, Shigella flexneri 2a str. 2457T
ccagucaguuaagc

SEQ ID NO: 3819125 - RNA, 14 nt, Shigella flexneri 2a str. 2457T
ccagucauccggcu

SEQ ID NO: 3819126 - RNA, 21 nt, Shigella flexneri 2a str. 2457T
ccagucauugagcuucucgau

SEQ ID NO: 3819127 - RNA, 15 nt, Shigella flexneri 2a str. 2457T
ccaguccauuaccga

SEQ ID NO: 3819128 - RNA, 21 nt, Shigella flexneri 2a str. 2457T
ccagucccguacccagcaaga

SEQ ID NO: 3819129 - RNA, 20 nt, Shigella flexneri 2a str. 2457T
ccaguccgcgcuugccgccg

SEQ ID NO: 3819130 - RNA, 15 nt, Shigella flexneri 2a str. 2457T
ccagucgcugcugac

SEQ ID NO: 3819131 - RNA, 15 nt, Shigella flexneri 2a str. 2457T
ccagucgucauccca

SEQ ID NO: 3819132 - RNA, 16 nt, Shigella flexneri 2a str. 2457T
ccagucgucaucccag

SEQ ID NO: 3819133 - RNA, 15 nt, Shigella flexneri 2a str. 2457T
ccagucguucaacca

SEQ ID NO: 3819134 - RNA, 20 nt, Shigella flexneri 2a str. 2457T
ccagucguucaaccacuuca

SEQ ID NO: 3819135 - RNA, 17 nt, Shigella flexneri 2a str. 2457T
ccagucuuccugcggca

SEQ ID NO: 3819136 - RNA, 19 nt, Shigella flexneri 2a str. 2457T
ccagucuuccugcggcaga

SEQ ID NO: 3819137 - RNA, 13 nt, Shigella flexneri 2a str. 2457T
ccagugaauacug

SEQ ID NO: 3819138 - RNA, 16 nt, Shigella flexneri 2a str. 2457T
ccagugaauuucacuu

SEQ ID NO: 3819139 - RNA, 18 nt, Shigella flexneri 2a str. 2457T
ccagugagucggggccag

SEQ ID NO: 3819140 - RNA, 21 nt, Shigella flexneri 2a str. 2457T
ccagugagucggggccagcau

SEQ ID NO: 3819141 - RNA, 13 nt, Shigella flexneri 2a str. 2457T
ccagugauuaacg

SEQ ID NO: 3819142 - RNA, 14 nt, Shigella flexneri 2a str. 2457T
ccagugauucagga

SEQ ID NO: 3819143 - RNA, 21 nt, Shigella flexneri 2a str. 2457T
ccagugcaggcaccagccccu

SEQ ID NO: 3819144 - RNA, 16 nt, Shigella flexneri 2a str. 2457T
ccagugcauccagcac

SEQ ID NO: 3819145 - RNA, 15 nt, Shigella flexneri 2a str. 2457T
ccagugccaaaccag

SEQ ID NO: 3819146 - RNA, 20 nt, Shigella flexneri 2a str. 2457T
ccagugccaaaccagaugaa

SEQ ID NO: 3819147 - RNA, 15 nt, Shigella flexneri 2a str. 2457T
ccagugccaaagcca

SEQ ID NO: 3819148 - RNA, 21 nt, Shigella flexneri 2a str. 2457T
ccagugccacacgcucuucca

SEQ ID NO: 3819149 - RNA, 16 nt, Shigella flexneri 2a str. 2457T
ccagugccgcccacca

SEQ ID NO: 3819150 - RNA, 17 nt, Shigella flexneri 2a str. 2457T
ccagugccgcccaccac

SEQ ID NO: 3819151 - RNA, 18 nt, Shigella flexneri 2a str. 2457T
ccagugccggaugauuca

SEQ ID NO: 3819152 - RNA, 21 nt, Shigella flexneri 2a str. 2457T
ccagugccggaugauucacau

SEQ ID NO: 3819153 - RNA, 21 nt, Shigella flexneri 2a str. 2457T
ccagugccguuccagccagug

SEQ ID NO: 3819154 - RNA, 15 nt, Shigella flexneri 2a str. 2457T
ccagugccucaagaa

SEQ ID NO: 3819155 - RNA, 21 nt, Shigella flexneri 2a str. 2457T
ccagugcgccccagguaauuu

SEQ ID NO: 3819156 - RNA, 19 nt, Shigella flexneri 2a str. 2457T
ccaguggaugcgccauacc

SEQ ID NO: 3819157 - RNA, 16 nt, Shigella flexneri 2a str. 2457T
ccaguggcagcaauuu

SEQ ID NO: 3819158 - RNA, 17 nt, Shigella flexneri 2a str. 2457T
ccaguguaaaacagcac

SEQ ID NO: 3819159 - RNA, 18 nt, Shigella flexneri 2a str. 2457T
ccaguuaaccugcuccuc

SEQ ID NO: 3819160 - RNA, 14 nt, Shigella flexneri 2a str. 2457T
ccaguuacugccac

SEQ ID NO: 3819161 - RNA, 17 nt, Shigella flexneri 2a str. 2457T
ccaguucaaaguugcau

SEQ ID NO: 3819162 - RNA, 15 nt, Shigella flexneri 2a str. 2457T
ccaguucaagugcua

SEQ ID NO: 3819163 - RNA, 21 nt, Shigella flexneri 2a str. 2457T
ccaguucaagugcuacccacu

SEQ ID NO: 3819164 - RNA, 12 nt, Shigella flexneri 2a str. 2457T
ccaguucacacc

SEQ ID NO: 3819165 - RNA, 17 nt, Shigella flexneri 2a str. 2457T
ccaguucacaccagcca

SEQ ID NO: 3819166 - RNA, 15 nt, Shigella flexneri 2a str. 2457T
ccaguucagcggcug

SEQ ID NO: 3819167 - RNA, 14 nt, Shigella flexneri 2a str. 2457T
ccaguucauuugaa

SEQ ID NO: 3819168 - RNA, 16 nt, Shigella flexneri 2a str. 2457T
ccaguucccccugcca

SEQ ID NO: 3819169 - RNA, 12 nt, Shigella flexneri 2a str. 2457T
ccaguucgauuu

SEQ ID NO: 3819170 - RNA, 15 nt, Shigella flexneri 2a str. 2457T
ccaguucguuguagu

SEQ ID NO: 3819171 - RNA, 16 nt, Shigella flexneri 2a str. 2457T
ccaguucuacaaucug

SEQ ID NO: 3819172 - RNA, 20 nt, Shigella flexneri 2a str. 2457T
ccaguugauucgcgcguucg

SEQ ID NO: 3819173 - RNA, 17 nt, Shigella flexneri 2a str. 2457T
ccaguugcauaauuucu

SEQ ID NO: 3819174 - RNA, 18 nt, Shigella flexneri 2a str. 2457T
ccaguugcuccagcaaua

SEQ ID NO: 3819175 - RNA, 14 nt, Shigella flexneri 2a str. 2457T
ccaguugucgguaa

SEQ ID NO: 3819176 - RNA, 22 nt, Shigella flexneri 2a str. 2457T
ccaguugucgguaauugcgccg

SEQ ID NO: 3819177 - RNA, 20 nt, Shigella flexneri 2a str. 2457T
ccaguugugucagugcgcga

SEQ ID NO: 3819178 - RNA, 15 nt, Shigella flexneri 2a str. 2457T
ccaguuguucgcgca

SEQ ID NO: 3819179 - RNA, 16 nt, Shigella flexneri 2a str. 2457T
ccaguuuacugucugc

SEQ ID NO: 3819180 - RNA, 20 nt, Shigella flexneri 2a str. 2457T
ccaguuucggcaucagcaga

SEQ ID NO: 3819181 - RNA, 15 nt, Shigella flexneri 2a str. 2457T
ccaguuugccuucac

SEQ ID NO: 3819182 - RNA, 11 nt, Shigella flexneri 2a str. 2457T
ccaguuugcgu

SEQ ID NO: 3819183 - RNA, 22 nt, Shigella flexneri 2a str. 2457T
ccaguuuguucagcugcgugcc

SEQ ID NO: 3819184 - RNA, 16 nt, Shigella flexneri 2a str. 2457T
ccaguuuucaaauauc

SEQ ID NO: 3819185 - RNA, 21 nt, Shigella flexneri 2a str. 2457T
ccaguuuugccagucagcucc

SEQ ID NO: 3819186 - RNA, 18 nt, Shigella flexneri 2a str. 2457T
ccaguuuuucuuuuucaa

SEQ ID NO: 3819187 - RNA, 21 nt, Shigella flexneri 2a str. 2457T
ccauaaaaggcaccuggaaau

SEQ ID NO: 3819188 - RNA, 19 nt, Shigella flexneri 2a str. 2457T
ccauaacgccugcuccagu

SEQ ID NO: 3819189 - RNA, 21 nt, Shigella flexneri 2a str. 2457T
ccauaacggcuguccauacgu

SEQ ID NO: 3819190 - RNA, 14 nt, Shigella flexneri 2a str. 2457T
ccauaauaagcgcc

SEQ ID NO: 3819191 - RNA, 13 nt, Shigella flexneri 2a str. 2457T
ccauaauaaucau

SEQ ID NO: 3819192 - RNA, 14 nt, Shigella flexneri 2a str. 2457T
ccauaauaaucauc

SEQ ID NO: 3819193 - RNA, 21 nt, Shigella flexneri 2a str. 2457T
ccauaaucacucuuccccgcu

SEQ ID NO: 3819194 - RNA, 19 nt, Shigella flexneri 2a str. 2457T
ccauaauuacgcuguucau

SEQ ID NO: 3819195 - RNA, 16 nt, Shigella flexneri 2a str. 2457T
ccauacaucuucauca

SEQ ID NO: 3819196 - RNA, 19 nt, Shigella flexneri 2a str. 2457T
ccauacaucuucaucaucc

SEQ ID NO: 3819197 - RNA, 18 nt, Shigella flexneri 2a str. 2457T
ccauacauguacauggug

SEQ ID NO: 3819198 - RNA, 20 nt, Shigella flexneri 2a str. 2457T
ccauaccacuuccagcagac

SEQ ID NO: 3819199 - RNA, 14 nt, Shigella flexneri 2a str. 2457T
ccauacccagcauc

SEQ ID NO: 3819200 - RNA, 17 nt, Shigella flexneri 2a str. 2457T
ccauacccgcaacauac

SEQ ID NO: 3819201 - RNA, 17 nt, Shigella flexneri 2a str. 2457T
ccauaccggcugcaaac

SEQ ID NO: 3819202 - RNA, 13 nt, Shigella flexneri 2a str. 2457T
ccauaccugcaca

SEQ ID NO: 3819203 - RNA, 20 nt, Shigella flexneri 2a str. 2457T
ccauacggcagagaucgccg

SEQ ID NO: 3819204 - RNA, 18 nt, Shigella flexneri 2a str. 2457T
ccauacggcucagcucug

SEQ ID NO: 3819205 - RNA, 16 nt, Shigella flexneri 2a str. 2457T
ccauacgggcaugugu

SEQ ID NO: 3819206 - RNA, 13 nt, Shigella flexneri 2a str. 2457T
ccauacugacgga

SEQ ID NO: 3819207 - RNA, 19 nt, Shigella flexneri 2a str. 2457T
ccauacugacuaucaucgc

SEQ ID NO: 3819208 - RNA, 21 nt, Shigella flexneri 2a str. 2457T
ccauacugacuaucaucgccg

SEQ ID NO: 3819209 - RNA, 20 nt, Shigella flexneri 2a str. 2457T
ccauagcaucccaauacccg

SEQ ID NO: 3819210 - RNA, 21 nt, Shigella flexneri 2a str. 2457T
ccauagcaucccaauacccgc

SEQ ID NO: 3819211 - RNA, 16 nt, Shigella flexneri 2a str. 2457T
ccauagcgaaguugau

SEQ ID NO: 3819212 - RNA, 16 nt, Shigella flexneri 2a str. 2457T
ccauagcgauguauuu

SEQ ID NO: 3819213 - RNA, 20 nt, Shigella flexneri 2a str. 2457T
ccauaggaugagguuucccg

SEQ ID NO: 3819214 - RNA, 22 nt, Shigella flexneri 2a str. 2457T
ccauaguguguuccucugcucc

SEQ ID NO: 3819215 - RNA, 13 nt, Shigella flexneri 2a str. 2457T
ccauauagcgcac

SEQ ID NO: 3819216 - RNA, 13 nt, Shigella flexneri 2a str. 2457T
ccauaucaagcau

SEQ ID NO: 3819217 - RNA, 19 nt, Shigella flexneri 2a str. 2457T
ccauaucgccauugccggu

SEQ ID NO: 3819218 - RNA, 20 nt, Shigella flexneri 2a str. 2457T
ccauaucuaugguuuuuucu

SEQ ID NO: 3819219 - RNA, 17 nt, Shigella flexneri 2a str. 2457T
ccauauggcccaucauc

SEQ ID NO: 3819220 - RNA, 18 nt, Shigella flexneri 2a str. 2457T
ccauauguugaaaagcca

SEQ ID NO: 3819221 - RNA, 24 nt, Shigella flexneri 2a str. 2457T
ccauauguugaaaagccagguuca

SEQ ID NO: 3819222 - RNA, 20 nt, Shigella flexneri 2a str. 2457T
ccauauucguuaucguacca

SEQ ID NO: 3819223 - RNA, 12 nt, Shigella flexneri 2a str. 2457T
ccaucaaaucug

SEQ ID NO: 3819224 - RNA, 17 nt, Shigella flexneri 2a str. 2457T
ccaucaacaaacgccag

SEQ ID NO: 3819225 - RNA, 16 nt, Shigella flexneri 2a str. 2457T
ccaucaaccacuacgu

SEQ ID NO: 3819226 - RNA, 19 nt, Shigella flexneri 2a str. 2457T
ccaucaacgccaucgccag

SEQ ID NO: 3819227 - RNA, 20 nt, Shigella flexneri 2a str. 2457T
ccaucaacgccaucgccagg

SEQ ID NO: 3819228 - RNA, 21 nt, Shigella flexneri 2a str. 2457T
ccaucaacgccaucgccagga

SEQ ID NO: 3819229 - RNA, 15 nt, Shigella flexneri 2a str. 2457T
ccaucaacuucucgc

SEQ ID NO: 3819230 - RNA, 20 nt, Shigella flexneri 2a str. 2457T
ccaucaaucacuuugcgcuc

SEQ ID NO: 3819231 - RNA, 13 nt, Shigella flexneri 2a str. 2457T
ccaucaauugcuc

SEQ ID NO: 3819232 - RNA, 18 nt, Shigella flexneri 2a str. 2457T
ccaucaauugcucacucc

SEQ ID NO: 3819233 - RNA, 15 nt, Shigella flexneri 2a str. 2457T
ccaucacaaaguggg

SEQ ID NO: 3819234 - RNA, 18 nt, Shigella flexneri 2a str. 2457T
ccaucaccaucguugcua

SEQ ID NO: 3819235 - RNA, 13 nt, Shigella flexneri 2a str. 2457T
ccaucaccgcgag

SEQ ID NO: 3819236 - RNA, 20 nt, Shigella flexneri 2a str. 2457T
ccaucaccucuucagcgucc

SEQ ID NO: 3819237 - RNA, 17 nt, Shigella flexneri 2a str. 2457T
ccaucacggcagccuga

SEQ ID NO: 3819238 - RNA, 14 nt, Shigella flexneri 2a str. 2457T
ccaucacuaccuga

SEQ ID NO: 3819239 - RNA, 16 nt, Shigella flexneri 2a str. 2457T
ccaucacuaucgccau

SEQ ID NO: 3819240 - RNA, 12 nt, Shigella flexneri 2a str. 2457T
ccaucacuucau

SEQ ID NO: 3819241 - RNA, 15 nt, Shigella flexneri 2a str. 2457T
ccaucacuuucaaaa

SEQ ID NO: 3819242 - RNA, 19 nt, Shigella flexneri 2a str. 2457T
ccaucagacuuugcgccau

SEQ ID NO: 3819243 - RNA, 12 nt, Shigella flexneri 2a str. 2457T
ccaucagcagca

SEQ ID NO: 3819244 - RNA, 23 nt, Shigella flexneri 2a str. 2457T
ccaucaggcagauacaaccaauc

SEQ ID NO: 3819245 - RNA, 16 nt, Shigella flexneri 2a str. 2457T
ccaucaggcauuacug

SEQ ID NO: 3819246 - RNA, 13 nt, Shigella flexneri 2a str. 2457T
ccaucaggucauc

SEQ ID NO: 3819247 - RNA, 14 nt, Shigella flexneri 2a str. 2457T
ccaucagugccagu

SEQ ID NO: 3819248 - RNA, 17 nt, Shigella flexneri 2a str. 2457T
ccaucagugccaguacg

SEQ ID NO: 3819249 - RNA, 23 nt, Shigella flexneri 2a str. 2457T
ccaucauaaaucggaaacagcgg

SEQ ID NO: 3819250 - RNA, 14 nt, Shigella flexneri 2a str. 2457T
ccaucauacccaac

SEQ ID NO: 3819251 - RNA, 14 nt, Shigella flexneri 2a str. 2457T
ccaucauauuuucc

SEQ ID NO: 3819252 - RNA, 13 nt, Shigella flexneri 2a str. 2457T
ccaucaucaccag

SEQ ID NO: 3819253 - RNA, 15 nt, Shigella flexneri 2a str. 2457T
ccaucaucaccagaa

SEQ ID NO: 3819254 - RNA, 13 nt, Shigella flexneri 2a str. 2457T
ccaucaucaucgg

SEQ ID NO: 3819255 - RNA, 12 nt, Shigella flexneri 2a str. 2457T
ccaucaucggca

SEQ ID NO: 3819256 - RNA, 14 nt, Shigella flexneri 2a str. 2457T
ccaucaucggcaaa

SEQ ID NO: 3819257 - RNA, 22 nt, Shigella flexneri 2a str. 2457T
ccaucaugcacacuaucgcuua

SEQ ID NO: 3819258 - RNA, 13 nt, Shigella flexneri 2a str. 2457T
ccaucaugcgcca

SEQ ID NO: 3819259 - RNA, 15 nt, Shigella flexneri 2a str. 2457T
ccaucaugcgccagg

SEQ ID NO: 3819260 - RNA, 15 nt, Shigella flexneri 2a str. 2457T
ccaucauucgccgcu

SEQ ID NO: 3819261 - RNA, 14 nt, Shigella flexneri 2a str. 2457T
ccauccacagggug

SEQ ID NO: 3819262 - RNA, 13 nt, Shigella flexneri 2a str. 2457T
ccauccagcaaca

SEQ ID NO: 3819263 - RNA, 23 nt, Shigella flexneri 2a str. 2457T
ccauccagcuuuuagaucacuca

SEQ ID NO: 3819264 - RNA, 21 nt, Shigella flexneri 2a str. 2457T
ccauccaggagauauugcugc

SEQ ID NO: 3819265 - RNA, 10 nt, Shigella flexneri 2a str. 2457T
ccauccauac

SEQ ID NO: 3819266 - RNA, 14 nt, Shigella flexneri 2a str. 2457T
ccauccaucaacgc

SEQ ID NO: 3819267 - RNA, 15 nt, Shigella flexneri 2a str. 2457T
ccauccaucaacgcc

SEQ ID NO: 3819268 - RNA, 17 nt, Shigella flexneri 2a str. 2457T
ccauccgaauucacuua

SEQ ID NO: 3819269 - RNA, 13 nt, Shigella flexneri 2a str. 2457T
ccauccgaguugu

SEQ ID NO: 3819270 - RNA, 16 nt, Shigella flexneri 2a str. 2457T
ccauccgcccacacca

SEQ ID NO: 3819271 - RNA, 20 nt, Shigella flexneri 2a str. 2457T
ccauccgcgcugaugcgauc

SEQ ID NO: 3819272 - RNA, 13 nt, Shigella flexneri 2a str. 2457T
ccauccggcagca

SEQ ID NO: 3819273 - RNA, 18 nt, Shigella flexneri 2a str. 2457T
ccauccggccgccacaca

SEQ ID NO: 3819274 - RNA, 20 nt, Shigella flexneri 2a str. 2457T
ccauccgggaucacaucaua

SEQ ID NO: 3819275 - RNA, 19 nt, Shigella flexneri 2a str. 2457T
ccauccgucauccauacca

SEQ ID NO: 3819276 - RNA, 18 nt, Shigella flexneri 2a str. 2457T
ccauccugacggauagcc

SEQ ID NO: 3819277 - RNA, 16 nt, Shigella flexneri 2a str. 2457T
ccaucgacgaaauggu

SEQ ID NO: 3819278 - RNA, 21 nt, Shigella flexneri 2a str. 2457T
ccaucgacgaaauggugugca

SEQ ID NO: 3819279 - RNA, 14 nt, Shigella flexneri 2a str. 2457T
ccaucgauaaucac

SEQ ID NO: 3819280 - RNA, 19 nt, Shigella flexneri 2a str. 2457T
ccaucgcaccaaacgggca

SEQ ID NO: 3819281 - RNA, 13 nt, Shigella flexneri 2a str. 2457T
ccaucgcauacug

SEQ ID NO: 3819282 - RNA, 13 nt, Shigella flexneri 2a str. 2457T
ccaucgccagcag

SEQ ID NO: 3819283 - RNA, 19 nt, Shigella flexneri 2a str. 2457T
ccaucgcgguuaaucggca

SEQ ID NO: 3819284 - RNA, 20 nt, Shigella flexneri 2a str. 2457T
ccaucgcgguuaaucggcag

SEQ ID NO: 3819285 - RNA, 20 nt, Shigella flexneri 2a str. 2457T
ccaucgcuacauaacgcagc

SEQ ID NO: 3819286 - RNA, 17 nt, Shigella flexneri 2a str. 2457T
ccaucggaaugcgaauu

SEQ ID NO: 3819287 - RNA, 21 nt, Shigella flexneri 2a str. 2457T
ccaucggcaaucauucccaga

SEQ ID NO: 3819288 - RNA, 15 nt, Shigella flexneri 2a str. 2457T
ccaucggcagcgcca

SEQ ID NO: 3819289 - RNA, 20 nt, Shigella flexneri 2a str. 2457T
ccaucggcauuaaucugcuc

SEQ ID NO: 3819290 - RNA, 19 nt, Shigella flexneri 2a str. 2457T
ccaucgggcuagacugaug

SEQ ID NO: 3819291 - RNA, 18 nt, Shigella flexneri 2a str. 2457T
ccaucguacaggcacaug

SEQ ID NO: 3819292 - RNA, 16 nt, Shigella flexneri 2a str. 2457T
ccaucgucacaccuuc

SEQ ID NO: 3819293 - RNA, 16 nt, Shigella flexneri 2a str. 2457T
ccaucguccagcagca

SEQ ID NO: 3819294 - RNA, 23 nt, Shigella flexneri 2a str. 2457T
ccaucguccagcagcaaugcagg

SEQ ID NO: 3819295 - RNA, 20 nt, Shigella flexneri 2a str. 2457T
ccaucguugaaagauaauca

SEQ ID NO: 3819296 - RNA, 20 nt, Shigella flexneri 2a str. 2457T
ccaucucaaaacguccggca

SEQ ID NO: 3819297 - RNA, 12 nt, Shigella flexneri 2a str. 2457T
ccaucuccagcu

SEQ ID NO: 3819298 - RNA, 15 nt, Shigella flexneri 2a str. 2457T
ccaucuccuuacugc

SEQ ID NO: 3819299 - RNA, 21 nt, Shigella flexneri 2a str. 2457T
ccaucucugcaacgucuuccc

SEQ ID NO: 3819300 - RNA, 16 nt, Shigella flexneri 2a str. 2457T
ccaucucuuccagcga

SEQ ID NO: 3819301 - RNA, 19 nt, Shigella flexneri 2a str. 2457T
ccaucugaugauauuuuuc

SEQ ID NO: 3819302 - RNA, 15 nt, Shigella flexneri 2a str. 2457T
ccaucuguucugccg

SEQ ID NO: 3819303 - RNA, 14 nt, Shigella flexneri 2a str. 2457T
ccaucuucaccgcc

SEQ ID NO: 3819304 - RNA, 15 nt, Shigella flexneri 2a str. 2457T
ccaucuuuccucacu

SEQ ID NO: 3819305 - RNA, 13 nt, Shigella flexneri 2a str. 2457T
ccaucuuuuuaag

SEQ ID NO: 3819306 - RNA, 17 nt, Shigella flexneri 2a str. 2457T
ccaugaaaauagacguu

SEQ ID NO: 3819307 - RNA, 18 nt, Shigella flexneri 2a str. 2457T
ccaugaacaaaauuccag

SEQ ID NO: 3819308 - RNA, 17 nt, Shigella flexneri 2a str. 2457T
ccaugaccgaucaaggc

SEQ ID NO: 3819309 - RNA, 13 nt, Shigella flexneri 2a str. 2457T
ccaugaccgccgc

SEQ ID NO: 3819310 - RNA, 20 nt, Shigella flexneri 2a str. 2457T
ccaugaccgccgcagcaacc

SEQ ID NO: 3819311 - RNA, 15 nt, Shigella flexneri 2a str. 2457T
ccaugacgaggagcu

SEQ ID NO: 3819312 - RNA, 13 nt, Shigella flexneri 2a str. 2457T
ccaugacgcacuu

SEQ ID NO: 3819313 - RNA, 14 nt, Shigella flexneri 2a str. 2457T
ccaugacuuucugg

SEQ ID NO: 3819314 - RNA, 12 nt, Shigella flexneri 2a str. 2457T
ccaugagacaaa

SEQ ID NO: 3819315 - RNA, 16 nt, Shigella flexneri 2a str. 2457T
ccaugauaguguccau

SEQ ID NO: 3819316 - RNA, 14 nt, Shigella flexneri 2a str. 2457T
ccaugauauuggca

SEQ ID NO: 3819317 - RNA, 16 nt, Shigella flexneri 2a str. 2457T
ccaugauccugcaaua

SEQ ID NO: 3819318 - RNA, 22 nt, Shigella flexneri 2a str. 2457T
ccaugauccugcaauaccgccg

SEQ ID NO: 3819319 - RNA, 17 nt, Shigella flexneri 2a str. 2457T
ccaugaugacaacauag

SEQ ID NO: 3819320 - RNA, 21 nt, Shigella flexneri 2a str. 2457T
ccaugauuucguagacugcag

SEQ ID NO: 3819321 - RNA, 20 nt, Shigella flexneri 2a str. 2457T
ccaugcaauauuguagcaac

SEQ ID NO: 3819322 - RNA, 17 nt, Shigella flexneri 2a str. 2457T
ccaugcaauuaccgcca

SEQ ID NO: 3819323 - RNA, 19 nt, Shigella flexneri 2a str. 2457T
ccaugcaggaucgcuccau

SEQ ID NO: 3819324 - RNA, 11 nt, Shigella flexneri 2a str. 2457T
ccaugcauauc

SEQ ID NO: 3819325 - RNA, 16 nt, Shigella flexneri 2a str. 2457T
ccaugccaaucagcag

SEQ ID NO: 3819326 - RNA, 18 nt, Shigella flexneri 2a str. 2457T
ccaugccaguuaucgcag

SEQ ID NO: 3819327 - RNA, 13 nt, Shigella flexneri 2a str. 2457T
ccaugccaucugc

SEQ ID NO: 3819328 - RNA, 16 nt, Shigella flexneri 2a str. 2457T
ccaugccaucugccag

SEQ ID NO: 3819329 - RNA, 23 nt, Shigella flexneri 2a str. 2457T
ccaugccgcccagaagcacugcc

SEQ ID NO: 3819330 - RNA, 19 nt, Shigella flexneri 2a str. 2457T
ccaugccggaugcgccagc

SEQ ID NO: 3819331 - RNA, 20 nt, Shigella flexneri 2a str. 2457T
ccaugccggaugcgccagca

SEQ ID NO: 3819332 - RNA, 21 nt, Shigella flexneri 2a str. 2457T
ccaugccggaugcgccagcau

SEQ ID NO: 3819333 - RNA, 22 nt, Shigella flexneri 2a str. 2457T
ccaugccggugaugccgccaga

SEQ ID NO: 3819334 - RNA, 16 nt, Shigella flexneri 2a str. 2457T
ccaugccuuguuugau

SEQ ID NO: 3819335 - RNA, 19 nt, Shigella flexneri 2a str. 2457T
ccaugcgaagaagggacua

SEQ ID NO: 3819336 - RNA, 23 nt, Shigella flexneri 2a str. 2457T
ccaugcgaagaccgcaucacgac

SEQ ID NO: 3819337 - RNA, 18 nt, Shigella flexneri 2a str. 2457T
ccaugcgaaugccaauuu

SEQ ID NO: 3819338 - RNA, 20 nt, Shigella flexneri 2a str. 2457T
ccaugcgcauuaagccauga

SEQ ID NO: 3819339 - RNA, 17 nt, Shigella flexneri 2a str. 2457T
ccaugcggcgaggaauc

SEQ ID NO: 3819340 - RNA, 19 nt, Shigella flexneri 2a str. 2457T
ccaugcguuuuaccgccuc

SEQ ID NO: 3819341 - RNA, 14 nt, Shigella flexneri 2a str. 2457T
ccaugcugagcuuc

SEQ ID NO: 3819342 - RNA, 16 nt, Shigella flexneri 2a str. 2457T
ccaugcugagcuucuu

SEQ ID NO: 3819343 - RNA, 15 nt, Shigella flexneri 2a str. 2457T
ccaugcugugcgcca

SEQ ID NO: 3819344 - RNA, 18 nt, Shigella flexneri 2a str. 2457T
ccaugcuucaauuuccug

SEQ ID NO: 3819345 - RNA, 17 nt, Shigella flexneri 2a str. 2457T
ccaugcuugaagggcug

SEQ ID NO: 3819346 - RNA, 18 nt, Shigella flexneri 2a str. 2457T
ccaugcuuugcaucccag

SEQ ID NO: 3819347 - RNA, 12 nt, Shigella flexneri 2a str. 2457T
ccauggacgaug

SEQ ID NO: 3819348 - RNA, 23 nt, Shigella flexneri 2a str. 2457T
ccaugguuucgaacgccaguuca

SEQ ID NO: 3819349 - RNA, 16 nt, Shigella flexneri 2a str. 2457T
ccaugucgcauccgac

SEQ ID NO: 3819350 - RNA, 13 nt, Shigella flexneri 2a str. 2457T
ccaugugcuggac

SEQ ID NO: 3819351 - RNA, 16 nt, Shigella flexneri 2a str. 2457T
ccauguguuuaucuau

SEQ ID NO: 3819352 - RNA, 20 nt, Shigella flexneri 2a str. 2457T
ccauguuauuaguguguaua

SEQ ID NO: 3819353 - RNA, 15 nt, Shigella flexneri 2a str. 2457T
ccauguugacuucaa

SEQ ID NO: 3819354 - RNA, 12 nt, Shigella flexneri 2a str. 2457T
ccauguugccug

SEQ ID NO: 3819355 - RNA, 23 nt, Shigella flexneri 2a str. 2457T
ccauuaaacgcaguaagcgccag

SEQ ID NO: 3819356 - RNA, 16 nt, Shigella flexneri 2a str. 2457T
ccauuaacuacaccgu

SEQ ID NO: 3819357 - RNA, 17 nt, Shigella flexneri 2a str. 2457T
ccauuacaagcccgcug

SEQ ID NO: 3819358 - RNA, 22 nt, Shigella flexneri 2a str. 2457T
ccauuauuaaauuuaauaauaa

SEQ ID NO: 3819359 - RNA, 13 nt, Shigella flexneri 2a str. 2457T
ccauucaaucuuc

SEQ ID NO: 3819360 - RNA, 16 nt, Shigella flexneri 2a str. 2457T
ccauucaccauuuuuu

SEQ ID NO: 3819361 - RNA, 17 nt, Shigella flexneri 2a str. 2457T
ccauucaccauuuuuua

SEQ ID NO: 3819362 - RNA, 11 nt, Shigella flexneri 2a str. 2457T
ccauucaggcu

SEQ ID NO: 3819363 - RNA, 22 nt, Shigella flexneri 2a str. 2457T
ccauuccaguaauugacgcauc

SEQ ID NO: 3819364 - RNA, 19 nt, Shigella flexneri 2a str. 2457T
ccauucccccuuugaccag

SEQ ID NO: 3819365 - RNA, 12 nt, Shigella flexneri 2a str. 2457T
ccauucccugcu

SEQ ID NO: 3819366 - RNA, 16 nt, Shigella flexneri 2a str. 2457T
ccauuccggccaucgc

SEQ ID NO: 3819367 - RNA, 19 nt, Shigella flexneri 2a str. 2457T
ccauugaagaauuuuugcg

SEQ ID NO: 3819368 - RNA, 23 nt, Shigella flexneri 2a str. 2457T
ccauugacagaauauacggaaug

SEQ ID NO: 3819369 - RNA, 14 nt, Shigella flexneri 2a str. 2457T
ccauugaccagcug

SEQ ID NO: 3819370 - RNA, 21 nt, Shigella flexneri 2a str. 2457T
ccauugacgcaucgcccgguu

SEQ ID NO: 3819371 - RNA, 23 nt, Shigella flexneri 2a str. 2457T
ccauugcccgaugcgcaaacuua

SEQ ID NO: 3819372 - RNA, 12 nt, Shigella flexneri 2a str. 2457T
ccauugcucugg

SEQ ID NO: 3819373 - RNA, 21 nt, Shigella flexneri 2a str. 2457T
ccauugcucuggcaaacucgc

SEQ ID NO: 3819374 - RNA, 20 nt, Shigella flexneri 2a str. 2457T
ccauugcugccgccaguucu

SEQ ID NO: 3819375 - RNA, 13 nt, Shigella flexneri 2a str. 2457T
ccauuggcaggcu

SEQ ID NO: 3819376 - RNA, 19 nt, Shigella flexneri 2a str. 2457T
ccauuggcggcguccugga

SEQ ID NO: 3819377 - RNA, 20 nt, Shigella flexneri 2a str. 2457T
ccauugggccacucaacauc

SEQ ID NO: 3819378 - RNA, 14 nt, Shigella flexneri 2a str. 2457T
ccauuguuagcaac

SEQ ID NO: 3819379 - RNA, 18 nt, Shigella flexneri 2a str. 2457T
ccauuuaacguuaucuga

SEQ ID NO: 3819380 - RNA, 15 nt, Shigella flexneri 2a str. 2457T
ccauuucaucgccag

SEQ ID NO: 3819381 - RNA, 19 nt, Shigella flexneri 2a str. 2457T
ccauuucccugacaaauca

SEQ ID NO: 3819382 - RNA, 15 nt, Shigella flexneri 2a str. 2457T
ccauuuccuguaaca

SEQ ID NO: 3819383 - RNA, 12 nt, Shigella flexneri 2a str. 2457T
ccauuucugcca

SEQ ID NO: 3819384 - RNA, 19 nt, Shigella flexneri 2a str. 2457T
ccauuucugccagugcugc

SEQ ID NO: 3819385 - RNA, 14 nt, Shigella flexneri 2a str. 2457T
ccauuucugcugcc

SEQ ID NO: 3819386 - RNA, 17 nt, Shigella flexneri 2a str. 2457T
ccauuucuucuccggca

SEQ ID NO: 3819387 - RNA, 23 nt, Shigella flexneri 2a str. 2457T
ccauuuggcggggauuuuuuuau

SEQ ID NO: 3819388 - RNA, 20 nt, Shigella flexneri 2a str. 2457T
ccauuugugcauagcacacu

SEQ ID NO: 3819389 - RNA, 11 nt, Shigella flexneri 2a str. 2457T
ccauuuuucag

SEQ ID NO: 3819390 - RNA, 22 nt, Shigella flexneri 2a str. 2457T
ccauuuuucagacguucuuccu

SEQ ID NO: 3819391 - RNA, 12 nt, Shigella flexneri 2a str. 2457T
ccauuuuuucgu

SEQ ID NO: 3819392 - RNA, 16 nt, Shigella flexneri 2a str. 2457T
cccaaacagcagaacg

SEQ ID NO: 3819393 - RNA, 18 nt, Shigella flexneri 2a str. 2457T
cccaaaccacccagcagc

SEQ ID NO: 3819394 - RNA, 17 nt, Shigella flexneri 2a str. 2457T
cccaacgcgccaccgac

SEQ ID NO: 3819395 - RNA, 14 nt, Shigella flexneri 2a str. 2457T
cccaacguaacaaa

SEQ ID NO: 3819396 - RNA, 17 nt, Shigella flexneri 2a str. 2457T
cccaacguaacaaaacu

SEQ ID NO: 3819397 - RNA, 18 nt, Shigella flexneri 2a str. 2457T
cccaacgugaccaguacc

SEQ ID NO: 3819398 - RNA, 17 nt, Shigella flexneri 2a str. 2457T
cccaacuuugugcaauu

SEQ ID NO: 3819399 - RNA, 23 nt, Shigella flexneri 2a str. 2457T
cccaaggcgaggggaccgccccu

SEQ ID NO: 3819400 - RNA, 20 nt, Shigella flexneri 2a str. 2457T
cccaauacgauuaacgccag

SEQ ID NO: 3819401 - RNA, 22 nt, Shigella flexneri 2a str. 2457T
cccaauacgauuaacgccagac

SEQ ID NO: 3819402 - RNA, 15 nt, Shigella flexneri 2a str. 2457T
cccaaucccccacuu

SEQ ID NO: 3819403 - RNA, 13 nt, Shigella flexneri 2a str. 2457T
cccaaugaccuuu

SEQ ID NO: 3819404 - RNA, 16 nt, Shigella flexneri 2a str. 2457T
cccaauguucguccau

SEQ ID NO: 3819405 - RNA, 18 nt, Shigella flexneri 2a str. 2457T
cccacaaacccgccagac

SEQ ID NO: 3819406 - RNA, 11 nt, Shigella flexneri 2a str. 2457T
cccacaaccgg

SEQ ID NO: 3819407 - RNA, 15 nt, Shigella flexneri 2a str. 2457T
cccacaaccggcggg

SEQ ID NO: 3819408 - RNA, 14 nt, Shigella flexneri 2a str. 2457T
cccacaccaccaug

SEQ ID NO: 3819409 - RNA, 12 nt, Shigella flexneri 2a str. 2457T
cccacagacgac

SEQ ID NO: 3819410 - RNA, 13 nt, Shigella flexneri 2a str. 2457T
cccacagcucugc

SEQ ID NO: 3819411 - RNA, 14 nt, Shigella flexneri 2a str. 2457T
cccacagcucugcu

SEQ ID NO: 3819412 - RNA, 19 nt, Shigella flexneri 2a str. 2457T
cccacaguuucauaucugc

SEQ ID NO: 3819413 - RNA, 12 nt, Shigella flexneri 2a str. 2457T
cccacauccaug

SEQ ID NO: 3819414 - RNA, 12 nt, Shigella flexneri 2a str. 2457T
cccaccaccauc

SEQ ID NO: 3819415 - RNA, 14 nt, Shigella flexneri 2a str. 2457T
cccaccagcaaaua

SEQ ID NO: 3819416 - RNA, 13 nt, Shigella flexneri 2a str. 2457T
cccaccagcgccg

SEQ ID NO: 3819417 - RNA, 13 nt, Shigella flexneri 2a str. 2457T
cccaccccagcag

SEQ ID NO: 3819418 - RNA, 15 nt, Shigella flexneri 2a str. 2457T
cccaccccggcccuc

SEQ ID NO: 3819419 - RNA, 14 nt, Shigella flexneri 2a str. 2457T
cccaccugcggcac

SEQ ID NO: 3819420 - RNA, 16 nt, Shigella flexneri 2a str. 2457T
cccacgaccgcagcau

SEQ ID NO: 3819421 - RNA, 19 nt, Shigella flexneri 2a str. 2457T
cccacgauugaucucguug

SEQ ID NO: 3819422 - RNA, 23 nt, Shigella flexneri 2a str. 2457T
cccacgauugaucucguugauca

SEQ ID NO: 3819423 - RNA, 12 nt, Shigella flexneri 2a str. 2457T
cccacgccagcc

SEQ ID NO: 3819424 - RNA, 12 nt, Shigella flexneri 2a str. 2457T
cccacgccgccc

SEQ ID NO: 3819425 - RNA, 17 nt, Shigella flexneri 2a str. 2457T
cccacgcgguauccaua

SEQ ID NO: 3819426 - RNA, 13 nt, Shigella flexneri 2a str. 2457T
cccacggcgguaa

SEQ ID NO: 3819427 - RNA, 23 nt, Shigella flexneri 2a str. 2457T
cccacguuaguguggccaguucc

SEQ ID NO: 3819428 - RNA, 17 nt, Shigella flexneri 2a str. 2457T
cccacucgccccgagaa

SEQ ID NO: 3819429 - RNA, 21 nt, Shigella flexneri 2a str. 2457T
cccacugacgcucggcgcaau

SEQ ID NO: 3819430 - RNA, 13 nt, Shigella flexneri 2a str. 2457T
cccacugcucaau

SEQ ID NO: 3819431 - RNA, 18 nt, Shigella flexneri 2a str. 2457T
cccacugugggauugcuu

SEQ ID NO: 3819432 - RNA, 17 nt, Shigella flexneri 2a str. 2457T
cccacuuucaggccagc

SEQ ID NO: 3819433 - RNA, 17 nt, Shigella flexneri 2a str. 2457T
cccacuuucugcgcaau

SEQ ID NO: 3819434 - RNA, 19 nt, Shigella flexneri 2a str. 2457T
cccacuuuuauuucacccc

SEQ ID NO: 3819435 - RNA, 20 nt, Shigella flexneri 2a str. 2457T
cccagaacgccgaauaacgc

SEQ ID NO: 3819436 - RNA, 16 nt, Shigella flexneri 2a str. 2457T
cccagaacuaucauac

SEQ ID NO: 3819437 - RNA, 22 nt, Shigella flexneri 2a str. 2457T
cccagaaucucuuuuguuuccc

SEQ ID NO: 3819438 - RNA, 22 nt, Shigella flexneri 2a str. 2457T
cccagaccuaacuuggcaaagc

SEQ ID NO: 3819439 - RNA, 18 nt, Shigella flexneri 2a str. 2457T
cccagaccugcguucagc

SEQ ID NO: 3819440 - RNA, 15 nt, Shigella flexneri 2a str. 2457T
cccagagccugaagg

SEQ ID NO: 3819441 - RNA, 16 nt, Shigella flexneri 2a str. 2457T
cccagauagcaacagc

SEQ ID NO: 3819442 - RNA, 16 nt, Shigella flexneri 2a str. 2457T
cccagcaccgcagaga

SEQ ID NO: 3819443 - RNA, 23 nt, Shigella flexneri 2a str. 2457T
cccagcagagaucuuucacgccc

SEQ ID NO: 3819444 - RNA, 20 nt, Shigella flexneri 2a str. 2457T
cccagcagcgccgcgccuau

SEQ ID NO: 3819445 - RNA, 21 nt, Shigella flexneri 2a str. 2457T
cccagcaggauguuccggcaa

SEQ ID NO: 3819446 - RNA, 16 nt, Shigella flexneri 2a str. 2457T
cccagcauggcaauaa

SEQ ID NO: 3819447 - RNA, 22 nt, Shigella flexneri 2a str. 2457T
cccagccagacgccagccacag

SEQ ID NO: 3819448 - RNA, 13 nt, Shigella flexneri 2a str. 2457T
cccagcccagcgc

SEQ ID NO: 3819449 - RNA, 14 nt, Shigella flexneri 2a str. 2457T
cccagcccccagca

SEQ ID NO: 3819450 - RNA, 15 nt, Shigella flexneri 2a str. 2457T
cccagcccccagcau

SEQ ID NO: 3819451 - RNA, 23 nt, Shigella flexneri 2a str. 2457T
cccagccgcgucugaauaucauc

SEQ ID NO: 3819452 - RNA, 16 nt, Shigella flexneri 2a str. 2457T
cccagccuaagccauu

SEQ ID NO: 3819453 - RNA, 16 nt, Shigella flexneri 2a str. 2457T
cccagcgcaucaggca

SEQ ID NO: 3819454 - RNA, 13 nt, Shigella flexneri 2a str. 2457T
cccagcgccgcca

SEQ ID NO: 3819455 - RNA, 19 nt, Shigella flexneri 2a str. 2457T
cccagcgcggugacgcaca

SEQ ID NO: 3819456 - RNA, 20 nt, Shigella flexneri 2a str. 2457T
cccagcgcggugacgcacag

SEQ ID NO: 3819457 - RNA, 14 nt, Shigella flexneri 2a str. 2457T
cccagcggaaaaua

SEQ ID NO: 3819458 - RNA, 12 nt, Shigella flexneri 2a str. 2457T
cccagcggaugu

SEQ ID NO: 3819459 - RNA, 17 nt, Shigella flexneri 2a str. 2457T
cccagcgguaaaauggu

SEQ ID NO: 3819460 - RNA, 21 nt, Shigella flexneri 2a str. 2457T
cccagcgucagcauaaaaaua

SEQ ID NO: 3819461 - RNA, 19 nt, Shigella flexneri 2a str. 2457T
cccagcguggagagcagca

SEQ ID NO: 3819462 - RNA, 17 nt, Shigella flexneri 2a str. 2457T
cccagcguugcacaugu

SEQ ID NO: 3819463 - RNA, 17 nt, Shigella flexneri 2a str. 2457T
cccagcucaucagcauu

SEQ ID NO: 3819464 - RNA, 13 nt, Shigella flexneri 2a str. 2457T
cccaggcaccguc

SEQ ID NO: 3819465 - RNA, 21 nt, Shigella flexneri 2a str. 2457T
cccaggcuucaggugcccaac

SEQ ID NO: 3819466 - RNA, 20 nt, Shigella flexneri 2a str. 2457T
cccagggcaauguaacaccu

SEQ ID NO: 3819467 - RNA, 15 nt, Shigella flexneri 2a str. 2457T
cccagggccaacugg

SEQ ID NO: 3819468 - RNA, 16 nt, Shigella flexneri 2a str. 2457T
cccagggccaacuggc

SEQ ID NO: 3819469 - RNA, 22 nt, Shigella flexneri 2a str. 2457T
cccagggccaacuggcaaaaga

SEQ ID NO: 3819470 - RNA, 17 nt, Shigella flexneri 2a str. 2457T
cccaguaaccacgcagc

SEQ ID NO: 3819471 - RNA, 15 nt, Shigella flexneri 2a str. 2457T
cccaguagacagcaa

SEQ ID NO: 3819472 - RNA, 16 nt, Shigella flexneri 2a str. 2457T
cccaguagacgagccg

SEQ ID NO: 3819473 - RNA, 21 nt, Shigella flexneri 2a str. 2457T
cccaguaucugacagcaaaua

SEQ ID NO: 3819474 - RNA, 14 nt, Shigella flexneri 2a str. 2457T
cccagucgcgcaau

SEQ ID NO: 3819475 - RNA, 16 nt, Shigella flexneri 2a str. 2457T
cccagugaguuggggc

SEQ ID NO: 3819476 - RNA, 21 nt, Shigella flexneri 2a str. 2457T
cccagugaguuggggccagca

SEQ ID NO: 3819477 - RNA, 14 nt, Shigella flexneri 2a str. 2457T
cccagugccugcau

SEQ ID NO: 3819478 - RNA, 15 nt, Shigella flexneri 2a str. 2457T
cccagugcggcaucg

SEQ ID NO: 3819479 - RNA, 15 nt, Shigella flexneri 2a str. 2457T
cccaguggcagcaau

SEQ ID NO: 3819480 - RNA, 19 nt, Shigella flexneri 2a str. 2457T
cccagugguuucgccagca

SEQ ID NO: 3819481 - RNA, 21 nt, Shigella flexneri 2a str. 2457T
cccagugguuucgccagcacc

SEQ ID NO: 3819482 - RNA, 22 nt, Shigella flexneri 2a str. 2457T
cccagugguuucgccagcaccg

SEQ ID NO: 3819483 - RNA, 20 nt, Shigella flexneri 2a str. 2457T
cccaguuacugccaucuucc

SEQ ID NO: 3819484 - RNA, 23 nt, Shigella flexneri 2a str. 2457T
cccaguugugggugcccacaaac

SEQ ID NO: 3819485 - RNA, 11 nt, Shigella flexneri 2a str. 2457T
cccaguuucau

SEQ ID NO: 3819486 - RNA, 21 nt, Shigella flexneri 2a str. 2457T
cccaguuucaugauauguuuu

SEQ ID NO: 3819487 - RNA, 23 nt, Shigella flexneri 2a str. 2457T
cccauaacggggcuaccggauuu

SEQ ID NO: 3819488 - RNA, 20 nt, Shigella flexneri 2a str. 2457T
cccauauguucccgcgccuc

SEQ ID NO: 3819489 - RNA, 23 nt, Shigella flexneri 2a str. 2457T
cccauauuuaaucaguucuacca

SEQ ID NO: 3819490 - RNA, 11 nt, Shigella flexneri 2a str. 2457T
cccaucacuau

SEQ ID NO: 3819491 - RNA, 13 nt, Shigella flexneri 2a str. 2457T
cccaucaguagca

SEQ ID NO: 3819492 - RNA, 19 nt, Shigella flexneri 2a str. 2457T
cccaucgcgcccgccgcca

SEQ ID NO: 3819493 - RNA, 23 nt, Shigella flexneri 2a str. 2457T
cccaucgucacaccuucagcgaa

SEQ ID NO: 3819494 - RNA, 14 nt, Shigella flexneri 2a str. 2457T
cccaucucuucuuc

SEQ ID NO: 3819495 - RNA, 19 nt, Shigella flexneri 2a str. 2457T
cccaucuuuuuaaguuuau

SEQ ID NO: 3819496 - RNA, 22 nt, Shigella flexneri 2a str. 2457T
cccaugaugcgcggcuccagaa

SEQ ID NO: 3819497 - RNA, 23 nt, Shigella flexneri 2a str. 2457T
cccauggacauacgcaccuuuac

SEQ ID NO: 3819498 - RNA, 16 nt, Shigella flexneri 2a str. 2457T
cccauuacaagcccgc

SEQ ID NO: 3819499 - RNA, 15 nt, Shigella flexneri 2a str. 2457T
cccauuccucaugga

SEQ ID NO: 3819500 - RNA, 12 nt, Shigella flexneri 2a str. 2457T
cccauuucucca

SEQ ID NO: 3819501 - RNA, 15 nt, Shigella flexneri 2a str. 2457T
cccauuucuccagca

SEQ ID NO: 3819502 - RNA, 12 nt, Shigella flexneri 2a str. 2457T
cccauuugccac

SEQ ID NO: 3819503 - RNA, 21 nt, Shigella flexneri 2a str. 2457T
ccccaaggcgaggggaccgcc

SEQ ID NO: 3819504 - RNA, 15 nt, Shigella flexneri 2a str. 2457T
ccccaauccacgcgg

SEQ ID NO: 3819505 - RNA, 13 nt, Shigella flexneri 2a str. 2457T
ccccaauguucgu

SEQ ID NO: 3819506 - RNA, 20 nt, Shigella flexneri 2a str. 2457T
ccccacaaucagccagaaca

SEQ ID NO: 3819507 - RNA, 21 nt, Shigella flexneri 2a str. 2457T
ccccacagcucugcugucacc

SEQ ID NO: 3819508 - RNA, 13 nt, Shigella flexneri 2a str. 2457T
ccccaccucauca

SEQ ID NO: 3819509 - RNA, 20 nt, Shigella flexneri 2a str. 2457T
ccccagaagcuuuccaucgg

SEQ ID NO: 3819510 - RNA, 22 nt, Shigella flexneri 2a str. 2457T
ccccagaauucacgcacuuccg

SEQ ID NO: 3819511 - RNA, 22 nt, Shigella flexneri 2a str. 2457T
ccccagaucccauaaccaacaa

SEQ ID NO: 3819512 - RNA, 14 nt, Shigella flexneri 2a str. 2457T
ccccaggccagcag

SEQ ID NO: 3819513 - RNA, 15 nt, Shigella flexneri 2a str. 2457T
ccccaggccagcagc

SEQ ID NO: 3819514 - RNA, 21 nt, Shigella flexneri 2a str. 2457T
ccccaggccagcagcagagca

SEQ ID NO: 3819515 - RNA, 22 nt, Shigella flexneri 2a str. 2457T
ccccaguaaauggugauaucac

SEQ ID NO: 3819516 - RNA, 21 nt, Shigella flexneri 2a str. 2457T
ccccaucaacgccaucgccag

SEQ ID NO: 3819517 - RNA, 21 nt, Shigella flexneri 2a str. 2457T
ccccaucuuccgucacaggca

SEQ ID NO: 3819518 - RNA, 23 nt, Shigella flexneri 2a str. 2457T
ccccauuaccugacagcagagca

SEQ ID NO: 3819519 - RNA, 17 nt, Shigella flexneri 2a str. 2457T
cccccaaauaaccccuc

SEQ ID NO: 3819520 - RNA, 13 nt, Shigella flexneri 2a str. 2457T
cccccaccccggc

SEQ ID NO: 3819521 - RNA, 14 nt, Shigella flexneri 2a str. 2457T
cccccaccccggcc

SEQ ID NO: 3819522 - RNA, 20 nt, Shigella flexneri 2a str. 2457T
cccccagaugacggcugcca

SEQ ID NO: 3819523 - RNA, 15 nt, Shigella flexneri 2a str. 2457T
cccccagcagcgccg

SEQ ID NO: 3819524 - RNA, 18 nt, Shigella flexneri 2a str. 2457T
cccccgcucuuccaggca

SEQ ID NO: 3819525 - RNA, 17 nt, Shigella flexneri 2a str. 2457T
cccccugaagcaguuuc

SEQ ID NO: 3819526 - RNA, 21 nt, Shigella flexneri 2a str. 2457T
cccccuuugaccagccaguca

SEQ ID NO: 3819527 - RNA, 21 nt, Shigella flexneri 2a str. 2457T
ccccgagaaaaauagcauuaa

SEQ ID NO: 3819528 - RNA, 23 nt, Shigella flexneri 2a str. 2457T
ccccgcacaacggcuacuucuuc

SEQ ID NO: 3819529 - RNA, 22 nt, Shigella flexneri 2a str. 2457T
ccccgcgcucacaccacagcag

SEQ ID NO: 3819530 - RNA, 17 nt, Shigella flexneri 2a str. 2457T
ccccggcccucucccua

SEQ ID NO: 3819531 - RNA, 22 nt, Shigella flexneri 2a str. 2457T
ccccggcugccggaugacagac

SEQ ID NO: 3819532 - RNA, 18 nt, Shigella flexneri 2a str. 2457T
ccccgguaauugcacguc

SEQ ID NO: 3819533 - RNA, 18 nt, Shigella flexneri 2a str. 2457T
ccccggucagcagcacca

SEQ ID NO: 3819534 - RNA, 12 nt, Shigella flexneri 2a str. 2457T
ccccgucaccac

SEQ ID NO: 3819535 - RNA, 21 nt, Shigella flexneri 2a str. 2457T
ccccgugaugaacugcgguaa

SEQ ID NO: 3819536 - RNA, 21 nt, Shigella flexneri 2a str. 2457T
ccccucacccuaacccucucc

SEQ ID NO: 3819537 - RNA, 15 nt, Shigella flexneri 2a str. 2457T
ccccucuauccagcu

SEQ ID NO: 3819538 - RNA, 17 nt, Shigella flexneri 2a str. 2457T
ccccugagacaguuauu

SEQ ID NO: 3819539 - RNA, 21 nt, Shigella flexneri 2a str. 2457T
ccccugagcguuacccgcagc

SEQ ID NO: 3819540 - RNA, 17 nt, Shigella flexneri 2a str. 2457T
ccccugauaaccgcauc

SEQ ID NO: 3819541 - RNA, 22 nt, Shigella flexneri 2a str. 2457T
ccccugcgauugugacacgcgc

SEQ ID NO: 3819542 - RNA, 11 nt, Shigella flexneri 2a str. 2457T
ccccugcgguu

SEQ ID NO: 3819543 - RNA, 14 nt, Shigella flexneri 2a str. 2457T
ccccuggcgagcau

SEQ ID NO: 3819544 - RNA, 12 nt, Shigella flexneri 2a str. 2457T
ccccuguugcaa

SEQ ID NO: 3819545 - RNA, 19 nt, Shigella flexneri 2a str. 2457T
ccccuguugugccagacca

SEQ ID NO: 3819546 - RNA, 13 nt, Shigella flexneri 2a str. 2457T
ccccuucugccgc

SEQ ID NO: 3819547 - RNA, 21 nt, Shigella flexneri 2a str. 2457T
ccccuuucuuauuuuucugca

SEQ ID NO: 3819548 - RNA, 22 nt, Shigella flexneri 2a str. 2457T
ccccuuugaccagccagucagu

SEQ ID NO: 3819549 - RNA, 19 nt, Shigella flexneri 2a str. 2457T
cccgaaggaauuuuacagc

SEQ ID NO: 3819550 - RNA, 14 nt, Shigella flexneri 2a str. 2457T
cccgaaugaccgcc

SEQ ID NO: 3819551 - RNA, 15 nt, Shigella flexneri 2a str. 2457T
cccgaaugaccgccc

SEQ ID NO: 3819552 - RNA, 18 nt, Shigella flexneri 2a str. 2457T
cccgacaaccugaccuuu

SEQ ID NO: 3819553 - RNA, 19 nt, Shigella flexneri 2a str. 2457T
cccgacgauaccgccgcac

SEQ ID NO: 3819554 - RNA, 17 nt, Shigella flexneri 2a str. 2457T
cccgacuccagcagugc

SEQ ID NO: 3819555 - RNA, 19 nt, Shigella flexneri 2a str. 2457T
cccgagauacaucaccgcc

SEQ ID NO: 3819556 - RNA, 21 nt, Shigella flexneri 2a str. 2457T
cccgagcggccaaagggagca

SEQ ID NO: 3819557 - RNA, 14 nt, Shigella flexneri 2a str. 2457T
cccgauacgcuugc

SEQ ID NO: 3819558 - RNA, 14 nt, Shigella flexneri 2a str. 2457T
cccgaucgcucaua

SEQ ID NO: 3819559 - RNA, 17 nt, Shigella flexneri 2a str. 2457T
cccgaugaugaugggcg

SEQ ID NO: 3819560 - RNA, 13 nt, Shigella flexneri 2a str. 2457T
cccgaugcaaaaa

SEQ ID NO: 3819561 - RNA, 11 nt, Shigella flexneri 2a str. 2457T
cccgauggcuu

SEQ ID NO: 3819562 - RNA, 17 nt, Shigella flexneri 2a str. 2457T
cccgauggucagcuuca

SEQ ID NO: 3819563 - RNA, 20 nt, Shigella flexneri 2a str. 2457T
cccgauggucagcuucaccu

SEQ ID NO: 3819564 - RNA, 21 nt, Shigella flexneri 2a str. 2457T
cccgcaaacaggaacaccagc

SEQ ID NO: 3819565 - RNA, 18 nt, Shigella flexneri 2a str. 2457T
cccgcaacagcaauacgu

SEQ ID NO: 3819566 - RNA, 23 nt, Shigella flexneri 2a str. 2457T
cccgcaagacgaaccggcaccca

SEQ ID NO: 3819567 - RNA, 16 nt, Shigella flexneri 2a str. 2457T
cccgcacaaagcacgc

SEQ ID NO: 3819568 - RNA, 23 nt, Shigella flexneri 2a str. 2457T
cccgcacagucacuacgcgaccg

SEQ ID NO: 3819569 - RNA, 21 nt, Shigella flexneri 2a str. 2457T
cccgcacgcuuaauugaaccu

SEQ ID NO: 3819570 - RNA, 16 nt, Shigella flexneri 2a str. 2457T
cccgcacggccgcaag

SEQ ID NO: 3819571 - RNA, 12 nt, Shigella flexneri 2a str. 2457T
cccgcagccacg

SEQ ID NO: 3819572 - RNA, 14 nt, Shigella flexneri 2a str. 2457T
cccgcagcuccagc

SEQ ID NO: 3819573 - RNA, 15 nt, Shigella flexneri 2a str. 2457T
cccgcagcuccagcc

SEQ ID NO: 3819574 - RNA, 18 nt, Shigella flexneri 2a str. 2457T
cccgcaggagcgccgaau

SEQ ID NO: 3819575 - RNA, 12 nt, Shigella flexneri 2a str. 2457T
cccgccacccca

SEQ ID NO: 3819576 - RNA, 13 nt, Shigella flexneri 2a str. 2457T
cccgccagcacga

SEQ ID NO: 3819577 - RNA, 16 nt, Shigella flexneri 2a str. 2457T
cccgccagcgcggcga

SEQ ID NO: 3819578 - RNA, 20 nt, Shigella flexneri 2a str. 2457T
cccgccauaacggcugucca

SEQ ID NO: 3819579 - RNA, 22 nt, Shigella flexneri 2a str. 2457T
cccgccgcugguuaccaccugc

SEQ ID NO: 3819580 - RNA, 16 nt, Shigella flexneri 2a str. 2457T
cccgccguugccgcag

SEQ ID NO: 3819581 - RNA, 18 nt, Shigella flexneri 2a str. 2457T
cccgcgauaaaaauccug

SEQ ID NO: 3819582 - RNA, 21 nt, Shigella flexneri 2a str. 2457T
cccgcgcgguaucaccaccca

SEQ ID NO: 3819583 - RNA, 18 nt, Shigella flexneri 2a str. 2457T
cccgcguuaagacacacu

SEQ ID NO: 3819584 - RNA, 19 nt, Shigella flexneri 2a str. 2457T
cccgcguuaagacacacua

SEQ ID NO: 3819585 - RNA, 12 nt, Shigella flexneri 2a str. 2457T
cccgcguucugg

SEQ ID NO: 3819586 - RNA, 13 nt, Shigella flexneri 2a str. 2457T
cccgcucaaacac

SEQ ID NO: 3819587 - RNA, 20 nt, Shigella flexneri 2a str. 2457T
cccgcucaaacaccgucgca

SEQ ID NO: 3819588 - RNA, 13 nt, Shigella flexneri 2a str. 2457T
cccgcugaaaagc

SEQ ID NO: 3819589 - RNA, 17 nt, Shigella flexneri 2a str. 2457T
cccgcuguaaaugcugc

SEQ ID NO: 3819590 - RNA, 21 nt, Shigella flexneri 2a str. 2457T
cccgcuguuuguucaagcgca

SEQ ID NO: 3819591 - RNA, 15 nt, Shigella flexneri 2a str. 2457T
cccgcuuccugcagc

SEQ ID NO: 3819592 - RNA, 15 nt, Shigella flexneri 2a str. 2457T
cccgcuucgcccgcc

SEQ ID NO: 3819593 - RNA, 20 nt, Shigella flexneri 2a str. 2457T
cccgcuucguuuucagcuuc

SEQ ID NO: 3819594 - RNA, 23 nt, Shigella flexneri 2a str. 2457T
cccgcuuuggcgucuucugccgg

SEQ ID NO: 3819595 - RNA, 20 nt, Shigella flexneri 2a str. 2457T
cccgcuuuuuugucaccuuu

SEQ ID NO: 3819596 - RNA, 23 nt, Shigella flexneri 2a str. 2457T
cccggaacgggagaaacccggcc

SEQ ID NO: 3819597 - RNA, 14 nt, Shigella flexneri 2a str. 2457T
cccggaacuccugg

SEQ ID NO: 3819598 - RNA, 17 nt, Shigella flexneri 2a str. 2457T
cccggaagcaucaaacg

SEQ ID NO: 3819599 - RNA, 12 nt, Shigella flexneri 2a str. 2457T
cccggaagccac

SEQ ID NO: 3819600 - RNA, 13 nt, Shigella flexneri 2a str. 2457T
cccggaagccacc

SEQ ID NO: 3819601 - RNA, 15 nt, Shigella flexneri 2a str. 2457T
cccggaauucucaaa

SEQ ID NO: 3819602 - RNA, 20 nt, Shigella flexneri 2a str. 2457T
cccggacaguccccucgccc

SEQ ID NO: 3819603 - RNA, 15 nt, Shigella flexneri 2a str. 2457T
cccggauaucaccac

SEQ ID NO: 3819604 - RNA, 16 nt, Shigella flexneri 2a str. 2457T
cccggaucguucacau

SEQ ID NO: 3819605 - RNA, 21 nt, Shigella flexneri 2a str. 2457T
cccggcaagaaauaccgaaga

SEQ ID NO: 3819606 - RNA, 23 nt, Shigella flexneri 2a str. 2457T
cccggcaagaaauaccgaagagu

SEQ ID NO: 3819607 - RNA, 21 nt, Shigella flexneri 2a str. 2457T
cccggcaaucaccgccagcgg

SEQ ID NO: 3819608 - RNA, 18 nt, Shigella flexneri 2a str. 2457T
cccggcaauggguaacgg

SEQ ID NO: 3819609 - RNA, 16 nt, Shigella flexneri 2a str. 2457T
cccggcaccaaucacc

SEQ ID NO: 3819610 - RNA, 20 nt, Shigella flexneri 2a str. 2457T
cccggcacguuuuggcagac

SEQ ID NO: 3819611 - RNA, 17 nt, Shigella flexneri 2a str. 2457T
cccggcauucaccucug

SEQ ID NO: 3819612 - RNA, 23 nt, Shigella flexneri 2a str. 2457T
cccggcauucaccucugcggcaa

SEQ ID NO: 3819613 - RNA, 17 nt, Shigella flexneri 2a str. 2457T
cccggccacagcgccag

SEQ ID NO: 3819614 - RNA, 17 nt, Shigella flexneri 2a str. 2457T
cccggccugugucacuu

SEQ ID NO: 3819615 - RNA, 23 nt, Shigella flexneri 2a str. 2457T
cccggcgaugguuuucaucccga

SEQ ID NO: 3819616 - RNA, 17 nt, Shigella flexneri 2a str. 2457T
cccggcgcagcgcgcga

SEQ ID NO: 3819617 - RNA, 16 nt, Shigella flexneri 2a str. 2457T
cccggcuggauaccaa

SEQ ID NO: 3819618 - RNA, 15 nt, Shigella flexneri 2a str. 2457T
cccgggucagcgcca

SEQ ID NO: 3819619 - RNA, 14 nt, Shigella flexneri 2a str. 2457T
cccgguaucaaacc

SEQ ID NO: 3819620 - RNA, 23 nt, Shigella flexneri 2a str. 2457T
cccggucagcagcaccaccgccc

SEQ ID NO: 3819621 - RNA, 15 nt, Shigella flexneri 2a str. 2457T
cccgucaccacuuca

SEQ ID NO: 3819622 - RNA, 19 nt, Shigella flexneri 2a str. 2457T
cccgucucccgaugccagc

SEQ ID NO: 3819623 - RNA, 18 nt, Shigella flexneri 2a str. 2457T
cccgucugacgcgugccu

SEQ ID NO: 3819624 - RNA, 15 nt, Shigella flexneri 2a str. 2457T
cccgugcacaaauuu

SEQ ID NO: 3819625 - RNA, 23 nt, Shigella flexneri 2a str. 2457T
cccguggcgagcgauaacccagc

SEQ ID NO: 3819626 - RNA, 19 nt, Shigella flexneri 2a str. 2457T
cccguucauccgcuucagg

SEQ ID NO: 3819627 - RNA, 23 nt, Shigella flexneri 2a str. 2457T
cccguuccaccgcguuuuccagu

SEQ ID NO: 3819628 - RNA, 14 nt, Shigella flexneri 2a str. 2457T
cccguuuucaccuu

SEQ ID NO: 3819629 - RNA, 16 nt, Shigella flexneri 2a str. 2457T
cccguuuuccgggcaa

SEQ ID NO: 3819630 - RNA, 18 nt, Shigella flexneri 2a str. 2457T
cccuaacccucuccccaa

SEQ ID NO: 3819631 - RNA, 16 nt, Shigella flexneri 2a str. 2457T
cccuaaucccgugccg

SEQ ID NO: 3819632 - RNA, 15 nt, Shigella flexneri 2a str. 2457T
cccuaggcauagaaa

SEQ ID NO: 3819633 - RNA, 11 nt, Shigella flexneri 2a str. 2457T
cccucaaacaa

SEQ ID NO: 3819634 - RNA, 22 nt, Shigella flexneri 2a str. 2457T
cccucacccuaacccucucccc

SEQ ID NO: 3819635 - RNA, 19 nt, Shigella flexneri 2a str. 2457T
cccucccguuucccugucu

SEQ ID NO: 3819636 - RNA, 14 nt, Shigella flexneri 2a str. 2457T
cccucgccccuccg

SEQ ID NO: 3819637 - RNA, 16 nt, Shigella flexneri 2a str. 2457T
cccucgcccgccgucc

SEQ ID NO: 3819638 - RNA, 16 nt, Shigella flexneri 2a str. 2457T
cccucgccgcuucccu

SEQ ID NO: 3819639 - RNA, 23 nt, Shigella flexneri 2a str. 2457T
cccucguuuugccgccaucaucg

SEQ ID NO: 3819640 - RNA, 14 nt, Shigella flexneri 2a str. 2457T
cccucuccccagaa

SEQ ID NO: 3819641 - RNA, 14 nt, Shigella flexneri 2a str. 2457T
cccucuucagccgc

SEQ ID NO: 3819642 - RNA, 14 nt, Shigella flexneri 2a str. 2457T
cccugaaggcgacg

SEQ ID NO: 3819643 - RNA, 17 nt, Shigella flexneri 2a str. 2457T
cccugacaaaucaugcg

SEQ ID NO: 3819644 - RNA, 16 nt, Shigella flexneri 2a str. 2457T
cccugagcaucaauac

SEQ ID NO: 3819645 - RNA, 14 nt, Shigella flexneri 2a str. 2457T
cccugauaaaucac

SEQ ID NO: 3819646 - RNA, 17 nt, Shigella flexneri 2a str. 2457T
cccugauaaaucaccug

SEQ ID NO: 3819647 - RNA, 21 nt, Shigella flexneri 2a str. 2457T
cccugauuaacgacacucucu

SEQ ID NO: 3819648 - RNA, 14 nt, Shigella flexneri 2a str. 2457T
cccugcaaacgggg

SEQ ID NO: 3819649 - RNA, 20 nt, Shigella flexneri 2a str. 2457T
cccugcaaauuauuugcgua

SEQ ID NO: 3819650 - RNA, 19 nt, Shigella flexneri 2a str. 2457T
cccugcacuuaacaggauc

SEQ ID NO: 3819651 - RNA, 20 nt, Shigella flexneri 2a str. 2457T
cccugcacuuaacaggaucu

SEQ ID NO: 3819652 - RNA, 15 nt, Shigella flexneri 2a str. 2457T
cccugcagcuggucg

SEQ ID NO: 3819653 - RNA, 14 nt, Shigella flexneri 2a str. 2457T
cccugcagucaccu

SEQ ID NO: 3819654 - RNA, 22 nt, Shigella flexneri 2a str. 2457T
cccugcagucaccugcccuccg

SEQ ID NO: 3819655 - RNA, 14 nt, Shigella flexneri 2a str. 2457T
cccugccaguccug

SEQ ID NO: 3819656 - RNA, 14 nt, Shigella flexneri 2a str. 2457T
cccugccgcggucu

SEQ ID NO: 3819657 - RNA, 14 nt, Shigella flexneri 2a str. 2457T
cccugccuccauga

SEQ ID NO: 3819658 - RNA, 23 nt, Shigella flexneri 2a str. 2457T
cccugcgauggugaagucauuga

SEQ ID NO: 3819659 - RNA, 19 nt, Shigella flexneri 2a str. 2457T
cccugcgcggcgacuucca

SEQ ID NO: 3819660 - RNA, 19 nt, Shigella flexneri 2a str. 2457T
cccugcgcuaaacaggauc

SEQ ID NO: 3819661 - RNA, 20 nt, Shigella flexneri 2a str. 2457T
cccugcgcuaaacaggaucu

SEQ ID NO: 3819662 - RNA, 18 nt, Shigella flexneri 2a str. 2457T
cccugcgcuggugaaaac

SEQ ID NO: 3819663 - RNA, 17 nt, Shigella flexneri 2a str. 2457T
cccugcgguuucaacga

SEQ ID NO: 3819664 - RNA, 20 nt, Shigella flexneri 2a str. 2457T
cccugcuaugcaagauguua

SEQ ID NO: 3819665 - RNA, 22 nt, Shigella flexneri 2a str. 2457T
cccugcucgucggcaaagcggg

SEQ ID NO: 3819666 - RNA, 14 nt, Shigella flexneri 2a str. 2457T
cccugcucuuucag

SEQ ID NO: 3819667 - RNA, 15 nt, Shigella flexneri 2a str. 2457T
cccugcucuuucagc

SEQ ID NO: 3819668 - RNA, 22 nt, Shigella flexneri 2a str. 2457T
cccugcuguuuuuucaggcccu

SEQ ID NO: 3819669 - RNA, 15 nt, Shigella flexneri 2a str. 2457T
cccugcuuugcaagc

SEQ ID NO: 3819670 - RNA, 19 nt, Shigella flexneri 2a str. 2457T
cccuggcaacccgggcucc

SEQ ID NO: 3819671 - RNA, 18 nt, Shigella flexneri 2a str. 2457T
cccuggcaauagcgcacg

SEQ ID NO: 3819672 - RNA, 20 nt, Shigella flexneri 2a str. 2457T
cccuggcaauagcgcacgcc

SEQ ID NO: 3819673 - RNA, 17 nt, Shigella flexneri 2a str. 2457T
cccuggccugaccgaug

SEQ ID NO: 3819674 - RNA, 21 nt, Shigella flexneri 2a str. 2457T
cccuggcgaugcccccagcag

SEQ ID NO: 3819675 - RNA, 16 nt, Shigella flexneri 2a str. 2457T
cccuggcucugcacua

SEQ ID NO: 3819676 - RNA, 19 nt, Shigella flexneri 2a str. 2457T
cccuggucaguuucagcca

SEQ ID NO: 3819677 - RNA, 16 nt, Shigella flexneri 2a str. 2457T
cccuguaauugccuga

SEQ ID NO: 3819678 - RNA, 23 nt, Shigella flexneri 2a str. 2457T
cccuguuugguugccagccacac

SEQ ID NO: 3819679 - RNA, 15 nt, Shigella flexneri 2a str. 2457T
cccuuacccuuacuc

SEQ ID NO: 3819680 - RNA, 22 nt, Shigella flexneri 2a str. 2457T
cccuuacgucccgaccccgacc

SEQ ID NO: 3819681 - RNA, 16 nt, Shigella flexneri 2a str. 2457T
cccuuauugcuaauga

SEQ ID NO: 3819682 - RNA, 20 nt, Shigella flexneri 2a str. 2457T
cccuucacgacauaaacauu

SEQ ID NO: 3819683 - RNA, 18 nt, Shigella flexneri 2a str. 2457T
cccuucacucugcugcca

SEQ ID NO: 3819684 - RNA, 17 nt, Shigella flexneri 2a str. 2457T
cccuucagccaccaggu

SEQ ID NO: 3819685 - RNA, 19 nt, Shigella flexneri 2a str. 2457T
cccuucaucgcuccugccg

SEQ ID NO: 3819686 - RNA, 20 nt, Shigella flexneri 2a str. 2457T
cccuuccagauucaguuuca

SEQ ID NO: 3819687 - RNA, 12 nt, Shigella flexneri 2a str. 2457T
cccuuccagcuu

SEQ ID NO: 3819688 - RNA, 23 nt, Shigella flexneri 2a str. 2457T
cccuucccgggucgcgacugcca

SEQ ID NO: 3819689 - RNA, 23 nt, Shigella flexneri 2a str. 2457T
cccuuccuugcuaagcccucuca

SEQ ID NO: 3819690 - RNA, 14 nt, Shigella flexneri 2a str. 2457T
cccuucgccgccgc

SEQ ID NO: 3819691 - RNA, 14 nt, Shigella flexneri 2a str. 2457T
cccuucucaauccc

SEQ ID NO: 3819692 - RNA, 10 nt, Shigella flexneri 2a str. 2457T
cccuucuucc

SEQ ID NO: 3819693 - RNA, 17 nt, Shigella flexneri 2a str. 2457T
cccuucuuuuauuucug

SEQ ID NO: 3819694 - RNA, 19 nt, Shigella flexneri 2a str. 2457T
cccuucuuuugucgugccc

SEQ ID NO: 3819695 - RNA, 19 nt, Shigella flexneri 2a str. 2457T
cccuugauguggcggaugg

SEQ ID NO: 3819696 - RNA, 13 nt, Shigella flexneri 2a str. 2457T
cccuugcaggcga

SEQ ID NO: 3819697 - RNA, 21 nt, Shigella flexneri 2a str. 2457T
cccuugcucugguucaccauu

SEQ ID NO: 3819698 - RNA, 19 nt, Shigella flexneri 2a str. 2457T
cccuugcuucgccaguucg

SEQ ID NO: 3819699 - RNA, 15 nt, Shigella flexneri 2a str. 2457T
cccuugucgcagcau

SEQ ID NO: 3819700 - RNA, 17 nt, Shigella flexneri 2a str. 2457T
cccuuucucuucaaacc

SEQ ID NO: 3819701 - RNA, 19 nt, Shigella flexneri 2a str. 2457T
cccuuugucgaaguuacca

SEQ ID NO: 3819702 - RNA, 22 nt, Shigella flexneri 2a str. 2457T
cccuuugucgaaguuaccaccc

SEQ ID NO: 3819703 - RNA, 15 nt, Shigella flexneri 2a str. 2457T
cccuuuuucacgcua

SEQ ID NO: 3819704 - RNA, 15 nt, Shigella flexneri 2a str. 2457T
cccuuuuuucaggug

SEQ ID NO: 3819705 - RNA, 13 nt, Shigella flexneri 2a str. 2457T
ccgaaacgcaccu

SEQ ID NO: 3819706 - RNA, 15 nt, Shigella flexneri 2a str. 2457T
ccgaaacgcaccuca

SEQ ID NO: 3819707 - RNA, 15 nt, Shigella flexneri 2a str. 2457T
ccgaaauauggcgcu

SEQ ID NO: 3819708 - RNA, 19 nt, Shigella flexneri 2a str. 2457T
ccgaacagcgccagacaaa

SEQ ID NO: 3819709 - RNA, 22 nt, Shigella flexneri 2a str. 2457T
ccgaacagcgccagacaaacca

SEQ ID NO: 3819710 - RNA, 23 nt, Shigella flexneri 2a str. 2457T
ccgaacagcgccagacaaaccac

SEQ ID NO: 3819711 - RNA, 16 nt, Shigella flexneri 2a str. 2457T
ccgaaccagugcucca

SEQ ID NO: 3819712 - RNA, 15 nt, Shigella flexneri 2a str. 2457T
ccgaagaaguaagcu

SEQ ID NO: 3819713 - RNA, 22 nt, Shigella flexneri 2a str. 2457T
ccgaagagggggcgauagaaua

SEQ ID NO: 3819714 - RNA, 19 nt, Shigella flexneri 2a str. 2457T
ccgaagaguaaccaaacgu

SEQ ID NO: 3819715 - RNA, 19 nt, Shigella flexneri 2a str. 2457T
ccgaagauagcgucauuuc

SEQ ID NO: 3819716 - RNA, 13 nt, Shigella flexneri 2a str. 2457T
ccgaagcagcuac

SEQ ID NO: 3819717 - RNA, 22 nt, Shigella flexneri 2a str. 2457T
ccgaagcccaucaguacaccac

SEQ ID NO: 3819718 - RNA, 21 nt, Shigella flexneri 2a str. 2457T
ccgaagcggcguuccaccgcu

SEQ ID NO: 3819719 - RNA, 21 nt, Shigella flexneri 2a str. 2457T
ccgaagcuuucuugcagcucu

SEQ ID NO: 3819720 - RNA, 14 nt, Shigella flexneri 2a str. 2457T
ccgaaggcaccauu

SEQ ID NO: 3819721 - RNA, 15 nt, Shigella flexneri 2a str. 2457T
ccgaaggcaccauua

SEQ ID NO: 3819722 - RNA, 17 nt, Shigella flexneri 2a str. 2457T
ccgaaggugcacuagac

SEQ ID NO: 3819723 - RNA, 18 nt, Shigella flexneri 2a str. 2457T
ccgaaguuguagcuggcu

SEQ ID NO: 3819724 - RNA, 14 nt, Shigella flexneri 2a str. 2457T
ccgaauaacgcgca

SEQ ID NO: 3819725 - RNA, 14 nt, Shigella flexneri 2a str. 2457T
ccgaauacggucuu

SEQ ID NO: 3819726 - RNA, 15 nt, Shigella flexneri 2a str. 2457T
ccgaauccaguaagc

SEQ ID NO: 3819727 - RNA, 16 nt, Shigella flexneri 2a str. 2457T
ccgaaugaccgccccu

SEQ ID NO: 3819728 - RNA, 16 nt, Shigella flexneri 2a str. 2457T
ccgaauuucauccugu

SEQ ID NO: 3819729 - RNA, 13 nt, Shigella flexneri 2a str. 2457T
ccgacacuggcag

SEQ ID NO: 3819730 - RNA, 12 nt, Shigella flexneri 2a str. 2457T
ccgacagaauau

SEQ ID NO: 3819731 - RNA, 13 nt, Shigella flexneri 2a str. 2457T
ccgacaucgccac

SEQ ID NO: 3819732 - RNA, 16 nt, Shigella flexneri 2a str. 2457T
ccgacauggugcgauu

SEQ ID NO: 3819733 - RNA, 14 nt, Shigella flexneri 2a str. 2457T
ccgacauugccagc

SEQ ID NO: 3819734 - RNA, 17 nt, Shigella flexneri 2a str. 2457T
ccgacauuugcacaaga

SEQ ID NO: 3819735 - RNA, 10 nt, Shigella flexneri 2a str. 2457T
ccgaccacuu

SEQ ID NO: 3819736 - RNA, 12 nt, Shigella flexneri 2a str. 2457T
ccgaccgcuuca

SEQ ID NO: 3819737 - RNA, 18 nt, Shigella flexneri 2a str. 2457T
ccgaccgucugcuggaac

SEQ ID NO: 3819738 - RNA, 12 nt, Shigella flexneri 2a str. 2457T
ccgaccucaaca

SEQ ID NO: 3819739 - RNA, 16 nt, Shigella flexneri 2a str. 2457T
ccgacgaggcgcuggc

SEQ ID NO: 3819740 - RNA, 19 nt, Shigella flexneri 2a str. 2457T
ccgacgauguuagcggcga

SEQ ID NO: 3819741 - RNA, 21 nt, Shigella flexneri 2a str. 2457T
ccgacgcaguggguaaugcug

SEQ ID NO: 3819742 - RNA, 13 nt, Shigella flexneri 2a str. 2457T
ccgacgugcagca

SEQ ID NO: 3819743 - RNA, 15 nt, Shigella flexneri 2a str. 2457T
ccgacgugcagcauc

SEQ ID NO: 3819744 - RNA, 19 nt, Shigella flexneri 2a str. 2457T
ccgacucacuugcagucgg

SEQ ID NO: 3819745 - RNA, 21 nt, Shigella flexneri 2a str. 2457T
ccgacuccagcagugccgcau

SEQ ID NO: 3819746 - RNA, 12 nt, Shigella flexneri 2a str. 2457T
ccgacugccugc

SEQ ID NO: 3819747 - RNA, 17 nt, Shigella flexneri 2a str. 2457T
ccgacugcgccaauacc

SEQ ID NO: 3819748 - RNA, 15 nt, Shigella flexneri 2a str. 2457T
ccgacugcggccuga

SEQ ID NO: 3819749 - RNA, 13 nt, Shigella flexneri 2a str. 2457T
ccgacuuauucuu

SEQ ID NO: 3819750 - RNA, 21 nt, Shigella flexneri 2a str. 2457T
ccgagaagauuuuuugccagc

SEQ ID NO: 3819751 - RNA, 22 nt, Shigella flexneri 2a str. 2457T
ccgagaagauuuuuugccagca

SEQ ID NO: 3819752 - RNA, 23 nt, Shigella flexneri 2a str. 2457T
ccgagauaaugguuuccagcauc

SEQ ID NO: 3819753 - RNA, 19 nt, Shigella flexneri 2a str. 2457T
ccgagcaaaucgcggcagu

SEQ ID NO: 3819754 - RNA, 15 nt, Shigella flexneri 2a str. 2457T
ccgagcaccacguug

SEQ ID NO: 3819755 - RNA, 17 nt, Shigella flexneri 2a str. 2457T
ccgagcagccacugcgg

SEQ ID NO: 3819756 - RNA, 19 nt, Shigella flexneri 2a str. 2457T
ccgagcgccccagaccuga

SEQ ID NO: 3819757 - RNA, 23 nt, Shigella flexneri 2a str. 2457T
ccgagcggucggagguucgaauc

SEQ ID NO: 3819758 - RNA, 20 nt, Shigella flexneri 2a str. 2457T
ccgagcguucaaaacggcug

SEQ ID NO: 3819759 - RNA, 17 nt, Shigella flexneri 2a str. 2457T
ccgaggcauucagccag

SEQ ID NO: 3819760 - RNA, 15 nt, Shigella flexneri 2a str. 2457T
ccgaggccaaaacca

SEQ ID NO: 3819761 - RNA, 20 nt, Shigella flexneri 2a str. 2457T
ccgaggcgcuggcagaaggc

SEQ ID NO: 3819762 - RNA, 23 nt, Shigella flexneri 2a str. 2457T
ccgaggcgcuggcagaaggccgc

SEQ ID NO: 3819763 - RNA, 15 nt, Shigella flexneri 2a str. 2457T
ccgagguagaacccu

SEQ ID NO: 3819764 - RNA, 19 nt, Shigella flexneri 2a str. 2457T
ccgaguaaaaaaacaucau

SEQ ID NO: 3819765 - RNA, 13 nt, Shigella flexneri 2a str. 2457T
ccgaguggcauuu

SEQ ID NO: 3819766 - RNA, 23 nt, Shigella flexneri 2a str. 2457T
ccgaguggcauuucgccaaacca

SEQ ID NO: 3819767 - RNA, 18 nt, Shigella flexneri 2a str. 2457T
ccgauaaaggucgacagc

SEQ ID NO: 3819768 - RNA, 22 nt, Shigella flexneri 2a str. 2457T
ccgauaaaggucgacagcagcc

SEQ ID NO: 3819769 - RNA, 20 nt, Shigella flexneri 2a str. 2457T
ccgauaaucaacaaaccaaa

SEQ ID NO: 3819770 - RNA, 21 nt, Shigella flexneri 2a str. 2457T
ccgauacacaucgucgccaga

SEQ ID NO: 3819771 - RNA, 21 nt, Shigella flexneri 2a str. 2457T
ccgauaccaauguagccgcgg

SEQ ID NO: 3819772 - RNA, 13 nt, Shigella flexneri 2a str. 2457T
ccgaucaaacgcc

SEQ ID NO: 3819773 - RNA, 13 nt, Shigella flexneri 2a str. 2457T
ccgaucaaggcau

SEQ ID NO: 3819774 - RNA, 16 nt, Shigella flexneri 2a str. 2457T
ccgaucaauuucacag

SEQ ID NO: 3819775 - RNA, 19 nt, Shigella flexneri 2a str. 2457T
ccgaucauacgaacgccug

SEQ ID NO: 3819776 - RNA, 14 nt, Shigella flexneri 2a str. 2457T
ccgauccggcacca

SEQ ID NO: 3819777 - RNA, 16 nt, Shigella flexneri 2a str. 2457T
ccgauccggcaccaau

SEQ ID NO: 3819778 - RNA, 18 nt, Shigella flexneri 2a str. 2457T
ccgauccuagaucgggca

SEQ ID NO: 3819779 - RNA, 17 nt, Shigella flexneri 2a str. 2457T
ccgaugaguuaagaaga

SEQ ID NO: 3819780 - RNA, 19 nt, Shigella flexneri 2a str. 2457T
ccgaugaucaacagcauca

SEQ ID NO: 3819781 - RNA, 21 nt, Shigella flexneri 2a str. 2457T
ccgaugaucaacagcaucauc

SEQ ID NO: 3819782 - RNA, 14 nt, Shigella flexneri 2a str. 2457T
ccgaugauucccag

SEQ ID NO: 3819783 - RNA, 22 nt, Shigella flexneri 2a str. 2457T
ccgauggcuugcgucauccagc

SEQ ID NO: 3819784 - RNA, 20 nt, Shigella flexneri 2a str. 2457T
ccgauuuucagccaucaucc

SEQ ID NO: 3819785 - RNA, 17 nt, Shigella flexneri 2a str. 2457T
ccgcaaaaccaacgccu

SEQ ID NO: 3819786 - RNA, 14 nt, Shigella flexneri 2a str. 2457T
ccgcaaaccuggca

SEQ ID NO: 3819787 - RNA, 13 nt, Shigella flexneri 2a str. 2457T
ccgcaaauaacgu

SEQ ID NO: 3819788 - RNA, 20 nt, Shigella flexneri 2a str. 2457T
ccgcaaaugauuagugccag

SEQ ID NO: 3819789 - RNA, 22 nt, Shigella flexneri 2a str. 2457T
ccgcaacaaugccgauaaauac

SEQ ID NO: 3819790 - RNA, 15 nt, Shigella flexneri 2a str. 2457T
ccgcaagcagacgcu

SEQ ID NO: 3819791 - RNA, 17 nt, Shigella flexneri 2a str. 2457T
ccgcaaggaagccugac

SEQ ID NO: 3819792 - RNA, 23 nt, Shigella flexneri 2a str. 2457T
ccgcaaucaucgaccccaggccg

SEQ ID NO: 3819793 - RNA, 14 nt, Shigella flexneri 2a str. 2457T
ccgcaauuccggug

SEQ ID NO: 3819794 - RNA, 15 nt, Shigella flexneri 2a str. 2457T
ccgcacaauacauag

SEQ ID NO: 3819795 - RNA, 13 nt, Shigella flexneri 2a str. 2457T
ccgcaccaggcag

SEQ ID NO: 3819796 - RNA, 12 nt, Shigella flexneri 2a str. 2457T
ccgcaccgccgu

SEQ ID NO: 3819797 - RNA, 18 nt, Shigella flexneri 2a str. 2457T
ccgcaccugaguaauuaa

SEQ ID NO: 3819798 - RNA, 17 nt, Shigella flexneri 2a str. 2457T
ccgcacggccgcaagca

SEQ ID NO: 3819799 - RNA, 16 nt, Shigella flexneri 2a str. 2457T
ccgcagaaaaagagca

SEQ ID NO: 3819800 - RNA, 21 nt, Shigella flexneri 2a str. 2457T
ccgcagagauagaacugcauu

SEQ ID NO: 3819801 - RNA, 22 nt, Shigella flexneri 2a str. 2457T
ccgcagauauucccguggcgag

SEQ ID NO: 3819802 - RNA, 15 nt, Shigella flexneri 2a str. 2457T
ccgcagaucagacca

SEQ ID NO: 3819803 - RNA, 16 nt, Shigella flexneri 2a str. 2457T
ccgcagauccagugcu

SEQ ID NO: 3819804 - RNA, 19 nt, Shigella flexneri 2a str. 2457T
ccgcagcauugcucaccgc

SEQ ID NO: 3819805 - RNA, 14 nt, Shigella flexneri 2a str. 2457T
ccgcagccaucaac

SEQ ID NO: 3819806 - RNA, 15 nt, Shigella flexneri 2a str. 2457T
ccgcagccaucacca

SEQ ID NO: 3819807 - RNA, 14 nt, Shigella flexneri 2a str. 2457T
ccgcagccgccaca

SEQ ID NO: 3819808 - RNA, 20 nt, Shigella flexneri 2a str. 2457T
ccgcagcgauugucagcugg

SEQ ID NO: 3819809 - RNA, 15 nt, Shigella flexneri 2a str. 2457T
ccgcaguaaagcgca

SEQ ID NO: 3819810 - RNA, 18 nt, Shigella flexneri 2a str. 2457T
ccgcagugauuucaaccg

SEQ ID NO: 3819811 - RNA, 23 nt, Shigella flexneri 2a str. 2457T
ccgcaguuaaagcaauuccagcg

SEQ ID NO: 3819812 - RNA, 21 nt, Shigella flexneri 2a str. 2457T
ccgcaguuucugauacugcuc

SEQ ID NO: 3819813 - RNA, 16 nt, Shigella flexneri 2a str. 2457T
ccgcauaccccuucac

SEQ ID NO: 3819814 - RNA, 19 nt, Shigella flexneri 2a str. 2457T
ccgcauaugagcgucgaag

SEQ ID NO: 3819815 - RNA, 23 nt, Shigella flexneri 2a str. 2457T
ccgcauaugcgggcguuuugcuu

SEQ ID NO: 3819816 - RNA, 16 nt, Shigella flexneri 2a str. 2457T
ccgcaucaaugaccuu

SEQ ID NO: 3819817 - RNA, 15 nt, Shigella flexneri 2a str. 2457T
ccgcaucacgacagc

SEQ ID NO: 3819818 - RNA, 19 nt, Shigella flexneri 2a str. 2457T
ccgcaucacuccacaccau

SEQ ID NO: 3819819 - RNA, 21 nt, Shigella flexneri 2a str. 2457T
ccgcaucacuccacaccauau

SEQ ID NO: 3819820 - RNA, 23 nt, Shigella flexneri 2a str. 2457T
ccgcaucaggcaucugagcauga

SEQ ID NO: 3819821 - RNA, 19 nt, Shigella flexneri 2a str. 2457T
ccgcauccggcaauaagca

SEQ ID NO: 3819822 - RNA, 21 nt, Shigella flexneri 2a str. 2457T
ccgcauccggugauuuucauc

SEQ ID NO: 3819823 - RNA, 19 nt, Shigella flexneri 2a str. 2457T
ccgcauccugcaccacgac

SEQ ID NO: 3819824 - RNA, 22 nt, Shigella flexneri 2a str. 2457T
ccgcauccugcaccacgacacc

SEQ ID NO: 3819825 - RNA, 22 nt, Shigella flexneri 2a str. 2457T
ccgcaucuucccagguuucaau

SEQ ID NO: 3819826 - RNA, 15 nt, Shigella flexneri 2a str. 2457T
ccgcaugcucacaga

SEQ ID NO: 3819827 - RNA, 18 nt, Shigella flexneri 2a str. 2457T
ccgcauggaaccaguuca

SEQ ID NO: 3819828 - RNA, 22 nt, Shigella flexneri 2a str. 2457T
ccgcauuuuuucuucaguuccg

SEQ ID NO: 3819829 - RNA, 14 nt, Shigella flexneri 2a str. 2457T
ccgccaaacgcggu

SEQ ID NO: 3819830 - RNA, 21 nt, Shigella flexneri 2a str. 2457T
ccgccaauaaccggcacuuca

SEQ ID NO: 3819831 - RNA, 13 nt, Shigella flexneri 2a str. 2457T
ccgccaccagcgu

SEQ ID NO: 3819832 - RNA, 15 nt, Shigella flexneri 2a str. 2457T
ccgccacgcccuccu

SEQ ID NO: 3819833 - RNA, 18 nt, Shigella flexneri 2a str. 2457T
ccgccacuaucgccauca

SEQ ID NO: 3819834 - RNA, 13 nt, Shigella flexneri 2a str. 2457T
ccgccacugccac

SEQ ID NO: 3819835 - RNA, 22 nt, Shigella flexneri 2a str. 2457T
ccgccacuugagccuccagcgg

SEQ ID NO: 3819836 - RNA, 17 nt, Shigella flexneri 2a str. 2457T
ccgccagacguccggcg

SEQ ID NO: 3819837 - RNA, 12 nt, Shigella flexneri 2a str. 2457T
ccgccagccgca

SEQ ID NO: 3819838 - RNA, 12 nt, Shigella flexneri 2a str. 2457T
ccgccagcgcca

SEQ ID NO: 3819839 - RNA, 14 nt, Shigella flexneri 2a str. 2457T
ccgccagcggcggc

SEQ ID NO: 3819840 - RNA, 19 nt, Shigella flexneri 2a str. 2457T
ccgccagcuucgcuuccca

SEQ ID NO: 3819841 - RNA, 17 nt, Shigella flexneri 2a str. 2457T
ccgccagugccaaagcc

SEQ ID NO: 3819842 - RNA, 15 nt, Shigella flexneri 2a str. 2457T
ccgccaguguggcgg

SEQ ID NO: 3819843 - RNA, 18 nt, Shigella flexneri 2a str. 2457T
ccgccaguuacugccacc

SEQ ID NO: 3819844 - RNA, 17 nt, Shigella flexneri 2a str. 2457T
ccgccaguucuuccagu

SEQ ID NO: 3819845 - RNA, 12 nt, Shigella flexneri 2a str. 2457T
ccgccaguuuac

SEQ ID NO: 3819846 - RNA, 17 nt, Shigella flexneri 2a str. 2457T
ccgccaguuuugugccc

SEQ ID NO: 3819847 - RNA, 18 nt, Shigella flexneri 2a str. 2457T
ccgccaguuuugugcccg

SEQ ID NO: 3819848 - RNA, 13 nt, Shigella flexneri 2a str. 2457T
ccgccauaaacag

SEQ ID NO: 3819849 - RNA, 19 nt, Shigella flexneri 2a str. 2457T
ccgccauaaacagcaggca

SEQ ID NO: 3819850 - RNA, 15 nt, Shigella flexneri 2a str. 2457T
ccgccauagaaagga

SEQ ID NO: 3819851 - RNA, 14 nt, Shigella flexneri 2a str. 2457T
ccgccaucgacaac

SEQ ID NO: 3819852 - RNA, 16 nt, Shigella flexneri 2a str. 2457T
ccgccaucucuuccag

SEQ ID NO: 3819853 - RNA, 17 nt, Shigella flexneri 2a str. 2457T
ccgccaucucuuccagc

SEQ ID NO: 3819854 - RNA, 16 nt, Shigella flexneri 2a str. 2457T
cgccauccgguuauca

SEQ ID NO: 3819855 - RNA, 22 nt, Shigella flexneri 2a str. 2457T
cgccauccgguuaucagaagau

SEQ ID NO: 3819856 - RNA, 23 nt, Shigella flexneri 2a str. 2457T
cgccauccugauagcuuacggcg

SEQ ID NO: 3819857 - RNA, 12 nt, Shigella flexneri 2a str. 2457T
cgccaucgccag

SEQ ID NO: 3819858 - RNA, 16 nt, Shigella flexneri 2a str. 2457T
cgccaucgccagcagc

SEQ ID NO: 3819859 - RNA, 15 nt, Shigella flexneri 2a str. 2457T
cgccaucgcccaucc

SEQ ID NO: 3819860 - RNA, 21 nt, Shigella flexneri 2a str. 2457T
cgccaucggcagcaucgcuca

SEQ ID NO: 3819861 - RNA, 21 nt, Shigella flexneri 2a str. 2457T
cgccaucguugaugcguaugg

SEQ ID NO: 3819862 - RNA, 14 nt, Shigella flexneri 2a str. 2457T
cgccaucucuucca

SEQ ID NO: 3819863 - RNA, 15 nt, Shigella flexneri 2a str. 2457T
cgccaucucuuccag

SEQ ID NO: 3819864 - RNA, 14 nt, Shigella flexneri 2a str. 2457T
cgccaugaagaugg

SEQ ID NO: 3819865 - RNA, 20 nt, Shigella flexneri 2a str. 2457T
cgccaugugcgacgggccaa

SEQ ID NO: 3819866 - RNA, 16 nt, Shigella flexneri 2a str. 2457T
cgccauguugccuggg

SEQ ID NO: 3819867 - RNA, 19 nt, Shigella flexneri 2a str. 2457T
cgccauguugccuggggag

SEQ ID NO: 3819868 - RNA, 21 nt, Shigella flexneri 2a str. 2457T
cgccauuaaacaacccaagcg

SEQ ID NO: 3819869 - RNA, 17 nt, Shigella flexneri 2a str. 2457T
cgccauugaaaccgcug

SEQ ID NO: 3819870 - RNA, 19 nt, Shigella flexneri 2a str. 2457T
cgccauugacguuccuuuc

SEQ ID NO: 3819871 - RNA, 17 nt, Shigella flexneri 2a str. 2457T
cgccauuucgucgucgg

SEQ ID NO: 3819872 - RNA, 20 nt, Shigella flexneri 2a str. 2457T
cgccauuucuucuccggcau

SEQ ID NO: 3819873 - RNA, 23 nt, Shigella flexneri 2a str. 2457T
cgccauuuugcgcggcauuacgc

SEQ ID NO: 3819874 - RNA, 16 nt, Shigella flexneri 2a str. 2457T
cgccauuuuuuauaca

SEQ ID NO: 3819875 - RNA, 15 nt, Shigella flexneri 2a str. 2457T
cgcccaaaccaccca

SEQ ID NO: 3819876 - RNA, 20 nt, Shigella flexneri 2a str. 2457T
cgcccaaaccacccagcagc

SEQ ID NO: 3819877 - RNA, 14 nt, Shigella flexneri 2a str. 2457T
cgcccaccaccagc

SEQ ID NO: 3819878 - RNA, 22 nt, Shigella flexneri 2a str. 2457T
cgcccacgcgcauucccagcgc

SEQ ID NO: 3819879 - RNA, 17 nt, Shigella flexneri 2a str. 2457T
cgcccagaccugcguuc

SEQ ID NO: 3819880 - RNA, 11 nt, Shigella flexneri 2a str. 2457T
cgcccagcaga

SEQ ID NO: 3819881 - RNA, 12 nt, Shigella flexneri 2a str. 2457T
cgcccagcagac

SEQ ID NO: 3819882 - RNA, 18 nt, Shigella flexneri 2a str. 2457T
cgcccagcgcaggaaaga

SEQ ID NO: 3819883 - RNA, 17 nt, Shigella flexneri 2a str. 2457T
cgcccagcguugcacau

SEQ ID NO: 3819884 - RNA, 14 nt, Shigella flexneri 2a str. 2457T
cgcccagcuaaucg

SEQ ID NO: 3819885 - RNA, 13 nt, Shigella flexneri 2a str. 2457T
cgcccagcuucau

SEQ ID NO: 3819886 - RNA, 12 nt, Shigella flexneri 2a str. 2457T
cgcccagugcgg

SEQ ID NO: 3819887 - RNA, 15 nt, Shigella flexneri 2a str. 2457T
cgcccaguucuacaa

SEQ ID NO: 3819888 - RNA, 21 nt, Shigella flexneri 2a str. 2457T
cgcccaguugaucaccagugc

SEQ ID NO: 3819889 - RNA, 12 nt, Shigella flexneri 2a str. 2457T
cgcccaucauuc

SEQ ID NO: 3819890 - RNA, 14 nt, Shigella flexneri 2a str. 2457T
cgcccauuccagua

SEQ ID NO: 3819891 - RNA, 13 nt, Shigella flexneri 2a str. 2457T
cgcccauugagcc

SEQ ID NO: 3819892 - RNA, 20 nt, Shigella flexneri 2a str. 2457T
cgccccacaaacccgccaga

SEQ ID NO: 3819893 - RNA, 19 nt, Shigella flexneri 2a str. 2457T
cgccccacagacccaggua

SEQ ID NO: 3819894 - RNA, 15 nt, Shigella flexneri 2a str. 2457T
cgcccccgauccagc

SEQ ID NO: 3819895 - RNA, 18 nt, Shigella flexneri 2a str. 2457T
cgcccccgggccuccccg

SEQ ID NO: 3819896 - RNA, 16 nt, Shigella flexneri 2a str. 2457T
cgccccgguuucucuu

SEQ ID NO: 3819897 - RNA, 15 nt, Shigella flexneri 2a str. 2457T
cgccccgugaugaac

SEQ ID NO: 3819898 - RNA, 11 nt, Shigella flexneri 2a str. 2457T
cgccccugaca

SEQ ID NO: 3819899 - RNA, 22 nt, Shigella flexneri 2a str. 2457T
cgccccugcacuuaacaggauc

SEQ ID NO: 3819900 - RNA, 14 nt, Shigella flexneri 2a str. 2457T
cgccccuuccaggc

SEQ ID NO: 3819901 - RNA, 17 nt, Shigella flexneri 2a str. 2457T
cgccccuucugccgcaa

SEQ ID NO: 3819902 - RNA, 21 nt, Shigella flexneri 2a str. 2457T
cgcccgaauugaagccaaauc

SEQ ID NO: 3819903 - RNA, 20 nt, Shigella flexneri 2a str. 2457T
cgcccgaccaucgccagcuc

SEQ ID NO: 3819904 - RNA, 16 nt, Shigella flexneri 2a str. 2457T
cgcccgacgaggcgcu

SEQ ID NO: 3819905 - RNA, 22 nt, Shigella flexneri 2a str. 2457T
cgcccgaugcauaauccgccgc

SEQ ID NO: 3819906 - RNA, 16 nt, Shigella flexneri 2a str. 2457T
cgcccgcuaugagcag

SEQ ID NO: 3819907 - RNA, 13 nt, Shigella flexneri 2a str. 2457T
cgcccgcuugcga

SEQ ID NO: 3819908 - RNA, 18 nt, Shigella flexneri 2a str. 2457T
cgcccggaaacgggcgcu

SEQ ID NO: 3819909 - RNA, 20 nt, Shigella flexneri 2a str. 2457T
cgcccggaaacgggcgcuga

SEQ ID NO: 3819910 - RNA, 19 nt, Shigella flexneri 2a str. 2457T
cgcccgguuuucgcgcgca

SEQ ID NO: 3819911 - RNA, 14 nt, Shigella flexneri 2a str. 2457T
cgcccgucaacggu

SEQ ID NO: 3819912 - RNA, 22 nt, Shigella flexneri 2a str. 2457T
cgcccgucacguucugcgccgu

SEQ ID NO: 3819913 - RNA, 18 nt, Shigella flexneri 2a str. 2457T
cgcccucagcccacaucc

SEQ ID NO: 3819914 - RNA, 19 nt, Shigella flexneri 2a str. 2457T
cgcccugauggcgcgccac

SEQ ID NO: 3819915 - RNA, 13 nt, Shigella flexneri 2a str. 2457T
cgcccugcuccag

SEQ ID NO: 3819916 - RNA, 17 nt, Shigella flexneri 2a str. 2457T
cgcccugcucgucggca

SEQ ID NO: 3819917 - RNA, 13 nt, Shigella flexneri 2a str. 2457T
cgcccuggaugca

SEQ ID NO: 3819918 - RNA, 18 nt, Shigella flexneri 2a str. 2457T
cgcccuggguaccgagaa

SEQ ID NO: 3819919 - RNA, 23 nt, Shigella flexneri 2a str. 2457T
cgcccuucacccauugccgccuc

SEQ ID NO: 3819920 - RNA, 18 nt, Shigella flexneri 2a str. 2457T
cgccgaauaacgcgcagc

SEQ ID NO: 3819921 - RNA, 14 nt, Shigella flexneri 2a str. 2457T
cgccgacgcccugc

SEQ ID NO: 3819922 - RNA, 13 nt, Shigella flexneri 2a str. 2457T
cgccgacggcgcu

SEQ ID NO: 3819923 - RNA, 19 nt, Shigella flexneri 2a str. 2457T
cgccgacggguaagaucuu

SEQ ID NO: 3819924 - RNA, 21 nt, Shigella flexneri 2a str. 2457T
cgccgacggucaggcuaauac

SEQ ID NO: 3819925 - RNA, 16 nt, Shigella flexneri 2a str. 2457T
cgccgagcaaugagcu

SEQ ID NO: 3819926 - RNA, 15 nt, Shigella flexneri 2a str. 2457T
cgccgagcaccacgu

SEQ ID NO: 3819927 - RNA, 19 nt, Shigella flexneri 2a str. 2457T
cgccgagcaguugcuucau

SEQ ID NO: 3819928 - RNA, 19 nt, Shigella flexneri 2a str. 2457T
cgccgauaucgcuggcaga

SEQ ID NO: 3819929 - RNA, 18 nt, Shigella flexneri 2a str. 2457T
cgccgaucgaagagacgc

SEQ ID NO: 3819930 - RNA, 19 nt, Shigella flexneri 2a str. 2457T
cgccgaucgaagagacgcu

SEQ ID NO: 3819931 - RNA, 21 nt, Shigella flexneri 2a str. 2457T
cgccgauuuugccuucauacu

SEQ ID NO: 3819932 - RNA, 13 nt, Shigella flexneri 2a str. 2457T
cgccgcaaaucgu

SEQ ID NO: 3819933 - RNA, 22 nt, Shigella flexneri 2a str. 2457T
cgccgcaaaucguauccggcau

SEQ ID NO: 3819934 - RNA, 14 nt, Shigella flexneri 2a str. 2457T
cgccgcacacgccg

SEQ ID NO: 3819935 - RNA, 22 nt, Shigella flexneri 2a str. 2457T
cgccgcauagcgacaggcuuuc

SEQ ID NO: 3819936 - RNA, 18 nt, Shigella flexneri 2a str. 2457T
cgccgcauaguaagccgg

SEQ ID NO: 3819937 - RNA, 13 nt, Shigella flexneri 2a str. 2457T
cgccgcauccgac

SEQ ID NO: 3819938 - RNA, 14 nt, Shigella flexneri 2a str. 2457T
cgccgcauccggca

SEQ ID NO: 3819939 - RNA, 13 nt, Shigella flexneri 2a str. 2457T
cgccgcauccggu

SEQ ID NO: 3819940 - RNA, 14 nt, Shigella flexneri 2a str. 2457T
cgccgccacugcaa

SEQ ID NO: 3819941 - RNA, 15 nt, Shigella flexneri 2a str. 2457T
cgccgccacugccac

SEQ ID NO: 3819942 - RNA, 14 nt, Shigella flexneri 2a str. 2457T
cgccgccaguacgc

SEQ ID NO: 3819943 - RNA, 23 nt, Shigella flexneri 2a str. 2457T
cgccgccagucgaauggcaucua

SEQ ID NO: 3819944 - RNA, 15 nt, Shigella flexneri 2a str. 2457T
cgccgccauagcgaa

SEQ ID NO: 3819945 - RNA, 20 nt, Shigella flexneri 2a str. 2457T
cgccgcccagccagccgagg

SEQ ID NO: 3819946 - RNA, 15 nt, Shigella flexneri 2a str. 2457T
cgccgcgacacaacg

SEQ ID NO: 3819947 - RNA, 16 nt, Shigella flexneri 2a str. 2457T
cgccgcgacgcccccu

SEQ ID NO: 3819948 - RNA, 13 nt, Shigella flexneri 2a str. 2457T
cgccgcgcggugg

SEQ ID NO: 3819949 - RNA, 21 nt, Shigella flexneri 2a str. 2457T
cgccgcguuuaucgacagacg

SEQ ID NO: 3819950 - RNA, 22 nt, Shigella flexneri 2a str. 2457T
cgccgcguuuaucgacagacgc

SEQ ID NO: 3819951 - RNA, 23 nt, Shigella flexneri 2a str. 2457T
cgccgcuauuauaucgcucucuu

SEQ ID NO: 3819952 - RNA, 13 nt, Shigella flexneri 2a str. 2457T
cgccgcugacggc

SEQ ID NO: 3819953 - RNA, 20 nt, Shigella flexneri 2a str. 2457T
cgccgcugucuaccagcacc

SEQ ID NO: 3819954 - RNA, 15 nt, Shigella flexneri 2a str. 2457T
cgccgcuuaccauaa

SEQ ID NO: 3819955 - RNA, 23 nt, Shigella flexneri 2a str. 2457T
cgccgcuucuguuuuaccugcgc

SEQ ID NO: 3819956 - RNA, 20 nt, Shigella flexneri 2a str. 2457T
cgccggaaucaacggcaaca

SEQ ID NO: 3819957 - RNA, 20 nt, Shigella flexneri 2a str. 2457T
cgccggacgucaggccgcca

SEQ ID NO: 3819958 - RNA, 23 nt, Shigella flexneri 2a str. 2457T
cgccggaugacacaucaccucca

SEQ ID NO: 3819959 - RNA, 18 nt, Shigella flexneri 2a str. 2457T
cgccgggaaauuuuuccg

SEQ ID NO: 3819960 - RNA, 16 nt, Shigella flexneri 2a str. 2457T
cgccgggguuauguga

SEQ ID NO: 3819961 - RNA, 15 nt, Shigella flexneri 2a str. 2457T
cgccgguaugggcaa

SEQ ID NO: 3819962 - RNA, 15 nt, Shigella flexneri 2a str. 2457T
cgccggucacgcccg

SEQ ID NO: 3819963 - RNA, 17 nt, Shigella flexneri 2a str. 2457T
cgccggugaccaucagc

SEQ ID NO: 3819964 - RNA, 16 nt, Shigella flexneri 2a str. 2457T
cgccgguuccagcuuc

SEQ ID NO: 3819965 - RNA, 22 nt, Shigella flexneri 2a str. 2457T
cgccgguugauuuuuuugauaa

SEQ ID NO: 3819966 - RNA, 14 nt, Shigella flexneri 2a str. 2457T
cgccguaacgcccu

SEQ ID NO: 3819967 - RNA, 14 nt, Shigella flexneri 2a str. 2457T
cgccguaagcgcgg

SEQ ID NO: 3819968 - RNA, 21 nt, Shigella flexneri 2a str. 2457T
cgccguacggcguaccgccgc

SEQ ID NO: 3819969 - RNA, 18 nt, Shigella flexneri 2a str. 2457T
cgccguauaauaucuuuu

SEQ ID NO: 3819970 - RNA, 13 nt, Shigella flexneri 2a str. 2457T
cgccgucaucaca

SEQ ID NO: 3819971 - RNA, 16 nt, Shigella flexneri 2a str. 2457T
cgccgucaucacaccg

SEQ ID NO: 3819972 - RNA, 15 nt, Shigella flexneri 2a str. 2457T
cgccgucaucacgca

SEQ ID NO: 3819973 - RNA, 20 nt, Shigella flexneri 2a str. 2457T
cgccgucaucacgcaggcug

SEQ ID NO: 3819974 - RNA, 18 nt, Shigella flexneri 2a str. 2457T
cgccguccacaaaccguu

SEQ ID NO: 3819975 - RNA, 14 nt, Shigella flexneri 2a str. 2457T
cgccguccggcgcu

SEQ ID NO: 3819976 - RNA, 13 nt, Shigella flexneri 2a str. 2457T
cgccgugaucugg

SEQ ID NO: 3819977 - RNA, 20 nt, Shigella flexneri 2a str. 2457T
cgccgugcaacugcggcgca

SEQ ID NO: 3819978 - RNA, 14 nt, Shigella flexneri 2a str. 2457T
cgccgugcacaccg

SEQ ID NO: 3819979 - RNA, 22 nt, Shigella flexneri 2a str. 2457T
cgccguuaacuucaccgguuca

SEQ ID NO: 3819980 - RNA, 21 nt, Shigella flexneri 2a str. 2457T
cgccguuauuaaaaagccugc

SEQ ID NO: 3819981 - RNA, 15 nt, Shigella flexneri 2a str. 2457T
cgccguugccgcagc

SEQ ID NO: 3819982 - RNA, 20 nt, Shigella flexneri 2a str. 2457T
cgccguuuuuacccagcagc

SEQ ID NO: 3819983 - RNA, 21 nt, Shigella flexneri 2a str. 2457T
cgccguuuuuacccagcagca

SEQ ID NO: 3819984 - RNA, 16 nt, Shigella flexneri 2a str. 2457T
cgccuaauaaauuugg

SEQ ID NO: 3819985 - RNA, 13 nt, Shigella flexneri 2a str. 2457T
cgccuaauccagc

SEQ ID NO: 3819986 - RNA, 19 nt, Shigella flexneri 2a str. 2457T
cgccuaccggaaucgcgcg

SEQ ID NO: 3819987 - RNA, 15 nt, Shigella flexneri 2a str. 2457T
cgccuacggcauucu

SEQ ID NO: 3819988 - RNA, 15 nt, Shigella flexneri 2a str. 2457T
cgccucacagggcuc

SEQ ID NO: 3819989 - RNA, 19 nt, Shigella flexneri 2a str. 2457T
cgccucacuauccgcccca

SEQ ID NO: 3819990 - RNA, 13 nt, Shigella flexneri 2a str. 2457T
cgccucagccaga

SEQ ID NO: 3819991 - RNA, 16 nt, Shigella flexneri 2a str. 2457T
cgccucccuucgcugc

SEQ ID NO: 3819992 - RNA, 14 nt, Shigella flexneri 2a str. 2457T
cgccuccuguucug

SEQ ID NO: 3819993 - RNA, 17 nt, Shigella flexneri 2a str. 2457T
cgccuccuguucugugc

SEQ ID NO: 3819994 - RNA, 18 nt, Shigella flexneri 2a str. 2457T
cgccucgagaaauuuuua

SEQ ID NO: 3819995 - RNA, 14 nt, Shigella flexneri 2a str. 2457T
cgccucgcauaauc

SEQ ID NO: 3819996 - RNA, 24 nt, Shigella flexneri 2a str. 2457T
cgccucguaaugcuccggcuccgc

SEQ ID NO: 3819997 - RNA, 22 nt, Shigella flexneri 2a str. 2457T
cgccucuaacagaucauccauc

SEQ ID NO: 3819998 - RNA, 23 nt, Shigella flexneri 2a str. 2457T
cgccucugcaagguucuuugcug

SEQ ID NO: 3819999 - RNA, 17 nt, Shigella flexneri 2a str. 2457T
cgccucuucauacaucu

SEQ ID NO: 3820000 - RNA, 18 nt, Shigella flexneri 2a str. 2457T
cgccugaaauacccgcuc

SEQ ID NO: 3820001 - RNA, 14 nt, Shigella flexneri 2a str. 2457T
cgccugaucgcgca

SEQ ID NO: 3820002 - RNA, 19 nt, Shigella flexneri 2a str. 2457T
cgccugauggacauucucc

SEQ ID NO: 3820003 - RNA, 20 nt, Shigella flexneri 2a str. 2457T
cgccugcaccauugcugccg

SEQ ID NO: 3820004 - RNA, 20 nt, Shigella flexneri 2a str. 2457T
cgccugcagggcuuucacgc

SEQ ID NO: 3820005 - RNA, 12 nt, Shigella flexneri 2a str. 2457T
cgccugcagguu

SEQ ID NO: 3820006 - RNA, 19 nt, Shigella flexneri 2a str. 2457T
cgccugccagaugcagcgg

SEQ ID NO: 3820007 - RNA, 21 nt, Shigella flexneri 2a str. 2457T
cgccugccgcauccggugauu

SEQ ID NO: 3820008 - RNA, 16 nt, Shigella flexneri 2a str. 2457T
cgccugcggccagcag

SEQ ID NO: 3820009 - RNA, 17 nt, Shigella flexneri 2a str. 2457T
cgccugcggccagcagc

SEQ ID NO: 3820010 - RNA, 23 nt, Shigella flexneri 2a str. 2457T
cgccugcggggagaugugauaac

SEQ ID NO: 3820011 - RNA, 23 nt, Shigella flexneri 2a str. 2457T
cgccugcuccucggugaucucaa

SEQ ID NO: 3820012 - RNA, 11 nt, Shigella flexneri 2a str. 2457T
cgccugcuucg

SEQ ID NO: 3820013 - RNA, 11 nt, Shigella flexneri 2a str. 2457T
cgccuggcagu

SEQ ID NO: 3820014 - RNA, 16 nt, Shigella flexneri 2a str. 2457T
cgccugguaccagcac

SEQ ID NO: 3820015 - RNA, 14 nt, Shigella flexneri 2a str. 2457T
cgccuggugaccgc

SEQ ID NO: 3820016 - RNA, 17 nt, Shigella flexneri 2a str. 2457T
cgccuguucccuucuca

SEQ ID NO: 3820017 - RNA, 13 nt, Shigella flexneri 2a str. 2457T
cgccuguugcguc

SEQ ID NO: 3820018 - RNA, 14 nt, Shigella flexneri 2a str. 2457T
cgccuuacgcugcg

SEQ ID NO: 3820019 - RNA, 18 nt, Shigella flexneri 2a str. 2457T
cgccuuacgcugcggucg

SEQ ID NO: 3820020 - RNA, 23 nt, Shigella flexneri 2a str. 2457T
cgccuuaucaggcggcuucgucg

SEQ ID NO: 3820021 - RNA, 19 nt, Shigella flexneri 2a str. 2457T
cgccuuauccggccuaccg

SEQ ID NO: 3820022 - RNA, 20 nt, Shigella flexneri 2a str. 2457T
cgccuuauccggccuaccgu

SEQ ID NO: 3820023 - RNA, 14 nt, Shigella flexneri 2a str. 2457T
cgccuuauccggcu

SEQ ID NO: 3820024 - RNA, 12 nt, Shigella flexneri 2a str. 2457T
cgccuucaacgu

SEQ ID NO: 3820025 - RNA, 18 nt, Shigella flexneri 2a str. 2457T
cgccuucagguuuuucag

SEQ ID NO: 3820026 - RNA, 13 nt, Shigella flexneri 2a str. 2457T
cgccuucaugcca

SEQ ID NO: 3820027 - RNA, 13 nt, Shigella flexneri 2a str. 2457T
cgccuucauucag

SEQ ID NO: 3820028 - RNA, 15 nt, Shigella flexneri 2a str. 2457T
cgccuucauucaggc

SEQ ID NO: 3820029 - RNA, 13 nt, Shigella flexneri 2a str. 2457T
cgccuucuugaac

SEQ ID NO: 3820030 - RNA, 19 nt, Shigella flexneri 2a str. 2457T
cgccuugcggaaauuccag

SEQ ID NO: 3820031 - RNA, 20 nt, Shigella flexneri 2a str. 2457T
cgccuuuaauauuaacgcca

SEQ ID NO: 3820032 - RNA, 16 nt, Shigella flexneri 2a str. 2457T
cgccuuuaccgcgcau

SEQ ID NO: 3820033 - RNA, 22 nt, Shigella flexneri 2a str. 2457T
cgccuuuaccgcgcauacggaa

SEQ ID NO: 3820034 - RNA, 14 nt, Shigella flexneri 2a str. 2457T
cgccuuucuuaaac

SEQ ID NO: 3820035 - RNA, 19 nt, Shigella flexneri 2a str. 2457T
cgccuuucuuaaacuucac

SEQ ID NO: 3820036 - RNA, 17 nt, Shigella flexneri 2a str. 2457T
cgccuuuuacgcauucg

SEQ ID NO: 3820037 - RNA, 22 nt, Shigella flexneri 2a str. 2457T
cgccuuuucaguuggcugacaa

SEQ ID NO: 3820038 - RNA, 21 nt, Shigella flexneri 2a str. 2457T
cgccuuuugauacucugucug

SEQ ID NO: 3820039 - RNA, 19 nt, Shigella flexneri 2a str. 2457T
cgccuuuuuucgccgcagc

SEQ ID NO: 3820040 - RNA, 15 nt, Shigella flexneri 2a str. 2457T
cgcgaaagaggcgca

SEQ ID NO: 3820041 - RNA, 22 nt, Shigella flexneri 2a str. 2457T
cgcgaaaugcagcguuuccagc

SEQ ID NO: 3820042 - RNA, 18 nt, Shigella flexneri 2a str. 2457T
cgcgaacagcacaucagc

SEQ ID NO: 3820043 - RNA, 22 nt, Shigella flexneri 2a str. 2457T
cgcgaacagcacaucagccaga

SEQ ID NO: 3820044 - RNA, 21 nt, Shigella flexneri 2a str. 2457T
cgcgaaccgccuggcgcugcu

SEQ ID NO: 3820045 - RNA, 19 nt, Shigella flexneri 2a str. 2457T
cgcgaacggggcugccagc

SEQ ID NO: 3820046 - RNA, 20 nt, Shigella flexneri 2a str. 2457T
cgcgaacuaaacaacgccgc

SEQ ID NO: 3820047 - RNA, 21 nt, Shigella flexneri 2a str. 2457T
cgcgaacuaaacaacgccgcc

SEQ ID NO: 3820048 - RNA, 13 nt, Shigella flexneri 2a str. 2457T
cgcgaacuggaug

SEQ ID NO: 3820049 - RNA, 18 nt, Shigella flexneri 2a str. 2457T
cgcgaacugucgguuugu

SEQ ID NO: 3820050 - RNA, 13 nt, Shigella flexneri 2a str. 2457T
cgcgaagaaacga

SEQ ID NO: 3820051 - RNA, 19 nt, Shigella flexneri 2a str. 2457T
cgcgaagcuggucagcauc

SEQ ID NO: 3820052 - RNA, 19 nt, Shigella flexneri 2a str. 2457T
cgcgacaagcgucgcauca

SEQ ID NO: 3820053 - RNA, 23 nt, Shigella flexneri 2a str. 2457T
cgcgacagauuuugccagcauga

SEQ ID NO: 3820054 - RNA, 19 nt, Shigella flexneri 2a str. 2457T
cgcgacaguaucaucauua

SEQ ID NO: 3820055 - RNA, 22 nt, Shigella flexneri 2a str. 2457T
cgcgacaucuucuccagcgaau

SEQ ID NO: 3820056 - RNA, 12 nt, Shigella flexneri 2a str. 2457T
cgcgacauggcg

SEQ ID NO: 3820057 - RNA, 16 nt, Shigella flexneri 2a str. 2457T
cgcgaccaaucacaca

SEQ ID NO: 3820058 - RNA, 11 nt, Shigella flexneri 2a str. 2457T
cgcgaccacca

SEQ ID NO: 3820059 - RNA, 23 nt, Shigella flexneri 2a str. 2457T
cgcgaccagcgucgcaucaggca

SEQ ID NO: 3820060 - RNA, 20 nt, Shigella flexneri 2a str. 2457T
cgcgaccaucggaucggcca

SEQ ID NO: 3820061 - RNA, 12 nt, Shigella flexneri 2a str. 2457T
cgcgaccgccgc

SEQ ID NO: 3820062 - RNA, 22 nt, Shigella flexneri 2a str. 2457T
cgcgaccgccucgcgccagcgu

SEQ ID NO: 3820063 - RNA, 22 nt, Shigella flexneri 2a str. 2457T
cgcgaccucacuuucuggcagc

SEQ ID NO: 3820064 - RNA, 15 nt, Shigella flexneri 2a str. 2457T
cgcgaccuguucucc

SEQ ID NO: 3820065 - RNA, 16 nt, Shigella flexneri 2a str. 2457T
cgcgacucccugacug

SEQ ID NO: 3820066 - RNA, 15 nt, Shigella flexneri 2a str. 2457T
cgcgacuuuuuccug

SEQ ID NO: 3820067 - RNA, 18 nt, Shigella flexneri 2a str. 2457T
cgcgagcuuuccggcggu

SEQ ID NO: 3820068 - RNA, 15 nt, Shigella flexneri 2a str. 2457T
cgcgagguuuuccuu

SEQ ID NO: 3820069 - RNA, 22 nt, Shigella flexneri 2a str. 2457T
cgcgauaaaagacgccgacauc

SEQ ID NO: 3820070 - RNA, 20 nt, Shigella flexneri 2a str. 2457T
cgcgauacuacguucaauca

SEQ ID NO: 3820071 - RNA, 17 nt, Shigella flexneri 2a str. 2457T
cgcgauagcaagcgcug

SEQ ID NO: 3820072 - RNA, 22 nt, Shigella flexneri 2a str. 2457T
cgcgauaucgcgguacuucuca

SEQ ID NO: 3820073 - RNA, 14 nt, Shigella flexneri 2a str. 2457T
cgcgauauugcugc

SEQ ID NO: 3820074 - RNA, 13 nt, Shigella flexneri 2a str. 2457T
cgcgaucgcgcca

SEQ ID NO: 3820075 - RNA, 19 nt, Shigella flexneri 2a str. 2457T
cgcgaucgcugagcuccug

SEQ ID NO: 3820076 - RNA, 13 nt, Shigella flexneri 2a str. 2457T
cgcgaucucguca

SEQ ID NO: 3820077 - RNA, 20 nt, Shigella flexneri 2a str. 2457T
cgcgaucuuccacgccugca

SEQ ID NO: 3820078 - RNA, 15 nt, Shigella flexneri 2a str. 2457T
cgcgaugccgccgua

SEQ ID NO: 3820079 - RNA, 16 nt, Shigella flexneri 2a str. 2457T
cgcgauuaugccgccg

SEQ ID NO: 3820080 - RNA, 21 nt, Shigella flexneri 2a str. 2457T
cgcgauucugauugccgcuuu

SEQ ID NO: 3820081 - RNA, 16 nt, Shigella flexneri 2a str. 2457T
cgcgcaaaaaaucgcc

SEQ ID NO: 3820082 - RNA, 15 nt, Shigella flexneri 2a str. 2457T
cgcgcaaauccacgu

SEQ ID NO: 3820083 - RNA, 18 nt, Shigella flexneri 2a str. 2457T
cgcgcaaccaacggccuu

SEQ ID NO: 3820084 - RNA, 20 nt, Shigella flexneri 2a str. 2457T
cgcgcaaccaacggccuugc

SEQ ID NO: 3820085 - RNA, 17 nt, Shigella flexneri 2a str. 2457T
cgcgcaaucagcaccgc

SEQ ID NO: 3820086 - RNA, 21 nt, Shigella flexneri 2a str. 2457T
cgcgcaaucagcaccgcgcgu

SEQ ID NO: 3820087 - RNA, 17 nt, Shigella flexneri 2a str. 2457T
cgcgcaauugccagaca

SEQ ID NO: 3820088 - RNA, 22 nt, Shigella flexneri 2a str. 2457T
cgcgcacguacaucccgcgaac

SEQ ID NO: 3820089 - RNA, 16 nt, Shigella flexneri 2a str. 2457T
cgcgcacgucagccuc

SEQ ID NO: 3820090 - RNA, 21 nt, Shigella flexneri 2a str. 2457T
cgcgcacuaugugccagcuuc

SEQ ID NO: 3820091 - RNA, 19 nt, Shigella flexneri 2a str. 2457T
cgcgcagaucguucggauc

SEQ ID NO: 3820092 - RNA, 13 nt, Shigella flexneri 2a str. 2457T
cgcgcagcuucac

SEQ ID NO: 3820093 - RNA, 21 nt, Shigella flexneri 2a str. 2457T
cgcgcaggaucgacugcaaac

SEQ ID NO: 3820094 - RNA, 22 nt, Shigella flexneri 2a str. 2457T
cgcgcaggcggauugcuucugc

SEQ ID NO: 3820095 - RNA, 18 nt, Shigella flexneri 2a str. 2457T
cgcgcaguuucuuaccua

SEQ ID NO: 3820096 - RNA, 22 nt, Shigella flexneri 2a str. 2457T
cgcgcaguuugucuucaaugcg

SEQ ID NO: 3820097 - RNA, 13 nt, Shigella flexneri 2a str. 2457T
cgcgcaucagcuc

SEQ ID NO: 3820098 - RNA, 18 nt, Shigella flexneri 2a str. 2457T
cgcgcaucuguaacggag

SEQ ID NO: 3820099 - RNA, 14 nt, Shigella flexneri 2a str. 2457T
cgcgccaauccaga

SEQ ID NO: 3820100 - RNA, 19 nt, Shigella flexneri 2a str. 2457T
cgcgccacaucagacucag

SEQ ID NO: 3820101 - RNA, 13 nt, Shigella flexneri 2a str. 2457T
cgcgccaccauuc

SEQ ID NO: 3820102 - RNA, 12 nt, Shigella flexneri 2a str. 2457T
cgcgccagccag

SEQ ID NO: 3820103 - RNA, 21 nt, Shigella flexneri 2a str. 2457T
cgcgccauauaauacgcaucg

SEQ ID NO: 3820104 - RNA, 18 nt, Shigella flexneri 2a str. 2457T
cgcgcccauacggcucag

SEQ ID NO: 3820105 - RNA, 18 nt, Shigella flexneri 2a str. 2457T
cgcgccccacggauugcc

SEQ ID NO: 3820106 - RNA, 21 nt, Shigella flexneri 2a str. 2457T
cgcgccccacggauugccgcu

SEQ ID NO: 3820107 - RNA, 16 nt, Shigella flexneri 2a str. 2457T
cgcgcccgccgcuggu

SEQ ID NO: 3820108 - RNA, 17 nt, Shigella flexneri 2a str. 2457T
cgcgcccuccugcagcg

SEQ ID NO: 3820109 - RNA, 14 nt, Shigella flexneri 2a str. 2457T
cgcgccgccaaccc

SEQ ID NO: 3820110 - RNA, 13 nt, Shigella flexneri 2a str. 2457T
cgcgccgccgccc

SEQ ID NO: 3820111 - RNA, 21 nt, Shigella flexneri 2a str. 2457T
cgcgccgcgguacagcucggu

SEQ ID NO: 3820112 - RNA, 15 nt, Shigella flexneri 2a str. 2457T
cgcgccucaggcacu

SEQ ID NO: 3820113 - RNA, 13 nt, Shigella flexneri 2a str. 2457T
cgcgccugccagg

SEQ ID NO: 3820114 - RNA, 14 nt, Shigella flexneri 2a str. 2457T
cgcgccugcggcca

SEQ ID NO: 3820115 - RNA, 15 nt, Shigella flexneri 2a str. 2457T
cgcgcgaauauggcg

SEQ ID NO: 3820116 - RNA, 21 nt, Shigella flexneri 2a str. 2457T
cgcgcgcugccagaaccgcuu

SEQ ID NO: 3820117 - RNA, 19 nt, Shigella flexneri 2a str. 2457T
cgcgcgcuuuuaccgcguc

SEQ ID NO: 3820118 - RNA, 18 nt, Shigella flexneri 2a str. 2457T
cgcgcggcgaaccagccg

SEQ ID NO: 3820119 - RNA, 18 nt, Shigella flexneri 2a str. 2457T
cgcgcgguaucaccaccc

SEQ ID NO: 3820120 - RNA, 21 nt, Shigella flexneri 2a str. 2457T
cgcgcggucauaaaauccgua

SEQ ID NO: 3820121 - RNA, 13 nt, Shigella flexneri 2a str. 2457T
cgcgcgucacgau

SEQ ID NO: 3820122 - RNA, 22 nt, Shigella flexneri 2a str. 2457T
cgcgcguccccugcccgcgauc

SEQ ID NO: 3820123 - RNA, 16 nt, Shigella flexneri 2a str. 2457T
cgcgcuaauuccaguc

SEQ ID NO: 3820124 - RNA, 14 nt, Shigella flexneri 2a str. 2457T
cgcgcuauugccgu

SEQ ID NO: 3820125 - RNA, 13 nt, Shigella flexneri 2a str. 2457T
cgcgcucacacca

SEQ ID NO: 3820126 - RNA, 15 nt, Shigella flexneri 2a str. 2457T
cgcgcucaucagcgg

SEQ ID NO: 3820127 - RNA, 22 nt, Shigella flexneri 2a str. 2457T
cgcgcucgaagcgggcgcgcag

SEQ ID NO: 3820128 - RNA, 14 nt, Shigella flexneri 2a str. 2457T
cgcgcucuucuucg

SEQ ID NO: 3820129 - RNA, 22 nt, Shigella flexneri 2a str. 2457T
cgcgcugccagaaccgcuucuu

SEQ ID NO: 3820130 - RNA, 15 nt, Shigella flexneri 2a str. 2457T
cgcgcuuaucgccag

SEQ ID NO: 3820131 - RNA, 16 nt, Shigella flexneri 2a str. 2457T
cgcgcuuaucgccagc

SEQ ID NO: 3820132 - RNA, 17 nt, Shigella flexneri 2a str. 2457T
cgcgcuucacaugccac

SEQ ID NO: 3820133 - RNA, 20 nt, Shigella flexneri 2a str. 2457T
cgcgcuugcggaagcaaccg

SEQ ID NO: 3820134 - RNA, 17 nt, Shigella flexneri 2a str. 2457T
cgcgcuuuuuuuaugcc

SEQ ID NO: 3820135 - RNA, 16 nt, Shigella flexneri 2a str. 2457T
cgcggaagacccggcg

SEQ ID NO: 3820136 - RNA, 18 nt, Shigella flexneri 2a str. 2457T
cgcggacaaacggcugga

SEQ ID NO: 3820137 - RNA, 12 nt, Shigella flexneri 2a str. 2457T
cgcggacgcaca

SEQ ID NO: 3820138 - RNA, 13 nt, Shigella flexneri 2a str. 2457T
cgcggauccccug

SEQ ID NO: 3820139 - RNA, 14 nt, Shigella flexneri 2a str. 2457T
cgcggauccccugc

SEQ ID NO: 3820140 - RNA, 22 nt, Shigella flexneri 2a str. 2457T
cgcggcaauuagcggccagcgg

SEQ ID NO: 3820141 - RNA, 22 nt, Shigella flexneri 2a str. 2457T
cgcggcacacagcacggcagca

SEQ ID NO: 3820142 - RNA, 21 nt, Shigella flexneri 2a str. 2457T
cgcggcagccaccgccagcgg

SEQ ID NO: 3820143 - RNA, 14 nt, Shigella flexneri 2a str. 2457T
cgcggcccaggcgg

SEQ ID NO: 3820144 - RNA, 19 nt, Shigella flexneri 2a str. 2457T
cgcggccuuuaccuucgcc

SEQ ID NO: 3820145 - RNA, 20 nt, Shigella flexneri 2a str. 2457T
cgcggcgaaggugccugccc

SEQ ID NO: 3820146 - RNA, 15 nt, Shigella flexneri 2a str. 2457T
cgcggcgacuuccag

SEQ ID NO: 3820147 - RNA, 13 nt, Shigella flexneri 2a str. 2457T
cgcggcuccagaa

SEQ ID NO: 3820148 - RNA, 12 nt, Shigella flexneri 2a str. 2457T
cgcggcucgugg

SEQ ID NO: 3820149 - RNA, 20 nt, Shigella flexneri 2a str. 2457T
cgcgggcgaauuaucggcag

SEQ ID NO: 3820150 - RNA, 21 nt, Shigella flexneri 2a str. 2457T
cgcgggcgaauuaucggcagc

SEQ ID NO: 3820151 - RNA, 20 nt, Shigella flexneri 2a str. 2457T
cgcggguaaguacgccauca

SEQ ID NO: 3820152 - RNA, 17 nt, Shigella flexneri 2a str. 2457T
cgcggguugccaccggu

SEQ ID NO: 3820153 - RNA, 15 nt, Shigella flexneri 2a str. 2457T
cgcgguaaacugcau

SEQ ID NO: 3820154 - RNA, 21 nt, Shigella flexneri 2a str. 2457T
cgcgguaaagcgcggcaguga

SEQ ID NO: 3820155 - RNA, 19 nt, Shigella flexneri 2a str. 2457T
cgcgguacuucucaccggu

SEQ ID NO: 3820156 - RNA, 12 nt, Shigella flexneri 2a str. 2457T
cgcgguagcacg

SEQ ID NO: 3820157 - RNA, 13 nt, Shigella flexneri 2a str. 2457T
cgcgguagcgggc

SEQ ID NO: 3820158 - RNA, 18 nt, Shigella flexneri 2a str. 2457T
cgcgguagcgggcaguaa

SEQ ID NO: 3820159 - RNA, 16 nt, Shigella flexneri 2a str. 2457T
cgcgguguauaccagc

SEQ ID NO: 3820160 - RNA, 20 nt, Shigella flexneri 2a str. 2457T
cgcgguguugauacaggcgc

SEQ ID NO: 3820161 - RNA, 22 nt, Shigella flexneri 2a str. 2457T
cgcgguguugauacaggcgcug

SEQ ID NO: 3820162 - RNA, 20 nt, Shigella flexneri 2a str. 2457T
cgcguaaccgguaccugccg

SEQ ID NO: 3820163 - RNA, 16 nt, Shigella flexneri 2a str. 2457T
cgcguaacugaagcau

SEQ ID NO: 3820164 - RNA, 14 nt, Shigella flexneri 2a str. 2457T
cgcguaauacauca

SEQ ID NO: 3820165 - RNA, 16 nt, Shigella flexneri 2a str. 2457T
cgcguaauggcagcau

SEQ ID NO: 3820166 - RNA, 14 nt, Shigella flexneri 2a str. 2457T
cgcguaccgcagca

SEQ ID NO: 3820167 - RNA, 12 nt, Shigella flexneri 2a str. 2457T
cgcguaccgccg

SEQ ID NO: 3820168 - RNA, 17 nt, Shigella flexneri 2a str. 2457T
cgcguagagaauccagu

SEQ ID NO: 3820169 - RNA, 20 nt, Shigella flexneri 2a str. 2457T
cgcguagagaauccagugcu

SEQ ID NO: 3820170 - RNA, 19 nt, Shigella flexneri 2a str. 2457T
cgcguaugguuuuuccagc

SEQ ID NO: 3820171 - RNA, 24 nt, Shigella flexneri 2a str. 2457T
cgcguaugguuuuuccagccgagc

SEQ ID NO: 3820172 - RNA, 19 nt, Shigella flexneri 2a str. 2457T
cgcgucaagcgucgcauca

SEQ ID NO: 3820173 - RNA, 13 nt, Shigella flexneri 2a str. 2457T
cgcgucacgcacu

SEQ ID NO: 3820174 - RNA, 16 nt, Shigella flexneri 2a str. 2457T
cgcgucagucgccccc

SEQ ID NO: 3820175 - RNA, 20 nt, Shigella flexneri 2a str. 2457T
cgcgucauugacgcuggcuu

SEQ ID NO: 3820176 - RNA, 19 nt, Shigella flexneri 2a str. 2457T
cgcguccggcgucgcuucu

SEQ ID NO: 3820177 - RNA, 18 nt, Shigella flexneri 2a str. 2457T
cgcgucgaccauaagaaa

SEQ ID NO: 3820178 - RNA, 20 nt, Shigella flexneri 2a str. 2457T
cgcgucguccccacagcguc

SEQ ID NO: 3820179 - RNA, 16 nt, Shigella flexneri 2a str. 2457T
cgcgucuuaucaugcc

SEQ ID NO: 3820180 - RNA, 16 nt, Shigella flexneri 2a str. 2457T
cgcgucuuaucuggcc

SEQ ID NO: 3820181 - RNA, 17 nt, Shigella flexneri 2a str. 2457T
cgcgugacgcuggcaga

SEQ ID NO: 3820182 - RNA, 16 nt, Shigella flexneri 2a str. 2457T
cgcgugcgcggcagcc

SEQ ID NO: 3820183 - RNA, 18 nt, Shigella flexneri 2a str. 2457T
cgcgugcggcauccggua

SEQ ID NO: 3820184 - RNA, 23 nt, Shigella flexneri 2a str. 2457T
cgcguggcaauggcgacuucugc

SEQ ID NO: 3820185 - RNA, 21 nt, Shigella flexneri 2a str. 2457T
cgcguuaucagcaacuggcaa

SEQ ID NO: 3820186 - RNA, 15 nt, Shigella flexneri 2a str. 2457T
cgcguuauccgcuuu

SEQ ID NO: 3820187 - RNA, 14 nt, Shigella flexneri 2a str. 2457T
cgcguuaucgacaa

SEQ ID NO: 3820188 - RNA, 14 nt, Shigella flexneri 2a str. 2457T
cgcguucacugccg

SEQ ID NO: 3820189 - RNA, 19 nt, Shigella flexneri 2a str. 2457T
cgcguucgauggcgcgcca

SEQ ID NO: 3820190 - RNA, 22 nt, Shigella flexneri 2a str. 2457T
cgcguugaugccgugcagcacg

SEQ ID NO: 3820191 - RNA, 21 nt, Shigella flexneri 2a str. 2457T
cgcguuggcaagauaggcauc

SEQ ID NO: 3820192 - RNA, 18 nt, Shigella flexneri 2a str. 2457T
cgcguuguugcaggaaca

SEQ ID NO: 3820193 - RNA, 17 nt, Shigella flexneri 2a str. 2457T
cgcguuuaaucacacca

SEQ ID NO: 3820194 - RNA, 14 nt, Shigella flexneri 2a str. 2457T
cgcguuuacagagc

SEQ ID NO: 3820195 - RNA, 21 nt, Shigella flexneri 2a str. 2457T
cgcguuuccacgcugauugca

SEQ ID NO: 3820196 - RNA, 21 nt, Shigella flexneri 2a str. 2457T
cgcguuucugcgcuucugcca

SEQ ID NO: 3820197 - RNA, 18 nt, Shigella flexneri 2a str. 2457T
cgcguuuuuucgauauca

SEQ ID NO: 3820198 - RNA, 18 nt, Shigella flexneri 2a str. 2457T
cgcuaaaaagcgccguuu

SEQ ID NO: 3820199 - RNA, 12 nt, Shigella flexneri 2a str. 2457T
cgcuaaauguuu

SEQ ID NO: 3820200 - RNA, 13 nt, Shigella flexneri 2a str. 2457T
cgcuaacagcagc

SEQ ID NO: 3820201 - RNA, 17 nt, Shigella flexneri 2a str. 2457T
cgcuaagauaccccagc

SEQ ID NO: 3820202 - RNA, 19 nt, Shigella flexneri 2a str. 2457T
cgcuaaggucaccaguuca

SEQ ID NO: 3820203 - RNA, 12 nt, Shigella flexneri 2a str. 2457T
cgcuaauaauaa

SEQ ID NO: 3820204 - RNA, 19 nt, Shigella flexneri 2a str. 2457T
cgcuaaugcgacccaugca

SEQ ID NO: 3820205 - RNA, 21 nt, Shigella flexneri 2a str. 2457T
cgcuaaugcgacccaugcacc

SEQ ID NO: 3820206 - RNA, 20 nt, Shigella flexneri 2a str. 2457T
cgcuaccaaaaaaucaaugc

SEQ ID NO: 3820207 - RNA, 14 nt, Shigella flexneri 2a str. 2457T
cgcuaccgcccuga

SEQ ID NO: 3820208 - RNA, 16 nt, Shigella flexneri 2a str. 2457T
cgcuacggcugauggc

SEQ ID NO: 3820209 - RNA, 13 nt, Shigella flexneri 2a str. 2457T
cgcuacuggcaau

SEQ ID NO: 3820210 - RNA, 15 nt, Shigella flexneri 2a str. 2457T
cgcuacuucaaacaa

SEQ ID NO: 3820211 - RNA, 20 nt, Shigella flexneri 2a str. 2457T
cgcuacuuuuuucacccaca

SEQ ID NO: 3820212 - RNA, 15 nt, Shigella flexneri 2a str. 2457T
cgcuauacagcagcc

SEQ ID NO: 3820213 - RNA, 23 nt, Shigella flexneri 2a str. 2457T
cgcuauaccgccgaucgccguuu

SEQ ID NO: 3820214 - RNA, 22 nt, Shigella flexneri 2a str. 2457T
cgcuauagacaccuugcaacuc

SEQ ID NO: 3820215 - RNA, 14 nt, Shigella flexneri 2a str. 2457T
cgcuaucagcgcca

SEQ ID NO: 3820216 - RNA, 15 nt, Shigella flexneri 2a str. 2457T
cgcuauccagcgcau

SEQ ID NO: 3820217 - RNA, 16 nt, Shigella flexneri 2a str. 2457T
cgcuauccagcgcaua

SEQ ID NO: 3820218 - RNA, 21 nt, Shigella flexneri 2a str. 2457T
cgcuaucguccacgucaucaa

SEQ ID NO: 3820219 - RNA, 23 nt, Shigella flexneri 2a str. 2457T
cgcuauuugcgccuggauuuucu

SEQ ID NO: 3820220 - RNA, 18 nt, Shigella flexneri 2a str. 2457T
cgcucaauaaucaaucuu

SEQ ID NO: 3820221 - RNA, 19 nt, Shigella flexneri 2a str. 2457T
cgcucaauauccugaccuu

SEQ ID NO: 3820222 - RNA, 18 nt, Shigella flexneri 2a str. 2457T
cgcucaaucguaugauca

SEQ ID NO: 3820223 - RNA, 13 nt, Shigella flexneri 2a str. 2457T
cgcucaaugcgcu

SEQ ID NO: 3820224 - RNA, 17 nt, Shigella flexneri 2a str. 2457T
cgcucacgcgcugccuc

SEQ ID NO: 3820225 - RNA, 13 nt, Shigella flexneri 2a str. 2457T
cgcucacgcgucu

SEQ ID NO: 3820226 - RNA, 13 nt, Shigella flexneri 2a str. 2457T
cgcucacugcaaa

SEQ ID NO: 3820227 - RNA, 14 nt, Shigella flexneri 2a str. 2457T
cgcucagcuccucu

SEQ ID NO: 3820228 - RNA, 15 nt, Shigella flexneri 2a str. 2457T
cgcucagucggcgcu

SEQ ID NO: 3820229 - RNA, 22 nt, Shigella flexneri 2a str. 2457T
cgcucagucggcgcuuuugcau

SEQ ID NO: 3820230 - RNA, 13 nt, Shigella flexneri 2a str. 2457T
cgcucaucagcgg

SEQ ID NO: 3820231 - RNA, 22 nt, Shigella flexneri 2a str. 2457T
cgcuccaaggucuccgcccagc

SEQ ID NO: 3820232 - RNA, 18 nt, Shigella flexneri 2a str. 2457T
cgcucccgcaggagcgcc

SEQ ID NO: 3820233 - RNA, 18 nt, Shigella flexneri 2a str. 2457T
cgcucccggauaucccag

SEQ ID NO: 3820234 - RNA, 21 nt, Shigella flexneri 2a str. 2457T
cgcucccuggcccaucgccag

SEQ ID NO: 3820235 - RNA, 14 nt, Shigella flexneri 2a str. 2457T
cgcuccgcaccuga

SEQ ID NO: 3820236 - RNA, 17 nt, Shigella flexneri 2a str. 2457T
cgcuccgcaccugagua

SEQ ID NO: 3820237 - RNA, 13 nt, Shigella flexneri 2a str. 2457T
cgcuccgucagca

SEQ ID NO: 3820238 - RNA, 14 nt, Shigella flexneri 2a str. 2457T
cgcuccgucagcac

SEQ ID NO: 3820239 - RNA, 19 nt, Shigella flexneri 2a str. 2457T
cgcucgagagagaaaauaa

SEQ ID NO: 3820240 - RNA, 19 nt, Shigella flexneri 2a str. 2457T
cgcucgccaaagcagugaa

SEQ ID NO: 3820241 - RNA, 13 nt, Shigella flexneri 2a str. 2457T
cgcucgcgccgca

SEQ ID NO: 3820242 - RNA, 20 nt, Shigella flexneri 2a str. 2457T
cgcucgcgccgcauccgaca

SEQ ID NO: 3820243 - RNA, 21 nt, Shigella flexneri 2a str. 2457T
cgcucggcaacaccucagcca

SEQ ID NO: 3820244 - RNA, 19 nt, Shigella flexneri 2a str. 2457T
cgcucucgcagcucaucaa

SEQ ID NO: 3820245 - RNA, 22 nt, Shigella flexneri 2a str. 2457T
cgcucucgcagcucaucaacac

SEQ ID NO: 3820246 - RNA, 16 nt, Shigella flexneri 2a str. 2457T
cgcucucucaguuaau

SEQ ID NO: 3820247 - RNA, 12 nt, Shigella flexneri 2a str. 2457T
cgcucuggcagg

SEQ ID NO: 3820248 - RNA, 22 nt, Shigella flexneri 2a str. 2457T
cgcucuguagggagagggccgg

SEQ ID NO: 3820249 - RNA, 19 nt, Shigella flexneri 2a str. 2457T
cgcucuuguucuuccggca

SEQ ID NO: 3820250 - RNA, 23 nt, Shigella flexneri 2a str. 2457T
cgcugaaagaagcggugaaaaaa

SEQ ID NO: 3820251 - RNA, 15 nt, Shigella flexneri 2a str. 2457T
cgcugaaagauggcg

SEQ ID NO: 3820252 - RNA, 19 nt, Shigella flexneri 2a str. 2457T
cgcugaagguguaauggau

SEQ ID NO: 3820253 - RNA, 13 nt, Shigella flexneri 2a str. 2457T
cgcugaauacgca

SEQ ID NO: 3820254 - RNA, 23 nt, Shigella flexneri 2a str. 2457T
cgcugaauggcgauuucacaaga

SEQ ID NO: 3820255 - RNA, 13 nt, Shigella flexneri 2a str. 2457T
cgcugacagcgcg

SEQ ID NO: 3820256 - RNA, 15 nt, Shigella flexneri 2a str. 2457T
cgcugacagcgcguc

SEQ ID NO: 3820257 - RNA, 23 nt, Shigella flexneri 2a str. 2457T
cgcugacauuacgcgcuucguug

SEQ ID NO: 3820258 - RNA, 17 nt, Shigella flexneri 2a str. 2457T
cgcugacccuugaugug

SEQ ID NO: 3820259 - RNA, 19 nt, Shigella flexneri 2a str. 2457T
cgcugaccuucuucagcaa

SEQ ID NO: 3820260 - RNA, 19 nt, Shigella flexneri 2a str. 2457T
cgcugagacgcgcuugcau

SEQ ID NO: 3820261 - RNA, 14 nt, Shigella flexneri 2a str. 2457T
cgcugagagaagca

SEQ ID NO: 3820262 - RNA, 22 nt, Shigella flexneri 2a str. 2457T
cgcugagcgauaaaaucagaaa

SEQ ID NO: 3820263 - RNA, 17 nt, Shigella flexneri 2a str. 2457T
cgcugauaaaucccgcc

SEQ ID NO: 3820264 - RNA, 17 nt, Shigella flexneri 2a str. 2457T
cgcugauauacccuuca

SEQ ID NO: 3820265 - RNA, 21 nt, Shigella flexneri 2a str. 2457T
cgcugauauucgacaccaucu

SEQ ID NO: 3820266 - RNA, 15 nt, Shigella flexneri 2a str. 2457T
cgcugauuaccuucc

SEQ ID NO: 3820267 - RNA, 12 nt, Shigella flexneri 2a str. 2457T
cgcugauucaag

SEQ ID NO: 3820268 - RNA, 20 nt, Shigella flexneri 2a str. 2457T
cgcugauuucaccaucuuca

SEQ ID NO: 3820269 - RNA, 16 nt, Shigella flexneri 2a str. 2457T
cgcugauuugcuucaa

SEQ ID NO: 3820270 - RNA, 22 nt, Shigella flexneri 2a str. 2457T
cgcugauuugcuucaauacgcu

SEQ ID NO: 3820271 - RNA, 14 nt, Shigella flexneri 2a str. 2457T
cgcugauuuuucug

SEQ ID NO: 3820272 - RNA, 22 nt, Shigella flexneri 2a str. 2457T
cgcugcaaggcucuauacgcau

SEQ ID NO: 3820273 - RNA, 22 nt, Shigella flexneri 2a str. 2457T
cgcugcaaguuuugucaguucg

SEQ ID NO: 3820274 - RNA, 14 nt, Shigella flexneri 2a str. 2457T
cgcugcacuuucuc

SEQ ID NO: 3820275 - RNA, 13 nt, Shigella flexneri 2a str. 2457T
cgcugcagcucug

SEQ ID NO: 3820276 - RNA, 14 nt, Shigella flexneri 2a str. 2457T
cgcugcaucgccaa

SEQ ID NO: 3820277 - RNA, 19 nt, Shigella flexneri 2a str. 2457T
cgcugcauggcaacuuuaa

SEQ ID NO: 3820278 - RNA, 23 nt, Shigella flexneri 2a str. 2457T
cgcugcauugacaagcucaccuc

SEQ ID NO: 3820279 - RNA, 20 nt, Shigella flexneri 2a str. 2457T
cgcugcauugcccaauacag

SEQ ID NO: 3820280 - RNA, 18 nt, Shigella flexneri 2a str. 2457T
cgcugccccugguuaucu

SEQ ID NO: 3820281 - RNA, 16 nt, Shigella flexneri 2a str. 2457T
cgcugcccugcugguu

SEQ ID NO: 3820282 - RNA, 16 nt, Shigella flexneri 2a str. 2457T
cgcugccgcuucuucu

SEQ ID NO: 3820283 - RNA, 20 nt, Shigella flexneri 2a str. 2457T
cgcugccucucuucgcugcu

SEQ ID NO: 3820284 - RNA, 23 nt, Shigella flexneri 2a str. 2457T
cgcugccuucggcgucuccaccu

SEQ ID NO: 3820285 - RNA, 21 nt, Shigella flexneri 2a str. 2457T
cgcugcgcuuacacacccggc

SEQ ID NO: 3820286 - RNA, 17 nt, Shigella flexneri 2a str. 2457T
cgcugcggcgcgcaucu

SEQ ID NO: 3820287 - RNA, 19 nt, Shigella flexneri 2a str. 2457T
cgcugcggcggacaaaguu

SEQ ID NO: 3820288 - RNA, 17 nt, Shigella flexneri 2a str. 2457T
cgcugcgguuuacgcca

SEQ ID NO: 3820289 - RNA, 13 nt, Shigella flexneri 2a str. 2457T
cgcugcguagcca

SEQ ID NO: 3820290 - RNA, 15 nt, Shigella flexneri 2a str. 2457T
cgcugcugcguaugg

SEQ ID NO: 3820291 - RNA, 18 nt, Shigella flexneri 2a str. 2457T
cgcugcuguacuuuuucc

SEQ ID NO: 3820292 - RNA, 20 nt, Shigella flexneri 2a str. 2457T
cgcugcuuguuccacuucau

SEQ ID NO: 3820293 - RNA, 23 nt, Shigella flexneri 2a str. 2457T
cgcugcuuuccugcugcgccugu

SEQ ID NO: 3820294 - RNA, 19 nt, Shigella flexneri 2a str. 2457T
cgcuggacguugcguugca

SEQ ID NO: 3820295 - RNA, 11 nt, Shigella flexneri 2a str. 2457T
cgcuggcaaca

SEQ ID NO: 3820296 - RNA, 14 nt, Shigella flexneri 2a str. 2457T
cgcuggcaccgcag

SEQ ID NO: 3820297 - RNA, 23 nt, Shigella flexneri 2a str. 2457T
cgcuggcagcugcuacgccguca

SEQ ID NO: 3820298 - RNA, 19 nt, Shigella flexneri 2a str. 2457T
cgcuggcgcucaagucgaa

SEQ ID NO: 3820299 - RNA, 23 nt, Shigella flexneri 2a str. 2457T
cgcuggcgggcguuaucacguug

SEQ ID NO: 3820300 - RNA, 16 nt, Shigella flexneri 2a str. 2457T
cgcuggcgucacgccg

SEQ ID NO: 3820301 - RNA, 17 nt, Shigella flexneri 2a str. 2457T
cgcuggcuuugcccugg

SEQ ID NO: 3820302 - RNA, 18 nt, Shigella flexneri 2a str. 2457T
cgcugggagaauugcgaa

SEQ ID NO: 3820303 - RNA, 20 nt, Shigella flexneri 2a str. 2457T
cgcuggugacaucgccagag

SEQ ID NO: 3820304 - RNA, 19 nt, Shigella flexneri 2a str. 2457T
cgcuggugaguaacgcgga

SEQ ID NO: 3820305 - RNA, 14 nt, Shigella flexneri 2a str. 2457T
cgcugguguacugc

SEQ ID NO: 3820306 - RNA, 11 nt, Shigella flexneri 2a str. 2457T
cgcuguaaaug

SEQ ID NO: 3820307 - RNA, 18 nt, Shigella flexneri 2a str. 2457T
cgcuguaauuaccagcgc

SEQ ID NO: 3820308 - RNA, 20 nt, Shigella flexneri 2a str. 2457T
cgcuguaauuuuuuuauuga

SEQ ID NO: 3820309 - RNA, 18 nt, Shigella flexneri 2a str. 2457T
cgcuguagccgccgucgu

SEQ ID NO: 3820310 - RNA, 17 nt, Shigella flexneri 2a str. 2457T
cgcugucggugccauca

SEQ ID NO: 3820311 - RNA, 20 nt, Shigella flexneri 2a str. 2457T
cgcugucuggcgucuccugc

SEQ ID NO: 3820312 - RNA, 19 nt, Shigella flexneri 2a str. 2457T
cgcugucuuuugaucaaau

SEQ ID NO: 3820313 - RNA, 23 nt, Shigella flexneri 2a str. 2457T
cgcugugcugcugacguagcagc

SEQ ID NO: 3820314 - RNA, 18 nt, Shigella flexneri 2a str. 2457T
cgcuguguaaacccagcc

SEQ ID NO: 3820315 - RNA, 23 nt, Shigella flexneri 2a str. 2457T
cgcuguguaaacccagccgcguc

SEQ ID NO: 3820316 - RNA, 19 nt, Shigella flexneri 2a str. 2457T
cgcuguguguaggccagcg

SEQ ID NO: 3820317 - RNA, 21 nt, Shigella flexneri 2a str. 2457T
cgcuguguguaggccagcgau

SEQ ID NO: 3820318 - RNA, 17 nt, Shigella flexneri 2a str. 2457T
cgcuguugucugaauga

SEQ ID NO: 3820319 - RNA, 18 nt, Shigella flexneri 2a str. 2457T
cgcuuaaauuuccaccgc

SEQ ID NO: 3820320 - RNA, 22 nt, Shigella flexneri 2a str. 2457T
cgcuuaagguuacccgcacggc

SEQ ID NO: 3820321 - RNA, 23 nt, Shigella flexneri 2a str. 2457T
cgcuuaaucaauugcaggaaggu

SEQ ID NO: 3820322 - RNA, 14 nt, Shigella flexneri 2a str. 2457T
cgcuuaauccgcgc

SEQ ID NO: 3820323 - RNA, 16 nt, Shigella flexneri 2a str. 2457T
cgcuuacacacccggc

SEQ ID NO: 3820324 - RNA, 17 nt, Shigella flexneri 2a str. 2457T
cgcuuacacacccggcc

SEQ ID NO: 3820325 - RNA, 15 nt, Shigella flexneri 2a str. 2457T
cgcuuacaucaacuc

SEQ ID NO: 3820326 - RNA, 17 nt, Shigella flexneri 2a str. 2457T
cgcuuacccuaaauccg

SEQ ID NO: 3820327 - RNA, 15 nt, Shigella flexneri 2a str. 2457T
cgcuuacgccugcca

SEQ ID NO: 3820328 - RNA, 23 nt, Shigella flexneri 2a str. 2457T
cgcuuacgcgucuuaucaugccu

SEQ ID NO: 3820329 - RNA, 19 nt, Shigella flexneri 2a str. 2457T
cgcuuacucauccacugcc

SEQ ID NO: 3820330 - RNA, 19 nt, Shigella flexneri 2a str. 2457T
cgcuucaaggugcgcgaug

SEQ ID NO: 3820331 - RNA, 17 nt, Shigella flexneri 2a str. 2457T
cgcuucaccaaucagaa

SEQ ID NO: 3820332 - RNA, 22 nt, Shigella flexneri 2a str. 2457T
cgcuucaccgacaucuuucugc

SEQ ID NO: 3820333 - RNA, 19 nt, Shigella flexneri 2a str. 2457T
cgcuucacucccugcccca

SEQ ID NO: 3820334 - RNA, 16 nt, Shigella flexneri 2a str. 2457T
cgcuucagcccgcgau

SEQ ID NO: 3820335 - RNA, 13 nt, Shigella flexneri 2a str. 2457T
cgcuucagccgga

SEQ ID NO: 3820336 - RNA, 14 nt, Shigella flexneri 2a str. 2457T
cgcuucagugacuu

SEQ ID NO: 3820337 - RNA, 19 nt, Shigella flexneri 2a str. 2457T
cgcuucagugacuucugcc

SEQ ID NO: 3820338 - RNA, 18 nt, Shigella flexneri 2a str. 2457T
cgcuucaugcuuaaucau

SEQ ID NO: 3820339 - RNA, 23 nt, Shigella flexneri 2a str. 2457T
cgcuucaugcuuaaucaucgacu

SEQ ID NO: 3820340 - RNA, 19 nt, Shigella flexneri 2a str. 2457T
cgcuuccagcgcaucugcc

SEQ ID NO: 3820341 - RNA, 23 nt, Shigella flexneri 2a str. 2457T
cgcuuccauugagaaagcccugg

SEQ ID NO: 3820342 - RNA, 19 nt, Shigella flexneri 2a str. 2457T
cgcuucccaacgcagcaac

SEQ ID NO: 3820343 - RNA, 11 nt, Shigella flexneri 2a str. 2457T
cgcuuccugca

SEQ ID NO: 3820344 - RNA, 17 nt, Shigella flexneri 2a str. 2457T
cgcuucgagauugcgga

SEQ ID NO: 3820345 - RNA, 16 nt, Shigella flexneri 2a str. 2457T
cgcuucgcccgccagc

SEQ ID NO: 3820346 - RNA, 16 nt, Shigella flexneri 2a str. 2457T
cgcuucggcgccuuuu

SEQ ID NO: 3820347 - RNA, 17 nt, Shigella flexneri 2a str. 2457T
cgcuucggcggguuuuu

SEQ ID NO: 3820348 - RNA, 14 nt, Shigella flexneri 2a str. 2457T
cgcuucucccagcc

SEQ ID NO: 3820349 - RNA, 13 nt, Shigella flexneri 2a str. 2457T
cgcuucugcguuc

SEQ ID NO: 3820350 - RNA, 11 nt, Shigella flexneri 2a str. 2457T
cgcuucugcuu

SEQ ID NO: 3820351 - RNA, 19 nt, Shigella flexneri 2a str. 2457T
cgcuucugguuauauuucc

SEQ ID NO: 3820352 - RNA, 12 nt, Shigella flexneri 2a str. 2457T
cgcuucuucagc

SEQ ID NO: 3820353 - RNA, 17 nt, Shigella flexneri 2a str. 2457T
cgcuucuucagccugca

SEQ ID NO: 3820354 - RNA, 20 nt, Shigella flexneri 2a str. 2457T
cgcuucuucugccgcuucca

SEQ ID NO: 3820355 - RNA, 13 nt, Shigella flexneri 2a str. 2457T
cgcuugacgcguc

SEQ ID NO: 3820356 - RNA, 19 nt, Shigella flexneri 2a str. 2457T
cgcuugccugugccacggc

SEQ ID NO: 3820357 - RNA, 23 nt, Shigella flexneri 2a str. 2457T
cgcuugcguaucgacggcguauu

SEQ ID NO: 3820358 - RNA, 15 nt, Shigella flexneri 2a str. 2457T
cgcuugcucgcgcac

SEQ ID NO: 3820359 - RNA, 23 nt, Shigella flexneri 2a str. 2457T
cgcuugucaucgaugagaugacg

SEQ ID NO: 3820360 - RNA, 14 nt, Shigella flexneri 2a str. 2457T
cgcuuguucgcaua

SEQ ID NO: 3820361 - RNA, 19 nt, Shigella flexneri 2a str. 2457T
cgcuuuacucaacuccccg

SEQ ID NO: 3820362 - RNA, 17 nt, Shigella flexneri 2a str. 2457T
cgcuuuaucgccuacca

SEQ ID NO: 3820363 - RNA, 18 nt, Shigella flexneri 2a str. 2457T
cgcuuuaucgccuaccaa

SEQ ID NO: 3820364 - RNA, 14 nt, Shigella flexneri 2a str. 2457T
cgcuuuaugugcuu

SEQ ID NO: 3820365 - RNA, 21 nt, Shigella flexneri 2a str. 2457T
cgcuuucgcuacuucaaacaa

SEQ ID NO: 3820366 - RNA, 17 nt, Shigella flexneri 2a str. 2457T
cgcuuucgcuuucucuu

SEQ ID NO: 3820367 - RNA, 18 nt, Shigella flexneri 2a str. 2457T
cgcuuucucaccaugacc

SEQ ID NO: 3820368 - RNA, 16 nt, Shigella flexneri 2a str. 2457T
cgcuuucucuucggcu

SEQ ID NO: 3820369 - RNA, 23 nt, Shigella flexneri 2a str. 2457T
cgcuuucugagcggccuuuuccu

SEQ ID NO: 3820370 - RNA, 15 nt, Shigella flexneri 2a str. 2457T
cgcuuugcaggcugg

SEQ ID NO: 3820371 - RNA, 20 nt, Shigella flexneri 2a str. 2457T
cgcuuugggcucaucaauac

SEQ ID NO: 3820372 - RNA, 13 nt, Shigella flexneri 2a str. 2457T
cgcuuuucagugc

SEQ ID NO: 3820373 - RNA, 16 nt, Shigella flexneri 2a str. 2457T
cgcuuuuggcaggaac

SEQ ID NO: 3820374 - RNA, 17 nt, Shigella flexneri 2a str. 2457T
cgcuuuuggcaggaacu

SEQ ID NO: 3820375 - RNA, 21 nt, Shigella flexneri 2a str. 2457T
cgcuuuuuccaggcuggcagg

SEQ ID NO: 3820376 - RNA, 21 nt, Shigella flexneri 2a str. 2457T
cggaaaauuauuuuaaauuuc

SEQ ID NO: 3820377 - RNA, 22 nt, Shigella flexneri 2a str. 2457T
cggaaacgacuauuaaacagga

SEQ ID NO: 3820378 - RNA, 17 nt, Shigella flexneri 2a str. 2457T
cggaaacugucaauaaa

SEQ ID NO: 3820379 - RNA, 14 nt, Shigella flexneri 2a str. 2457T
cggaaagcacaaaa

SEQ ID NO: 3820380 - RNA, 21 nt, Shigella flexneri 2a str. 2457T
cggaaaguuuaauugccauuu

SEQ ID NO: 3820381 - RNA, 12 nt, Shigella flexneri 2a str. 2457T
cggaaauauauu

SEQ ID NO: 3820382 - RNA, 18 nt, Shigella flexneri 2a str. 2457T
cggaaaucuccagauaau

SEQ ID NO: 3820383 - RNA, 20 nt, Shigella flexneri 2a str. 2457T
cggaaauuaccgcaccacca

SEQ ID NO: 3820384 - RNA, 15 nt, Shigella flexneri 2a str. 2457T
cggaaauugccacug

SEQ ID NO: 3820385 - RNA, 19 nt, Shigella flexneri 2a str. 2457T
cggaacacucuuccagucg

SEQ ID NO: 3820386 - RNA, 12 nt, Shigella flexneri 2a str. 2457T
cggaacaggcag

SEQ ID NO: 3820387 - RNA, 21 nt, Shigella flexneri 2a str. 2457T
cggaacaucgccugccgcagg

SEQ ID NO: 3820388 - RNA, 15 nt, Shigella flexneri 2a str. 2457T
cggaacaucugcccc

SEQ ID NO: 3820389 - RNA, 14 nt, Shigella flexneri 2a str. 2457T
cggaaccagccagg

SEQ ID NO: 3820390 - RNA, 16 nt, Shigella flexneri 2a str. 2457T
cggaacuccuggagcg

SEQ ID NO: 3820391 - RNA, 12 nt, Shigella flexneri 2a str. 2457T
cggaacugaagc

SEQ ID NO: 3820392 - RNA, 13 nt, Shigella flexneri 2a str. 2457T
cggaacugaugau

SEQ ID NO: 3820393 - RNA, 18 nt, Shigella flexneri 2a str. 2457T
cggaacuugccgggcgca

SEQ ID NO: 3820394 - RNA, 13 nt, Shigella flexneri 2a str. 2457T
cggaagagauggu

SEQ ID NO: 3820395 - RNA, 22 nt, Shigella flexneri 2a str. 2457T
cggaagcaaaauaaccggcaag

SEQ ID NO: 3820396 - RNA, 12 nt, Shigella flexneri 2a str. 2457T
cggaagccacca

SEQ ID NO: 3820397 - RNA, 13 nt, Shigella flexneri 2a str. 2457T
cggaagccaccac

SEQ ID NO: 3820398 - RNA, 15 nt, Shigella flexneri 2a str. 2457T
cggaagcgucaaggu

SEQ ID NO: 3820399 - RNA, 12 nt, Shigella flexneri 2a str. 2457T
cggaagcuccac

SEQ ID NO: 3820400 - RNA, 16 nt, Shigella flexneri 2a str. 2457T
cggaaguaccaauggc

SEQ ID NO: 3820401 - RNA, 21 nt, Shigella flexneri 2a str. 2457T
cggaagucgcagcugccugca

SEQ ID NO: 3820402 - RNA, 15 nt, Shigella flexneri 2a str. 2457T
cggaauaaucagaug

SEQ ID NO: 3820403 - RNA, 15 nt, Shigella flexneri 2a str. 2457T
cggaauaucagaggc

SEQ ID NO: 3820404 - RNA, 15 nt, Shigella flexneri 2a str. 2457T
cggaauaucgcuggc

SEQ ID NO: 3820405 - RNA, 16 nt, Shigella flexneri 2a str. 2457T
cggaaucaccggcaaa

SEQ ID NO: 3820406 - RNA, 20 nt, Shigella flexneri 2a str. 2457T
cggaaugauauuggucacca

SEQ ID NO: 3820407 - RNA, 17 nt, Shigella flexneri 2a str. 2457T
cggaaugcagucacgcc

SEQ ID NO: 3820408 - RNA, 22 nt, Shigella flexneri 2a str. 2457T
cggaauuguggugaucacccag

SEQ ID NO: 3820409 - RNA, 14 nt, Shigella flexneri 2a str. 2457T
cggaauuuuccuuc

SEQ ID NO: 3820410 - RNA, 19 nt, Shigella flexneri 2a str. 2457T
cggacaaacggcuggaaca

SEQ ID NO: 3820411 - RNA, 23 nt, Shigella flexneri 2a str. 2457T
cggacagucacguagcggcggca

SEQ ID NO: 3820412 - RNA, 14 nt, Shigella flexneri 2a str. 2457T
cggacaguccccuc

SEQ ID NO: 3820413 - RNA, 21 nt, Shigella flexneri 2a str. 2457T
cggacaugaaccgugucgcca

SEQ ID NO: 3820414 - RNA, 17 nt, Shigella flexneri 2a str. 2457T
cggacaugacucuacgc

SEQ ID NO: 3820415 - RNA, 23 nt, Shigella flexneri 2a str. 2457T
cggacauugaguuuacgcagcag

SEQ ID NO: 3820416 - RNA, 22 nt, Shigella flexneri 2a str. 2457T
cggaccagacgaucguaauggc

SEQ ID NO: 3820417 - RNA, 21 nt, Shigella flexneri 2a str. 2457T
cggaccagccgcuaccagcgc

SEQ ID NO: 3820418 - RNA, 15 nt, Shigella flexneri 2a str. 2457T
cggaccgucaucuuc

SEQ ID NO: 3820419 - RNA, 21 nt, Shigella flexneri 2a str. 2457T
cggacgcaccgcguauugcuc

SEQ ID NO: 3820420 - RNA, 21 nt, Shigella flexneri 2a str. 2457T
cggacggucgacgggcccaua

SEQ ID NO: 3820421 - RNA, 15 nt, Shigella flexneri 2a str. 2457T
cggacguucgcccac

SEQ ID NO: 3820422 - RNA, 15 nt, Shigella flexneri 2a str. 2457T
cggacguuugccaug

SEQ ID NO: 3820423 - RNA, 20 nt, Shigella flexneri 2a str. 2457T
cggacugaaaguacuucaca

SEQ ID NO: 3820424 - RNA, 14 nt, Shigella flexneri 2a str. 2457T
cggacuucacaucc

SEQ ID NO: 3820425 - RNA, 15 nt, Shigella flexneri 2a str. 2457T
cggacuuuuuauuua

SEQ ID NO: 3820426 - RNA, 13 nt, Shigella flexneri 2a str. 2457T
cggagaagcguag

SEQ ID NO: 3820427 - RNA, 22 nt, Shigella flexneri 2a str. 2457T
cggagagaaaaaccuccggcgu

SEQ ID NO: 3820428 - RNA, 17 nt, Shigella flexneri 2a str. 2457T
cggagaguaaacgguga

SEQ ID NO: 3820429 - RNA, 15 nt, Shigella flexneri 2a str. 2457T
cggagcaaccugcac

SEQ ID NO: 3820430 - RNA, 17 nt, Shigella flexneri 2a str. 2457T
cggagcaaugaucucaa

SEQ ID NO: 3820431 - RNA, 21 nt, Shigella flexneri 2a str. 2457T
cggagcagcagucaggcgcgc

SEQ ID NO: 3820432 - RNA, 14 nt, Shigella flexneri 2a str. 2457T
cggagccagccguu

SEQ ID NO: 3820433 - RNA, 22 nt, Shigella flexneri 2a str. 2457T
cggagccauugcccgaugcgca

SEQ ID NO: 3820434 - RNA, 18 nt, Shigella flexneri 2a str. 2457T
cggagcuucacccgcagc

SEQ ID NO: 3820435 - RNA, 15 nt, Shigella flexneri 2a str. 2457T
cggaggaaagcaccu

SEQ ID NO: 3820436 - RNA, 19 nt, Shigella flexneri 2a str. 2457T
cggagggauguggcccagc

SEQ ID NO: 3820437 - RNA, 19 nt, Shigella flexneri 2a str. 2457T
cggagggguuuuugccagc

SEQ ID NO: 3820438 - RNA, 18 nt, Shigella flexneri 2a str. 2457T
cggaguaaugccagucag

SEQ ID NO: 3820439 - RNA, 23 nt, Shigella flexneri 2a str. 2457T
cggaguagucucucgccucaugg

SEQ ID NO: 3820440 - RNA, 15 nt, Shigella flexneri 2a str. 2457T
cggagucgcauuaac

SEQ ID NO: 3820441 - RNA, 23 nt, Shigella flexneri 2a str. 2457T
cggaguugaccagcuccagcaga

SEQ ID NO: 3820442 - RNA, 16 nt, Shigella flexneri 2a str. 2457T
cggaguugcagauuug

SEQ ID NO: 3820443 - RNA, 14 nt, Shigella flexneri 2a str. 2457T
cggaguuuaugagg

SEQ ID NO: 3820444 - RNA, 16 nt, Shigella flexneri 2a str. 2457T
cggaguuuaugaggca

SEQ ID NO: 3820445 - RNA, 22 nt, Shigella flexneri 2a str. 2457T
cggauaaacaauguuauccggc

SEQ ID NO: 3820446 - RNA, 18 nt, Shigella flexneri 2a str. 2457T
cggauaaacuuggcuaua

SEQ ID NO: 3820447 - RNA, 14 nt, Shigella flexneri 2a str. 2457T
cggauaagacgcga

SEQ ID NO: 3820448 - RNA, 18 nt, Shigella flexneri 2a str. 2457T
cggauaagacgcgccagc

SEQ ID NO: 3820449 - RNA, 19 nt, Shigella flexneri 2a str. 2457T
cggauaagacgcgccagcg

SEQ ID NO: 3820450 - RNA, 22 nt, Shigella flexneri 2a str. 2457T
cggauaaggcgcucgcgccgca

SEQ ID NO: 3820451 - RNA, 22 nt, Shigella flexneri 2a str. 2457T
cggauaaucgcuggugccgugg

SEQ ID NO: 3820452 - RNA, 16 nt, Shigella flexneri 2a str. 2457T
cggauaaucggcaaua

SEQ ID NO: 3820453 - RNA, 19 nt, Shigella flexneri 2a str. 2457T
cggauaccaccagugccau

SEQ ID NO: 3820454 - RNA, 20 nt, Shigella flexneri 2a str. 2457T
cggauaccaccagugccauu

SEQ ID NO: 3820455 - RNA, 22 nt, Shigella flexneri 2a str. 2457T
cggauacgguuuuuugaacaga

SEQ ID NO: 3820456 - RNA, 21 nt, Shigella flexneri 2a str. 2457T
cggauagauuuuuaaugcuuu

SEQ ID NO: 3820457 - RNA, 13 nt, Shigella flexneri 2a str. 2457T
cggauaucaccac

SEQ ID NO: 3820458 - RNA, 22 nt, Shigella flexneri 2a str. 2457T
cggauauccacccgcagccauc

SEQ ID NO: 3820459 - RNA, 18 nt, Shigella flexneri 2a str. 2457T
cggauaucuuucgccaug

SEQ ID NO: 3820460 - RNA, 15 nt, Shigella flexneri 2a str. 2457T
cggauauugccggau

SEQ ID NO: 3820461 - RNA, 17 nt, Shigella flexneri 2a str. 2457T
cggauauuuugccaggu

SEQ ID NO: 3820462 - RNA, 23 nt, Shigella flexneri 2a str. 2457T
cggaucaugguagcgugauggcc

SEQ ID NO: 3820463 - RNA, 14 nt, Shigella flexneri 2a str. 2457T
cggaucauuaguca

SEQ ID NO: 3820464 - RNA, 19 nt, Shigella flexneri 2a str. 2457T
cggauccccugcgcggcga

SEQ ID NO: 3820465 - RNA, 17 nt, Shigella flexneri 2a str. 2457T
cggaucgguagaccgga

SEQ ID NO: 3820466 - RNA, 17 nt, Shigella flexneri 2a str. 2457T
cggaucucagcucauua

SEQ ID NO: 3820467 - RNA, 16 nt, Shigella flexneri 2a str. 2457T
cggaugacccagcgcg

SEQ ID NO: 3820468 - RNA, 18 nt, Shigella flexneri 2a str. 2457T
cggaugaguacagcgcau

SEQ ID NO: 3820469 - RNA, 16 nt, Shigella flexneri 2a str. 2457T
cggaugaucauccggc

SEQ ID NO: 3820470 - RNA, 14 nt, Shigella flexneri 2a str. 2457T
cggaugauucacau

SEQ ID NO: 3820471 - RNA, 24 nt, Shigella flexneri 2a str. 2457T
cggaugcagcaucaugucgcccac

SEQ ID NO: 3820472 - RNA, 20 nt, Shigella flexneri 2a str. 2457T
cggaugcgaguuuucgcauc

SEQ ID NO: 3820473 - RNA, 14 nt, Shigella flexneri 2a str. 2457T
cggaugcgccagca

SEQ ID NO: 3820474 - RNA, 14 nt, Shigella flexneri 2a str. 2457T
cggaugcgccguca

SEQ ID NO: 3820475 - RNA, 15 nt, Shigella flexneri 2a str. 2457T
cggaugcgccgucag

SEQ ID NO: 3820476 - RNA, 20 nt, Shigella flexneri 2a str. 2457T
cggaugcggcgugaaugccu

SEQ ID NO: 3820477 - RNA, 17 nt, Shigella flexneri 2a str. 2457T
cggauguagcaacggag

SEQ ID NO: 3820478 - RNA, 14 nt, Shigella flexneri 2a str. 2457T
cggauuacccgcgc

SEQ ID NO: 3820479 - RNA, 18 nt, Shigella flexneri 2a str. 2457T
cggauuacgacucaaccc

SEQ ID NO: 3820480 - RNA, 22 nt, Shigella flexneri 2a str. 2457T
cggauuggucgcucgcgccgca

SEQ ID NO: 3820481 - RNA, 15 nt, Shigella flexneri 2a str. 2457T
cggcaaaaacaacga

SEQ ID NO: 3820482 - RNA, 15 nt, Shigella flexneri 2a str. 2457T
cggcaaaaaucggca

SEQ ID NO: 3820483 - RNA, 14 nt, Shigella flexneri 2a str. 2457T
cggcaaaaccguuc

SEQ ID NO: 3820484 - RNA, 15 nt, Shigella flexneri 2a str. 2457T
cggcaaaaucuucca

SEQ ID NO: 3820485 - RNA, 12 nt, Shigella flexneri 2a str. 2457T
cggcaaacacgc

SEQ ID NO: 3820486 - RNA, 13 nt, Shigella flexneri 2a str. 2457T
cggcaaacacgca

SEQ ID NO: 3820487 - RNA, 15 nt, Shigella flexneri 2a str. 2457T
cggcaaacugcugau

SEQ ID NO: 3820488 - RNA, 16 nt, Shigella flexneri 2a str. 2457T
cggcaaacuucgucaa

SEQ ID NO: 3820489 - RNA, 17 nt, Shigella flexneri 2a str. 2457T
cggcaaauaacagaccu

SEQ ID NO: 3820490 - RNA, 21 nt, Shigella flexneri 2a str. 2457T
cggcaaauucauuaccaaccu

SEQ ID NO: 3820491 - RNA, 19 nt, Shigella flexneri 2a str. 2457T
cggcaacaaauucacgccu

SEQ ID NO: 3820492 - RNA, 18 nt, Shigella flexneri 2a str. 2457T
cggcaacaauauuaacuc

SEQ ID NO: 3820493 - RNA, 13 nt, Shigella flexneri 2a str. 2457T
cggcaaccgcauc

SEQ ID NO: 3820494 - RNA, 22 nt, Shigella flexneri 2a str. 2457T
cggcaacgacugcgagcaaaau

SEQ ID NO: 3820495 - RNA, 14 nt, Shigella flexneri 2a str. 2457T
cggcaacggcggau

SEQ ID NO: 3820496 - RNA, 17 nt, Shigella flexneri 2a str. 2457T
cggcaacguacuuacuc

SEQ ID NO: 3820497 - RNA, 21 nt, Shigella flexneri 2a str. 2457T
cggcaacgucggaaaccgcuu

SEQ ID NO: 3820498 - RNA, 19 nt, Shigella flexneri 2a str. 2457T
cggcaagaaauaccgaaga

SEQ ID NO: 3820499 - RNA, 23 nt, Shigella flexneri 2a str. 2457T
cggcaagaucgcgaugggucgcc

SEQ ID NO: 3820500 - RNA, 13 nt, Shigella flexneri 2a str. 2457T
cggcaagcaaaug

SEQ ID NO: 3820501 - RNA, 22 nt, Shigella flexneri 2a str. 2457T
cggcaaggguugagauuuauuu

SEQ ID NO: 3820502 - RNA, 23 nt, Shigella flexneri 2a str. 2457T
cggcaaguaauaauaucuccagc

SEQ ID NO: 3820503 - RNA, 20 nt, Shigella flexneri 2a str. 2457T
cggcaaguguuggcgacauc

SEQ ID NO: 3820504 - RNA, 22 nt, Shigella flexneri 2a str. 2457T
cggcaauauagauaucaugcuc

SEQ ID NO: 3820505 - RNA, 20 nt, Shigella flexneri 2a str. 2457T
cggcaaucauucccagaccu

SEQ ID NO: 3820506 - RNA, 18 nt, Shigella flexneri 2a str. 2457T
cggcaauccccgccagca

SEQ ID NO: 3820507 - RNA, 23 nt, Shigella flexneri 2a str. 2457T
cggcaaucggugcaaaugccaga

SEQ ID NO: 3820508 - RNA, 15 nt, Shigella flexneri 2a str. 2457T
cggcaaucuguuaug

SEQ ID NO: 3820509 - RNA, 14 nt, Shigella flexneri 2a str. 2457T
cggcaauggcugcg

SEQ ID NO: 3820510 - RNA, 20 nt, Shigella flexneri 2a str. 2457T
cggcaauggguaacggcaga

SEQ ID NO: 3820511 - RNA, 21 nt, Shigella flexneri 2a str. 2457T
cggcaauguuaccgaucgcca

SEQ ID NO: 3820512 - RNA, 18 nt, Shigella flexneri 2a str. 2457T
cggcaauuagcggcuggc

SEQ ID NO: 3820513 - RNA, 17 nt, Shigella flexneri 2a str. 2457T
cggcaauucucucugau

SEQ ID NO: 3820514 - RNA, 13 nt, Shigella flexneri 2a str. 2457T
cggcacaagaaaa

SEQ ID NO: 3820515 - RNA, 19 nt, Shigella flexneri 2a str. 2457T
cggcacaagaaaacggcac

SEQ ID NO: 3820516 - RNA, 19 nt, Shigella flexneri 2a str. 2457T
cggcaccaaaauucugcug

SEQ ID NO: 3820517 - RNA, 14 nt, Shigella flexneri 2a str. 2457T
cggcaccaaucacc

SEQ ID NO: 3820518 - RNA, 22 nt, Shigella flexneri 2a str. 2457T
cggcaccaaucaccgccagcaa

SEQ ID NO: 3820519 - RNA, 23 nt, Shigella flexneri 2a str. 2457T
cggcaccacaaacucuuuuccgg

SEQ ID NO: 3820520 - RNA, 18 nt, Shigella flexneri 2a str. 2457T
cggcaccacauucugcau

SEQ ID NO: 3820521 - RNA, 21 nt, Shigella flexneri 2a str. 2457T
cggcaccauuccaccucccgu

SEQ ID NO: 3820522 - RNA, 23 nt, Shigella flexneri 2a str. 2457T
cggcaccguuuuugccgaugucu

SEQ ID NO: 3820523 - RNA, 21 nt, Shigella flexneri 2a str. 2457T
cggcacgauaaauggcucuuc

SEQ ID NO: 3820524 - RNA, 15 nt, Shigella flexneri 2a str. 2457T
cggcacgccagucgg

SEQ ID NO: 3820525 - RNA, 23 nt, Shigella flexneri 2a str. 2457T
cggcacguucgaugcggcucagc

SEQ ID NO: 3820526 - RNA, 15 nt, Shigella flexneri 2a str. 2457T
cggcacuccucuuca

SEQ ID NO: 3820527 - RNA, 23 nt, Shigella flexneri 2a str. 2457T
cggcacucuuucagcaacauggu

SEQ ID NO: 3820528 - RNA, 14 nt, Shigella flexneri 2a str. 2457T
cggcagaaaaucca

SEQ ID NO: 3820529 - RNA, 19 nt, Shigella flexneri 2a str. 2457T
cggcagaacagaacauccc

SEQ ID NO: 3820530 - RNA, 22 nt, Shigella flexneri 2a str. 2457T
cggcagagugaagguuucugca

SEQ ID NO: 3820531 - RNA, 15 nt, Shigella flexneri 2a str. 2457T
cggcagcaaucgacc

SEQ ID NO: 3820532 - RNA, 19 nt, Shigella flexneri 2a str. 2457T
cggcagcaaucgaccaggc

SEQ ID NO: 3820533 - RNA, 21 nt, Shigella flexneri 2a str. 2457T
cggcagcaauggcacugucga

SEQ ID NO: 3820534 - RNA, 16 nt, Shigella flexneri 2a str. 2457T
cggcagcaggaucucc

SEQ ID NO: 3820535 - RNA, 21 nt, Shigella flexneri 2a str. 2457T
cggcagcauguguaaccgcuu

SEQ ID NO: 3820536 - RNA, 17 nt, Shigella flexneri 2a str. 2457T
cggcagccaccgccagc

SEQ ID NO: 3820537 - RNA, 22 nt, Shigella flexneri 2a str. 2457T
cggcagccauuccgggaaacga

SEQ ID NO: 3820538 - RNA, 15 nt, Shigella flexneri 2a str. 2457T
cggcagccugacgcc

SEQ ID NO: 3820539 - RNA, 12 nt, Shigella flexneri 2a str. 2457T
cggcagcgaacc

SEQ ID NO: 3820540 - RNA, 13 nt, Shigella flexneri 2a str. 2457T
cggcagcgcgcuc

SEQ ID NO: 3820541 - RNA, 15 nt, Shigella flexneri 2a str. 2457T
cggcagcggcuucau

SEQ ID NO: 3820542 - RNA, 14 nt, Shigella flexneri 2a str. 2457T
cggcagcgguucca

SEQ ID NO: 3820543 - RNA, 12 nt, Shigella flexneri 2a str. 2457T
cggcagcgucgg

SEQ ID NO: 3820544 - RNA, 23 nt, Shigella flexneri 2a str. 2457T
cggcagcgucggaagcgagguau

SEQ ID NO: 3820545 - RNA, 14 nt, Shigella flexneri 2a str. 2457T
cggcagcuccagca

SEQ ID NO: 3820546 - RNA, 16 nt, Shigella flexneri 2a str. 2457T
cggcagcucgaccgcu

SEQ ID NO: 3820547 - RNA, 16 nt, Shigella flexneri 2a str. 2457T
cggcaggacgcgcgcu

SEQ ID NO: 3820548 - RNA, 15 nt, Shigella flexneri 2a str. 2457T
cggcaggaucugcgc

SEQ ID NO: 3820549 - RNA, 19 nt, Shigella flexneri 2a str. 2457T
cggcaggcagcgccacgua

SEQ ID NO: 3820550 - RNA, 22 nt, Shigella flexneri 2a str. 2457T
cggcaggccuaacacaugcaag

SEQ ID NO: 3820551 - RNA, 17 nt, Shigella flexneri 2a str. 2457T
cggcagguugaugauga

SEQ ID NO: 3820552 - RNA, 19 nt, Shigella flexneri 2a str. 2457T
cggcaguaauaccagaccu

SEQ ID NO: 3820553 - RNA, 18 nt, Shigella flexneri 2a str. 2457T
cggcaguauagcggcaug

SEQ ID NO: 3820554 - RNA, 15 nt, Shigella flexneri 2a str. 2457T
cggcagucugcugac

SEQ ID NO: 3820555 - RNA, 20 nt, Shigella flexneri 2a str. 2457T
cggcagucugcugaccaccu

SEQ ID NO: 3820556 - RNA, 16 nt, Shigella flexneri 2a str. 2457T
cggcagugacugcccc

SEQ ID NO: 3820557 - RNA, 19 nt, Shigella flexneri 2a str. 2457T
cggcagugcuuucauuuca

SEQ ID NO: 3820558 - RNA, 21 nt, Shigella flexneri 2a str. 2457T
cggcaguggcuaagcaggcug

SEQ ID NO: 3820559 - RNA, 22 nt, Shigella flexneri 2a str. 2457T
cggcaguucgguugggaucgcc

SEQ ID NO: 3820560 - RNA, 16 nt, Shigella flexneri 2a str. 2457T
cggcaguuugagauug

SEQ ID NO: 3820561 - RNA, 13 nt, Shigella flexneri 2a str. 2457T
cggcauaaacgcu

SEQ ID NO: 3820562 - RNA, 20 nt, Shigella flexneri 2a str. 2457T
cggcauaaccggaucgccaa

SEQ ID NO: 3820563 - RNA, 22 nt, Shigella flexneri 2a str. 2457T
cggcauaaucauuacaaccgcu

SEQ ID NO: 3820564 - RNA, 22 nt, Shigella flexneri 2a str. 2457T
cggcauacuuugauuaaccguu

SEQ ID NO: 3820565 - RNA, 19 nt, Shigella flexneri 2a str. 2457T
cggcauagccaccuggcug

SEQ ID NO: 3820566 - RNA, 23 nt, Shigella flexneri 2a str. 2457T
cggcaucaccccacgucaucacg

SEQ ID NO: 3820567 - RNA, 18 nt, Shigella flexneri 2a str. 2457T
cggcaucagaaacacacu

SEQ ID NO: 3820568 - RNA, 15 nt, Shigella flexneri 2a str. 2457T
cggcaucagcagaau

SEQ ID NO: 3820569 - RNA, 22 nt, Shigella flexneri 2a str. 2457T
cggcaucagcagaaucgcaacc

SEQ ID NO: 3820570 - RNA, 12 nt, Shigella flexneri 2a str. 2457T
cggcauccagcg

SEQ ID NO: 3820571 - RNA, 20 nt, Shigella flexneri 2a str. 2457T
cggcauccagguuucuucca

SEQ ID NO: 3820572 - RNA, 17 nt, Shigella flexneri 2a str. 2457T
cggcaucgcaaaccaga

SEQ ID NO: 3820573 - RNA, 19 nt, Shigella flexneri 2a str. 2457T
cggcaucgcauucaccaga

SEQ ID NO: 3820574 - RNA, 18 nt, Shigella flexneri 2a str. 2457T
cggcaucgccgcuaucgc

SEQ ID NO: 3820575 - RNA, 13 nt, Shigella flexneri 2a str. 2457T
cggcaucgcucca

SEQ ID NO: 3820576 - RNA, 21 nt, Shigella flexneri 2a str. 2457T
cggcaucgcuccacgccauau

SEQ ID NO: 3820577 - RNA, 22 nt, Shigella flexneri 2a str. 2457T
cggcaucgggcgaguuuccauc

SEQ ID NO: 3820578 - RNA, 18 nt, Shigella flexneri 2a str. 2457T
cggcaucuuguucauagu

SEQ ID NO: 3820579 - RNA, 21 nt, Shigella flexneri 2a str. 2457T
cggcaugaaaacccuucaaau

SEQ ID NO: 3820580 - RNA, 16 nt, Shigella flexneri 2a str. 2457T
cggcaugaaagcgaug

SEQ ID NO: 3820581 - RNA, 20 nt, Shigella flexneri 2a str. 2457T
cggcaugcaaucuuagcgga

SEQ ID NO: 3820582 - RNA, 14 nt, Shigella flexneri 2a str. 2457T
cggcauggaucgcc

SEQ ID NO: 3820583 - RNA, 16 nt, Shigella flexneri 2a str. 2457T
cggcauuaccggcaau

SEQ ID NO: 3820584 - RNA, 23 nt, Shigella flexneri 2a str. 2457T
cggcauucagugcaaaugccaga

SEQ ID NO: 3820585 - RNA, 17 nt, Shigella flexneri 2a str. 2457T
cggcauucccagccccc

SEQ ID NO: 3820586 - RNA, 19 nt, Shigella flexneri 2a str. 2457T
cggcauuuccauaccuaaa

SEQ ID NO: 3820587 - RNA, 15 nt, Shigella flexneri 2a str. 2457T
cggcauuuugcugau

SEQ ID NO: 3820588 - RNA, 18 nt, Shigella flexneri 2a str. 2457T
cggcauuuugcugaugca

SEQ ID NO: 3820589 - RNA, 13 nt, Shigella flexneri 2a str. 2457T
cggcauuuugugc

SEQ ID NO: 3820590 - RNA, 15 nt, Shigella flexneri 2a str. 2457T
cggcauuuuucggcg

SEQ ID NO: 3820591 - RNA, 22 nt, Shigella flexneri 2a str. 2457T
cggcauuuuucggcgucagaac

SEQ ID NO: 3820592 - RNA, 23 nt, Shigella flexneri 2a str. 2457T
cggcauuuuuuucaccaacgcaa

SEQ ID NO: 3820593 - RNA, 15 nt, Shigella flexneri 2a str. 2457T
cggccacagccagcc

SEQ ID NO: 3820594 - RNA, 19 nt, Shigella flexneri 2a str. 2457T
cggccacucuuuggcaacc

SEQ ID NO: 3820595 - RNA, 12 nt, Shigella flexneri 2a str. 2457T
cggccagcagcu

SEQ ID NO: 3820596 - RNA, 16 nt, Shigella flexneri 2a str. 2457T
cggccagcaucgcaac

SEQ ID NO: 3820597 - RNA, 14 nt, Shigella flexneri 2a str. 2457T
cggccagcgcaccu

SEQ ID NO: 3820598 - RNA, 22 nt, Shigella flexneri 2a str. 2457T
cggccagcgggcgucaaaauca

SEQ ID NO: 3820599 - RNA, 15 nt, Shigella flexneri 2a str. 2457T
cggccagguuaacca

SEQ ID NO: 3820600 - RNA, 23 nt, Shigella flexneri 2a str. 2457T
cggccaguaagcaguccagcgcc

SEQ ID NO: 3820601 - RNA, 17 nt, Shigella flexneri 2a str. 2457T
cggccagugcuucgcgg

SEQ ID NO: 3820602 - RNA, 22 nt, Shigella flexneri 2a str. 2457T
cggccaguuucggacgcggcac

SEQ ID NO: 3820603 - RNA, 14 nt, Shigella flexneri 2a str. 2457T
cggccauauccagc

SEQ ID NO: 3820604 - RNA, 18 nt, Shigella flexneri 2a str. 2457T
cggccccaucgaaccauc

SEQ ID NO: 3820605 - RNA, 18 nt, Shigella flexneri 2a str. 2457T
cggcccggcccaacgcau

SEQ ID NO: 3820606 - RNA, 14 nt, Shigella flexneri 2a str. 2457T
cggcccggcuuucu

SEQ ID NO: 3820607 - RNA, 17 nt, Shigella flexneri 2a str. 2457T
cggcccuuuuuuuacuu

SEQ ID NO: 3820608 - RNA, 16 nt, Shigella flexneri 2a str. 2457T
cggccgcacuuacagc

SEQ ID NO: 3820609 - RNA, 13 nt, Shigella flexneri 2a str. 2457T
cggccguuccauu

SEQ ID NO: 3820610 - RNA, 20 nt, Shigella flexneri 2a str. 2457T
cggccuacacaugcgucccc

SEQ ID NO: 3820611 - RNA, 15 nt, Shigella flexneri 2a str. 2457T
cggccuaccaugacc

SEQ ID NO: 3820612 - RNA, 17 nt, Shigella flexneri 2a str. 2457T
cggccuaucaacgucgu

SEQ ID NO: 3820613 - RNA, 19 nt, Shigella flexneri 2a str. 2457T
cggccucgcuacgccagca

SEQ ID NO: 3820614 - RNA, 18 nt, Shigella flexneri 2a str. 2457T
cggccucuucaaacggca

SEQ ID NO: 3820615 - RNA, 17 nt, Shigella flexneri 2a str. 2457T
cggccugcguauugcuu

SEQ ID NO: 3820616 - RNA, 13 nt, Shigella flexneri 2a str. 2457T
cggccuuuuccuu

SEQ ID NO: 3820617 - RNA, 14 nt, Shigella flexneri 2a str. 2457T
cggcgaaaacgcca

SEQ ID NO: 3820618 - RNA, 20 nt, Shigella flexneri 2a str. 2457T
cggcgaaacgguaauuauug

SEQ ID NO: 3820619 - RNA, 14 nt, Shigella flexneri 2a str. 2457T
cggcgaaagcuggc

SEQ ID NO: 3820620 - RNA, 14 nt, Shigella flexneri 2a str. 2457T
cggcgaacuuaauc

SEQ ID NO: 3820621 - RNA, 16 nt, Shigella flexneri 2a str. 2457T
cggcgaagagagcgcc

SEQ ID NO: 3820622 - RNA, 18 nt, Shigella flexneri 2a str. 2457T
cggcgaagauacccgcga

SEQ ID NO: 3820623 - RNA, 13 nt, Shigella flexneri 2a str. 2457T
cggcgacccgcga

SEQ ID NO: 3820624 - RNA, 22 nt, Shigella flexneri 2a str. 2457T
cggcgaccguucgccaggucag

SEQ ID NO: 3820625 - RNA, 13 nt, Shigella flexneri 2a str. 2457T
cggcgacgacggu

SEQ ID NO: 3820626 - RNA, 13 nt, Shigella flexneri 2a str. 2457T
cggcgacugaggc

SEQ ID NO: 3820627 - RNA, 18 nt, Shigella flexneri 2a str. 2457T
cggcgacuggauaaugaa

SEQ ID NO: 3820628 - RNA, 13 nt, Shigella flexneri 2a str. 2457T
cggcgaguauucu

SEQ ID NO: 3820629 - RNA, 20 nt, Shigella flexneri 2a str. 2457T
cggcgaguauucuugcugau

SEQ ID NO: 3820630 - RNA, 14 nt, Shigella flexneri 2a str. 2457T
cggcgaucgugagc

SEQ ID NO: 3820631 - RNA, 18 nt, Shigella flexneri 2a str. 2457T
cggcgaucuuuuaauaau

SEQ ID NO: 3820632 - RNA, 14 nt, Shigella flexneri 2a str. 2457T
cggcgauuuacagc

SEQ ID NO: 3820633 - RNA, 22 nt, Shigella flexneri 2a str. 2457T
cggcgcaauucccggaccguca

SEQ ID NO: 3820634 - RNA, 18 nt, Shigella flexneri 2a str. 2457T
cggcgcaucggucgauga

SEQ ID NO: 3820635 - RNA, 13 nt, Shigella flexneri 2a str. 2457T
cggcgcaugccuc

SEQ ID NO: 3820636 - RNA, 14 nt, Shigella flexneri 2a str. 2457T
cggcgcgccaggcg

SEQ ID NO: 3820637 - RNA, 13 nt, Shigella flexneri 2a str. 2457T
cggcgcggcagcu

SEQ ID NO: 3820638 - RNA, 18 nt, Shigella flexneri 2a str. 2457T
cggcgcggugcuggauga

SEQ ID NO: 3820639 - RNA, 14 nt, Shigella flexneri 2a str. 2457T
cggcgcuacggcgu

SEQ ID NO: 3820640 - RNA, 13 nt, Shigella flexneri 2a str. 2457T
cggcgcucaaucc

SEQ ID NO: 3820641 - RNA, 13 nt, Shigella flexneri 2a str. 2457T
cggcgcucugccc

SEQ ID NO: 3820642 - RNA, 15 nt, Shigella flexneri 2a str. 2457T
cggcgcuuuugcauc

SEQ ID NO: 3820643 - RNA, 22 nt, Shigella flexneri 2a str. 2457T
cggcggaauagcguacggcaug

SEQ ID NO: 3820644 - RNA, 17 nt, Shigella flexneri 2a str. 2457T
cggcggaucaccgcguc

SEQ ID NO: 3820645 - RNA, 13 nt, Shigella flexneri 2a str. 2457T
cggcggcacagcg

SEQ ID NO: 3820646 - RNA, 22 nt, Shigella flexneri 2a str. 2457T
cggcggcgauguccagacgcgc

SEQ ID NO: 3820647 - RNA, 15 nt, Shigella flexneri 2a str. 2457T
cggcggcggaaaaag

SEQ ID NO: 3820648 - RNA, 14 nt, Shigella flexneri 2a str. 2457T
cggcggcgggcgca

SEQ ID NO: 3820649 - RNA, 14 nt, Shigella flexneri 2a str. 2457T
cggcgggcgauauc

SEQ ID NO: 3820650 - RNA, 18 nt, Shigella flexneri 2a str. 2457T
cggcggguuaaccagcac

SEQ ID NO: 3820651 - RNA, 16 nt, Shigella flexneri 2a str. 2457T
cggcgguaaaaucauc

SEQ ID NO: 3820652 - RNA, 17 nt, Shigella flexneri 2a str. 2457T
cggcggucagcgccagc

SEQ ID NO: 3820653 - RNA, 19 nt, Shigella flexneri 2a str. 2457T
cggcggugagaagaccgcc

SEQ ID NO: 3820654 - RNA, 15 nt, Shigella flexneri 2a str. 2457T
cggcggugucgccag

SEQ ID NO: 3820655 - RNA, 23 nt, Shigella flexneri 2a str. 2457T
cggcggugucuaacgaugccagc

SEQ ID NO: 3820656 - RNA, 22 nt, Shigella flexneri 2a str. 2457T
cggcgguguucuuguuugauga

SEQ ID NO: 3820657 - RNA, 15 nt, Shigella flexneri 2a str. 2457T
cggcgguugacgccc

SEQ ID NO: 3820658 - RNA, 18 nt, Shigella flexneri 2a str. 2457T
cggcguaaccgcccagug

SEQ ID NO: 3820659 - RNA, 13 nt, Shigella flexneri 2a str. 2457T
cggcguaacgcac

SEQ ID NO: 3820660 - RNA, 15 nt, Shigella flexneri 2a str. 2457T
cggcguaacgccacg

SEQ ID NO: 3820661 - RNA, 19 nt, Shigella flexneri 2a str. 2457T
cggcguaccuucaggcaca

SEQ ID NO: 3820662 - RNA, 22 nt, Shigella flexneri 2a str. 2457T
cggcguaccuuugccuuccagc

SEQ ID NO: 3820663 - RNA, 18 nt, Shigella flexneri 2a str. 2457T
cggcguacuaucugcugc

SEQ ID NO: 3820664 - RNA, 15 nt, Shigella flexneri 2a str. 2457T
cggcguauccggcuc

SEQ ID NO: 3820665 - RNA, 17 nt, Shigella flexneri 2a str. 2457T
cggcguaucgacaauca

SEQ ID NO: 3820666 - RNA, 21 nt, Shigella flexneri 2a str. 2457T
cggcguaucguaaaacgcgga

SEQ ID NO: 3820667 - RNA, 15 nt, Shigella flexneri 2a str. 2457T
cggcguccuggaacu

SEQ ID NO: 3820668 - RNA, 22 nt, Shigella flexneri 2a str. 2457T
cggcgugaacgccuuauccggc

SEQ ID NO: 3820669 - RNA, 13 nt, Shigella flexneri 2a str. 2457T
cggcgugaaugcc

SEQ ID NO: 3820670 - RNA, 16 nt, Shigella flexneri 2a str. 2457T
cggcgugaccucuucg

SEQ ID NO: 3820671 - RNA, 14 nt, Shigella flexneri 2a str. 2457T
cggcguuccccagu

SEQ ID NO: 3820672 - RNA, 16 nt, Shigella flexneri 2a str. 2457T
cggcguugagaaacgc

SEQ ID NO: 3820673 - RNA, 22 nt, Shigella flexneri 2a str. 2457T
cggcguuguaagguuaagccuc

SEQ ID NO: 3820674 - RNA, 22 nt, Shigella flexneri 2a str. 2457T
cggcguuuuguagagcagcacg

SEQ ID NO: 3820675 - RNA, 23 nt, Shigella flexneri 2a str. 2457T
cggcguuuuguagagcagcacgc

SEQ ID NO: 3820676 - RNA, 13 nt, Shigella flexneri 2a str. 2457T
cggcuaucuacgc

SEQ ID NO: 3820677 - RNA, 21 nt, Shigella flexneri 2a str. 2457T
cggcuaucuacgcguaaaugc

SEQ ID NO: 3820678 - RNA, 13 nt, Shigella flexneri 2a str. 2457T
cggcuauuuccgg

SEQ ID NO: 3820679 - RNA, 16 nt, Shigella flexneri 2a str. 2457T
cggcucagccagacgc

SEQ ID NO: 3820680 - RNA, 21 nt, Shigella flexneri 2a str. 2457T
cggcucaguaaaaucgacauc

SEQ ID NO: 3820681 - RNA, 14 nt, Shigella flexneri 2a str. 2457T
cggcucauugccau

SEQ ID NO: 3820682 - RNA, 11 nt, Shigella flexneri 2a str. 2457T
cggcuccagau

SEQ ID NO: 3820683 - RNA, 22 nt, Shigella flexneri 2a str. 2457T
cggcuccagcaaugucauaaac

SEQ ID NO: 3820684 - RNA, 23 nt, Shigella flexneri 2a str. 2457T
cggcucccgcagccacuccuuau

SEQ ID NO: 3820685 - RNA, 19 nt, Shigella flexneri 2a str. 2457T
cggcucgccuuucggcugc

SEQ ID NO: 3820686 - RNA, 20 nt, Shigella flexneri 2a str. 2457T
cggcucgccuuucggcugca

SEQ ID NO: 3820687 - RNA, 19 nt, Shigella flexneri 2a str. 2457T
cggcucggucagacccggg

SEQ ID NO: 3820688 - RNA, 16 nt, Shigella flexneri 2a str. 2457T
cggcugaaaugaugcu

SEQ ID NO: 3820689 - RNA, 23 nt, Shigella flexneri 2a str. 2457T
cggcugaacugauacucgucgcg

SEQ ID NO: 3820690 - RNA, 23 nt, Shigella flexneri 2a str. 2457T
cggcugauaacaauaucaaaugc

SEQ ID NO: 3820691 - RNA, 18 nt, Shigella flexneri 2a str. 2457T
cggcugcuucggucagca

SEQ ID NO: 3820692 - RNA, 16 nt, Shigella flexneri 2a str. 2457T
cggcuggcugaccuga

SEQ ID NO: 3820693 - RNA, 21 nt, Shigella flexneri 2a str. 2457T
cggcugggaaaucaccaccag

SEQ ID NO: 3820694 - RNA, 23 nt, Shigella flexneri 2a str. 2457T
cggcugggaaaucaccaccagca

SEQ ID NO: 3820695 - RNA, 17 nt, Shigella flexneri 2a str. 2457T
cggcuggguuggcaaug

SEQ ID NO: 3820696 - RNA, 19 nt, Shigella flexneri 2a str. 2457T
cggcuggugauuucgucca

SEQ ID NO: 3820697 - RNA, 23 nt, Shigella flexneri 2a str. 2457T
cggcuguagagcuaccggcagga

SEQ ID NO: 3820698 - RNA, 14 nt, Shigella flexneri 2a str. 2457T
cggcuguaugaccu

SEQ ID NO: 3820699 - RNA, 14 nt, Shigella flexneri 2a str. 2457T
cggcuguccggcac

SEQ ID NO: 3820700 - RNA, 19 nt, Shigella flexneri 2a str. 2457T
cggcuguuggaaucacuca

SEQ ID NO: 3820701 - RNA, 17 nt, Shigella flexneri 2a str. 2457T
cggcuuagcguuacguu

SEQ ID NO: 3820702 - RNA, 16 nt, Shigella flexneri 2a str. 2457T
cggcuuauucauuacu

SEQ ID NO: 3820703 - RNA, 23 nt, Shigella flexneri 2a str. 2457T
cggcuuauugcuucaagaugcca

SEQ ID NO: 3820704 - RNA, 13 nt, Shigella flexneri 2a str. 2457T
cggcuucgccucc

SEQ ID NO: 3820705 - RNA, 18 nt, Shigella flexneri 2a str. 2457T
cggcuucgccuccuguuc

SEQ ID NO: 3820706 - RNA, 19 nt, Shigella flexneri 2a str. 2457T
cggcuucgccuccuguucu

SEQ ID NO: 3820707 - RNA, 18 nt, Shigella flexneri 2a str. 2457T
cggcuuguacgccgccgc

SEQ ID NO: 3820708 - RNA, 20 nt, Shigella flexneri 2a str. 2457T
cggcuuugaauaucuccucu

SEQ ID NO: 3820709 - RNA, 17 nt, Shigella flexneri 2a str. 2457T
cggcuuugcagguucug

SEQ ID NO: 3820710 - RNA, 17 nt, Shigella flexneri 2a str. 2457T
cgggaauaaaagccagg

SEQ ID NO: 3820711 - RNA, 17 nt, Shigella flexneri 2a str. 2457T
cgggacaacaaacgcaa

SEQ ID NO: 3820712 - RNA, 14 nt, Shigella flexneri 2a str. 2457T
cgggaccagcauuc

SEQ ID NO: 3820713 - RNA, 14 nt, Shigella flexneri 2a str. 2457T
cgggagcaauuugu

SEQ ID NO: 3820714 - RNA, 13 nt, Shigella flexneri 2a str. 2457T
cgggaucaccaga

SEQ ID NO: 3820715 - RNA, 18 nt, Shigella flexneri 2a str. 2457T
cgggaucaccagaccaau

SEQ ID NO: 3820716 - RNA, 20 nt, Shigella flexneri 2a str. 2457T
cgggaucagguauaccgaaa

SEQ ID NO: 3820717 - RNA, 20 nt, Shigella flexneri 2a str. 2457T
cgggaugguguaaaugccgg

SEQ ID NO: 3820718 - RNA, 13 nt, Shigella flexneri 2a str. 2457T
cgggauuauggau

SEQ ID NO: 3820719 - RNA, 14 nt, Shigella flexneri 2a str. 2457T
cgggcaaagcgacg

SEQ ID NO: 3820720 - RNA, 15 nt, Shigella flexneri 2a str. 2457T
cgggcaaagcgacgc

SEQ ID NO: 3820721 - RNA, 18 nt, Shigella flexneri 2a str. 2457T
cgggcaaagcgacgcgca

SEQ ID NO: 3820722 - RNA, 18 nt, Shigella flexneri 2a str. 2457T
cgggcaaauccacugaau

SEQ ID NO: 3820723 - RNA, 16 nt, Shigella flexneri 2a str. 2457T
cgggcaacguuccagc

SEQ ID NO: 3820724 - RNA, 14 nt, Shigella flexneri 2a str. 2457T
cgggcaacugcugc

SEQ ID NO: 3820725 - RNA, 15 nt, Shigella flexneri 2a str. 2457T
cgggcaagccagcau

SEQ ID NO: 3820726 - RNA, 17 nt, Shigella flexneri 2a str. 2457T
cgggcaagccagcauac

SEQ ID NO: 3820727 - RNA, 14 nt, Shigella flexneri 2a str. 2457T
cgggcaaucggcug

SEQ ID NO: 3820728 - RNA, 21 nt, Shigella flexneri 2a str. 2457T
cgggcacagauuuccaagcgc

SEQ ID NO: 3820729 - RNA, 17 nt, Shigella flexneri 2a str. 2457T
cgggcacaggcgaugcc

SEQ ID NO: 3820730 - RNA, 18 nt, Shigella flexneri 2a str. 2457T
cgggcaccaguaacgaua

SEQ ID NO: 3820731 - RNA, 16 nt, Shigella flexneri 2a str. 2457T
cgggcagaggcaauau

SEQ ID NO: 3820732 - RNA, 19 nt, Shigella flexneri 2a str. 2457T
cgggcagcagaaccaggga

SEQ ID NO: 3820733 - RNA, 15 nt, Shigella flexneri 2a str. 2457T
cgggcaucagcagca

SEQ ID NO: 3820734 - RNA, 14 nt, Shigella flexneri 2a str. 2457T
cgggcaugauagcc

SEQ ID NO: 3820735 - RNA, 18 nt, Shigella flexneri 2a str. 2457T
cgggcaugauagcccgga

SEQ ID NO: 3820736 - RNA, 15 nt, Shigella flexneri 2a str. 2457T
cgggccaaagcauuc

SEQ ID NO: 3820737 - RNA, 17 nt, Shigella flexneri 2a str. 2457T
cgggccaguuucauagu

SEQ ID NO: 3820738 - RNA, 20 nt, Shigella flexneri 2a str. 2457T
cgggccauaaaaggaagagg

SEQ ID NO: 3820739 - RNA, 21 nt, Shigella flexneri 2a str. 2457T
cgggccauaaaaggaagaggc

SEQ ID NO: 3820740 - RNA, 20 nt, Shigella flexneri 2a str. 2457T
cgggcccauaacgccugcuc

SEQ ID NO: 3820741 - RNA, 21 nt, Shigella flexneri 2a str. 2457T
cgggccgcaaaccagcgcaug

SEQ ID NO: 3820742 - RNA, 17 nt, Shigella flexneri 2a str. 2457T
cgggccguaacugugcc

SEQ ID NO: 3820743 - RNA, 18 nt, Shigella flexneri 2a str. 2457T
cgggccuccccugauuca

SEQ ID NO: 3820744 - RNA, 21 nt, Shigella flexneri 2a str. 2457T
cgggccuccccugauucaucc

SEQ ID NO: 3820745 - RNA, 15 nt, Shigella flexneri 2a str. 2457T
cgggccugaacaagc

SEQ ID NO: 3820746 - RNA, 16 nt, Shigella flexneri 2a str. 2457T
cgggccugaacaagca

SEQ ID NO: 3820747 - RNA, 14 nt, Shigella flexneri 2a str. 2457T
cgggcgaccaauca

SEQ ID NO: 3820748 - RNA, 13 nt, Shigella flexneri 2a str. 2457T
cgggcgacgaaca

SEQ ID NO: 3820749 - RNA, 16 nt, Shigella flexneri 2a str. 2457T
cgggcgauccggcaaa

SEQ ID NO: 3820750 - RNA, 15 nt, Shigella flexneri 2a str. 2457T
cgggcgcaagggcug

SEQ ID NO: 3820751 - RNA, 14 nt, Shigella flexneri 2a str. 2457T
cgggcguccugcuu

SEQ ID NO: 3820752 - RNA, 22 nt, Shigella flexneri 2a str. 2457T
cgggcuaacuucuuuuucgaca

SEQ ID NO: 3820753 - RNA, 14 nt, Shigella flexneri 2a str. 2457T
cgggcuaaucguca

SEQ ID NO: 3820754 - RNA, 13 nt, Shigella flexneri 2a str. 2457T
cgggcucaugcug

SEQ ID NO: 3820755 - RNA, 20 nt, Shigella flexneri 2a str. 2457T
cgggcugguuuucagcgaaa

SEQ ID NO: 3820756 - RNA, 15 nt, Shigella flexneri 2a str. 2457T
cgggcuuccggcaau

SEQ ID NO: 3820757 - RNA, 15 nt, Shigella flexneri 2a str. 2457T
cggggaacgcaaaau

SEQ ID NO: 3820758 - RNA, 16 nt, Shigella flexneri 2a str. 2457T
cggggacaggcggccc

SEQ ID NO: 3820759 - RNA, 14 nt, Shigella flexneri 2a str. 2457T
cggggacaggcggg

SEQ ID NO: 3820760 - RNA, 16 nt, Shigella flexneri 2a str. 2457T
cggggacgcugucggc

SEQ ID NO: 3820761 - RNA, 19 nt, Shigella flexneri 2a str. 2457T
cggggagauauuccccaga

SEQ ID NO: 3820762 - RNA, 13 nt, Shigella flexneri 2a str. 2457T
cggggaucacucc

SEQ ID NO: 3820763 - RNA, 17 nt, Shigella flexneri 2a str. 2457T
cggggaucacuggcaga

SEQ ID NO: 3820764 - RNA, 20 nt, Shigella flexneri 2a str. 2457T
cggggauuauugccgcagcg

SEQ ID NO: 3820765 - RNA, 19 nt, Shigella flexneri 2a str. 2457T
cggggccagcauuccagau

SEQ ID NO: 3820766 - RNA, 17 nt, Shigella flexneri 2a str. 2457T
cggggcuauaccagaua

SEQ ID NO: 3820767 - RNA, 20 nt, Shigella flexneri 2a str. 2457T
cggggcuguuuuccagcacc

SEQ ID NO: 3820768 - RNA, 23 nt, Shigella flexneri 2a str. 2457T
cgggguaaauccacguuccugga

SEQ ID NO: 3820769 - RNA, 18 nt, Shigella flexneri 2a str. 2457T
cggggugauaacgccugg

SEQ ID NO: 3820770 - RNA, 14 nt, Shigella flexneri 2a str. 2457T
cgggguuugcagau

SEQ ID NO: 3820771 - RNA, 20 nt, Shigella flexneri 2a str. 2457T
cggguaaauaauauccccag

SEQ ID NO: 3820772 - RNA, 14 nt, Shigella flexneri 2a str. 2457T
cggguaaccagcca

SEQ ID NO: 3820773 - RNA, 21 nt, Shigella flexneri 2a str. 2457T
cggguaacuaauaauugcccc

SEQ ID NO: 3820774 - RNA, 14 nt, Shigella flexneri 2a str. 2457T
cggguaccagaauc

SEQ ID NO: 3820775 - RNA, 14 nt, Shigella flexneri 2a str. 2457T
cgggucaccgccga

SEQ ID NO: 3820776 - RNA, 16 nt, Shigella flexneri 2a str. 2457T
cgggucaccgcggugu

SEQ ID NO: 3820777 - RNA, 15 nt, Shigella flexneri 2a str. 2457T
cgggucaggccagga

SEQ ID NO: 3820778 - RNA, 20 nt, Shigella flexneri 2a str. 2457T
cgggucaguauuccaaucgg

SEQ ID NO: 3820779 - RNA, 16 nt, Shigella flexneri 2a str. 2457T
cgggugcaaucaacac

SEQ ID NO: 3820780 - RNA, 21 nt, Shigella flexneri 2a str. 2457T
cgggugcaaucaacaccacug

SEQ ID NO: 3820781 - RNA, 23 nt, Shigella flexneri 2a str. 2457T
cgggugcaaucaacaccacugcc

SEQ ID NO: 3820782 - RNA, 19 nt, Shigella flexneri 2a str. 2457T
cggguggugacuggcaaca

SEQ ID NO: 3820783 - RNA, 18 nt, Shigella flexneri 2a str. 2457T
cggguguccacucgguaa

SEQ ID NO: 3820784 - RNA, 14 nt, Shigella flexneri 2a str. 2457T
cggguuaaauccug

SEQ ID NO: 3820785 - RNA, 17 nt, Shigella flexneri 2a str. 2457T
cggguuaaccagcacca

SEQ ID NO: 3820786 - RNA, 20 nt, Shigella flexneri 2a str. 2457T
cggguuaaccagcaccagcu

SEQ ID NO: 3820787 - RNA, 15 nt, Shigella flexneri 2a str. 2457T
cggguuggagcgcgu

SEQ ID NO: 3820788 - RNA, 18 nt, Shigella flexneri 2a str. 2457T
cggguuuacuuccccggc

SEQ ID NO: 3820789 - RNA, 13 nt, Shigella flexneri 2a str. 2457T
cggguuuccugga

SEQ ID NO: 3820790 - RNA, 15 nt, Shigella flexneri 2a str. 2457T
cggguuuucaacggc

SEQ ID NO: 3820791 - RNA, 14 nt, Shigella flexneri 2a str. 2457T
cggguuuucaauga

SEQ ID NO: 3820792 - RNA, 18 nt, Shigella flexneri 2a str. 2457T
cgguaaaaccuuugcgaa

SEQ ID NO: 3820793 - RNA, 13 nt, Shigella flexneri 2a str. 2457T
cgguaaaaucauc

SEQ ID NO: 3820794 - RNA, 16 nt, Shigella flexneri 2a str. 2457T
cgguaaaaucauccug

SEQ ID NO: 3820795 - RNA, 16 nt, Shigella flexneri 2a str. 2457T
cgguaaagcccucacc

SEQ ID NO: 3820796 - RNA, 17 nt, Shigella flexneri 2a str. 2457T
cgguaaaugcucauacc

SEQ ID NO: 3820797 - RNA, 13 nt, Shigella flexneri 2a str. 2457T
cgguaacauccag

SEQ ID NO: 3820798 - RNA, 18 nt, Shigella flexneri 2a str. 2457T
cgguaaccccucuucagc

SEQ ID NO: 3820799 - RNA, 23 nt, Shigella flexneri 2a str. 2457T
cgguaacgauuucaucgcccagg

SEQ ID NO: 3820800 - RNA, 15 nt, Shigella flexneri 2a str. 2457T
cgguaacuuaucugu

SEQ ID NO: 3820801 - RNA, 23 nt, Shigella flexneri 2a str. 2457T
cgguaagaguaaagcccgccauc

SEQ ID NO: 3820802 - RNA, 21 nt, Shigella flexneri 2a str. 2457T
cgguaagcccgugaccagcga

SEQ ID NO: 3820803 - RNA, 15 nt, Shigella flexneri 2a str. 2457T
cgguaagcugaugac

SEQ ID NO: 3820804 - RNA, 22 nt, Shigella flexneri 2a str. 2457T
cgguaauaaaugccggaagcug

SEQ ID NO: 3820805 - RNA, 16 nt, Shigella flexneri 2a str. 2457T
cgguaauccgggugaa

SEQ ID NO: 3820806 - RNA, 19 nt, Shigella flexneri 2a str. 2457T
cgguaauuauugaugaagu

SEQ ID NO: 3820807 - RNA, 14 nt, Shigella flexneri 2a str. 2457T
cgguaauuccggcg

SEQ ID NO: 3820808 - RNA, 14 nt, Shigella flexneri 2a str. 2457T
cgguaauuucacaa

SEQ ID NO: 3820809 - RNA, 23 nt, Shigella flexneri 2a str. 2457T
cgguacaaacaucauccagugcc

SEQ ID NO: 3820810 - RNA, 24 nt, Shigella flexneri 2a str. 2457T
cgguaccaguacgcccacgccagc

SEQ ID NO: 3820811 - RNA, 20 nt, Shigella flexneri 2a str. 2457T
cgguaccuuugaacugcuga

SEQ ID NO: 3820812 - RNA, 15 nt, Shigella flexneri 2a str. 2457T
cgguacucgcgcagu

SEQ ID NO: 3820813 - RNA, 20 nt, Shigella flexneri 2a str. 2457T
cgguacugaccaucagcagc

SEQ ID NO: 3820814 - RNA, 12 nt, Shigella flexneri 2a str. 2457T
cgguacuucacc

SEQ ID NO: 3820815 - RNA, 16 nt, Shigella flexneri 2a str. 2457T
cgguagaauuguaauc

SEQ ID NO: 3820816 - RNA, 22 nt, Shigella flexneri 2a str. 2457T
cgguagauuauuucgcugcgga

SEQ ID NO: 3820817 - RNA, 21 nt, Shigella flexneri 2a str. 2457T
cgguagcagcuuucagcagcg

SEQ ID NO: 3820818 - RNA, 18 nt, Shigella flexneri 2a str. 2457T
cgguaguuaaacuuucau

SEQ ID NO: 3820819 - RNA, 16 nt, Shigella flexneri 2a str. 2457T
cgguaguuucucccca

SEQ ID NO: 3820820 - RNA, 14 nt, Shigella flexneri 2a str. 2457T
cgguauagaucaga

SEQ ID NO: 3820821 - RNA, 19 nt, Shigella flexneri 2a str. 2457T
cgguauagaucagacgaca

SEQ ID NO: 3820822 - RNA, 13 nt, Shigella flexneri 2a str. 2457T
cgguaucaaacac

SEQ ID NO: 3820823 - RNA, 14 nt, Shigella flexneri 2a str. 2457T
cgguaucaccaccc

SEQ ID NO: 3820824 - RNA, 17 nt, Shigella flexneri 2a str. 2457T
cgguaucaccacccagc

SEQ ID NO: 3820825 - RNA, 19 nt, Shigella flexneri 2a str. 2457T
cgguaucaccacccagcgg

SEQ ID NO: 3820826 - RNA, 16 nt, Shigella flexneri 2a str. 2457T
cgguaugacccagcgc

SEQ ID NO: 3820827 - RNA, 18 nt, Shigella flexneri 2a str. 2457T
cgguauuaaucugccagc

SEQ ID NO: 3820828 - RNA, 14 nt, Shigella flexneri 2a str. 2457T
cgguauuggugaaa

SEQ ID NO: 3820829 - RNA, 15 nt, Shigella flexneri 2a str. 2457T
cggucaaaagcugca

SEQ ID NO: 3820830 - RNA, 14 nt, Shigella flexneri 2a str. 2457T
cggucacgcccgga

SEQ ID NO: 3820831 - RNA, 20 nt, Shigella flexneri 2a str. 2457T
cggucacggcuguagccagc

SEQ ID NO: 3820832 - RNA, 14 nt, Shigella flexneri 2a str. 2457T
cggucagcagcacc

SEQ ID NO: 3820833 - RNA, 16 nt, Shigella flexneri 2a str. 2457T
cggucagcagcaccac

SEQ ID NO: 3820834 - RNA, 22 nt, Shigella flexneri 2a str. 2457T
ccggcagagaaaaugccgcaca

SEQ ID NO: 3820835 - RNA, 17 nt, Shigella flexneri 2a str. 2457T
ccggcagccccaaacag

SEQ ID NO: 3820836 - RNA, 23 nt, Shigella flexneri 2a str. 2457T
ccggcauaaacaaagugcacuuu

SEQ ID NO: 3820837 - RNA, 15 nt, Shigella flexneri 2a str. 2457T
ccggcauaaacaacg

SEQ ID NO: 3820838 - RNA, 20 nt, Shigella flexneri 2a str. 2457T
ccggcauaaacaacgagcuu

SEQ ID NO: 3820839 - RNA, 17 nt, Shigella flexneri 2a str. 2457T
ccggcaucaaccagcac

SEQ ID NO: 3820840 - RNA, 19 nt, Shigella flexneri 2a str. 2457T
ccggcauccagccaaacau

SEQ ID NO: 3820841 - RNA, 16 nt, Shigella flexneri 2a str. 2457T
ccggcauccagcguuc

SEQ ID NO: 3820842 - RNA, 23 nt, Shigella flexneri 2a str. 2457T
ccggcaucguuugcugccuucac

SEQ ID NO: 3820843 - RNA, 15 nt, Shigella flexneri 2a str. 2457T
ccggcauuacggauu

SEQ ID NO: 3820844 - RNA, 12 nt, Shigella flexneri 2a str. 2457T
ccggccagagca

SEQ ID NO: 3820845 - RNA, 12 nt, Shigella flexneri 2a str. 2457T
ccggccagcauc

SEQ ID NO: 3820846 - RNA, 23 nt, Shigella flexneri 2a str. 2457T
ccggccagcgccaccaccagcac

SEQ ID NO: 3820847 - RNA, 13 nt, Shigella flexneri 2a str. 2457T
ccggccagcgccg

SEQ ID NO: 3820848 - RNA, 21 nt, Shigella flexneri 2a str. 2457T
ccggccaguaagcaguccagc

SEQ ID NO: 3820849 - RNA, 15 nt, Shigella flexneri 2a str. 2457T
ccggccaucgccuga

SEQ ID NO: 3820850 - RNA, 14 nt, Shigella flexneri 2a str. 2457T
ccggccauuccagc

SEQ ID NO: 3820851 - RNA, 16 nt, Shigella flexneri 2a str. 2457T
ccggccccggaaccgg

SEQ ID NO: 3820852 - RNA, 21 nt, Shigella flexneri 2a str. 2457T
ccggccccugaucggccauga

SEQ ID NO: 3820853 - RNA, 22 nt, Shigella flexneri 2a str. 2457T
ccggccccugaucggccaugau

SEQ ID NO: 3820854 - RNA, 20 nt, Shigella flexneri 2a str. 2457T
ccggcccuaaacucuuuacc

SEQ ID NO: 3820855 - RNA, 17 nt, Shigella flexneri 2a str. 2457T
ccggccuacaagaacca

SEQ ID NO: 3820856 - RNA, 14 nt, Shigella flexneri 2a str. 2457T
ccggccuacacaug

SEQ ID NO: 3820857 - RNA, 19 nt, Shigella flexneri 2a str. 2457T
ccggccuaccguucaggca

SEQ ID NO: 3820858 - RNA, 23 nt, Shigella flexneri 2a str. 2457T
ccggccuguuuauccaucacgcu

SEQ ID NO: 3820859 - RNA, 19 nt, Shigella flexneri 2a str. 2457T
ccggcgacccgcgacuggu

SEQ ID NO: 3820860 - RNA, 20 nt, Shigella flexneri 2a str. 2457T
ccggcgacguauugcgcaga

SEQ ID NO: 3820861 - RNA, 13 nt, Shigella flexneri 2a str. 2457T
ccggcgcauccau

SEQ ID NO: 3820862 - RNA, 15 nt, Shigella flexneri 2a str. 2457T
ccggcgcauccauga

SEQ ID NO: 3820863 - RNA, 11 nt, Shigella flexneri 2a str. 2457T
ccggcgcuaau

SEQ ID NO: 3820864 - RNA, 19 nt, Shigella flexneri 2a str. 2457T
ccggcgcuaauucaacgcc

SEQ ID NO: 3820865 - RNA, 19 nt, Shigella flexneri 2a str. 2457T
ccggcggaauggucggcgc

SEQ ID NO: 3820866 - RNA, 22 nt, Shigella flexneri 2a str. 2457T
ccggcgggaaaaaucuucgauc

SEQ ID NO: 3820867 - RNA, 18 nt, Shigella flexneri 2a str. 2457T
ccggcgguaaaucgccgc

SEQ ID NO: 3820868 - RNA, 17 nt, Shigella flexneri 2a str. 2457T
ccggcgucgcauccggc

SEQ ID NO: 3820869 - RNA, 18 nt, Shigella flexneri 2a str. 2457T
ccggcgucgcauccggca

SEQ ID NO: 3820870 - RNA, 17 nt, Shigella flexneri 2a str. 2457T
ccggcgucgcuucucaa

SEQ ID NO: 3820871 - RNA, 22 nt, Shigella flexneri 2a str. 2457T
ccggcugaggcguuucaacucc

SEQ ID NO: 3820872 - RNA, 21 nt, Shigella flexneri 2a str. 2457T
ccggcuuauaauccccggccu

SEQ ID NO: 3820873 - RNA, 13 nt, Shigella flexneri 2a str. 2457T
ccggcuugaacca

SEQ ID NO: 3820874 - RNA, 14 nt, Shigella flexneri 2a str. 2457T
ccggcuuucugcaa

SEQ ID NO: 3820875 - RNA, 23 nt, Shigella flexneri 2a str. 2457T
ccggcuuucugcaaccaggaagu

SEQ ID NO: 3820876 - RNA, 19 nt, Shigella flexneri 2a str. 2457T
ccgggaaauccucaaccgg

SEQ ID NO: 3820877 - RNA, 22 nt, Shigella flexneri 2a str. 2457T
ccgggaacuggcaacaauggca

SEQ ID NO: 3820878 - RNA, 23 nt, Shigella flexneri 2a str. 2457T
ccgggaagcucucuuccaguucg

SEQ ID NO: 3820879 - RNA, 14 nt, Shigella flexneri 2a str. 2457T
ccgggagaaggccu

SEQ ID NO: 3820880 - RNA, 18 nt, Shigella flexneri 2a str. 2457T
ccgggaucagacgaccca

SEQ ID NO: 3820881 - RNA, 17 nt, Shigella flexneri 2a str. 2457T
ccgggauggucagcgga

SEQ ID NO: 3820882 - RNA, 13 nt, Shigella flexneri 2a str. 2457T
ccgggauugagau

SEQ ID NO: 3820883 - RNA, 14 nt, Shigella flexneri 2a str. 2457T
ccgggcauauuucc

SEQ ID NO: 3820884 - RNA, 18 nt, Shigella flexneri 2a str. 2457T
ccgggcaucagcagcacg

SEQ ID NO: 3820885 - RNA, 18 nt, Shigella flexneri 2a str. 2457T
ccggggcgcgugcuccag

SEQ ID NO: 3820886 - RNA, 14 nt, Shigella flexneri 2a str. 2457T
ccggguaccacgca

SEQ ID NO: 3820887 - RNA, 16 nt, Shigella flexneri 2a str. 2457T
ccggguaccagaauca

SEQ ID NO: 3820888 - RNA, 23 nt, Shigella flexneri 2a str. 2457T
ccgggugaacugccacacaggcc

SEQ ID NO: 3820889 - RNA, 13 nt, Shigella flexneri 2a str. 2457T
ccgggugcagaca

SEQ ID NO: 3820890 - RNA, 17 nt, Shigella flexneri 2a str. 2457T
ccggguuugccacauca

SEQ ID NO: 3820891 - RNA, 21 nt, Shigella flexneri 2a str. 2457T
ccggguuugccacaucacugu

SEQ ID NO: 3820892 - RNA, 19 nt, Shigella flexneri 2a str. 2457T
ccggguuuucaaugauaaa

SEQ ID NO: 3820893 - RNA, 16 nt, Shigella flexneri 2a str. 2457T
ccggguuuuuuauuaa

SEQ ID NO: 3820894 - RNA, 15 nt, Shigella flexneri 2a str. 2457T
ccgguaaagcaauga

SEQ ID NO: 3820895 - RNA, 14 nt, Shigella flexneri 2a str. 2457T
ccgguaagcauuua

SEQ ID NO: 3820896 - RNA, 22 nt, Shigella flexneri 2a str. 2457T
ccgguaaugcugaaauuacgcg

SEQ ID NO: 3820897 - RNA, 21 nt, Shigella flexneri 2a str. 2457T
ccgguacaaacaucauccagu

SEQ ID NO: 3820898 - RNA, 16 nt, Shigella flexneri 2a str. 2457T
ccgguaccuuugaacu

SEQ ID NO: 3820899 - RNA, 15 nt, Shigella flexneri 2a str. 2457T
ccgguagucaccgcc

SEQ ID NO: 3820900 - RNA, 20 nt, Shigella flexneri 2a str. 2457T
ccgguaucaaacccuuccau

SEQ ID NO: 3820901 - RNA, 15 nt, Shigella flexneri 2a str. 2457T
ccggucaaaugaccg

SEQ ID NO: 3820902 - RNA, 19 nt, Shigella flexneri 2a str. 2457T
ccggucacgcccggaauuu

SEQ ID NO: 3820903 - RNA, 20 nt, Shigella flexneri 2a str. 2457T
ccggucagcagcaccaccgc

SEQ ID NO: 3820904 - RNA, 14 nt, Shigella flexneri 2a str. 2457T
ccgguccuggcgau

SEQ ID NO: 3820905 - RNA, 19 nt, Shigella flexneri 2a str. 2457T
ccggucuaccgauccggca

SEQ ID NO: 3820906 - RNA, 22 nt, Shigella flexneri 2a str. 2457T
ccggucuaccgauccggcacca

SEQ ID NO: 3820907 - RNA, 18 nt, Shigella flexneri 2a str. 2457T
ccggucuggguuucgcca

SEQ ID NO: 3820908 - RNA, 21 nt, Shigella flexneri 2a str. 2457T
ccggucuggguuucgccaggc

SEQ ID NO: 3820909 - RNA, 23 nt, Shigella flexneri 2a str. 2457T
ccggucuggguuucgccaggcac

SEQ ID NO: 3820910 - RNA, 19 nt, Shigella flexneri 2a str. 2457T
ccggugaaucgcaauuuau

SEQ ID NO: 3820911 - RNA, 11 nt, Shigella flexneri 2a str. 2457T
ccggugcauuc

SEQ ID NO: 3820912 - RNA, 16 nt, Shigella flexneri 2a str. 2457T
ccggugcgccagaccu

SEQ ID NO: 3820913 - RNA, 13 nt, Shigella flexneri 2a str. 2457T
ccgguggcauccg

SEQ ID NO: 3820914 - RNA, 20 nt, Shigella flexneri 2a str. 2457T
ccgguuaaaucgacguucug

SEQ ID NO: 3820915 - RNA, 15 nt, Shigella flexneri 2a str. 2457T
ccgguuaaccuuuaa

SEQ ID NO: 3820916 - RNA, 15 nt, Shigella flexneri 2a str. 2457T
ccgguuaacgccgcg

SEQ ID NO: 3820917 - RNA, 22 nt, Shigella flexneri 2a str. 2457T
ccgguuacgccaccagcugaca

SEQ ID NO: 3820918 - RNA, 14 nt, Shigella flexneri 2a str. 2457T
ccgguucaucacga

SEQ ID NO: 3820919 - RNA, 16 nt, Shigella flexneri 2a str. 2457T
ccgguucggccauauc

SEQ ID NO: 3820920 - RNA, 21 nt, Shigella flexneri 2a str. 2457T
ccgguucggccauauccagcc

SEQ ID NO: 3820921 - RNA, 14 nt, Shigella flexneri 2a str. 2457T
ccgguuuagugaua

SEQ ID NO: 3820922 - RNA, 17 nt, Shigella flexneri 2a str. 2457T
ccgguuucaauccaggu

SEQ ID NO: 3820923 - RNA, 22 nt, Shigella flexneri 2a str. 2457T
ccgguuucgugaaacucagcau

SEQ ID NO: 3820924 - RNA, 16 nt, Shigella flexneri 2a str. 2457T
ccgguuuugcaggaaa

SEQ ID NO: 3820925 - RNA, 16 nt, Shigella flexneri 2a str. 2457T
ccgguuuugguuuucu

SEQ ID NO: 3820926 - RNA, 12 nt, Shigella flexneri 2a str. 2457T
ccgguuuuucaa

SEQ ID NO: 3820927 - RNA, 12 nt, Shigella flexneri 2a str. 2457T
ccguaaaaaaug

SEQ ID NO: 3820928 - RNA, 20 nt, Shigella flexneri 2a str. 2457T
ccguaaagcccauaccacag

SEQ ID NO: 3820929 - RNA, 22 nt, Shigella flexneri 2a str. 2457T
ccguaaaucccagugccugcau

SEQ ID NO: 3820930 - RNA, 17 nt, Shigella flexneri 2a str. 2457T
ccguaagcaacgccaaa

SEQ ID NO: 3820931 - RNA, 14 nt, Shigella flexneri 2a str. 2457T
ccguaagcgcggag

SEQ ID NO: 3820932 - RNA, 19 nt, Shigella flexneri 2a str. 2457T
ccguaauagauccuuuuuc

SEQ ID NO: 3820933 - RNA, 19 nt, Shigella flexneri 2a str. 2457T
ccguaauccguggucuguu

SEQ ID NO: 3820934 - RNA, 21 nt, Shigella flexneri 2a str. 2457T
ccguacaaagugccgccagcu

SEQ ID NO: 3820935 - RNA, 15 nt, Shigella flexneri 2a str. 2457T
ccguaccaucgccag

SEQ ID NO: 3820936 - RNA, 15 nt, Shigella flexneri 2a str. 2457T
ccguagcguucuuug

SEQ ID NO: 3820937 - RNA, 23 nt, Shigella flexneri 2a str. 2457T
ccguagcuucaccgcaucgucac

SEQ ID NO: 3820938 - RNA, 17 nt, Shigella flexneri 2a str. 2457T
ccguaguauuuucuuug

SEQ ID NO: 3820939 - RNA, 19 nt, Shigella flexneri 2a str. 2457T
ccguaguccauacccagca

SEQ ID NO: 3820940 - RNA, 12 nt, Shigella flexneri 2a str. 2457T
ccguagugaaaa

SEQ ID NO: 3820941 - RNA, 13 nt, Shigella flexneri 2a str. 2457T
ccguaguggccac

SEQ ID NO: 3820942 - RNA, 18 nt, Shigella flexneri 2a str. 2457T
ccguauaauaucuuuucu

SEQ ID NO: 3820943 - RNA, 19 nt, Shigella flexneri 2a str. 2457T
ccguaugcgguacugacca

SEQ ID NO: 3820944 - RNA, 22 nt, Shigella flexneri 2a str. 2457T
ccguauguucccaccagccacg

SEQ ID NO: 3820945 - RNA, 17 nt, Shigella flexneri 2a str. 2457T
ccguauuacugagaugg

SEQ ID NO: 3820946 - RNA, 23 nt, Shigella flexneri 2a str. 2457T
ccgucacgcguugcuaugcugaa

SEQ ID NO: 3820947 - RNA, 17 nt, Shigella flexneri 2a str. 2457T
ccgucacgguaauaaca

SEQ ID NO: 3820948 - RNA, 14 nt, Shigella flexneri 2a str. 2457T
ccgucagcaaaaua

SEQ ID NO: 3820949 - RNA, 19 nt, Shigella flexneri 2a str. 2457T
ccgucagcgaucagcauuu

SEQ ID NO: 3820950 - RNA, 13 nt, Shigella flexneri 2a str. 2457T
ccgucagcggcaa

SEQ ID NO: 3820951 - RNA, 22 nt, Shigella flexneri 2a str. 2457T
ccgucagucacaccgcgcgucc

SEQ ID NO: 3820952 - RNA, 15 nt, Shigella flexneri 2a str. 2457T
ccgucaugccgguaa

SEQ ID NO: 3820953 - RNA, 17 nt, Shigella flexneri 2a str. 2457T
ccgucauuguuaacgcc

SEQ ID NO: 3820954 - RNA, 16 nt, Shigella flexneri 2a str. 2457T
ccgucccuaccgguaa

SEQ ID NO: 3820955 - RNA, 16 nt, Shigella flexneri 2a str. 2457T
ccgucccucgccccuu

SEQ ID NO: 3820956 - RNA, 15 nt, Shigella flexneri 2a str. 2457T
ccguccggcaucgca

SEQ ID NO: 3820957 - RNA, 15 nt, Shigella flexneri 2a str. 2457T
ccguccggcgggcaa

SEQ ID NO: 3820958 - RNA, 23 nt, Shigella flexneri 2a str. 2457T
ccguccuucaucuucauccggcu

SEQ ID NO: 3820959 - RNA, 22 nt, Shigella flexneri 2a str. 2457T
ccgucgagcagagaaacgccag

SEQ ID NO: 3820960 - RNA, 14 nt, Shigella flexneri 2a str. 2457T
ccgucgaggaacau

SEQ ID NO: 3820961 - RNA, 17 nt, Shigella flexneri 2a str. 2457T
ccgucgaugccccagua

SEQ ID NO: 3820962 - RNA, 21 nt, Shigella flexneri 2a str. 2457T
ccgucgcauggggaucgugau

SEQ ID NO: 3820963 - RNA, 14 nt, Shigella flexneri 2a str. 2457T
ccgucgugaaugcc

SEQ ID NO: 3820964 - RNA, 21 nt, Shigella flexneri 2a str. 2457T
ccgucguugagcaucugcaaa

SEQ ID NO: 3820965 - RNA, 17 nt, Shigella flexneri 2a str. 2457T
ccgucuucccgcagcca

SEQ ID NO: 3820966 - RNA, 14 nt, Shigella flexneri 2a str. 2457T
ccgucuuuuuucac

SEQ ID NO: 3820967 - RNA, 17 nt, Shigella flexneri 2a str. 2457T
ccgugaacaauuucagc

SEQ ID NO: 3820968 - RNA, 13 nt, Shigella flexneri 2a str. 2457T
ccgugaauaugga

SEQ ID NO: 3820969 - RNA, 14 nt, Shigella flexneri 2a str. 2457T
ccgugaauuacugc

SEQ ID NO: 3820970 - RNA, 17 nt, Shigella flexneri 2a str. 2457T
ccgugacugggugccgc

SEQ ID NO: 3820971 - RNA, 24 nt, Shigella flexneri 2a str. 2457T
ccgugagcggaacggcaggaauac

SEQ ID NO: 3820972 - RNA, 18 nt, Shigella flexneri 2a str. 2457T
ccgugaucguggccauga

SEQ ID NO: 3820973 - RNA, 13 nt, Shigella flexneri 2a str. 2457T
ccgugaucuggcg

SEQ ID NO: 3820974 - RNA, 21 nt, Shigella flexneri 2a str. 2457T
ccgugaugcgcaagggucguc

SEQ ID NO: 3820975 - RNA, 12 nt, Shigella flexneri 2a str. 2457T
ccgugauucacg

SEQ ID NO: 3820976 - RNA, 23 nt, Shigella flexneri 2a str. 2457T
ccgugcagcgcaaucgccuccag

SEQ ID NO: 3820977 - RNA, 19 nt, Shigella flexneri 2a str. 2457T
ccgugcaucuccugaaaca

SEQ ID NO: 3820978 - RNA, 18 nt, Shigella flexneri 2a str. 2457T
ccgugccgcuaauggugc

SEQ ID NO: 3820979 - RNA, 16 nt, Shigella flexneri 2a str. 2457T
ccgugccggacggucg

SEQ ID NO: 3820980 - RNA, 17 nt, Shigella flexneri 2a str. 2457T
ccgugcugacucagcgg

SEQ ID NO: 3820981 - RNA, 18 nt, Shigella flexneri 2a str. 2457T
ccgugcugacucagcggc

SEQ ID NO: 3820982 - RNA, 21 nt, Shigella flexneri 2a str. 2457T
ccgugcugacucagcggcugc

SEQ ID NO: 3820983 - RNA, 22 nt, Shigella flexneri 2a str. 2457T
ccguggucggcaaaauacauga

SEQ ID NO: 3820984 - RNA, 16 nt, Shigella flexneri 2a str. 2457T
ccgugguucauaugau

SEQ ID NO: 3820985 - RNA, 15 nt, Shigella flexneri 2a str. 2457T
ccguuaacccuugcg

SEQ ID NO: 3820986 - RNA, 15 nt, Shigella flexneri 2a str. 2457T
ccguuaagaugguua

SEQ ID NO: 3820987 - RNA, 13 nt, Shigella flexneri 2a str. 2457T
ccguuaagcugga

SEQ ID NO: 3820988 - RNA, 15 nt, Shigella flexneri 2a str. 2457T
ccguuaauuuccgcg

SEQ ID NO: 3820989 - RNA, 19 nt, Shigella flexneri 2a str. 2457T
ccguuauccugaucaagca

SEQ ID NO: 3820990 - RNA, 19 nt, Shigella flexneri 2a str. 2457T
ccguuauuaaaaagccugc

SEQ ID NO: 3820991 - RNA, 18 nt, Shigella flexneri 2a str. 2457T
ccguuauuacgcccgcca

SEQ ID NO: 3820992 - RNA, 23 nt, Shigella flexneri 2a str. 2457T
ccguucgccaggucagagagcca

SEQ ID NO: 3820993 - RNA, 22 nt, Shigella flexneri 2a str. 2457T
ccguucgcuaccuuucagugcg

SEQ ID NO: 3820994 - RNA, 15 nt, Shigella flexneri 2a str. 2457T
ccguugaccagcauc

SEQ ID NO: 3820995 - RNA, 19 nt, Shigella flexneri 2a str. 2457T
ccguugcaauacuuccgcu

SEQ ID NO: 3820996 - RNA, 16 nt, Shigella flexneri 2a str. 2457T
ccguugcgcgucaacu

SEQ ID NO: 3820997 - RNA, 16 nt, Shigella flexneri 2a str. 2457T
ccguugcuguuccauc

SEQ ID NO: 3820998 - RNA, 21 nt, Shigella flexneri 2a str. 2457T
ccguugcuugaugcacuggga

SEQ ID NO: 3820999 - RNA, 20 nt, Shigella flexneri 2a str. 2457T
ccguuggcguaaaucaaacc

SEQ ID NO: 3821000 - RNA, 19 nt, Shigella flexneri 2a str. 2457T
ccguugugcgauccacgcc

SEQ ID NO: 3821001 - RNA, 13 nt, Shigella flexneri 2a str. 2457T
ccguuuaauauua

SEQ ID NO: 3821002 - RNA, 19 nt, Shigella flexneri 2a str. 2457T
ccguuuacgucauuaccgc

SEQ ID NO: 3821003 - RNA, 12 nt, Shigella flexneri 2a str. 2457T
ccguuucuccac

SEQ ID NO: 3821004 - RNA, 21 nt, Shigella flexneri 2a str. 2457T
ccguuucucuguucagccuga

SEQ ID NO: 3821005 - RNA, 23 nt, Shigella flexneri 2a str. 2457T
ccguuuggugguuuggcggcggc

SEQ ID NO: 3821006 - RNA, 17 nt, Shigella flexneri 2a str. 2457T
ccguuuuacugggaaga

SEQ ID NO: 3821007 - RNA, 14 nt, Shigella flexneri 2a str. 2457T
ccguuuucaccuua

SEQ ID NO: 3821008 - RNA, 12 nt, Shigella flexneri 2a str. 2457T
ccguuuuccagc

SEQ ID NO: 3821009 - RNA, 19 nt, Shigella flexneri 2a str. 2457T
ccuaaaaaguuauaaauaa

SEQ ID NO: 3821010 - RNA, 17 nt, Shigella flexneri 2a str. 2457T
ccuaaaagcacgccaga

SEQ ID NO: 3821011 - RNA, 18 nt, Shigella flexneri 2a str. 2457T
ccuaaacguuuaaaaacu

SEQ ID NO: 3821012 - RNA, 13 nt, Shigella flexneri 2a str. 2457T
ccuaaaggcaaaa

SEQ ID NO: 3821013 - RNA, 12 nt, Shigella flexneri 2a str. 2457T
ccuaaaucgcua

SEQ ID NO: 3821014 - RNA, 17 nt, Shigella flexneri 2a str. 2457T
ccuaacaaccaucccca

SEQ ID NO: 3821015 - RNA, 18 nt, Shigella flexneri 2a str. 2457T
ccuaacaaccauccccaa

SEQ ID NO: 3821016 - RNA, 15 nt, Shigella flexneri 2a str. 2457T
ccuaacaaggcuucg

SEQ ID NO: 3821017 - RNA, 15 nt, Shigella flexneri 2a str. 2457T
ccuaacacaugcaag

SEQ ID NO: 3821018 - RNA, 21 nt, Shigella flexneri 2a str. 2457T
ccuaacacaugcaagucgaac

SEQ ID NO: 3821019 - RNA, 16 nt, Shigella flexneri 2a str. 2457T
ccuaacauaaugcaac

SEQ ID NO: 3821020 - RNA, 16 nt, Shigella flexneri 2a str. 2457T
ccuaacaucauccccg

SEQ ID NO: 3821021 - RNA, 14 nt, Shigella flexneri 2a str. 2457T
ccuaacauuuuacu

SEQ ID NO: 3821022 - RNA, 23 nt, Shigella flexneri 2a str. 2457T
ccuaacccucuccccaagggggc

SEQ ID NO: 3821023 - RNA, 12 nt, Shigella flexneri 2a str. 2457T
ccuaagcuuucg

SEQ ID NO: 3821024 - RNA, 13 nt, Shigella flexneri 2a str. 2457T
ccuaaggaaucca

SEQ ID NO: 3821025 - RNA, 15 nt, Shigella flexneri 2a str. 2457T
ccuaaggaauccagc

SEQ ID NO: 3821026 - RNA, 11 nt, Shigella flexneri 2a str. 2457T
ccuaauaaacc

SEQ ID NO: 3821027 - RNA, 15 nt, Shigella flexneri 2a str. 2457T
ccuaauccagccuac

SEQ ID NO: 3821028 - RNA, 17 nt, Shigella flexneri 2a str. 2457T
ccuaaucgacgcggacg

SEQ ID NO: 3821029 - RNA, 13 nt, Shigella flexneri 2a str. 2457T
ccuaauuuuuuga

SEQ ID NO: 3821030 - RNA, 14 nt, Shigella flexneri 2a str. 2457T
ccuacaaaaucuug

SEQ ID NO: 3821031 - RNA, 12 nt, Shigella flexneri 2a str. 2457T
ccuacacgccag

SEQ ID NO: 3821032 - RNA, 18 nt, Shigella flexneri 2a str. 2457T
ccuacagguaagguaaug

SEQ ID NO: 3821033 - RNA, 15 nt, Shigella flexneri 2a str. 2457T
ccuacaucguuccug

SEQ ID NO: 3821034 - RNA, 20 nt, Shigella flexneri 2a str. 2457T
ccuacaugauuucugcaaua

SEQ ID NO: 3821035 - RNA, 15 nt, Shigella flexneri 2a str. 2457T
ccuaccggaaucgcg

SEQ ID NO: 3821036 - RNA, 18 nt, Shigella flexneri 2a str. 2457T
ccuaccggcuggcgcaua

SEQ ID NO: 3821037 - RNA, 14 nt, Shigella flexneri 2a str. 2457T
ccuaccugcaguuc

SEQ ID NO: 3821038 - RNA, 17 nt, Shigella flexneri 2a str. 2457T
ccuacgaggaguuuuuc

SEQ ID NO: 3821039 - RNA, 17 nt, Shigella flexneri 2a str. 2457T
ccuacgcgcccgcgcag

SEQ ID NO: 3821040 - RNA, 18 nt, Shigella flexneri 2a str. 2457T
ccuacucucgcaugggga

SEQ ID NO: 3821041 - RNA, 13 nt, Shigella flexneri 2a str. 2457T
ccuacugcuccua

SEQ ID NO: 3821042 - RNA, 15 nt, Shigella flexneri 2a str. 2457T
ccuagaaaucauuca

SEQ ID NO: 3821043 - RNA, 16 nt, Shigella flexneri 2a str. 2457T
ccuagcaaacuaucug

SEQ ID NO: 3821044 - RNA, 13 nt, Shigella flexneri 2a str. 2457T
ccuauaguucaau

SEQ ID NO: 3821045 - RNA, 14 nt, Shigella flexneri 2a str. 2457T
ccuaucaccagcgg

SEQ ID NO: 3821046 - RNA, 16 nt, Shigella flexneri 2a str. 2457T
ccuaucaccagcggug

SEQ ID NO: 3821047 - RNA, 15 nt, Shigella flexneri 2a str. 2457T
ccuaucuucauggag

SEQ ID NO: 3821048 - RNA, 18 nt, Shigella flexneri 2a str. 2457T
ccuaugcaacaacugaaa

SEQ ID NO: 3821049 - RNA, 16 nt, Shigella flexneri 2a str. 2457T
ccucaacauacaaaua

SEQ ID NO: 3821050 - RNA, 13 nt, Shigella flexneri 2a str. 2457T
ccucaacgccgca

SEQ ID NO: 3821051 - RNA, 19 nt, Shigella flexneri 2a str. 2457T
ccucaacgccuaaugccag

SEQ ID NO: 3821052 - RNA, 20 nt, Shigella flexneri 2a str. 2457T
ccucaauuagcggcucaugu

SEQ ID NO: 3821053 - RNA, 20 nt, Shigella flexneri 2a str. 2457T
ccucacagcuaaucaucauc

SEQ ID NO: 3821054 - RNA, 22 nt, Shigella flexneri 2a str. 2457T
ccucaccauuccguuucuccac

SEQ ID NO: 3821055 - RNA, 19 nt, Shigella flexneri 2a str. 2457T
ccucacgcauucucuuuuc

SEQ ID NO: 3821056 - RNA, 21 nt, Shigella flexneri 2a str. 2457T
ccucacuuucuggcagcugcg

SEQ ID NO: 3821057 - RNA, 19 nt, Shigella flexneri 2a str. 2457T
ccucagaguuaaccugaaa

SEQ ID NO: 3821058 - RNA, 16 nt, Shigella flexneri 2a str. 2457T
ccucagcagacugaua

SEQ ID NO: 3821059 - RNA, 16 nt, Shigella flexneri 2a str. 2457T
ccucagcgaacaggac

SEQ ID NO: 3821060 - RNA, 22 nt, Shigella flexneri 2a str. 2457T
ccucagcgaacaggaccuugac

SEQ ID NO: 3821061 - RNA, 14 nt, Shigella flexneri 2a str. 2457T
ccucaucaccacag

SEQ ID NO: 3821062 - RNA, 15 nt, Shigella flexneri 2a str. 2457T
ccucauucaccaguu

SEQ ID NO: 3821063 - RNA, 14 nt, Shigella flexneri 2a str. 2457T
ccuccaagccugau

SEQ ID NO: 3821064 - RNA, 16 nt, Shigella flexneri 2a str. 2457T
ccuccacgcccagcgc

SEQ ID NO: 3821065 - RNA, 21 nt, Shigella flexneri 2a str. 2457T
ccuccagcgagcuggcgcuga

SEQ ID NO: 3821066 - RNA, 22 nt, Shigella flexneri 2a str. 2457T
ccuccagcgagcuggcgcugau

SEQ ID NO: 3821067 - RNA, 20 nt, Shigella flexneri 2a str. 2457T
ccuccauaagaguagcccga

SEQ ID NO: 3821068 - RNA, 14 nt, Shigella flexneri 2a str. 2457T
ccuccauguccagc

SEQ ID NO: 3821069 - RNA, 13 nt, Shigella flexneri 2a str. 2457T
ccucccccugagc

SEQ ID NO: 3821070 - RNA, 23 nt, Shigella flexneri 2a str. 2457T
ccucccgcuguuuguucaagcgc

SEQ ID NO: 3821071 - RNA, 16 nt, Shigella flexneri 2a str. 2457T
ccucccguuucccugu

SEQ ID NO: 3821072 - RNA, 12 nt, Shigella flexneri 2a str. 2457T
ccuccgcaauau

SEQ ID NO: 3821073 - RNA, 11 nt, Shigella flexneri 2a str. 2457T
ccuccggcguu

SEQ ID NO: 3821074 - RNA, 15 nt, Shigella flexneri 2a str. 2457T
ccuccggcguuucag

SEQ ID NO: 3821075 - RNA, 12 nt, Shigella flexneri 2a str. 2457T
ccuccggcuggg

SEQ ID NO: 3821076 - RNA, 18 nt, Shigella flexneri 2a str. 2457T
ccuccgggaccuuucuga

SEQ ID NO: 3821077 - RNA, 23 nt, Shigella flexneri 2a str. 2457T
ccuccgggaccuuucugaugcau

SEQ ID NO: 3821078 - RNA, 16 nt, Shigella flexneri 2a str. 2457T
ccuccguuucacuucu

SEQ ID NO: 3821079 - RNA, 11 nt, Shigella flexneri 2a str. 2457T
ccuccugcagc

SEQ ID NO: 3821080 - RNA, 15 nt, Shigella flexneri 2a str. 2457T
ccuccugucuucccu

SEQ ID NO: 3821081 - RNA, 18 nt, Shigella flexneri 2a str. 2457T
ccuccugucuucccugcu

SEQ ID NO: 3821082 - RNA, 19 nt, Shigella flexneri 2a str. 2457T
ccuccuguucugugcgcca

SEQ ID NO: 3821083 - RNA, 17 nt, Shigella flexneri 2a str. 2457T
ccuccuuuuaucaucac

SEQ ID NO: 3821084 - RNA, 14 nt, Shigella flexneri 2a str. 2457T
ccucgcauuuuugu

SEQ ID NO: 3821085 - RNA, 18 nt, Shigella flexneri 2a str. 2457T
ccucgcccauuuuucaug

SEQ ID NO: 3821086 - RNA, 14 nt, Shigella flexneri 2a str. 2457T
ccucgccccuccgg

SEQ ID NO: 3821087 - RNA, 14 nt, Shigella flexneri 2a str. 2457T
ccucgcccgcagaa

SEQ ID NO: 3821088 - RNA, 15 nt, Shigella flexneri 2a str. 2457T
ccucgccgcuucccu

SEQ ID NO: 3821089 - RNA, 15 nt, Shigella flexneri 2a str. 2457T
ccucgccguuuucug

SEQ ID NO: 3821090 - RNA, 22 nt, Shigella flexneri 2a str. 2457T
ccucgcgcguccacggugcgac

SEQ ID NO: 3821091 - RNA, 14 nt, Shigella flexneri 2a str. 2457T
ccucgcuacgccag

SEQ ID NO: 3821092 - RNA, 23 nt, Shigella flexneri 2a str. 2457T
ccucggagaacggauucagugag

SEQ ID NO: 3821093 - RNA, 18 nt, Shigella flexneri 2a str. 2457T
ccucgggauccaugcacg

SEQ ID NO: 3821094 - RNA, 19 nt, Shigella flexneri 2a str. 2457T
ccucguaaugcuccggcuc

SEQ ID NO: 3821095 - RNA, 16 nt, Shigella flexneri 2a str. 2457T
ccucgucccaaaagcu

SEQ ID NO: 3821096 - RNA, 20 nt, Shigella flexneri 2a str. 2457T
ccucgucggcgguuuucauc

SEQ ID NO: 3821097 - RNA, 23 nt, Shigella flexneri 2a str. 2457T
ccucgugcucagagcuacaaaga

SEQ ID NO: 3821098 - RNA, 22 nt, Shigella flexneri 2a str. 2457T
ccucguuaccccuucauccaca

SEQ ID NO: 3821099 - RNA, 14 nt, Shigella flexneri 2a str. 2457T
ccucguucuucccu

SEQ ID NO: 3821100 - RNA, 18 nt, Shigella flexneri 2a str. 2457T
ccucguuuugccgccauc

SEQ ID NO: 3821101 - RNA, 14 nt, Shigella flexneri 2a str. 2457T
ccucuaacagauca

SEQ ID NO: 3821102 - RNA, 17 nt, Shigella flexneri 2a str. 2457T
ccucuaacucuucugaa

SEQ ID NO: 3821103 - RNA, 15 nt, Shigella flexneri 2a str. 2457T
ccucucagaaagggg

SEQ ID NO: 3821104 - RNA, 15 nt, Shigella flexneri 2a str. 2457T
ccucucaugagcaga

SEQ ID NO: 3821105 - RNA, 15 nt, Shigella flexneri 2a str. 2457T
ccucuccccagcgga

SEQ ID NO: 3821106 - RNA, 18 nt, Shigella flexneri 2a str. 2457T
ccucugcgacucucagcc

SEQ ID NO: 3821107 - RNA, 15 nt, Shigella flexneri 2a str. 2457T
ccucugcgcccagca

SEQ ID NO: 3821108 - RNA, 14 nt, Shigella flexneri 2a str. 2457T
ccucugcucccggc

SEQ ID NO: 3821109 - RNA, 15 nt, Shigella flexneri 2a str. 2457T
ccucuucaauuaaca

SEQ ID NO: 3821110 - RNA, 16 nt, Shigella flexneri 2a str. 2457T
ccucuucacguuuuuc

SEQ ID NO: 3821111 - RNA, 20 nt, Shigella flexneri 2a str. 2457T
ccucuucagccgcaaaccug

SEQ ID NO: 3821112 - RNA, 21 nt, Shigella flexneri 2a str. 2457T
ccucuucagcguccauccaca

SEQ ID NO: 3821113 - RNA, 19 nt, Shigella flexneri 2a str. 2457T
ccucuuccauuucaucgcc

SEQ ID NO: 3821114 - RNA, 20 nt, Shigella flexneri 2a str. 2457T
ccucuuccauuucaucgcca

SEQ ID NO: 3821115 - RNA, 21 nt, Shigella flexneri 2a str. 2457T
ccucuuccauuucaucgccag

SEQ ID NO: 3821116 - RNA, 15 nt, Shigella flexneri 2a str. 2457T
ccucuucccagaccc

SEQ ID NO: 3821117 - RNA, 17 nt, Shigella flexneri 2a str. 2457T
ccucuucccagacccag

SEQ ID NO: 3821118 - RNA, 16 nt, Shigella flexneri 2a str. 2457T
ccucuucggcagucac

SEQ ID NO: 3821119 - RNA, 16 nt, Shigella flexneri 2a str. 2457T
ccucuucuuuuagcuc

SEQ ID NO: 3821120 - RNA, 19 nt, Shigella flexneri 2a str. 2457T
ccucuugucaggccggaau

SEQ ID NO: 3821121 - RNA, 18 nt, Shigella flexneri 2a str. 2457T
ccucuuuacgcaaaauca

SEQ ID NO: 3821122 - RNA, 13 nt, Shigella flexneri 2a str. 2457T
ccucuuucuagac

SEQ ID NO: 3821123 - RNA, 21 nt, Shigella flexneri 2a str. 2457T
ccucuuuuuauuuacucuccu

SEQ ID NO: 3821124 - RNA, 13 nt, Shigella flexneri 2a str. 2457T
ccugaaaacgaaa

SEQ ID NO: 3821125 - RNA, 23 nt, Shigella flexneri 2a str. 2457T
ccugaaacgcggcguaaccgccc

SEQ ID NO: 3821126 - RNA, 18 nt, Shigella flexneri 2a str. 2457T
ccugaaagcgugucaugu

SEQ ID NO: 3821127 - RNA, 23 nt, Shigella flexneri 2a str. 2457T
ccugaaaguauuugacuguucua

SEQ ID NO: 3821128 - RNA, 13 nt, Shigella flexneri 2a str. 2457T
ccugaagaucaac

SEQ ID NO: 3821129 - RNA, 15 nt, Shigella flexneri 2a str. 2457T
ccugaagaugcugca

SEQ ID NO: 3821130 - RNA, 16 nt, Shigella flexneri 2a str. 2457T
ccugaagcguccgcuu

SEQ ID NO: 3821131 - RNA, 19 nt, Shigella flexneri 2a str. 2457T
ccugaagguguuugacugu

SEQ ID NO: 3821132 - RNA, 22 nt, Shigella flexneri 2a str. 2457T
ccugaauaacaccagccagaau

SEQ ID NO: 3821133 - RNA, 20 nt, Shigella flexneri 2a str. 2457T
ccugaauaaucguaaucagc

SEQ ID NO: 3821134 - RNA, 23 nt, Shigella flexneri 2a str. 2457T
ccugaauaaugucccccgggcgg

SEQ ID NO: 3821135 - RNA, 18 nt, Shigella flexneri 2a str. 2457T
ccugaaucaccugauuga

SEQ ID NO: 3821136 - RNA, 19 nt, Shigella flexneri 2a str. 2457T
ccugaauggugaccugcag

SEQ ID NO: 3821137 - RNA, 16 nt, Shigella flexneri 2a str. 2457T
ccugaauuugcuccag

SEQ ID NO: 3821138 - RNA, 20 nt, Shigella flexneri 2a str. 2457T
ccugaauuugcuccagaaac

SEQ ID NO: 3821139 - RNA, 13 nt, Shigella flexneri 2a str. 2457T
ccugacaaaucau

SEQ ID NO: 3821140 - RNA, 12 nt, Shigella flexneri 2a str. 2457T
ccugacaacaaa

SEQ ID NO: 3821141 - RNA, 20 nt, Shigella flexneri 2a str. 2457T
ccugacagcacgccccggcu

SEQ ID NO: 3821142 - RNA, 15 nt, Shigella flexneri 2a str. 2457T
ccugacagcagagca

SEQ ID NO: 3821143 - RNA, 22 nt, Shigella flexneri 2a str. 2457T
ccugacauugcguugauaugca

SEQ ID NO: 3821144 - RNA, 14 nt, Shigella flexneri 2a str. 2457T
ccugacccagcacc

SEQ ID NO: 3821145 - RNA, 15 nt, Shigella flexneri 2a str. 2457T
ccugaccuugcuuug

SEQ ID NO: 3821146 - RNA, 18 nt, Shigella flexneri 2a str. 2457T
ccugacgcccguuuucac

SEQ ID NO: 3821147 - RNA, 18 nt, Shigella flexneri 2a str. 2457T
ccugacggaaaucaucca

SEQ ID NO: 3821148 - RNA, 20 nt, Shigella flexneri 2a str. 2457T
ccugacucggacgcguuuca

SEQ ID NO: 3821149 - RNA, 12 nt, Shigella flexneri 2a str. 2457T
ccugacugguua

SEQ ID NO: 3821150 - RNA, 16 nt, Shigella flexneri 2a str. 2457T
ccugacuugccagaua

SEQ ID NO: 3821151 - RNA, 17 nt, Shigella flexneri 2a str. 2457T
ccugacuuugccccagc

SEQ ID NO: 3821152 - RNA, 14 nt, Shigella flexneri 2a str. 2457T
ccugagaagcgcaa

SEQ ID NO: 3821153 - RNA, 22 nt, Shigella flexneri 2a str. 2457T
ccugagaauuccgacagagaaa

SEQ ID NO: 3821154 - RNA, 17 nt, Shigella flexneri 2a str. 2457T
ccugagacagacagccu

SEQ ID NO: 3821155 - RNA, 16 nt, Shigella flexneri 2a str. 2457T
ccugagcagccaccac

SEQ ID NO: 3821156 - RNA, 22 nt, Shigella flexneri 2a str. 2457T
ccugagcgguuaacacggcagc

SEQ ID NO: 3821157 - RNA, 23 nt, Shigella flexneri 2a str. 2457T
ccugagcuggcagaccugcuuug

SEQ ID NO: 3821158 - RNA, 16 nt, Shigella flexneri 2a str. 2457T
ccugagucagaaacug

SEQ ID NO: 3821159 - RNA, 17 nt, Shigella flexneri 2a str. 2457T
ccugagucagaaacugu

SEQ ID NO: 3821160 - RNA, 14 nt, Shigella flexneri 2a str. 2457T
ccugagucaucaac

SEQ ID NO: 3821161 - RNA, 18 nt, Shigella flexneri 2a str. 2457T
ccugagugggcgucagca

SEQ ID NO: 3821162 - RNA, 22 nt, Shigella flexneri 2a str. 2457T
ccugaguuaagcaaaaaaacau

SEQ ID NO: 3821163 - RNA, 21 nt, Shigella flexneri 2a str. 2457T
ccugauaagacgcgacaagcg

SEQ ID NO: 3821164 - RNA, 20 nt, Shigella flexneri 2a str. 2457T
ccugauaagacgcgccagcg

SEQ ID NO: 3821165 - RNA, 14 nt, Shigella flexneri 2a str. 2457T
ccugauaagcgcag

SEQ ID NO: 3821166 - RNA, 21 nt, Shigella flexneri 2a str. 2457T
ccugauacgcgccaaucggca

SEQ ID NO: 3821167 - RNA, 17 nt, Shigella flexneri 2a str. 2457T
ccugauacucucgcucc

SEQ ID NO: 3821168 - RNA, 19 nt, Shigella flexneri 2a str. 2457T
ccugauagcccgcacaaag

SEQ ID NO: 3821169 - RNA, 12 nt, Shigella flexneri 2a str. 2457T
ccugaucaagca

SEQ ID NO: 3821170 - RNA, 15 nt, Shigella flexneri 2a str. 2457T
ccugaucaagcacau

SEQ ID NO: 3821171 - RNA, 16 nt, Shigella flexneri 2a str. 2457T
ccugaucaagcacaug

SEQ ID NO: 3821172 - RNA, 19 nt, Shigella flexneri 2a str. 2457T
ccugauccagcucuucuuc

SEQ ID NO: 3821173 - RNA, 22 nt, Shigella flexneri 2a str. 2457T
ccugauccagcucuucuucacu

SEQ ID NO: 3821174 - RNA, 15 nt, Shigella flexneri 2a str. 2457T
ccugaugagaugcug

SEQ ID NO: 3821175 - RNA, 19 nt, Shigella flexneri 2a str. 2457T
ccugaugcaucagucacga

SEQ ID NO: 3821176 - RNA, 18 nt, Shigella flexneri 2a str. 2457T
ccugaugcgauauguuua

SEQ ID NO: 3821177 - RNA, 17 nt, Shigella flexneri 2a str. 2457T
ccugaugcgcugcgcuu

SEQ ID NO: 3821178 - RNA, 17 nt, Shigella flexneri 2a str. 2457T
ccugaugcguugcgcuu

SEQ ID NO: 3821179 - RNA, 14 nt, Shigella flexneri 2a str. 2457T
ccugauggcgcgcc

SEQ ID NO: 3821180 - RNA, 15 nt, Shigella flexneri 2a str. 2457T
ccugauguacaacca

SEQ ID NO: 3821181 - RNA, 16 nt, Shigella flexneri 2a str. 2457T
ccugaugugacgcuug

SEQ ID NO: 3821182 - RNA, 14 nt, Shigella flexneri 2a str. 2457T
ccugauugaccgcc

SEQ ID NO: 3821183 - RNA, 18 nt, Shigella flexneri 2a str. 2457T
ccugauugaccgccagcg

SEQ ID NO: 3821184 - RNA, 16 nt, Shigella flexneri 2a str. 2457T
ccugcaaaauagucau

SEQ ID NO: 3821185 - RNA, 13 nt, Shigella flexneri 2a str. 2457T
ccugcaaacgcuu

SEQ ID NO: 3821186 - RNA, 14 nt, Shigella flexneri 2a str. 2457T
ccugcaaacgcuuu

SEQ ID NO: 3821187 - RNA, 14 nt, Shigella flexneri 2a str. 2457T
ccugcaaauaaaua

SEQ ID NO: 3821188 - RNA, 15 nt, Shigella flexneri 2a str. 2457T
ccugcaaauaaauac

SEQ ID NO: 3821189 - RNA, 16 nt, Shigella flexneri 2a str. 2457T
ccugcaacagcaccag

SEQ ID NO: 3821190 - RNA, 12 nt, Shigella flexneri 2a str. 2457T
ccugcaacgcuu

SEQ ID NO: 3821191 - RNA, 13 nt, Shigella flexneri 2a str. 2457T
ccugcaacgcuuu

SEQ ID NO: 3821192 - RNA, 17 nt, Shigella flexneri 2a str. 2457T
ccugcaagguggucaga

SEQ ID NO: 3821193 - RNA, 23 nt, Shigella flexneri 2a str. 2457T
ccugcacaaauagccagcagagc

SEQ ID NO: 3821194 - RNA, 10 nt, Shigella flexneri 2a str. 2457T
ccugcacaug

SEQ ID NO: 3821195 - RNA, 23 nt, Shigella flexneri 2a str. 2457T
ccugcacggagauauccagcgcc

SEQ ID NO: 3821196 - RNA, 16 nt, Shigella flexneri 2a str. 2457T
ccugcacugcaggccg

SEQ ID NO: 3821197 - RNA, 12 nt, Shigella flexneri 2a str. 2457T
ccugcagcugcu

SEQ ID NO: 3821198 - RNA, 16 nt, Shigella flexneri 2a str. 2457T
ccugcagcuggucgcc

SEQ ID NO: 3821199 - RNA, 16 nt, Shigella flexneri 2a str. 2457T
ccugcagggcuuucac

SEQ ID NO: 3821200 - RNA, 13 nt, Shigella flexneri 2a str. 2457T
ccugcagugaaau

SEQ ID NO: 3821201 - RNA, 18 nt, Shigella flexneri 2a str. 2457T
ccugcauaaacgccguca

SEQ ID NO: 3821202 - RNA, 20 nt, Shigella flexneri 2a str. 2457T
ccugcauacgacgugccgca

SEQ ID NO: 3821203 - RNA, 13 nt, Shigella flexneri 2a str. 2457T
ccugcauccgcca

SEQ ID NO: 3821204 - RNA, 22 nt, Shigella flexneri 2a str. 2457T
ccugcaugcgaaugcagggccg

SEQ ID NO: 3821205 - RNA, 19 nt, Shigella flexneri 2a str. 2457T
ccugccagaggagccauca

SEQ ID NO: 3821206 - RNA, 17 nt, Shigella flexneri 2a str. 2457T
ccugccagcgccgacag

SEQ ID NO: 3821207 - RNA, 12 nt, Shigella flexneri 2a str. 2457T
ccugccagcuug

SEQ ID NO: 3821208 - RNA, 14 nt, Shigella flexneri 2a str. 2457T
ccugccaucuggca

SEQ ID NO: 3821209 - RNA, 18 nt, Shigella flexneri 2a str. 2457T
ccugccaucuggcaggcu

SEQ ID NO: 3821210 - RNA, 13 nt, Shigella flexneri 2a str. 2457T
ccugcccacucca

SEQ ID NO: 3821211 - RNA, 15 nt, Shigella flexneri 2a str. 2457T
ccugcccacuccagc

SEQ ID NO: 3821212 - RNA, 19 nt, Shigella flexneri 2a str. 2457T
ccugccgcaggacgggcaa

SEQ ID NO: 3821213 - RNA, 13 nt, Shigella flexneri 2a str. 2457T
ccugccgccagca

SEQ ID NO: 3821214 - RNA, 22 nt, Shigella flexneri 2a str. 2457T
ccugccguuguugccuuauugc

SEQ ID NO: 3821215 - RNA, 12 nt, Shigella flexneri 2a str. 2457T
ccugccugcagc

SEQ ID NO: 3821216 - RNA, 17 nt, Shigella flexneri 2a str. 2457T
ccugccugcagcugcuc

SEQ ID NO: 3821217 - RNA, 19 nt, Shigella flexneri 2a str. 2457T
ccugccuucacuuccggca

SEQ ID NO: 3821218 - RNA, 22 nt, Shigella flexneri 2a str. 2457T
ccugcgacagggaucucuucca

SEQ ID NO: 3821219 - RNA, 17 nt, Shigella flexneri 2a str. 2457T
ccugcgauggugguugc

SEQ ID NO: 3821220 - RNA, 15 nt, Shigella flexneri 2a str. 2457T
ccugcgccagccagc

SEQ ID NO: 3821221 - RNA, 14 nt, Shigella flexneri 2a str. 2457T
ccugcgccagcggc

SEQ ID NO: 3821222 - RNA, 17 nt, Shigella flexneri 2a str. 2457T
ccugcgccugcaccauu

SEQ ID NO: 3821223 - RNA, 12 nt, Shigella flexneri 2a str. 2457T
ccugcgcgauga

SEQ ID NO: 3821224 - RNA, 18 nt, Shigella flexneri 2a str. 2457T
ccugcgcgcccgccgccu

SEQ ID NO: 3821225 - RNA, 17 nt, Shigella flexneri 2a str. 2457T
ccugcgcuuccugcaac

SEQ ID NO: 3821226 - RNA, 13 nt, Shigella flexneri 2a str. 2457T
ccugcggaaccgg

SEQ ID NO: 3821227 - RNA, 14 nt, Shigella flexneri 2a str. 2457T
ccugcggaaccggu

SEQ ID NO: 3821228 - RNA, 13 nt, Shigella flexneri 2a str. 2457T
ccugcggacaguc

SEQ ID NO: 3821229 - RNA, 15 nt, Shigella flexneri 2a str. 2457T
ccugcggcaacgcuc

SEQ ID NO: 3821230 - RNA, 19 nt, Shigella flexneri 2a str. 2457T
ccugcggcaccuaauaacu

SEQ ID NO: 3821231 - RNA, 14 nt, Shigella flexneri 2a str. 2457T
ccugcggccagcag

SEQ ID NO: 3821232 - RNA, 17 nt, Shigella flexneri 2a str. 2457T
ccugcggcggcaucgcc

SEQ ID NO: 3821233 - RNA, 19 nt, Shigella flexneri 2a str. 2457T
ccugcggcggcaucgccuu

SEQ ID NO: 3821234 - RNA, 18 nt, Shigella flexneri 2a str. 2457T
ccugcgggagcgcuuuuu

SEQ ID NO: 3821235 - RNA, 23 nt, Shigella flexneri 2a str. 2457T
ccugcgggagcgcuuuuuuccug

SEQ ID NO: 3821236 - RNA, 21 nt, Shigella flexneri 2a str. 2457T
ccugcgggaugguuggucugg

SEQ ID NO: 3821237 - RNA, 16 nt, Shigella flexneri 2a str. 2457T
ccugcggguucuuacc

SEQ ID NO: 3821238 - RNA, 23 nt, Shigella flexneri 2a str. 2457T
ccugcucaaacuucgucacagcg

SEQ ID NO: 3821239 - RNA, 23 nt, Shigella flexneri 2a str. 2457T
ccugcucaagcguuucaucuuca

SEQ ID NO: 3821240 - RNA, 23 nt, Shigella flexneri 2a str. 2457T
ccugcuccagcaacucaaucgcc

SEQ ID NO: 3821241 - RNA, 19 nt, Shigella flexneri 2a str. 2457T
ccugcucccgaaccuuuuc

SEQ ID NO: 3821242 - RNA, 18 nt, Shigella flexneri 2a str. 2457T
ccugcucgucauccgcca

SEQ ID NO: 3821243 - RNA, 15 nt, Shigella flexneri 2a str. 2457T
ccugcucgucggcaa

SEQ ID NO: 3821244 - RNA, 22 nt, Shigella flexneri 2a str. 2457T
ccugcucgucggcaaagcgggc

SEQ ID NO: 3821245 - RNA, 17 nt, Shigella flexneri 2a str. 2457T
ccugcucugccagacgg

SEQ ID NO: 3821246 - RNA, 14 nt, Shigella flexneri 2a str. 2457T
ccugcugaacguga

SEQ ID NO: 3821247 - RNA, 17 nt, Shigella flexneri 2a str. 2457T
ccugcugauuaucggca

SEQ ID NO: 3821248 - RNA, 22 nt, Shigella flexneri 2a str. 2457T
ccugcugcgccuguaacuguuc

SEQ ID NO: 3821249 - RNA, 23 nt, Shigella flexneri 2a str. 2457T
ccugcuggaaaggccgcgaaccg

SEQ ID NO: 3821250 - RNA, 17 nt, Shigella flexneri 2a str. 2457T
ccugcugguuagcggcc

SEQ ID NO: 3821251 - RNA, 14 nt, Shigella flexneri 2a str. 2457T
ccugcugugccgua

SEQ ID NO: 3821252 - RNA, 22 nt, Shigella flexneri 2a str. 2457T
ccugcuuauagcgcaucgcagc

SEQ ID NO: 3821253 - RNA, 21 nt, Shigella flexneri 2a str. 2457T
ccugcuuaucgcccugcucca

SEQ ID NO: 3821254 - RNA, 18 nt, Shigella flexneri 2a str. 2457T
ccugcuuuugccagcgug

SEQ ID NO: 3821255 - RNA, 15 nt, Shigella flexneri 2a str. 2457T
ccuggaaccaggcgc

SEQ ID NO: 3821256 - RNA, 21 nt, Shigella flexneri 2a str. 2457T
ccuggagaguguuuuaucugu

SEQ ID NO: 3821257 - RNA, 13 nt, Shigella flexneri 2a str. 2457T
ccuggcacagcag

SEQ ID NO: 3821258 - RNA, 16 nt, Shigella flexneri 2a str. 2457T
ccuggcauguggcggc

SEQ ID NO: 3821259 - RNA, 20 nt, Shigella flexneri 2a str. 2457T
ccuggcgaacccaaccguga

SEQ ID NO: 3821260 - RNA, 21 nt, Shigella flexneri 2a str. 2457T
ccuggcgagcauuaauacacc

SEQ ID NO: 3821261 - RNA, 17 nt, Shigella flexneri 2a str. 2457T
ccuggcgcagcugcgcu

SEQ ID NO: 3821262 - RNA, 18 nt, Shigella flexneri 2a str. 2457T
ccuggcgcagcugcgcuu

SEQ ID NO: 3821263 - RNA, 12 nt, Shigella flexneri 2a str. 2457T
ccuggcgcgaaa

SEQ ID NO: 3821264 - RNA, 16 nt, Shigella flexneri 2a str. 2457T
ccuggcgggaauaaaa

SEQ ID NO: 3821265 - RNA, 20 nt, Shigella flexneri 2a str. 2457T
ccuggcgggaauaaaagcca

SEQ ID NO: 3821266 - RNA, 23 nt, Shigella flexneri 2a str. 2457T
ccuggcgggaauaaaagccagga

SEQ ID NO: 3821267 - RNA, 15 nt, Shigella flexneri 2a str. 2457T
ccuggcggggauuau

SEQ ID NO: 3821268 - RNA, 18 nt, Shigella flexneri 2a str. 2457T
ccuggcgguuaauaauga

SEQ ID NO: 3821269 - RNA, 15 nt, Shigella flexneri 2a str. 2457T
ccuggcgucuggccc

SEQ ID NO: 3821270 - RNA, 16 nt, Shigella flexneri 2a str. 2457T
ccuggcgucuggccca

SEQ ID NO: 3821271 - RNA, 16 nt, Shigella flexneri 2a str. 2457T
ccuggcuaccauccgc

SEQ ID NO: 3821272 - RNA, 23 nt, Shigella flexneri 2a str. 2457T
ccuggcugauugauauccagauc

SEQ ID NO: 3821273 - RNA, 13 nt, Shigella flexneri 2a str. 2457T
ccugggcaauggu

SEQ ID NO: 3821274 - RNA, 17 nt, Shigella flexneri 2a str. 2457T
ccugggcgaugcuggca

SEQ ID NO: 3821275 - RNA, 15 nt, Shigella flexneri 2a str. 2457T
ccugguaccagcacc

SEQ ID NO: 3821276 - RNA, 20 nt, Shigella flexneri 2a str. 2457T
ccugguaucuuuacagcgcu

SEQ ID NO: 3821277 - RNA, 13 nt, Shigella flexneri 2a str. 2457T
ccuggucgcugau

SEQ ID NO: 3821278 - RNA, 19 nt, Shigella flexneri 2a str. 2457T
ccugguuauuucacuucaa

SEQ ID NO: 3821279 - RNA, 13 nt, Shigella flexneri 2a str. 2457T
ccugguucucacu

SEQ ID NO: 3821280 - RNA, 18 nt, Shigella flexneri 2a str. 2457T
ccugguuucuggucauug

SEQ ID NO: 3821281 - RNA, 22 nt, Shigella flexneri 2a str. 2457T
ccuguaaaacgcgcccucagcc

SEQ ID NO: 3821282 - RNA, 16 nt, Shigella flexneri 2a str. 2457T
ccuguaccacaaccug

SEQ ID NO: 3821283 - RNA, 14 nt, Shigella flexneri 2a str. 2457T
ccuguaccagcccg

SEQ ID NO: 3821284 - RNA, 21 nt, Shigella flexneri 2a str. 2457T
ccuguaccuucagcggcagcu

SEQ ID NO: 3821285 - RNA, 13 nt, Shigella flexneri 2a str. 2457T
ccuguacggcagu

SEQ ID NO: 3821286 - RNA, 16 nt, Shigella flexneri 2a str. 2457T
ccuguacggcagugaa

SEQ ID NO: 3821287 - RNA, 20 nt, Shigella flexneri 2a str. 2457T
ccuguacgucgagaauaucg

SEQ ID NO: 3821288 - RNA, 15 nt, Shigella flexneri 2a str. 2457T
ccuguacuguuucac

SEQ ID NO: 3821289 - RNA, 17 nt, Shigella flexneri 2a str. 2457T
ccuguaguguguugcaa

SEQ ID NO: 3821290 - RNA, 22 nt, Shigella flexneri 2a str. 2457T
ccuguaguguguugcaauacac

SEQ ID NO: 3821291 - RNA, 19 nt, Shigella flexneri 2a str. 2457T
ccuguauaaacuauccugu

SEQ ID NO: 3821292 - RNA, 21 nt, Shigella flexneri 2a str. 2457T
ccuguaucaggcuguguuuaa

SEQ ID NO: 3821293 - RNA, 13 nt, Shigella flexneri 2a str. 2457T
ccuguaucccagu

SEQ ID NO: 3821294 - RNA, 19 nt, Shigella flexneri 2a str. 2457T
ccuguaucccaguucgauu

SEQ ID NO: 3821295 - RNA, 21 nt, Shigella flexneri 2a str. 2457T
ccugucauacgcguaaaacag

SEQ ID NO: 3821296 - RNA, 14 nt, Shigella flexneri 2a str. 2457T
ccugucgaggccaa

SEQ ID NO: 3821297 - RNA, 23 nt, Shigella flexneri 2a str. 2457T
ccugucgggugcuuuuuucaauu

SEQ ID NO: 3821298 - RNA, 22 nt, Shigella flexneri 2a str. 2457T
ccugucucucagcacaccauaa

SEQ ID NO: 3821299 - RNA, 15 nt, Shigella flexneri 2a str. 2457T
ccugucuucccugcu

SEQ ID NO: 3821300 - RNA, 16 nt, Shigella flexneri 2a str. 2457T
ccugugcaaccuuuuc

SEQ ID NO: 3821301 - RNA, 19 nt, Shigella flexneri 2a str. 2457T
ccugugcaaccuuuuccau

SEQ ID NO: 3821302 - RNA, 12 nt, Shigella flexneri 2a str. 2457T
ccugugcagcga

SEQ ID NO: 3821303 - RNA, 22 nt, Shigella flexneri 2a str. 2457T
ccugugccagcucgugcagaac

SEQ ID NO: 3821304 - RNA, 13 nt, Shigella flexneri 2a str. 2457T
ccugugcgcccug

SEQ ID NO: 3821305 - RNA, 19 nt, Shigella flexneri 2a str. 2457T
ccuguggauaaagcaguuu

SEQ ID NO: 3821306 - RNA, 16 nt, Shigella flexneri 2a str. 2457T
ccugugucacuuugac

SEQ ID NO: 3821307 - RNA, 15 nt, Shigella flexneri 2a str. 2457T
ccuguguccuguuga

SEQ ID NO: 3821308 - RNA, 14 nt, Shigella flexneri 2a str. 2457T
ccuguuaaucagcu

SEQ ID NO: 3821309 - RNA, 23 nt, Shigella flexneri 2a str. 2457T
ccuguuaaucagcuaauggcugc

SEQ ID NO: 3821310 - RNA, 23 nt, Shigella flexneri 2a str. 2457T
ccuguucaucgacagaacggaua

SEQ ID NO: 3821311 - RNA, 17 nt, Shigella flexneri 2a str. 2457T
ccuguugaaaaaccaga

SEQ ID NO: 3821312 - RNA, 16 nt, Shigella flexneri 2a str. 2457T
ccuguugaaauuauug

SEQ ID NO: 3821313 - RNA, 21 nt, Shigella flexneri 2a str. 2457T
ccuguugauggggguccugag

SEQ ID NO: 3821314 - RNA, 15 nt, Shigella flexneri 2a str. 2457T
ccuguugcccuuugc

SEQ ID NO: 3821315 - RNA, 24 nt, Shigella flexneri 2a str. 2457T
ccuguugcgucgccgccuguucca

SEQ ID NO: 3821316 - RNA, 19 nt, Shigella flexneri 2a str. 2457T
ccuguugucuuuccagacu

SEQ ID NO: 3821317 - RNA, 21 nt, Shigella flexneri 2a str. 2457T
ccuguugucuuuccagacuca

SEQ ID NO: 3821318 - RNA, 23 nt, Shigella flexneri 2a str. 2457T
ccuguuucacuucgucagaaaug

SEQ ID NO: 3821319 - RNA, 18 nt, Shigella flexneri 2a str. 2457T
ccuguuucggacuucugu

SEQ ID NO: 3821320 - RNA, 17 nt, Shigella flexneri 2a str. 2457T
ccuuaaaagugaggugu

SEQ ID NO: 3821321 - RNA, 13 nt, Shigella flexneri 2a str. 2457T
ccuuaaacaccug

SEQ ID NO: 3821322 - RNA, 17 nt, Shigella flexneri 2a str. 2457T
ccuuaacuggcgcgacg

SEQ ID NO: 3821323 - RNA, 13 nt, Shigella flexneri 2a str. 2457T
ccuuaauaaccca

SEQ ID NO: 3821324 - RNA, 23 nt, Shigella flexneri 2a str. 2457T
ccuuacccgcgacgcgcuuuuac

SEQ ID NO: 3821325 - RNA, 20 nt, Shigella flexneri 2a str. 2457T
ccuuacccuuacucacuaaa

SEQ ID NO: 3821326 - RNA, 22 nt, Shigella flexneri 2a str. 2457T
ccuuacgcagcgguauaaucug

SEQ ID NO: 3821327 - RNA, 21 nt, Shigella flexneri 2a str. 2457T
ccuuacgcguucauacuuuuc

SEQ ID NO: 3821328 - RNA, 12 nt, Shigella flexneri 2a str. 2457T
ccuuacugcccc

SEQ ID NO: 3821329 - RNA, 23 nt, Shigella flexneri 2a str. 2457T
ccuuagcaaaauagcuguuuauu

SEQ ID NO: 3821330 - RNA, 17 nt, Shigella flexneri 2a str. 2457T
ccuuagcaacaggccag

SEQ ID NO: 3821331 - RNA, 21 nt, Shigella flexneri 2a str. 2457T
ccuuagcaacaggccaguucg

SEQ ID NO: 3821332 - RNA, 23 nt, Shigella flexneri 2a str. 2457T
ccuuaguaacgccagcggucaua

SEQ ID NO: 3821333 - RNA, 14 nt, Shigella flexneri 2a str. 2457T
ccuuauccagcaga

SEQ ID NO: 3821334 - RNA, 12 nt, Shigella flexneri 2a str. 2457T
ccuuauccagcc

SEQ ID NO: 3821335 - RNA, 19 nt, Shigella flexneri 2a str. 2457T
ccuuauccgacauuucugc

SEQ ID NO: 3821336 - RNA, 12 nt, Shigella flexneri 2a str. 2457T
ccuuauccggcc

SEQ ID NO: 3821337 - RNA, 16 nt, Shigella flexneri 2a str. 2457T
ccuuauccggcuuacc

SEQ ID NO: 3821338 - RNA, 14 nt, Shigella flexneri 2a str. 2457T
ccuuaucgaagagg

SEQ ID NO: 3821339 - RNA, 17 nt, Shigella flexneri 2a str. 2457T
ccuuauugucuuuaaau

SEQ ID NO: 3821340 - RNA, 19 nt, Shigella flexneri 2a str. 2457T
ccuucaaacguuuugcaau

SEQ ID NO: 3821341 - RNA, 19 nt, Shigella flexneri 2a str. 2457T
ccuucaacuugcuguuucg

SEQ ID NO: 3821342 - RNA, 15 nt, Shigella flexneri 2a str. 2457T
ccuucaagaauuaaa

SEQ ID NO: 3821343 - RNA, 14 nt, Shigella flexneri 2a str. 2457T
ccuucacacugccu

SEQ ID NO: 3821344 - RNA, 17 nt, Shigella flexneri 2a str. 2457T
ccuucacaggccgccag

SEQ ID NO: 3821345 - RNA, 13 nt, Shigella flexneri 2a str. 2457T
ccuucacccauug

SEQ ID NO: 3821346 - RNA, 19 nt, Shigella flexneri 2a str. 2457T
ccuucacccauugccgccu

SEQ ID NO: 3821347 - RNA, 17 nt, Shigella flexneri 2a str. 2457T
ccuucacgcgcuccagg

SEQ ID NO: 3821348 - RNA, 16 nt, Shigella flexneri 2a str. 2457T
ccuucacuuuugccag

SEQ ID NO: 3821349 - RNA, 21 nt, Shigella flexneri 2a str. 2457T
ccuucacuuuugccagacgaa

SEQ ID NO: 3821350 - RNA, 12 nt, Shigella flexneri 2a str. 2457T
ccuucagcggca

SEQ ID NO: 3821351 - RNA, 21 nt, Shigella flexneri 2a str. 2457T
ccuucagguuuuucagcugcc

SEQ ID NO: 3821352 - RNA, 23 nt, Shigella flexneri 2a str. 2457T
ccuucauauuccugacccagcac

SEQ ID NO: 3821353 - RNA, 22 nt, Shigella flexneri 2a str. 2457T
ccuucaucacgcagcgucagca

SEQ ID NO: 3821354 - RNA, 13 nt, Shigella flexneri 2a str. 2457T
ccuucauccagca

SEQ ID NO: 3821355 - RNA, 20 nt, Shigella flexneri 2a str. 2457T
ccuucaucccuuucgcuuca

SEQ ID NO: 3821356 - RNA, 16 nt, Shigella flexneri 2a str. 2457T
ccuucaucgcuccugc

SEQ ID NO: 3821357 - RNA, 20 nt, Shigella flexneri 2a str. 2457T
ccuucaucuucaacugccau

SEQ ID NO: 3821358 - RNA, 14 nt, Shigella flexneri 2a str. 2457T
ccuuccacaccacu

SEQ ID NO: 3821359 - RNA, 15 nt, Shigella flexneri 2a str. 2457T
ccuuccacaccacuu

SEQ ID NO: 3821360 - RNA, 18 nt, Shigella flexneri 2a str. 2457T
ccuuccagcgcguucugu

SEQ ID NO: 3821361 - RNA, 22 nt, Shigella flexneri 2a str. 2457T
ccuuccaucgcaucuucgccca

SEQ ID NO: 3821362 - RNA, 15 nt, Shigella flexneri 2a str. 2457T
ccuucccccaccacc

SEQ ID NO: 3821363 - RNA, 17 nt, Shigella flexneri 2a str. 2457T
ccuuccccguucugcca

SEQ ID NO: 3821364 - RNA, 12 nt, Shigella flexneri 2a str. 2457T
ccuucccuuuca

SEQ ID NO: 3821365 - RNA, 16 nt, Shigella flexneri 2a str. 2457T
ccuuccuuauuucuug

SEQ ID NO: 3821366 - RNA, 19 nt, Shigella flexneri 2a str. 2457T
ccuucgaaugccgcagcac

SEQ ID NO: 3821367 - RNA, 17 nt, Shigella flexneri 2a str. 2457T
ccuucgcccugcgucgc

SEQ ID NO: 3821368 - RNA, 21 nt, Shigella flexneri 2a str. 2457T
ccuucgcggaauuucagaaaa

SEQ ID NO: 3821369 - RNA, 14 nt, Shigella flexneri 2a str. 2457T
ccuucggauuuccg

SEQ ID NO: 3821370 - RNA, 17 nt, Shigella flexneri 2a str. 2457T
ccuucggcgucuccacc

SEQ ID NO: 3821371 - RNA, 20 nt, Shigella flexneri 2a str. 2457T
ccuucgggcuggcauuuuuu

SEQ ID NO: 3821372 - RNA, 20 nt, Shigella flexneri 2a str. 2457T
ccuucggggcuaaugccagu

SEQ ID NO: 3821373 - RNA, 20 nt, Shigella flexneri 2a str. 2457T
ccuucgguagcagcuuucag

SEQ ID NO: 3821374 - RNA, 14 nt, Shigella flexneri 2a str. 2457T
ccuucggucagagu

SEQ ID NO: 3821375 - RNA, 14 nt, Shigella flexneri 2a str. 2457T
ccuucgugcggcug

SEQ ID NO: 3821376 - RNA, 17 nt, Shigella flexneri 2a str. 2457T
ccuucguucacagaggg

SEQ ID NO: 3821377 - RNA, 20 nt, Shigella flexneri 2a str. 2457T
ccuucuaccuuaacgguauc

SEQ ID NO: 3821378 - RNA, 18 nt, Shigella flexneri 2a str. 2457T
ccuucugcgcccgcccgc

SEQ ID NO: 3821379 - RNA, 15 nt, Shigella flexneri 2a str. 2457T
ccuucuggcgacccg

SEQ ID NO: 3821380 - RNA, 13 nt, Shigella flexneri 2a str. 2457T
ccuucuucugccg

SEQ ID NO: 3821381 - RNA, 15 nt, Shigella flexneri 2a str. 2457T
ccuucuucugccgcc

SEQ ID NO: 3821382 - RNA, 13 nt, Shigella flexneri 2a str. 2457T
ccuucuucuuuca

SEQ ID NO: 3821383 - RNA, 20 nt, Shigella flexneri 2a str. 2457T
ccuucuuuacugcccgcuug

SEQ ID NO: 3821384 - RNA, 18 nt, Shigella flexneri 2a str. 2457T
ccuucuuugaacugaaua

SEQ ID NO: 3821385 - RNA, 17 nt, Shigella flexneri 2a str. 2457T
ccuucuuuuauuucuga

SEQ ID NO: 3821386 - RNA, 23 nt, Shigella flexneri 2a str. 2457T
ccuugaaaucguuugcauccagc

SEQ ID NO: 3821387 - RNA, 12 nt, Shigella flexneri 2a str. 2457T
ccuugccagaug

SEQ ID NO: 3821388 - RNA, 16 nt, Shigella flexneri 2a str. 2457T
ccuugccagauguugu

SEQ ID NO: 3821389 - RNA, 21 nt, Shigella flexneri 2a str. 2457T
ccuugcgauuacgcucggcaa

SEQ ID NO: 3821390 - RNA, 22 nt, Shigella flexneri 2a str. 2457T
ccuugcgauuacgcucggcaaa

SEQ ID NO: 3821391 - RNA, 20 nt, Shigella flexneri 2a str. 2457T
ccuugcggaaauuccagcgg

SEQ ID NO: 3821392 - RNA, 21 nt, Shigella flexneri 2a str. 2457T
ccuugcggaaauuccagcggc

SEQ ID NO: 3821393 - RNA, 23 nt, Shigella flexneri 2a str. 2457T
ccuugcggaaauuccagcggcag

SEQ ID NO: 3821394 - RNA, 16 nt, Shigella flexneri 2a str. 2457T
ccuugcggaagcguca

SEQ ID NO: 3821395 - RNA, 17 nt, Shigella flexneri 2a str. 2457T
ccuugcgggaucaggcg

SEQ ID NO: 3821396 - RNA, 21 nt, Shigella flexneri 2a str. 2457T
ccuugcguacaccaacaucac

SEQ ID NO: 3821397 - RNA, 14 nt, Shigella flexneri 2a str. 2457T
ccuugcguuucuga

SEQ ID NO: 3821398 - RNA, 15 nt, Shigella flexneri 2a str. 2457T
ccuugcucaaugagu

SEQ ID NO: 3821399 - RNA, 19 nt, Shigella flexneri 2a str. 2457T
ccuugcucauccauugcuu

SEQ ID NO: 3821400 - RNA, 20 nt, Shigella flexneri 2a str. 2457T
ccuugcuuugcaacugcugu

SEQ ID NO: 3821401 - RNA, 23 nt, Shigella flexneri 2a str. 2457T
ccuuggucgaagcuucucauccu

SEQ ID NO: 3821402 - RNA, 18 nt, Shigella flexneri 2a str. 2457T
ccuugucaugcagcucca

SEQ ID NO: 3821403 - RNA, 22 nt, Shigella flexneri 2a str. 2457T
ccuugucaugcagcuccaccga

SEQ ID NO: 3821404 - RNA, 20 nt, Shigella flexneri 2a str. 2457T
ccuugugcacuggcgcgaau

SEQ ID NO: 3821405 - RNA, 22 nt, Shigella flexneri 2a str. 2457T
ccuuguugcuauggggaaaaau

SEQ ID NO: 3821406 - RNA, 18 nt, Shigella flexneri 2a str. 2457T
ccuuguuguaaugacaac

SEQ ID NO: 3821407 - RNA, 11 nt, Shigella flexneri 2a str. 2457T
ccuuguuucuu

SEQ ID NO: 3821408 - RNA, 16 nt, Shigella flexneri 2a str. 2457T
ccuuuaaaucccgcuu

SEQ ID NO: 3821409 - RNA, 15 nt, Shigella flexneri 2a str. 2457T
ccuuuaccuucgccg

SEQ ID NO: 3821410 - RNA, 18 nt, Shigella flexneri 2a str. 2457T
ccuuuacgaagaaagcaa

SEQ ID NO: 3821411 - RNA, 16 nt, Shigella flexneri 2a str. 2457T
ccuuuacggcgcguca

SEQ ID NO: 3821412 - RNA, 19 nt, Shigella flexneri 2a str. 2457T
ccuuuacggcgcgucagau

SEQ ID NO: 3821413 - RNA, 14 nt, Shigella flexneri 2a str. 2457T
ccuuuagcgagcga

SEQ ID NO: 3821414 - RNA, 23 nt, Shigella flexneri 2a str. 2457T
ccuuuaucgaaguacuccugcuc

SEQ ID NO: 3821415 - RNA, 15 nt, Shigella flexneri 2a str. 2457T
ccuuuaugacgaucg

SEQ ID NO: 3821416 - RNA, 21 nt, Shigella flexneri 2a str. 2457T
ccuuucaauaccgccugcaaa

SEQ ID NO: 3821417 - RNA, 23 nt, Shigella flexneri 2a str. 2457T
ccuuucacgccgggaaauuuuuc

SEQ ID NO: 3821418 - RNA, 20 nt, Shigella flexneri 2a str. 2457T
ccuuucagaguuguaccagc

SEQ ID NO: 3821419 - RNA, 18 nt, Shigella flexneri 2a str. 2457T
ccuuuccagucuucuugc

SEQ ID NO: 3821420 - RNA, 17 nt, Shigella flexneri 2a str. 2457T
ccuuucccuauuuuuuc

SEQ ID NO: 3821421 - RNA, 12 nt, Shigella flexneri 2a str. 2457T
ccuuuccuccug

SEQ ID NO: 3821422 - RNA, 22 nt, Shigella flexneri 2a str. 2457T
ccuuuccuuaagccagcgcccg

SEQ ID NO: 3821423 - RNA, 16 nt, Shigella flexneri 2a str. 2457T
ccuuucggcugcagca

SEQ ID NO: 3821424 - RNA, 23 nt, Shigella flexneri 2a str. 2457T
ccuuucguugcgcaacacagauu

SEQ ID NO: 3821425 - RNA, 15 nt, Shigella flexneri 2a str. 2457T
ccuuucugagaggaa

SEQ ID NO: 3821426 - RNA, 13 nt, Shigella flexneri 2a str. 2457T
ccuuucugcaucc

SEQ ID NO: 3821427 - RNA, 21 nt, Shigella flexneri 2a str. 2457T
ccuuucugcauccguucuucg

SEQ ID NO: 3821428 - RNA, 21 nt, Shigella flexneri 2a str. 2457T
ccuuucuguuccauaaucgcc

SEQ ID NO: 3821429 - RNA, 18 nt, Shigella flexneri 2a str. 2457T
ccuuugaaaauaacaucg

SEQ ID NO: 3821430 - RNA, 21 nt, Shigella flexneri 2a str. 2457T
ccuuugaaaauaacaucgcca

SEQ ID NO: 3821431 - RNA, 22 nt, Shigella flexneri 2a str. 2457T
ccuuugaacaaccagaaagaug

SEQ ID NO: 3821432 - RNA, 13 nt, Shigella flexneri 2a str. 2457T
ccuuugccaaaau

SEQ ID NO: 3821433 - RNA, 14 nt, Shigella flexneri 2a str. 2457T
ccuuugccaaaaug

SEQ ID NO: 3821434 - RNA, 15 nt, Shigella flexneri 2a str. 2457T
ccuuugccuuccagc

SEQ ID NO: 3821435 - RNA, 17 nt, Shigella flexneri 2a str. 2457T
ccuuugccuuccagcga

SEQ ID NO: 3821436 - RNA, 18 nt, Shigella flexneri 2a str. 2457T
ccuuugccuuccagcgau

SEQ ID NO: 3821437 - RNA, 15 nt, Shigella flexneri 2a str. 2457T
ccuuugcuggcauga

SEQ ID NO: 3821438 - RNA, 18 nt, Shigella flexneri 2a str. 2457T
ccuuuggcgagccagauc

SEQ ID NO: 3821439 - RNA, 17 nt, Shigella flexneri 2a str. 2457T
ccuuuguaggccagaua

SEQ ID NO: 3821440 - RNA, 16 nt, Shigella flexneri 2a str. 2457T
ccuuuguaugccuggc

SEQ ID NO: 3821441 - RNA, 13 nt, Shigella flexneri 2a str. 2457T
ccuuuugccagua

SEQ ID NO: 3821442 - RNA, 13 nt, Shigella flexneri 2a str. 2457T
ccuuuuucccaaa

SEQ ID NO: 3821443 - RNA, 18 nt, Shigella flexneri 2a str. 2457T
ccuuuuucucugguccaa

SEQ ID NO: 3821444 - RNA, 17 nt, Shigella flexneri 2a str. 2457T
ccuuuuuuacagguguu

SEQ ID NO: 3821445 - RNA, 15 nt, Shigella flexneri 2a str. 2457T
ccuuuuuuauuuuuu

SEQ ID NO: 3821446 - RNA, 21 nt, Shigella flexneri 2a str. 2457T
ccuuuuuuugucuguuugcuc

SEQ ID NO: 3821447 - RNA, 17 nt, Shigella flexneri 2a str. 2457T
cgaaaaaaauuacucau

SEQ ID NO: 3821448 - RNA, 21 nt, Shigella flexneri 2a str. 2457T
cgaaaacgccaccgcgccggg

SEQ ID NO: 3821449 - RNA, 16 nt, Shigella flexneri 2a str. 2457T
cgaaaagcuucuuccu

SEQ ID NO: 3821450 - RNA, 23 nt, Shigella flexneri 2a str. 2457T
cgaaaaugcccgccgugcugcca

SEQ ID NO: 3821451 - RNA, 15 nt, Shigella flexneri 2a str. 2457T
cgaaaaugcgcauga

SEQ ID NO: 3821452 - RNA, 17 nt, Shigella flexneri 2a str. 2457T
cgaaacagggcuggaag

SEQ ID NO: 3821453 - RNA, 16 nt, Shigella flexneri 2a str. 2457T
cgaaaccgacugccau

SEQ ID NO: 3821454 - RNA, 19 nt, Shigella flexneri 2a str. 2457T
cgaaaccggauacccugcc

SEQ ID NO: 3821455 - RNA, 18 nt, Shigella flexneri 2a str. 2457T
cgaaaccguggcggaaau

SEQ ID NO: 3821456 - RNA, 19 nt, Shigella flexneri 2a str. 2457T
cgaaacgaaagucccgaua

SEQ ID NO: 3821457 - RNA, 14 nt, Shigella flexneri 2a str. 2457T
cgaaacgauuaauu

SEQ ID NO: 3821458 - RNA, 20 nt, Shigella flexneri 2a str. 2457T
cgaaacgcaccucagcaagu

SEQ ID NO: 3821459 - RNA, 16 nt, Shigella flexneri 2a str. 2457T
cgaaacgccugcaauu

SEQ ID NO: 3821460 - RNA, 16 nt, Shigella flexneri 2a str. 2457T
cgaaagagcuggcgaa

SEQ ID NO: 3821461 - RNA, 21 nt, Shigella flexneri 2a str. 2457T
cgaaagaggcgcagaugaagc

SEQ ID NO: 3821462 - RNA, 13 nt, Shigella flexneri 2a str. 2457T
cgaaagccccagc

SEQ ID NO: 3821463 - RNA, 16 nt, Shigella flexneri 2a str. 2457T
cgaaagcgccaucaau

SEQ ID NO: 3821464 - RNA, 19 nt, Shigella flexneri 2a str. 2457T
cgaaagcuggcacugggau

SEQ ID NO: 3821465 - RNA, 12 nt, Shigella flexneri 2a str. 2457T
cgaaaguaccau

SEQ ID NO: 3821466 - RNA, 21 nt, Shigella flexneri 2a str. 2457T
cgaaaguuaauccacagcaau

SEQ ID NO: 3821467 - RNA, 16 nt, Shigella flexneri 2a str. 2457T
cgaaauaacugcuauu

SEQ ID NO: 3821468 - RNA, 20 nt, Shigella flexneri 2a str. 2457T
cgaaaucaccgccaccagcg

SEQ ID NO: 3821469 - RNA, 19 nt, Shigella flexneri 2a str. 2457T
cgaaauccauguugcugga

SEQ ID NO: 3821470 - RNA, 16 nt, Shigella flexneri 2a str. 2457T
cgaaaucuacggugga

SEQ ID NO: 3821471 - RNA, 19 nt, Shigella flexneri 2a str. 2457T
cgaaaugacaguaucguga

SEQ ID NO: 3821472 - RNA, 17 nt, Shigella flexneri 2a str. 2457T
cgaaaugagauauuuca

SEQ ID NO: 3821473 - RNA, 20 nt, Shigella flexneri 2a str. 2457T
cgaaauggcugccaaugaua

SEQ ID NO: 3821474 - RNA, 23 nt, Shigella flexneri 2a str. 2457T
cgaaauggugugcaugguguuca

SEQ ID NO: 3821475 - RNA, 12 nt, Shigella flexneri 2a str. 2457T
cgaacaaaacca

SEQ ID NO: 3821476 - RNA, 14 nt, Shigella flexneri 2a str. 2457T
cgaacaacagauca

SEQ ID NO: 3821477 - RNA, 14 nt, Shigella flexneri 2a str. 2457T
cgaacaccagcagu

SEQ ID NO: 3821478 - RNA, 21 nt, Shigella flexneri 2a str. 2457T
cgaacaccagcaguaaaccac

SEQ ID NO: 3821479 - RNA, 18 nt, Shigella flexneri 2a str. 2457T
cgaacagacaaaaagaau

SEQ ID NO: 3821480 - RNA, 14 nt, Shigella flexneri 2a str. 2457T
cgaacaggauugcc

SEQ ID NO: 3821481 - RNA, 15 nt, Shigella flexneri 2a str. 2457T
cgaacaggccgacug

SEQ ID NO: 3821482 - RNA, 22 nt, Shigella flexneri 2a str. 2457T
cgaacaguucaacgccgcuauc

SEQ ID NO: 3821483 - RNA, 15 nt, Shigella flexneri 2a str. 2457T
cgaaccaaacagcgc

SEQ ID NO: 3821484 - RNA, 12 nt, Shigella flexneri 2a str. 2457T
cgaaccagcgga

SEQ ID NO: 3821485 - RNA, 22 nt, Shigella flexneri 2a str. 2457T
cgaaccaucaccucuucagcgu

SEQ ID NO: 3821486 - RNA, 14 nt, Shigella flexneri 2a str. 2457T
cgaacccagcaggu

SEQ ID NO: 3821487 - RNA, 17 nt, Shigella flexneri 2a str. 2457T
cgaaccgucccucgccc

SEQ ID NO: 3821488 - RNA, 21 nt, Shigella flexneri 2a str. 2457T
cgaacgcagugauaacucaaa

SEQ ID NO: 3821489 - RNA, 15 nt, Shigella flexneri 2a str. 2457T
cgaacgccucugcaa

SEQ ID NO: 3821490 - RNA, 18 nt, Shigella flexneri 2a str. 2457T
cgaacgccuucgccaucu

SEQ ID NO: 3821491 - RNA, 16 nt, Shigella flexneri 2a str. 2457T
cgaacgcuaugacgcc

SEQ ID NO: 3821492 - RNA, 10 nt, Shigella flexneri 2a str. 2457T
cgaacgcugc

SEQ ID NO: 3821493 - RNA, 16 nt, Shigella flexneri 2a str. 2457T
cgaacggcuguugaug

SEQ ID NO: 3821494 - RNA, 22 nt, Shigella flexneri 2a str. 2457T
cgaacgggauaaacgaaaugcg

SEQ ID NO: 3821495 - RNA, 20 nt, Shigella flexneri 2a str. 2457T
cgaacggggcugccagcucu

SEQ ID NO: 3821496 - RNA, 12 nt, Shigella flexneri 2a str. 2457T
cgaacggucagu

SEQ ID NO: 3821497 - RNA, 16 nt, Shigella flexneri 2a str. 2457T
cgaacguccagccagg

SEQ ID NO: 3821498 - RNA, 17 nt, Shigella flexneri 2a str. 2457T
cgaacguuuaauaaaac

SEQ ID NO: 3821499 - RNA, 16 nt, Shigella flexneri 2a str. 2457T
cgaacuaaacaacgcc

SEQ ID NO: 3821500 - RNA, 16 nt, Shigella flexneri 2a str. 2457T
cgaacuaaccgcgcuc

SEQ ID NO: 3821501 - RNA, 18 nt, Shigella flexneri 2a str. 2457T
cgaacucauacaccagcg

SEQ ID NO: 3821502 - RNA, 19 nt, Shigella flexneri 2a str. 2457T
cgaacucauacaccagcgg

SEQ ID NO: 3821503 - RNA, 21 nt, Shigella flexneri 2a str. 2457T
cgaacucauacaccagcggca

SEQ ID NO: 3821504 - RNA, 22 nt, Shigella flexneri 2a str. 2457T
cgaacucauacaccagcggcac

SEQ ID NO: 3821505 - RNA, 17 nt, Shigella flexneri 2a str. 2457T
cgaacuccgaucccugc

SEQ ID NO: 3821506 - RNA, 19 nt, Shigella flexneri 2a str. 2457T
cgaacuccgccccggcaau

SEQ ID NO: 3821507 - RNA, 15 nt, Shigella flexneri 2a str. 2457T
cgaacucuuccggca

SEQ ID NO: 3821508 - RNA, 21 nt, Shigella flexneri 2a str. 2457T
cgaacuggaugaaaaaauccc

SEQ ID NO: 3821509 - RNA, 16 nt, Shigella flexneri 2a str. 2457T
cgaacugguaaggaac

SEQ ID NO: 3821510 - RNA, 21 nt, Shigella flexneri 2a str. 2457T
cgaacugucgguuuguacucu

SEQ ID NO: 3821511 - RNA, 17 nt, Shigella flexneri 2a str. 2457T
cgaagaaagcgggugaa

SEQ ID NO: 3821512 - RNA, 13 nt, Shigella flexneri 2a str. 2457T
cgaagaacugcug

SEQ ID NO: 3821513 - RNA, 19 nt, Shigella flexneri 2a str. 2457T
cgaagaacugcuggaagcu

SEQ ID NO: 3821514 - RNA, 24 nt, Shigella flexneri 2a str. 2457T
cgaagaaguaagcugagugcucaa

SEQ ID NO: 3821515 - RNA, 22 nt, Shigella flexneri 2a str. 2457T
cgaagacaucgcagggaucauc

SEQ ID NO: 3821516 - RNA, 18 nt, Shigella flexneri 2a str. 2457T
cgaagagagcgccagaag

SEQ ID NO: 3821517 - RNA, 17 nt, Shigella flexneri 2a str. 2457T
cgaagagaucgauguuu

SEQ ID NO: 3821518 - RNA, 11 nt, Shigella flexneri 2a str. 2457T
cgaagaggggg

SEQ ID NO: 3821519 - RNA, 20 nt, Shigella flexneri 2a str. 2457T
cgaagauggcauacaacgcc

SEQ ID NO: 3821520 - RNA, 18 nt, Shigella flexneri 2a str. 2457T
cgaagauuucguuuucua

SEQ ID NO: 3821521 - RNA, 14 nt, Shigella flexneri 2a str. 2457T
cgaagcaagcggag

SEQ ID NO: 3821522 - RNA, 15 nt, Shigella flexneri 2a str. 2457T
cgaagccaauuugcg

SEQ ID NO: 3821523 - RNA, 14 nt, Shigella flexneri 2a str. 2457T
cgaagcccacgccg

SEQ ID NO: 3821524 - RNA, 16 nt, Shigella flexneri 2a str. 2457T
cgaagccggacugggc

SEQ ID NO: 3821525 - RNA, 19 nt, Shigella flexneri 2a str. 2457T
cgaagccugcgaugucuga

SEQ ID NO: 3821526 - RNA, 20 nt, Shigella flexneri 2a str. 2457T
cgaagccugcgaugucugau

SEQ ID NO: 3821527 - RNA, 15 nt, Shigella flexneri 2a str. 2457T
cgaagcgcaguuuaa

SEQ ID NO: 3821528 - RNA, 14 nt, Shigella flexneri 2a str. 2457T
cgaagcgcgcagcg

SEQ ID NO: 3821529 - RNA, 23 nt, Shigella flexneri 2a str. 2457T
cgaagcuggcggcggcgggcgca

SEQ ID NO: 3821530 - RNA, 13 nt, Shigella flexneri 2a str. 2457T
cgaaggacggccg

SEQ ID NO: 3821531 - RNA, 13 nt, Shigella flexneri 2a str. 2457T
cgaaggcggcgaa

SEQ ID NO: 3821532 - RNA, 14 nt, Shigella flexneri 2a str. 2457T
cgaaggcggcgaag

SEQ ID NO: 3821533 - RNA, 13 nt, Shigella flexneri 2a str. 2457T
cgaaggugcauug

SEQ ID NO: 3821534 - RNA, 20 nt, Shigella flexneri 2a str. 2457T
cgaaguauggaaaucaccca

SEQ ID NO: 3821535 - RNA, 21 nt, Shigella flexneri 2a str. 2457T
cgaaguauggaaaucacccag

SEQ ID NO: 3821536 - RNA, 18 nt, Shigella flexneri 2a str. 2457T
cgaagucguucagaucuu

SEQ ID NO: 3821537 - RNA, 20 nt, Shigella flexneri 2a str. 2457T
cgaaguggacgaacaguuca

SEQ ID NO: 3821538 - RNA, 19 nt, Shigella flexneri 2a str. 2457T
cgaaguuccgauaaucggu

SEQ ID NO: 3821539 - RNA, 12 nt, Shigella flexneri 2a str. 2457T
cgaaguuuuccu

SEQ ID NO: 3821540 - RNA, 16 nt, Shigella flexneri 2a str. 2457T
cgaauaaaaaaagaaa

SEQ ID NO: 3821541 - RNA, 15 nt, Shigella flexneri 2a str. 2457T
cgaauaagcugcgug

SEQ ID NO: 3821542 - RNA, 12 nt, Shigella flexneri 2a str. 2457T
cgaauacacccu

SEQ ID NO: 3821543 - RNA, 16 nt, Shigella flexneri 2a str. 2457T
cgaauaccuucuuccu

SEQ ID NO: 3821544 - RNA, 22 nt, Shigella flexneri 2a str. 2457T
cgaauacggauauguuuacuuc

SEQ ID NO: 3821545 - RNA, 23 nt, Shigella flexneri 2a str. 2457T
cgaauacguugcuucaugccgga

SEQ ID NO: 3821546 - RNA, 20 nt, Shigella flexneri 2a str. 2457T
cgaauauaaauauuuucuga

SEQ ID NO: 3821547 - RNA, 12 nt, Shigella flexneri 2a str. 2457T
cgaauauuuccc

SEQ ID NO: 3821548 - RNA, 18 nt, Shigella flexneri 2a str. 2457T
cgaaucaaccgcgccuga

SEQ ID NO: 3821549 - RNA, 18 nt, Shigella flexneri 2a str. 2457T
cgaaucagauucacggua

SEQ ID NO: 3821550 - RNA, 23 nt, Shigella flexneri 2a str. 2457T
cgaaucaugguuuauuucccaga

SEQ ID NO: 3821551 - RNA, 19 nt, Shigella flexneri 2a str. 2457T
cgaaucccgcugcaaucuu

SEQ ID NO: 3821552 - RNA, 17 nt, Shigella flexneri 2a str. 2457T
cgaaucgcuucauuuac

SEQ ID NO: 3821553 - RNA, 15 nt, Shigella flexneri 2a str. 2457T
cgaaucugcaaucaa

SEQ ID NO: 3821554 - RNA, 13 nt, Shigella flexneri 2a str. 2457T
cgaaugacaugcc

SEQ ID NO: 3821555 - RNA, 20 nt, Shigella flexneri 2a str. 2457T
cgaaugacccgagccacguc

SEQ ID NO: 3821556 - RNA, 21 nt, Shigella flexneri 2a str. 2457T
cgaaugacccgagccacguca

SEQ ID NO: 3821557 - RNA, 17 nt, Shigella flexneri 2a str. 2457T
cgaaugaccgccccugc

SEQ ID NO: 3821558 - RNA, 21 nt, Shigella flexneri 2a str. 2457T
cgaauggaaagcccgccccgc

SEQ ID NO: 3821559 - RNA, 15 nt, Shigella flexneri 2a str. 2457T
cgaauuagcauggcu

SEQ ID NO: 3821560 - RNA, 22 nt, Shigella flexneri 2a str. 2457T
cgaauuaugauagucuguuaac

SEQ ID NO: 3821561 - RNA, 10 nt, Shigella flexneri 2a str. 2457T
cgaauuccaa

SEQ ID NO: 3821562 - RNA, 14 nt, Shigella flexneri 2a str. 2457T
cgaauuugaacaag

SEQ ID NO: 3821563 - RNA, 23 nt, Shigella flexneri 2a str. 2457T
cgaauuuuccaugaccugccagg

SEQ ID NO: 3821564 - RNA, 16 nt, Shigella flexneri 2a str. 2457T
cgacaaaaauuacugc

SEQ ID NO: 3821565 - RNA, 18 nt, Shigella flexneri 2a str. 2457T
cgacaaaaauuacugccu

SEQ ID NO: 3821566 - RNA, 23 nt, Shigella flexneri 2a str. 2457T
cgacaaaacgauguccgcucuca

SEQ ID NO: 3821567 - RNA, 23 nt, Shigella flexneri 2a str. 2457T
cgacaaauaccaccgugccgccg

SEQ ID NO: 3821568 - RNA, 14 nt, Shigella flexneri 2a str. 2457T
cgacaaauguugca

SEQ ID NO: 3821569 - RNA, 13 nt, Shigella flexneri 2a str. 2457T
cgacaacagaaau

SEQ ID NO: 3821570 - RNA, 22 nt, Shigella flexneri 2a str. 2457T
cgacaacgcaacgccgccggaa

SEQ ID NO: 3821571 - RNA, 18 nt, Shigella flexneri 2a str. 2457T
cgacaacgcggcacagca

SEQ ID NO: 3821572 - RNA, 18 nt, Shigella flexneri 2a str. 2457T
cgacaacugacgaaucaa

SEQ ID NO: 3821573 - RNA, 16 nt, Shigella flexneri 2a str. 2457T
cgacaagauccugaua

SEQ ID NO: 3821574 - RNA, 17 nt, Shigella flexneri 2a str. 2457T
cgacaaggcaucagauc

SEQ ID NO: 3821575 - RNA, 15 nt, Shigella flexneri 2a str. 2457T
cgacaaucaaccagc

SEQ ID NO: 3821576 - RNA, 16 nt, Shigella flexneri 2a str. 2457T
cgacaaucaucgccuu

SEQ ID NO: 3821577 - RNA, 16 nt, Shigella flexneri 2a str. 2457T
cgacaaucgcaaauau

SEQ ID NO: 3821578 - RNA, 13 nt, Shigella flexneri 2a str. 2457T
cgacaaugccaca

SEQ ID NO: 3821579 - RNA, 16 nt, Shigella flexneri 2a str. 2457T
cgacaaugccacaaac

SEQ ID NO: 3821580 - RNA, 13 nt, Shigella flexneri 2a str. 2457T
cgacaauucgcgu

SEQ ID NO: 3821581 - RNA, 23 nt, Shigella flexneri 2a str. 2457T
cgacaauucgcguaguaaagccu

SEQ ID NO: 3821582 - RNA, 13 nt, Shigella flexneri 2a str. 2457T
cgacacaacgcuu

SEQ ID NO: 3821583 - RNA, 15 nt, Shigella flexneri 2a str. 2457T
cgacacaauccaugc

SEQ ID NO: 3821584 - RNA, 14 nt, Shigella flexneri 2a str. 2457T
cgacaccagccauc

SEQ ID NO: 3821585 - RNA, 16 nt, Shigella flexneri 2a str. 2457T
cgacaccguuaaauaa

SEQ ID NO: 3821586 - RNA, 17 nt, Shigella flexneri 2a str. 2457T
cgacacgccuccuggcu

SEQ ID NO: 3821587 - RNA, 19 nt, Shigella flexneri 2a str. 2457T
cgacacuggcagugugucu

SEQ ID NO: 3821588 - RNA, 21 nt, Shigella flexneri 2a str. 2457T
cgacagaacggauaucgagaa

SEQ ID NO: 3821589 - RNA, 16 nt, Shigella flexneri 2a str. 2457T
cgacagacgacgacgc

SEQ ID NO: 3821590 - RNA, 16 nt, Shigella flexneri 2a str. 2457T
cgacagagaaagcaaa

SEQ ID NO: 3821591 - RNA, 18 nt, Shigella flexneri 2a str. 2457T
cgacagauucaggcgcag

SEQ ID NO: 3821592 - RNA, 20 nt, Shigella flexneri 2a str. 2457T
cgacagauucaggcgcagca

SEQ ID NO: 3821593 - RNA, 14 nt, Shigella flexneri 2a str. 2457T
cgacagcagccccg

SEQ ID NO: 3821594 - RNA, 23 nt, Shigella flexneri 2a str. 2457T
cgacagccauaaagaaaucaccu

SEQ ID NO: 3821595 - RNA, 17 nt, Shigella flexneri 2a str. 2457T
cgacagcgauuccaguu

SEQ ID NO: 3821596 - RNA, 15 nt, Shigella flexneri 2a str. 2457T
cgacaggcaagcaua

SEQ ID NO: 3821597 - RNA, 20 nt, Shigella flexneri 2a str. 2457T
cgacaggcuuucuucgucgu

SEQ ID NO: 3821598 - RNA, 16 nt, Shigella flexneri 2a str. 2457T
cgacagggaucucuuc

SEQ ID NO: 3821599 - RNA, 20 nt, Shigella flexneri 2a str. 2457T
cgacaguaccagcaguacag

SEQ ID NO: 3821600 - RNA, 23 nt, Shigella flexneri 2a str. 2457T
cgacaguugcugcgugaccgcca

SEQ ID NO: 3821601 - RNA, 16 nt, Shigella flexneri 2a str. 2457T
cgacaguuucaccugc

SEQ ID NO: 3821602 - RNA, 17 nt, Shigella flexneri 2a str. 2457T
cgacaguuucaccugcu

SEQ ID NO: 3821603 - RNA, 20 nt, Shigella flexneri 2a str. 2457T
cgacaguuucaccugcugau

SEQ ID NO: 3821604 - RNA, 14 nt, Shigella flexneri 2a str. 2457T
cgacauagccaucc

SEQ ID NO: 3821605 - RNA, 21 nt, Shigella flexneri 2a str. 2457T
cgacauaucauuuugcugcca

SEQ ID NO: 3821606 - RNA, 13 nt, Shigella flexneri 2a str. 2457T
cgacaucaucagc

SEQ ID NO: 3821607 - RNA, 16 nt, Shigella flexneri 2a str. 2457T
cgacaucaucagcggu

SEQ ID NO: 3821608 - RNA, 19 nt, Shigella flexneri 2a str. 2457T
cgacauccaugcacugcaa

SEQ ID NO: 3821609 - RNA, 23 nt, Shigella flexneri 2a str. 2457T
cgacaucgccacggcaugaaagc

SEQ ID NO: 3821610 - RNA, 23 nt, Shigella flexneri 2a str. 2457T
cgacaucuuucugcgcaucuucc

SEQ ID NO: 3821611 - RNA, 21 nt, Shigella flexneri 2a str. 2457T
cgacaugacccggcguaugcc

SEQ ID NO: 3821612 - RNA, 16 nt, Shigella flexneri 2a str. 2457T
cgacaugcaucacgcg

SEQ ID NO: 3821613 - RNA, 12 nt, Shigella flexneri 2a str. 2457T
cgacauggcaac

SEQ ID NO: 3821614 - RNA, 19 nt, Shigella flexneri 2a str. 2457T
cgacauggcgaaaauuggu

SEQ ID NO: 3821615 - RNA, 15 nt, Shigella flexneri 2a str. 2457T
cgacauuucugcugc

SEQ ID NO: 3821616 - RNA, 13 nt, Shigella flexneri 2a str. 2457T
cgaccaaucgcgg

SEQ ID NO: 3821617 - RNA, 13 nt, Shigella flexneri 2a str. 2457T
cgaccaccaccgc

SEQ ID NO: 3821618 - RNA, 12 nt, Shigella flexneri 2a str. 2457T
cgaccaccagcg

SEQ ID NO: 3821619 - RNA, 13 nt, Shigella flexneri 2a str. 2457T
cgaccaccagcgu

SEQ ID NO: 3821620 - RNA, 17 nt, Shigella flexneri 2a str. 2457T
cgaccacccaccgcagc

SEQ ID NO: 3821621 - RNA, 15 nt, Shigella flexneri 2a str. 2457T
cgaccacucuuucga

SEQ ID NO: 3821622 - RNA, 13 nt, Shigella flexneri 2a str. 2457T
cgaccacuucaug

SEQ ID NO: 3821623 - RNA, 18 nt, Shigella flexneri 2a str. 2457T
cgaccacuucaugcccca

SEQ ID NO: 3821624 - RNA, 12 nt, Shigella flexneri 2a str. 2457T
cgaccagaaaug

SEQ ID NO: 3821625 - RNA, 18 nt, Shigella flexneri 2a str. 2457T
cgaccagaauaagucugg

SEQ ID NO: 3821626 - RNA, 21 nt, Shigella flexneri 2a str. 2457T
cgaccagauaagaacugacuu

SEQ ID NO: 3821627 - RNA, 15 nt, Shigella flexneri 2a str. 2457T
cgaccagcagcugcg

SEQ ID NO: 3821628 - RNA, 22 nt, Shigella flexneri 2a str. 2457T
cgaccagcggaauucccgcuuc

SEQ ID NO: 3821629 - RNA, 12 nt, Shigella flexneri 2a str. 2457T
cgaccaggcaaa

SEQ ID NO: 3821630 - RNA, 13 nt, Shigella flexneri 2a str. 2457T
cgaccaggcaaac

SEQ ID NO: 3821631 - RNA, 17 nt, Shigella flexneri 2a str. 2457T
cgaccaggcaaaccagu

SEQ ID NO: 3821632 - RNA, 17 nt, Shigella flexneri 2a str. 2457T
cgaccaggccaucagca

SEQ ID NO: 3821633 - RNA, 18 nt, Shigella flexneri 2a str. 2457T
cgaccaggccaucagcag

SEQ ID NO: 3821634 - RNA, 18 nt, Shigella flexneri 2a str. 2457T
cgaccaucagcugccagg

SEQ ID NO: 3821635 - RNA, 19 nt, Shigella flexneri 2a str. 2457T
cgaccaucggaucggccau

SEQ ID NO: 3821636 - RNA, 16 nt, Shigella flexneri 2a str. 2457T
cgacccgacagaugcu

SEQ ID NO: 3821637 - RNA, 15 nt, Shigella flexneri 2a str. 2457T
cgacccgcgacuggu

SEQ ID NO: 3821638 - RNA, 12 nt, Shigella flexneri 2a str. 2457T
cgaccgcagcau

SEQ ID NO: 3821639 - RNA, 19 nt, Shigella flexneri 2a str. 2457T
cgaccgccucgcgccagcg

SEQ ID NO: 3821640 - RNA, 21 nt, Shigella flexneri 2a str. 2457T
cgaccggccauuccagcaccc

SEQ ID NO: 3821641 - RNA, 19 nt, Shigella flexneri 2a str. 2457T
cgaccuaaacguuuaaaaa

SEQ ID NO: 3821642 - RNA, 22 nt, Shigella flexneri 2a str. 2457T
cgaccucaaaggccgacagcag

SEQ ID NO: 3821643 - RNA, 21 nt, Shigella flexneri 2a str. 2457T
cgaccuguaccuucagcggca

SEQ ID NO: 3821644 - RNA, 16 nt, Shigella flexneri 2a str. 2457T
cgaccuguucuccugg

SEQ ID NO: 3821645 - RNA, 22 nt, Shigella flexneri 2a str. 2457T
cgaccuucgcggucagcgccuc

SEQ ID NO: 3821646 - RNA, 14 nt, Shigella flexneri 2a str. 2457T
cgacgacaggcaag

SEQ ID NO: 3821647 - RNA, 13 nt, Shigella flexneri 2a str. 2457T
cgacgaccaccga

SEQ ID NO: 3821648 - RNA, 13 nt, Shigella flexneri 2a str. 2457T
cgacgacgcgcgc

SEQ ID NO: 3821649 - RNA, 12 nt, Shigella flexneri 2a str. 2457T
cgacgacuggcc

SEQ ID NO: 3821650 - RNA, 23 nt, Shigella flexneri 2a str. 2457T
cgacgagaaaugucggcccgcau

SEQ ID NO: 3821651 - RNA, 12 nt, Shigella flexneri 2a str. 2457T
cgacgauugcuu

SEQ ID NO: 3821652 - RNA, 15 nt, Shigella flexneri 2a str. 2457T
cgacgcauacgaucc

SEQ ID NO: 3821653 - RNA, 16 nt, Shigella flexneri 2a str. 2457T
cgacgcauacgauccu

SEQ ID NO: 3821654 - RNA, 22 nt, Shigella flexneri 2a str. 2457T
cgacgccguuuaaauacaccuu

SEQ ID NO: 3821655 - RNA, 15 nt, Shigella flexneri 2a str. 2457T
cgacgcgccagcacc

SEQ ID NO: 3821656 - RNA, 21 nt, Shigella flexneri 2a str. 2457T
cgacgcgcgcgggucaccgcg

SEQ ID NO: 3821657 - RNA, 17 nt, Shigella flexneri 2a str. 2457T
cgacgcugaugucagca

SEQ ID NO: 3821658 - RNA, 16 nt, Shigella flexneri 2a str. 2457T
cgacgcuggcgcgucu

SEQ ID NO: 3821659 - RNA, 18 nt, Shigella flexneri 2a str. 2457T
cgacgcuugccgcgucuu

SEQ ID NO: 3821660 - RNA, 16 nt, Shigella flexneri 2a str. 2457T
cgacggcaccacauuc

SEQ ID NO: 3821661 - RNA, 15 nt, Shigella flexneri 2a str. 2457T
cgacggcaucgccau

SEQ ID NO: 3821662 - RNA, 19 nt, Shigella flexneri 2a str. 2457T
cgacggcgaaucaaccgcg

SEQ ID NO: 3821663 - RNA, 22 nt, Shigella flexneri 2a str. 2457T
cgacggcgggugacuucccgca

SEQ ID NO: 3821664 - RNA, 14 nt, Shigella flexneri 2a str. 2457T
cgacggcuggcaaa

SEQ ID NO: 3821665 - RNA, 11 nt, Shigella flexneri 2a str. 2457T
cgacgggcgac

SEQ ID NO: 3821666 - RNA, 14 nt, Shigella flexneri 2a str. 2457T
cgacguaccagcgu

SEQ ID NO: 3821667 - RNA, 13 nt, Shigella flexneri 2a str. 2457T
cgacguagcccgg

SEQ ID NO: 3821668 - RNA, 18 nt, Shigella flexneri 2a str. 2457T
cgacguccaaucagcaca

SEQ ID NO: 3821669 - RNA, 16 nt, Shigella flexneri 2a str. 2457T
cgacgugcagcaucga

SEQ ID NO: 3821670 - RNA, 13 nt, Shigella flexneri 2a str. 2457T
cgacgugcgggcg

SEQ ID NO: 3821671 - RNA, 16 nt, Shigella flexneri 2a str. 2457T
cgacguuuuacagcaa

SEQ ID NO: 3821672 - RNA, 14 nt, Shigella flexneri 2a str. 2457T
cgacuauuaugaau

SEQ ID NO: 3821673 - RNA, 17 nt, Shigella flexneri 2a str. 2457T
cgacucaaaucacgcag

SEQ ID NO: 3821674 - RNA, 17 nt, Shigella flexneri 2a str. 2457T
cgacucaaccccagcca

SEQ ID NO: 3821675 - RNA, 21 nt, Shigella flexneri 2a str. 2457T
cgacugacgugccugugcagc

SEQ ID NO: 3821676 - RNA, 23 nt, Shigella flexneri 2a str. 2457T
cgacugauugaacuguggcgcga

SEQ ID NO: 3821677 - RNA, 20 nt, Shigella flexneri 2a str. 2457T
cgacugcaaaccaugacgca

SEQ ID NO: 3821678 - RNA, 23 nt, Shigella flexneri 2a str. 2457T
cgacugcaaaccaugacgcacuu

SEQ ID NO: 3821679 - RNA, 14 nt, Shigella flexneri 2a str. 2457T
cgacugccgcucac

SEQ ID NO: 3821680 - RNA, 15 nt, Shigella flexneri 2a str. 2457T
cgacugccgcucacc

SEQ ID NO: 3821681 - RNA, 16 nt, Shigella flexneri 2a str. 2457T
cgacugcgccaauacc

SEQ ID NO: 3821682 - RNA, 18 nt, Shigella flexneri 2a str. 2457T
cgacuuauucuucaacaa

SEQ ID NO: 3821683 - RNA, 23 nt, Shigella flexneri 2a str. 2457T
cgacuucagauaaaucacgcuuc

SEQ ID NO: 3821684 - RNA, 12 nt, Shigella flexneri 2a str. 2457T
cgacuuuaccgc

SEQ ID NO: 3821685 - RNA, 13 nt, Shigella flexneri 2a str. 2457T
cgacuuuaugcgu

SEQ ID NO: 3821686 - RNA, 14 nt, Shigella flexneri 2a str. 2457T
cgacuuugccuggc

SEQ ID NO: 3821687 - RNA, 20 nt, Shigella flexneri 2a str. 2457T
cgacuuugccuggcggcaga

SEQ ID NO: 3821688 - RNA, 23 nt, Shigella flexneri 2a str. 2457T
cgacuuuucauaagcgucagaaa

SEQ ID NO: 3821689 - RNA, 14 nt, Shigella flexneri 2a str. 2457T
cgagaaauuuuuau

SEQ ID NO: 3821690 - RNA, 19 nt, Shigella flexneri 2a str. 2457T
cgagaacucggaagcagcg

SEQ ID NO: 3821691 - RNA, 13 nt, Shigella flexneri 2a str. 2457T
cgagaagcaacug

SEQ ID NO: 3821692 - RNA, 21 nt, Shigella flexneri 2a str. 2457T
cgagaagcagcaacacaauca

SEQ ID NO: 3821693 - RNA, 18 nt, Shigella flexneri 2a str. 2457T
cgagaauacugaagucga

SEQ ID NO: 3821694 - RNA, 16 nt, Shigella flexneri 2a str. 2457T
cgagaauaucgauauc

SEQ ID NO: 3821695 - RNA, 15 nt, Shigella flexneri 2a str. 2457T
cgagaaucagcgaga

SEQ ID NO: 3821696 - RNA, 21 nt, Shigella flexneri 2a str. 2457T
cgagaaucagcgagacaacaa

SEQ ID NO: 3821697 - RNA, 23 nt, Shigella flexneri 2a str. 2457T
cgagacgguuaaaaacagccagc

SEQ ID NO: 3821698 - RNA, 24 nt, Shigella flexneri 2a str. 2457T
cgagacgguuaaaaacagccagca

SEQ ID NO: 3821699 - RNA, 15 nt, Shigella flexneri 2a str. 2457T
cgagagaagagacag

SEQ ID NO: 3821700 - RNA, 21 nt, Shigella flexneri 2a str. 2457T
cgagagaauggggucagcagg

SEQ ID NO: 3821701 - RNA, 23 nt, Shigella flexneri 2a str. 2457T
cgagagaauggggucagcaggug

SEQ ID NO: 3821702 - RNA, 20 nt, Shigella flexneri 2a str. 2457T
cgagagacgcuugucaccgu

SEQ ID NO: 3821703 - RNA, 15 nt, Shigella flexneri 2a str. 2457T
cgagagagaaaauaa

SEQ ID NO: 3821704 - RNA, 21 nt, Shigella flexneri 2a str. 2457T
cgagagcaaugcgcaucaaag

SEQ ID NO: 3821705 - RNA, 13 nt, Shigella flexneri 2a str. 2457T
cgagaguaacaca

SEQ ID NO: 3821706 - RNA, 14 nt, Shigella flexneri 2a str. 2457T
cgagaguaacacau

SEQ ID NO: 3821707 - RNA, 17 nt, Shigella flexneri 2a str. 2457T
cgagauacaucaccgcc

SEQ ID NO: 3821708 - RNA, 17 nt, Shigella flexneri 2a str. 2457T
cgagauaccuaacauuu

SEQ ID NO: 3821709 - RNA, 23 nt, Shigella flexneri 2a str. 2457T
cgagaucuuuaucaaucaccgcu

SEQ ID NO: 3821710 - RNA, 20 nt, Shigella flexneri 2a str. 2457T
cgagauuagacggcgcaaca

SEQ ID NO: 3821711 - RNA, 13 nt, Shigella flexneri 2a str. 2457T
cgagcacgccgcc

SEQ ID NO: 3821712 - RNA, 12 nt, Shigella flexneri 2a str. 2457T
cgagcagccacu

SEQ ID NO: 3821713 - RNA, 15 nt, Shigella flexneri 2a str. 2457T
cgagcaggagaagca

SEQ ID NO: 3821714 - RNA, 14 nt, Shigella flexneri 2a str. 2457T
cgagcauugccagc

SEQ ID NO: 3821715 - RNA, 15 nt, Shigella flexneri 2a str. 2457T
cgagccauaaacuga

SEQ ID NO: 3821716 - RNA, 18 nt, Shigella flexneri 2a str. 2457T
cgagcccagaugccggau

SEQ ID NO: 3821717 - RNA, 11 nt, Shigella flexneri 2a str. 2457T
cgagcccuucg

SEQ ID NO: 3821718 - RNA, 16 nt, Shigella flexneri 2a str. 2457T
cgagccgguugccuga

SEQ ID NO: 3821719 - RNA, 19 nt, Shigella flexneri 2a str. 2457T
cgagcgacagauucaggcg

SEQ ID NO: 3821720 - RNA, 19 nt, Shigella flexneri 2a str. 2457T
cgagcgccuuauccugccu

SEQ ID NO: 3821721 - RNA, 14 nt, Shigella flexneri 2a str. 2457T
cgagcguggaacuu

SEQ ID NO: 3821722 - RNA, 13 nt, Shigella flexneri 2a str. 2457T
cgagcuggaagcc

SEQ ID NO: 3821723 - RNA, 16 nt, Shigella flexneri 2a str. 2457T
cgagcuuuccggcggu

SEQ ID NO: 3821724 - RNA, 17 nt, Shigella flexneri 2a str. 2457T
cgagcuuucgaccagcc

SEQ ID NO: 3821725 - RNA, 18 nt, Shigella flexneri 2a str. 2457T
cgagcuuucgaccagcca

SEQ ID NO: 3821726 - RNA, 12 nt, Shigella flexneri 2a str. 2457T
cgaggacagcau

SEQ ID NO: 3821727 - RNA, 16 nt, Shigella flexneri 2a str. 2457T
cgaggacagcaucguc

SEQ ID NO: 3821728 - RNA, 14 nt, Shigella flexneri 2a str. 2457T
cgaggagcuggagg

SEQ ID NO: 3821729 - RNA, 20 nt, Shigella flexneri 2a str. 2457T
cgaggaucuuugccagaucg

SEQ ID NO: 3821730 - RNA, 16 nt, Shigella flexneri 2a str. 2457T
cgaggcaaccagcacg

SEQ ID NO: 3821731 - RNA, 17 nt, Shigella flexneri 2a str. 2457T
cgaggcaaccagcacgc

SEQ ID NO: 3821732 - RNA, 13 nt, Shigella flexneri 2a str. 2457T
cgaggcacagcag

SEQ ID NO: 3821733 - RNA, 14 nt, Shigella flexneri 2a str. 2457T
cgaggccaauuugg

SEQ ID NO: 3821734 - RNA, 20 nt, Shigella flexneri 2a str. 2457T
cgaggccaauuuggcugcca

SEQ ID NO: 3821735 - RNA, 16 nt, Shigella flexneri 2a str. 2457T
cgaggccuaacaccau

SEQ ID NO: 3821736 - RNA, 15 nt, Shigella flexneri 2a str. 2457T
cgaggcgaacaugcg

SEQ ID NO: 3821737 - RNA, 15 nt, Shigella flexneri 2a str. 2457T
cgaggcgcuggcgca

SEQ ID NO: 3821738 - RNA, 21 nt, Shigella flexneri 2a str. 2457T
cgaggcucugauugccuucca

SEQ ID NO: 3821739 - RNA, 18 nt, Shigella flexneri 2a str. 2457T
cgagggaaaauaaaaugu

SEQ ID NO: 3821740 - RNA, 16 nt, Shigella flexneri 2a str. 2457T
cgaggguaaacaacau

SEQ ID NO: 3821741 - RNA, 18 nt, Shigella flexneri 2a str. 2457T
cgaggugucuucgcgcac

SEQ ID NO: 3821742 - RNA, 22 nt, Shigella flexneri 2a str. 2457T
cgagguuaaugaucgcgccgcc

SEQ ID NO: 3821743 - RNA, 19 nt, Shigella flexneri 2a str. 2457T
cgaguaaacaggggcugua

SEQ ID NO: 3821744 - RNA, 13 nt, Shigella flexneri 2a str. 2457T
cgaguaaucaggc

SEQ ID NO: 3821745 - RNA, 14 nt, Shigella flexneri 2a str. 2457T
cgaguaaucaggcu

SEQ ID NO: 3821746 - RNA, 13 nt, Shigella flexneri 2a str. 2457T
cgaguagaucaac

SEQ ID NO: 3821747 - RNA, 14 nt, Shigella flexneri 2a str. 2457T
cgagucaacgcuuc

SEQ ID NO: 3821748 - RNA, 11 nt, Shigella flexneri 2a str. 2457T
cgaguccuguu

SEQ ID NO: 3821749 - RNA, 19 nt, Shigella flexneri 2a str. 2457T
cgaguccuguugucuuucc

SEQ ID NO: 3821750 - RNA, 20 nt, Shigella flexneri 2a str. 2457T
cgaguccuguugucuuucca

SEQ ID NO: 3821751 - RNA, 12 nt, Shigella flexneri 2a str. 2457T
cgaguccuucca

SEQ ID NO: 3821752 - RNA, 15 nt, Shigella flexneri 2a str. 2457T
cgagucgcugagcgu

SEQ ID NO: 3821753 - RNA, 19 nt, Shigella flexneri 2a str. 2457T
cgaguggcgauugccgcac

SEQ ID NO: 3821754 - RNA, 14 nt, Shigella flexneri 2a str. 2457T
cgaguucagaucag

SEQ ID NO: 3821755 - RNA, 15 nt, Shigella flexneri 2a str. 2457T
cgaguuuuucagucc

SEQ ID NO: 3821756 - RNA, 15 nt, Shigella flexneri 2a str. 2457T
cgauaaaaauaccga

SEQ ID NO: 3821757 - RNA, 14 nt, Shigella flexneri 2a str. 2457T
cgauaaaccagcaa

SEQ ID NO: 3821758 - RNA, 16 nt, Shigella flexneri 2a str. 2457T
cgauaaaccagcaacc

SEQ ID NO: 3821759 - RNA, 13 nt, Shigella flexneri 2a str. 2457T
cgauaaagcuggg

SEQ ID NO: 3821760 - RNA, 20 nt, Shigella flexneri 2a str. 2457T
cgauaaaggucgacagcagc

SEQ ID NO: 3821761 - RNA, 21 nt, Shigella flexneri 2a str. 2457T
cgauaaauacagcguuaaaaa

SEQ ID NO: 3821762 - RNA, 13 nt, Shigella flexneri 2a str. 2457T
cgauaaaucagau

SEQ ID NO: 3821763 - RNA, 18 nt, Shigella flexneri 2a str. 2457T
cgauaaccaucuucuuca

SEQ ID NO: 3821764 - RNA, 22 nt, Shigella flexneri 2a str. 2457T
cgauaaccgcaaaaccaacgcc

SEQ ID NO: 3821765 - RNA, 21 nt, Shigella flexneri 2a str. 2457T
cgauaacggaucggaacgcga

SEQ ID NO: 3821766 - RNA, 14 nt, Shigella flexneri 2a str. 2457T
cgauaacggucgua

SEQ ID NO: 3821767 - RNA, 12 nt, Shigella flexneri 2a str. 2457T
cgauaagcaccg

SEQ ID NO: 3821768 - RNA, 12 nt, Shigella flexneri 2a str. 2457T
cgauaagggagc

SEQ ID NO: 3821769 - RNA, 23 nt, Shigella flexneri 2a str. 2457T
cgauaagguaucgcgaaaaaaag

SEQ ID NO: 3821770 - RNA, 15 nt, Shigella flexneri 2a str. 2457T
cgauaaucagcgcca

SEQ ID NO: 3821771 - RNA, 18 nt, Shigella flexneri 2a str. 2457T
cgauaaucagcgccagcg

SEQ ID NO: 3821772 - RNA, 18 nt, Shigella flexneri 2a str. 2457T
cgauaaucucaauauccg

SEQ ID NO: 3821773 - RNA, 15 nt, Shigella flexneri 2a str. 2457T
cgauaauuuaugccu

SEQ ID NO: 3821774 - RNA, 16 nt, Shigella flexneri 2a str. 2457T
cgauacagaagcaccg

SEQ ID NO: 3821775 - RNA, 22 nt, Shigella flexneri 2a str. 2457T
cgauaccaauguagccgcggau

SEQ ID NO: 3821776 - RNA, 12 nt, Shigella flexneri 2a str. 2457T
cgauaccacccg

SEQ ID NO: 3821777 - RNA, 18 nt, Shigella flexneri 2a str. 2457T
cgauaccgcuguccacgc

SEQ ID NO: 3821778 - RNA, 20 nt, Shigella flexneri 2a str. 2457T
cgauacgcaguacggcagca

SEQ ID NO: 3821779 - RNA, 22 nt, Shigella flexneri 2a str. 2457T
cgauacgccucgggaaggucag

SEQ ID NO: 3821780 - RNA, 16 nt, Shigella flexneri 2a str. 2457T
cgauacgggcucgggc

SEQ ID NO: 3821781 - RNA, 15 nt, Shigella flexneri 2a str. 2457T
cgauacggucgagga

SEQ ID NO: 3821782 - RNA, 20 nt, Shigella flexneri 2a str. 2457T
cgauacuacguucaaucacc

SEQ ID NO: 3821783 - RNA, 17 nt, Shigella flexneri 2a str. 2457T
cgauagagagcagucag

SEQ ID NO: 3821784 - RNA, 21 nt, Shigella flexneri 2a str. 2457T
cgauaggggggauugccgcga

SEQ ID NO: 3821785 - RNA, 18 nt, Shigella flexneri 2a str. 2457T
cgauaguggaacaaagaa

SEQ ID NO: 3821786 - RNA, 23 nt, Shigella flexneri 2a str. 2457T
cgauauaaaccaucggcgcuggc

SEQ ID NO: 3821787 - RNA, 19 nt, Shigella flexneri 2a str. 2457T
cgauauccugaaacgcggc

SEQ ID NO: 3821788 - RNA, 15 nt, Shigella flexneri 2a str. 2457T
cgauaucgaugacgc

SEQ ID NO: 3821789 - RNA, 20 nt, Shigella flexneri 2a str. 2457T
cgauaucggaggccuguuca

SEQ ID NO: 3821790 - RNA, 16 nt, Shigella flexneri 2a str. 2457T
cgauaucuggaucaac

SEQ ID NO: 3821791 - RNA, 17 nt, Shigella flexneri 2a str. 2457T
cgauaugaccauuggua

SEQ ID NO: 3821792 - RNA, 16 nt, Shigella flexneri 2a str. 2457T
cgauauucuucaguau

SEQ ID NO: 3821793 - RNA, 18 nt, Shigella flexneri 2a str. 2457T
cgaucaaacgccagauca

SEQ ID NO: 3821794 - RNA, 19 nt, Shigella flexneri 2a str. 2457T
cgaucacccaagcuucggg

SEQ ID NO: 3821795 - RNA, 17 nt, Shigella flexneri 2a str. 2457T
cgaucacuuucugcgcc

SEQ ID NO: 3821796 - RNA, 18 nt, Shigella flexneri 2a str. 2457T
cgaucacuuucugcgcca

SEQ ID NO: 3821797 - RNA, 21 nt, Shigella flexneri 2a str. 2457T
cgaucacuuucugcgccagcg

SEQ ID NO: 3821798 - RNA, 19 nt, Shigella flexneri 2a str. 2457T
cgaucagcaauuucuccgc

SEQ ID NO: 3821799 - RNA, 12 nt, Shigella flexneri 2a str. 2457T
cgaucagcggac

SEQ ID NO: 3821800 - RNA, 21 nt, Shigella flexneri 2a str. 2457T
cgaucaggaacuguugcaaaa

SEQ ID NO: 3821801 - RNA, 15 nt, Shigella flexneri 2a str. 2457T
cgaucauauuguucc

SEQ ID NO: 3821802 - RNA, 22 nt, Shigella flexneri 2a str. 2457T
cgaucauuggccggaauaccac

SEQ ID NO: 3821803 - RNA, 20 nt, Shigella flexneri 2a str. 2457T
cgauccagcgcaauaccgau

SEQ ID NO: 3821804 - RNA, 15 nt, Shigella flexneri 2a str. 2457T
cgauccuguucaaac

SEQ ID NO: 3821805 - RNA, 13 nt, Shigella flexneri 2a str. 2457T
cgauccuucaaac

SEQ ID NO: 3821806 - RNA, 21 nt, Shigella flexneri 2a str. 2457T
cgaucgaugugauaaauacga

SEQ ID NO: 3821807 - RNA, 18 nt, Shigella flexneri 2a str. 2457T
cgaucgcaaauccauuca

SEQ ID NO: 3821808 - RNA, 14 nt, Shigella flexneri 2a str. 2457T
cgaucgccagcagg

SEQ ID NO: 3821809 - RNA, 17 nt, Shigella flexneri 2a str. 2457T
cgaucgcccgccaagca

SEQ ID NO: 3821810 - RNA, 13 nt, Shigella flexneri 2a str. 2457T
cgaucgcgccaau

SEQ ID NO: 3821811 - RNA, 20 nt, Shigella flexneri 2a str. 2457T
cgaucgcgccaaucagcgca

SEQ ID NO: 3821812 - RNA, 22 nt, Shigella flexneri 2a str. 2457T
cgaucgcuuucgcuuucucuuc

SEQ ID NO: 3821813 - RNA, 17 nt, Shigella flexneri 2a str. 2457T
cgaucgggcauuuccau

SEQ ID NO: 3821814 - RNA, 13 nt, Shigella flexneri 2a str. 2457T
cgaucgucugggc

SEQ ID NO: 3821815 - RNA, 23 nt, Shigella flexneri 2a str. 2457T
cgaucgugauacaacugccgcgc

SEQ ID NO: 3821816 - RNA, 13 nt, Shigella flexneri 2a str. 2457T
cgaucucaaucuu

SEQ ID NO: 3821817 - RNA, 18 nt, Shigella flexneri 2a str. 2457T
cgaucucuucgccugccu

SEQ ID NO: 3821818 - RNA, 19 nt, Shigella flexneri 2a str. 2457T
cgaucucuucgccugccug

SEQ ID NO: 3821819 - RNA, 19 nt, Shigella flexneri 2a str. 2457T
cgaucugacgugcgcaaac

SEQ ID NO: 3821820 - RNA, 20 nt, Shigella flexneri 2a str. 2457T
cgaucuggugcaauuucagc

SEQ ID NO: 3821821 - RNA, 17 nt, Shigella flexneri 2a str. 2457T
cgaucuuccacgccugc

SEQ ID NO: 3821822 - RNA, 18 nt, Shigella flexneri 2a str. 2457T
cgaucuuccacgccugca

SEQ ID NO: 3821823 - RNA, 12 nt, Shigella flexneri 2a str. 2457T
cgaucuuccggc

SEQ ID NO: 3821824 - RNA, 23 nt, Shigella flexneri 2a str. 2457T
cgaucuugcgaccgcucuuuuuu

SEQ ID NO: 3821825 - RNA, 19 nt, Shigella flexneri 2a str. 2457T
cgaugaaaaagaagcaaau

SEQ ID NO: 3821826 - RNA, 14 nt, Shigella flexneri 2a str. 2457T
cgaugaaucaccac

SEQ ID NO: 3821827 - RNA, 18 nt, Shigella flexneri 2a str. 2457T
cgaugacagucuggaagc

SEQ ID NO: 3821828 - RNA, 19 nt, Shigella flexneri 2a str. 2457T
cgaugaccuugucaugcag

SEQ ID NO: 3821829 - RNA, 16 nt, Shigella flexneri 2a str. 2457T
cgaugagacccgccac

SEQ ID NO: 3821830 - RNA, 14 nt, Shigella flexneri 2a str. 2457T
cgaugagaugacgc

SEQ ID NO: 3821831 - RNA, 16 nt, Shigella flexneri 2a str. 2457T
cgaugaguuaagaaga

SEQ ID NO: 3821832 - RNA, 15 nt, Shigella flexneri 2a str. 2457T
cgaugaucaacagca

SEQ ID NO: 3821833 - RNA, 13 nt, Shigella flexneri 2a str. 2457T
cgaugaucgccau

SEQ ID NO: 3821834 - RNA, 17 nt, Shigella flexneri 2a str. 2457T
cgaugcaaccgagcgcc

SEQ ID NO: 3821835 - RNA, 16 nt, Shigella flexneri 2a str. 2457T
cgaugcaagaggguua

SEQ ID NO: 3821836 - RNA, 12 nt, Shigella flexneri 2a str. 2457T
cgaugcacagca

SEQ ID NO: 3821837 - RNA, 16 nt, Shigella flexneri 2a str. 2457T
cgaugccaucauggcg

SEQ ID NO: 3821838 - RNA, 13 nt, Shigella flexneri 2a str. 2457T
cgaugccuggcaa

SEQ ID NO: 3821839 - RNA, 23 nt, Shigella flexneri 2a str. 2457T
cgaugcgaucauuaacaccacgc

SEQ ID NO: 3821840 - RNA, 20 nt, Shigella flexneri 2a str. 2457T
cgaugcgucuugccaucaua

SEQ ID NO: 3821841 - RNA, 13 nt, Shigella flexneri 2a str. 2457T
cgaugcuaaaaac

SEQ ID NO: 3821842 - RNA, 15 nt, Shigella flexneri 2a str. 2457T
cgaugcugacgcauc

SEQ ID NO: 3821843 - RNA, 22 nt, Shigella flexneri 2a str. 2457T
cgaugcugauguacccgcugca

SEQ ID NO: 3821844 - RNA, 13 nt, Shigella flexneri 2a str. 2457T
cgaugcuggcaga

SEQ ID NO: 3821845 - RNA, 21 nt, Shigella flexneri 2a str. 2457T
cgaugcuuuccaacuguacca

SEQ ID NO: 3821846 - RNA, 19 nt, Shigella flexneri 2a str. 2457T
cgaugcuuugaccucccgc

SEQ ID NO: 3821847 - RNA, 19 nt, Shigella flexneri 2a str. 2457T
cgauggcaaacaaacugcg

SEQ ID NO: 3821848 - RNA, 14 nt, Shigella flexneri 2a str. 2457T
cgauggcccgcuug

SEQ ID NO: 3821849 - RNA, 19 nt, Shigella flexneri 2a str. 2457T
cgauggcccgcuugccaga

SEQ ID NO: 3821850 - RNA, 21 nt, Shigella flexneri 2a str. 2457T
cgauggcgcagaauuugucga

SEQ ID NO: 3821851 - RNA, 20 nt, Shigella flexneri 2a str. 2457T
cgaugguagcagcgaagaga

SEQ ID NO: 3821852 - RNA, 18 nt, Shigella flexneri 2a str. 2457T
cgauggucagcuucaccu

SEQ ID NO: 3821853 - RNA, 18 nt, Shigella flexneri 2a str. 2457T
cgauggucuggcgacggc

SEQ ID NO: 3821854 - RNA, 12 nt, Shigella flexneri 2a str. 2457T
cgauggucuguu

SEQ ID NO: 3821855 - RNA, 20 nt, Shigella flexneri 2a str. 2457T
cgauggugaagucauugaag

SEQ ID NO: 3821856 - RNA, 19 nt, Shigella flexneri 2a str. 2457T
cgaugguugcccugcuggu

SEQ ID NO: 3821857 - RNA, 16 nt, Shigella flexneri 2a str. 2457T
cgaugucaaucagggc

SEQ ID NO: 3821858 - RNA, 23 nt, Shigella flexneri 2a str. 2457T
cgauguccagacgcgcagcuuca

SEQ ID NO: 3821859 - RNA, 19 nt, Shigella flexneri 2a str. 2457T
cgaugugaacccugauuuc

SEQ ID NO: 3821860 - RNA, 19 nt, Shigella flexneri 2a str. 2457T
cgauguuguacaugcugcu

SEQ ID NO: 3821861 - RNA, 17 nt, Shigella flexneri 2a str. 2457T
cgauuaaaaacccugca

SEQ ID NO: 3821862 - RNA, 19 nt, Shigella flexneri 2a str. 2457T
cgauuaaaaacccugcaga

SEQ ID NO: 3821863 - RNA, 21 nt, Shigella flexneri 2a str. 2457T
cgauuaauaaaauuauccagc

SEQ ID NO: 3821864 - RNA, 18 nt, Shigella flexneri 2a str. 2457T
cgauuauagcuaacucua

SEQ ID NO: 3821865 - RNA, 14 nt, Shigella flexneri 2a str. 2457T
cgauuaucgguuau

SEQ ID NO: 3821866 - RNA, 17 nt, Shigella flexneri 2a str. 2457T
cgauucacauaacggcc

SEQ ID NO: 3821867 - RNA, 17 nt, Shigella flexneri 2a str. 2457T
cgauucacauuuaaaca

SEQ ID NO: 3821868 - RNA, 20 nt, Shigella flexneri 2a str. 2457T
cgauucccagucauccggcu

SEQ ID NO: 3821869 - RNA, 18 nt, Shigella flexneri 2a str. 2457T
cgauucucgccgcccuga

SEQ ID NO: 3821870 - RNA, 21 nt, Shigella flexneri 2a str. 2457T
cgauugaucucguugaucacc

SEQ ID NO: 3821871 - RNA, 23 nt, Shigella flexneri 2a str. 2457T
cgauugauuuaucagguauugau

SEQ ID NO: 3821872 - RNA, 12 nt, Shigella flexneri 2a str. 2457T
cgauugccggau

SEQ ID NO: 3821873 - RNA, 15 nt, Shigella flexneri 2a str. 2457T
cgauugcucaacgcc

SEQ ID NO: 3821874 - RNA, 17 nt, Shigella flexneri 2a str. 2457T
cgauugucagcuggugg

SEQ ID NO: 3821875 - RNA, 23 nt, Shigella flexneri 2a str. 2457T
cgauugugauucgauucacauuu

SEQ ID NO: 3821876 - RNA, 14 nt, Shigella flexneri 2a str. 2457T
cgauuuaucgauuu

SEQ ID NO: 3821877 - RNA, 19 nt, Shigella flexneri 2a str. 2457T
cgauuuaugauauuuuuuu

SEQ ID NO: 3821878 - RNA, 18 nt, Shigella flexneri 2a str. 2457T
cgauuucaaccacucacg

SEQ ID NO: 3821879 - RNA, 21 nt, Shigella flexneri 2a str. 2457T
cgauuucaaccacucacgaua

SEQ ID NO: 3821880 - RNA, 18 nt, Shigella flexneri 2a str. 2457T
cgauuuccaucuccagcu

SEQ ID NO: 3821881 - RNA, 14 nt, Shigella flexneri 2a str. 2457T
cgauuucgccaccc

SEQ ID NO: 3821882 - RNA, 19 nt, Shigella flexneri 2a str. 2457T
cgauuucuacacccagccc

SEQ ID NO: 3821883 - RNA, 15 nt, Shigella flexneri 2a str. 2457T
cgauuucuuuauccg

SEQ ID NO: 3821884 - RNA, 21 nt, Shigella flexneri 2a str. 2457T
cgauuugccgucucuuucaug

SEQ ID NO: 3821885 - RNA, 15 nt, Shigella flexneri 2a str. 2457T
cgauuuggccgaaga

SEQ ID NO: 3821886 - RNA, 18 nt, Shigella flexneri 2a str. 2457T
cgauuuggccgaagagga

SEQ ID NO: 3821887 - RNA, 19 nt, Shigella flexneri 2a str. 2457T
cgauuuggccgaagaggaa

SEQ ID NO: 3821888 - RNA, 12 nt, Shigella flexneri 2a str. 2457T
cgauuuucaaaa

SEQ ID NO: 3821889 - RNA, 13 nt, Shigella flexneri 2a str. 2457T
cgauuuugaaguc

SEQ ID NO: 3821890 - RNA, 17 nt, Shigella flexneri 2a str. 2457T
cgauuuuuuuaauaaua

SEQ ID NO: 3821891 - RNA, 23 nt, Shigella flexneri 2a str. 2457T
cgauuuuuuuaauaauauucagc

SEQ ID NO: 3821892 - RNA, 15 nt, Shigella flexneri 2a str. 2457T
cgcaaaaaacauuga

SEQ ID NO: 3821893 - RNA, 13 nt, Shigella flexneri 2a str. 2457T
cgcaaaaccucuu

SEQ ID NO: 3821894 - RNA, 17 nt, Shigella flexneri 2a str. 2457T
cgcaaaaccucuuccag

SEQ ID NO: 3821895 - RNA, 20 nt, Shigella flexneri 2a str. 2457T
cgcaaaaccucuuccagcag

SEQ ID NO: 3821896 - RNA, 21 nt, Shigella flexneri 2a str. 2457T
cgcaaaaccucuuccagcaga

SEQ ID NO: 3821897 - RNA, 16 nt, Shigella flexneri 2a str. 2457T
cgcaaaacugccugau

SEQ ID NO: 3821898 - RNA, 13 nt, Shigella flexneri 2a str. 2457T
cgcaaaauguugu

SEQ ID NO: 3821899 - RNA, 20 nt, Shigella flexneri 2a str. 2457T
cgcaaacaggcgcagaacuu

SEQ ID NO: 3821900 - RNA, 20 nt, Shigella flexneri 2a str. 2457T
cgcaaacaguacaucuucca

SEQ ID NO: 3821901 - RNA, 20 nt, Shigella flexneri 2a str. 2457T
cgcaaacguggggugaauaa

SEQ ID NO: 3821902 - RNA, 14 nt, Shigella flexneri 2a str. 2457T
cgcaaacugccguu

SEQ ID NO: 3821903 - RNA, 17 nt, Shigella flexneri 2a str. 2457T
cgcaaagagagaagcca

SEQ ID NO: 3821904 - RNA, 19 nt, Shigella flexneri 2a str. 2457T
cgcaaagagagaagccaga

SEQ ID NO: 3821905 - RNA, 12 nt, Shigella flexneri 2a str. 2457T
cgcaaagcgacg

SEQ ID NO: 3821906 - RNA, 17 nt, Shigella flexneri 2a str. 2457T
cgcaaaggccagcaauc

SEQ ID NO: 3821907 - RNA, 18 nt, Shigella flexneri 2a str. 2457T
cgcaaaguagcggccuga

SEQ ID NO: 3821908 - RNA, 20 nt, Shigella flexneri 2a str. 2457T
cgcaaaguagcugaaaauca

SEQ ID NO: 3821909 - RNA, 13 nt, Shigella flexneri 2a str. 2457T
cgcaaauucggcg

SEQ ID NO: 3821910 - RNA, 14 nt, Shigella flexneri 2a str. 2457T
cgcaacagaccaga

SEQ ID NO: 3821911 - RNA, 21 nt, Shigella flexneri 2a str. 2457T
cgcaacagugaaauacaguua

SEQ ID NO: 3821912 - RNA, 12 nt, Shigella flexneri 2a str. 2457T
cgcaacaucgca

SEQ ID NO: 3821913 - RNA, 12 nt, Shigella flexneri 2a str. 2457T
cgcaacauguca

SEQ ID NO: 3821914 - RNA, 18 nt, Shigella flexneri 2a str. 2457T
cgcaacaugucagcaauc

SEQ ID NO: 3821915 - RNA, 17 nt, Shigella flexneri 2a str. 2457T
cgcaacauugcgccuca

SEQ ID NO: 3821916 - RNA, 15 nt, Shigella flexneri 2a str. 2457T
cgcaaccagcgucag

SEQ ID NO: 3821917 - RNA, 14 nt, Shigella flexneri 2a str. 2457T
cgcaacgcgcguga

SEQ ID NO: 3821918 - RNA, 23 nt, Shigella flexneri 2a str. 2457T
cgcaacgcgcgugaaguggcaca

SEQ ID NO: 3821919 - RNA, 15 nt, Shigella flexneri 2a str. 2457T
cgcaacggcugcugc

SEQ ID NO: 3821920 - RNA, 15 nt, Shigella flexneri 2a str. 2457T
cgcaacggugcggcu

SEQ ID NO: 3821921 - RNA, 16 nt, Shigella flexneri 2a str. 2457T
cgcaacguaucaucgc

SEQ ID NO: 3821922 - RNA, 18 nt, Shigella flexneri 2a str. 2457T
cgcaacguaucaucgcug

SEQ ID NO: 3821923 - RNA, 19 nt, Shigella flexneri 2a str. 2457T
cgcaacguaucaucgcuga

SEQ ID NO: 3821924 - RNA, 15 nt, Shigella flexneri 2a str. 2457T
cgcaacguaucuggu

SEQ ID NO: 3821925 - RNA, 18 nt, Shigella flexneri 2a str. 2457T
cgcaacugguccagcccc

SEQ ID NO: 3821926 - RNA, 16 nt, Shigella flexneri 2a str. 2457T
cgcaacuuccccucug

SEQ ID NO: 3821927 - RNA, 19 nt, Shigella flexneri 2a str. 2457T
cgcaagcagacgcucguua

SEQ ID NO: 3821928 - RNA, 20 nt, Shigella flexneri 2a str. 2457T
cgcaagcgaaugaggcagca

SEQ ID NO: 3821929 - RNA, 15 nt, Shigella flexneri 2a str. 2457T
cgcaagcggcaucca

SEQ ID NO: 3821930 - RNA, 15 nt, Shigella flexneri 2a str. 2457T
cgcaauaaucaucuc

SEQ ID NO: 3821931 - RNA, 17 nt, Shigella flexneri 2a str. 2457T
cgcaauagcacugcuuu

SEQ ID NO: 3821932 - RNA, 19 nt, Shigella flexneri 2a str. 2457T
cgcaauauccugcgcuucc

SEQ ID NO: 3821933 - RNA, 20 nt, Shigella flexneri 2a str. 2457T
cgcaauauccugcgcuuccu

SEQ ID NO: 3821934 - RNA, 22 nt, Shigella flexneri 2a str. 2457T
cgcaaucaccgggccgaugcgg

SEQ ID NO: 3821935 - RNA, 15 nt, Shigella flexneri 2a str. 2457T
cgcaaucagcaccgc

SEQ ID NO: 3821936 - RNA, 15 nt, Shigella flexneri 2a str. 2457T
cgcaaucgcccagcg

SEQ ID NO: 3821937 - RNA, 23 nt, Shigella flexneri 2a str. 2457T
cgcaaucgcccagcgcguaaaua

SEQ ID NO: 3821938 - RNA, 21 nt, Shigella flexneri 2a str. 2457T
cgcaaucgccuccagcgcugg

SEQ ID NO: 3821939 - RNA, 18 nt, Shigella flexneri 2a str. 2457T
cgcaaugauuuugaugga

SEQ ID NO: 3821940 - RNA, 17 nt, Shigella flexneri 2a str. 2457T
cgcaauuaacgccccaa

SEQ ID NO: 3821941 - RNA, 19 nt, Shigella flexneri 2a str. 2457T
cgcaauuccagcaagccac

SEQ ID NO: 3821942 - RNA, 22 nt, Shigella flexneri 2a str. 2457T
cgcaauuuauacugcgauggga

SEQ ID NO: 3821943 - RNA, 14 nt, Shigella flexneri 2a str. 2457T
cgcaauuuccauug

SEQ ID NO: 3821944 - RNA, 19 nt, Shigella flexneri 2a str. 2457T
cgcaauuuccauugcucug

SEQ ID NO: 3821945 - RNA, 22 nt, Shigella flexneri 2a str. 2457T
cgcacaauggcggugaucccaa

SEQ ID NO: 3821946 - RNA, 14 nt, Shigella flexneri 2a str. 2457T
cgcacacaacagac

SEQ ID NO: 3821947 - RNA, 22 nt, Shigella flexneri 2a str. 2457T
cgcacacauccacaaugcggau

SEQ ID NO: 3821948 - RNA, 14 nt, Shigella flexneri 2a str. 2457T
cgcacaccccggcg

SEQ ID NO: 3821949 - RNA, 17 nt, Shigella flexneri 2a str. 2457T
cgcacaccgagauaaug

SEQ ID NO: 3821950 - RNA, 19 nt, Shigella flexneri 2a str. 2457T
cgcacagcccgccgccauc

SEQ ID NO: 3821951 - RNA, 15 nt, Shigella flexneri 2a str. 2457T
cgcacauuucaauca

SEQ ID NO: 3821952 - RNA, 14 nt, Shigella flexneri 2a str. 2457T
cgcaccaccagcag

SEQ ID NO: 3821953 - RNA, 17 nt, Shigella flexneri 2a str. 2457T
cgcaccagaaacaauaa

SEQ ID NO: 3821954 - RNA, 22 nt, Shigella flexneri 2a str. 2457T
cgcaccagcggaaugcagucac

SEQ ID NO: 3821955 - RNA, 13 nt, Shigella flexneri 2a str. 2457T
cgcaccagcuugc

SEQ ID NO: 3821956 - RNA, 23 nt, Shigella flexneri 2a str. 2457T
cgcaccaggcgaaaacgcugacc

SEQ ID NO: 3821957 - RNA, 18 nt, Shigella flexneri 2a str. 2457T
cgcaccccugauaaccgc

SEQ ID NO: 3821958 - RNA, 20 nt, Shigella flexneri 2a str. 2457T
cgcaccccugauaaccgcau

SEQ ID NO: 3821959 - RNA, 13 nt, Shigella flexneri 2a str. 2457T
cgcacccgccauc

SEQ ID NO: 3821960 - RNA, 14 nt, Shigella flexneri 2a str. 2457T
cgcacccgccauca

SEQ ID NO: 3821961 - RNA, 17 nt, Shigella flexneri 2a str. 2457T
cgcaccgccaccaccga

SEQ ID NO: 3821962 - RNA, 17 nt, Shigella flexneri 2a str. 2457T
cgcaccgggcuuccggc

SEQ ID NO: 3821963 - RNA, 18 nt, Shigella flexneri 2a str. 2457T
cgcaccgugacaguaauc

SEQ ID NO: 3821964 - RNA, 12 nt, Shigella flexneri 2a str. 2457T
cgcaccugccag

SEQ ID NO: 3821965 - RNA, 16 nt, Shigella flexneri 2a str. 2457T
cgcaccugccagcgcc

SEQ ID NO: 3821966 - RNA, 19 nt, Shigella flexneri 2a str. 2457T
cgcacgaggaacagcgcgc

SEQ ID NO: 3821967 - RNA, 20 nt, Shigella flexneri 2a str. 2457T
cgcacgaggaagauuacgcu

SEQ ID NO: 3821968 - RNA, 17 nt, Shigella flexneri 2a str. 2457T
cgcacgcagaaucucug

SEQ ID NO: 3821969 - RNA, 22 nt, Shigella flexneri 2a str. 2457T
cgcacgccuggcagucacggcg

SEQ ID NO: 3821970 - RNA, 16 nt, Shigella flexneri 2a str. 2457T
cgcacgcgcuucacau

SEQ ID NO: 3821971 - RNA, 11 nt, Shigella flexneri 2a str. 2457T
cgcacgcucaa

SEQ ID NO: 3821972 - RNA, 19 nt, Shigella flexneri 2a str. 2457T
cgcacgcucuauggcaccu

SEQ ID NO: 3821973 - RNA, 16 nt, Shigella flexneri 2a str. 2457T
cgcacgcugucaccag

SEQ ID NO: 3821974 - RNA, 21 nt, Shigella flexneri 2a str. 2457T
cgcacguucugucgcucugcu

SEQ ID NO: 3821975 - RNA, 18 nt, Shigella flexneri 2a str. 2457T
cgcacguugucagcaacu

SEQ ID NO: 3821976 - RNA, 20 nt, Shigella flexneri 2a str. 2457T
cgcacuaugugccagcuucc

SEQ ID NO: 3821977 - RNA, 14 nt, Shigella flexneri 2a str. 2457T
cgcacucgcccuga

SEQ ID NO: 3821978 - RNA, 18 nt, Shigella flexneri 2a str. 2457T
cgcacugcguggagaugu

SEQ ID NO: 3821979 - RNA, 13 nt, Shigella flexneri 2a str. 2457T
cgcacugcuugaa

SEQ ID NO: 3821980 - RNA, 21 nt, Shigella flexneri 2a str. 2457T
cgcacuguuggcgaaaauccu

SEQ ID NO: 3821981 - RNA, 13 nt, Shigella flexneri 2a str. 2457T
cgcacuuaauaua

SEQ ID NO: 3821982 - RNA, 18 nt, Shigella flexneri 2a str. 2457T
cgcacuuugccagaaauc

SEQ ID NO: 3821983 - RNA, 19 nt, Shigella flexneri 2a str. 2457T
cgcacuuugucaucagucu

SEQ ID NO: 3821984 - RNA, 13 nt, Shigella flexneri 2a str. 2457T
cgcagaaagaggc

SEQ ID NO: 3821985 - RNA, 16 nt, Shigella flexneri 2a str. 2457T
cgcagaaccagaagcg

SEQ ID NO: 3821986 - RNA, 12 nt, Shigella flexneri 2a str. 2457T
cgcagaauggcg

SEQ ID NO: 3821987 - RNA, 22 nt, Shigella flexneri 2a str. 2457T
cgcagacaaucacaucacugcc

SEQ ID NO: 3821988 - RNA, 13 nt, Shigella flexneri 2a str. 2457T
cgcagacaccaga

SEQ ID NO: 3821989 - RNA, 15 nt, Shigella flexneri 2a str. 2457T
cgcagacuuaagauc

SEQ ID NO: 3821990 - RNA, 19 nt, Shigella flexneri 2a str. 2457T
cgcagagauagaacugcau

SEQ ID NO: 3821991 - RNA, 12 nt, Shigella flexneri 2a str. 2457T
cgcagauaaaua

SEQ ID NO: 3821992 - RNA, 17 nt, Shigella flexneri 2a str. 2457T
cgcagauaaauaucaau

SEQ ID NO: 3821993 - RNA, 16 nt, Shigella flexneri 2a str. 2457T
cgcagaucagaccaau

SEQ ID NO: 3821994 - RNA, 13 nt, Shigella flexneri 2a str. 2457T
cgcagaucgaaca

SEQ ID NO: 3821995 - RNA, 19 nt, Shigella flexneri 2a str. 2457T
cgcagaugaagcuggcaaa

SEQ ID NO: 3821996 - RNA, 21 nt, Shigella flexneri 2a str. 2457T
cgcagaugaagcuggcaaagu

SEQ ID NO: 3821997 - RNA, 22 nt, Shigella flexneri 2a str. 2457T
cgcagcaagccgucgugaaugc

SEQ ID NO: 3821998 - RNA, 14 nt, Shigella flexneri 2a str. 2457T
cgcagcagcgcgcc

SEQ ID NO: 3821999 - RNA, 16 nt, Shigella flexneri 2a str. 2457T
cgcagcaguugccagu

SEQ ID NO: 3822000 - RNA, 22 nt, Shigella flexneri 2a str. 2457T
cgcagcauugcucaccgccagc

SEQ ID NO: 3822001 - RNA, 16 nt, Shigella flexneri 2a str. 2457T
cgcagccagcgcgccu

SEQ ID NO: 3822002 - RNA, 23 nt, Shigella flexneri 2a str. 2457T
cgcagccagcgucgcacccggca

SEQ ID NO: 3822003 - RNA, 13 nt, Shigella flexneri 2a str. 2457T
cgcagccaguuaa

SEQ ID NO: 3822004 - RNA, 18 nt, Shigella flexneri 2a str. 2457T
cgcagccaucaaccugug

SEQ ID NO: 3822005 - RNA, 13 nt, Shigella flexneri 2a str. 2457T
cgcagccaucagc

SEQ ID NO: 3822006 - RNA, 17 nt, Shigella flexneri 2a str. 2457T
cgcagccaucagcgaga

SEQ ID NO: 3822007 - RNA, 19 nt, Shigella flexneri 2a str. 2457T
cgcagcccagaugcggcgg

SEQ ID NO: 3822008 - RNA, 16 nt, Shigella flexneri 2a str. 2457T
cgcagccccagagccu

SEQ ID NO: 3822009 - RNA, 17 nt, Shigella flexneri 2a str. 2457T
cgcagccgccagaaaug

SEQ ID NO: 3822010 - RNA, 14 nt, Shigella flexneri 2a str. 2457T
cgcagcgcgcgaau

SEQ ID NO: 3822011 - RNA, 17 nt, Shigella flexneri 2a str. 2457T
cgcagcucacuucgauc

SEQ ID NO: 3822012 - RNA, 13 nt, Shigella flexneri 2a str. 2457T
cgcagcuccagcc

SEQ ID NO: 3822013 - RNA, 17 nt, Shigella flexneri 2a str. 2457T
cgcagcuccagcccgcg

SEQ ID NO: 3822014 - RNA, 13 nt, Shigella flexneri 2a str. 2457T
cgcagcugagaaa

SEQ ID NO: 3822015 - RNA, 14 nt, Shigella flexneri 2a str. 2457T
cgcagcugcgcauc

SEQ ID NO: 3822016 - RNA, 19 nt, Shigella flexneri 2a str. 2457T
cgcagcugcgcguuaucua

SEQ ID NO: 3822017 - RNA, 22 nt, Shigella flexneri 2a str. 2457T
cgcagcugguguaacugcgcca

SEQ ID NO: 3822018 - RNA, 18 nt, Shigella flexneri 2a str. 2457T
cgcagcuucacuucuuac

SEQ ID NO: 3822019 - RNA, 10 nt, Shigella flexneri 2a str. 2457T
cgcaggaaag

SEQ ID NO: 3822020 - RNA, 21 nt, Shigella flexneri 2a str. 2457T
cgcaggaaagauaagcgaaca

SEQ ID NO: 3822021 - RNA, 15 nt, Shigella flexneri 2a str. 2457T
cgcaggauaucgugg

SEQ ID NO: 3822022 - RNA, 14 nt, Shigella flexneri 2a str. 2457T
cgcaggaugggcaa

SEQ ID NO: 3822023 - RNA, 14 nt, Shigella flexneri 2a str. 2457T
cgcaggccaauagc

SEQ ID NO: 3822024 - RNA, 16 nt, Shigella flexneri 2a str. 2457T
cgcaggcgcaauggcg

SEQ ID NO: 3822025 - RNA, 20 nt, Shigella flexneri 2a str. 2457T
cgcaggcgcaauggcgcaau

SEQ ID NO: 3822026 - RNA, 12 nt, Shigella flexneri 2a str. 2457T
cgcaggcgcgcu

SEQ ID NO: 3822027 - RNA, 16 nt, Shigella flexneri 2a str. 2457T
cgcagggaguuaccgu

SEQ ID NO: 3822028 - RNA, 23 nt, Shigella flexneri 2a str. 2457T
cgcagggaucauccacccgcagc

SEQ ID NO: 3822029 - RNA, 17 nt, Shigella flexneri 2a str. 2457T
cgcagggcaugacacag

SEQ ID NO: 3822030 - RNA, 20 nt, Shigella flexneri 2a str. 2457T
cgcagggcuguuuaucguga

SEQ ID NO: 3822031 - RNA, 21 nt, Shigella flexneri 2a str. 2457T
cgcagguagguucugcggcgu

SEQ ID NO: 3822032 - RNA, 13 nt, Shigella flexneri 2a str. 2457T
cgcagguuccgca

SEQ ID NO: 3822033 - RNA, 16 nt, Shigella flexneri 2a str. 2457T
cgcaguaaauccgcca

SEQ ID NO: 3822034 - RNA, 19 nt, Shigella flexneri 2a str. 2457T
cgcaguaaauccgccacuu

SEQ ID NO: 3822035 - RNA, 18 nt, Shigella flexneri 2a str. 2457T
cgcaguaagcgacgggcg

SEQ ID NO: 3822036 - RNA, 22 nt, Shigella flexneri 2a str. 2457T
cgcaguaccacuucauccggau

SEQ ID NO: 3822037 - RNA, 16 nt, Shigella flexneri 2a str. 2457T
cgcaguaccagcaacg

SEQ ID NO: 3822038 - RNA, 23 nt, Shigella flexneri 2a str. 2457T
cgcaguaugcgauacccccagua

SEQ ID NO: 3822039 - RNA, 15 nt, Shigella flexneri 2a str. 2457T
cgcagucgccagcaa

SEQ ID NO: 3822040 - RNA, 14 nt, Shigella flexneri 2a str. 2457T
cgcagucuucccag

SEQ ID NO: 3822041 - RNA, 14 nt, Shigella flexneri 2a str. 2457T
cgcagugacauuca

SEQ ID NO: 3822042 - RNA, 19 nt, Shigella flexneri 2a str. 2457T
cgcagugagaagccaccgc

SEQ ID NO: 3822043 - RNA, 12 nt, Shigella flexneri 2a str. 2457T
cgcagugcugca

SEQ ID NO: 3822044 - RNA, 17 nt, Shigella flexneri 2a str. 2457T
cgcaguugcaguaccag

SEQ ID NO: 3822045 - RNA, 23 nt, Shigella flexneri 2a str. 2457T
cgcauaacugccggaugcggcgu

SEQ ID NO: 3822046 - RNA, 14 nt, Shigella flexneri 2a str. 2457T
cgcauaagccaccu

SEQ ID NO: 3822047 - RNA, 17 nt, Shigella flexneri 2a str. 2457T
cgcauaaucugaagaaa

SEQ ID NO: 3822048 - RNA, 21 nt, Shigella flexneri 2a str. 2457T
cgcauacagccagacaaucga

SEQ ID NO: 3822049 - RNA, 21 nt, Shigella flexneri 2a str. 2457T
cgcauaccaaaauccaccagu

SEQ ID NO: 3822050 - RNA, 22 nt, Shigella flexneri 2a str. 2457T
cgcauaccauccaggagauauu

SEQ ID NO: 3822051 - RNA, 19 nt, Shigella flexneri 2a str. 2457T
cgcauaugcuuugccguca

SEQ ID NO: 3822052 - RNA, 17 nt, Shigella flexneri 2a str. 2457T
cgcaucaggcaaucucu

SEQ ID NO: 3822053 - RNA, 14 nt, Shigella flexneri 2a str. 2457T
cgcaucaggcaauu

SEQ ID NO: 3822054 - RNA, 18 nt, Shigella flexneri 2a str. 2457T
cgcaucaggcaucgugca

SEQ ID NO: 3822055 - RNA, 18 nt, Shigella flexneri 2a str. 2457T
cgcaucaggcaucugcgc

SEQ ID NO: 3822056 - RNA, 22 nt, Shigella flexneri 2a str. 2457T
cgcaucaggcauugugcacgau

SEQ ID NO: 3822057 - RNA, 19 nt, Shigella flexneri 2a str. 2457T
cgcaucagggcgcuggcga

SEQ ID NO: 3822058 - RNA, 13 nt, Shigella flexneri 2a str. 2457T
cgcauccaccaga

SEQ ID NO: 3822059 - RNA, 23 nt, Shigella flexneri 2a str. 2457T
cgcauccagccaacguuucugga

SEQ ID NO: 3822060 - RNA, 17 nt, Shigella flexneri 2a str. 2457T
cgcaucccauuucucca

SEQ ID NO: 3822061 - RNA, 15 nt, Shigella flexneri 2a str. 2457T
cgcauccgacacugg

SEQ ID NO: 3822062 - RNA, 17 nt, Shigella flexneri 2a str. 2457T
cgcauccgacaucaacc

SEQ ID NO: 3822063 - RNA, 17 nt, Shigella flexneri 2a str. 2457T
cgcauccgaucgcgcau

SEQ ID NO: 3822064 - RNA, 15 nt, Shigella flexneri 2a str. 2457T
cgcauccgcuugcgu

SEQ ID NO: 3822065 - RNA, 13 nt, Shigella flexneri 2a str. 2457T
cgcauccggcaau

SEQ ID NO: 3822066 - RNA, 22 nt, Shigella flexneri 2a str. 2457T
cgcauccggcaauaagcaacgc

SEQ ID NO: 3822067 - RNA, 23 nt, Shigella flexneri 2a str. 2457T
cgcauccggcaauucucucugau

SEQ ID NO: 3822068 - RNA, 19 nt, Shigella flexneri 2a str. 2457T
cgcauccggcauaaacaaa

SEQ ID NO: 3822069 - RNA, 15 nt, Shigella flexneri 2a str. 2457T
cgcauccggcaugaa

SEQ ID NO: 3822070 - RNA, 13 nt, Shigella flexneri 2a str. 2457T
cgcauccggcauu

SEQ ID NO: 3822071 - RNA, 23 nt, Shigella flexneri 2a str. 2457T
cgcauccggcauucagugcaaau

SEQ ID NO: 3822072 - RNA, 21 nt, Shigella flexneri 2a str. 2457T
cgcauccgggauggucagcgg

SEQ ID NO: 3822073 - RNA, 18 nt, Shigella flexneri 2a str. 2457T
cgcauccggucacuuuca

SEQ ID NO: 3822074 - RNA, 20 nt, Shigella flexneri 2a str. 2457T
cgcaucgaauugcgcauccg

SEQ ID NO: 3822075 - RNA, 15 nt, Shigella flexneri 2a str. 2457T
cgcaucgcugcgcuu

SEQ ID NO: 3822076 - RNA, 15 nt, Shigella flexneri 2a str. 2457T
cgcaucggcgucgug

SEQ ID NO: 3822077 - RNA, 17 nt, Shigella flexneri 2a str. 2457T
cgcaucggcgucgugga

SEQ ID NO: 3822078 - RNA, 16 nt, Shigella flexneri 2a str. 2457T
cgcaucgggcaauggc

SEQ ID NO: 3822079 - RNA, 12 nt, Shigella flexneri 2a str. 2457T
cgcaucggucag

SEQ ID NO: 3822080 - RNA, 13 nt, Shigella flexneri 2a str. 2457T
cgcaucggucaga

SEQ ID NO: 3822081 - RNA, 20 nt, Shigella flexneri 2a str. 2457T
cgcaucggucagacccaguu

SEQ ID NO: 3822082 - RNA, 20 nt, Shigella flexneri 2a str. 2457T
cgcaucggugauaacuguau

SEQ ID NO: 3822083 - RNA, 16 nt, Shigella flexneri 2a str. 2457T
cgcaugaauuacgcaa

SEQ ID NO: 3822084 - RNA, 19 nt, Shigella flexneri 2a str. 2457T
cgcauuaagccaugaauga

SEQ ID NO: 3822085 - RNA, 18 nt, Shigella flexneri 2a str. 2457T
cgcauucagcagcagcaa

SEQ ID NO: 3822086 - RNA, 17 nt, Shigella flexneri 2a str. 2457T
cgcauucccagcgcguu

SEQ ID NO: 3822087 - RNA, 15 nt, Shigella flexneri 2a str. 2457T
cgcauugccagagug

SEQ ID NO: 3822088 - RNA, 13 nt, Shigella flexneri 2a str. 2457T
cgcauugcuggcu

SEQ ID NO: 3822089 - RNA, 16 nt, Shigella flexneri 2a str. 2457T
cgcauuuucuucauuc

SEQ ID NO: 3822090 - RNA, 18 nt, Shigella flexneri 2a str. 2457T
cgccaaaaggcaauucaa

SEQ ID NO: 3822091 - RNA, 19 nt, Shigella flexneri 2a str. 2457T
cgccaaacccaccagcuga

SEQ ID NO: 3822092 - RNA, 20 nt, Shigella flexneri 2a str. 2457T
cgccaaacccaccagcugau

SEQ ID NO: 3822093 - RNA, 23 nt, Shigella flexneri 2a str. 2457T
cgccaaaccgaccaaucacaucg

SEQ ID NO: 3822094 - RNA, 14 nt, Shigella flexneri 2a str. 2457T
cgccaaagcggcag

SEQ ID NO: 3822095 - RNA, 15 nt, Shigella flexneri 2a str. 2457T
cgccaaagcggcagu

SEQ ID NO: 3822096 - RNA, 16 nt, Shigella flexneri 2a str. 2457T
cgccaaagcggcaguu

SEQ ID NO: 3822097 - RNA, 23 nt, Shigella flexneri 2a str. 2457T
cgccaaaucgauaaaacuucccg

SEQ ID NO: 3822098 - RNA, 18 nt, Shigella flexneri 2a str. 2457T
cgccaaaucgcugcugcu

SEQ ID NO: 3822099 - RNA, 18 nt, Shigella flexneri 2a str. 2457T
cgccaaaugucaccagcc

SEQ ID NO: 3822100 - RNA, 14 nt, Shigella flexneri 2a str. 2457T
cgccaaccagcuga

SEQ ID NO: 3822101 - RNA, 15 nt, Shigella flexneri 2a str. 2457T
cgccaaccugcuggu

SEQ ID NO: 3822102 - RNA, 21 nt, Shigella flexneri 2a str. 2457T
cgccaacggugaaaaaccaau

SEQ ID NO: 3822103 - RNA, 23 nt, Shigella flexneri 2a str. 2457T
cgccaagcagcgcgcagaacaua

SEQ ID NO: 3822104 - RNA, 16 nt, Shigella flexneri 2a str. 2457T
cgccaauaaccggcac

SEQ ID NO: 3822105 - RNA, 13 nt, Shigella flexneri 2a str. 2457T
cgccaaucagcgc

SEQ ID NO: 3822106 - RNA, 20 nt, Shigella flexneri 2a str. 2457T
cgccaaucagcgcagcaccc

SEQ ID NO: 3822107 - RNA, 21 nt, Shigella flexneri 2a str. 2457T
cgccaaugaccgcgccaucca

SEQ ID NO: 3822108 - RNA, 19 nt, Shigella flexneri 2a str. 2457T
cgccaauucguaaguacau

SEQ ID NO: 3822109 - RNA, 19 nt, Shigella flexneri 2a str. 2457T
cgccacaacuucaacguug

SEQ ID NO: 3822110 - RNA, 13 nt, Shigella flexneri 2a str. 2457T
cgccacagcagcc

SEQ ID NO: 3822111 - RNA, 18 nt, Shigella flexneri 2a str. 2457T
cgccacauaagaucaucg

SEQ ID NO: 3822112 - RNA, 17 nt, Shigella flexneri 2a str. 2457T
cgccacauccggcacaa

SEQ ID NO: 3822113 - RNA, 14 nt, Shigella flexneri 2a str. 2457T
cgccaccacaacau

SEQ ID NO: 3822114 - RNA, 13 nt, Shigella flexneri 2a str. 2457T
cgccaccaccagc

SEQ ID NO: 3822115 - RNA, 12 nt, Shigella flexneri 2a str. 2457T
cgccaccagcgu

SEQ ID NO: 3822116 - RNA, 13 nt, Shigella flexneri 2a str. 2457T
cgccaccagcuga

SEQ ID NO: 3822117 - RNA, 18 nt, Shigella flexneri 2a str. 2457T
cgccaccauucccuggcg

SEQ ID NO: 3822118 - RNA, 13 nt, Shigella flexneri 2a str. 2457T
cgccacccagucc

SEQ ID NO: 3822119 - RNA, 16 nt, Shigella flexneri 2a str. 2457T
cgccaccgaccaggca

SEQ ID NO: 3822120 - RNA, 13 nt, Shigella flexneri 2a str. 2457T
cgccaccgcacgc

SEQ ID NO: 3822121 - RNA, 13 nt, Shigella flexneri 2a str. 2457T
cgccaccgcgcgu

SEQ ID NO: 3822122 - RNA, 17 nt, Shigella flexneri 2a str. 2457T
cgccaccggcaaucugc

SEQ ID NO: 3822123 - RNA, 12 nt, Shigella flexneri 2a str. 2457T
cgccaccggcuu

SEQ ID NO: 3822124 - RNA, 20 nt, Shigella flexneri 2a str. 2457T
cgccaccucuuucaccaacg

SEQ ID NO: 3822125 - RNA, 23 nt, Shigella flexneri 2a str. 2457T
cgccaccuuucucggcaucacgc

SEQ ID NO: 3822126 - RNA, 20 nt, Shigella flexneri 2a str. 2457T
cgccacgaaauugaggaugc

SEQ ID NO: 3822127 - RNA, 12 nt, Shigella flexneri 2a str. 2457T
cgccacgacuca

SEQ ID NO: 3822128 - RNA, 22 nt, Shigella flexneri 2a str. 2457T
cgccacgacucaaaucacgcag

SEQ ID NO: 3822129 - RNA, 19 nt, Shigella flexneri 2a str. 2457T
cgccacgcucacucaucac

SEQ ID NO: 3822130 - RNA, 23 nt, Shigella flexneri 2a str. 2457T
cgccacgguaucaagcccgccgg

SEQ ID NO: 3822131 - RNA, 13 nt, Shigella flexneri 2a str. 2457T
cgccacuaacgca

SEQ ID NO: 3822132 - RNA, 22 nt, Shigella flexneri 2a str. 2457T
cgccacuaucgccaucaggcag

SEQ ID NO: 3822133 - RNA, 15 nt, Shigella flexneri 2a str. 2457T
cgccacucugacggc

SEQ ID NO: 3822134 - RNA, 22 nt, Shigella flexneri 2a str. 2457T
cgccacuuagcgcuuggucgaa

SEQ ID NO: 3822135 - RNA, 18 nt, Shigella flexneri 2a str. 2457T
cgccacuucccagccuuc

SEQ ID NO: 3822136 - RNA, 22 nt, Shigella flexneri 2a str. 2457T
cgccacuuuaaauucagcauua

SEQ ID NO: 3822137 - RNA, 16 nt, Shigella flexneri 2a str. 2457T
cgccacuuucacgccg

SEQ ID NO: 3822138 - RNA, 16 nt, Shigella flexneri 2a str. 2457T
cgccacuuuucggcaa

SEQ ID NO: 3822139 - RNA, 15 nt, Shigella flexneri 2a str. 2457T
cgccagaaaaccugg

SEQ ID NO: 3822140 - RNA, 17 nt, Shigella flexneri 2a str. 2457T
cgccagaaaaccuggcg

SEQ ID NO: 3822141 - RNA, 13 nt, Shigella flexneri 2a str. 2457T
cgccagaaaucag

SEQ ID NO: 3822142 - RNA, 19 nt, Shigella flexneri 2a str. 2457T
cgccagaaaucagcuuugg

SEQ ID NO: 3822143 - RNA, 23 nt, Shigella flexneri 2a str. 2457T
cgccagaacacgcucccagcaga

SEQ ID NO: 3822144 - RNA, 14 nt, Shigella flexneri 2a str. 2457T
cgccagaaguugcu

SEQ ID NO: 3822145 - RNA, 18 nt, Shigella flexneri 2a str. 2457T
cgccagacaauugccgcc

SEQ ID NO: 3822146 - RNA, 19 nt, Shigella flexneri 2a str. 2457T
cgccagacaauugccgcca

SEQ ID NO: 3822147 - RNA, 16 nt, Shigella flexneri 2a str. 2457T
cgccagacccagacgc

SEQ ID NO: 3822148 - RNA, 20 nt, Shigella flexneri 2a str. 2457T
cgccagaccuaccaucuccu

SEQ ID NO: 3822149 - RNA, 18 nt, Shigella flexneri 2a str. 2457T
cgccagagagcgaauauc

SEQ ID NO: 3822150 - RNA, 18 nt, Shigella flexneri 2a str. 2457T
cgccagagagcggagcaa

SEQ ID NO: 3822151 - RNA, 15 nt, Shigella flexneri 2a str. 2457T
cgccagaggcgacaa

SEQ ID NO: 3822152 - RNA, 17 nt, Shigella flexneri 2a str. 2457T
cgccagauagccgaccg

SEQ ID NO: 3822153 - RNA, 14 nt, Shigella flexneri 2a str. 2457T
cgccagauuacgcu

SEQ ID NO: 3822154 - RNA, 20 nt, Shigella flexneri 2a str. 2457T
cgccagcaagagcaaauaaa

SEQ ID NO: 3822155 - RNA, 11 nt, Shigella flexneri 2a str. 2457T
cgccagcaccg

SEQ ID NO: 3822156 - RNA, 15 nt, Shigella flexneri 2a str. 2457T
cgccagcagcagcgc

SEQ ID NO: 3822157 - RNA, 19 nt, Shigella flexneri 2a str. 2457T
cgccagcagcagcgccaac

SEQ ID NO: 3822158 - RNA, 15 nt, Shigella flexneri 2a str. 2457T
cgccagcaucgcauc

SEQ ID NO: 3822159 - RNA, 20 nt, Shigella flexneri 2a str. 2457T
cgccagcaucggcagcgcca

SEQ ID NO: 3822160 - RNA, 17 nt, Shigella flexneri 2a str. 2457T
cgccagcauucccgcca

SEQ ID NO: 3822161 - RNA, 22 nt, Shigella flexneri 2a str. 2457T
cgccagcauucccgccagcggc

SEQ ID NO: 3822162 - RNA, 21 nt, Shigella flexneri 2a str. 2457T
cgccagccaauugccauauac

SEQ ID NO: 3822163 - RNA, 21 nt, Shigella flexneri 2a str. 2457T
cgccagccaccacaauugacc

SEQ ID NO: 3822164 - RNA, 20 nt, Shigella flexneri 2a str. 2457T
cgccagcgaaccaccaaacu

SEQ ID NO: 3822165 - RNA, 15 nt, Shigella flexneri 2a str. 2457T
cgccagcgcgcaguu

SEQ ID NO: 3822166 - RNA, 17 nt, Shigella flexneri 2a str. 2457T
cgccagcggcccggaga

SEQ ID NO: 3822167 - RNA, 23 nt, Shigella flexneri 2a str. 2457T
cgccagcggcguuugcuccugcu

SEQ ID NO: 3822168 - RNA, 20 nt, Shigella flexneri 2a str. 2457T
cgccagcggguucccggcgu

SEQ ID NO: 3822169 - RNA, 17 nt, Shigella flexneri 2a str. 2457T
cgccagcgucucuucaa

SEQ ID NO: 3822170 - RNA, 19 nt, Shigella flexneri 2a str. 2457T
cgccagcgucucuucaauu

SEQ ID NO: 3822171 - RNA, 15 nt, Shigella flexneri 2a str. 2457T
cgccagcgucugagc

SEQ ID NO: 3822172 - RNA, 22 nt, Shigella flexneri 2a str. 2457T
cgccagcguuacuucaccuucu

SEQ ID NO: 3822173 - RNA, 13 nt, Shigella flexneri 2a str. 2457T
cgccagcguugau

SEQ ID NO: 3822174 - RNA, 18 nt, Shigella flexneri 2a str. 2457T
cgccagcucacgggcggc

SEQ ID NO: 3822175 - RNA, 22 nt, Shigella flexneri 2a str. 2457T
cgccagcucacgggcggcaggu

SEQ ID NO: 3822176 - RNA, 16 nt, Shigella flexneri 2a str. 2457T
cgccagcugcauuuca

SEQ ID NO: 3822177 - RNA, 20 nt, Shigella flexneri 2a str. 2457T
cgccaggaauuugguccuga

SEQ ID NO: 3822178 - RNA, 19 nt, Shigella flexneri 2a str. 2457T
cgccaggagacgcgcaaau

SEQ ID NO: 3822179 - RNA, 14 nt, Shigella flexneri 2a str. 2457T
cgccaggccagccu

SEQ ID NO: 3822180 - RNA, 19 nt, Shigella flexneri 2a str. 2457T
cgccaggccagccugguua

SEQ ID NO: 3822181 - RNA, 13 nt, Shigella flexneri 2a str. 2457T
cgccaggcgcuga

SEQ ID NO: 3822182 - RNA, 14 nt, Shigella flexneri 2a str. 2457T
cgccaggcgcugau

SEQ ID NO: 3822183 - RNA, 18 nt, Shigella flexneri 2a str. 2457T
cgccaggcguuugaaaaa

SEQ ID NO: 3822184 - RNA, 22 nt, Shigella flexneri 2a str. 2457T
cgccaggcuuuccgucagcggc

SEQ ID NO: 3822185 - RNA, 16 nt, Shigella flexneri 2a str. 2457T
cgccagggccgcgaau

SEQ ID NO: 3822186 - RNA, 18 nt, Shigella flexneri 2a str. 2457T
cgccaggucagagagcca

SEQ ID NO: 3822187 - RNA, 20 nt, Shigella flexneri 2a str. 2457T
cgccaggucagagagccagc

SEQ ID NO: 3822188 - RNA, 22 nt, Shigella flexneri 2a str. 2457T
cgccaggucagagagccagccc

SEQ ID NO: 3822189 - RNA, 22 nt, Shigella flexneri 2a str. 2457T
cgccagugauugcuugccccuu

SEQ ID NO: 3822190 - RNA, 14 nt, Shigella flexneri 2a str. 2457T
cgccagugccgccc

SEQ ID NO: 3822191 - RNA, 19 nt, Shigella flexneri 2a str. 2457T
cgccagugccgcccaccac

SEQ ID NO: 3822192 - RNA, 20 nt, Shigella flexneri 2a str. 2457T
cgccaguuacugccaccauc

SEQ ID NO: 3822193 - RNA, 14 nt, Shigella flexneri 2a str. 2457T
cgccaguucuucca

SEQ ID NO: 3822194 - RNA, 17 nt, Shigella flexneri 2a str. 2457T
cgccaguucuuccaguu

SEQ ID NO: 3822195 - RNA, 23 nt, Shigella flexneri 2a str. 2457T
cgccaguucuuccaguuccggca

SEQ ID NO: 3822196 - RNA, 13 nt, Shigella flexneri 2a str. 2457T
cgccaguugcggc

SEQ ID NO: 3822197 - RNA, 11 nt, Shigella flexneri 2a str. 2457T
cgccaguuuac

SEQ ID NO: 3822198 - RNA, 14 nt, Shigella flexneri 2a str. 2457T
cgccaguuuacugu

SEQ ID NO: 3822199 - RNA, 19 nt, Shigella flexneri 2a str. 2457T
cgccaguuuacugucugcu

SEQ ID NO: 3822200 - RNA, 14 nt, Shigella flexneri 2a str. 2457T
cgccaguuuugcca

SEQ ID NO: 3822201 - RNA, 17 nt, Shigella flexneri 2a str. 2457T
cgccauaaacagcaggc

SEQ ID NO: 3822202 - RNA, 14 nt, Shigella flexneri 2a str. 2457T
cgccauaacggcug

SEQ ID NO: 3822203 - RNA, 19 nt, Shigella flexneri 2a str. 2457T
cgccauaacggcuguccau

SEQ ID NO: 3822204 - RNA, 18 nt, Shigella flexneri 2a str. 2457T
cgccauaccaugcaccaa

SEQ ID NO: 3822205 - RNA, 17 nt, Shigella flexneri 2a str. 2457T
cgccaucaaugugcuga

SEQ ID NO: 3822206 - RNA, 22 nt, Shigella flexneri 2a str. 2457T
cgccaucaauuuugaugauauc

SEQ ID NO: 3822207 - RNA, 20 nt, Shigella flexneri 2a str. 2457T
cgccaucagugccaguacgc

SEQ ID NO: 3822208 - RNA, 14 nt, Shigella flexneri 2a str. 2457T
cgccaucaucggca

SEQ ID NO: 3822209 - RNA, 21 nt, Shigella flexneri 2a str. 2457T
cgccaucccuaccgcccgcgc

SEQ ID NO: 3822210 - RNA, 12 nt, Shigella flexneri 2a str. 2457T
cgccauccggca

SEQ ID NO: 3822211 - RNA, 14 nt, Shigella flexneri 2a str. 2457T
cgccauccggcagc

SEQ ID NO: 3822212 - RNA, 18 nt, Shigella flexneri 2a str. 2457T
ggcugguuuucagcgaaa

SEQ ID NO: 3822213 - RNA, 19 nt, Shigella flexneri 2a str. 2457T
ggcugugcccguaaaaaau

SEQ ID NO: 3822214 - RNA, 19 nt, Shigella flexneri 2a str. 2457T
ggcuguucacugugcuggu

SEQ ID NO: 3822215 - RNA, 20 nt, Shigella flexneri 2a str. 2457T
ggcuguugauguccaguucc

SEQ ID NO: 3822216 - RNA, 20 nt, Shigella flexneri 2a str. 2457T
ggcuguuucaggaacaccgc

SEQ ID NO: 3822217 - RNA, 17 nt, Shigella flexneri 2a str. 2457T
ggcuguuuucagcacca

SEQ ID NO: 3822218 - RNA, 23 nt, Shigella flexneri 2a str. 2457T
ggcuguuuuccagcaccacuucc

SEQ ID NO: 3822219 - RNA, 18 nt, Shigella flexneri 2a str. 2457T
ggcuuaaacgcagagaca

SEQ ID NO: 3822220 - RNA, 13 nt, Shigella flexneri 2a str. 2457T
ggcuuaauugccc

SEQ ID NO: 3822221 - RNA, 16 nt, Shigella flexneri 2a str. 2457T
ggcuuaccaaauaaac

SEQ ID NO: 3822222 - RNA, 15 nt, Shigella flexneri 2a str. 2457T
ggcuuauccggcaug

SEQ ID NO: 3822223 - RNA, 22 nt, Shigella flexneri 2a str. 2457T
ggcuucaaucaauaacagcgca

SEQ ID NO: 3822224 - RNA, 22 nt, Shigella flexneri 2a str. 2457T
ggcuucauccagcagugacuca

SEQ ID NO: 3822225 - RNA, 23 nt, Shigella flexneri 2a str. 2457T
ggcuucaucccgguuauuaaaac

SEQ ID NO: 3822226 - RNA, 22 nt, Shigella flexneri 2a str. 2457T
ggcuucaucuuuccaaaccuca

SEQ ID NO: 3822227 - RNA, 23 nt, Shigella flexneri 2a str. 2457T
ggcuucccgcguuaagacacacu

SEQ ID NO: 3822228 - RNA, 18 nt, Shigella flexneri 2a str. 2457T
ggcuucgacgauugcuuu

SEQ ID NO: 3822229 - RNA, 22 nt, Shigella flexneri 2a str. 2457T
ggcuucgccaaaucgcugcugc

SEQ ID NO: 3822230 - RNA, 15 nt, Shigella flexneri 2a str. 2457T
ggcuucguccaugcu

SEQ ID NO: 3822231 - RNA, 22 nt, Shigella flexneri 2a str. 2457T
gggguuuucucuuuccagcaac

SEQ ID NO: 3822232 - RNA, 12 nt, Shigella flexneri 2a str. 2457T
ggguaaaaggau

SEQ ID NO: 3822233 - RNA, 13 nt, Shigella flexneri 2a str. 2457T
ggguaagcgccac

SEQ ID NO: 3822234 - RNA, 15 nt, Shigella flexneri 2a str. 2457T
ggguaauuucauuaa

SEQ ID NO: 3822235 - RNA, 15 nt, Shigella flexneri 2a str. 2457T
ggguacgacuuccug

SEQ ID NO: 3822236 - RNA, 21 nt, Shigella flexneri 2a str. 2457T
gggucaccgccgauaccgaca

SEQ ID NO: 3822237 - RNA, 13 nt, Shigella flexneri 2a str. 2457T
gggucaguaugga

SEQ ID NO: 3822238 - RNA, 21 nt, Shigella flexneri 2a str. 2457T
gggucauccaggaacuccaga

SEQ ID NO: 3822239 - RNA, 17 nt, Shigella flexneri 2a str. 2457T
gggucgccagaagguga

SEQ ID NO: 3822240 - RNA, 16 nt, Shigella flexneri 2a str. 2457T
gggugauuaaagaaaa

SEQ ID NO: 3822241 - RNA, 15 nt, Shigella flexneri 2a str. 2457T
gggugcaaucaacac

SEQ ID NO: 3822242 - RNA, 21 nt, Shigella flexneri 2a str. 2457T
gggugcaaucaacaccacugc

SEQ ID NO: 3822243 - RNA, 23 nt, Shigella flexneri 2a str. 2457T
gggugcaaucaacaccacugcca

SEQ ID NO: 3822244 - RNA, 15 nt, Shigella flexneri 2a str. 2457T
ggguguuaagcgcag

SEQ ID NO: 3822245 - RNA, 15 nt, Shigella flexneri 2a str. 2457T
ggguuagucugcauu

SEQ ID NO: 3822246 - RNA, 19 nt, Shigella flexneri 2a str. 2457T
ggguuagucugcauuuucu

SEQ ID NO: 3822247 - RNA, 17 nt, Shigella flexneri 2a str. 2457T
ggguucaccgcgagcau

SEQ ID NO: 3822248 - RNA, 13 nt, Shigella flexneri 2a str. 2457T
ggguucagcauug

SEQ ID NO: 3822249 - RNA, 17 nt, Shigella flexneri 2a str. 2457T
ggguucgacgcgguuga

SEQ ID NO: 3822250 - RNA, 17 nt, Shigella flexneri 2a str. 2457T
ggguugccaccgguaca

SEQ ID NO: 3822251 - RNA, 16 nt, Shigella flexneri 2a str. 2457T
gguaaaaccaugccau

SEQ ID NO: 3822252 - RNA, 18 nt, Shigella flexneri 2a str. 2457T
gguaaaaccgacuuaaaa

SEQ ID NO: 3822253 - RNA, 21 nt, Shigella flexneri 2a str. 2457T
gguaaaaccugacaacaaaac

SEQ ID NO: 3822254 - RNA, 12 nt, Shigella flexneri 2a str. 2457T
gguaaacaacau

SEQ ID NO: 3822255 - RNA, 17 nt, Shigella flexneri 2a str. 2457T
gguaaacaacaugcuau

SEQ ID NO: 3822256 - RNA, 20 nt, Shigella flexneri 2a str. 2457T
gguaaacaccuucauccagc

SEQ ID NO: 3822257 - RNA, 22 nt, Shigella flexneri 2a str. 2457T
gguaaagaagagcggcaaacgu

SEQ ID NO: 3822258 - RNA, 15 nt, Shigella flexneri 2a str. 2457T
gguaaagcccucacc

SEQ ID NO: 3822259 - RNA, 16 nt, Shigella flexneri 2a str. 2457T
gguaaaugcaucgccg

SEQ ID NO: 3822260 - RNA, 11 nt, Shigella flexneri 2a str. 2457T
gguaaauuguu

SEQ ID NO: 3822261 - RNA, 14 nt, Shigella flexneri 2a str. 2457T
gguaaccgccagua

SEQ ID NO: 3822262 - RNA, 15 nt, Shigella flexneri 2a str. 2457T
gguaaccgccaguaa

SEQ ID NO: 3822263 - RNA, 20 nt, Shigella flexneri 2a str. 2457T
gguaacgucgguuucaucac

SEQ ID NO: 3822264 - RNA, 17 nt, Shigella flexneri 2a str. 2457T
gguaacuuaucuguaau

SEQ ID NO: 3822265 - RNA, 22 nt, Shigella flexneri 2a str. 2457T
gguaagaucuuuguuucgguau

SEQ ID NO: 3822266 - RNA, 23 nt, Shigella flexneri 2a str. 2457T
gguaagcgccacaaucgcuucau

SEQ ID NO: 3822267 - RNA, 13 nt, Shigella flexneri 2a str. 2457T
gguaaggauaaaa

SEQ ID NO: 3822268 - RNA, 20 nt, Shigella flexneri 2a str. 2457T
gguaaguacgccaucacgca

SEQ ID NO: 3822269 - RNA, 12 nt, Shigella flexneri 2a str. 2457T
gguaagugccac

SEQ ID NO: 3822270 - RNA, 21 nt, Shigella flexneri 2a str. 2457T
gguaaguucacgcagguuaga

SEQ ID NO: 3822271 - RNA, 17 nt, Shigella flexneri 2a str. 2457T
gguaauaaugcagaucu

SEQ ID NO: 3822272 - RNA, 15 nt, Shigella flexneri 2a str. 2457T
gguaauaggcaggca

SEQ ID NO: 3822273 - RNA, 23 nt, Shigella flexneri 2a str. 2457T
gguaaucacgcauggacacugcc

SEQ ID NO: 3822274 - RNA, 21 nt, Shigella flexneri 2a str. 2457T
gguaaugacuccaacuuacug

SEQ ID NO: 3822275 - RNA, 16 nt, Shigella flexneri 2a str. 2457T
gguaauggcaauacug

SEQ ID NO: 3822276 - RNA, 12 nt, Shigella flexneri 2a str. 2457T
gguaauggucag

SEQ ID NO: 3822277 - RNA, 17 nt, Shigella flexneri 2a str. 2457T
gguaauuaagauucagc

SEQ ID NO: 3822278 - RNA, 11 nt, Shigella flexneri 2a str. 2457T
gguaauucccu

SEQ ID NO: 3822279 - RNA, 17 nt, Shigella flexneri 2a str. 2457T
gguaauuugaucaaaua

SEQ ID NO: 3822280 - RNA, 21 nt, Shigella flexneri 2a str. 2457T
gguacaaagccaacagcagcc

SEQ ID NO: 3822281 - RNA, 16 nt, Shigella flexneri 2a str. 2457T
gguaccagaaucaccu

SEQ ID NO: 3822282 - RNA, 13 nt, Shigella flexneri 2a str. 2457T
gguaccagcaccg

SEQ ID NO: 3822283 - RNA, 19 nt, Shigella flexneri 2a str. 2457T
gguaccuuugaacugcuga

SEQ ID NO: 3822284 - RNA, 15 nt, Shigella flexneri 2a str. 2457T
gguacgaauacggau

SEQ ID NO: 3822285 - RNA, 17 nt, Shigella flexneri 2a str. 2457T
gguacgacuuccuggcu

SEQ ID NO: 3822286 - RNA, 18 nt, Shigella flexneri 2a str. 2457T
gguacuaucagcguaaag

SEQ ID NO: 3822287 - RNA, 16 nt, Shigella flexneri 2a str. 2457T
gguacuucaaucgcca

SEQ ID NO: 3822288 - RNA, 16 nt, Shigella flexneri 2a str. 2457T
gguacuuucacaggga

SEQ ID NO: 3822289 - RNA, 15 nt, Shigella flexneri 2a str. 2457T
gguagaacccuacca

SEQ ID NO: 3822290 - RNA, 22 nt, Shigella flexneri 2a str. 2457T
gguagacaccaaggaacugugc

SEQ ID NO: 3822291 - RNA, 15 nt, Shigella flexneri 2a str. 2457T
gguagagaaguuuga

SEQ ID NO: 3822292 - RNA, 21 nt, Shigella flexneri 2a str. 2457T
gguagagcagcgcauucguaa

SEQ ID NO: 3822293 - RNA, 20 nt, Shigella flexneri 2a str. 2457T
gguagcaaaacaauuuggug

SEQ ID NO: 3822294 - RNA, 19 nt, Shigella flexneri 2a str. 2457T
gguagcgaugacagucugg

SEQ ID NO: 3822295 - RNA, 20 nt, Shigella flexneri 2a str. 2457T
gguagcgaugacagucugga

SEQ ID NO: 3822296 - RNA, 22 nt, Shigella flexneri 2a str. 2457T
gguagcugcccccgcucuucca

SEQ ID NO: 3822297 - RNA, 15 nt, Shigella flexneri 2a str. 2457T
gguaggccugauaag

SEQ ID NO: 3822298 - RNA, 15 nt, Shigella flexneri 2a str. 2457T
gguaguccaugacca

SEQ ID NO: 3822299 - RNA, 19 nt, Shigella flexneri 2a str. 2457T
gguagugaugcgcauuaug

SEQ ID NO: 3822300 - RNA, 20 nt, Shigella flexneri 2a str. 2457T
gguagugaugcgcauuaugg

SEQ ID NO: 3822301 - RNA, 13 nt, Shigella flexneri 2a str. 2457T
gguaguuucuccc

SEQ ID NO: 3822302 - RNA, 18 nt, Shigella flexneri 2a str. 2457T
gguauaccgaaaucgcca

SEQ ID NO: 3822303 - RNA, 15 nt, Shigella flexneri 2a str. 2457T
gguauacgucccggu

SEQ ID NO: 3822304 - RNA, 15 nt, Shigella flexneri 2a str. 2457T
gguauagaucagacg

SEQ ID NO: 3822305 - RNA, 13 nt, Shigella flexneri 2a str. 2457T
gguauauaacgca

SEQ ID NO: 3822306 - RNA, 13 nt, Shigella flexneri 2a str. 2457T
gguaucaaacaca

SEQ ID NO: 3822307 - RNA, 17 nt, Shigella flexneri 2a str. 2457T
gguauccagacggcgcu

SEQ ID NO: 3822308 - RNA, 17 nt, Shigella flexneri 2a str. 2457T
gguaucgcacagaugcg

SEQ ID NO: 3822309 - RNA, 18 nt, Shigella flexneri 2a str. 2457T
gguaucgggcaguuuacc

SEQ ID NO: 3822310 - RNA, 22 nt, Shigella flexneri 2a str. 2457T
gguaucguaaccuugauccugc

SEQ ID NO: 3822311 - RNA, 21 nt, Shigella flexneri 2a str. 2457T
gguaucuucccagccaaugca

SEQ ID NO: 3822312 - RNA, 21 nt, Shigella flexneri 2a str. 2457T
gguaucuuuaaucgagauacg

SEQ ID NO: 3822313 - RNA, 20 nt, Shigella flexneri 2a str. 2457T
gguaugcuuccuaacauaau

SEQ ID NO: 3822314 - RNA, 18 nt, Shigella flexneri 2a str. 2457T
gguauggucacggugagg

SEQ ID NO: 3822315 - RNA, 13 nt, Shigella flexneri 2a str. 2457T
gguauuggugaaa

SEQ ID NO: 3822316 - RNA, 16 nt, Shigella flexneri 2a str. 2457T
gguauuuucugaaacg

SEQ ID NO: 3822317 - RNA, 12 nt, Shigella flexneri 2a str. 2457T
gguauuuuucua

SEQ ID NO: 3822318 - RNA, 19 nt, Shigella flexneri 2a str. 2457T
ggucaaaaaaugaaacugg

SEQ ID NO: 3822319 - RNA, 21 nt, Shigella flexneri 2a str. 2457T
ggucaaaauccauuuucuauu

SEQ ID NO: 3822320 - RNA, 22 nt, Shigella flexneri 2a str. 2457T
ggucaaaugaccgggcuuuccg

SEQ ID NO: 3822321 - RNA, 16 nt, Shigella flexneri 2a str. 2457T
ggucaacgucaacuuu

SEQ ID NO: 3822322 - RNA, 23 nt, Shigella flexneri 2a str. 2457T
ggucaaguaauuaucuuuacuga

SEQ ID NO: 3822323 - RNA, 22 nt, Shigella flexneri 2a str. 2457T
ggucaauuccuucugggcgcgg

SEQ ID NO: 3822324 - RNA, 22 nt, Shigella flexneri 2a str. 2457T
ggucacggcuguagccagcucg

SEQ ID NO: 3822325 - RNA, 17 nt, Shigella flexneri 2a str. 2457T
ggucacugacaccagca

SEQ ID NO: 3822326 - RNA, 16 nt, Shigella flexneri 2a str. 2457T
ggucagacaacuuccc

SEQ ID NO: 3822327 - RNA, 13 nt, Shigella flexneri 2a str. 2457T
ggucagacccagu

SEQ ID NO: 3822328 - RNA, 10 nt, Shigella flexneri 2a str. 2457T
ggucagagaa

SEQ ID NO: 3822329 - RNA, 13 nt, Shigella flexneri 2a str. 2457T
ggucagagaaucg

SEQ ID NO: 3822330 - RNA, 16 nt, Shigella flexneri 2a str. 2457T
ggucagauuucaaucu

SEQ ID NO: 3822331 - RNA, 21 nt, Shigella flexneri 2a str. 2457T
ggucagcaggagcagccccug

SEQ ID NO: 3822332 - RNA, 22 nt, Shigella flexneri 2a str. 2457T
ggucagcaggagcagccccugc

SEQ ID NO: 3822333 - RNA, 14 nt, Shigella flexneri 2a str. 2457T
ggucagcaucguca

SEQ ID NO: 3822334 - RNA, 14 nt, Shigella flexneri 2a str. 2457T
ggucagccagcggc

SEQ ID NO: 3822335 - RNA, 17 nt, Shigella flexneri 2a str. 2457T
ggucagcgccagcgugu

SEQ ID NO: 3822336 - RNA, 14 nt, Shigella flexneri 2a str. 2457T
ggucagcggccagu

SEQ ID NO: 3822337 - RNA, 16 nt, Shigella flexneri 2a str. 2457T
ggucaggcuaaagaaa

SEQ ID NO: 3822338 - RNA, 18 nt, Shigella flexneri 2a str. 2457T
ggucaguaaugagcacag

SEQ ID NO: 3822339 - RNA, 17 nt, Shigella flexneri 2a str. 2457T
ggucaguugccagacgg

SEQ ID NO: 3822340 - RNA, 16 nt, Shigella flexneri 2a str. 2457T
ggucauaggccgcuga

SEQ ID NO: 3822341 - RNA, 20 nt, Shigella flexneri 2a str. 2457T
ggucaucaaucauuuuuuga

SEQ ID NO: 3822342 - RNA, 10 nt, Shigella flexneri 2a str. 2457T
ggucaucaca

SEQ ID NO: 3822343 - RNA, 20 nt, Shigella flexneri 2a str. 2457T
ggucaucacaucccagcaga

SEQ ID NO: 3822344 - RNA, 18 nt, Shigella flexneri 2a str. 2457T
ggucauuaugaccguuca

SEQ ID NO: 3822345 - RNA, 14 nt, Shigella flexneri 2a str. 2457T
ggucauuuucuuca

SEQ ID NO: 3822346 - RNA, 20 nt, Shigella flexneri 2a str. 2457T
ggucauuuucuucagcaguu

SEQ ID NO: 3822347 - RNA, 18 nt, Shigella flexneri 2a str. 2457T
gguccccucgcuccucug

SEQ ID NO: 3822348 - RNA, 19 nt, Shigella flexneri 2a str. 2457T
ggucccucaacaacagucu

SEQ ID NO: 3822349 - RNA, 19 nt, Shigella flexneri 2a str. 2457T
gguccuaacaaccaucccc

SEQ ID NO: 3822350 - RNA, 20 nt, Shigella flexneri 2a str. 2457T
gguccuaacaaccaucccca

SEQ ID NO: 3822351 - RNA, 12 nt, Shigella flexneri 2a str. 2457T
gguccuucaggc

SEQ ID NO: 3822352 - RNA, 12 nt, Shigella flexneri 2a str. 2457T
gguccuuuugcc

SEQ ID NO: 3822353 - RNA, 17 nt, Shigella flexneri 2a str. 2457T
ggucgaaauaauguuuc

SEQ ID NO: 3822354 - RNA, 14 nt, Shigella flexneri 2a str. 2457T
ggucgacagcagcc

SEQ ID NO: 3822355 - RNA, 17 nt, Shigella flexneri 2a str. 2457T
ggucgaugcgcucgcca

SEQ ID NO: 3822356 - RNA, 18 nt, Shigella flexneri 2a str. 2457T
ggucgcacugcucuuuuu

SEQ ID NO: 3822357 - RNA, 17 nt, Shigella flexneri 2a str. 2457T
ggucggcaaacugcuga

SEQ ID NO: 3822358 - RNA, 22 nt, Shigella flexneri 2a str. 2457T
ggucgucaaaaaacuucuucac

SEQ ID NO: 3822359 - RNA, 16 nt, Shigella flexneri 2a str. 2457T
ggucgucuuuuacagc

SEQ ID NO: 3822360 - RNA, 13 nt, Shigella flexneri 2a str. 2457T
ggucgugcagaac

SEQ ID NO: 3822361 - RNA, 22 nt, Shigella flexneri 2a str. 2457T
ggucguucgcccauuccaguaa

SEQ ID NO: 3822362 - RNA, 13 nt, Shigella flexneri 2a str. 2457T
ggucugcaaaaug

SEQ ID NO: 3822363 - RNA, 18 nt, Shigella flexneri 2a str. 2457T
ggucugcaugacggcuga

SEQ ID NO: 3822364 - RNA, 17 nt, Shigella flexneri 2a str. 2457T
ggucugccaacuuugcc

SEQ ID NO: 3822365 - RNA, 17 nt, Shigella flexneri 2a str. 2457T
ggucuggaacuggcugc

SEQ ID NO: 3822366 - RNA, 18 nt, Shigella flexneri 2a str. 2457T
ggucuggcaaaaauaagg

SEQ ID NO: 3822367 - RNA, 23 nt, Shigella flexneri 2a str. 2457T
ggucuguaccaccagaaucgcca

SEQ ID NO: 3822368 - RNA, 21 nt, Shigella flexneri 2a str. 2457T
ggucuuacuggggaaguggcg

SEQ ID NO: 3822369 - RNA, 12 nt, Shigella flexneri 2a str. 2457T
ggugaaaaaaag

SEQ ID NO: 3822370 - RNA, 17 nt, Shigella flexneri 2a str. 2457T
ggugaaaguaaaaaaga

SEQ ID NO: 3822371 - RNA, 18 nt, Shigella flexneri 2a str. 2457T
ggugaaaguaaaaaagaa

SEQ ID NO: 3822372 - RNA, 18 nt, Shigella flexneri 2a str. 2457T
ggugaaaguaacaaagcc

SEQ ID NO: 3822373 - RNA, 13 nt, Shigella flexneri 2a str. 2457T
ggugaaccagaga

SEQ ID NO: 3822374 - RNA, 20 nt, Shigella flexneri 2a str. 2457T
ggugaacucacacagcgagu

SEQ ID NO: 3822375 - RNA, 18 nt, Shigella flexneri 2a str. 2457T
ggugaagcgcccugcaau

SEQ ID NO: 3822376 - RNA, 16 nt, Shigella flexneri 2a str. 2457T
ggugaaggcaaacugu

SEQ ID NO: 3822377 - RNA, 22 nt, Shigella flexneri 2a str. 2457T
ggugaagguaaguuguugauaa

SEQ ID NO: 3822378 - RNA, 17 nt, Shigella flexneri 2a str. 2457T
ggugacaaagugccugu

SEQ ID NO: 3822379 - RNA, 21 nt, Shigella flexneri 2a str. 2457T
ggugacaaucaccaggucacc

SEQ ID NO: 3822380 - RNA, 14 nt, Shigella flexneri 2a str. 2457T
ggugacgcauuuua

SEQ ID NO: 3822381 - RNA, 17 nt, Shigella flexneri 2a str. 2457T
ggugacgcgggcagcag

SEQ ID NO: 3822382 - RNA, 15 nt, Shigella flexneri 2a str. 2457T
ggugagcgaugcugc

SEQ ID NO: 3822383 - RNA, 14 nt, Shigella flexneri 2a str. 2457T
ggugagcgugcggu

SEQ ID NO: 3822384 - RNA, 16 nt, Shigella flexneri 2a str. 2457T
ggugaggccagagcag

SEQ ID NO: 3822385 - RNA, 21 nt, Shigella flexneri 2a str. 2457T
ggugaguuguaucgcucggca

SEQ ID NO: 3822386 - RNA, 20 nt, Shigella flexneri 2a str. 2457T
ggugauaaucaucccacaug

SEQ ID NO: 3822387 - RNA, 23 nt, Shigella flexneri 2a str. 2457T
ggugauaaucaucccacaugaau

SEQ ID NO: 3822388 - RNA, 17 nt, Shigella flexneri 2a str. 2457T
ggugauacugaucguca

SEQ ID NO: 3822389 - RNA, 13 nt, Shigella flexneri 2a str. 2457T
ggugaucacccag

SEQ ID NO: 3822390 - RNA, 14 nt, Shigella flexneri 2a str. 2457T
ggugaugguuucau

SEQ ID NO: 3822391 - RNA, 15 nt, Shigella flexneri 2a str. 2457T
ggugauguauaucgg

SEQ ID NO: 3822392 - RNA, 19 nt, Shigella flexneri 2a str. 2457T
ggugauguuuaucgucugg

SEQ ID NO: 3822393 - RNA, 20 nt, Shigella flexneri 2a str. 2457T
ggugauuaucggcauagcca

SEQ ID NO: 3822394 - RNA, 23 nt, Shigella flexneri 2a str. 2457T
ggugauuuugccugugcaaccuu

SEQ ID NO: 3822395 - RNA, 12 nt, Shigella flexneri 2a str. 2457T
ggugcaaucaaa

SEQ ID NO: 3822396 - RNA, 15 nt, Shigella flexneri 2a str. 2457T
ggugcagaaucaauc

SEQ ID NO: 3822397 - RNA, 12 nt, Shigella flexneri 2a str. 2457T
ggugcagccgug

SEQ ID NO: 3822398 - RNA, 22 nt, Shigella flexneri 2a str. 2457T
ggugcaucggggaauugugcuu

SEQ ID NO: 3822399 - RNA, 17 nt, Shigella flexneri 2a str. 2457T
ggugccagcaacuggcg

SEQ ID NO: 3822400 - RNA, 20 nt, Shigella flexneri 2a str. 2457T
ggugccgccacgaaacugcu

SEQ ID NO: 3822401 - RNA, 13 nt, Shigella flexneri 2a str. 2457T
ggugccgcgcagc

SEQ ID NO: 3822402 - RNA, 19 nt, Shigella flexneri 2a str. 2457T
ggugccuuauccgacauuu

SEQ ID NO: 3822403 - RNA, 20 nt, Shigella flexneri 2a str. 2457T
ggugcgacaaacauugcugc

SEQ ID NO: 3822404 - RNA, 17 nt, Shigella flexneri 2a str. 2457T
ggugcgaccaaacugcu

SEQ ID NO: 3822405 - RNA, 15 nt, Shigella flexneri 2a str. 2457T
ggugcuguugccaaa

SEQ ID NO: 3822406 - RNA, 13 nt, Shigella flexneri 2a str. 2457T
gguggcgaccgga

SEQ ID NO: 3822407 - RNA, 12 nt, Shigella flexneri 2a str. 2457T
ggugggcggcgu

SEQ ID NO: 3822408 - RNA, 16 nt, Shigella flexneri 2a str. 2457T
ggugggcuacggcaug

SEQ ID NO: 3822409 - RNA, 17 nt, Shigella flexneri 2a str. 2457T
ggugguuuggcggcggc

SEQ ID NO: 3822410 - RNA, 21 nt, Shigella flexneri 2a str. 2457T
gguguaaugccagucaguuaa

SEQ ID NO: 3822411 - RNA, 17 nt, Shigella flexneri 2a str. 2457T
gguguacucaucgcccg

SEQ ID NO: 3822412 - RNA, 18 nt, Shigella flexneri 2a str. 2457T
gguguacugcaacucgcg

SEQ ID NO: 3822413 - RNA, 13 nt, Shigella flexneri 2a str. 2457T
ggugucacggugu

SEQ ID NO: 3822414 - RNA, 17 nt, Shigella flexneri 2a str. 2457T
gguguggcauggcgaau

SEQ ID NO: 3822415 - RNA, 21 nt, Shigella flexneri 2a str. 2457T
gguguuacccgcuaacuggug

SEQ ID NO: 3822416 - RNA, 17 nt, Shigella flexneri 2a str. 2457T
gguuaaccuuuaaucag

SEQ ID NO: 3822417 - RNA, 19 nt, Shigella flexneri 2a str. 2457T
gguuaauaccgagcguuca

SEQ ID NO: 3822418 - RNA, 19 nt, Shigella flexneri 2a str. 2457T
gguuaccaccugcucguca

SEQ ID NO: 3822419 - RNA, 20 nt, Shigella flexneri 2a str. 2457T
gguuacgcaccagauaagca

SEQ ID NO: 3822420 - RNA, 19 nt, Shigella flexneri 2a str. 2457T
gguuagaauaccugccugu

SEQ ID NO: 3822421 - RNA, 11 nt, Shigella flexneri 2a str. 2457T
gguuagccugu

SEQ ID NO: 3822422 - RNA, 19 nt, Shigella flexneri 2a str. 2457T
gguuaggcugugaaccgca

SEQ ID NO: 3822423 - RNA, 22 nt, Shigella flexneri 2a str. 2457T
gguuaguaugaagaacaaguuc

SEQ ID NO: 3822424 - RNA, 17 nt, Shigella flexneri 2a str. 2457T
gguuagucugcauuuuc

SEQ ID NO: 3822425 - RNA, 16 nt, Shigella flexneri 2a str. 2457T
gguuauccagcaacca

SEQ ID NO: 3822426 - RNA, 18 nt, Shigella flexneri 2a str. 2457T
gguuauccgccagcgcca

SEQ ID NO: 3822427 - RNA, 14 nt, Shigella flexneri 2a str. 2457T
guaacauuacgugg

SEQ ID NO: 3822428 - RNA, 23 nt, Shigella flexneri 2a str. 2457T
guaaccaaacguggucgccagca

SEQ ID NO: 3822429 - RNA, 16 nt, Shigella flexneri 2a str. 2457T
guaaccaaaucuccag

SEQ ID NO: 3822430 - RNA, 14 nt, Shigella flexneri 2a str. 2457T
guaaccacggcagc

SEQ ID NO: 3822431 - RNA, 22 nt, Shigella flexneri 2a str. 2457T
guaaccagcgcagacaccagaa

SEQ ID NO: 3822432 - RNA, 18 nt, Shigella flexneri 2a str. 2457T
guaacccaccaugccgau

SEQ ID NO: 3822433 - RNA, 18 nt, Shigella flexneri 2a str. 2457T
guaaccguugaccagcau

SEQ ID NO: 3822434 - RNA, 12 nt, Shigella flexneri 2a str. 2457T
guaaccuucacc

SEQ ID NO: 3822435 - RNA, 16 nt, Shigella flexneri 2a str. 2457T
guaacgaccaccaccg

SEQ ID NO: 3822436 - RNA, 13 nt, Shigella flexneri 2a str. 2457T
guaacgacugcgg

SEQ ID NO: 3822437 - RNA, 18 nt, Shigella flexneri 2a str. 2457T
guaacgagacaaugcaaa

SEQ ID NO: 3822438 - RNA, 18 nt, Shigella flexneri 2a str. 2457T
guaacgcacugguggugc

SEQ ID NO: 3822439 - RNA, 22 nt, Shigella flexneri 2a str. 2457T
guaacgccagcggucauaacgc

SEQ ID NO: 3822440 - RNA, 16 nt, Shigella flexneri 2a str. 2457T
guaacgcuugcugaua

SEQ ID NO: 3822441 - RNA, 22 nt, Shigella flexneri 2a str. 2457T
guaacguuugauuaacgccaga

SEQ ID NO: 3822442 - RNA, 16 nt, Shigella flexneri 2a str. 2457T
guaacucacugaugcc

SEQ ID NO: 3822443 - RNA, 20 nt, Shigella flexneri 2a str. 2457T
guaacucacugaugccguuu

SEQ ID NO: 3822444 - RNA, 15 nt, Shigella flexneri 2a str. 2457T
guaacugaagcauug

SEQ ID NO: 3822445 - RNA, 16 nt, Shigella flexneri 2a str. 2457T
guaacugagcggccag

SEQ ID NO: 3822446 - RNA, 17 nt, Shigella flexneri 2a str. 2457T
guaacuuaucuguaauu

SEQ ID NO: 3822447 - RNA, 15 nt, Shigella flexneri 2a str. 2457T
guaagagaacagaua

SEQ ID NO: 3822448 - RNA, 21 nt, Shigella flexneri 2a str. 2457T
guaagaguuucaacaucaucu

SEQ ID NO: 3822449 - RNA, 23 nt, Shigella flexneri 2a str. 2457T
guaagcgauaaaaauaccgagca

SEQ ID NO: 3822450 - RNA, 14 nt, Shigella flexneri 2a str. 2457T
guaagcgauaacgc

SEQ ID NO: 3822451 - RNA, 15 nt, Shigella flexneri 2a str. 2457T
guaagcgccagggca

SEQ ID NO: 3822452 - RNA, 16 nt, Shigella flexneri 2a str. 2457T
guaagcgccagggcau

SEQ ID NO: 3822453 - RNA, 21 nt, Shigella flexneri 2a str. 2457T
guaagcgcggauuuuauucag

SEQ ID NO: 3822454 - RNA, 17 nt, Shigella flexneri 2a str. 2457T
guaaggcaucuucuuca

SEQ ID NO: 3822455 - RNA, 13 nt, Shigella flexneri 2a str. 2457T
guaaggucaucaa

SEQ ID NO: 3822456 - RNA, 14 nt, Shigella flexneri 2a str. 2457T
guaaguaagauaaa

SEQ ID NO: 3822457 - RNA, 22 nt, Shigella flexneri 2a str. 2457T
guaaguacauuaaaauuggcuu

SEQ ID NO: 3822458 - RNA, 13 nt, Shigella flexneri 2a str. 2457T
guaaguacgccau

SEQ ID NO: 3822459 - RNA, 18 nt, Shigella flexneri 2a str. 2457T
guaaguacgccaucacgc

SEQ ID NO: 3822460 - RNA, 22 nt, Shigella flexneri 2a str. 2457T
guaaguuacauuuuaauaauga

SEQ ID NO: 3822461 - RNA, 13 nt, Shigella flexneri 2a str. 2457T
guaaguuuaaccu

SEQ ID NO: 3822462 - RNA, 19 nt, Shigella flexneri 2a str. 2457T
guaauaaaaucuauuauua

SEQ ID NO: 3822463 - RNA, 19 nt, Shigella flexneri 2a str. 2457T
guaauaaagcccccuguuu

SEQ ID NO: 3822464 - RNA, 15 nt, Shigella flexneri 2a str. 2457T
guaauaacaauacau

SEQ ID NO: 3822465 - RNA, 21 nt, Shigella flexneri 2a str. 2457T
guaauaacaauacaucuuuuc

SEQ ID NO: 3822466 - RNA, 22 nt, Shigella flexneri 2a str. 2457T
guaauaacaauacaucuuuuca

SEQ ID NO: 3822467 - RNA, 15 nt, Shigella flexneri 2a str. 2457T
guaauaacuuccuga

SEQ ID NO: 3822468 - RNA, 18 nt, Shigella flexneri 2a str. 2457T
guaauaaugcccaucgug

SEQ ID NO: 3822469 - RNA, 17 nt, Shigella flexneri 2a str. 2457T
guaauaauuacuuacau

SEQ ID NO: 3822470 - RNA, 16 nt, Shigella flexneri 2a str. 2457T
guaauacggcucucac

SEQ ID NO: 3822471 - RNA, 20 nt, Shigella flexneri 2a str. 2457T
guaauagauccuuuuuccca

SEQ ID NO: 3822472 - RNA, 20 nt, Shigella flexneri 2a str. 2457T
guaauaggcaggcaucauca

SEQ ID NO: 3822473 - RNA, 20 nt, Shigella flexneri 2a str. 2457T
guaaucaacauauuccccug

SEQ ID NO: 3822474 - RNA, 13 nt, Shigella flexneri 2a str. 2457T
guaaucaccaccc

SEQ ID NO: 3822475 - RNA, 18 nt, Shigella flexneri 2a str. 2457T
guaaucaccacccauuuu

SEQ ID NO: 3822476 - RNA, 14 nt, Shigella flexneri 2a str. 2457T
guaaucauauuaaa

SEQ ID NO: 3822477 - RNA, 15 nt, Shigella flexneri 2a str. 2457T
guaaucauauuaaau

SEQ ID NO: 3822478 - RNA, 23 nt, Shigella flexneri 2a str. 2457T
guaauccgggugaacugccacac

SEQ ID NO: 3822479 - RNA, 21 nt, Shigella flexneri 2a str. 2457T
guaauccucuuugcuuccuga

SEQ ID NO: 3822480 - RNA, 23 nt, Shigella flexneri 2a str. 2457T
guaauccucuuugcuuccugagu

SEQ ID NO: 3822481 - RNA, 12 nt, Shigella flexneri 2a str. 2457T
guaauccugaaa

SEQ ID NO: 3822482 - RNA, 19 nt, Shigella flexneri 2a str. 2457T
guaauccuucccccaccac

SEQ ID NO: 3822483 - RNA, 14 nt, Shigella flexneri 2a str. 2457T
guaaucgccagcaa

SEQ ID NO: 3822484 - RNA, 19 nt, Shigella flexneri 2a str. 2457T
guaaucgccagcaaaauca

SEQ ID NO: 3822485 - RNA, 17 nt, Shigella flexneri 2a str. 2457T
guaaucggcgaaaccgc

SEQ ID NO: 3822486 - RNA, 17 nt, Shigella flexneri 2a str. 2457T
guaaucguauucaacgg

SEQ ID NO: 3822487 - RNA, 21 nt, Shigella flexneri 2a str. 2457T
guaaugaacuccggagaguau

SEQ ID NO: 3822488 - RNA, 11 nt, Shigella flexneri 2a str. 2457T
guaaugagaac

SEQ ID NO: 3822489 - RNA, 14 nt, Shigella flexneri 2a str. 2457T
guaaugauacuaua

SEQ ID NO: 3822490 - RNA, 14 nt, Shigella flexneri 2a str. 2457T
guaaugauguaaaa

SEQ ID NO: 3822491 - RNA, 22 nt, Shigella flexneri 2a str. 2457T
guaaugccagucaguuaagcaa

SEQ ID NO: 3822492 - RNA, 22 nt, Shigella flexneri 2a str. 2457T
guaaugccguuuuggguguaca

SEQ ID NO: 3822493 - RNA, 21 nt, Shigella flexneri 2a str. 2457T
guaaugccugggcgauuuccu

SEQ ID NO: 3822494 - RNA, 17 nt, Shigella flexneri 2a str. 2457T
guaaugcgguauccaac

SEQ ID NO: 3822495 - RNA, 23 nt, Shigella flexneri 2a str. 2457T
guaaugcggucguaaucgcccgc

SEQ ID NO: 3822496 - RNA, 22 nt, Shigella flexneri 2a str. 2457T
guaaugcucgacgagaauuucc

SEQ ID NO: 3822497 - RNA, 12 nt, Shigella flexneri 2a str. 2457T
guaauggucagu

SEQ ID NO: 3822498 - RNA, 13 nt, Shigella flexneri 2a str. 2457T
guaauucagccau

SEQ ID NO: 3822499 - RNA, 15 nt, Shigella flexneri 2a str. 2457T
guaauugagaaccac

SEQ ID NO: 3822500 - RNA, 21 nt, Shigella flexneri 2a str. 2457T
guaauugagaaccacaaugaa

SEQ ID NO: 3822501 - RNA, 18 nt, Shigella flexneri 2a str. 2457T
guaauugaucucacaauc

SEQ ID NO: 3822502 - RNA, 18 nt, Shigella flexneri 2a str. 2457T
guaauuggccugacaggu

SEQ ID NO: 3822503 - RNA, 20 nt, Shigella flexneri 2a str. 2457T
guaauuggccugacagguga

SEQ ID NO: 3822504 - RNA, 14 nt, Shigella flexneri 2a str. 2457T
guaauuucacaagu

SEQ ID NO: 3822505 - RNA, 12 nt, Shigella flexneri 2a str. 2457T
guaauuuuuaua

SEQ ID NO: 3822506 - RNA, 13 nt, Shigella flexneri 2a str. 2457T
guacaaacaucau

SEQ ID NO: 3822507 - RNA, 17 nt, Shigella flexneri 2a str. 2457T
guacaaagccaacagca

SEQ ID NO: 3822508 - RNA, 20 nt, Shigella flexneri 2a str. 2457T
guacaaagccaacagcagcc

SEQ ID NO: 3822509 - RNA, 20 nt, Shigella flexneri 2a str. 2457T
guacaaauuuuaggcguuaa

SEQ ID NO: 3822510 - RNA, 18 nt, Shigella flexneri 2a str. 2457T
guacaaccgcaaagguug

SEQ ID NO: 3822511 - RNA, 13 nt, Shigella flexneri 2a str. 2457T
guacaacuuucuc

SEQ ID NO: 3822512 - RNA, 18 nt, Shigella flexneri 2a str. 2457T
guacaagaguaacccacg

SEQ ID NO: 3822513 - RNA, 14 nt, Shigella flexneri 2a str. 2457T
guacaccaacauca

SEQ ID NO: 3822514 - RNA, 14 nt, Shigella flexneri 2a str. 2457T
guacacuuuccugg

SEQ ID NO: 3822515 - RNA, 15 nt, Shigella flexneri 2a str. 2457T
guacacuuuccuggu

SEQ ID NO: 3822516 - RNA, 19 nt, Shigella flexneri 2a str. 2457T
guacagacagauaaaaugc

SEQ ID NO: 3822517 - RNA, 15 nt, Shigella flexneri 2a str. 2457T
guacagauccgccau

SEQ ID NO: 3822518 - RNA, 14 nt, Shigella flexneri 2a str. 2457T
guacagccgccaga

SEQ ID NO: 3822519 - RNA, 22 nt, Shigella flexneri 2a str. 2457T
guacagcggcagggaaaacuca

SEQ ID NO: 3822520 - RNA, 18 nt, Shigella flexneri 2a str. 2457T
guacaggauauauuucau

SEQ ID NO: 3822521 - RNA, 12 nt, Shigella flexneri 2a str. 2457T
guacaggcagcu

SEQ ID NO: 3822522 - RNA, 16 nt, Shigella flexneri 2a str. 2457T
guacaggcagcuuaga

SEQ ID NO: 3822523 - RNA, 22 nt, Shigella flexneri 2a str. 2457T
guacaggugccgcagccccaga

SEQ ID NO: 3822524 - RNA, 19 nt, Shigella flexneri 2a str. 2457T
guaggccugauaagcguag

SEQ ID NO: 3822525 - RNA, 22 nt, Shigella flexneri 2a str. 2457T
guaggcgcguuucugcgcuucu

SEQ ID NO: 3822526 - RNA, 18 nt, Shigella flexneri 2a str. 2457T
guaggcggauaaggcguu

SEQ ID NO: 3822527 - RNA, 17 nt, Shigella flexneri 2a str. 2457T
guaggcguccugcugaa

SEQ ID NO: 3822528 - RNA, 19 nt, Shigella flexneri 2a str. 2457T
guaggcuggauaaggcguu

SEQ ID NO: 3822529 - RNA, 11 nt, Shigella flexneri 2a str. 2457T
guagguuuugg

SEQ ID NO: 3822530 - RNA, 22 nt, Shigella flexneri 2a str. 2457T
guaguauuugaguucacugccg

SEQ ID NO: 3822531 - RNA, 15 nt, Shigella flexneri 2a str. 2457T
guagugaaggcaaac

SEQ ID NO: 3822532 - RNA, 18 nt, Shigella flexneri 2a str. 2457T
guagugauuuuaauaaau

SEQ ID NO: 3822533 - RNA, 15 nt, Shigella flexneri 2a str. 2457T
guagugccgucagca

SEQ ID NO: 3822534 - RNA, 16 nt, Shigella flexneri 2a str. 2457T
guaguggaucagcaaa

SEQ ID NO: 3822535 - RNA, 14 nt, Shigella flexneri 2a str. 2457T
guaguggccacaga

SEQ ID NO: 3822536 - RNA, 19 nt, Shigella flexneri 2a str. 2457T
guaguuaugaaaauaggaa

SEQ ID NO: 3822537 - RNA, 23 nt, Shigella flexneri 2a str. 2457T
guaguucuuucucugcaaauauu

SEQ ID NO: 3822538 - RNA, 16 nt, Shigella flexneri 2a str. 2457T
guaguugcccuuuuca

SEQ ID NO: 3822539 - RNA, 12 nt, Shigella flexneri 2a str. 2457T
guaguuucuccc

SEQ ID NO: 3822540 - RNA, 21 nt, Shigella flexneri 2a str. 2457T
guaguuuggugagaacaccaa

SEQ ID NO: 3822541 - RNA, 23 nt, Shigella flexneri 2a str. 2457T
guauaaacgugugugccagguuc

SEQ ID NO: 3822542 - RNA, 18 nt, Shigella flexneri 2a str. 2457T
guauaaacuauccugugc

SEQ ID NO: 3822543 - RNA, 23 nt, Shigella flexneri 2a str. 2457T
guauaaucaccaaucacaacuaa

SEQ ID NO: 3822544 - RNA, 16 nt, Shigella flexneri 2a str. 2457T
guauacaacauucagg

SEQ ID NO: 3822545 - RNA, 15 nt, Shigella flexneri 2a str. 2457T
guauacgccacauca

SEQ ID NO: 3822546 - RNA, 17 nt, Shigella flexneri 2a str. 2457T
guauacgggcuuuuuaa

SEQ ID NO: 3822547 - RNA, 20 nt, Shigella flexneri 2a str. 2457T
guauaguguccacaggaaaa

SEQ ID NO: 3822548 - RNA, 14 nt, Shigella flexneri 2a str. 2457T
guauauaaaaaaca

SEQ ID NO: 3822549 - RNA, 18 nt, Shigella flexneri 2a str. 2457T
guauauuucgaaugcuca

SEQ ID NO: 3822550 - RNA, 13 nt, Shigella flexneri 2a str. 2457T
guaucaaacacag

SEQ ID NO: 3822551 - RNA, 14 nt, Shigella flexneri 2a str. 2457T
guaucaaacccuuc

SEQ ID NO: 3822552 - RNA, 19 nt, Shigella flexneri 2a str. 2457T
guaucaagcccgccgggac

SEQ ID NO: 3822553 - RNA, 16 nt, Shigella flexneri 2a str. 2457T
guaucaccccgcccga

SEQ ID NO: 3822554 - RNA, 19 nt, Shigella flexneri 2a str. 2457T
guaucagcgucauuaccca

SEQ ID NO: 3822555 - RNA, 22 nt, Shigella flexneri 2a str. 2457T
guaucaggcugaaaaucuucuc

SEQ ID NO: 3822556 - RNA, 14 nt, Shigella flexneri 2a str. 2457T
guaucaggcugugu

SEQ ID NO: 3822557 - RNA, 16 nt, Shigella flexneri 2a str. 2457T
guaucaucauuauuaa

SEQ ID NO: 3822558 - RNA, 14 nt, Shigella flexneri 2a str. 2457T
guaucaucgcugaa

SEQ ID NO: 3822559 - RNA, 22 nt, Shigella flexneri 2a str. 2457T
guaucaugcaguaccagauaau

SEQ ID NO: 3822560 - RNA, 13 nt, Shigella flexneri 2a str. 2457T
guauccaugcgca

SEQ ID NO: 3822561 - RNA, 20 nt, Shigella flexneri 2a str. 2457T
guaucccaguucgauuuccc

SEQ ID NO: 3822562 - RNA, 18 nt, Shigella flexneri 2a str. 2457T
guauccguuuuacuggga

SEQ ID NO: 3822563 - RNA, 17 nt, Shigella flexneri 2a str. 2457T
guauccugucauacgcg

SEQ ID NO: 3822564 - RNA, 21 nt, Shigella flexneri 2a str. 2457T
guauccuguuuuuaagugaug

SEQ ID NO: 3822565 - RNA, 17 nt, Shigella flexneri 2a str. 2457T
guaucgaguggcgcagu

SEQ ID NO: 3822566 - RNA, 18 nt, Shigella flexneri 2a str. 2457T
guaucgcgaaaaaaagau

SEQ ID NO: 3822567 - RNA, 14 nt, Shigella flexneri 2a str. 2457T
guaucgcucggcag

SEQ ID NO: 3822568 - RNA, 15 nt, Shigella flexneri 2a str. 2457T
guaucguggcgcagc

SEQ ID NO: 3822569 - RNA, 18 nt, Shigella flexneri 2a str. 2457T
guaucuaccacugccuga

SEQ ID NO: 3822570 - RNA, 12 nt, Shigella flexneri 2a str. 2457T
guaucuauucac

SEQ ID NO: 3822571 - RNA, 12 nt, Shigella flexneri 2a str. 2457T
guaucuauucau

SEQ ID NO: 3822572 - RNA, 15 nt, Shigella flexneri 2a str. 2457T
guaucucguccaguu

SEQ ID NO: 3822573 - RNA, 17 nt, Shigella flexneri 2a str. 2457T
guaucuucaugcuccag

SEQ ID NO: 3822574 - RNA, 19 nt, Shigella flexneri 2a str. 2457T
guaucuucaugcuccagca

SEQ ID NO: 3822575 - RNA, 14 nt, Shigella flexneri 2a str. 2457T
guaucuugcgucac

SEQ ID NO: 3822576 - RNA, 19 nt, Shigella flexneri 2a str. 2457T
guaucuuuacagcgcuaac

SEQ ID NO: 3822577 - RNA, 12 nt, Shigella flexneri 2a str. 2457T
guaugccuggca

SEQ ID NO: 3822578 - RNA, 18 nt, Shigella flexneri 2a str. 2457T
guaugccuggcauuucug

SEQ ID NO: 3822579 - RNA, 19 nt, Shigella flexneri 2a str. 2457T
guauggagcaggaauauac

SEQ ID NO: 3822580 - RNA, 17 nt, Shigella flexneri 2a str. 2457T
guaugguuacugucguu

SEQ ID NO: 3822581 - RNA, 12 nt, Shigella flexneri 2a str. 2457T
guauuacagagg

SEQ ID NO: 3822582 - RNA, 15 nt, Shigella flexneri 2a str. 2457T
guauuacuccagaua

SEQ ID NO: 3822583 - RNA, 18 nt, Shigella flexneri 2a str. 2457T
guauuagaugcuaguuau

SEQ ID NO: 3822584 - RNA, 23 nt, Shigella flexneri 2a str. 2457T
guauuaguggcaaccacaaccgc

SEQ ID NO: 3822585 - RNA, 14 nt, Shigella flexneri 2a str. 2457T
guauuauauauaau

SEQ ID NO: 3822586 - RNA, 17 nt, Shigella flexneri 2a str. 2457T
guauuaucgauaaacgc

SEQ ID NO: 3822587 - RNA, 19 nt, Shigella flexneri 2a str. 2457T
guauucaaccguuuccagu

SEQ ID NO: 3822588 - RNA, 15 nt, Shigella flexneri 2a str. 2457T
guauucagcaauucu

SEQ ID NO: 3822589 - RNA, 22 nt, Shigella flexneri 2a str. 2457T
guauucaggucagcggccaguu

SEQ ID NO: 3822590 - RNA, 17 nt, Shigella flexneri 2a str. 2457T
guauucaugcccugccc

SEQ ID NO: 3822591 - RNA, 14 nt, Shigella flexneri 2a str. 2457T
guauucauugccug

SEQ ID NO: 3822592 - RNA, 21 nt, Shigella flexneri 2a str. 2457T
guauugccguuucgcagguuc

SEQ ID NO: 3822593 - RNA, 15 nt, Shigella flexneri 2a str. 2457T
guauuguuaaauauu

SEQ ID NO: 3822594 - RNA, 22 nt, Shigella flexneri 2a str. 2457T
guauuuaaagugcaaaaauuca

SEQ ID NO: 3822595 - RNA, 11 nt, Shigella flexneri 2a str. 2457T
guauuuccagg

SEQ ID NO: 3822596 - RNA, 17 nt, Shigella flexneri 2a str. 2457T
guauuuccaguccagcu

SEQ ID NO: 3822597 - RNA, 16 nt, Shigella flexneri 2a str. 2457T
guauuugauauuuauu

SEQ ID NO: 3822598 - RNA, 13 nt, Shigella flexneri 2a str. 2457T
guauuuuggcuua

SEQ ID NO: 3822599 - RNA, 23 nt, Shigella flexneri 2a str. 2457T
guauuuugucagcccuuuuggca

SEQ ID NO: 3822600 - RNA, 12 nt, Shigella flexneri 2a str. 2457T
guauuuuuaauu

SEQ ID NO: 3822601 - RNA, 16 nt, Shigella flexneri 2a str. 2457T
gucaaaaaaugaaacu

SEQ ID NO: 3822602 - RNA, 20 nt, Shigella flexneri 2a str. 2457T
gucaaaagaugcgcugagua

SEQ ID NO: 3822603 - RNA, 20 nt, Shigella flexneri 2a str. 2457T
gucaaaauccauuuucuauu

SEQ ID NO: 3822604 - RNA, 15 nt, Shigella flexneri 2a str. 2457T
gucaaaauuagagau

SEQ ID NO: 3822605 - RNA, 20 nt, Shigella flexneri 2a str. 2457T
gucaaaauuagagauuccgg

SEQ ID NO: 3822606 - RNA, 22 nt, Shigella flexneri 2a str. 2457T
gucaaacgcacgucugauguaa

SEQ ID NO: 3822607 - RNA, 18 nt, Shigella flexneri 2a str. 2457T
gucaaacgggcuucuaau

SEQ ID NO: 3822608 - RNA, 21 nt, Shigella flexneri 2a str. 2457T
gucaaaguaaccuuugaacaa

SEQ ID NO: 3822609 - RNA, 14 nt, Shigella flexneri 2a str. 2457T
gucaaauaauuccu

SEQ ID NO: 3822610 - RNA, 23 nt, Shigella flexneri 2a str. 2457T
gucaaaugaccgggcuuuccgcu

SEQ ID NO: 3822611 - RNA, 12 nt, Shigella flexneri 2a str. 2457T
gucaacagggca

SEQ ID NO: 3822612 - RNA, 14 nt, Shigella flexneri 2a str. 2457T
gucaacagggcaga

SEQ ID NO: 3822613 - RNA, 22 nt, Shigella flexneri 2a str. 2457T
gucaauacuuucacaaaaauaa

SEQ ID NO: 3822614 - RNA, 19 nt, Shigella flexneri 2a str. 2457T
gucaauauuaucgauuuuc

SEQ ID NO: 3822615 - RNA, 23 nt, Shigella flexneri 2a str. 2457T
gucaauauuaucgauuuucugcu

SEQ ID NO: 3822616 - RNA, 11 nt, Shigella flexneri 2a str. 2457T
gucaaucugac

SEQ ID NO: 3822617 - RNA, 20 nt, Shigella flexneri 2a str. 2457T
gucaaugccgucaccagcau

SEQ ID NO: 3822618 - RNA, 14 nt, Shigella flexneri 2a str. 2457T
gucacaaauaaaaa

SEQ ID NO: 3822619 - RNA, 16 nt, Shigella flexneri 2a str. 2457T
gucacaaaucucccuu

SEQ ID NO: 3822620 - RNA, 16 nt, Shigella flexneri 2a str. 2457T
gucacaccuuauuuac

SEQ ID NO: 3822621 - RNA, 14 nt, Shigella flexneri 2a str. 2457T
gucacagaagagag

SEQ ID NO: 3822622 - RNA, 21 nt, Shigella flexneri 2a str. 2457T
gucaugcagcuccaccgauuu

SEQ ID NO: 3822623 - RNA, 22 nt, Shigella flexneri 2a str. 2457T
gucauggcauuaauaugcucaa

SEQ ID NO: 3822624 - RNA, 15 nt, Shigella flexneri 2a str. 2457T
gucaugguaaugauc

SEQ ID NO: 3822625 - RNA, 13 nt, Shigella flexneri 2a str. 2457T
gucauuaccagcg

SEQ ID NO: 3822626 - RNA, 22 nt, Shigella flexneri 2a str. 2457T
gucauuacgggcaaucaucacc

SEQ ID NO: 3822627 - RNA, 13 nt, Shigella flexneri 2a str. 2457T
gucauuaugucug

SEQ ID NO: 3822628 - RNA, 13 nt, Shigella flexneri 2a str. 2457T
gucauuccuucaa

SEQ ID NO: 3822629 - RNA, 20 nt, Shigella flexneri 2a str. 2457T
gucauucugcaaggcaaaau

SEQ ID NO: 3822630 - RNA, 13 nt, Shigella flexneri 2a str. 2457T
gucauugacgcug

SEQ ID NO: 3822631 - RNA, 14 nt, Shigella flexneri 2a str. 2457T
gucauugacgcugg

SEQ ID NO: 3822632 - RNA, 18 nt, Shigella flexneri 2a str. 2457T
guccaaaagguccuucag

SEQ ID NO: 3822633 - RNA, 22 nt, Shigella flexneri 2a str. 2457T
guccaaaagguccuucaggccc

SEQ ID NO: 3822634 - RNA, 23 nt, Shigella flexneri 2a str. 2457T
guccacaggaaaacuacacacug

SEQ ID NO: 3822635 - RNA, 16 nt, Shigella flexneri 2a str. 2457T
guccaccgcgaugcug

SEQ ID NO: 3822636 - RNA, 16 nt, Shigella flexneri 2a str. 2457T
guccacugcgagaaaa

SEQ ID NO: 3822637 - RNA, 18 nt, Shigella flexneri 2a str. 2457T
guccacuggucugacgcu

SEQ ID NO: 3822638 - RNA, 23 nt, Shigella flexneri 2a str. 2457T
guccacuugaaaauuauaucuua

SEQ ID NO: 3822639 - RNA, 19 nt, Shigella flexneri 2a str. 2457T
guccagacgcgcagcuuca

SEQ ID NO: 3822640 - RNA, 16 nt, Shigella flexneri 2a str. 2457T
guccagauaauaauca

SEQ ID NO: 3822641 - RNA, 16 nt, Shigella flexneri 2a str. 2457T
guccagccaccgcgug

SEQ ID NO: 3822642 - RNA, 12 nt, Shigella flexneri 2a str. 2457T
guccagccgcca

SEQ ID NO: 3822643 - RNA, 14 nt, Shigella flexneri 2a str. 2457T
guccagccgccagg

SEQ ID NO: 3822644 - RNA, 23 nt, Shigella flexneri 2a str. 2457T
guccagcuuuucgauaacccggc

SEQ ID NO: 3822645 - RNA, 22 nt, Shigella flexneri 2a str. 2457T
guccaggcugcaaagucugggc

SEQ ID NO: 3822646 - RNA, 18 nt, Shigella flexneri 2a str. 2457T
guccaguucccaaccauu

SEQ ID NO: 3822647 - RNA, 22 nt, Shigella flexneri 2a str. 2457T
guccaguuugccuucacaggcc

SEQ ID NO: 3822648 - RNA, 21 nt, Shigella flexneri 2a str. 2457T
guccauagcgauguauuucau

SEQ ID NO: 3822649 - RNA, 15 nt, Shigella flexneri 2a str. 2457T
guccauggugucuga

SEQ ID NO: 3822650 - RNA, 14 nt, Shigella flexneri 2a str. 2457T
gucccaguucaugu

SEQ ID NO: 3822651 - RNA, 17 nt, Shigella flexneri 2a str. 2457T
gucccaugaugcgcggc

SEQ ID NO: 3822652 - RNA, 21 nt, Shigella flexneri 2a str. 2457T
guccccacaucacuccaucca

SEQ ID NO: 3822653 - RNA, 18 nt, Shigella flexneri 2a str. 2457T
guccccaguaaucgggca

SEQ ID NO: 3822654 - RNA, 13 nt, Shigella flexneri 2a str. 2457T
guccccgagcaca

SEQ ID NO: 3822655 - RNA, 17 nt, Shigella flexneri 2a str. 2457T
guccccgagcacaugca

SEQ ID NO: 3822656 - RNA, 23 nt, Shigella flexneri 2a str. 2457T
guccccgagcacaugcagugccg

SEQ ID NO: 3822657 - RNA, 11 nt, Shigella flexneri 2a str. 2457T
gucccucccug

SEQ ID NO: 3822658 - RNA, 18 nt, Shigella flexneri 2a str. 2457T
gucccuuccgcaauacag

SEQ ID NO: 3822659 - RNA, 22 nt, Shigella flexneri 2a str. 2457T
gucccuucgguagcagcuuuca

SEQ ID NO: 3822660 - RNA, 12 nt, Shigella flexneri 2a str. 2457T
gucccuuucagg

SEQ ID NO: 3822661 - RNA, 22 nt, Shigella flexneri 2a str. 2457T
guccgauuaaaaacccugcaga

SEQ ID NO: 3822662 - RNA, 20 nt, Shigella flexneri 2a str. 2457T
guccgcaauacaucaaagcg

SEQ ID NO: 3822663 - RNA, 12 nt, Shigella flexneri 2a str. 2457T
guccgccagccu

SEQ ID NO: 3822664 - RNA, 22 nt, Shigella flexneri 2a str. 2457T
guccgcgucuuaucaggccuac

SEQ ID NO: 3822665 - RNA, 23 nt, Shigella flexneri 2a str. 2457T
guccgcuauuucuugugcauggc

SEQ ID NO: 3822666 - RNA, 14 nt, Shigella flexneri 2a str. 2457T
guccgcuucaccac

SEQ ID NO: 3822667 - RNA, 17 nt, Shigella flexneri 2a str. 2457T
guccggcagcagaaagc

SEQ ID NO: 3822668 - RNA, 16 nt, Shigella flexneri 2a str. 2457T
guccggcugccagcca

SEQ ID NO: 3822669 - RNA, 15 nt, Shigella flexneri 2a str. 2457T
guccgggcaucagca

SEQ ID NO: 3822670 - RNA, 22 nt, Shigella flexneri 2a str. 2457T
guccgguuucgugaaacucagc

SEQ ID NO: 3822671 - RNA, 12 nt, Shigella flexneri 2a str. 2457T
guccguugaaaa

SEQ ID NO: 3822672 - RNA, 16 nt, Shigella flexneri 2a str. 2457T
guccguugaaaaugcu

SEQ ID NO: 3822673 - RNA, 22 nt, Shigella flexneri 2a str. 2457T
guccucccuuauugcuaaugau

SEQ ID NO: 3822674 - RNA, 16 nt, Shigella flexneri 2a str. 2457T
guccucuucagcauca

SEQ ID NO: 3822675 - RNA, 18 nt, Shigella flexneri 2a str. 2457T
guccugagcacuuuucug

SEQ ID NO: 3822676 - RNA, 14 nt, Shigella flexneri 2a str. 2457T
guccugcaaggugg

SEQ ID NO: 3822677 - RNA, 16 nt, Shigella flexneri 2a str. 2457T
guccugcaaggugguc

SEQ ID NO: 3822678 - RNA, 18 nt, Shigella flexneri 2a str. 2457T
guccuguugaaaaaccag

SEQ ID NO: 3822679 - RNA, 18 nt, Shigella flexneri 2a str. 2457T
guccuguugucuuuccag

SEQ ID NO: 3822680 - RNA, 18 nt, Shigella flexneri 2a str. 2457T
guccuucaauaucauuac

SEQ ID NO: 3822681 - RNA, 21 nt, Shigella flexneri 2a str. 2457T
guccuucaucuucauccggcu

SEQ ID NO: 3822682 - RNA, 15 nt, Shigella flexneri 2a str. 2457T
guccuuuuauuacgu

SEQ ID NO: 3822683 - RNA, 21 nt, Shigella flexneri 2a str. 2457T
guccuuuugccgcccagucac

SEQ ID NO: 3822684 - RNA, 18 nt, Shigella flexneri 2a str. 2457T
gucgaaagcccaucaucc

SEQ ID NO: 3822685 - RNA, 15 nt, Shigella flexneri 2a str. 2457T
gucgaacauacacaa

SEQ ID NO: 3822686 - RNA, 14 nt, Shigella flexneri 2a str. 2457T
gucgaacggguuaa

SEQ ID NO: 3822687 - RNA, 20 nt, Shigella flexneri 2a str. 2457T
gucgaacucauacaccagcg

SEQ ID NO: 3822688 - RNA, 12 nt, Shigella flexneri 2a str. 2457T
gucgacagcagc

SEQ ID NO: 3822689 - RNA, 19 nt, Shigella flexneri 2a str. 2457T
gucgaccauaagaaauuuc

SEQ ID NO: 3822690 - RNA, 12 nt, Shigella flexneri 2a str. 2457T
gucgacggaaua

SEQ ID NO: 3822691 - RNA, 18 nt, Shigella flexneri 2a str. 2457T
gucgacgguauaaacgug

SEQ ID NO: 3822692 - RNA, 17 nt, Shigella flexneri 2a str. 2457T
gucgacuucagauaaau

SEQ ID NO: 3822693 - RNA, 18 nt, Shigella flexneri 2a str. 2457T
gucgagaauaucgauauc

SEQ ID NO: 3822694 - RNA, 15 nt, Shigella flexneri 2a str. 2457T
gucgagaucgcggca

SEQ ID NO: 3822695 - RNA, 20 nt, Shigella flexneri 2a str. 2457T
gucgaggccaauuuggcugc

SEQ ID NO: 3822696 - RNA, 21 nt, Shigella flexneri 2a str. 2457T
gucgagguacgcuccagcagg

SEQ ID NO: 3822697 - RNA, 22 nt, Shigella flexneri 2a str. 2457T
gucgauagcgcccgaacggaaa

SEQ ID NO: 3822698 - RNA, 14 nt, Shigella flexneri 2a str. 2457T
gucgauauaauuga

SEQ ID NO: 3822699 - RNA, 19 nt, Shigella flexneri 2a str. 2457T
gucgauaucgcugucgcca

SEQ ID NO: 3822700 - RNA, 23 nt, Shigella flexneri 2a str. 2457T
gucgaucacccaagcuucgggau

SEQ ID NO: 3822701 - RNA, 17 nt, Shigella flexneri 2a str. 2457T
gucgaucguacauggca

SEQ ID NO: 3822702 - RNA, 17 nt, Shigella flexneri 2a str. 2457T
gucgaucguuaagcgau

SEQ ID NO: 3822703 - RNA, 14 nt, Shigella flexneri 2a str. 2457T
gucgaucugacgug

SEQ ID NO: 3822704 - RNA, 22 nt, Shigella flexneri 2a str. 2457T
gucgaugcgcaauuaaauaaag

SEQ ID NO: 3822705 - RNA, 18 nt, Shigella flexneri 2a str. 2457T
gucgaugcgcuggcggcu

SEQ ID NO: 3822706 - RNA, 14 nt, Shigella flexneri 2a str. 2457T
gucgaugugccgga

SEQ ID NO: 3822707 - RNA, 17 nt, Shigella flexneri 2a str. 2457T
gucgcaagacgaaaaau

SEQ ID NO: 3822708 - RNA, 20 nt, Shigella flexneri 2a str. 2457T
gucgcaauacccugacccag

SEQ ID NO: 3822709 - RNA, 14 nt, Shigella flexneri 2a str. 2457T
gucgcagccagcgc

SEQ ID NO: 3822710 - RNA, 15 nt, Shigella flexneri 2a str. 2457T
gucgcagccagcgcg

SEQ ID NO: 3822711 - RNA, 15 nt, Shigella flexneri 2a str. 2457T
gucgcagcugccugc

SEQ ID NO: 3822712 - RNA, 16 nt, Shigella flexneri 2a str. 2457T
gucgcaguagccaugc

SEQ ID NO: 3822713 - RNA, 15 nt, Shigella flexneri 2a str. 2457T
gucgcaucaggcauu

SEQ ID NO: 3822714 - RNA, 18 nt, Shigella flexneri 2a str. 2457T
gucgcauccggcaauuac

SEQ ID NO: 3822715 - RNA, 20 nt, Shigella flexneri 2a str. 2457T
gucgcauccggcaugaacaa

SEQ ID NO: 3822716 - RNA, 23 nt, Shigella flexneri 2a str. 2457T
gucgcauccggcaugaacaaagc

SEQ ID NO: 3822717 - RNA, 20 nt, Shigella flexneri 2a str. 2457T
gucgcaucuggcauaaacaa

SEQ ID NO: 3822718 - RNA, 14 nt, Shigella flexneri 2a str. 2457T
gucgccaacuucau

SEQ ID NO: 3822719 - RNA, 13 nt, Shigella flexneri 2a str. 2457T
gucuuuaauggca

SEQ ID NO: 3822720 - RNA, 16 nt, Shigella flexneri 2a str. 2457T
gucuuuacuaaacggu

SEQ ID NO: 3822721 - RNA, 16 nt, Shigella flexneri 2a str. 2457T
gucuuugcguuccauc

SEQ ID NO: 3822722 - RNA, 16 nt, Shigella flexneri 2a str. 2457T
gucuuuuuucaacuuu

SEQ ID NO: 3822723 - RNA, 12 nt, Shigella flexneri 2a str. 2457T
gucuuuuuucac

SEQ ID NO: 3822724 - RNA, 14 nt, Shigella flexneri 2a str. 2457T
gucuuuuuucacug

SEQ ID NO: 3822725 - RNA, 24 nt, Shigella flexneri 2a str. 2457T
gucuuuuuucacuggcaaugacgg

SEQ ID NO: 3822726 - RNA, 17 nt, Shigella flexneri 2a str. 2457T
gucuuuuuuccagcaca

SEQ ID NO: 3822727 - RNA, 13 nt, Shigella flexneri 2a str. 2457T
gugaaaaauaaaa

SEQ ID NO: 3822728 - RNA, 18 nt, Shigella flexneri 2a str. 2457T
gugaaaaauggcgcccau

SEQ ID NO: 3822729 - RNA, 22 nt, Shigella flexneri 2a str. 2457T
gugaaaacgacgcgguauuggu

SEQ ID NO: 3822730 - RNA, 16 nt, Shigella flexneri 2a str. 2457T
gugaaaagcugcauac

SEQ ID NO: 3822731 - RNA, 14 nt, Shigella flexneri 2a str. 2457T
gugaaaaucgaguu

SEQ ID NO: 3822732 - RNA, 14 nt, Shigella flexneri 2a str. 2457T
gugaaaauguggua

SEQ ID NO: 3822733 - RNA, 18 nt, Shigella flexneri 2a str. 2457T
gugaaaauucuccggcgu

SEQ ID NO: 3822734 - RNA, 21 nt, Shigella flexneri 2a str. 2457T
gugaaagagccgucauucugc

SEQ ID NO: 3822735 - RNA, 22 nt, Shigella flexneri 2a str. 2457T
gugaaaguccucucggcaagca

SEQ ID NO: 3822736 - RNA, 16 nt, Shigella flexneri 2a str. 2457T
gugaaauacaguuauc

SEQ ID NO: 3822737 - RNA, 20 nt, Shigella flexneri 2a str. 2457T
gugaacgagaaaaugacgau

SEQ ID NO: 3822738 - RNA, 22 nt, Shigella flexneri 2a str. 2457T
gugaacgagaaaaugacgauga

SEQ ID NO: 3822739 - RNA, 20 nt, Shigella flexneri 2a str. 2457T
gugaacgccuaauccagccu

SEQ ID NO: 3822740 - RNA, 13 nt, Shigella flexneri 2a str. 2457T
gugaacgccuuau

SEQ ID NO: 3822741 - RNA, 20 nt, Shigella flexneri 2a str. 2457T
gugaacgccuuauccgaccu

SEQ ID NO: 3822742 - RNA, 20 nt, Shigella flexneri 2a str. 2457T
gugaacgccuuauccggucu

SEQ ID NO: 3822743 - RNA, 19 nt, Shigella flexneri 2a str. 2457T
gugaacguguaggccugau

SEQ ID NO: 3822744 - RNA, 20 nt, Shigella flexneri 2a str. 2457T
gugaacucaggcugccagau

SEQ ID NO: 3822745 - RNA, 21 nt, Shigella flexneri 2a str. 2457T
gugaacugccacacaggccau

SEQ ID NO: 3822746 - RNA, 18 nt, Shigella flexneri 2a str. 2457T
gugaagagauccaccagc

SEQ ID NO: 3822747 - RNA, 22 nt, Shigella flexneri 2a str. 2457T
gugaagagugacuucgccguga

SEQ ID NO: 3822748 - RNA, 18 nt, Shigella flexneri 2a str. 2457T
gugaagcacguaaaucuu

SEQ ID NO: 3822749 - RNA, 22 nt, Shigella flexneri 2a str. 2457T
gugaaggcaaacuucucgccau

SEQ ID NO: 3822750 - RNA, 17 nt, Shigella flexneri 2a str. 2457T
gugaagguugucaucaa

SEQ ID NO: 3822751 - RNA, 15 nt, Shigella flexneri 2a str. 2457T
gugaaucacuccauc

SEQ ID NO: 3822752 - RNA, 20 nt, Shigella flexneri 2a str. 2457T
gugaaucgggcgugauucca

SEQ ID NO: 3822753 - RNA, 17 nt, Shigella flexneri 2a str. 2457T
gugaaugguggcgauga

SEQ ID NO: 3822754 - RNA, 15 nt, Shigella flexneri 2a str. 2457T
gugaauuguuuuaua

SEQ ID NO: 3822755 - RNA, 18 nt, Shigella flexneri 2a str. 2457T
gugacacaaucaaauccu

SEQ ID NO: 3822756 - RNA, 16 nt, Shigella flexneri 2a str. 2457T
gugacaccaaccgcgg

SEQ ID NO: 3822757 - RNA, 19 nt, Shigella flexneri 2a str. 2457T
gugacagauuuugccagca

SEQ ID NO: 3822758 - RNA, 12 nt, Shigella flexneri 2a str. 2457T
gugacagcagcg

SEQ ID NO: 3822759 - RNA, 18 nt, Shigella flexneri 2a str. 2457T
gugacagcccggcauguu

SEQ ID NO: 3822760 - RNA, 13 nt, Shigella flexneri 2a str. 2457T
gugacagcgguga

SEQ ID NO: 3822761 - RNA, 11 nt, Shigella flexneri 2a str. 2457T
gugacauucug

SEQ ID NO: 3822762 - RNA, 20 nt, Shigella flexneri 2a str. 2457T
gugaccagaacugauccaua

SEQ ID NO: 3822763 - RNA, 13 nt, Shigella flexneri 2a str. 2457T
gugaccagcagca

SEQ ID NO: 3822764 - RNA, 17 nt, Shigella flexneri 2a str. 2457T
gugaccagcagcauuuc

SEQ ID NO: 3822765 - RNA, 18 nt, Shigella flexneri 2a str. 2457T
gugaccaguugcuccagc

SEQ ID NO: 3822766 - RNA, 16 nt, Shigella flexneri 2a str. 2457T
gugacccgcagccagc

SEQ ID NO: 3822767 - RNA, 18 nt, Shigella flexneri 2a str. 2457T
gugacccgcagccagcac

SEQ ID NO: 3822768 - RNA, 14 nt, Shigella flexneri 2a str. 2457T
gugaccgaaggcga

SEQ ID NO: 3822769 - RNA, 23 nt, Shigella flexneri 2a str. 2457T
gugaccgaaggugcacuagacga

SEQ ID NO: 3822770 - RNA, 22 nt, Shigella flexneri 2a str. 2457T
gugacgaaagucugggccgaua

SEQ ID NO: 3822771 - RNA, 16 nt, Shigella flexneri 2a str. 2457T
gugacgcaaccgcaaa

SEQ ID NO: 3822772 - RNA, 14 nt, Shigella flexneri 2a str. 2457T
gugacgcauuuuac

SEQ ID NO: 3822773 - RNA, 16 nt, Shigella flexneri 2a str. 2457T
gugacgcgggcagcag

SEQ ID NO: 3822774 - RNA, 17 nt, Shigella flexneri 2a str. 2457T
gugacgcugucuuauca

SEQ ID NO: 3822775 - RNA, 21 nt, Shigella flexneri 2a str. 2457T
gugacucaauggcauccgcca

SEQ ID NO: 3822776 - RNA, 22 nt, Shigella flexneri 2a str. 2457T
gugacucccacuuuuauuucac

SEQ ID NO: 3822777 - RNA, 16 nt, Shigella flexneri 2a str. 2457T
gugacuggaaaucaaa

SEQ ID NO: 3822778 - RNA, 15 nt, Shigella flexneri 2a str. 2457T
gugacuucugccagc

SEQ ID NO: 3822779 - RNA, 18 nt, Shigella flexneri 2a str. 2457T
gugacuucugccagcugc

SEQ ID NO: 3822780 - RNA, 16 nt, Shigella flexneri 2a str. 2457T
gugagagauaauaaaa

SEQ ID NO: 3822781 - RNA, 23 nt, Shigella flexneri 2a str. 2457T
gugagaucauuauuaaacagaca

SEQ ID NO: 3822782 - RNA, 14 nt, Shigella flexneri 2a str. 2457T
gugagauugcugcg

SEQ ID NO: 3822783 - RNA, 14 nt, Shigella flexneri 2a str. 2457T
gugagcacaucugg

SEQ ID NO: 3822784 - RNA, 15 nt, Shigella flexneri 2a str. 2457T
gugagcagggcacuu

SEQ ID NO: 3822785 - RNA, 18 nt, Shigella flexneri 2a str. 2457T
gugagcgggcgaaccagg

SEQ ID NO: 3822786 - RNA, 22 nt, Shigella flexneri 2a str. 2457T
gugagcgguguugccgaagcag

SEQ ID NO: 3822787 - RNA, 12 nt, Shigella flexneri 2a str. 2457T
gugagcgugcgg

SEQ ID NO: 3822788 - RNA, 17 nt, Shigella flexneri 2a str. 2457T
gugagcuacacgggcau

SEQ ID NO: 3822789 - RNA, 14 nt, Shigella flexneri 2a str. 2457T
gugaggaucaccag

SEQ ID NO: 3822790 - RNA, 21 nt, Shigella flexneri 2a str. 2457T
gugaggcgaugccugcuuccg

SEQ ID NO: 3822791 - RNA, 14 nt, Shigella flexneri 2a str. 2457T
gugauaaaacgcag

SEQ ID NO: 3822792 - RNA, 22 nt, Shigella flexneri 2a str. 2457T
gugauaaaacgcagucuuccca

SEQ ID NO: 3822793 - RNA, 19 nt, Shigella flexneri 2a str. 2457T
gugauaaacccaacggcaa

SEQ ID NO: 3822794 - RNA, 17 nt, Shigella flexneri 2a str. 2457T
gugauaaucaguuugau

SEQ ID NO: 3822795 - RNA, 14 nt, Shigella flexneri 2a str. 2457T
gugauacagcaaaa

SEQ ID NO: 3822796 - RNA, 13 nt, Shigella flexneri 2a str. 2457T
gugauacuucuuc

SEQ ID NO: 3822797 - RNA, 17 nt, Shigella flexneri 2a str. 2457T
gugauauccaccgcguu

SEQ ID NO: 3822798 - RNA, 18 nt, Shigella flexneri 2a str. 2457T
gugauccgccgcgcggug

SEQ ID NO: 3822799 - RNA, 15 nt, Shigella flexneri 2a str. 2457T
gugaucgugccggau

SEQ ID NO: 3822800 - RNA, 17 nt, Shigella flexneri 2a str. 2457T
gugaucguggccaugac

SEQ ID NO: 3822801 - RNA, 22 nt, Shigella flexneri 2a str. 2457T
gugaugcggucgcugacgccau

SEQ ID NO: 3822802 - RNA, 20 nt, Shigella flexneri 2a str. 2457T
gugauguuccgcuuguugcu

SEQ ID NO: 3822803 - RNA, 15 nt, Shigella flexneri 2a str. 2457T
gugauuaaagaaaau

SEQ ID NO: 3822804 - RNA, 15 nt, Shigella flexneri 2a str. 2457T
gugauuaacgcgccg

SEQ ID NO: 3822805 - RNA, 15 nt, Shigella flexneri 2a str. 2457T
gugauuaacuguucu

SEQ ID NO: 3822806 - RNA, 17 nt, Shigella flexneri 2a str. 2457T
gugauuagggcggacaa

SEQ ID NO: 3822807 - RNA, 14 nt, Shigella flexneri 2a str. 2457T
gugauuaucggcau

SEQ ID NO: 3822808 - RNA, 19 nt, Shigella flexneri 2a str. 2457T
gugauucauaguaagcaga

SEQ ID NO: 3822809 - RNA, 21 nt, Shigella flexneri 2a str. 2457T
gugauucauaguaagcagauu

SEQ ID NO: 3822810 - RNA, 21 nt, Shigella flexneri 2a str. 2457T
gugauuccgccaguugcggcu

SEQ ID NO: 3822811 - RNA, 17 nt, Shigella flexneri 2a str. 2457T
gugauugguuucaaaga

SEQ ID NO: 3822812 - RNA, 23 nt, Shigella flexneri 2a str. 2457T
gugauuguggcaaucauauucac

SEQ ID NO: 3822813 - RNA, 15 nt, Shigella flexneri 2a str. 2457T
gugauuuaucuucga

SEQ ID NO: 3822814 - RNA, 13 nt, Shigella flexneri 2a str. 2457T
gugcaaaaucaaa

SEQ ID NO: 3822815 - RNA, 11 nt, Shigella flexneri 2a str. 2457T
gugcaaaugcc

SEQ ID NO: 3822816 - RNA, 16 nt, Shigella flexneri 2a str. 2457T
gugcaaccuuuuccau

SEQ ID NO: 3822817 - RNA, 23 nt, Shigella flexneri 2a str. 2457T
guggaauaugcgccacaccacug

SEQ ID NO: 3822818 - RNA, 24 nt, Shigella flexneri 2a str. 2457T
guggacauagcucugccacugguu

SEQ ID NO: 3822819 - RNA, 14 nt, Shigella flexneri 2a str. 2457T
guggacuggcugcg

SEQ ID NO: 3822820 - RNA, 19 nt, Shigella flexneri 2a str. 2457T
guggagcaacacgccagcg

SEQ ID NO: 3822821 - RNA, 20 nt, Shigella flexneri 2a str. 2457T
guggagcaacacgccagcgu

SEQ ID NO: 3822822 - RNA, 12 nt, Shigella flexneri 2a str. 2457T
guggauaaagca

SEQ ID NO: 3822823 - RNA, 16 nt, Shigella flexneri 2a str. 2457T
guggauagacgcaggu

SEQ ID NO: 3822824 - RNA, 19 nt, Shigella flexneri 2a str. 2457T
guggaucacaucgccggug

SEQ ID NO: 3822825 - RNA, 22 nt, Shigella flexneri 2a str. 2457T
guggaucccagaagaauaucaa

SEQ ID NO: 3822826 - RNA, 16 nt, Shigella flexneri 2a str. 2457T
guggaucgauuucaau

SEQ ID NO: 3822827 - RNA, 16 nt, Shigella flexneri 2a str. 2457T
guggcaaucguagccc

SEQ ID NO: 3822828 - RNA, 21 nt, Shigella flexneri 2a str. 2457T
guggcaauggcgacuucugcu

SEQ ID NO: 3822829 - RNA, 14 nt, Shigella flexneri 2a str. 2457T
guggcagccagcca

SEQ ID NO: 3822830 - RNA, 17 nt, Shigella flexneri 2a str. 2457T
guggcagggaaucagau

SEQ ID NO: 3822831 - RNA, 13 nt, Shigella flexneri 2a str. 2457T
guggcagggcagc

SEQ ID NO: 3822832 - RNA, 16 nt, Shigella flexneri 2a str. 2457T
guggcagggcagcgau

SEQ ID NO: 3822833 - RNA, 19 nt, Shigella flexneri 2a str. 2457T
guggcaucaauaccgcgua

SEQ ID NO: 3822834 - RNA, 20 nt, Shigella flexneri 2a str. 2457T
guggcauugguugcuggaaa

SEQ ID NO: 3822835 - RNA, 16 nt, Shigella flexneri 2a str. 2457T
guggcccagccuuucc

SEQ ID NO: 3822836 - RNA, 19 nt, Shigella flexneri 2a str. 2457T
guggcgauaaucagcgcca

SEQ ID NO: 3822837 - RNA, 21 nt, Shigella flexneri 2a str. 2457T
guggcgauaaucagcgccagc

SEQ ID NO: 3822838 - RNA, 19 nt, Shigella flexneri 2a str. 2457T
guggcgaugggacgcgcga

SEQ ID NO: 3822839 - RNA, 21 nt, Shigella flexneri 2a str. 2457T
guggcgauguaauucagccau

SEQ ID NO: 3822840 - RNA, 17 nt, Shigella flexneri 2a str. 2457T
guggcgcagccgucauu

SEQ ID NO: 3822841 - RNA, 18 nt, Shigella flexneri 2a str. 2457T
guggcgguaacauccaga

SEQ ID NO: 3822842 - RNA, 14 nt, Shigella flexneri 2a str. 2457T
guggcguggcgcuc

SEQ ID NO: 3822843 - RNA, 23 nt, Shigella flexneri 2a str. 2457T
guggcuuuuuuauugcuucacca

SEQ ID NO: 3822844 - RNA, 18 nt, Shigella flexneri 2a str. 2457T
gugggaucacaucuucaa

SEQ ID NO: 3822845 - RNA, 23 nt, Shigella flexneri 2a str. 2457T
gugggauucaccaaucggcagaa

SEQ ID NO: 3822846 - RNA, 18 nt, Shigella flexneri 2a str. 2457T
gugggauuccagcgccgc

SEQ ID NO: 3822847 - RNA, 16 nt, Shigella flexneri 2a str. 2457T
gugggcaggaaaauca

SEQ ID NO: 3822848 - RNA, 13 nt, Shigella flexneri 2a str. 2457T
gugggcaggagaa

SEQ ID NO: 3822849 - RNA, 17 nt, Shigella flexneri 2a str. 2457T
gugggcgcugcuguacu

SEQ ID NO: 3822850 - RNA, 16 nt, Shigella flexneri 2a str. 2457T
guggggaaugauauuu

SEQ ID NO: 3822851 - RNA, 19 nt, Shigella flexneri 2a str. 2457T
guggggucucugcaaaaaa

SEQ ID NO: 3822852 - RNA, 16 nt, Shigella flexneri 2a str. 2457T
guggguaaugcuguga

SEQ ID NO: 3822853 - RNA, 15 nt, Shigella flexneri 2a str. 2457T
guggguggucagcgu

SEQ ID NO: 3822854 - RNA, 13 nt, Shigella flexneri 2a str. 2457T
gugguagcggcuc

SEQ ID NO: 3822855 - RNA, 13 nt, Shigella flexneri 2a str. 2457T
guggucagcacaa

SEQ ID NO: 3822856 - RNA, 19 nt, Shigella flexneri 2a str. 2457T
guggucccucccugacgau

SEQ ID NO: 3822857 - RNA, 18 nt, Shigella flexneri 2a str. 2457T
guggucuuuagacugcca

SEQ ID NO: 3822858 - RNA, 19 nt, Shigella flexneri 2a str. 2457T
guggugaaggcacuggucg

SEQ ID NO: 3822859 - RNA, 16 nt, Shigella flexneri 2a str. 2457T
guggugaucacccaga

SEQ ID NO: 3822860 - RNA, 20 nt, Shigella flexneri 2a str. 2457T
gugguuaacgaccagcggaa

SEQ ID NO: 3822861 - RNA, 14 nt, Shigella flexneri 2a str. 2457T
gugguugucgcagg

SEQ ID NO: 3822862 - RNA, 19 nt, Shigella flexneri 2a str. 2457T
gugguugucgcaggcggug

SEQ ID NO: 3822863 - RNA, 14 nt, Shigella flexneri 2a str. 2457T
gugguuuggcggcg

SEQ ID NO: 3822864 - RNA, 15 nt, Shigella flexneri 2a str. 2457T
gugguuuggcggcgg

SEQ ID NO: 3822865 - RNA, 21 nt, Shigella flexneri 2a str. 2457T
guguaacgcguacccagcagc

SEQ ID NO: 3822866 - RNA, 18 nt, Shigella flexneri 2a str. 2457T
guguaagaaaggcagagu

SEQ ID NO: 3822867 - RNA, 19 nt, Shigella flexneri 2a str. 2457T
guguacaaacccagccgcc

SEQ ID NO: 3822868 - RNA, 17 nt, Shigella flexneri 2a str. 2457T
guguacagcggcaggga

SEQ ID NO: 3822869 - RNA, 14 nt, Shigella flexneri 2a str. 2457T
guguagcgcaucac

SEQ ID NO: 3822870 - RNA, 12 nt, Shigella flexneri 2a str. 2457T
guguagggcagg

SEQ ID NO: 3822871 - RNA, 21 nt, Shigella flexneri 2a str. 2457T
guguaucugggcgaaacagag

SEQ ID NO: 3822872 - RNA, 23 nt, Shigella flexneri 2a str. 2457T
gugucaggccggcauauaccuca

SEQ ID NO: 3822873 - RNA, 14 nt, Shigella flexneri 2a str. 2457T
gugucauggcugac

SEQ ID NO: 3822874 - RNA, 13 nt, Shigella flexneri 2a str. 2457T
guguccacuuccg

SEQ ID NO: 3822875 - RNA, 19 nt, Shigella flexneri 2a str. 2457T
guguccagcggcauaaaac

SEQ ID NO: 3822876 - RNA, 22 nt, Shigella flexneri 2a str. 2457T
gugucuuaucuggcauuugcac

SEQ ID NO: 3822877 - RNA, 13 nt, Shigella flexneri 2a str. 2457T
gugugaaaccuuu

SEQ ID NO: 3822878 - RNA, 15 nt, Shigella flexneri 2a str. 2457T
gugugaaaucagcac

SEQ ID NO: 3822879 - RNA, 14 nt, Shigella flexneri 2a str. 2457T
gugugacaccaacc

SEQ ID NO: 3822880 - RNA, 17 nt, Shigella flexneri 2a str. 2457T
gugugcuacggucugcc

SEQ ID NO: 3822881 - RNA, 23 nt, Shigella flexneri 2a str. 2457T
gugugcucaaucugauagugauc

SEQ ID NO: 3822882 - RNA, 12 nt, Shigella flexneri 2a str. 2457T
gugugcuccagu

SEQ ID NO: 3822883 - RNA, 16 nt, Shigella flexneri 2a str. 2457T
guguggagugcagcau

SEQ ID NO: 3822884 - RNA, 13 nt, Shigella flexneri 2a str. 2457T
guguggcgcgcca

SEQ ID NO: 3822885 - RNA, 21 nt, Shigella flexneri 2a str. 2457T
gugugguuauugggugacugg

SEQ ID NO: 3822886 - RNA, 17 nt, Shigella flexneri 2a str. 2457T
guguguauggcauuguc

SEQ ID NO: 3822887 - RNA, 13 nt, Shigella flexneri 2a str. 2457T
gugugugcugauu

SEQ ID NO: 3822888 - RNA, 17 nt, Shigella flexneri 2a str. 2457T
guguguuccucugcucc

SEQ ID NO: 3822889 - RNA, 15 nt, Shigella flexneri 2a str. 2457T
guguuaucaaaucac

SEQ ID NO: 3822890 - RNA, 22 nt, Shigella flexneri 2a str. 2457T
guguucacgccgcauccggcau

SEQ ID NO: 3822891 - RNA, 14 nt, Shigella flexneri 2a str. 2457T
guguuccagagaac

SEQ ID NO: 3822892 - RNA, 13 nt, Shigella flexneri 2a str. 2457T
guguuccucugcc

SEQ ID NO: 3822893 - RNA, 15 nt, Shigella flexneri 2a str. 2457T
guguugcaggaaaag

SEQ ID NO: 3822894 - RNA, 22 nt, Shigella flexneri 2a str. 2457T
guguugccgccaccuuucuguu

SEQ ID NO: 3822895 - RNA, 17 nt, Shigella flexneri 2a str. 2457T
guguugcguuuaaacca

SEQ ID NO: 3822896 - RNA, 17 nt, Shigella flexneri 2a str. 2457T
guguugcuccccagaau

SEQ ID NO: 3822897 - RNA, 16 nt, Shigella flexneri 2a str. 2457T
guguuggcaaucagcg

SEQ ID NO: 3822898 - RNA, 15 nt, Shigella flexneri 2a str. 2457T
guguuggcgucagac

SEQ ID NO: 3822899 - RNA, 18 nt, Shigella flexneri 2a str. 2457T
guguuggggcaagauauu

SEQ ID NO: 3822900 - RNA, 23 nt, Shigella flexneri 2a str. 2457T
guguuuuccaccgugauccgccg

SEQ ID NO: 3822901 - RNA, 19 nt, Shigella flexneri 2a str. 2457T
guguuuuuuuaugguagug

SEQ ID NO: 3822902 - RNA, 17 nt, Shigella flexneri 2a str. 2457T
guuaaaacgcacgcugu

SEQ ID NO: 3822903 - RNA, 17 nt, Shigella flexneri 2a str. 2457T
guuaaaacuuuuagcau

SEQ ID NO: 3822904 - RNA, 21 nt, Shigella flexneri 2a str. 2457T
guuaaaauucaagacaucaau

SEQ ID NO: 3822905 - RNA, 18 nt, Shigella flexneri 2a str. 2457T
guuaaacccgcucaaaca

SEQ ID NO: 3822906 - RNA, 14 nt, Shigella flexneri 2a str. 2457T
guuaaaccgccagu

SEQ ID NO: 3822907 - RNA, 22 nt, Shigella flexneri 2a str. 2457T
guuaaaguugagcgaaaacgaa

SEQ ID NO: 3822908 - RNA, 12 nt, Shigella flexneri 2a str. 2457T
guuaacaacaac

SEQ ID NO: 3822909 - RNA, 12 nt, Shigella flexneri 2a str. 2457T
guuaaccagcac

SEQ ID NO: 3822910 - RNA, 18 nt, Shigella flexneri 2a str. 2457T
guuaaccccaguaauuca

SEQ ID NO: 3822911 - RNA, 23 nt, Shigella flexneri 2a str. 2457T
guuaaccggaggauaugcaucau

SEQ ID NO: 3822912 - RNA, 15 nt, Shigella flexneri 2a str. 2457T
guuaacucccccuuu

SEQ ID NO: 3822913 - RNA, 22 nt, Shigella flexneri 2a str. 2457T
guuaacugcuuaucaucacgca

SEQ ID NO: 3822914 - RNA, 21 nt, Shigella flexneri 2a str. 2457T
guuccacggaauauuucaccg

SEQ ID NO: 3822915 - RNA, 12 nt, Shigella flexneri 2a str. 2457T
guuccacuauuu

SEQ ID NO: 3822916 - RNA, 19 nt, Shigella flexneri 2a str. 2457T
guuccacuucugcggguga

SEQ ID NO: 3822917 - RNA, 20 nt, Shigella flexneri 2a str. 2457T
guuccagagaacgaccauca

SEQ ID NO: 3822918 - RNA, 12 nt, Shigella flexneri 2a str. 2457T
guuccagcagaa

SEQ ID NO: 3822919 - RNA, 16 nt, Shigella flexneri 2a str. 2457T
guuccagccaguguua

SEQ ID NO: 3822920 - RNA, 21 nt, Shigella flexneri 2a str. 2457T
guuccagccaguguuaaccag

SEQ ID NO: 3822921 - RNA, 18 nt, Shigella flexneri 2a str. 2457T
guuccagggccuccugca

SEQ ID NO: 3822922 - RNA, 17 nt, Shigella flexneri 2a str. 2457T
guuccagugcguaccca

SEQ ID NO: 3822923 - RNA, 19 nt, Shigella flexneri 2a str. 2457T
guuccagugcguacccagc

SEQ ID NO: 3822924 - RNA, 14 nt, Shigella flexneri 2a str. 2457T
guuccaguggcuga

SEQ ID NO: 3822925 - RNA, 14 nt, Shigella flexneri 2a str. 2457T
guuccauaaucgcc

SEQ ID NO: 3822926 - RNA, 22 nt, Shigella flexneri 2a str. 2457T
guuccauaaucgccugaccgau

SEQ ID NO: 3822927 - RNA, 16 nt, Shigella flexneri 2a str. 2457T
guuccauaugaauucc

SEQ ID NO: 3822928 - RNA, 13 nt, Shigella flexneri 2a str. 2457T
guuccaucaccag

SEQ ID NO: 3822929 - RNA, 14 nt, Shigella flexneri 2a str. 2457T
guuccauggcagga

SEQ ID NO: 3822930 - RNA, 13 nt, Shigella flexneri 2a str. 2457T
guuccauucaaac

SEQ ID NO: 3822931 - RNA, 14 nt, Shigella flexneri 2a str. 2457T
guuccauucaaacg

SEQ ID NO: 3822932 - RNA, 20 nt, Shigella flexneri 2a str. 2457T
guuccccccacaaucagcca

SEQ ID NO: 3822933 - RNA, 15 nt, Shigella flexneri 2a str. 2457T
guuccccucaacaug

SEQ ID NO: 3822934 - RNA, 15 nt, Shigella flexneri 2a str. 2457T
guuccgcaaagcgcc

SEQ ID NO: 3822935 - RNA, 16 nt, Shigella flexneri 2a str. 2457T
guuccgcugcugacuu

SEQ ID NO: 3822936 - RNA, 23 nt, Shigella flexneri 2a str. 2457T
guuccggagaagcguagguguua

SEQ ID NO: 3822937 - RNA, 21 nt, Shigella flexneri 2a str. 2457T
guuccggcaugauucauccgu

SEQ ID NO: 3822938 - RNA, 17 nt, Shigella flexneri 2a str. 2457T
guuccggcguacgggca

SEQ ID NO: 3822939 - RNA, 16 nt, Shigella flexneri 2a str. 2457T
guuccgggaucaccag

SEQ ID NO: 3822940 - RNA, 15 nt, Shigella flexneri 2a str. 2457T
guuccgugagcggaa

SEQ ID NO: 3822941 - RNA, 16 nt, Shigella flexneri 2a str. 2457T
guuccuaacaugccac

SEQ ID NO: 3822942 - RNA, 15 nt, Shigella flexneri 2a str. 2457T
guuccugcaacuucu

SEQ ID NO: 3822943 - RNA, 17 nt, Shigella flexneri 2a str. 2457T
guuccugcuuggcgcga

SEQ ID NO: 3822944 - RNA, 20 nt, Shigella flexneri 2a str. 2457T
guuccuuaacuucaucagca

SEQ ID NO: 3822945 - RNA, 15 nt, Shigella flexneri 2a str. 2457T
guucgagaaaaccga

SEQ ID NO: 3822946 - RNA, 14 nt, Shigella flexneri 2a str. 2457T
guucgagcaucaca

SEQ ID NO: 3822947 - RNA, 18 nt, Shigella flexneri 2a str. 2457T
guucgagcaucacaucaa

SEQ ID NO: 3822948 - RNA, 15 nt, Shigella flexneri 2a str. 2457T
guucgauauccaguc

SEQ ID NO: 3822949 - RNA, 21 nt, Shigella flexneri 2a str. 2457T
guucgauauccaguccgcgcu

SEQ ID NO: 3822950 - RNA, 17 nt, Shigella flexneri 2a str. 2457T
guucgcaccaaauccaa

SEQ ID NO: 3822951 - RNA, 22 nt, Shigella flexneri 2a str. 2457T
guucgcaccaucaaaguuuuua

SEQ ID NO: 3822952 - RNA, 19 nt, Shigella flexneri 2a str. 2457T
guucgccccaaaaaagcga

SEQ ID NO: 3822953 - RNA, 16 nt, Shigella flexneri 2a str. 2457T
guucgccugcaccaug

SEQ ID NO: 3822954 - RNA, 19 nt, Shigella flexneri 2a str. 2457T
guucgcguaacugcugcuc

SEQ ID NO: 3822955 - RNA, 15 nt, Shigella flexneri 2a str. 2457T
guucguaggccagau

SEQ ID NO: 3822956 - RNA, 16 nt, Shigella flexneri 2a str. 2457T
guucgucauacuccag

SEQ ID NO: 3822957 - RNA, 17 nt, Shigella flexneri 2a str. 2457T
guucguugaucacuuuc

SEQ ID NO: 3822958 - RNA, 14 nt, Shigella flexneri 2a str. 2457T
guucuacauaaaac

SEQ ID NO: 3822959 - RNA, 15 nt, Shigella flexneri 2a str. 2457T
guucuaccgcagggg

SEQ ID NO: 3822960 - RNA, 21 nt, Shigella flexneri 2a str. 2457T
guucucccauaggaugagguu

SEQ ID NO: 3822961 - RNA, 14 nt, Shigella flexneri 2a str. 2457T
guucucucagucuu

SEQ ID NO: 3822962 - RNA, 14 nt, Shigella flexneri 2a str. 2457T
guucucuggcccgc

SEQ ID NO: 3822963 - RNA, 15 nt, Shigella flexneri 2a str. 2457T
guucugaccggccag

SEQ ID NO: 3822964 - RNA, 17 nt, Shigella flexneri 2a str. 2457T
guucugcccugaauggu

SEQ ID NO: 3822965 - RNA, 16 nt, Shigella flexneri 2a str. 2457T
guucugccguccagcc

SEQ ID NO: 3822966 - RNA, 16 nt, Shigella flexneri 2a str. 2457T
guucugccuggcgcag

SEQ ID NO: 3822967 - RNA, 21 nt, Shigella flexneri 2a str. 2457T
guucugccuggcgcagcaaag

SEQ ID NO: 3822968 - RNA, 18 nt, Shigella flexneri 2a str. 2457T
guucugcggcguaacgca

SEQ ID NO: 3822969 - RNA, 22 nt, Shigella flexneri 2a str. 2457T
guucugcguuaagacuuuuuuc

SEQ ID NO: 3822970 - RNA, 20 nt, Shigella flexneri 2a str. 2457T
guucugcuucaacauacccu

SEQ ID NO: 3822971 - RNA, 17 nt, Shigella flexneri 2a str. 2457T
guucuggccguacccag

SEQ ID NO: 3822972 - RNA, 23 nt, Shigella flexneri 2a str. 2457T
guucuggccuuuaauaugccacg

SEQ ID NO: 3822973 - RNA, 16 nt, Shigella flexneri 2a str. 2457T
guucuggcgcgaacag

SEQ ID NO: 3822974 - RNA, 13 nt, Shigella flexneri 2a str. 2457T
guucuguggcagg

SEQ ID NO: 3822975 - RNA, 19 nt, Shigella flexneri 2a str. 2457T
guucugugucuuauuggca

SEQ ID NO: 3822976 - RNA, 22 nt, Shigella flexneri 2a str. 2457T
guucuuaccggugacagcggug

SEQ ID NO: 3822977 - RNA, 11 nt, Shigella flexneri 2a str. 2457T
guucuucccuc

SEQ ID NO: 3822978 - RNA, 12 nt, Shigella flexneri 2a str. 2457T
guucuuuuaaau

SEQ ID NO: 3822979 - RNA, 13 nt, Shigella flexneri 2a str. 2457T
guugaaaaaccag

SEQ ID NO: 3822980 - RNA, 19 nt, Shigella flexneri 2a str. 2457T
guugaacgguuuggugaug

SEQ ID NO: 3822981 - RNA, 13 nt, Shigella flexneri 2a str. 2457T
guugaaguuuaua

SEQ ID NO: 3822982 - RNA, 18 nt, Shigella flexneri 2a str. 2457T
guugaauuccgaauuuca

SEQ ID NO: 3822983 - RNA, 17 nt, Shigella flexneri 2a str. 2457T
guugacaaagugcgcgu

SEQ ID NO: 3822984 - RNA, 16 nt, Shigella flexneri 2a str. 2457T
guugacucggagucga

SEQ ID NO: 3822985 - RNA, 19 nt, Shigella flexneri 2a str. 2457T
guugagagguaaaaccuga

SEQ ID NO: 3822986 - RNA, 21 nt, Shigella flexneri 2a str. 2457T
guugagagguaaaaccugaca

SEQ ID NO: 3822987 - RNA, 15 nt, Shigella flexneri 2a str. 2457T
guugagcggcaguaa

SEQ ID NO: 3822988 - RNA, 21 nt, Shigella flexneri 2a str. 2457T
guugaggauggcgucgauaau

SEQ ID NO: 3822989 - RNA, 14 nt, Shigella flexneri 2a str. 2457T
guugaggccaacgc

SEQ ID NO: 3822990 - RNA, 19 nt, Shigella flexneri 2a str. 2457T
guugaggccaacguccaua

SEQ ID NO: 3822991 - RNA, 17 nt, Shigella flexneri 2a str. 2457T
guugagggcgcaauuuc

SEQ ID NO: 3822992 - RNA, 21 nt, Shigella flexneri 2a str. 2457T
guugaucauaaaaauuaaauc

SEQ ID NO: 3822993 - RNA, 12 nt, Shigella flexneri 2a str. 2457T
guugauccagga

SEQ ID NO: 3822994 - RNA, 23 nt, Shigella flexneri 2a str. 2457T
guugaucgccccggaagcaucaa

SEQ ID NO: 3822995 - RNA, 14 nt, Shigella flexneri 2a str. 2457T
guugaucgcuuuca

SEQ ID NO: 3822996 - RNA, 15 nt, Shigella flexneri 2a str. 2457T
guugaucuauaccac

SEQ ID NO: 3822997 - RNA, 20 nt, Shigella flexneri 2a str. 2457T
guugauguuuggccgcgcca

SEQ ID NO: 3822998 - RNA, 17 nt, Shigella flexneri 2a str. 2457T
guugauuaugaucgcca

SEQ ID NO: 3822999 - RNA, 17 nt, Shigella flexneri 2a str. 2457T
guugauuuuauaaucaa

SEQ ID NO: 3823000 - RNA, 20 nt, Shigella flexneri 2a str. 2457T
guugcaacucgacuggagcc

SEQ ID NO: 3823001 - RNA, 23 nt, Shigella flexneri 2a str. 2457T
guugcaauacaccuccggcuggg

SEQ ID NO: 3823002 - RNA, 13 nt, Shigella flexneri 2a str. 2457T
guugcaccagcaa

SEQ ID NO: 3823003 - RNA, 18 nt, Shigella flexneri 2a str. 2457T
guugcacccaguacgggc

SEQ ID NO: 3823004 - RNA, 19 nt, Shigella flexneri 2a str. 2457T
guugcaccgaguucuucac

SEQ ID NO: 3823005 - RNA, 19 nt, Shigella flexneri 2a str. 2457T
guugcacgcagacacugcu

SEQ ID NO: 3823006 - RNA, 16 nt, Shigella flexneri 2a str. 2457T
guugcagcaggauggc

SEQ ID NO: 3823007 - RNA, 15 nt, Shigella flexneri 2a str. 2457T
guugcagcgucauca

SEQ ID NO: 3823008 - RNA, 14 nt, Shigella flexneri 2a str. 2457T
guugcaucgccugc

SEQ ID NO: 3823009 - RNA, 18 nt, Shigella flexneri 2a str. 2457T
guugcaugauuucgucau

SEQ ID NO: 3823010 - RNA, 17 nt, Shigella flexneri 2a str. 2457T
guugcauuuccauaaau

SEQ ID NO: 3823011 - RNA, 14 nt, Shigella flexneri 2a str. 2457T
guugcauuugcaga

SEQ ID NO: 3823012 - RNA, 15 nt, Shigella flexneri 2a str. 2457T
guuucaauccaggua

SEQ ID NO: 3823013 - RNA, 19 nt, Shigella flexneri 2a str. 2457T
guuucaaugauaagccuuc

SEQ ID NO: 3823014 - RNA, 22 nt, Shigella flexneri 2a str. 2457T
guuucaccagcaguaaaccgcu

SEQ ID NO: 3823015 - RNA, 16 nt, Shigella flexneri 2a str. 2457T
guuucacguaccagau

SEQ ID NO: 3823016 - RNA, 15 nt, Shigella flexneri 2a str. 2457T
guuucagcagcggca

SEQ ID NO: 3823017 - RNA, 17 nt, Shigella flexneri 2a str. 2457T
guuucagccucugccgc

SEQ ID NO: 3823018 - RNA, 19 nt, Shigella flexneri 2a str. 2457T
guuucaguaauccuuucuc

SEQ ID NO: 3823019 - RNA, 17 nt, Shigella flexneri 2a str. 2457T
guuucauagcgucccag

SEQ ID NO: 3823020 - RNA, 22 nt, Shigella flexneri 2a str. 2457T
guuucauagugcaaauccacuc

SEQ ID NO: 3823021 - RNA, 20 nt, Shigella flexneri 2a str. 2457T
guuucauaucugccagauaa

SEQ ID NO: 3823022 - RNA, 18 nt, Shigella flexneri 2a str. 2457T
guuuccagauuuugcuua

SEQ ID NO: 3823023 - RNA, 13 nt, Shigella flexneri 2a str. 2457T
guuuccagcacca

SEQ ID NO: 3823024 - RNA, 13 nt, Shigella flexneri 2a str. 2457T
guuuccauucgcu

SEQ ID NO: 3823025 - RNA, 13 nt, Shigella flexneri 2a str. 2457T
guuucccuguuca

SEQ ID NO: 3823026 - RNA, 15 nt, Shigella flexneri 2a str. 2457T
guuuccgcuucucaa

SEQ ID NO: 3823027 - RNA, 16 nt, Shigella flexneri 2a str. 2457T
guuuccgcuucugcuu

SEQ ID NO: 3823028 - RNA, 22 nt, Shigella flexneri 2a str. 2457T
guuucgaacaggccgacuggca

SEQ ID NO: 3823029 - RNA, 23 nt, Shigella flexneri 2a str. 2457T
guuucgaauuacacagccacagg

SEQ ID NO: 3823030 - RNA, 21 nt, Shigella flexneri 2a str. 2457T
guuucgaucagcaauuucucc

SEQ ID NO: 3823031 - RNA, 15 nt, Shigella flexneri 2a str. 2457T
guuucgccuuuugau

SEQ ID NO: 3823032 - RNA, 15 nt, Shigella flexneri 2a str. 2457T
guuucgcgguuggug

SEQ ID NO: 3823033 - RNA, 19 nt, Shigella flexneri 2a str. 2457T
guuucgcuauagacaccuu

SEQ ID NO: 3823034 - RNA, 19 nt, Shigella flexneri 2a str. 2457T
guuucgcuucuucagccug

SEQ ID NO: 3823035 - RNA, 13 nt, Shigella flexneri 2a str. 2457T
guuucuccacgau

SEQ ID NO: 3823036 - RNA, 16 nt, Shigella flexneri 2a str. 2457T
guuucucgccacuaaa

SEQ ID NO: 3823037 - RNA, 14 nt, Shigella flexneri 2a str. 2457T
guuucucuguucag

SEQ ID NO: 3823038 - RNA, 18 nt, Shigella flexneri 2a str. 2457T
guuucucuguucagccug

SEQ ID NO: 3823039 - RNA, 20 nt, Shigella flexneri 2a str. 2457T
guuucucuuaaaugcacaau

SEQ ID NO: 3823040 - RNA, 19 nt, Shigella flexneri 2a str. 2457T
guuucugauacagcucaug

SEQ ID NO: 3823041 - RNA, 16 nt, Shigella flexneri 2a str. 2457T
guuucugauacugcuc

SEQ ID NO: 3823042 - RNA, 19 nt, Shigella flexneri 2a str. 2457T
guuucugauacugcuccgg

SEQ ID NO: 3823043 - RNA, 13 nt, Shigella flexneri 2a str. 2457T
guuucugcagcuc

SEQ ID NO: 3823044 - RNA, 18 nt, Shigella flexneri 2a str. 2457T
guuucugcauuauccagc

SEQ ID NO: 3823045 - RNA, 16 nt, Shigella flexneri 2a str. 2457T
guuucugcgcuucugc

SEQ ID NO: 3823046 - RNA, 18 nt, Shigella flexneri 2a str. 2457T
guuucuggcuuaaacgca

SEQ ID NO: 3823047 - RNA, 16 nt, Shigella flexneri 2a str. 2457T
guuucuggucauugcc

SEQ ID NO: 3823048 - RNA, 20 nt, Shigella flexneri 2a str. 2457T
guuucuggugugcagcguga

SEQ ID NO: 3823049 - RNA, 16 nt, Shigella flexneri 2a str. 2457T
guuucuuccagcgcca

SEQ ID NO: 3823050 - RNA, 20 nt, Shigella flexneri 2a str. 2457T
guuucuuuaggauuugucuc

SEQ ID NO: 3823051 - RNA, 16 nt, Shigella flexneri 2a str. 2457T
guuugaaaaaaccugc

SEQ ID NO: 3823052 - RNA, 14 nt, Shigella flexneri 2a str. 2457T
guuugaaauaccag

SEQ ID NO: 3823053 - RNA, 19 nt, Shigella flexneri 2a str. 2457T
guuugacauaaauuccgcu

SEQ ID NO: 3823054 - RNA, 21 nt, Shigella flexneri 2a str. 2457T
guuugacccggaacgugguuu

SEQ ID NO: 3823055 - RNA, 21 nt, Shigella flexneri 2a str. 2457T
guuugaugcgugagguaacaa

SEQ ID NO: 3823056 - RNA, 19 nt, Shigella flexneri 2a str. 2457T
guuugauucacuggcaaaa

SEQ ID NO: 3823057 - RNA, 21 nt, Shigella flexneri 2a str. 2457T
guuugauucacuggcaaaagc

SEQ ID NO: 3823058 - RNA, 18 nt, Shigella flexneri 2a str. 2457T
guuugcagaugcgcuuca

SEQ ID NO: 3823059 - RNA, 21 nt, Shigella flexneri 2a str. 2457T
guuugcagugaucgugugcca

SEQ ID NO: 3823060 - RNA, 14 nt, Shigella flexneri 2a str. 2457T
guuugcauccagcu

SEQ ID NO: 3823061 - RNA, 14 nt, Shigella flexneri 2a str. 2457T
guuugcaucgccau

SEQ ID NO: 3823062 - RNA, 22 nt, Shigella flexneri 2a str. 2457T
guuugccagugccguuccagcc

SEQ ID NO: 3823063 - RNA, 22 nt, Shigella flexneri 2a str. 2457T
guuugccaugcauauccaggcu

SEQ ID NO: 3823064 - RNA, 16 nt, Shigella flexneri 2a str. 2457T
guuugccccggcugcg

SEQ ID NO: 3823065 - RNA, 21 nt, Shigella flexneri 2a str. 2457T
guuugcgcagccaguuaaccu

SEQ ID NO: 3823066 - RNA, 15 nt, Shigella flexneri 2a str. 2457T
guuugcgcccaguua

SEQ ID NO: 3823067 - RNA, 18 nt, Shigella flexneri 2a str. 2457T
guuugcgguguguggcug

SEQ ID NO: 3823068 - RNA, 15 nt, Shigella flexneri 2a str. 2457T
guuugcgucauggua

SEQ ID NO: 3823069 - RNA, 13 nt, Shigella flexneri 2a str. 2457T
guuugcugccuuc

SEQ ID NO: 3823070 - RNA, 11 nt, Shigella flexneri 2a str. 2457T
guuuggcaaau

SEQ ID NO: 3823071 - RNA, 24 nt, Shigella flexneri 2a str. 2457T
guuuggccaauaguuccacuauuu

SEQ ID NO: 3823072 - RNA, 18 nt, Shigella flexneri 2a str. 2457T
guuuggugaaauauagaa

SEQ ID NO: 3823073 - RNA, 12 nt, Shigella flexneri 2a str. 2457T
guuuggugguuu

SEQ ID NO: 3823074 - RNA, 13 nt, Shigella flexneri 2a str. 2457T
guuugucauaaau

SEQ ID NO: 3823075 - RNA, 18 nt, Shigella flexneri 2a str. 2457T
guuugugcugugacagau

SEQ ID NO: 3823076 - RNA, 13 nt, Shigella flexneri 2a str. 2457T
guuuguuauccac

SEQ ID NO: 3823077 - RNA, 15 nt, Shigella flexneri 2a str. 2457T
guuuuacaacguauu

SEQ ID NO: 3823078 - RNA, 20 nt, Shigella flexneri 2a str. 2457T
guuuuacaacguuaccgggu

SEQ ID NO: 3823079 - RNA, 16 nt, Shigella flexneri 2a str. 2457T
guuuuaccuucauccc

SEQ ID NO: 3823080 - RNA, 15 nt, Shigella flexneri 2a str. 2457T
guuuuacguaaugcu

SEQ ID NO: 3823081 - RNA, 21 nt, Shigella flexneri 2a str. 2457T
guuuuacuggaguuauucauu

SEQ ID NO: 3823082 - RNA, 17 nt, Shigella flexneri 2a str. 2457T
guuuuacuuugccuuuc

SEQ ID NO: 3823083 - RNA, 14 nt, Shigella flexneri 2a str. 2457T
guuuuauaaucgca

SEQ ID NO: 3823084 - RNA, 22 nt, Shigella flexneri 2a str. 2457T
guuuuauaaucgcaucaaucuu

SEQ ID NO: 3823085 - RNA, 14 nt, Shigella flexneri 2a str. 2457T
guuuuauauaacgc

SEQ ID NO: 3823086 - RNA, 16 nt, Shigella flexneri 2a str. 2457T
guuuuaucuccauccg

SEQ ID NO: 3823087 - RNA, 16 nt, Shigella flexneri 2a str. 2457T
guuuuauuauuccauc

SEQ ID NO: 3823088 - RNA, 20 nt, Shigella flexneri 2a str. 2457T
guuuucaaagguaaugguca

SEQ ID NO: 3823089 - RNA, 11 nt, Shigella flexneri 2a str. 2457T
guuuucaacgg

SEQ ID NO: 3823090 - RNA, 15 nt, Shigella flexneri 2a str. 2457T
guuuucaacggcggc

SEQ ID NO: 3823091 - RNA, 20 nt, Shigella flexneri 2a str. 2457T
guuuucaaugauaaagguca

SEQ ID NO: 3823092 - RNA, 20 nt, Shigella flexneri 2a str. 2457T
guuuucaccgcggauuucac

SEQ ID NO: 3823093 - RNA, 14 nt, Shigella flexneri 2a str. 2457T
guuuucaccggcac

SEQ ID NO: 3823094 - RNA, 17 nt, Shigella flexneri 2a str. 2457T
guuuucaguaccgcguc

SEQ ID NO: 3823095 - RNA, 18 nt, Shigella flexneri 2a str. 2457T
guuuucaguugcucugca

SEQ ID NO: 3823096 - RNA, 14 nt, Shigella flexneri 2a str. 2457T
guuuuccagcacca

SEQ ID NO: 3823097 - RNA, 14 nt, Shigella flexneri 2a str. 2457T
guuuuccagugcca

SEQ ID NO: 3823098 - RNA, 18 nt, Shigella flexneri 2a str. 2457T
guuuuccagugccagaac

SEQ ID NO: 3823099 - RNA, 13 nt, Shigella flexneri 2a str. 2457T
guuuuccuucagg

SEQ ID NO: 3823100 - RNA, 20 nt, Shigella flexneri 2a str. 2457T
guuuucgucaacguagcuau

SEQ ID NO: 3823101 - RNA, 17 nt, Shigella flexneri 2a str. 2457T
guuuucuaacucauuuu

SEQ ID NO: 3823102 - RNA, 20 nt, Shigella flexneri 2a str. 2457T
guuuucuaacucauuuuuua

SEQ ID NO: 3823103 - RNA, 14 nt, Shigella flexneri 2a str. 2457T
guuuucuccagcgc

SEQ ID NO: 3823104 - RNA, 11 nt, Shigella flexneri 2a str. 2457T
guuuucucucu

SEQ ID NO: 3823105 - RNA, 14 nt, Shigella flexneri 2a str. 2457T
guuuugaucuccag

SEQ ID NO: 3823106 - RNA, 13 nt, Shigella flexneri 2a str. 2457T
guuuugaugaauc

SEQ ID NO: 3823107 - RNA, 17 nt, Shigella flexneri 2a str. 2457T
guuuugcaucaacugcg

SEQ ID NO: 3823108 - RNA, 18 nt, Shigella flexneri 2a str. 2457T
guuuugcauggcaacuaa

SEQ ID NO: 3823109 - RNA, 20 nt, Shigella flexneri 2a str. 2457T
guuuugcccacucaacgguu

SEQ ID NO: 3823110 - RNA, 22 nt, Shigella flexneri 2a str. 2457T
uaaacgccggaugacacaucac

SEQ ID NO: 3823111 - RNA, 17 nt, Shigella flexneri 2a str. 2457T
uaaacgccguucuucag

SEQ ID NO: 3823112 - RNA, 20 nt, Shigella flexneri 2a str. 2457T
uaaacgccucugucagaaau

SEQ ID NO: 3823113 - RNA, 21 nt, Shigella flexneri 2a str. 2457T
uaaacgccugcuuaucgcccu

SEQ ID NO: 3823114 - RNA, 20 nt, Shigella flexneri 2a str. 2457T
uaaacgccuuauccguccua

SEQ ID NO: 3823115 - RNA, 18 nt, Shigella flexneri 2a str. 2457T
uaaacgcgcgcuggaagg

SEQ ID NO: 3823116 - RNA, 14 nt, Shigella flexneri 2a str. 2457T
uaaacgcuggcagg

SEQ ID NO: 3823117 - RNA, 20 nt, Shigella flexneri 2a str. 2457T
uaaacggcguaaaauucaca

SEQ ID NO: 3823118 - RNA, 19 nt, Shigella flexneri 2a str. 2457T
uaaacggcugggaaaucac

SEQ ID NO: 3823119 - RNA, 17 nt, Shigella flexneri 2a str. 2457T
uaaacgucucacuaacg

SEQ ID NO: 3823120 - RNA, 14 nt, Shigella flexneri 2a str. 2457T
uaaacguuuaaaaa

SEQ ID NO: 3823121 - RNA, 14 nt, Shigella flexneri 2a str. 2457T
uaaacugagccaaa

SEQ ID NO: 3823122 - RNA, 13 nt, Shigella flexneri 2a str. 2457T
uaaacuucaccag

SEQ ID NO: 3823123 - RNA, 19 nt, Shigella flexneri 2a str. 2457T
uaaacuucacuuccccgag

SEQ ID NO: 3823124 - RNA, 12 nt, Shigella flexneri 2a str. 2457T
uaaacuuucaua

SEQ ID NO: 3823125 - RNA, 13 nt, Shigella flexneri 2a str. 2457T
uaaagaaaguaau

SEQ ID NO: 3823126 - RNA, 21 nt, Shigella flexneri 2a str. 2457T
uaaagaaaucaccugccggag

SEQ ID NO: 3823127 - RNA, 10 nt, Shigella flexneri 2a str. 2457T
uaaagaagag

SEQ ID NO: 3823128 - RNA, 21 nt, Shigella flexneri 2a str. 2457T
uaaagaagauaccgaacauac

SEQ ID NO: 3823129 - RNA, 20 nt, Shigella flexneri 2a str. 2457T
uaaagaaggcauaacucccc

SEQ ID NO: 3823130 - RNA, 15 nt, Shigella flexneri 2a str. 2457T
uaaagaccauaaaua

SEQ ID NO: 3823131 - RNA, 21 nt, Shigella flexneri 2a str. 2457T
uaaagagaacucuuuuuuccg

SEQ ID NO: 3823132 - RNA, 22 nt, Shigella flexneri 2a str. 2457T
uaaagagcauuacacgcggcug

SEQ ID NO: 3823133 - RNA, 21 nt, Shigella flexneri 2a str. 2457T
uaaagcaucaauugcuaccga

SEQ ID NO: 3823134 - RNA, 20 nt, Shigella flexneri 2a str. 2457T
uaaagcauucacgccgcauc

SEQ ID NO: 3823135 - RNA, 19 nt, Shigella flexneri 2a str. 2457T
uaaagcccauaccacagca

SEQ ID NO: 3823136 - RNA, 21 nt, Shigella flexneri 2a str. 2457T
uaaagcccucaccgaagcgag

SEQ ID NO: 3823137 - RNA, 22 nt, Shigella flexneri 2a str. 2457T
uaaagccggugcggucaggcau

SEQ ID NO: 3823138 - RNA, 20 nt, Shigella flexneri 2a str. 2457T
uaaagccgugcugcugccaa

SEQ ID NO: 3823139 - RNA, 23 nt, Shigella flexneri 2a str. 2457T
uaaagccguggguauauuucagg

SEQ ID NO: 3823140 - RNA, 16 nt, Shigella flexneri 2a str. 2457T
uaaagccugcuggcag

SEQ ID NO: 3823141 - RNA, 14 nt, Shigella flexneri 2a str. 2457T
uaaagccuuuuacc

SEQ ID NO: 3823142 - RNA, 16 nt, Shigella flexneri 2a str. 2457T
uaaagccuuuuaccgc

SEQ ID NO: 3823143 - RNA, 19 nt, Shigella flexneri 2a str. 2457T
uaaagcgcggcagugacug

SEQ ID NO: 3823144 - RNA, 18 nt, Shigella flexneri 2a str. 2457T
uaaagcugccgucaauuu

SEQ ID NO: 3823145 - RNA, 21 nt, Shigella flexneri 2a str. 2457T
uaaaggagaaggguuaugaug

SEQ ID NO: 3823146 - RNA, 22 nt, Shigella flexneri 2a str. 2457T
uaaaggcggcagaacagaacau

SEQ ID NO: 3823147 - RNA, 21 nt, Shigella flexneri 2a str. 2457T
uaaagggacagauaauggaau

SEQ ID NO: 3823148 - RNA, 20 nt, Shigella flexneri 2a str. 2457T
uaaagggaucaauaaugaug

SEQ ID NO: 3823149 - RNA, 18 nt, Shigella flexneri 2a str. 2457T
uaaaggggugaaaaaaac

SEQ ID NO: 3823150 - RNA, 22 nt, Shigella flexneri 2a str. 2457T
uaaaggugaacaucgcagggaa

SEQ ID NO: 3823151 - RNA, 17 nt, Shigella flexneri 2a str. 2457T
uaaaguacucuuugaac

SEQ ID NO: 3823152 - RNA, 15 nt, Shigella flexneri 2a str. 2457T
uaaaguagaaauuau

SEQ ID NO: 3823153 - RNA, 14 nt, Shigella flexneri 2a str. 2457T
uaaaguagugucua

SEQ ID NO: 3823154 - RNA, 22 nt, Shigella flexneri 2a str. 2457T
uaaagucagcguuauagcgcau

SEQ ID NO: 3823155 - RNA, 13 nt, Shigella flexneri 2a str. 2457T
uaaaguuagucgc

SEQ ID NO: 3823156 - RNA, 14 nt, Shigella flexneri 2a str. 2457T
uaaaguuagucgcg

SEQ ID NO: 3823157 - RNA, 19 nt, Shigella flexneri 2a str. 2457T
uaaaguugcucucaaagac

SEQ ID NO: 3823158 - RNA, 12 nt, Shigella flexneri 2a str. 2457T
uaaaguuguuuu

SEQ ID NO: 3823159 - RNA, 15 nt, Shigella flexneri 2a str. 2457T
uaaaguuguuuucuu

SEQ ID NO: 3823160 - RNA, 14 nt, Shigella flexneri 2a str. 2457T
uaaaguuuuauccc

SEQ ID NO: 3823161 - RNA, 16 nt, Shigella flexneri 2a str. 2457T
uaaauaaaaagagauu

SEQ ID NO: 3823162 - RNA, 21 nt, Shigella flexneri 2a str. 2457T
uaaauaacuggugcuaacagc

SEQ ID NO: 3823163 - RNA, 20 nt, Shigella flexneri 2a str. 2457T
uaaauaaggugguagcugcc

SEQ ID NO: 3823164 - RNA, 12 nt, Shigella flexneri 2a str. 2457T
uaaauacagagc

SEQ ID NO: 3823165 - RNA, 13 nt, Shigella flexneri 2a str. 2457T
uaaauacagagca

SEQ ID NO: 3823166 - RNA, 22 nt, Shigella flexneri 2a str. 2457T
uaaauacagcuuaaucaccagc

SEQ ID NO: 3823167 - RNA, 15 nt, Shigella flexneri 2a str. 2457T
uaaauaccguucauu

SEQ ID NO: 3823168 - RNA, 22 nt, Shigella flexneri 2a str. 2457T
uaaauaccguucauuaacgccc

SEQ ID NO: 3823169 - RNA, 18 nt, Shigella flexneri 2a str. 2457T
uaaauaccuuccggcgua

SEQ ID NO: 3823170 - RNA, 18 nt, Shigella flexneri 2a str. 2457T
uaaauacgccccacagac

SEQ ID NO: 3823171 - RNA, 16 nt, Shigella flexneri 2a str. 2457T
uaaauacuccauaacu

SEQ ID NO: 3823172 - RNA, 16 nt, Shigella flexneri 2a str. 2457T
uaaauagaggaaucug

SEQ ID NO: 3823173 - RNA, 17 nt, Shigella flexneri 2a str. 2457T
uaaauagaggaaucuga

SEQ ID NO: 3823174 - RNA, 12 nt, Shigella flexneri 2a str. 2457T
uaaauaguggca

SEQ ID NO: 3823175 - RNA, 18 nt, Shigella flexneri 2a str. 2457T
uaaauaguggcaaauucu

SEQ ID NO: 3823176 - RNA, 18 nt, Shigella flexneri 2a str. 2457T
uaaauauauaaaaaaaca

SEQ ID NO: 3823177 - RNA, 21 nt, Shigella flexneri 2a str. 2457T
uaaauauuaaggguaaaagga

SEQ ID NO: 3823178 - RNA, 18 nt, Shigella flexneri 2a str. 2457T
uaaauauuaauacaacaa

SEQ ID NO: 3823179 - RNA, 21 nt, Shigella flexneri 2a str. 2457T
uaaauauuaauacaacaacac

SEQ ID NO: 3823180 - RNA, 14 nt, Shigella flexneri 2a str. 2457T
uaaauauuauuggc

SEQ ID NO: 3823181 - RNA, 11 nt, Shigella flexneri 2a str. 2457T
uaaaucaaacc

SEQ ID NO: 3823182 - RNA, 20 nt, Shigella flexneri 2a str. 2457T
uaaaucagaacuucgcguug

SEQ ID NO: 3823183 - RNA, 11 nt, Shigella flexneri 2a str. 2457T
uaaaucagauc

SEQ ID NO: 3823184 - RNA, 18 nt, Shigella flexneri 2a str. 2457T
uaaaucaucggguuacug

SEQ ID NO: 3823185 - RNA, 14 nt, Shigella flexneri 2a str. 2457T
uaaauccauaagau

SEQ ID NO: 3823186 - RNA, 14 nt, Shigella flexneri 2a str. 2457T
uaaaucccagugcc

SEQ ID NO: 3823187 - RNA, 20 nt, Shigella flexneri 2a str. 2457T
uaaaucccagugccugcaua

SEQ ID NO: 3823188 - RNA, 22 nt, Shigella flexneri 2a str. 2457T
uaaauccccggcggcguucagu

SEQ ID NO: 3823189 - RNA, 14 nt, Shigella flexneri 2a str. 2457T
uaaaucccgccauu

SEQ ID NO: 3823190 - RNA, 16 nt, Shigella flexneri 2a str. 2457T
uaaaucccuggcugca

SEQ ID NO: 3823191 - RNA, 14 nt, Shigella flexneri 2a str. 2457T
uaaauccuuuguac

SEQ ID NO: 3823192 - RNA, 15 nt, Shigella flexneri 2a str. 2457T
uaaauccuuuguaca

SEQ ID NO: 3823193 - RNA, 15 nt, Shigella flexneri 2a str. 2457T
uaaaucgccaugguc

SEQ ID NO: 3823194 - RNA, 22 nt, Shigella flexneri 2a str. 2457T
uaaaucgggcgguguuggggca

SEQ ID NO: 3823195 - RNA, 18 nt, Shigella flexneri 2a str. 2457T
uaaaucgguauuuccauu

SEQ ID NO: 3823196 - RNA, 14 nt, Shigella flexneri 2a str. 2457T
uaaaucugccguca

SEQ ID NO: 3823197 - RNA, 19 nt, Shigella flexneri 2a str. 2457T
uaaaugaacucaacgccuu

SEQ ID NO: 3823198 - RNA, 20 nt, Shigella flexneri 2a str. 2457T
uaaaugccgcaaugugcucu

SEQ ID NO: 3823199 - RNA, 20 nt, Shigella flexneri 2a str. 2457T
uaaaugccgcguggccugga

SEQ ID NO: 3823200 - RNA, 17 nt, Shigella flexneri 2a str. 2457T
uaaaugcugcagccagg

SEQ ID NO: 3823201 - RNA, 22 nt, Shigella flexneri 2a str. 2457T
uaaauggcgaacgggauaaacg

SEQ ID NO: 3823202 - RNA, 24 nt, Shigella flexneri 2a str. 2457T
uaaauguauucugaaaacggacau

SEQ ID NO: 3823203 - RNA, 23 nt, Shigella flexneri 2a str. 2457T
uaaauuaacugcgcgauuaucau

SEQ ID NO: 3823204 - RNA, 18 nt, Shigella flexneri 2a str. 2457T
uaaauuacugccgcuguu

SEQ ID NO: 3823205 - RNA, 21 nt, Shigella flexneri 2a str. 2457T
uaaauucaaugaauuaaaaaa

SEQ ID NO: 3823206 - RNA, 21 nt, Shigella flexneri 2a str. 2457T
uaaauucccgcagauaaauau

SEQ ID NO: 3823207 - RNA, 21 nt, Shigella flexneri 2a str. 2457T
uaacgaucgccugguaccagc

SEQ ID NO: 3823208 - RNA, 17 nt, Shigella flexneri 2a str. 2457T
uaacgaugccagcaccg

SEQ ID NO: 3823209 - RNA, 14 nt, Shigella flexneri 2a str. 2457T
uaacgcaagugauc

SEQ ID NO: 3823210 - RNA, 20 nt, Shigella flexneri 2a str. 2457T
uaacgcagaaucuucuucuc

SEQ ID NO: 3823211 - RNA, 22 nt, Shigella flexneri 2a str. 2457T
uaacgcagggcuguuuaucgug

SEQ ID NO: 3823212 - RNA, 22 nt, Shigella flexneri 2a str. 2457T
uaacgcaucggcuaaaccauca

SEQ ID NO: 3823213 - RNA, 23 nt, Shigella flexneri 2a str. 2457T
uaacgccaauucauuccuugaaa

SEQ ID NO: 3823214 - RNA, 17 nt, Shigella flexneri 2a str. 2457T
uaacgccauauugcugu

SEQ ID NO: 3823215 - RNA, 19 nt, Shigella flexneri 2a str. 2457T
uaacgccaugagcggacug

SEQ ID NO: 3823216 - RNA, 15 nt, Shigella flexneri 2a str. 2457T
uaacgccccaaucca

SEQ ID NO: 3823217 - RNA, 12 nt, Shigella flexneri 2a str. 2457T
uaacgccccaca

SEQ ID NO: 3823218 - RNA, 15 nt, Shigella flexneri 2a str. 2457T
uaacgccccacaaac

SEQ ID NO: 3823219 - RNA, 16 nt, Shigella flexneri 2a str. 2457T
uaacgccccacaaacc

SEQ ID NO: 3823220 - RNA, 14 nt, Shigella flexneri 2a str. 2457T
uaacgccuggcagu

SEQ ID NO: 3823221 - RNA, 19 nt, Shigella flexneri 2a str. 2457T
uaacgccuuauccggccua

SEQ ID NO: 3823222 - RNA, 16 nt, Shigella flexneri 2a str. 2457T
uaacgccuucccuuuc

SEQ ID NO: 3823223 - RNA, 19 nt, Shigella flexneri 2a str. 2457T
uaacgccuucccuuucagc

SEQ ID NO: 3823224 - RNA, 22 nt, Shigella flexneri 2a str. 2457T
uaacgccuucccuuucagcaaa

SEQ ID NO: 3823225 - RNA, 15 nt, Shigella flexneri 2a str. 2457T
uaacgccuuuuccag

SEQ ID NO: 3823226 - RNA, 18 nt, Shigella flexneri 2a str. 2457T
uaacgcuggcagcaagug

SEQ ID NO: 3823227 - RNA, 17 nt, Shigella flexneri 2a str. 2457T
uaacgcuucucccagcc

SEQ ID NO: 3823228 - RNA, 18 nt, Shigella flexneri 2a str. 2457T
uaacgcuugcugauaacg

SEQ ID NO: 3823229 - RNA, 23 nt, Shigella flexneri 2a str. 2457T
uaacggaacguugccugauuuua

SEQ ID NO: 3823230 - RNA, 17 nt, Shigella flexneri 2a str. 2457T
uaacggaauugccaacg

SEQ ID NO: 3823231 - RNA, 21 nt, Shigella flexneri 2a str. 2457T
uaacggaggacuuauggcugg

SEQ ID NO: 3823232 - RNA, 22 nt, Shigella flexneri 2a str. 2457T
uaacggcagaagcugcaggacc

SEQ ID NO: 3823233 - RNA, 20 nt, Shigella flexneri 2a str. 2457T
uaacggcagcaaggcuauuc

SEQ ID NO: 3823234 - RNA, 19 nt, Shigella flexneri 2a str. 2457T
uaacggccuuuugccagau

SEQ ID NO: 3823235 - RNA, 16 nt, Shigella flexneri 2a str. 2457T
uaacggcugauaacaa

SEQ ID NO: 3823236 - RNA, 19 nt, Shigella flexneri 2a str. 2457T
uaacggucgguuagaacaa

SEQ ID NO: 3823237 - RNA, 21 nt, Shigella flexneri 2a str. 2457T
uaacgguucaauuuaaggaau

SEQ ID NO: 3823238 - RNA, 19 nt, Shigella flexneri 2a str. 2457T
uaacgucgguuucaucaca

SEQ ID NO: 3823239 - RNA, 15 nt, Shigella flexneri 2a str. 2457T
uaacguuauauccca

SEQ ID NO: 3823240 - RNA, 17 nt, Shigella flexneri 2a str. 2457T
uaacguuauaucccauu

SEQ ID NO: 3823241 - RNA, 19 nt, Shigella flexneri 2a str. 2457T
uaacguugaaccgccccac

SEQ ID NO: 3823242 - RNA, 13 nt, Shigella flexneri 2a str. 2457T
uaacguuuuuaaa

SEQ ID NO: 3823243 - RNA, 15 nt, Shigella flexneri 2a str. 2457T
uaacuacaaucacga

SEQ ID NO: 3823244 - RNA, 22 nt, Shigella flexneri 2a str. 2457T
uaacuacccaaccgauaaccac

SEQ ID NO: 3823245 - RNA, 20 nt, Shigella flexneri 2a str. 2457T
uaacuauaaccguaauaguu

SEQ ID NO: 3823246 - RNA, 23 nt, Shigella flexneri 2a str. 2457T
uaacuauuguuuugaugaaucag

SEQ ID NO: 3823247 - RNA, 20 nt, Shigella flexneri 2a str. 2457T
uaacucaaaaauaaucaucu

SEQ ID NO: 3823248 - RNA, 21 nt, Shigella flexneri 2a str. 2457T
uaacucaaaaauaaucaucuc

SEQ ID NO: 3823249 - RNA, 15 nt, Shigella flexneri 2a str. 2457T
uaacucaauaccuga

SEQ ID NO: 3823250 - RNA, 23 nt, Shigella flexneri 2a str. 2457T
uaacucaauaccugaugagaugc

SEQ ID NO: 3823251 - RNA, 17 nt, Shigella flexneri 2a str. 2457T
uaacucccccuuucuga

SEQ ID NO: 3823252 - RNA, 22 nt, Shigella flexneri 2a str. 2457T
uaacuccuucuaaagcaacucc

SEQ ID NO: 3823253 - RNA, 23 nt, Shigella flexneri 2a str. 2457T
uaacuccuucuaaagcaacucca

SEQ ID NO: 3823254 - RNA, 20 nt, Shigella flexneri 2a str. 2457T
uaacucuuucaaugcuuuuu

SEQ ID NO: 3823255 - RNA, 19 nt, Shigella flexneri 2a str. 2457T
uaacucuuugaugaaacau

SEQ ID NO: 3823256 - RNA, 17 nt, Shigella flexneri 2a str. 2457T
uaacugacuuccgcuag

SEQ ID NO: 3823257 - RNA, 22 nt, Shigella flexneri 2a str. 2457T
uaacugauggcaaaugcagcau

SEQ ID NO: 3823258 - RNA, 19 nt, Shigella flexneri 2a str. 2457T
uaacugccgucaaugcgca

SEQ ID NO: 3823259 - RNA, 15 nt, Shigella flexneri 2a str. 2457T
uaacuggucaucaaa

SEQ ID NO: 3823260 - RNA, 17 nt, Shigella flexneri 2a str. 2457T
uaacuuaauaaacauca

SEQ ID NO: 3823261 - RNA, 13 nt, Shigella flexneri 2a str. 2457T
uaacuuaauguca

SEQ ID NO: 3823262 - RNA, 12 nt, Shigella flexneri 2a str. 2457T
uaacuucaucag

SEQ ID NO: 3823263 - RNA, 15 nt, Shigella flexneri 2a str. 2457T
uaacuucaucagcaa

SEQ ID NO: 3823264 - RNA, 22 nt, Shigella flexneri 2a str. 2457T
uaacuucuuuacuggcuuucau

SEQ ID NO: 3823265 - RNA, 17 nt, Shigella flexneri 2a str. 2457T
uaacuuugaagcccagu

SEQ ID NO: 3823266 - RNA, 23 nt, Shigella flexneri 2a str. 2457T
uaagaaauagcccucgccgcuuc

SEQ ID NO: 3823267 - RNA, 23 nt, Shigella flexneri 2a str. 2457T
uaagaacugacuuccacuuccug

SEQ ID NO: 3823268 - RNA, 17 nt, Shigella flexneri 2a str. 2457T
uaagaagccuuuaucug

SEQ ID NO: 3823269 - RNA, 16 nt, Shigella flexneri 2a str. 2457T
uaagaagggcuggcca

SEQ ID NO: 3823270 - RNA, 17 nt, Shigella flexneri 2a str. 2457T
uaagaaugcgaaaacga

SEQ ID NO: 3823271 - RNA, 22 nt, Shigella flexneri 2a str. 2457T
uaagaauguccauuauuucaau

SEQ ID NO: 3823272 - RNA, 16 nt, Shigella flexneri 2a str. 2457T
uaagaauugauaaaaa

SEQ ID NO: 3823273 - RNA, 17 nt, Shigella flexneri 2a str. 2457T
uaagaauugauaaaaaa

SEQ ID NO: 3823274 - RNA, 14 nt, Shigella flexneri 2a str. 2457T
uaagaauuuuauac

SEQ ID NO: 3823275 - RNA, 21 nt, Shigella flexneri 2a str. 2457T
uaagacagcgucacaucaggc

SEQ ID NO: 3823276 - RNA, 22 nt, Shigella flexneri 2a str. 2457T
uaagacgcgcagcgucgcauca

SEQ ID NO: 3823277 - RNA, 16 nt, Shigella flexneri 2a str. 2457T
uaagacgcgccagcgu

SEQ ID NO: 3823278 - RNA, 22 nt, Shigella flexneri 2a str. 2457T
uaagacgcguuagcaucgcauc

SEQ ID NO: 3823279 - RNA, 18 nt, Shigella flexneri 2a str. 2457T
uaagacuggcaaaugaca

SEQ ID NO: 3823280 - RNA, 18 nt, Shigella flexneri 2a str. 2457T
uaagacuuaccagcccua

SEQ ID NO: 3823281 - RNA, 20 nt, Shigella flexneri 2a str. 2457T
uaagaguagcccgauacgcu

SEQ ID NO: 3823282 - RNA, 15 nt, Shigella flexneri 2a str. 2457T
uaagaguuucaacau

SEQ ID NO: 3823283 - RNA, 23 nt, Shigella flexneri 2a str. 2457T
uaagauaaauuccugcuuauugu

SEQ ID NO: 3823284 - RNA, 18 nt, Shigella flexneri 2a str. 2457T
uaagauaccccagcgcaa

SEQ ID NO: 3823285 - RNA, 18 nt, Shigella flexneri 2a str. 2457T
uaagaucaucggccagau

SEQ ID NO: 3823286 - RNA, 22 nt, Shigella flexneri 2a str. 2457T
uaagaucaucggccagauaaua

SEQ ID NO: 3823287 - RNA, 22 nt, Shigella flexneri 2a str. 2457T
uaagauccccggucuuacccgc

SEQ ID NO: 3823288 - RNA, 15 nt, Shigella flexneri 2a str. 2457T
uaagaugcgccagca

SEQ ID NO: 3823289 - RNA, 15 nt, Shigella flexneri 2a str. 2457T
uaagaugcuacaaca

SEQ ID NO: 3823290 - RNA, 13 nt, Shigella flexneri 2a str. 2457T
uaagauucagccc

SEQ ID NO: 3823291 - RNA, 14 nt, Shigella flexneri 2a str. 2457T
uaagcaaaaaaaca

SEQ ID NO: 3823292 - RNA, 15 nt, Shigella flexneri 2a str. 2457T
uaagcaaaaaaacau

SEQ ID NO: 3823293 - RNA, 16 nt, Shigella flexneri 2a str. 2457T
uaagcaaaaaaacaua

SEQ ID NO: 3823294 - RNA, 22 nt, Shigella flexneri 2a str. 2457T
uaagcaaagcggucuucuguga

SEQ ID NO: 3823295 - RNA, 21 nt, Shigella flexneri 2a str. 2457T
uaagcaacugacuggcucuuu

SEQ ID NO: 3823296 - RNA, 20 nt, Shigella flexneri 2a str. 2457T
uaagcacuacucuauacagg

SEQ ID NO: 3823297 - RNA, 16 nt, Shigella flexneri 2a str. 2457T
uaagcagccaucugau

SEQ ID NO: 3823298 - RNA, 18 nt, Shigella flexneri 2a str. 2457T
uaagcaggcuggcuacga

SEQ ID NO: 3823299 - RNA, 17 nt, Shigella flexneri 2a str. 2457T
uaagcaguccagcgccu

SEQ ID NO: 3823300 - RNA, 23 nt, Shigella flexneri 2a str. 2457T
uaagccagaccacccguaauccc

SEQ ID NO: 3823301 - RNA, 17 nt, Shigella flexneri 2a str. 2457T
uaagccauuuaacucac

SEQ ID NO: 3823302 - RNA, 20 nt, Shigella flexneri 2a str. 2457T
uaagcccagaacaaauaaau

SEQ ID NO: 3823303 - RNA, 15 nt, Shigella flexneri 2a str. 2457T
uaaucaccaaucaca

SEQ ID NO: 3823304 - RNA, 16 nt, Shigella flexneri 2a str. 2457T
uaaucaccaaucacaa

SEQ ID NO: 3823305 - RNA, 18 nt, Shigella flexneri 2a str. 2457T
uaaucaccaaucacaacu

SEQ ID NO: 3823306 - RNA, 17 nt, Shigella flexneri 2a str. 2457T
uaaucagaauuuuucgc

SEQ ID NO: 3823307 - RNA, 19 nt, Shigella flexneri 2a str. 2457T
uaaucagcgaguuaccuua

SEQ ID NO: 3823308 - RNA, 16 nt, Shigella flexneri 2a str. 2457T
uaaucagcuuuuccau

SEQ ID NO: 3823309 - RNA, 13 nt, Shigella flexneri 2a str. 2457T
uaaucaggcuauc

SEQ ID NO: 3823310 - RNA, 17 nt, Shigella flexneri 2a str. 2457T
uaaucauauuaaauuuu

SEQ ID NO: 3823311 - RNA, 18 nt, Shigella flexneri 2a str. 2457T
uaaucauauuguccugua

SEQ ID NO: 3823312 - RNA, 21 nt, Shigella flexneri 2a str. 2457T
uaaucaucacgccaauaccgc

SEQ ID NO: 3823313 - RNA, 18 nt, Shigella flexneri 2a str. 2457T
uaaucaucccacaugaau

SEQ ID NO: 3823314 - RNA, 12 nt, Shigella flexneri 2a str. 2457T
uaauccacuuuc

SEQ ID NO: 3823315 - RNA, 17 nt, Shigella flexneri 2a str. 2457T
uaauccacuuucuuaaa

SEQ ID NO: 3823316 - RNA, 21 nt, Shigella flexneri 2a str. 2457T
uaauccauaguguguuccucu

SEQ ID NO: 3823317 - RNA, 15 nt, Shigella flexneri 2a str. 2457T
uaauccccaaugacc

SEQ ID NO: 3823318 - RNA, 20 nt, Shigella flexneri 2a str. 2457T
uaauccgcuguaauugccgc

SEQ ID NO: 3823319 - RNA, 21 nt, Shigella flexneri 2a str. 2457T
uaauccgguuuacccgcuuga

SEQ ID NO: 3823320 - RNA, 15 nt, Shigella flexneri 2a str. 2457T
uaauccguaaagccc

SEQ ID NO: 3823321 - RNA, 18 nt, Shigella flexneri 2a str. 2457T
uaauccugaguuaagcaa

SEQ ID NO: 3823322 - RNA, 15 nt, Shigella flexneri 2a str. 2457T
uaauccuuucucaau

SEQ ID NO: 3823323 - RNA, 13 nt, Shigella flexneri 2a str. 2457T
uaaucgaaccaaa

SEQ ID NO: 3823324 - RNA, 17 nt, Shigella flexneri 2a str. 2457T
uaaucgauaaaccagca

SEQ ID NO: 3823325 - RNA, 20 nt, Shigella flexneri 2a str. 2457T
uaaucgcauugguuuuuugg

SEQ ID NO: 3823326 - RNA, 18 nt, Shigella flexneri 2a str. 2457T
uaaucgccagcaaaauca

SEQ ID NO: 3823327 - RNA, 22 nt, Shigella flexneri 2a str. 2457T
uaaucgccagcaaaaucaccau

SEQ ID NO: 3823328 - RNA, 16 nt, Shigella flexneri 2a str. 2457T
uaaucgcccggauauc

SEQ ID NO: 3823329 - RNA, 19 nt, Shigella flexneri 2a str. 2457T
uaaucgccguauaauaucu

SEQ ID NO: 3823330 - RNA, 18 nt, Shigella flexneri 2a str. 2457T
uaaucgccuuaauaaccc

SEQ ID NO: 3823331 - RNA, 16 nt, Shigella flexneri 2a str. 2457T
uaaucgcucagcgcau

SEQ ID NO: 3823332 - RNA, 20 nt, Shigella flexneri 2a str. 2457T
uaaucggcgcggcgguugac

SEQ ID NO: 3823333 - RNA, 19 nt, Shigella flexneri 2a str. 2457T
uaaucggggauaagaauau

SEQ ID NO: 3823334 - RNA, 23 nt, Shigella flexneri 2a str. 2457T
uaaucguccgauuaaaaacccug

SEQ ID NO: 3823335 - RNA, 14 nt, Shigella flexneri 2a str. 2457T
uaaucgugaaaagc

SEQ ID NO: 3823336 - RNA, 22 nt, Shigella flexneri 2a str. 2457T
uaaucguuggcagacguuuuuu

SEQ ID NO: 3823337 - RNA, 14 nt, Shigella flexneri 2a str. 2457T
uaaucguugucuua

SEQ ID NO: 3823338 - RNA, 18 nt, Shigella flexneri 2a str. 2457T
uaaucuaccguuacggcu

SEQ ID NO: 3823339 - RNA, 14 nt, Shigella flexneri 2a str. 2457T
uaaucuauauuucu

SEQ ID NO: 3823340 - RNA, 16 nt, Shigella flexneri 2a str. 2457T
uaaucucgccuuauca

SEQ ID NO: 3823341 - RNA, 15 nt, Shigella flexneri 2a str. 2457T
uaaucucuacaccaa

SEQ ID NO: 3823342 - RNA, 19 nt, Shigella flexneri 2a str. 2457T
uaaucucuacaccaacgcc

SEQ ID NO: 3823343 - RNA, 17 nt, Shigella flexneri 2a str. 2457T
uaaucugaagaaaacca

SEQ ID NO: 3823344 - RNA, 12 nt, Shigella flexneri 2a str. 2457T
uaaucugccagc

SEQ ID NO: 3823345 - RNA, 22 nt, Shigella flexneri 2a str. 2457T
uaaucugguaucgaguggcgca

SEQ ID NO: 3823346 - RNA, 22 nt, Shigella flexneri 2a str. 2457T
uaaucuuccagaucaccgcaga

SEQ ID NO: 3823347 - RNA, 11 nt, Shigella flexneri 2a str. 2457T
uaaugaaucau

SEQ ID NO: 3823348 - RNA, 20 nt, Shigella flexneri 2a str. 2457T
uaaugacaaaauugcuguua

SEQ ID NO: 3823349 - RNA, 11 nt, Shigella flexneri 2a str. 2457T
uaaugacucca

SEQ ID NO: 3823350 - RNA, 22 nt, Shigella flexneri 2a str. 2457T
uaaugacuccaacuuacugaua

SEQ ID NO: 3823351 - RNA, 15 nt, Shigella flexneri 2a str. 2457T
uaaugagauauuuaa

SEQ ID NO: 3823352 - RNA, 13 nt, Shigella flexneri 2a str. 2457T
uaaugagcacaga

SEQ ID NO: 3823353 - RNA, 22 nt, Shigella flexneri 2a str. 2457T
uaaugauacuauaaguguaaaa

SEQ ID NO: 3823354 - RNA, 16 nt, Shigella flexneri 2a str. 2457T
uaaugauguaaaaaua

SEQ ID NO: 3823355 - RNA, 18 nt, Shigella flexneri 2a str. 2457T
uaaugauuuaaaaccacu

SEQ ID NO: 3823356 - RNA, 15 nt, Shigella flexneri 2a str. 2457T
uaaugcaaaaugccg

SEQ ID NO: 3823357 - RNA, 16 nt, Shigella flexneri 2a str. 2457T
uaaugcaaucaaaaau

SEQ ID NO: 3823358 - RNA, 18 nt, Shigella flexneri 2a str. 2457T
uaaugcaaucaaaaaugg

SEQ ID NO: 3823359 - RNA, 19 nt, Shigella flexneri 2a str. 2457T
uaaugcaggcagcacugcu

SEQ ID NO: 3823360 - RNA, 13 nt, Shigella flexneri 2a str. 2457T
uaaugccaguccc

SEQ ID NO: 3823361 - RNA, 17 nt, Shigella flexneri 2a str. 2457T
uaaugcccgaugaccuu

SEQ ID NO: 3823362 - RNA, 23 nt, Shigella flexneri 2a str. 2457T
uaaugccgacauaggccagccgc

SEQ ID NO: 3823363 - RNA, 11 nt, Shigella flexneri 2a str. 2457T
uaaugccggau

SEQ ID NO: 3823364 - RNA, 16 nt, Shigella flexneri 2a str. 2457T
uaaugccguuuggcaa

SEQ ID NO: 3823365 - RNA, 12 nt, Shigella flexneri 2a str. 2457T
uaaugccucgug

SEQ ID NO: 3823366 - RNA, 16 nt, Shigella flexneri 2a str. 2457T
uaaugccucuccccag

SEQ ID NO: 3823367 - RNA, 22 nt, Shigella flexneri 2a str. 2457T
uaaugccucuccccagcggaaa

SEQ ID NO: 3823368 - RNA, 22 nt, Shigella flexneri 2a str. 2457T
uaaugccugcacuuugugucag

SEQ ID NO: 3823369 - RNA, 22 nt, Shigella flexneri 2a str. 2457T
uaaugccugggcgauuuccuuc

SEQ ID NO: 3823370 - RNA, 15 nt, Shigella flexneri 2a str. 2457T
uaaugcgcuuccugc

SEQ ID NO: 3823371 - RNA, 14 nt, Shigella flexneri 2a str. 2457T
uaaugcgcuuuuac

SEQ ID NO: 3823372 - RNA, 16 nt, Shigella flexneri 2a str. 2457T
uaaugcugucgguuua

SEQ ID NO: 3823373 - RNA, 18 nt, Shigella flexneri 2a str. 2457T
uaaugcuguuccagacca

SEQ ID NO: 3823374 - RNA, 12 nt, Shigella flexneri 2a str. 2457T
uaaugcuucaca

SEQ ID NO: 3823375 - RNA, 12 nt, Shigella flexneri 2a str. 2457T
uaauggaaaacu

SEQ ID NO: 3823376 - RNA, 13 nt, Shigella flexneri 2a str. 2457T
uaauggacgaacu

SEQ ID NO: 3823377 - RNA, 20 nt, Shigella flexneri 2a str. 2457T
uaauggcaccguucuuuauu

SEQ ID NO: 3823378 - RNA, 21 nt, Shigella flexneri 2a str. 2457T
uaauggcuggggaauauuuaa

SEQ ID NO: 3823379 - RNA, 11 nt, Shigella flexneri 2a str. 2457T
uaaugucuggg

SEQ ID NO: 3823380 - RNA, 18 nt, Shigella flexneri 2a str. 2457T
uaaugucuuuaauggcac

SEQ ID NO: 3823381 - RNA, 20 nt, Shigella flexneri 2a str. 2457T
uaaugugucugaaagcagac

SEQ ID NO: 3823382 - RNA, 14 nt, Shigella flexneri 2a str. 2457T
uaauguguucaacu

SEQ ID NO: 3823383 - RNA, 23 nt, Shigella flexneri 2a str. 2457T
uaauguugauccagucagugguu

SEQ ID NO: 3823384 - RNA, 14 nt, Shigella flexneri 2a str. 2457T
uaauguuuaucuac

SEQ ID NO: 3823385 - RNA, 13 nt, Shigella flexneri 2a str. 2457T
uaauuaaaaauag

SEQ ID NO: 3823386 - RNA, 14 nt, Shigella flexneri 2a str. 2457T
uaauuaauacgcca

SEQ ID NO: 3823387 - RNA, 20 nt, Shigella flexneri 2a str. 2457T
uaauuacaccaaucauucaa

SEQ ID NO: 3823388 - RNA, 14 nt, Shigella flexneri 2a str. 2457T
uaauuacacccuua

SEQ ID NO: 3823389 - RNA, 24 nt, Shigella flexneri 2a str. 2457T
uaauuaccuuaucaaucucagcaa

SEQ ID NO: 3823390 - RNA, 12 nt, Shigella flexneri 2a str. 2457T
uaauuacugaga

SEQ ID NO: 3823391 - RNA, 23 nt, Shigella flexneri 2a str. 2457T
uaauuacugccuuaaucaagaaa

SEQ ID NO: 3823392 - RNA, 12 nt, Shigella flexneri 2a str. 2457T
uaauuagcuguu

SEQ ID NO: 3823393 - RNA, 17 nt, Shigella flexneri 2a str. 2457T
uaauuaggcuaaauaac

SEQ ID NO: 3823394 - RNA, 15 nt, Shigella flexneri 2a str. 2457T
uaauuagugcugcug

SEQ ID NO: 3823395 - RNA, 13 nt, Shigella flexneri 2a str. 2457T
uaauuauccugug

SEQ ID NO: 3823396 - RNA, 11 nt, Shigella flexneri 2a str. 2457T
uaauuauuaac

SEQ ID NO: 3823397 - RNA, 15 nt, Shigella flexneri 2a str. 2457T
uaauucaaaaaccug

SEQ ID NO: 3823398 - RNA, 11 nt, Shigella flexneri 2a str. 2457T
uaauucagccg

SEQ ID NO: 3823399 - RNA, 12 nt, Shigella flexneri 2a str. 2457T
uaauucaggaaa

SEQ ID NO: 3823400 - RNA, 23 nt, Shigella flexneri 2a str. 2457T
uaauuccucccguuaugaucagc

SEQ ID NO: 3823401 - RNA, 19 nt, Shigella flexneri 2a str. 2457T
uaauugaccagaucuucau

SEQ ID NO: 3823402 - RNA, 23 nt, Shigella flexneri 2a str. 2457T
uaauugccagcuugcuuuccagc

SEQ ID NO: 3823403 - RNA, 20 nt, Shigella flexneri 2a str. 2457T
uaauugccggaugcgacgca

SEQ ID NO: 3823404 - RNA, 10 nt, Shigella flexneri 2a str. 2457T
uaauugcucc

SEQ ID NO: 3823405 - RNA, 15 nt, Shigella flexneri 2a str. 2457T
uaauugcuuuuacca

SEQ ID NO: 3823406 - RNA, 23 nt, Shigella flexneri 2a str. 2457T
uaauugcuuuuaccauacuggau

SEQ ID NO: 3823407 - RNA, 18 nt, Shigella flexneri 2a str. 2457T
uaauugcuuuuuuccaua

SEQ ID NO: 3823408 - RNA, 20 nt, Shigella flexneri 2a str. 2457T
uaauuggaauacauauauua

SEQ ID NO: 3823409 - RNA, 20 nt, Shigella flexneri 2a str. 2457T
uaauuguuaucguuugcauu

SEQ ID NO: 3823410 - RNA, 15 nt, Shigella flexneri 2a str. 2457T
uaauuuagugaccaa

SEQ ID NO: 3823411 - RNA, 19 nt, Shigella flexneri 2a str. 2457T
uaauuuagugaccaaucau

SEQ ID NO: 3823412 - RNA, 19 nt, Shigella flexneri 2a str. 2457T
uaauuucauuuugauauuu

SEQ ID NO: 3823413 - RNA, 13 nt, Shigella flexneri 2a str. 2457T
uaauuuccacgcc

SEQ ID NO: 3823414 - RNA, 18 nt, Shigella flexneri 2a str. 2457T
uaauuucggcagcgcgcu

SEQ ID NO: 3823415 - RNA, 18 nt, Shigella flexneri 2a str. 2457T
uaauuucuucguucgcug

SEQ ID NO: 3823416 - RNA, 20 nt, Shigella flexneri 2a str. 2457T
uaauuugcggaauuuuuccg

SEQ ID NO: 3823417 - RNA, 21 nt, Shigella flexneri 2a str. 2457T
uaauuuugugcagcaugcacc

SEQ ID NO: 3823418 - RNA, 23 nt, Shigella flexneri 2a str. 2457T
uaauuuuuauauagccagccuca

SEQ ID NO: 3823419 - RNA, 18 nt, Shigella flexneri 2a str. 2457T
uaauuuuucaauauccaa

SEQ ID NO: 3823420 - RNA, 23 nt, Shigella flexneri 2a str. 2457T
uaauuuuuccagcauuucuucca

SEQ ID NO: 3823421 - RNA, 14 nt, Shigella flexneri 2a str. 2457T
uaauuuuuucuucc

SEQ ID NO: 3823422 - RNA, 22 nt, Shigella flexneri 2a str. 2457T
uacaaaaaaggccgcaggcugu

SEQ ID NO: 3823423 - RNA, 15 nt, Shigella flexneri 2a str. 2457T
uacaaaaaaugugaa

SEQ ID NO: 3823424 - RNA, 23 nt, Shigella flexneri 2a str. 2457T
uacaaaaucuugcaaauucaaua

SEQ ID NO: 3823425 - RNA, 19 nt, Shigella flexneri 2a str. 2457T
uacaaagccaacagcagcc

SEQ ID NO: 3823426 - RNA, 16 nt, Shigella flexneri 2a str. 2457T
uacaaaguguuguucu

SEQ ID NO: 3823427 - RNA, 22 nt, Shigella flexneri 2a str. 2457T
uacaaauuugugcaaauucaau

SEQ ID NO: 3823428 - RNA, 21 nt, Shigella flexneri 2a str. 2457T
uacaaccaaaucugauuaaua

SEQ ID NO: 3823429 - RNA, 23 nt, Shigella flexneri 2a str. 2457T
uacaaccgcaaagguugcugcgc

SEQ ID NO: 3823430 - RNA, 17 nt, Shigella flexneri 2a str. 2457T
uacaaccugcuggaaag

SEQ ID NO: 3823431 - RNA, 19 nt, Shigella flexneri 2a str. 2457T
uacaacgccguuuaauauu

SEQ ID NO: 3823432 - RNA, 15 nt, Shigella flexneri 2a str. 2457T
uacaacgcgcgguga

SEQ ID NO: 3823433 - RNA, 13 nt, Shigella flexneri 2a str. 2457T
uacaacguuaccg

SEQ ID NO: 3823434 - RNA, 21 nt, Shigella flexneri 2a str. 2457T
uacaacugccgcgccugaauc

SEQ ID NO: 3823435 - RNA, 15 nt, Shigella flexneri 2a str. 2457T
uacaacuuacgcagu

SEQ ID NO: 3823436 - RNA, 13 nt, Shigella flexneri 2a str. 2457T
uacaagcagagag

SEQ ID NO: 3823437 - RNA, 21 nt, Shigella flexneri 2a str. 2457T
uacaaguccguugaaaaugcu

SEQ ID NO: 3823438 - RNA, 16 nt, Shigella flexneri 2a str. 2457T
uacaauaugaauuacu

SEQ ID NO: 3823439 - RNA, 21 nt, Shigella flexneri 2a str. 2457T
uacaaucccgcuuacaucaac

SEQ ID NO: 3823440 - RNA, 23 nt, Shigella flexneri 2a str. 2457T
uacaauuuacguuuuaaaccuac

SEQ ID NO: 3823441 - RNA, 21 nt, Shigella flexneri 2a str. 2457T
uacacaagccaggacgcaguc

SEQ ID NO: 3823442 - RNA, 23 nt, Shigella flexneri 2a str. 2457T
uacacaagccaggacgcagucca

SEQ ID NO: 3823443 - RNA, 16 nt, Shigella flexneri 2a str. 2457T
uacacagacgguuuuu

SEQ ID NO: 3823444 - RNA, 17 nt, Shigella flexneri 2a str. 2457T
uacaccaacaucacgca

SEQ ID NO: 3823445 - RNA, 12 nt, Shigella flexneri 2a str. 2457T
uacacccagccc

SEQ ID NO: 3823446 - RNA, 14 nt, Shigella flexneri 2a str. 2457T
uacacccagccccg

SEQ ID NO: 3823447 - RNA, 23 nt, Shigella flexneri 2a str. 2457T
uacacccagccccgguuuuucug

SEQ ID NO: 3823448 - RNA, 20 nt, Shigella flexneri 2a str. 2457T
uacaccgcagccgccacaau

SEQ ID NO: 3823449 - RNA, 20 nt, Shigella flexneri 2a str. 2457T
uacaccggcaacguuuucaa

SEQ ID NO: 3823450 - RNA, 16 nt, Shigella flexneri 2a str. 2457T
uacaccucucgcccgc

SEQ ID NO: 3823451 - RNA, 22 nt, Shigella flexneri 2a str. 2457T
uacacgcggcuguugccggauu

SEQ ID NO: 3823452 - RNA, 17 nt, Shigella flexneri 2a str. 2457T
uacacuucacacacuuu

SEQ ID NO: 3823453 - RNA, 14 nt, Shigella flexneri 2a str. 2457T
uacagaaaugaaaa

SEQ ID NO: 3823454 - RNA, 16 nt, Shigella flexneri 2a str. 2457T
uacagaaaugaaaaaa

SEQ ID NO: 3823455 - RNA, 15 nt, Shigella flexneri 2a str. 2457T
uacagaagcaccgua

SEQ ID NO: 3823456 - RNA, 15 nt, Shigella flexneri 2a str. 2457T
uacagacucaaacca

SEQ ID NO: 3823457 - RNA, 15 nt, Shigella flexneri 2a str. 2457T
uacagauccgccauu

SEQ ID NO: 3823458 - RNA, 13 nt, Shigella flexneri 2a str. 2457T
uacagaugcugcu

SEQ ID NO: 3823459 - RNA, 20 nt, Shigella flexneri 2a str. 2457T
uacagcaauggaaaaaguuu

SEQ ID NO: 3823460 - RNA, 14 nt, Shigella flexneri 2a str. 2457T
uacagcauugucuc

SEQ ID NO: 3823461 - RNA, 14 nt, Shigella flexneri 2a str. 2457T
uacagcauuuccuu

SEQ ID NO: 3823462 - RNA, 19 nt, Shigella flexneri 2a str. 2457T
uacagccaugcgaaugcca

SEQ ID NO: 3823463 - RNA, 17 nt, Shigella flexneri 2a str. 2457T
uacagccgacaaugcca

SEQ ID NO: 3823464 - RNA, 18 nt, Shigella flexneri 2a str. 2457T
uacagccgacaaugccac

SEQ ID NO: 3823465 - RNA, 19 nt, Shigella flexneri 2a str. 2457T
uacagccgacaaugccaca

SEQ ID NO: 3823466 - RNA, 22 nt, Shigella flexneri 2a str. 2457T
uacagccgacaaugccacaaac

SEQ ID NO: 3823467 - RNA, 13 nt, Shigella flexneri 2a str. 2457T
uacagccggaacg

SEQ ID NO: 3823468 - RNA, 17 nt, Shigella flexneri 2a str. 2457T
uacagccggacccacac

SEQ ID NO: 3823469 - RNA, 15 nt, Shigella flexneri 2a str. 2457T
uacagccgguacauu

SEQ ID NO: 3823470 - RNA, 23 nt, Shigella flexneri 2a str. 2457T
uacagcgcggaccccacgcucuc

SEQ ID NO: 3823471 - RNA, 19 nt, Shigella flexneri 2a str. 2457T
uacagcggcagggaaaacu

SEQ ID NO: 3823472 - RNA, 20 nt, Shigella flexneri 2a str. 2457T
uacagcggcagggaaaacuc

SEQ ID NO: 3823473 - RNA, 22 nt, Shigella flexneri 2a str. 2457T
uacagcuuagcgccuucuacag

SEQ ID NO: 3823474 - RNA, 17 nt, Shigella flexneri 2a str. 2457T
uacaggauauauuucau

SEQ ID NO: 3823475 - RNA, 22 nt, Shigella flexneri 2a str. 2457T
uacaggauauauuucaucaacu

SEQ ID NO: 3823476 - RNA, 19 nt, Shigella flexneri 2a str. 2457T
uacaggcaacgaccagaaa

SEQ ID NO: 3823477 - RNA, 15 nt, Shigella flexneri 2a str. 2457T
uacaggcagcuuaga

SEQ ID NO: 3823478 - RNA, 16 nt, Shigella flexneri 2a str. 2457T
uacaggcagcuuagaa

SEQ ID NO: 3823479 - RNA, 21 nt, Shigella flexneri 2a str. 2457T
uacaggguaaaaccaugccau

SEQ ID NO: 3823480 - RNA, 19 nt, Shigella flexneri 2a str. 2457T
uacaguauaaguaaugaac

SEQ ID NO: 3823481 - RNA, 19 nt, Shigella flexneri 2a str. 2457T
uacaguaugagcaaacaau

SEQ ID NO: 3823482 - RNA, 18 nt, Shigella flexneri 2a str. 2457T
uacagucuggcgaacucu

SEQ ID NO: 3823483 - RNA, 13 nt, Shigella flexneri 2a str. 2457T
uacaguuuuacaa

SEQ ID NO: 3823484 - RNA, 14 nt, Shigella flexneri 2a str. 2457T
uacauaacgcagcg

SEQ ID NO: 3823485 - RNA, 12 nt, Shigella flexneri 2a str. 2457T
uacauacgcaaa

SEQ ID NO: 3823486 - RNA, 15 nt, Shigella flexneri 2a str. 2457T
uacauacgcaaaaaa

SEQ ID NO: 3823487 - RNA, 16 nt, Shigella flexneri 2a str. 2457T
uacauacgcaaaaaac

SEQ ID NO: 3823488 - RNA, 18 nt, Shigella flexneri 2a str. 2457T
uacauacgcaaaaaacau

SEQ ID NO: 3823489 - RNA, 19 nt, Shigella flexneri 2a str. 2457T
uacauacgcaaaaaacauu

SEQ ID NO: 3823490 - RNA, 11 nt, Shigella flexneri 2a str. 2457T
uacauacugag

SEQ ID NO: 3823491 - RNA, 15 nt, Shigella flexneri 2a str. 2457T
uacauacugagaacc

SEQ ID NO: 3823492 - RNA, 13 nt, Shigella flexneri 2a str. 2457T
uacauacuuaaau

SEQ ID NO: 3823493 - RNA, 12 nt, Shigella flexneri 2a str. 2457T
uacaucaccgcc

SEQ ID NO: 3823494 - RNA, 12 nt, Shigella flexneri 2a str. 2457T
uacaucagcgac

SEQ ID NO: 3823495 - RNA, 19 nt, Shigella flexneri 2a str. 2457T
uacauccacugcauacuga

SEQ ID NO: 3823496 - RNA, 20 nt, Shigella flexneri 2a str. 2457T
uacaucgcgcuuaucgccag

SEQ ID NO: 3823497 - RNA, 14 nt, Shigella flexneri 2a str. 2457T
uacaucuuaaucuu

SEQ ID NO: 3823498 - RNA, 17 nt, Shigella flexneri 2a str. 2457T
uaccuaacauuuuacuu

SEQ ID NO: 3823499 - RNA, 21 nt, Shigella flexneri 2a str. 2457T
uaccucacgaucacagcaguc

SEQ ID NO: 3823500 - RNA, 18 nt, Shigella flexneri 2a str. 2457T
uaccucagcagacugaua

SEQ ID NO: 3823501 - RNA, 15 nt, Shigella flexneri 2a str. 2457T
uaccucauggagaua

SEQ ID NO: 3823502 - RNA, 21 nt, Shigella flexneri 2a str. 2457T
uaccucuuguucgucgucuuu

SEQ ID NO: 3823503 - RNA, 15 nt, Shigella flexneri 2a str. 2457T
uaccucuuuuuucaa

SEQ ID NO: 3823504 - RNA, 12 nt, Shigella flexneri 2a str. 2457T
uaccugacagca

SEQ ID NO: 3823505 - RNA, 23 nt, Shigella flexneri 2a str. 2457T
uaccugaggcgcuacgcuaucag

SEQ ID NO: 3823506 - RNA, 18 nt, Shigella flexneri 2a str. 2457T
uaccugaugagaugcugg

SEQ ID NO: 3823507 - RNA, 18 nt, Shigella flexneri 2a str. 2457T
uaccugcuuaaucauauu

SEQ ID NO: 3823508 - RNA, 23 nt, Shigella flexneri 2a str. 2457T
uaccuguauaaacuauccugugc

SEQ ID NO: 3823509 - RNA, 21 nt, Shigella flexneri 2a str. 2457T
uaccuguguuuugcaucaacu

SEQ ID NO: 3823510 - RNA, 20 nt, Shigella flexneri 2a str. 2457T
uaccuuaucaaucucagcaa

SEQ ID NO: 3823511 - RNA, 17 nt, Shigella flexneri 2a str. 2457T
uaccuucaacacuggca

SEQ ID NO: 3823512 - RNA, 14 nt, Shigella flexneri 2a str. 2457T
uaccuucaucccuu

SEQ ID NO: 3823513 - RNA, 15 nt, Shigella flexneri 2a str. 2457T
uaccuucauuugcca

SEQ ID NO: 3823514 - RNA, 23 nt, Shigella flexneri 2a str. 2457T
uaccuuccggcguaccuuugccu

SEQ ID NO: 3823515 - RNA, 14 nt, Shigella flexneri 2a str. 2457T
uaccuuccuccggc

SEQ ID NO: 3823516 - RNA, 16 nt, Shigella flexneri 2a str. 2457T
uaccuuccugccagau

SEQ ID NO: 3823517 - RNA, 22 nt, Shigella flexneri 2a str. 2457T
uaccuucguuauauccaggcag

SEQ ID NO: 3823518 - RNA, 12 nt, Shigella flexneri 2a str. 2457T
uaccuucuuccc

SEQ ID NO: 3823519 - RNA, 12 nt, Shigella flexneri 2a str. 2457T
uaccuucuuccu

SEQ ID NO: 3823520 - RNA, 14 nt, Shigella flexneri 2a str. 2457T
uaccuugcugcucc

SEQ ID NO: 3823521 - RNA, 22 nt, Shigella flexneri 2a str. 2457T
uaccuugcuuauccucuguaaa

SEQ ID NO: 3823522 - RNA, 18 nt, Shigella flexneri 2a str. 2457T
uaccuuucgauuucucuu

SEQ ID NO: 3823523 - RNA, 18 nt, Shigella flexneri 2a str. 2457T
uacgaaguuuaauucuuu

SEQ ID NO: 3823524 - RNA, 18 nt, Shigella flexneri 2a str. 2457T
uacgaauucuaucaugca

SEQ ID NO: 3823525 - RNA, 16 nt, Shigella flexneri 2a str. 2457T
uacgacacgccuccug

SEQ ID NO: 3823526 - RNA, 19 nt, Shigella flexneri 2a str. 2457T
uacgagugcgcucuucaac

SEQ ID NO: 3823527 - RNA, 20 nt, Shigella flexneri 2a str. 2457T
uacgauaaugccguuuggca

SEQ ID NO: 3823528 - RNA, 18 nt, Shigella flexneri 2a str. 2457T
uacgauagaauauuucua

SEQ ID NO: 3823529 - RNA, 22 nt, Shigella flexneri 2a str. 2457T
uacgaucaagauugauccccgc

SEQ ID NO: 3823530 - RNA, 22 nt, Shigella flexneri 2a str. 2457T
uacgauccaccaccgcaaaaua

SEQ ID NO: 3823531 - RNA, 17 nt, Shigella flexneri 2a str. 2457T
uacgauguguggcaucg

SEQ ID NO: 3823532 - RNA, 14 nt, Shigella flexneri 2a str. 2457T
uacgauuugcggcg

SEQ ID NO: 3823533 - RNA, 15 nt, Shigella flexneri 2a str. 2457T
uacgcaaaaccucuu

SEQ ID NO: 3823534 - RNA, 24 nt, Shigella flexneri 2a str. 2457T
uacgcaaaaccucuuccagcagau

SEQ ID NO: 3823535 - RNA, 21 nt, Shigella flexneri 2a str. 2457T
uacgcaacugccaguaaagca

SEQ ID NO: 3823536 - RNA, 18 nt, Shigella flexneri 2a str. 2457T
uacgcagauauucguuca

SEQ ID NO: 3823537 - RNA, 19 nt, Shigella flexneri 2a str. 2457T
uacgcauaugcaucagauc

SEQ ID NO: 3823538 - RNA, 17 nt, Shigella flexneri 2a str. 2457T
uacgcaucaccagacaa

SEQ ID NO: 3823539 - RNA, 16 nt, Shigella flexneri 2a str. 2457T
uacgcauugcucacuu

SEQ ID NO: 3823540 - RNA, 15 nt, Shigella flexneri 2a str. 2457T
uacgccaucgccagc

SEQ ID NO: 3823541 - RNA, 18 nt, Shigella flexneri 2a str. 2457T
uacgccaucgccagcagc

SEQ ID NO: 3823542 - RNA, 21 nt, Shigella flexneri 2a str. 2457T
uacgccaucgccagcagccau

SEQ ID NO: 3823543 - RNA, 14 nt, Shigella flexneri 2a str. 2457T
uacgcccacgccag

SEQ ID NO: 3823544 - RNA, 16 nt, Shigella flexneri 2a str. 2457T
uacgcccaucauucag

SEQ ID NO: 3823545 - RNA, 18 nt, Shigella flexneri 2a str. 2457T
uacgcccgucaacggugc

SEQ ID NO: 3823546 - RNA, 16 nt, Shigella flexneri 2a str. 2457T
uacgcccucgaucggc

SEQ ID NO: 3823547 - RNA, 16 nt, Shigella flexneri 2a str. 2457T
uacgccgagcgccagc

SEQ ID NO: 3823548 - RNA, 16 nt, Shigella flexneri 2a str. 2457T
uacgccgcauccaaca

SEQ ID NO: 3823549 - RNA, 18 nt, Shigella flexneri 2a str. 2457T
uacgccgcauccggcaua

SEQ ID NO: 3823550 - RNA, 18 nt, Shigella flexneri 2a str. 2457T
uacgccgcaucuggcaua

SEQ ID NO: 3823551 - RNA, 20 nt, Shigella flexneri 2a str. 2457T
uacgccugccagcucuuucg

SEQ ID NO: 3823552 - RNA, 14 nt, Shigella flexneri 2a str. 2457T
uacgcgaucguccg

SEQ ID NO: 3823553 - RNA, 21 nt, Shigella flexneri 2a str. 2457T
uacgcgccaaucggcaauuca

SEQ ID NO: 3823554 - RNA, 15 nt, Shigella flexneri 2a str. 2457T
uacgcgcucaccgcu

SEQ ID NO: 3823555 - RNA, 17 nt, Shigella flexneri 2a str. 2457T
uacgcguaaaacagcca

SEQ ID NO: 3823556 - RNA, 22 nt, Shigella flexneri 2a str. 2457T
uacgcguaaaugcguugcuggc

SEQ ID NO: 3823557 - RNA, 14 nt, Shigella flexneri 2a str. 2457T
uacgcgucuuauca

SEQ ID NO: 3823558 - RNA, 14 nt, Shigella flexneri 2a str. 2457T
uacgcucacugcaa

SEQ ID NO: 3823559 - RNA, 15 nt, Shigella flexneri 2a str. 2457T
uacgcucacugcaaa

SEQ ID NO: 3823560 - RNA, 23 nt, Shigella flexneri 2a str. 2457T
uacgcucaucaggccuacaaaau

SEQ ID NO: 3823561 - RNA, 13 nt, Shigella flexneri 2a str. 2457T
uacgcuccagcag

SEQ ID NO: 3823562 - RNA, 21 nt, Shigella flexneri 2a str. 2457T
uacgcugaggauuuucaucuu

SEQ ID NO: 3823563 - RNA, 17 nt, Shigella flexneri 2a str. 2457T
uacgcugcauuuucggc

SEQ ID NO: 3823564 - RNA, 23 nt, Shigella flexneri 2a str. 2457T
uacgcuuaucaggccuacaaaau

SEQ ID NO: 3823565 - RNA, 14 nt, Shigella flexneri 2a str. 2457T
uacgcuugccggac

SEQ ID NO: 3823566 - RNA, 22 nt, Shigella flexneri 2a str. 2457T
uacggaaugauauuggucacca

SEQ ID NO: 3823567 - RNA, 13 nt, Shigella flexneri 2a str. 2457T
uacggcauucugc

SEQ ID NO: 3823568 - RNA, 21 nt, Shigella flexneri 2a str. 2457T
uacggcggucuggcgauuggc

SEQ ID NO: 3823569 - RNA, 17 nt, Shigella flexneri 2a str. 2457T
uacggcguuaacuuguu

SEQ ID NO: 3823570 - RNA, 19 nt, Shigella flexneri 2a str. 2457T
uacggcuccgcaagcgaau

SEQ ID NO: 3823571 - RNA, 20 nt, Shigella flexneri 2a str. 2457T
uacggcugauggcgccaguu

SEQ ID NO: 3823572 - RNA, 16 nt, Shigella flexneri 2a str. 2457T
uacggcuggaagguga

SEQ ID NO: 3823573 - RNA, 17 nt, Shigella flexneri 2a str. 2457T
uacgggaggucaucagc

SEQ ID NO: 3823574 - RNA, 19 nt, Shigella flexneri 2a str. 2457T
uacgggcaccaguaacgau

SEQ ID NO: 3823575 - RNA, 19 nt, Shigella flexneri 2a str. 2457T
uacgggcgcgagguaacau

SEQ ID NO: 3823576 - RNA, 20 nt, Shigella flexneri 2a str. 2457T
uacgguuuucucgccaccgg

SEQ ID NO: 3823577 - RNA, 13 nt, Shigella flexneri 2a str. 2457T
uacguaauucacc

SEQ ID NO: 3823578 - RNA, 15 nt, Shigella flexneri 2a str. 2457T
uacguaggccugaua

SEQ ID NO: 3823579 - RNA, 13 nt, Shigella flexneri 2a str. 2457T
uacgucacuucau

SEQ ID NO: 3823580 - RNA, 13 nt, Shigella flexneri 2a str. 2457T
uacgucaucccaa

SEQ ID NO: 3823581 - RNA, 22 nt, Shigella flexneri 2a str. 2457T
uacguucauggcgcgacauggc

SEQ ID NO: 3823582 - RNA, 18 nt, Shigella flexneri 2a str. 2457T
uacguuccuuuacgguga

SEQ ID NO: 3823583 - RNA, 12 nt, Shigella flexneri 2a str. 2457T
uacguucuuaca

SEQ ID NO: 3823584 - RNA, 22 nt, Shigella flexneri 2a str. 2457T
uacguugcauuuccauaaauug

SEQ ID NO: 3823585 - RNA, 20 nt, Shigella flexneri 2a str. 2457T
uacguugcuucaugccggau

SEQ ID NO: 3823586 - RNA, 18 nt, Shigella flexneri 2a str. 2457T
uacguuucgccugcaaau

SEQ ID NO: 3823587 - RNA, 17 nt, Shigella flexneri 2a str. 2457T
uacuaaaugugcaauca

SEQ ID NO: 3823588 - RNA, 15 nt, Shigella flexneri 2a str. 2457T
uacuaaucucaccca

SEQ ID NO: 3823589 - RNA, 16 nt, Shigella flexneri 2a str. 2457T
uacuacguaauuucaa

SEQ ID NO: 3823590 - RNA, 12 nt, Shigella flexneri 2a str. 2457T
uacuacguucaa

SEQ ID NO: 3823591 - RNA, 16 nt, Shigella flexneri 2a str. 2457T
uacuaugauuuuccug

SEQ ID NO: 3823592 - RNA, 21 nt, Shigella flexneri 2a str. 2457T
uacuaugauuuuccugaggag

SEQ ID NO: 3823593 - RNA, 14 nt, Shigella flexneri 2a str. 2457T
uacucaagcagcca

SEQ ID NO: 3823594 - RNA, 14 nt, Shigella flexneri 2a str. 2457T
uacucagcgccugc

SEQ ID NO: 3823595 - RNA, 21 nt, Shigella flexneri 2a str. 2457T
uagcuauaaaccugcuggcgc

SEQ ID NO: 3823596 - RNA, 19 nt, Shigella flexneri 2a str. 2457T
uagcucaaaguaaucaagc

SEQ ID NO: 3823597 - RNA, 22 nt, Shigella flexneri 2a str. 2457T
uagcucugccacugguuuuccu

SEQ ID NO: 3823598 - RNA, 20 nt, Shigella flexneri 2a str. 2457T
uagcugauuccauuauucaa

SEQ ID NO: 3823599 - RNA, 15 nt, Shigella flexneri 2a str. 2457T
uagcuggauuuucau

SEQ ID NO: 3823600 - RNA, 21 nt, Shigella flexneri 2a str. 2457T
uagcuggcuucgguuuuuauu

SEQ ID NO: 3823601 - RNA, 21 nt, Shigella flexneri 2a str. 2457T
uagcuucaaauagugccuggc

SEQ ID NO: 3823602 - RNA, 15 nt, Shigella flexneri 2a str. 2457T
uagcuucaccgcauc

SEQ ID NO: 3823603 - RNA, 23 nt, Shigella flexneri 2a str. 2457T
uagcuucaccgcaucgucacuga

SEQ ID NO: 3823604 - RNA, 13 nt, Shigella flexneri 2a str. 2457T
uagcuuggcagag

SEQ ID NO: 3823605 - RNA, 13 nt, Shigella flexneri 2a str. 2457T
uagcuuuggugcc

SEQ ID NO: 3823606 - RNA, 22 nt, Shigella flexneri 2a str. 2457T
uaggaagccggaauuuuccuuc

SEQ ID NO: 3823607 - RNA, 21 nt, Shigella flexneri 2a str. 2457T
uaggacagcguugccagcucg

SEQ ID NO: 3823608 - RNA, 16 nt, Shigella flexneri 2a str. 2457T
uaggacgaaaaaucaa

SEQ ID NO: 3823609 - RNA, 17 nt, Shigella flexneri 2a str. 2457T
uaggacgaaaaaucaau

SEQ ID NO: 3823610 - RNA, 11 nt, Shigella flexneri 2a str. 2457T
uaggagccacc

SEQ ID NO: 3823611 - RNA, 14 nt, Shigella flexneri 2a str. 2457T
uaggcaagccacaa

SEQ ID NO: 3823612 - RNA, 15 nt, Shigella flexneri 2a str. 2457T
uaggcaauuggcgca

SEQ ID NO: 3823613 - RNA, 23 nt, Shigella flexneri 2a str. 2457T
uaggcaauuggcgcaucaugccu

SEQ ID NO: 3823614 - RNA, 14 nt, Shigella flexneri 2a str. 2457T
uaggcaucagcaau

SEQ ID NO: 3823615 - RNA, 12 nt, Shigella flexneri 2a str. 2457T
uaggccggauaa

SEQ ID NO: 3823616 - RNA, 16 nt, Shigella flexneri 2a str. 2457T
uaggccggauaaggcg

SEQ ID NO: 3823617 - RNA, 20 nt, Shigella flexneri 2a str. 2457T
uaggccugauaagacgcgua

SEQ ID NO: 3823618 - RNA, 20 nt, Shigella flexneri 2a str. 2457T
uaggccugauaagacgcguc

SEQ ID NO: 3823619 - RNA, 20 nt, Shigella flexneri 2a str. 2457T
uaggccugauaagacgcguu

SEQ ID NO: 3823620 - RNA, 18 nt, Shigella flexneri 2a str. 2457T
uaggccugauaagcguag

SEQ ID NO: 3823621 - RNA, 14 nt, Shigella flexneri 2a str. 2457T
uaggcuggaucaga

SEQ ID NO: 3823622 - RNA, 21 nt, Shigella flexneri 2a str. 2457T
uaggcuucuauaccaaugauu

SEQ ID NO: 3823623 - RNA, 21 nt, Shigella flexneri 2a str. 2457T
uaggcuuuacuuaaucccauc

SEQ ID NO: 3823624 - RNA, 13 nt, Shigella flexneri 2a str. 2457T
uagggacaaagaa

SEQ ID NO: 3823625 - RNA, 14 nt, Shigella flexneri 2a str. 2457T
uagggaguuuaauc

SEQ ID NO: 3823626 - RNA, 14 nt, Shigella flexneri 2a str. 2457T
uagggaucaucuua

SEQ ID NO: 3823627 - RNA, 16 nt, Shigella flexneri 2a str. 2457T
uagguaaacaucacau

SEQ ID NO: 3823628 - RNA, 14 nt, Shigella flexneri 2a str. 2457T
uagguacaaagcca

SEQ ID NO: 3823629 - RNA, 23 nt, Shigella flexneri 2a str. 2457T
uaggucuuugacgucgaaacuga

SEQ ID NO: 3823630 - RNA, 22 nt, Shigella flexneri 2a str. 2457T
uaggugacucguuaugugaguu

SEQ ID NO: 3823631 - RNA, 19 nt, Shigella flexneri 2a str. 2457T
uaggugcucaaugccugau

SEQ ID NO: 3823632 - RNA, 20 nt, Shigella flexneri 2a str. 2457T
uagguucucucagucuuucc

SEQ ID NO: 3823633 - RNA, 16 nt, Shigella flexneri 2a str. 2457T
uaguaagauuauauaa

SEQ ID NO: 3823634 - RNA, 13 nt, Shigella flexneri 2a str. 2457T
uaguaauuuugaa

SEQ ID NO: 3823635 - RNA, 14 nt, Shigella flexneri 2a str. 2457T
uaguagaagaggaa

SEQ ID NO: 3823636 - RNA, 16 nt, Shigella flexneri 2a str. 2457T
uaguaguucauccccu

SEQ ID NO: 3823637 - RNA, 21 nt, Shigella flexneri 2a str. 2457T
uaguaguucauccccucuucc

SEQ ID NO: 3823638 - RNA, 16 nt, Shigella flexneri 2a str. 2457T
uaguaucgcucaauau

SEQ ID NO: 3823639 - RNA, 12 nt, Shigella flexneri 2a str. 2457T
uaguaucuauuc

SEQ ID NO: 3823640 - RNA, 20 nt, Shigella flexneri 2a str. 2457T
uaguauggagcaggaauaua

SEQ ID NO: 3823641 - RNA, 13 nt, Shigella flexneri 2a str. 2457T
uaguauuaagcca

SEQ ID NO: 3823642 - RNA, 11 nt, Shigella flexneri 2a str. 2457T
uaguauuuauc

SEQ ID NO: 3823643 - RNA, 20 nt, Shigella flexneri 2a str. 2457T
uaguauuugaguucacugcc

SEQ ID NO: 3823644 - RNA, 18 nt, Shigella flexneri 2a str. 2457T
uaguauuuucuuugacaa

SEQ ID NO: 3823645 - RNA, 11 nt, Shigella flexneri 2a str. 2457T
uagucaccgcc

SEQ ID NO: 3823646 - RNA, 13 nt, Shigella flexneri 2a str. 2457T
uagucaucaucag

SEQ ID NO: 3823647 - RNA, 15 nt, Shigella flexneri 2a str. 2457T
uagucaugaugacgc

SEQ ID NO: 3823648 - RNA, 13 nt, Shigella flexneri 2a str. 2457T
uagucauuuuuug

SEQ ID NO: 3823649 - RNA, 20 nt, Shigella flexneri 2a str. 2457T
uaguccacacgccaggccac

SEQ ID NO: 3823650 - RNA, 20 nt, Shigella flexneri 2a str. 2457T
uagucccuucgguagcagcu

SEQ ID NO: 3823651 - RNA, 17 nt, Shigella flexneri 2a str. 2457T
uagucugaccucuucua

SEQ ID NO: 3823652 - RNA, 20 nt, Shigella flexneri 2a str. 2457T
uagugaaaaagcucccuaaa

SEQ ID NO: 3823653 - RNA, 15 nt, Shigella flexneri 2a str. 2457T
uagugaaaucgccaa

SEQ ID NO: 3823654 - RNA, 14 nt, Shigella flexneri 2a str. 2457T
uagugaucaaacac

SEQ ID NO: 3823655 - RNA, 21 nt, Shigella flexneri 2a str. 2457T
uagugaugccauacuucauaa

SEQ ID NO: 3823656 - RNA, 22 nt, Shigella flexneri 2a str. 2457T
uagugccgaggguucccccuca

SEQ ID NO: 3823657 - RNA, 17 nt, Shigella flexneri 2a str. 2457T
uagugccgcacuugcca

SEQ ID NO: 3823658 - RNA, 14 nt, Shigella flexneri 2a str. 2457T
uagugccgucagca

SEQ ID NO: 3823659 - RNA, 16 nt, Shigella flexneri 2a str. 2457T
uagugccgucagcagg

SEQ ID NO: 3823660 - RNA, 14 nt, Shigella flexneri 2a str. 2457T
uagugucuuaucug

SEQ ID NO: 3823661 - RNA, 23 nt, Shigella flexneri 2a str. 2457T
uaguguuggaucugauccaacaa

SEQ ID NO: 3823662 - RNA, 17 nt, Shigella flexneri 2a str. 2457T
uaguguuuguauuagau

SEQ ID NO: 3823663 - RNA, 16 nt, Shigella flexneri 2a str. 2457T
uaguuaaacuuucaua

SEQ ID NO: 3823664 - RNA, 17 nt, Shigella flexneri 2a str. 2457T
uaguuagccggagaaau

SEQ ID NO: 3823665 - RNA, 16 nt, Shigella flexneri 2a str. 2457T
uaguuaugaaaauagg

SEQ ID NO: 3823666 - RNA, 13 nt, Shigella flexneri 2a str. 2457T
uaguucauccccu

SEQ ID NO: 3823667 - RNA, 19 nt, Shigella flexneri 2a str. 2457T
uaguucauccccucuucca

SEQ ID NO: 3823668 - RNA, 22 nt, Shigella flexneri 2a str. 2457T
uaguucauccccucuuccauuu

SEQ ID NO: 3823669 - RNA, 17 nt, Shigella flexneri 2a str. 2457T
uaguugauuaauuucau

SEQ ID NO: 3823670 - RNA, 19 nt, Shigella flexneri 2a str. 2457T
uaguugcugucgacaaagc

SEQ ID NO: 3823671 - RNA, 16 nt, Shigella flexneri 2a str. 2457T
uaguuguacaacugcu

SEQ ID NO: 3823672 - RNA, 16 nt, Shigella flexneri 2a str. 2457T
uaguuuaaacauuuuu

SEQ ID NO: 3823673 - RNA, 19 nt, Shigella flexneri 2a str. 2457T
uaguuuacuucuauaauga

SEQ ID NO: 3823674 - RNA, 12 nt, Shigella flexneri 2a str. 2457T
uaguuucagccu

SEQ ID NO: 3823675 - RNA, 13 nt, Shigella flexneri 2a str. 2457T
uaguuucucccca

SEQ ID NO: 3823676 - RNA, 17 nt, Shigella flexneri 2a str. 2457T
uaguuugauaauuuuag

SEQ ID NO: 3823677 - RNA, 19 nt, Shigella flexneri 2a str. 2457T
uaguuugauaauuuuagau

SEQ ID NO: 3823678 - RNA, 20 nt, Shigella flexneri 2a str. 2457T
uaguuuguugaaguuuauac

SEQ ID NO: 3823679 - RNA, 21 nt, Shigella flexneri 2a str. 2457T
uaguuuuuacaaacaagaucc

SEQ ID NO: 3823680 - RNA, 21 nt, Shigella flexneri 2a str. 2457T
uauaaaauuuaacauuuggau

SEQ ID NO: 3823681 - RNA, 13 nt, Shigella flexneri 2a str. 2457T
uauaaacaacggc

SEQ ID NO: 3823682 - RNA, 23 nt, Shigella flexneri 2a str. 2457T
uauaaacguggggucucugcaaa

SEQ ID NO: 3823683 - RNA, 14 nt, Shigella flexneri 2a str. 2457T
uauaaauaaaaauu

SEQ ID NO: 3823684 - RNA, 14 nt, Shigella flexneri 2a str. 2457T
uauaaauauuuucu

SEQ ID NO: 3823685 - RNA, 19 nt, Shigella flexneri 2a str. 2457T
uauaaauuccuaaaguugu

SEQ ID NO: 3823686 - RNA, 15 nt, Shigella flexneri 2a str. 2457T
uauaacauuuuucuc

SEQ ID NO: 3823687 - RNA, 18 nt, Shigella flexneri 2a str. 2457T
uauaaccugaauauuagu

SEQ ID NO: 3823688 - RNA, 13 nt, Shigella flexneri 2a str. 2457T
uauaacugcgguc

SEQ ID NO: 3823689 - RNA, 16 nt, Shigella flexneri 2a str. 2457T
uauaagccaguaagac

SEQ ID NO: 3823690 - RNA, 12 nt, Shigella flexneri 2a str. 2457T
uauaagcucaau

SEQ ID NO: 3823691 - RNA, 15 nt, Shigella flexneri 2a str. 2457T
uauaaguguaaaauu

SEQ ID NO: 3823692 - RNA, 12 nt, Shigella flexneri 2a str. 2457T
uauaauacgcuu

SEQ ID NO: 3823693 - RNA, 13 nt, Shigella flexneri 2a str. 2457T
uaucccuguuaaa

SEQ ID NO: 3823694 - RNA, 23 nt, Shigella flexneri 2a str. 2457T
uaucccuuacgcguucauacuuu

SEQ ID NO: 3823695 - RNA, 21 nt, Shigella flexneri 2a str. 2457T
uaucccuucuccacaccguug

SEQ ID NO: 3823696 - RNA, 14 nt, Shigella flexneri 2a str. 2457T
uauccgacaucccg

SEQ ID NO: 3823697 - RNA, 18 nt, Shigella flexneri 2a str. 2457T
uauccgcaggugacgcgg

SEQ ID NO: 3823698 - RNA, 21 nt, Shigella flexneri 2a str. 2457T
uauccgccagugccaaagcca

SEQ ID NO: 3823699 - RNA, 22 nt, Shigella flexneri 2a str. 2457T
uauccggcacuuacuuuccuua

SEQ ID NO: 3823700 - RNA, 17 nt, Shigella flexneri 2a str. 2457T
uauccggccuacaaaac

SEQ ID NO: 3823701 - RNA, 15 nt, Shigella flexneri 2a str. 2457T
uauccggccuacaca

SEQ ID NO: 3823702 - RNA, 15 nt, Shigella flexneri 2a str. 2457T
uauccggcuaacaaa

SEQ ID NO: 3823703 - RNA, 13 nt, Shigella flexneri 2a str. 2457T
uauccgguucacu

SEQ ID NO: 3823704 - RNA, 20 nt, Shigella flexneri 2a str. 2457T
uauccgguucacuucacgca

SEQ ID NO: 3823705 - RNA, 15 nt, Shigella flexneri 2a str. 2457T
uauccugauaaaaac

SEQ ID NO: 3823706 - RNA, 21 nt, Shigella flexneri 2a str. 2457T
uauccugcccacuccagcuau

SEQ ID NO: 3823707 - RNA, 20 nt, Shigella flexneri 2a str. 2457T
uauccugucaguucguuuua

SEQ ID NO: 3823708 - RNA, 21 nt, Shigella flexneri 2a str. 2457T
uauccuguggauaaagcaguu

SEQ ID NO: 3823709 - RNA, 18 nt, Shigella flexneri 2a str. 2457T
uauccuucugcguuuuug

SEQ ID NO: 3823710 - RNA, 14 nt, Shigella flexneri 2a str. 2457T
uaucgaaccagcgg

SEQ ID NO: 3823711 - RNA, 14 nt, Shigella flexneri 2a str. 2457T
uaucgaacguccag

SEQ ID NO: 3823712 - RNA, 17 nt, Shigella flexneri 2a str. 2457T
uaucgacagacgccagc

SEQ ID NO: 3823713 - RNA, 16 nt, Shigella flexneri 2a str. 2457T
uaucgacgcgccagca

SEQ ID NO: 3823714 - RNA, 17 nt, Shigella flexneri 2a str. 2457T
uaucgauaaauggcgca

SEQ ID NO: 3823715 - RNA, 22 nt, Shigella flexneri 2a str. 2457T
uaucgauaaauggcgcauccag

SEQ ID NO: 3823716 - RNA, 16 nt, Shigella flexneri 2a str. 2457T
uaucgaucacauccag

SEQ ID NO: 3823717 - RNA, 19 nt, Shigella flexneri 2a str. 2457T
uaucgccaggccagccugg

SEQ ID NO: 3823718 - RNA, 18 nt, Shigella flexneri 2a str. 2457T
uaucgcgaaaaaaagaug

SEQ ID NO: 3823719 - RNA, 16 nt, Shigella flexneri 2a str. 2457T
uaucgcgaugauuuuc

SEQ ID NO: 3823720 - RNA, 22 nt, Shigella flexneri 2a str. 2457T
uaucgcgucaacagggcagaca

SEQ ID NO: 3823721 - RNA, 14 nt, Shigella flexneri 2a str. 2457T
uaucgcucggcaga

SEQ ID NO: 3823722 - RNA, 16 nt, Shigella flexneri 2a str. 2457T
uaucgcucuugcucuc

SEQ ID NO: 3823723 - RNA, 18 nt, Shigella flexneri 2a str. 2457T
uaucgcugauauacccuu

SEQ ID NO: 3823724 - RNA, 21 nt, Shigella flexneri 2a str. 2457T
uaucgcugauauacccuucau

SEQ ID NO: 3823725 - RNA, 23 nt, Shigella flexneri 2a str. 2457T
uaucgcugauauacccuucauca

SEQ ID NO: 3823726 - RNA, 13 nt, Shigella flexneri 2a str. 2457T
uaucggagaacag

SEQ ID NO: 3823727 - RNA, 23 nt, Shigella flexneri 2a str. 2457T
uaucggcgcugcuuuccugcugc

SEQ ID NO: 3823728 - RNA, 13 nt, Shigella flexneri 2a str. 2457T
uaucggguuuguu

SEQ ID NO: 3823729 - RNA, 23 nt, Shigella flexneri 2a str. 2457T
uaucguagccccagucuuccugc

SEQ ID NO: 3823730 - RNA, 19 nt, Shigella flexneri 2a str. 2457T
uaucgugacaauaauaccc

SEQ ID NO: 3823731 - RNA, 19 nt, Shigella flexneri 2a str. 2457T
uaucuacagcauuuccuua

SEQ ID NO: 3823732 - RNA, 20 nt, Shigella flexneri 2a str. 2457T
uaucuaucaggacgaaaaau

SEQ ID NO: 3823733 - RNA, 12 nt, Shigella flexneri 2a str. 2457T
uaucuauucauc

SEQ ID NO: 3823734 - RNA, 14 nt, Shigella flexneri 2a str. 2457T
uaucuauuucaggu

SEQ ID NO: 3823735 - RNA, 17 nt, Shigella flexneri 2a str. 2457T
uaucuauuucaggucaa

SEQ ID NO: 3823736 - RNA, 13 nt, Shigella flexneri 2a str. 2457T
uaucucaaaaauu

SEQ ID NO: 3823737 - RNA, 12 nt, Shigella flexneri 2a str. 2457T
uaucuccagcua

SEQ ID NO: 3823738 - RNA, 22 nt, Shigella flexneri 2a str. 2457T
uaucucccugauccaaccggau

SEQ ID NO: 3823739 - RNA, 17 nt, Shigella flexneri 2a str. 2457T
uaucugcugcuugcggu

SEQ ID NO: 3823740 - RNA, 19 nt, Shigella flexneri 2a str. 2457T
uaucugcugugguuugccc

SEQ ID NO: 3823741 - RNA, 15 nt, Shigella flexneri 2a str. 2457T
uaucuggcaacuuau

SEQ ID NO: 3823742 - RNA, 11 nt, Shigella flexneri 2a str. 2457T
uaucuggcaag

SEQ ID NO: 3823743 - RNA, 15 nt, Shigella flexneri 2a str. 2457T
uaucugggcugccug

SEQ ID NO: 3823744 - RNA, 13 nt, Shigella flexneri 2a str. 2457T
uaucuguguaaug

SEQ ID NO: 3823745 - RNA, 17 nt, Shigella flexneri 2a str. 2457T
uaucuuacccuuccuua

SEQ ID NO: 3823746 - RNA, 19 nt, Shigella flexneri 2a str. 2457T
uaucuucccagccaaugca

SEQ ID NO: 3823747 - RNA, 13 nt, Shigella flexneri 2a str. 2457T
uaucuucccagcg

SEQ ID NO: 3823748 - RNA, 21 nt, Shigella flexneri 2a str. 2457T
uaucuucccgccguugccgca

SEQ ID NO: 3823749 - RNA, 14 nt, Shigella flexneri 2a str. 2457T
uaucuucgauaaac

SEQ ID NO: 3823750 - RNA, 19 nt, Shigella flexneri 2a str. 2457T
uaucuucgauaaacucaau

SEQ ID NO: 3823751 - RNA, 15 nt, Shigella flexneri 2a str. 2457T
uaucuuuauuaucaa

SEQ ID NO: 3823752 - RNA, 20 nt, Shigella flexneri 2a str. 2457T
uaucuuugauugaagaaauc

SEQ ID NO: 3823753 - RNA, 21 nt, Shigella flexneri 2a str. 2457T
uaugaaagcaacguuaaaucg

SEQ ID NO: 3823754 - RNA, 18 nt, Shigella flexneri 2a str. 2457T
uaugaacacgaucucacg

SEQ ID NO: 3823755 - RNA, 17 nt, Shigella flexneri 2a str. 2457T
uaugaagaacaaguuca

SEQ ID NO: 3823756 - RNA, 18 nt, Shigella flexneri 2a str. 2457T
uaugaauagcggaaaucu

SEQ ID NO: 3823757 - RNA, 22 nt, Shigella flexneri 2a str. 2457T
uaugaauagcggaaaucuccag

SEQ ID NO: 3823758 - RNA, 22 nt, Shigella flexneri 2a str. 2457T
uaugaauauauccgaaaaagga

SEQ ID NO: 3823759 - RNA, 19 nt, Shigella flexneri 2a str. 2457T
uaugaaucuuuucaucgca

SEQ ID NO: 3823760 - RNA, 21 nt, Shigella flexneri 2a str. 2457T
uaugaauuacuucucuuuccc

SEQ ID NO: 3823761 - RNA, 16 nt, Shigella flexneri 2a str. 2457T
uaugacguaucaccga

SEQ ID NO: 3823762 - RNA, 20 nt, Shigella flexneri 2a str. 2457T
uaugagcgauuuuuuauagu

SEQ ID NO: 3823763 - RNA, 18 nt, Shigella flexneri 2a str. 2457T
uaugaggcacuaaggcga

SEQ ID NO: 3823764 - RNA, 17 nt, Shigella flexneri 2a str. 2457T
uaugagucguaaacaac

SEQ ID NO: 3823765 - RNA, 15 nt, Shigella flexneri 2a str. 2457T
uaugauauuuuuuua

SEQ ID NO: 3823766 - RNA, 20 nt, Shigella flexneri 2a str. 2457T
uaugaucaaaaucauauaau

SEQ ID NO: 3823767 - RNA, 12 nt, Shigella flexneri 2a str. 2457T
uaugaucgccac

SEQ ID NO: 3823768 - RNA, 14 nt, Shigella flexneri 2a str. 2457T
uaugaucuugcccg

SEQ ID NO: 3823769 - RNA, 18 nt, Shigella flexneri 2a str. 2457T
uaugaugcgacuugucau

SEQ ID NO: 3823770 - RNA, 13 nt, Shigella flexneri 2a str. 2457T
uaugauugccuga

SEQ ID NO: 3823771 - RNA, 14 nt, Shigella flexneri 2a str. 2457T
uaugauuuaaaaaa

SEQ ID NO: 3823772 - RNA, 13 nt, Shigella flexneri 2a str. 2457T
uaugauuuuccug

SEQ ID NO: 3823773 - RNA, 23 nt, Shigella flexneri 2a str. 2457T
uaugcaacaacugaaaaaaaauu

SEQ ID NO: 3823774 - RNA, 16 nt, Shigella flexneri 2a str. 2457T
uaugcaagauguuaau

SEQ ID NO: 3823775 - RNA, 12 nt, Shigella flexneri 2a str. 2457T
uaugcagccuuu

SEQ ID NO: 3823776 - RNA, 13 nt, Shigella flexneri 2a str. 2457T
uaugcauuauaug

SEQ ID NO: 3823777 - RNA, 21 nt, Shigella flexneri 2a str. 2457T
uaugccacgugagcuuuucug

SEQ ID NO: 3823778 - RNA, 24 nt, Shigella flexneri 2a str. 2457T
uaugccacgugagcuuuucugcuu

SEQ ID NO: 3823779 - RNA, 12 nt, Shigella flexneri 2a str. 2457T
uaugccagcccc

SEQ ID NO: 3823780 - RNA, 21 nt, Shigella flexneri 2a str. 2457T
uaugccagccccagcgucagc

SEQ ID NO: 3823781 - RNA, 22 nt, Shigella flexneri 2a str. 2457T
uaugccagccccagcgucagca

SEQ ID NO: 3823782 - RNA, 14 nt, Shigella flexneri 2a str. 2457T
uaugcccagcgcag

SEQ ID NO: 3823783 - RNA, 14 nt, Shigella flexneri 2a str. 2457T
uaugcccuuucaau

SEQ ID NO: 3823784 - RNA, 16 nt, Shigella flexneri 2a str. 2457T
uaugccgaucaucauc

SEQ ID NO: 3823785 - RNA, 11 nt, Shigella flexneri 2a str. 2457T
uaugccggaua

SEQ ID NO: 3823786 - RNA, 15 nt, Shigella flexneri 2a str. 2457T
uaugccucaacccuu

SEQ ID NO: 3823787 - RNA, 13 nt, Shigella flexneri 2a str. 2457T
uaugccucuuuca

SEQ ID NO: 3823788 - RNA, 16 nt, Shigella flexneri 2a str. 2457T
uaugccugauuacggu

SEQ ID NO: 3823789 - RNA, 20 nt, Shigella flexneri 2a str. 2457T
uaugccuguccucuucagca

SEQ ID NO: 3823790 - RNA, 13 nt, Shigella flexneri 2a str. 2457T
uaugcgcauugcc

SEQ ID NO: 3823791 - RNA, 16 nt, Shigella flexneri 2a str. 2457T
uauuguugaauuccga

SEQ ID NO: 3823792 - RNA, 21 nt, Shigella flexneri 2a str. 2457T
uauuguugauaaggaaauuca

SEQ ID NO: 3823793 - RNA, 22 nt, Shigella flexneri 2a str. 2457T
uauuuaaaugauuacucguauu

SEQ ID NO: 3823794 - RNA, 23 nt, Shigella flexneri 2a str. 2457T
uauuuaaauugcgguuuuuaagg

SEQ ID NO: 3823795 - RNA, 23 nt, Shigella flexneri 2a str. 2457T
uauuuaauggcgacauaaaauaa

SEQ ID NO: 3823796 - RNA, 16 nt, Shigella flexneri 2a str. 2457T
uauuuaccaauauaau

SEQ ID NO: 3823797 - RNA, 20 nt, Shigella flexneri 2a str. 2457T
uauuuaccgcaugcucacag

SEQ ID NO: 3823798 - RNA, 15 nt, Shigella flexneri 2a str. 2457T
uauuuacucuccugc

SEQ ID NO: 3823799 - RNA, 13 nt, Shigella flexneri 2a str. 2457T
uauuuagguaaug

SEQ ID NO: 3823800 - RNA, 22 nt, Shigella flexneri 2a str. 2457T
uauuuauguggauauuauuaau

SEQ ID NO: 3823801 - RNA, 16 nt, Shigella flexneri 2a str. 2457T
uauuuauucaaaccaa

SEQ ID NO: 3823802 - RNA, 13 nt, Shigella flexneri 2a str. 2457T
uauuuauuuucag

SEQ ID NO: 3823803 - RNA, 16 nt, Shigella flexneri 2a str. 2457T
uauuucaauaugauaa

SEQ ID NO: 3823804 - RNA, 15 nt, Shigella flexneri 2a str. 2457T
uauuucaaugcauua

SEQ ID NO: 3823805 - RNA, 16 nt, Shigella flexneri 2a str. 2457T
uauuucacauaacugc

SEQ ID NO: 3823806 - RNA, 22 nt, Shigella flexneri 2a str. 2457T
uauuucacccgcgaccaccagc

SEQ ID NO: 3823807 - RNA, 20 nt, Shigella flexneri 2a str. 2457T
uauuuccagcucaaccagau

SEQ ID NO: 3823808 - RNA, 24 nt, Shigella flexneri 2a str. 2457T
uauuucccggccaacgauaauuca

SEQ ID NO: 3823809 - RNA, 15 nt, Shigella flexneri 2a str. 2457T
uauuuccggcgacgu

SEQ ID NO: 3823810 - RNA, 16 nt, Shigella flexneri 2a str. 2457T
uauuucgaauuuucca

SEQ ID NO: 3823811 - RNA, 21 nt, Shigella flexneri 2a str. 2457T
uauuucucggcaaauucauua

SEQ ID NO: 3823812 - RNA, 19 nt, Shigella flexneri 2a str. 2457T
uauuucuucauacuaccug

SEQ ID NO: 3823813 - RNA, 14 nt, Shigella flexneri 2a str. 2457T
uauuucuugugcau

SEQ ID NO: 3823814 - RNA, 15 nt, Shigella flexneri 2a str. 2457T
uauuucuuuaucacc

SEQ ID NO: 3823815 - RNA, 22 nt, Shigella flexneri 2a str. 2457T
uauuucuuuguagaugauuuuu

SEQ ID NO: 3823816 - RNA, 14 nt, Shigella flexneri 2a str. 2457T
uauuucuuuuacau

SEQ ID NO: 3823817 - RNA, 21 nt, Shigella flexneri 2a str. 2457T
uauuucuuuugguugccguca

SEQ ID NO: 3823818 - RNA, 15 nt, Shigella flexneri 2a str. 2457T
uauuugacuguucua

SEQ ID NO: 3823819 - RNA, 14 nt, Shigella flexneri 2a str. 2457T
uauuugaguguauu

SEQ ID NO: 3823820 - RNA, 18 nt, Shigella flexneri 2a str. 2457T
uauuugaguucacugccg

SEQ ID NO: 3823821 - RNA, 21 nt, Shigella flexneri 2a str. 2457T
uauuugcaccuaaagcgcgca

SEQ ID NO: 3823822 - RNA, 20 nt, Shigella flexneri 2a str. 2457T
uauuugcccaccugcggcac

SEQ ID NO: 3823823 - RNA, 22 nt, Shigella flexneri 2a str. 2457T
uauuugccgugcguguucggua

SEQ ID NO: 3823824 - RNA, 23 nt, Shigella flexneri 2a str. 2457T
uauuugccuaauaaaucuaaaac

SEQ ID NO: 3823825 - RNA, 19 nt, Shigella flexneri 2a str. 2457T
uauuugcgucagcucacaa

SEQ ID NO: 3823826 - RNA, 16 nt, Shigella flexneri 2a str. 2457T
uauuuggcauugguca

SEQ ID NO: 3823827 - RNA, 14 nt, Shigella flexneri 2a str. 2457T
uauuuguucagcaa

SEQ ID NO: 3823828 - RNA, 17 nt, Shigella flexneri 2a str. 2457T
uauuuuacauccggcaa

SEQ ID NO: 3823829 - RNA, 15 nt, Shigella flexneri 2a str. 2457T
uauuuuagaaaaacu

SEQ ID NO: 3823830 - RNA, 21 nt, Shigella flexneri 2a str. 2457T
uauuuuccgagguuaauauuu

SEQ ID NO: 3823831 - RNA, 20 nt, Shigella flexneri 2a str. 2457T
uauuuugccggacgcugagc

SEQ ID NO: 3823832 - RNA, 17 nt, Shigella flexneri 2a str. 2457T
uauuuugcuuccggcaa

SEQ ID NO: 3823833 - RNA, 17 nt, Shigella flexneri 2a str. 2457T
uauuuugguaaugacuc

SEQ ID NO: 3823834 - RNA, 20 nt, Shigella flexneri 2a str. 2457T
uauuuuuaaccguauuuugg

SEQ ID NO: 3823835 - RNA, 19 nt, Shigella flexneri 2a str. 2457T
uauuuuuaucccucauauu

SEQ ID NO: 3823836 - RNA, 13 nt, Shigella flexneri 2a str. 2457T
uauuuuucccuga

SEQ ID NO: 3823837 - RNA, 17 nt, Shigella flexneri 2a str. 2457T
uauuuuuuuaauuguga

SEQ ID NO: 3823838 - RNA, 18 nt, Shigella flexneri 2a str. 2457T
uauuuuuuuccuaaaccc

SEQ ID NO: 3823839 - RNA, 12 nt, Shigella flexneri 2a str. 2457T
ucaaaaaacugg

SEQ ID NO: 3823840 - RNA, 19 nt, Shigella flexneri 2a str. 2457T
ucaaaaaacuggaaaaaua

SEQ ID NO: 3823841 - RNA, 20 nt, Shigella flexneri 2a str. 2457T
ucaaaaaacuggaaaaauaa

SEQ ID NO: 3823842 - RNA, 20 nt, Shigella flexneri 2a str. 2457T
ucaaaaaacuucuucacacc

SEQ ID NO: 3823843 - RNA, 19 nt, Shigella flexneri 2a str. 2457T
ucaaaaaaggcugacaaau

SEQ ID NO: 3823844 - RNA, 22 nt, Shigella flexneri 2a str. 2457T
ucaaaaaaggcugacaaaucag

SEQ ID NO: 3823845 - RNA, 14 nt, Shigella flexneri 2a str. 2457T
ucaaaaaagucaga

SEQ ID NO: 3823846 - RNA, 21 nt, Shigella flexneri 2a str. 2457T
ucaaaaaaugaaacuggaaga

SEQ ID NO: 3823847 - RNA, 14 nt, Shigella flexneri 2a str. 2457T
ucaaaaacaaagaa

SEQ ID NO: 3823848 - RNA, 15 nt, Shigella flexneri 2a str. 2457T
ucaaaaacaaagaac

SEQ ID NO: 3823849 - RNA, 13 nt, Shigella flexneri 2a str. 2457T
ucaaaaagcugua

SEQ ID NO: 3823850 - RNA, 15 nt, Shigella flexneri 2a str. 2457T
ucaaaacaaaaaccg

SEQ ID NO: 3823851 - RNA, 19 nt, Shigella flexneri 2a str. 2457T
ucaaaacggugaucaaaac

SEQ ID NO: 3823852 - RNA, 16 nt, Shigella flexneri 2a str. 2457T
ucaaaacguccggcaa

SEQ ID NO: 3823853 - RNA, 15 nt, Shigella flexneri 2a str. 2457T
ucaaaagauugaauu

SEQ ID NO: 3823854 - RNA, 20 nt, Shigella flexneri 2a str. 2457T
ucaaaauaucgacauucaau

SEQ ID NO: 3823855 - RNA, 14 nt, Shigella flexneri 2a str. 2457T
ucaaacacaaaguc

SEQ ID NO: 3823856 - RNA, 21 nt, Shigella flexneri 2a str. 2457T
ucaaacacaaaguccugaccu

SEQ ID NO: 3823857 - RNA, 16 nt, Shigella flexneri 2a str. 2457T
ucaaacaguucuggaa

SEQ ID NO: 3823858 - RNA, 13 nt, Shigella flexneri 2a str. 2457T
ucaaaccaauggc

SEQ ID NO: 3823859 - RNA, 20 nt, Shigella flexneri 2a str. 2457T
ucaaaccaauggcauuggca

SEQ ID NO: 3823860 - RNA, 22 nt, Shigella flexneri 2a str. 2457T
ucaaaccaauggcauuggcaga

SEQ ID NO: 3823861 - RNA, 15 nt, Shigella flexneri 2a str. 2457T
ucaaaccacuuaauu

SEQ ID NO: 3823862 - RNA, 17 nt, Shigella flexneri 2a str. 2457T
ucaaaccacuuaauuau

SEQ ID NO: 3823863 - RNA, 21 nt, Shigella flexneri 2a str. 2457T
ucaaaccacuuaauuauuaac

SEQ ID NO: 3823864 - RNA, 22 nt, Shigella flexneri 2a str. 2457T
ucaaaccauucccugcuuugca

SEQ ID NO: 3823865 - RNA, 22 nt, Shigella flexneri 2a str. 2457T
ucaaaccauuuugcaaggcuuc

SEQ ID NO: 3823866 - RNA, 12 nt, Shigella flexneri 2a str. 2457T
ucaaacccuucc

SEQ ID NO: 3823867 - RNA, 17 nt, Shigella flexneri 2a str. 2457T
ucaaacccuucuucaau

SEQ ID NO: 3823868 - RNA, 20 nt, Shigella flexneri 2a str. 2457T
ucaaaccguaguccauaccc

SEQ ID NO: 3823869 - RNA, 16 nt, Shigella flexneri 2a str. 2457T
ucaaacgaagcggcug

SEQ ID NO: 3823870 - RNA, 16 nt, Shigella flexneri 2a str. 2457T
ucaaacgaaucugcaa

SEQ ID NO: 3823871 - RNA, 21 nt, Shigella flexneri 2a str. 2457T
ucaaacgaaucugcaaucaaa

SEQ ID NO: 3823872 - RNA, 22 nt, Shigella flexneri 2a str. 2457T
ucaaacgaccaaucgcgggcaa

SEQ ID NO: 3823873 - RNA, 21 nt, Shigella flexneri 2a str. 2457T
ucaaacgauuuuuuuaauaau

SEQ ID NO: 3823874 - RNA, 17 nt, Shigella flexneri 2a str. 2457T
ucaaacgcacgucugau

SEQ ID NO: 3823875 - RNA, 14 nt, Shigella flexneri 2a str. 2457T
ucaaacgccacagc

SEQ ID NO: 3823876 - RNA, 19 nt, Shigella flexneri 2a str. 2457T
ucaaacggcguuuucucau

SEQ ID NO: 3823877 - RNA, 16 nt, Shigella flexneri 2a str. 2457T
ucaaacgguugauaaa

SEQ ID NO: 3823878 - RNA, 17 nt, Shigella flexneri 2a str. 2457T
ucaaacgguugauaaau

SEQ ID NO: 3823879 - RNA, 17 nt, Shigella flexneri 2a str. 2457T
ucaaacucggcuucgcu

SEQ ID NO: 3823880 - RNA, 12 nt, Shigella flexneri 2a str. 2457T
ucaaacucuuca

SEQ ID NO: 3823881 - RNA, 14 nt, Shigella flexneri 2a str. 2457T
ucaaacucuucaca

SEQ ID NO: 3823882 - RNA, 16 nt, Shigella flexneri 2a str. 2457T
ucaaacucuucacacc

SEQ ID NO: 3823883 - RNA, 20 nt, Shigella flexneri 2a str. 2457T
ucaaacugaccuuuagcgcg

SEQ ID NO: 3823884 - RNA, 23 nt, Shigella flexneri 2a str. 2457T
ucaaacuggguuuugaucuccag

SEQ ID NO: 3823885 - RNA, 18 nt, Shigella flexneri 2a str. 2457T
ucaaacuuuaauuuuuca

SEQ ID NO: 3823886 - RNA, 15 nt, Shigella flexneri 2a str. 2457T
ucaaacuuuuaaauu

SEQ ID NO: 3823887 - RNA, 17 nt, Shigella flexneri 2a str. 2457T
ucaaagaugaugucaca

SEQ ID NO: 3823888 - RNA, 15 nt, Shigella flexneri 2a str. 2457T
ucaacuuucgaucag

SEQ ID NO: 3823889 - RNA, 16 nt, Shigella flexneri 2a str. 2457T
ucaagaaacagcaguu

SEQ ID NO: 3823890 - RNA, 18 nt, Shigella flexneri 2a str. 2457T
ucaagaaaccgaaguugu

SEQ ID NO: 3823891 - RNA, 12 nt, Shigella flexneri 2a str. 2457T
ucaagaaaugca

SEQ ID NO: 3823892 - RNA, 17 nt, Shigella flexneri 2a str. 2457T
ucaagaauacuguccau

SEQ ID NO: 3823893 - RNA, 23 nt, Shigella flexneri 2a str. 2457T
ucaagaaugcucgcuggcaggcc

SEQ ID NO: 3823894 - RNA, 13 nt, Shigella flexneri 2a str. 2457T
ucaagacaucaau

SEQ ID NO: 3823895 - RNA, 21 nt, Shigella flexneri 2a str. 2457T
ucaagacgaauaccuucuucc

SEQ ID NO: 3823896 - RNA, 15 nt, Shigella flexneri 2a str. 2457T
ucaagagacugcugg

SEQ ID NO: 3823897 - RNA, 20 nt, Shigella flexneri 2a str. 2457T
ucaagauagggaaugagcug

SEQ ID NO: 3823898 - RNA, 19 nt, Shigella flexneri 2a str. 2457T
ucaagauauuucaccagcg

SEQ ID NO: 3823899 - RNA, 14 nt, Shigella flexneri 2a str. 2457T
ucaagaucaucaaa

SEQ ID NO: 3823900 - RNA, 18 nt, Shigella flexneri 2a str. 2457T
ucaagauuaaaagugauu

SEQ ID NO: 3823901 - RNA, 15 nt, Shigella flexneri 2a str. 2457T
ucaagauuagccccc

SEQ ID NO: 3823902 - RNA, 21 nt, Shigella flexneri 2a str. 2457T
ucaagcaaggccagguuuucu

SEQ ID NO: 3823903 - RNA, 13 nt, Shigella flexneri 2a str. 2457T
ucaagcacaauca

SEQ ID NO: 3823904 - RNA, 20 nt, Shigella flexneri 2a str. 2457T
ucaagcguuucaucuucagu

SEQ ID NO: 3823905 - RNA, 18 nt, Shigella flexneri 2a str. 2457T
ucaagcugugccugaaua

SEQ ID NO: 3823906 - RNA, 20 nt, Shigella flexneri 2a str. 2457T
ucaaggauugcagcacugau

SEQ ID NO: 3823907 - RNA, 23 nt, Shigella flexneri 2a str. 2457T
ucaaggcauauaccacacccgca

SEQ ID NO: 3823908 - RNA, 17 nt, Shigella flexneri 2a str. 2457T
ucaaggugcgcgaugcu

SEQ ID NO: 3823909 - RNA, 19 nt, Shigella flexneri 2a str. 2457T
ucaaguauuuuuaauuaaa

SEQ ID NO: 3823910 - RNA, 21 nt, Shigella flexneri 2a str. 2457T
ucaagugcuuucaucaaaaaa

SEQ ID NO: 3823911 - RNA, 21 nt, Shigella flexneri 2a str. 2457T
ucaaguguggccgccagugau

SEQ ID NO: 3823912 - RNA, 13 nt, Shigella flexneri 2a str. 2457T
ucaaguugacucu

SEQ ID NO: 3823913 - RNA, 19 nt, Shigella flexneri 2a str. 2457T
ucaaguugacucucaucca

SEQ ID NO: 3823914 - RNA, 13 nt, Shigella flexneri 2a str. 2457T
ucaauaaaaauac

SEQ ID NO: 3823915 - RNA, 21 nt, Shigella flexneri 2a str. 2457T
ucaauaaaaauacauacgcaa

SEQ ID NO: 3823916 - RNA, 13 nt, Shigella flexneri 2a str. 2457T
ucaauaaaagcau

SEQ ID NO: 3823917 - RNA, 17 nt, Shigella flexneri 2a str. 2457T
ucaauaaaaggaaacag

SEQ ID NO: 3823918 - RNA, 13 nt, Shigella flexneri 2a str. 2457T
ucaauaaacggga

SEQ ID NO: 3823919 - RNA, 15 nt, Shigella flexneri 2a str. 2457T
ucaauaacagcgcaa

SEQ ID NO: 3823920 - RNA, 10 nt, Shigella flexneri 2a str. 2457T
ucaauaauca

SEQ ID NO: 3823921 - RNA, 20 nt, Shigella flexneri 2a str. 2457T
ucaauaccgccugcaaauaa

SEQ ID NO: 3823922 - RNA, 18 nt, Shigella flexneri 2a str. 2457T
ucaauacuuucacaaaaa

SEQ ID NO: 3823923 - RNA, 14 nt, Shigella flexneri 2a str. 2457T
ucaauacuuuccag

SEQ ID NO: 3823924 - RNA, 16 nt, Shigella flexneri 2a str. 2457T
ucaauacuuuccagca

SEQ ID NO: 3823925 - RNA, 22 nt, Shigella flexneri 2a str. 2457T
ucaauacuuuccagcauauguu

SEQ ID NO: 3823926 - RNA, 13 nt, Shigella flexneri 2a str. 2457T
ucaauauauugca

SEQ ID NO: 3823927 - RNA, 18 nt, Shigella flexneri 2a str. 2457T
ucaauauauugcaaucuc

SEQ ID NO: 3823928 - RNA, 14 nt, Shigella flexneri 2a str. 2457T
ucaauaucaucauu

SEQ ID NO: 3823929 - RNA, 18 nt, Shigella flexneri 2a str. 2457T
ucaauaucaucauuugca

SEQ ID NO: 3823930 - RNA, 23 nt, Shigella flexneri 2a str. 2457T
ucaauaucauuacgccagucacg

SEQ ID NO: 3823931 - RNA, 14 nt, Shigella flexneri 2a str. 2457T
ucaauaugaauuaa

SEQ ID NO: 3823932 - RNA, 17 nt, Shigella flexneri 2a str. 2457T
ucaauaugauaaaccuc

SEQ ID NO: 3823933 - RNA, 12 nt, Shigella flexneri 2a str. 2457T
ucaauauuuuca

SEQ ID NO: 3823934 - RNA, 16 nt, Shigella flexneri 2a str. 2457T
ucaauauuuucaaucu

SEQ ID NO: 3823935 - RNA, 22 nt, Shigella flexneri 2a str. 2457T
ucaaucaacuuauugguaaacu

SEQ ID NO: 3823936 - RNA, 13 nt, Shigella flexneri 2a str. 2457T
ucaaucacaucau

SEQ ID NO: 3823937 - RNA, 15 nt, Shigella flexneri 2a str. 2457T
ucaaucaccgcuuca

SEQ ID NO: 3823938 - RNA, 17 nt, Shigella flexneri 2a str. 2457T
ucaaucaccgcuucacu

SEQ ID NO: 3823939 - RNA, 14 nt, Shigella flexneri 2a str. 2457T
ucaaucaggcuauc

SEQ ID NO: 3823940 - RNA, 15 nt, Shigella flexneri 2a str. 2457T
ucaaucauccauauu

SEQ ID NO: 3823941 - RNA, 19 nt, Shigella flexneri 2a str. 2457T
ucaaucauccauauuuuca

SEQ ID NO: 3823942 - RNA, 12 nt, Shigella flexneri 2a str. 2457T
ucaaucauuuuu

SEQ ID NO: 3823943 - RNA, 20 nt, Shigella flexneri 2a str. 2457T
ucaauccaguguaaaacagc

SEQ ID NO: 3823944 - RNA, 15 nt, Shigella flexneri 2a str. 2457T
ucaaucgccaccaca

SEQ ID NO: 3823945 - RNA, 18 nt, Shigella flexneri 2a str. 2457T
ucaaucguaugaucaucc

SEQ ID NO: 3823946 - RNA, 14 nt, Shigella flexneri 2a str. 2457T
ucaaucucuucaca

SEQ ID NO: 3823947 - RNA, 16 nt, Shigella flexneri 2a str. 2457T
ucaaucucuuuuucca

SEQ ID NO: 3823948 - RNA, 21 nt, Shigella flexneri 2a str. 2457T
ucaaucucuuuuuccaccgca

SEQ ID NO: 3823949 - RNA, 16 nt, Shigella flexneri 2a str. 2457T
ucaaucugauagugau

SEQ ID NO: 3823950 - RNA, 16 nt, Shigella flexneri 2a str. 2457T
ucaaucugcugccuga

SEQ ID NO: 3823951 - RNA, 13 nt, Shigella flexneri 2a str. 2457T
ucaaucuggccug

SEQ ID NO: 3823952 - RNA, 21 nt, Shigella flexneri 2a str. 2457T
ucaaucuuuuucaugcuauuc

SEQ ID NO: 3823953 - RNA, 14 nt, Shigella flexneri 2a str. 2457T
ucaaugauaagccu

SEQ ID NO: 3823954 - RNA, 21 nt, Shigella flexneri 2a str. 2457T
ucaaugauaguucaacagauu

SEQ ID NO: 3823955 - RNA, 17 nt, Shigella flexneri 2a str. 2457T
ucaaugauuucugccag

SEQ ID NO: 3823956 - RNA, 18 nt, Shigella flexneri 2a str. 2457T
ucaaugauuucugccagc

SEQ ID NO: 3823957 - RNA, 17 nt, Shigella flexneri 2a str. 2457T
ucaaugcauuaaauugu

SEQ ID NO: 3823958 - RNA, 20 nt, Shigella flexneri 2a str. 2457T
ucaaugcauuaucagagauu

SEQ ID NO: 3823959 - RNA, 16 nt, Shigella flexneri 2a str. 2457T
ucaaugcccaucacua

SEQ ID NO: 3823960 - RNA, 18 nt, Shigella flexneri 2a str. 2457T
ucaaugccgucaccagca

SEQ ID NO: 3823961 - RNA, 12 nt, Shigella flexneri 2a str. 2457T
ucaaugcgaucu

SEQ ID NO: 3823962 - RNA, 21 nt, Shigella flexneri 2a str. 2457T
ucaaugcuuuuugcauuuccg

SEQ ID NO: 3823963 - RNA, 22 nt, Shigella flexneri 2a str. 2457T
ucaauggaaggggccgaaaaau

SEQ ID NO: 3823964 - RNA, 16 nt, Shigella flexneri 2a str. 2457T
ucaauggucagcgcca

SEQ ID NO: 3823965 - RNA, 15 nt, Shigella flexneri 2a str. 2457T
ucaauguaucucuga

SEQ ID NO: 3823966 - RNA, 14 nt, Shigella flexneri 2a str. 2457T
ucaaugucugucau

SEQ ID NO: 3823967 - RNA, 21 nt, Shigella flexneri 2a str. 2457T
ucaaugugcugaguguaacgc

SEQ ID NO: 3823968 - RNA, 21 nt, Shigella flexneri 2a str. 2457T
ucaauuaccaacucaucgccg

SEQ ID NO: 3823969 - RNA, 14 nt, Shigella flexneri 2a str. 2457T
ucaauuccuauuuu

SEQ ID NO: 3823970 - RNA, 18 nt, Shigella flexneri 2a str. 2457T
ucaauuccuucugggcgc

SEQ ID NO: 3823971 - RNA, 13 nt, Shigella flexneri 2a str. 2457T
ucaauucucuaau

SEQ ID NO: 3823972 - RNA, 17 nt, Shigella flexneri 2a str. 2457T
ucaauugccaccaugca

SEQ ID NO: 3823973 - RNA, 17 nt, Shigella flexneri 2a str. 2457T
ucaauugcgcaccagcu

SEQ ID NO: 3823974 - RNA, 18 nt, Shigella flexneri 2a str. 2457T
ucaauuuccaguuucaca

SEQ ID NO: 3823975 - RNA, 20 nt, Shigella flexneri 2a str. 2457T
ucaauuuccgucgcaugggg

SEQ ID NO: 3823976 - RNA, 20 nt, Shigella flexneri 2a str. 2457T
ucaauuugagcgaagcgcau

SEQ ID NO: 3823977 - RNA, 20 nt, Shigella flexneri 2a str. 2457T
ucaauuuucacuuucggcag

SEQ ID NO: 3823978 - RNA, 24 nt, Shigella flexneri 2a str. 2457T
ucaauuuugaugauaucagccugc

SEQ ID NO: 3823979 - RNA, 10 nt, Shigella flexneri 2a str. 2457T
ucacaaaaag

SEQ ID NO: 3823980 - RNA, 22 nt, Shigella flexneri 2a str. 2457T
ucacaaaaauaauuuucguagu

SEQ ID NO: 3823981 - RNA, 12 nt, Shigella flexneri 2a str. 2457T
ucacaaacauca

SEQ ID NO: 3823982 - RNA, 20 nt, Shigella flexneri 2a str. 2457T
ucacaaagacgccaucaauu

SEQ ID NO: 3823983 - RNA, 23 nt, Shigella flexneri 2a str. 2457T
ucacaaauucuggcggcaauaac

SEQ ID NO: 3823984 - RNA, 13 nt, Shigella flexneri 2a str. 2457T
ucacaauaaucgc

SEQ ID NO: 3823985 - RNA, 18 nt, Shigella flexneri 2a str. 2457T
ucacaaucggcuuucacc

SEQ ID NO: 3823986 - RNA, 14 nt, Shigella flexneri 2a str. 2457T
ucaccgcagcaucg

SEQ ID NO: 3823987 - RNA, 23 nt, Shigella flexneri 2a str. 2457T
ucaccgcagcaucgucaucagcu

SEQ ID NO: 3823988 - RNA, 14 nt, Shigella flexneri 2a str. 2457T
ucaccgcaucguca

SEQ ID NO: 3823989 - RNA, 15 nt, Shigella flexneri 2a str. 2457T
ucaccgcaucgucac

SEQ ID NO: 3823990 - RNA, 14 nt, Shigella flexneri 2a str. 2457T
ucaccgccaccagc

SEQ ID NO: 3823991 - RNA, 15 nt, Shigella flexneri 2a str. 2457T
ucaccgccaccagcg

SEQ ID NO: 3823992 - RNA, 19 nt, Shigella flexneri 2a str. 2457T
ucaccgccacuaccaucag

SEQ ID NO: 3823993 - RNA, 20 nt, Shigella flexneri 2a str. 2457T
ucaccgccgagacauccacu

SEQ ID NO: 3823994 - RNA, 21 nt, Shigella flexneri 2a str. 2457T
ucaccgccgccuuuuacgcau

SEQ ID NO: 3823995 - RNA, 16 nt, Shigella flexneri 2a str. 2457T
ucaccgccugaucaug

SEQ ID NO: 3823996 - RNA, 21 nt, Shigella flexneri 2a str. 2457T
ucaccgcguaugcccagcgca

SEQ ID NO: 3823997 - RNA, 21 nt, Shigella flexneri 2a str. 2457T
ucaccgcgucuucgcugcuuu

SEQ ID NO: 3823998 - RNA, 18 nt, Shigella flexneri 2a str. 2457T
ucaccggcguucccgucc

SEQ ID NO: 3823999 - RNA, 19 nt, Shigella flexneri 2a str. 2457T
ucaccggcuucucgccuac

SEQ ID NO: 3824000 - RNA, 16 nt, Shigella flexneri 2a str. 2457T
ucaccggugagcugca

SEQ ID NO: 3824001 - RNA, 17 nt, Shigella flexneri 2a str. 2457T
ucaccguucacugccac

SEQ ID NO: 3824002 - RNA, 18 nt, Shigella flexneri 2a str. 2457T
ucaccguucagcuugcgu

SEQ ID NO: 3824003 - RNA, 18 nt, Shigella flexneri 2a str. 2457T
ucaccucaucaccacaga

SEQ ID NO: 3824004 - RNA, 21 nt, Shigella flexneri 2a str. 2457T
ucaccuccagcgaaggaucac

SEQ ID NO: 3824005 - RNA, 21 nt, Shigella flexneri 2a str. 2457T
ucaccugaugcccguacgcug

SEQ ID NO: 3824006 - RNA, 21 nt, Shigella flexneri 2a str. 2457T
ucaccugcccgguauccauca

SEQ ID NO: 3824007 - RNA, 22 nt, Shigella flexneri 2a str. 2457T
ucaccugugacgacuuuuucca

SEQ ID NO: 3824008 - RNA, 23 nt, Shigella flexneri 2a str. 2457T
ucaccuuacggcacuccucuuca

SEQ ID NO: 3824009 - RNA, 19 nt, Shigella flexneri 2a str. 2457T
ucaccuuccacgcggguaa

SEQ ID NO: 3824010 - RNA, 13 nt, Shigella flexneri 2a str. 2457T
ucaccuuccagua

SEQ ID NO: 3824011 - RNA, 13 nt, Shigella flexneri 2a str. 2457T
ucaccuuuaaccu

SEQ ID NO: 3824012 - RNA, 15 nt, Shigella flexneri 2a str. 2457T
ucaccuuuaaccucc

SEQ ID NO: 3824013 - RNA, 13 nt, Shigella flexneri 2a str. 2457T
ucaccuuuucggu

SEQ ID NO: 3824014 - RNA, 15 nt, Shigella flexneri 2a str. 2457T
ucacgaacacagugg

SEQ ID NO: 3824015 - RNA, 15 nt, Shigella flexneri 2a str. 2457T
ucacgaauauuuccc

SEQ ID NO: 3824016 - RNA, 15 nt, Shigella flexneri 2a str. 2457T
ucacgaaucuauuca

SEQ ID NO: 3824017 - RNA, 18 nt, Shigella flexneri 2a str. 2457T
ucacgaaucuauucauuu

SEQ ID NO: 3824018 - RNA, 20 nt, Shigella flexneri 2a str. 2457T
ucacgacaaaugcgccgcca

SEQ ID NO: 3824019 - RNA, 14 nt, Shigella flexneri 2a str. 2457T
ucacgagagauacg

SEQ ID NO: 3824020 - RNA, 14 nt, Shigella flexneri 2a str. 2457T
ucacgaucacagca

SEQ ID NO: 3824021 - RNA, 12 nt, Shigella flexneri 2a str. 2457T
ucacgaugcuaa

SEQ ID NO: 3824022 - RNA, 14 nt, Shigella flexneri 2a str. 2457T
ucacgaugcuaaaa

SEQ ID NO: 3824023 - RNA, 17 nt, Shigella flexneri 2a str. 2457T
ucacgauuguuaaucac

SEQ ID NO: 3824024 - RNA, 13 nt, Shigella flexneri 2a str. 2457T
ucacgcaaccaca

SEQ ID NO: 3824025 - RNA, 14 nt, Shigella flexneri 2a str. 2457T
ucacgcaauaccug

SEQ ID NO: 3824026 - RNA, 16 nt, Shigella flexneri 2a str. 2457T
ucacgcagcgucagca

SEQ ID NO: 3824027 - RNA, 16 nt, Shigella flexneri 2a str. 2457T
ucacgcagcucacgca

SEQ ID NO: 3824028 - RNA, 23 nt, Shigella flexneri 2a str. 2457T
ucacgcagggugugcuccagucg

SEQ ID NO: 3824029 - RNA, 15 nt, Shigella flexneri 2a str. 2457T
ucacgcagugcugca

SEQ ID NO: 3824030 - RNA, 18 nt, Shigella flexneri 2a str. 2457T
ucacgcauggacacugcc

SEQ ID NO: 3824031 - RNA, 19 nt, Shigella flexneri 2a str. 2457T
ucacgccaauaauggccuu

SEQ ID NO: 3824032 - RNA, 22 nt, Shigella flexneri 2a str. 2457T
ucacgccaauaauggccuuuuc

SEQ ID NO: 3824033 - RNA, 22 nt, Shigella flexneri 2a str. 2457T
ucacgcccagauccacuaacug

SEQ ID NO: 3824034 - RNA, 13 nt, Shigella flexneri 2a str. 2457T
ucacgcccagucc

SEQ ID NO: 3824035 - RNA, 18 nt, Shigella flexneri 2a str. 2457T
ucacgccgcauccggcau

SEQ ID NO: 3824036 - RNA, 21 nt, Shigella flexneri 2a str. 2457T
ucacgccgcauccggcauaaa

SEQ ID NO: 3824037 - RNA, 15 nt, Shigella flexneri 2a str. 2457T
ucacgccgcaucugg

SEQ ID NO: 3824038 - RNA, 14 nt, Shigella flexneri 2a str. 2457T
ucacgcgccagaga

SEQ ID NO: 3824039 - RNA, 22 nt, Shigella flexneri 2a str. 2457T
ucacgcuauacaaccaccccac

SEQ ID NO: 3824040 - RNA, 14 nt, Shigella flexneri 2a str. 2457T
ucacgcucauccug

SEQ ID NO: 3824041 - RNA, 13 nt, Shigella flexneri 2a str. 2457T
ucacggcaccagc

SEQ ID NO: 3824042 - RNA, 14 nt, Shigella flexneri 2a str. 2457T
ucacggcaccagcc

SEQ ID NO: 3824043 - RNA, 15 nt, Shigella flexneri 2a str. 2457T
ucacggcaccagcca

SEQ ID NO: 3824044 - RNA, 15 nt, Shigella flexneri 2a str. 2457T
ucacggcacucgcug

SEQ ID NO: 3824045 - RNA, 19 nt, Shigella flexneri 2a str. 2457T
ucacggcccauuccucaug

SEQ ID NO: 3824046 - RNA, 19 nt, Shigella flexneri 2a str. 2457T
ucacggcgacggcuggcaa

SEQ ID NO: 3824047 - RNA, 18 nt, Shigella flexneri 2a str. 2457T
ucacggcugcuaauauuu

SEQ ID NO: 3824048 - RNA, 18 nt, Shigella flexneri 2a str. 2457T
ucacggcuguagccagcu

SEQ ID NO: 3824049 - RNA, 20 nt, Shigella flexneri 2a str. 2457T
ucacggcuguagccagcucg

SEQ ID NO: 3824050 - RNA, 19 nt, Shigella flexneri 2a str. 2457T
ucacggucagcauauccag

SEQ ID NO: 3824051 - RNA, 21 nt, Shigella flexneri 2a str. 2457T
ucacgucaggaucgugcggca

SEQ ID NO: 3824052 - RNA, 13 nt, Shigella flexneri 2a str. 2457T
ucacgucgcccac

SEQ ID NO: 3824053 - RNA, 15 nt, Shigella flexneri 2a str. 2457T
ucacgucucaucagg

SEQ ID NO: 3824054 - RNA, 21 nt, Shigella flexneri 2a str. 2457T
ucacguucacccaucacuacc

SEQ ID NO: 3824055 - RNA, 13 nt, Shigella flexneri 2a str. 2457T
ucacguuccaggc

SEQ ID NO: 3824056 - RNA, 14 nt, Shigella flexneri 2a str. 2457T
ucacguugauggua

SEQ ID NO: 3824057 - RNA, 19 nt, Shigella flexneri 2a str. 2457T
ucacuaaacccgaccacuu

SEQ ID NO: 3824058 - RNA, 13 nt, Shigella flexneri 2a str. 2457T
ucacuacaaucag

SEQ ID NO: 3824059 - RNA, 23 nt, Shigella flexneri 2a str. 2457T
ucacuaccagcgccaccgguuua

SEQ ID NO: 3824060 - RNA, 23 nt, Shigella flexneri 2a str. 2457T
ucacuacgcgaccgugggcaauu

SEQ ID NO: 3824061 - RNA, 16 nt, Shigella flexneri 2a str. 2457T
ucacuauacuccugau

SEQ ID NO: 3824062 - RNA, 23 nt, Shigella flexneri 2a str. 2457T
ucacuauccgccccauuuuuaac

SEQ ID NO: 3824063 - RNA, 16 nt, Shigella flexneri 2a str. 2457T
ucacuauguaauccug

SEQ ID NO: 3824064 - RNA, 14 nt, Shigella flexneri 2a str. 2457T
ucacuauuaaagaa

SEQ ID NO: 3824065 - RNA, 13 nt, Shigella flexneri 2a str. 2457T
ucacucaaaauau

SEQ ID NO: 3824066 - RNA, 14 nt, Shigella flexneri 2a str. 2457T
ucacucaaaauauc

SEQ ID NO: 3824067 - RNA, 12 nt, Shigella flexneri 2a str. 2457T
ucacucaccgca

SEQ ID NO: 3824068 - RNA, 12 nt, Shigella flexneri 2a str. 2457T
ucacucaucaac

SEQ ID NO: 3824069 - RNA, 19 nt, Shigella flexneri 2a str. 2457T
ucacuccccgcaacaguga

SEQ ID NO: 3824070 - RNA, 19 nt, Shigella flexneri 2a str. 2457T
ucacucccuuucugccacg

SEQ ID NO: 3824071 - RNA, 14 nt, Shigella flexneri 2a str. 2457T
ucacugacaccagc

SEQ ID NO: 3824072 - RNA, 15 nt, Shigella flexneri 2a str. 2457T
ucacugacaccagca

SEQ ID NO: 3824073 - RNA, 13 nt, Shigella flexneri 2a str. 2457T
ucacugacaccau

SEQ ID NO: 3824074 - RNA, 15 nt, Shigella flexneri 2a str. 2457T
ucacugacuuuucgu

SEQ ID NO: 3824075 - RNA, 23 nt, Shigella flexneri 2a str. 2457T
ucacugaugugauggccgcgcag

SEQ ID NO: 3824076 - RNA, 13 nt, Shigella flexneri 2a str. 2457T
ucacugcaaauac

SEQ ID NO: 3824077 - RNA, 21 nt, Shigella flexneri 2a str. 2457T
ucacugccagaauagccgcag

SEQ ID NO: 3824078 - RNA, 21 nt, Shigella flexneri 2a str. 2457T
ucacugccguacaggcagcuu

SEQ ID NO: 3824079 - RNA, 22 nt, Shigella flexneri 2a str. 2457T
ucacugcgaaagcgucagcuuu

SEQ ID NO: 3824080 - RNA, 23 nt, Shigella flexneri 2a str. 2457T
ucacugcuuuggcucuucgcucc

SEQ ID NO: 3824081 - RNA, 15 nt, Shigella flexneri 2a str. 2457T
ucacuggcaaaagcc

SEQ ID NO: 3824082 - RNA, 14 nt, Shigella flexneri 2a str. 2457T
ucacuggcgucaug

SEQ ID NO: 3824083 - RNA, 22 nt, Shigella flexneri 2a str. 2457T
ucacugggcgauuaauaaaauu

SEQ ID NO: 3824084 - RNA, 13 nt, Shigella flexneri 2a str. 2457T
ucagccacuuccu

SEQ ID NO: 3824085 - RNA, 13 nt, Shigella flexneri 2a str. 2457T
ucagccagaaugu

SEQ ID NO: 3824086 - RNA, 15 nt, Shigella flexneri 2a str. 2457T
ucagccagcuggcag

SEQ ID NO: 3824087 - RNA, 16 nt, Shigella flexneri 2a str. 2457T
ucagccagcuggcaga

SEQ ID NO: 3824088 - RNA, 17 nt, Shigella flexneri 2a str. 2457T
ucagccagcuggcagaa

SEQ ID NO: 3824089 - RNA, 18 nt, Shigella flexneri 2a str. 2457T
ucagccaucauccauucg

SEQ ID NO: 3824090 - RNA, 13 nt, Shigella flexneri 2a str. 2457T
ucagcccagcccu

SEQ ID NO: 3824091 - RNA, 22 nt, Shigella flexneri 2a str. 2457T
ucagcccgcgauacaccugaug

SEQ ID NO: 3824092 - RNA, 14 nt, Shigella flexneri 2a str. 2457T
ucagcccggcaacg

SEQ ID NO: 3824093 - RNA, 15 nt, Shigella flexneri 2a str. 2457T
ucagccgcaaaccug

SEQ ID NO: 3824094 - RNA, 15 nt, Shigella flexneri 2a str. 2457T
ucagccgcacaccug

SEQ ID NO: 3824095 - RNA, 18 nt, Shigella flexneri 2a str. 2457T
ucagccguacccaggccc

SEQ ID NO: 3824096 - RNA, 17 nt, Shigella flexneri 2a str. 2457T
ucagccgucauccagga

SEQ ID NO: 3824097 - RNA, 14 nt, Shigella flexneri 2a str. 2457T
ucagccugacagca

SEQ ID NO: 3824098 - RNA, 16 nt, Shigella flexneri 2a str. 2457T
ucagcgaacaccagca

SEQ ID NO: 3824099 - RNA, 22 nt, Shigella flexneri 2a str. 2457T
ucagcgagacgugcguaccauu

SEQ ID NO: 3824100 - RNA, 17 nt, Shigella flexneri 2a str. 2457T
ucagcgagagcaaugcg

SEQ ID NO: 3824101 - RNA, 21 nt, Shigella flexneri 2a str. 2457T
ucagcgaguuuuucaguccac

SEQ ID NO: 3824102 - RNA, 17 nt, Shigella flexneri 2a str. 2457T
ucagcgcaaagagugaa

SEQ ID NO: 3824103 - RNA, 19 nt, Shigella flexneri 2a str. 2457T
ucagcgcaaagagugaagu

SEQ ID NO: 3824104 - RNA, 12 nt, Shigella flexneri 2a str. 2457T
ucagcgcagaca

SEQ ID NO: 3824105 - RNA, 16 nt, Shigella flexneri 2a str. 2457T
ucagcgcagcacccag

SEQ ID NO: 3824106 - RNA, 13 nt, Shigella flexneri 2a str. 2457T
ucagcgcaugauu

SEQ ID NO: 3824107 - RNA, 16 nt, Shigella flexneri 2a str. 2457T
ucagcgcaugauuccc

SEQ ID NO: 3824108 - RNA, 13 nt, Shigella flexneri 2a str. 2457T
ucagcgccaaccc

SEQ ID NO: 3824109 - RNA, 15 nt, Shigella flexneri 2a str. 2457T
ucagcgccagcgcga

SEQ ID NO: 3824110 - RNA, 15 nt, Shigella flexneri 2a str. 2457T
ucagcgccugcugca

SEQ ID NO: 3824111 - RNA, 16 nt, Shigella flexneri 2a str. 2457T
ucagcggcaauucuuu

SEQ ID NO: 3824112 - RNA, 22 nt, Shigella flexneri 2a str. 2457T
ucagcggcacuguuucgccagg

SEQ ID NO: 3824113 - RNA, 14 nt, Shigella flexneri 2a str. 2457T
ucagcggcaguucg

SEQ ID NO: 3824114 - RNA, 20 nt, Shigella flexneri 2a str. 2457T
ucagcggcguaucuuccagg

SEQ ID NO: 3824115 - RNA, 15 nt, Shigella flexneri 2a str. 2457T
ucagcgggcagggca

SEQ ID NO: 3824116 - RNA, 17 nt, Shigella flexneri 2a str. 2457T
ucagcgggcagggcauc

SEQ ID NO: 3824117 - RNA, 22 nt, Shigella flexneri 2a str. 2457T
ucagcgggguucuccugagaau

SEQ ID NO: 3824118 - RNA, 12 nt, Shigella flexneri 2a str. 2457T
ucagcggugcgg

SEQ ID NO: 3824119 - RNA, 16 nt, Shigella flexneri 2a str. 2457T
ucagcgguggugaaaa

SEQ ID NO: 3824120 - RNA, 16 nt, Shigella flexneri 2a str. 2457T
ucagcguaucaauuaa

SEQ ID NO: 3824121 - RNA, 14 nt, Shigella flexneri 2a str. 2457T
ucagcguccgggaa

SEQ ID NO: 3824122 - RNA, 16 nt, Shigella flexneri 2a str. 2457T
ucagcgucgccuggug

SEQ ID NO: 3824123 - RNA, 22 nt, Shigella flexneri 2a str. 2457T
ucagcgucuguuuuaucacauc

SEQ ID NO: 3824124 - RNA, 18 nt, Shigella flexneri 2a str. 2457T
ucagcguuccacgugcgg

SEQ ID NO: 3824125 - RNA, 14 nt, Shigella flexneri 2a str. 2457T
ucagcguuccccag

SEQ ID NO: 3824126 - RNA, 14 nt, Shigella flexneri 2a str. 2457T
ucagcucauuaaaa

SEQ ID NO: 3824127 - RNA, 16 nt, Shigella flexneri 2a str. 2457T
ucagcuccucuuucau

SEQ ID NO: 3824128 - RNA, 21 nt, Shigella flexneri 2a str. 2457T
ucagcuccucuuucauuucac

SEQ ID NO: 3824129 - RNA, 16 nt, Shigella flexneri 2a str. 2457T
ucagcugacaacguuu

SEQ ID NO: 3824130 - RNA, 17 nt, Shigella flexneri 2a str. 2457T
ucagcugcacacagggc

SEQ ID NO: 3824131 - RNA, 14 nt, Shigella flexneri 2a str. 2457T
ucagcugccagggc

SEQ ID NO: 3824132 - RNA, 15 nt, Shigella flexneri 2a str. 2457T
ucagcuggcguaccg

SEQ ID NO: 3824133 - RNA, 19 nt, Shigella flexneri 2a str. 2457T
ucagcuuuggugaaaaaau

SEQ ID NO: 3824134 - RNA, 14 nt, Shigella flexneri 2a str. 2457T
ucagcuuuuccaua

SEQ ID NO: 3824135 - RNA, 12 nt, Shigella flexneri 2a str. 2457T
ucaggaaauaaa

SEQ ID NO: 3824136 - RNA, 16 nt, Shigella flexneri 2a str. 2457T
ucaggaaauaaauaau

SEQ ID NO: 3824137 - RNA, 19 nt, Shigella flexneri 2a str. 2457T
ucaggaacaccgcacgcag

SEQ ID NO: 3824138 - RNA, 22 nt, Shigella flexneri 2a str. 2457T
ucaggaaccacaaccacuuugu

SEQ ID NO: 3824139 - RNA, 20 nt, Shigella flexneri 2a str. 2457T
ucaggaacuguuucaccauu

SEQ ID NO: 3824140 - RNA, 17 nt, Shigella flexneri 2a str. 2457T
ucaggagcaacuggagu

SEQ ID NO: 3824141 - RNA, 22 nt, Shigella flexneri 2a str. 2457T
ucaggcaaaaaaaugcacauau

SEQ ID NO: 3824142 - RNA, 17 nt, Shigella flexneri 2a str. 2457T
ucaggcaacccagaaga

SEQ ID NO: 3824143 - RNA, 23 nt, Shigella flexneri 2a str. 2457T
ucaggcaaugggcaaacgcucuc

SEQ ID NO: 3824144 - RNA, 13 nt, Shigella flexneri 2a str. 2457T
ucaggcacguucc

SEQ ID NO: 3824145 - RNA, 18 nt, Shigella flexneri 2a str. 2457T
ucaggcagauacaaccaa

SEQ ID NO: 3824146 - RNA, 22 nt, Shigella flexneri 2a str. 2457T
ucaggcagauacaaccaaucgc

SEQ ID NO: 3824147 - RNA, 17 nt, Shigella flexneri 2a str. 2457T
ucaggcaggucuuucac

SEQ ID NO: 3824148 - RNA, 12 nt, Shigella flexneri 2a str. 2457T
ucaggcagucug

SEQ ID NO: 3824149 - RNA, 13 nt, Shigella flexneri 2a str. 2457T
ucaggcaucaugc

SEQ ID NO: 3824150 - RNA, 21 nt, Shigella flexneri 2a str. 2457T
ucaggcaucggugcuggccua

SEQ ID NO: 3824151 - RNA, 16 nt, Shigella flexneri 2a str. 2457T
ucaggcaucugagcau

SEQ ID NO: 3824152 - RNA, 20 nt, Shigella flexneri 2a str. 2457T
ucaggcauucucgaauuaau

SEQ ID NO: 3824153 - RNA, 18 nt, Shigella flexneri 2a str. 2457T
ucaggccgaggcacagca

SEQ ID NO: 3824154 - RNA, 15 nt, Shigella flexneri 2a str. 2457T
ucaggccggaauaac

SEQ ID NO: 3824155 - RNA, 18 nt, Shigella flexneri 2a str. 2457T
ucaggccuacaaaaucua

SEQ ID NO: 3824156 - RNA, 16 nt, Shigella flexneri 2a str. 2457T
ucaggccuacaggauu

SEQ ID NO: 3824157 - RNA, 15 nt, Shigella flexneri 2a str. 2457T
ucaggcgcugaaaga

SEQ ID NO: 3824158 - RNA, 16 nt, Shigella flexneri 2a str. 2457T
ucaggcggcucaccug

SEQ ID NO: 3824159 - RNA, 18 nt, Shigella flexneri 2a str. 2457T
ucaggcgugauucauaca

SEQ ID NO: 3824160 - RNA, 20 nt, Shigella flexneri 2a str. 2457T
ucaggcguuuacgccgcauc

SEQ ID NO: 3824161 - RNA, 20 nt, Shigella flexneri 2a str. 2457T
ucaggcuguguuuaagacgc

SEQ ID NO: 3824162 - RNA, 22 nt, Shigella flexneri 2a str. 2457T
ucaggcuuuuuuauugccaucu

SEQ ID NO: 3824163 - RNA, 20 nt, Shigella flexneri 2a str. 2457T
ucagggagucuugcuggaug

SEQ ID NO: 3824164 - RNA, 16 nt, Shigella flexneri 2a str. 2457T
ucagggccgaucaacg

SEQ ID NO: 3824165 - RNA, 16 nt, Shigella flexneri 2a str. 2457T
ucagggucuuccagca

SEQ ID NO: 3824166 - RNA, 18 nt, Shigella flexneri 2a str. 2457T
ucagggucuuccagcaaa

SEQ ID NO: 3824167 - RNA, 22 nt, Shigella flexneri 2a str. 2457T
ucagguaagcgauaaaaauacc

SEQ ID NO: 3824168 - RNA, 13 nt, Shigella flexneri 2a str. 2457T
ucagguaccagca

SEQ ID NO: 3824169 - RNA, 22 nt, Shigella flexneri 2a str. 2457T
ucaggucaaaagauugaauuau

SEQ ID NO: 3824170 - RNA, 14 nt, Shigella flexneri 2a str. 2457T
ucaggugucuggca

SEQ ID NO: 3824171 - RNA, 18 nt, Shigella flexneri 2a str. 2457T
ucaguaaaguuaccuucg

SEQ ID NO: 3824172 - RNA, 23 nt, Shigella flexneri 2a str. 2457T
ucaguaaaguuaccuucgaagaa

SEQ ID NO: 3824173 - RNA, 19 nt, Shigella flexneri 2a str. 2457T
ucaguaaccgcuuuuucaa

SEQ ID NO: 3824174 - RNA, 15 nt, Shigella flexneri 2a str. 2457T
ucaguacaccaccua

SEQ ID NO: 3824175 - RNA, 15 nt, Shigella flexneri 2a str. 2457T
ucaguagaauaaucu

SEQ ID NO: 3824176 - RNA, 14 nt, Shigella flexneri 2a str. 2457T
ucaguagcgcaauc

SEQ ID NO: 3824177 - RNA, 21 nt, Shigella flexneri 2a str. 2457T
ucaguagcgcaaucaccacca

SEQ ID NO: 3824178 - RNA, 22 nt, Shigella flexneri 2a str. 2457T
ucaguagcgcaaucaccaccac

SEQ ID NO: 3824179 - RNA, 19 nt, Shigella flexneri 2a str. 2457T
ucaguauggaucaaaucuc

SEQ ID NO: 3824180 - RNA, 13 nt, Shigella flexneri 2a str. 2457T
ucaguauggucga

SEQ ID NO: 3824181 - RNA, 15 nt, Shigella flexneri 2a str. 2457T
ucaguauuuccacaa

SEQ ID NO: 3824182 - RNA, 16 nt, Shigella flexneri 2a str. 2457T
ucauccagacugcuca

SEQ ID NO: 3824183 - RNA, 18 nt, Shigella flexneri 2a str. 2457T
ucauccagacugcucagc

SEQ ID NO: 3824184 - RNA, 22 nt, Shigella flexneri 2a str. 2457T
ucauccagacugcucagcuccu

SEQ ID NO: 3824185 - RNA, 21 nt, Shigella flexneri 2a str. 2457T
ucauccagcacggugaagaag

SEQ ID NO: 3824186 - RNA, 23 nt, Shigella flexneri 2a str. 2457T
ucauccagcacggugaagaagcg

SEQ ID NO: 3824187 - RNA, 13 nt, Shigella flexneri 2a str. 2457T
ucauccagcacuu

SEQ ID NO: 3824188 - RNA, 23 nt, Shigella flexneri 2a str. 2457T
ucauccagcacuugcaggaacag

SEQ ID NO: 3824189 - RNA, 15 nt, Shigella flexneri 2a str. 2457T
ucauccagugccgcc

SEQ ID NO: 3824190 - RNA, 16 nt, Shigella flexneri 2a str. 2457T
ucauccauaaauaccu

SEQ ID NO: 3824191 - RNA, 17 nt, Shigella flexneri 2a str. 2457T
ucauccaucaaauuacc

SEQ ID NO: 3824192 - RNA, 17 nt, Shigella flexneri 2a str. 2457T
ucaucccaguggauauc

SEQ ID NO: 3824193 - RNA, 23 nt, Shigella flexneri 2a str. 2457T
ucauccccccacgcguacucacu

SEQ ID NO: 3824194 - RNA, 14 nt, Shigella flexneri 2a str. 2457T
ucauccccucuucc

SEQ ID NO: 3824195 - RNA, 17 nt, Shigella flexneri 2a str. 2457T
ucaucccggaugcgucg

SEQ ID NO: 3824196 - RNA, 18 nt, Shigella flexneri 2a str. 2457T
ucauccgcacaaucccuu

SEQ ID NO: 3824197 - RNA, 20 nt, Shigella flexneri 2a str. 2457T
ucauccggcaccuuuucauc

SEQ ID NO: 3824198 - RNA, 21 nt, Shigella flexneri 2a str. 2457T
ucauccggcuuuuuuacauca

SEQ ID NO: 3824199 - RNA, 16 nt, Shigella flexneri 2a str. 2457T
ucauccguuucucugu

SEQ ID NO: 3824200 - RNA, 19 nt, Shigella flexneri 2a str. 2457T
ucauccuaaacgcuggcag

SEQ ID NO: 3824201 - RNA, 13 nt, Shigella flexneri 2a str. 2457T
ucauccucuucug

SEQ ID NO: 3824202 - RNA, 15 nt, Shigella flexneri 2a str. 2457T
ucauccucuucugcc

SEQ ID NO: 3824203 - RNA, 17 nt, Shigella flexneri 2a str. 2457T
ucauccugcugcacgcc

SEQ ID NO: 3824204 - RNA, 12 nt, Shigella flexneri 2a str. 2457T
ucauccuucagu

SEQ ID NO: 3824205 - RNA, 15 nt, Shigella flexneri 2a str. 2457T
ucauccuucagugcc

SEQ ID NO: 3824206 - RNA, 14 nt, Shigella flexneri 2a str. 2457T
ucaucgaauaaauu

SEQ ID NO: 3824207 - RNA, 15 nt, Shigella flexneri 2a str. 2457T
ucaucgauaccaaua

SEQ ID NO: 3824208 - RNA, 14 nt, Shigella flexneri 2a str. 2457T
ucaucgcaaugauu

SEQ ID NO: 3824209 - RNA, 17 nt, Shigella flexneri 2a str. 2457T
ucaucgcauccagugcg

SEQ ID NO: 3824210 - RNA, 22 nt, Shigella flexneri 2a str. 2457T
ucaucgcaucgaugguugcccu

SEQ ID NO: 3824211 - RNA, 15 nt, Shigella flexneri 2a str. 2457T
ucaucgccagcgaau

SEQ ID NO: 3824212 - RNA, 15 nt, Shigella flexneri 2a str. 2457T
ucaucgcccaggcaa

SEQ ID NO: 3824213 - RNA, 22 nt, Shigella flexneri 2a str. 2457T
ucaucgcccaguugaucaccag

SEQ ID NO: 3824214 - RNA, 23 nt, Shigella flexneri 2a str. 2457T
ucaucgcccaguugaucaccagu

SEQ ID NO: 3824215 - RNA, 15 nt, Shigella flexneri 2a str. 2457T
ucaucgccuuccagc

SEQ ID NO: 3824216 - RNA, 16 nt, Shigella flexneri 2a str. 2457T
ucaucgccuuccagcg

SEQ ID NO: 3824217 - RNA, 17 nt, Shigella flexneri 2a str. 2457T
ucaucgcggcacacagc

SEQ ID NO: 3824218 - RNA, 15 nt, Shigella flexneri 2a str. 2457T
ucaucgcuacaccaa

SEQ ID NO: 3824219 - RNA, 19 nt, Shigella flexneri 2a str. 2457T
ucaucgggaagaggaucug

SEQ ID NO: 3824220 - RNA, 23 nt, Shigella flexneri 2a str. 2457T
ucaucggguuacugauuuuauug

SEQ ID NO: 3824221 - RNA, 22 nt, Shigella flexneri 2a str. 2457T
ucaucggugguguaaccuucac

SEQ ID NO: 3824222 - RNA, 17 nt, Shigella flexneri 2a str. 2457T
ucaucucccacgcggca

SEQ ID NO: 3824223 - RNA, 17 nt, Shigella flexneri 2a str. 2457T
ucaucucgcucaaaaau

SEQ ID NO: 3824224 - RNA, 15 nt, Shigella flexneri 2a str. 2457T
ucaucucuccuuucg

SEQ ID NO: 3824225 - RNA, 16 nt, Shigella flexneri 2a str. 2457T
ucaucugaccacggcc

SEQ ID NO: 3824226 - RNA, 16 nt, Shigella flexneri 2a str. 2457T
ucaucugccacuucug

SEQ ID NO: 3824227 - RNA, 15 nt, Shigella flexneri 2a str. 2457T
ucaucuggcguacca

SEQ ID NO: 3824228 - RNA, 19 nt, Shigella flexneri 2a str. 2457T
ucaucuggcguaccaauca

SEQ ID NO: 3824229 - RNA, 22 nt, Shigella flexneri 2a str. 2457T
ucaucuguugugccacauccag

SEQ ID NO: 3824230 - RNA, 14 nt, Shigella flexneri 2a str. 2457T
ucaucuuaacuucg

SEQ ID NO: 3824231 - RNA, 17 nt, Shigella flexneri 2a str. 2457T
ucaucuuuccaaaccuc

SEQ ID NO: 3824232 - RNA, 16 nt, Shigella flexneri 2a str. 2457T
ucaugaaaaccguuag

SEQ ID NO: 3824233 - RNA, 19 nt, Shigella flexneri 2a str. 2457T
ucaugaccccagguaucgu

SEQ ID NO: 3824234 - RNA, 16 nt, Shigella flexneri 2a str. 2457T
ucaugacuacacuaaa

SEQ ID NO: 3824235 - RNA, 20 nt, Shigella flexneri 2a str. 2457T
ucaugcagcuccaccgauuu

SEQ ID NO: 3824236 - RNA, 17 nt, Shigella flexneri 2a str. 2457T
ucaugcaucauaaccug

SEQ ID NO: 3824237 - RNA, 18 nt, Shigella flexneri 2a str. 2457T
ucaugcaucgguuuugcg

SEQ ID NO: 3824238 - RNA, 14 nt, Shigella flexneri 2a str. 2457T
ucaugccaaaaaua

SEQ ID NO: 3824239 - RNA, 15 nt, Shigella flexneri 2a str. 2457T
ucaugccaaaaggga

SEQ ID NO: 3824240 - RNA, 13 nt, Shigella flexneri 2a str. 2457T
ucaugccagugau

SEQ ID NO: 3824241 - RNA, 23 nt, Shigella flexneri 2a str. 2457T
ucaugcccugcccguugccagga

SEQ ID NO: 3824242 - RNA, 19 nt, Shigella flexneri 2a str. 2457T
ucaugccgauaacucauau

SEQ ID NO: 3824243 - RNA, 12 nt, Shigella flexneri 2a str. 2457T
ucaugccggaug

SEQ ID NO: 3824244 - RNA, 22 nt, Shigella flexneri 2a str. 2457T
ucaugcugcggcuguccggcac

SEQ ID NO: 3824245 - RNA, 24 nt, Shigella flexneri 2a str. 2457T
ucaugcugcuggguguagcgcauc

SEQ ID NO: 3824246 - RNA, 16 nt, Shigella flexneri 2a str. 2457T
ucauggcagucuuaau

SEQ ID NO: 3824247 - RNA, 17 nt, Shigella flexneri 2a str. 2457T
ucauggcugacugucgc

SEQ ID NO: 3824248 - RNA, 20 nt, Shigella flexneri 2a str. 2457T
ucaugguuacgccggugauu

SEQ ID NO: 3824249 - RNA, 16 nt, Shigella flexneri 2a str. 2457T
ucaugguuagccugua

SEQ ID NO: 3824250 - RNA, 21 nt, Shigella flexneri 2a str. 2457T
ucaugucacccacugugguau

SEQ ID NO: 3824251 - RNA, 17 nt, Shigella flexneri 2a str. 2457T
ucaugucggcagugauu

SEQ ID NO: 3824252 - RNA, 13 nt, Shigella flexneri 2a str. 2457T
ucaugucugccgc

SEQ ID NO: 3824253 - RNA, 14 nt, Shigella flexneri 2a str. 2457T
ucaugugucgccgc

SEQ ID NO: 3824254 - RNA, 12 nt, Shigella flexneri 2a str. 2457T
ucauuaaaaaua

SEQ ID NO: 3824255 - RNA, 13 nt, Shigella flexneri 2a str. 2457T
ucauuaaaaauau

SEQ ID NO: 3824256 - RNA, 18 nt, Shigella flexneri 2a str. 2457T
ucauuaaaaauaugaccu

SEQ ID NO: 3824257 - RNA, 13 nt, Shigella flexneri 2a str. 2457T
ucauuaaagccgc

SEQ ID NO: 3824258 - RNA, 16 nt, Shigella flexneri 2a str. 2457T
ucauuaagaacuccug

SEQ ID NO: 3824259 - RNA, 15 nt, Shigella flexneri 2a str. 2457T
ucauuacaaccgcug

SEQ ID NO: 3824260 - RNA, 14 nt, Shigella flexneri 2a str. 2457T
ucauuaccagcgag

SEQ ID NO: 3824261 - RNA, 12 nt, Shigella flexneri 2a str. 2457T
ucauuaccuuca

SEQ ID NO: 3824262 - RNA, 19 nt, Shigella flexneri 2a str. 2457T
ucauuacgaaguuuaauuc

SEQ ID NO: 3824263 - RNA, 15 nt, Shigella flexneri 2a str. 2457T
ucauuacgccaguca

SEQ ID NO: 3824264 - RNA, 12 nt, Shigella flexneri 2a str. 2457T
ucauuagcccaa

SEQ ID NO: 3824265 - RNA, 21 nt, Shigella flexneri 2a str. 2457T
ucauuagcccaauaaucaccg

SEQ ID NO: 3824266 - RNA, 18 nt, Shigella flexneri 2a str. 2457T
ucauuagucacaaaucuc

SEQ ID NO: 3824267 - RNA, 16 nt, Shigella flexneri 2a str. 2457T
ucauuaugaucaaaau

SEQ ID NO: 3824268 - RNA, 21 nt, Shigella flexneri 2a str. 2457T
ucauuaugaucaaaaucauau

SEQ ID NO: 3824269 - RNA, 13 nt, Shigella flexneri 2a str. 2457T
ucauuaugcugga

SEQ ID NO: 3824270 - RNA, 13 nt, Shigella flexneri 2a str. 2457T
ucauuauuaauau

SEQ ID NO: 3824271 - RNA, 13 nt, Shigella flexneri 2a str. 2457T
ucauuauuaauuu

SEQ ID NO: 3824272 - RNA, 17 nt, Shigella flexneri 2a str. 2457T
ucauuauuuucagaagg

SEQ ID NO: 3824273 - RNA, 14 nt, Shigella flexneri 2a str. 2457T
ucauucgacaacug

SEQ ID NO: 3824274 - RNA, 21 nt, Shigella flexneri 2a str. 2457T
ucauucgacgcgcgcacacaa

SEQ ID NO: 3824275 - RNA, 15 nt, Shigella flexneri 2a str. 2457T
ucauucgccgguucc

SEQ ID NO: 3824276 - RNA, 19 nt, Shigella flexneri 2a str. 2457T
ucauucgccgguuccagcu

SEQ ID NO: 3824277 - RNA, 19 nt, Shigella flexneri 2a str. 2457T
ucauucgcgccagauggca

SEQ ID NO: 3824278 - RNA, 16 nt, Shigella flexneri 2a str. 2457T
ucauucgguuuucaau

SEQ ID NO: 3824279 - RNA, 19 nt, Shigella flexneri 2a str. 2457T
ucauucgucuccuggccgu

SEQ ID NO: 3824280 - RNA, 17 nt, Shigella flexneri 2a str. 2457T
uccagcacggugaagaa

SEQ ID NO: 3824281 - RNA, 18 nt, Shigella flexneri 2a str. 2457T
uccagcacgucgagcagg

SEQ ID NO: 3824282 - RNA, 20 nt, Shigella flexneri 2a str. 2457T
uccagcagaccuucugccag

SEQ ID NO: 3824283 - RNA, 17 nt, Shigella flexneri 2a str. 2457T
uccagcagcgcaauuaa

SEQ ID NO: 3824284 - RNA, 15 nt, Shigella flexneri 2a str. 2457T
uccagcagugccgca

SEQ ID NO: 3824285 - RNA, 15 nt, Shigella flexneri 2a str. 2457T
uccagcauaaugacu

SEQ ID NO: 3824286 - RNA, 17 nt, Shigella flexneri 2a str. 2457T
uccagcauaaugacucu

SEQ ID NO: 3824287 - RNA, 15 nt, Shigella flexneri 2a str. 2457T
uccagcauaccuucc

SEQ ID NO: 3824288 - RNA, 17 nt, Shigella flexneri 2a str. 2457T
uccagcaucgaccagga

SEQ ID NO: 3824289 - RNA, 21 nt, Shigella flexneri 2a str. 2457T
uccagccaccgcguggcagac

SEQ ID NO: 3824290 - RNA, 21 nt, Shigella flexneri 2a str. 2457T
uccagccacggcuccagcaau

SEQ ID NO: 3824291 - RNA, 14 nt, Shigella flexneri 2a str. 2457T
uccagcgauaauga

SEQ ID NO: 3824292 - RNA, 21 nt, Shigella flexneri 2a str. 2457T
uccagcgauaccggugcaccu

SEQ ID NO: 3824293 - RNA, 17 nt, Shigella flexneri 2a str. 2457T
uccagcgauuccgggua

SEQ ID NO: 3824294 - RNA, 17 nt, Shigella flexneri 2a str. 2457T
uccagcgcaauaccgau

SEQ ID NO: 3824295 - RNA, 20 nt, Shigella flexneri 2a str. 2457T
uccagcgcaucccauuucuc

SEQ ID NO: 3824296 - RNA, 18 nt, Shigella flexneri 2a str. 2457T
uccagcgccaguaauucu

SEQ ID NO: 3824297 - RNA, 23 nt, Shigella flexneri 2a str. 2457T
uccagcgccauuggcuuuugcuu

SEQ ID NO: 3824298 - RNA, 13 nt, Shigella flexneri 2a str. 2457T
uccagcgccgcca

SEQ ID NO: 3824299 - RNA, 13 nt, Shigella flexneri 2a str. 2457T
uccagcgccugaa

SEQ ID NO: 3824300 - RNA, 14 nt, Shigella flexneri 2a str. 2457T
uccagcgcugcggc

SEQ ID NO: 3824301 - RNA, 23 nt, Shigella flexneri 2a str. 2457T
uccagcgguaacuuaucuguaau

SEQ ID NO: 3824302 - RNA, 16 nt, Shigella flexneri 2a str. 2457T
uccagcgguugggcau

SEQ ID NO: 3824303 - RNA, 23 nt, Shigella flexneri 2a str. 2457T
uccagcuauaacguugccggaua

SEQ ID NO: 3824304 - RNA, 19 nt, Shigella flexneri 2a str. 2457T
uccagcucaaccagauucg

SEQ ID NO: 3824305 - RNA, 15 nt, Shigella flexneri 2a str. 2457T
uccagcuccguccag

SEQ ID NO: 3824306 - RNA, 14 nt, Shigella flexneri 2a str. 2457T
uccagcucuucuuc

SEQ ID NO: 3824307 - RNA, 15 nt, Shigella flexneri 2a str. 2457T
uccagcucuucuuca

SEQ ID NO: 3824308 - RNA, 16 nt, Shigella flexneri 2a str. 2457T
uccagcucuucuucac

SEQ ID NO: 3824309 - RNA, 18 nt, Shigella flexneri 2a str. 2457T
uccagcucuuuuccagcc

SEQ ID NO: 3824310 - RNA, 19 nt, Shigella flexneri 2a str. 2457T
uccagcuuagcauccccau

SEQ ID NO: 3824311 - RNA, 19 nt, Shigella flexneri 2a str. 2457T
uccagcuucagauucagcg

SEQ ID NO: 3824312 - RNA, 17 nt, Shigella flexneri 2a str. 2457T
uccaggaaggccagcag

SEQ ID NO: 3824313 - RNA, 19 nt, Shigella flexneri 2a str. 2457T
uccaggagcguauucagca

SEQ ID NO: 3824314 - RNA, 13 nt, Shigella flexneri 2a str. 2457T
uccaggagcucca

SEQ ID NO: 3824315 - RNA, 20 nt, Shigella flexneri 2a str. 2457T
uccaggcugcaaagucuggg

SEQ ID NO: 3824316 - RNA, 13 nt, Shigella flexneri 2a str. 2457T
uccagggccucuc

SEQ ID NO: 3824317 - RNA, 23 nt, Shigella flexneri 2a str. 2457T
uccagggccucuccuuuaccacu

SEQ ID NO: 3824318 - RNA, 23 nt, Shigella flexneri 2a str. 2457T
uccagggcgaaaagcuucuuccu

SEQ ID NO: 3824319 - RNA, 22 nt, Shigella flexneri 2a str. 2457T
uccagggggaagcgcaccaauu

SEQ ID NO: 3824320 - RNA, 18 nt, Shigella flexneri 2a str. 2457T
uccaggguaaacaucggu

SEQ ID NO: 3824321 - RNA, 20 nt, Shigella flexneri 2a str. 2457T
uccaggucaaccuagccuuc

SEQ ID NO: 3824322 - RNA, 21 nt, Shigella flexneri 2a str. 2457T
uccagguccuccuguaccuuc

SEQ ID NO: 3824323 - RNA, 14 nt, Shigella flexneri 2a str. 2457T
uccagguuacgcac

SEQ ID NO: 3824324 - RNA, 16 nt, Shigella flexneri 2a str. 2457T
uccagguuucuuccag

SEQ ID NO: 3824325 - RNA, 12 nt, Shigella flexneri 2a str. 2457T
uccaguaagcug

SEQ ID NO: 3824326 - RNA, 21 nt, Shigella flexneri 2a str. 2457T
uccaguaaugcgcccaugccg

SEQ ID NO: 3824327 - RNA, 13 nt, Shigella flexneri 2a str. 2457T
uccaguacgccuu

SEQ ID NO: 3824328 - RNA, 17 nt, Shigella flexneri 2a str. 2457T
uccaguagauucaacau

SEQ ID NO: 3824329 - RNA, 20 nt, Shigella flexneri 2a str. 2457T
uccaguagauucaacauaau

SEQ ID NO: 3824330 - RNA, 22 nt, Shigella flexneri 2a str. 2457T
uccaguccaccugaccugcgac

SEQ ID NO: 3824331 - RNA, 16 nt, Shigella flexneri 2a str. 2457T
uccagucgagaaccug

SEQ ID NO: 3824332 - RNA, 12 nt, Shigella flexneri 2a str. 2457T
uccagucgcugc

SEQ ID NO: 3824333 - RNA, 19 nt, Shigella flexneri 2a str. 2457T
uccagucguuaugcacgcu

SEQ ID NO: 3824334 - RNA, 19 nt, Shigella flexneri 2a str. 2457T
uccagugccggaugauuca

SEQ ID NO: 3824335 - RNA, 20 nt, Shigella flexneri 2a str. 2457T
uccagugccggaugauucac

SEQ ID NO: 3824336 - RNA, 21 nt, Shigella flexneri 2a str. 2457T
uccagugcgcuuuauucagau

SEQ ID NO: 3824337 - RNA, 20 nt, Shigella flexneri 2a str. 2457T
uccaguuaucgcgauacacc

SEQ ID NO: 3824338 - RNA, 21 nt, Shigella flexneri 2a str. 2457T
uccaguuccuucaacccauca

SEQ ID NO: 3824339 - RNA, 18 nt, Shigella flexneri 2a str. 2457T
uccaguucgaucucuucg

SEQ ID NO: 3824340 - RNA, 13 nt, Shigella flexneri 2a str. 2457T
uccaguucugcuu

SEQ ID NO: 3824341 - RNA, 14 nt, Shigella flexneri 2a str. 2457T
uccaguugguugau

SEQ ID NO: 3824342 - RNA, 11 nt, Shigella flexneri 2a str. 2457T
uccaguuucac

SEQ ID NO: 3824343 - RNA, 14 nt, Shigella flexneri 2a str. 2457T
uccaguuucacaaa

SEQ ID NO: 3824344 - RNA, 17 nt, Shigella flexneri 2a str. 2457T
uccaguuucacuuucac

SEQ ID NO: 3824345 - RNA, 15 nt, Shigella flexneri 2a str. 2457T
uccaguuuucaaaua

SEQ ID NO: 3824346 - RNA, 21 nt, Shigella flexneri 2a str. 2457T
uccaguuuucaaauaucuauu

SEQ ID NO: 3824347 - RNA, 22 nt, Shigella flexneri 2a str. 2457T
uccaguuuucuuugccacuccu

SEQ ID NO: 3824348 - RNA, 14 nt, Shigella flexneri 2a str. 2457T
uccauaaaacaucc

SEQ ID NO: 3824349 - RNA, 15 nt, Shigella flexneri 2a str. 2457T
uccauaagauugcau

SEQ ID NO: 3824350 - RNA, 18 nt, Shigella flexneri 2a str. 2457T
uccauaagcccagaacaa

SEQ ID NO: 3824351 - RNA, 15 nt, Shigella flexneri 2a str. 2457T
uccauacaucuucau

SEQ ID NO: 3824352 - RNA, 21 nt, Shigella flexneri 2a str. 2457T
uccauaccacgaccucaaagg

SEQ ID NO: 3824353 - RNA, 18 nt, Shigella flexneri 2a str. 2457T
uccauacccagcaucagu

SEQ ID NO: 3824354 - RNA, 16 nt, Shigella flexneri 2a str. 2457T
uccauaccuaaaaaau

SEQ ID NO: 3824355 - RNA, 16 nt, Shigella flexneri 2a str. 2457T
uccauagcgauguauu

SEQ ID NO: 3824356 - RNA, 20 nt, Shigella flexneri 2a str. 2457T
uccauagucacuaccuguuu

SEQ ID NO: 3824357 - RNA, 23 nt, Shigella flexneri 2a str. 2457T
uccauaguguguuccucugcucc

SEQ ID NO: 3824358 - RNA, 18 nt, Shigella flexneri 2a str. 2457T
uccauauggcugcauuca

SEQ ID NO: 3824359 - RNA, 16 nt, Shigella flexneri 2a str. 2457T
uccauauugucuucaa

SEQ ID NO: 3824360 - RNA, 21 nt, Shigella flexneri 2a str. 2457T
uccaucaaagguuuuucagua

SEQ ID NO: 3824361 - RNA, 16 nt, Shigella flexneri 2a str. 2457T
uccaucaagauuagcg

SEQ ID NO: 3824362 - RNA, 18 nt, Shigella flexneri 2a str. 2457T
uccaucacgcugaauuua

SEQ ID NO: 3824363 - RNA, 14 nt, Shigella flexneri 2a str. 2457T
uccaucacuucauc

SEQ ID NO: 3824364 - RNA, 19 nt, Shigella flexneri 2a str. 2457T
uccaucagauucagcagcg

SEQ ID NO: 3824365 - RNA, 16 nt, Shigella flexneri 2a str. 2457T
uccaucauaugcgcca

SEQ ID NO: 3824366 - RNA, 22 nt, Shigella flexneri 2a str. 2457T
uccauccggcuggucagcaacu

SEQ ID NO: 3824367 - RNA, 18 nt, Shigella flexneri 2a str. 2457T
uccaucgaccaaccuugc

SEQ ID NO: 3824368 - RNA, 17 nt, Shigella flexneri 2a str. 2457T
uccaucggcauuaaucu

SEQ ID NO: 3824369 - RNA, 14 nt, Shigella flexneri 2a str. 2457T
uccaucgggcuauu

SEQ ID NO: 3824370 - RNA, 19 nt, Shigella flexneri 2a str. 2457T
uccaucgucuccagagcag

SEQ ID NO: 3824371 - RNA, 23 nt, Shigella flexneri 2a str. 2457T
uccaucucgccauccuuacgcag

SEQ ID NO: 3824372 - RNA, 18 nt, Shigella flexneri 2a str. 2457T
uccaucuuuaugaaauau

SEQ ID NO: 3824373 - RNA, 19 nt, Shigella flexneri 2a str. 2457T
uccaucuuuaugaaauauc

SEQ ID NO: 3824374 - RNA, 14 nt, Shigella flexneri 2a str. 2457T
uccaugaaaauaga

SEQ ID NO: 3824375 - RNA, 14 nt, Shigella flexneri 2a str. 2457T
uccaugccaucugc

SEQ ID NO: 3824376 - RNA, 22 nt, Shigella flexneri 2a str. 2457T
uccaugccgaguggcauuucgc

SEQ ID NO: 3824377 - RNA, 19 nt, Shigella flexneri 2a str. 2457T
ucccggugaagcgcccugc

SEQ ID NO: 3824378 - RNA, 14 nt, Shigella flexneri 2a str. 2457T
ucccgguuauuaaa

SEQ ID NO: 3824379 - RNA, 14 nt, Shigella flexneri 2a str. 2457T
ucccgugccagagc

SEQ ID NO: 3824380 - RNA, 13 nt, Shigella flexneri 2a str. 2457T
ucccuaaaauauu

SEQ ID NO: 3824381 - RNA, 14 nt, Shigella flexneri 2a str. 2457T
ucccuaaaauauug

SEQ ID NO: 3824382 - RNA, 23 nt, Shigella flexneri 2a str. 2457T
ucccucaacaacagucucugccg

SEQ ID NO: 3824383 - RNA, 18 nt, Shigella flexneri 2a str. 2457T
ucccucauacugguuucu

SEQ ID NO: 3824384 - RNA, 18 nt, Shigella flexneri 2a str. 2457T
ucccuccacuccgguguu

SEQ ID NO: 3824385 - RNA, 17 nt, Shigella flexneri 2a str. 2457T
ucccucccguuucccug

SEQ ID NO: 3824386 - RNA, 19 nt, Shigella flexneri 2a str. 2457T
ucccucccguuucccuguc

SEQ ID NO: 3824387 - RNA, 21 nt, Shigella flexneri 2a str. 2457T
ucccucgucgguggugguccc

SEQ ID NO: 3824388 - RNA, 14 nt, Shigella flexneri 2a str. 2457T
ucccucuacauuca

SEQ ID NO: 3824389 - RNA, 15 nt, Shigella flexneri 2a str. 2457T
ucccugaaggcugcc

SEQ ID NO: 3824390 - RNA, 22 nt, Shigella flexneri 2a str. 2457T
ucccugaauaacaccagccaga

SEQ ID NO: 3824391 - RNA, 15 nt, Shigella flexneri 2a str. 2457T
ucccugacaaaucau

SEQ ID NO: 3824392 - RNA, 22 nt, Shigella flexneri 2a str. 2457T
ucccugacaaaucaugcggaua

SEQ ID NO: 3824393 - RNA, 18 nt, Shigella flexneri 2a str. 2457T
ucccugacgauagauaga

SEQ ID NO: 3824394 - RNA, 13 nt, Shigella flexneri 2a str. 2457T
ucccugccagucc

SEQ ID NO: 3824395 - RNA, 15 nt, Shigella flexneri 2a str. 2457T
ucccugcgccagcgg

SEQ ID NO: 3824396 - RNA, 18 nt, Shigella flexneri 2a str. 2457T
ucccugcgccagcggcag

SEQ ID NO: 3824397 - RNA, 19 nt, Shigella flexneri 2a str. 2457T
ucccugcgccagcggcagu

SEQ ID NO: 3824398 - RNA, 19 nt, Shigella flexneri 2a str. 2457T
ucccugcugaauccccuuc

SEQ ID NO: 3824399 - RNA, 17 nt, Shigella flexneri 2a str. 2457T
ucccugcuucggucaga

SEQ ID NO: 3824400 - RNA, 18 nt, Shigella flexneri 2a str. 2457T
ucccuggcccaucgccag

SEQ ID NO: 3824401 - RNA, 15 nt, Shigella flexneri 2a str. 2457T
ucccuggcgcuauca

SEQ ID NO: 3824402 - RNA, 19 nt, Shigella flexneri 2a str. 2457T
ucccugguaaaaaaugauu

SEQ ID NO: 3824403 - RNA, 14 nt, Shigella flexneri 2a str. 2457T
ucccugucucucag

SEQ ID NO: 3824404 - RNA, 15 nt, Shigella flexneri 2a str. 2457T
ucccuuacccuuacu

SEQ ID NO: 3824405 - RNA, 18 nt, Shigella flexneri 2a str. 2457T
ucccuucagccaccaggu

SEQ ID NO: 3824406 - RNA, 13 nt, Shigella flexneri 2a str. 2457T
ucccuucccagcc

SEQ ID NO: 3824407 - RNA, 15 nt, Shigella flexneri 2a str. 2457T
ucccuuucucuucaa

SEQ ID NO: 3824408 - RNA, 20 nt, Shigella flexneri 2a str. 2457T
uccgaagccggacugggcgc

SEQ ID NO: 3824409 - RNA, 22 nt, Shigella flexneri 2a str. 2457T
uccgacaaauguguucagcgau

SEQ ID NO: 3824410 - RNA, 13 nt, Shigella flexneri 2a str. 2457T
uccgacagagaaa

SEQ ID NO: 3824411 - RNA, 18 nt, Shigella flexneri 2a str. 2457T
uccgacaucccgccagcc

SEQ ID NO: 3824412 - RNA, 18 nt, Shigella flexneri 2a str. 2457T
uccgacauuucugcugcc

SEQ ID NO: 3824413 - RNA, 22 nt, Shigella flexneri 2a str. 2457T
uccgaccaggcguucugccugg

SEQ ID NO: 3824414 - RNA, 23 nt, Shigella flexneri 2a str. 2457T
uccgagaaucguacucaccagac

SEQ ID NO: 3824415 - RNA, 19 nt, Shigella flexneri 2a str. 2457T
uccgagaauggacaccagc

SEQ ID NO: 3824416 - RNA, 14 nt, Shigella flexneri 2a str. 2457T
uccgagccgcuacg

SEQ ID NO: 3824417 - RNA, 22 nt, Shigella flexneri 2a str. 2457T
uccgaggcguuuucuaacagcg

SEQ ID NO: 3824418 - RNA, 18 nt, Shigella flexneri 2a str. 2457T
uccgaguggcugaaggag

SEQ ID NO: 3824419 - RNA, 15 nt, Shigella flexneri 2a str. 2457T
uccgauauucaauug

SEQ ID NO: 3824420 - RNA, 13 nt, Shigella flexneri 2a str. 2457T
uccgaucccugcg

SEQ ID NO: 3824421 - RNA, 13 nt, Shigella flexneri 2a str. 2457T
uccgauccucacu

SEQ ID NO: 3824422 - RNA, 15 nt, Shigella flexneri 2a str. 2457T
uccgaucgcgcauca

SEQ ID NO: 3824423 - RNA, 18 nt, Shigella flexneri 2a str. 2457T
uccgaucgcgcaucagca

SEQ ID NO: 3824424 - RNA, 16 nt, Shigella flexneri 2a str. 2457T
uccgauuaccggcaac

SEQ ID NO: 3824425 - RNA, 15 nt, Shigella flexneri 2a str. 2457T
uccgauucccgcaac

SEQ ID NO: 3824426 - RNA, 13 nt, Shigella flexneri 2a str. 2457T
uccgcaaagccca

SEQ ID NO: 3824427 - RNA, 20 nt, Shigella flexneri 2a str. 2457T
uccgcaauacaucaaagcgu

SEQ ID NO: 3824428 - RNA, 12 nt, Shigella flexneri 2a str. 2457T
uccgcaaucaaa

SEQ ID NO: 3824429 - RNA, 23 nt, Shigella flexneri 2a str. 2457T
uccgcaaucaaaugacugguuuu

SEQ ID NO: 3824430 - RNA, 21 nt, Shigella flexneri 2a str. 2457T
uccgcaaugcggagguuucuu

SEQ ID NO: 3824431 - RNA, 13 nt, Shigella flexneri 2a str. 2457T
uccgcaaugugua

SEQ ID NO: 3824432 - RNA, 21 nt, Shigella flexneri 2a str. 2457T
uccgcacgaggaagauuacgc

SEQ ID NO: 3824433 - RNA, 18 nt, Shigella flexneri 2a str. 2457T
uccgcacguuagaaacaa

SEQ ID NO: 3824434 - RNA, 16 nt, Shigella flexneri 2a str. 2457T
uccgcagacacuuucc

SEQ ID NO: 3824435 - RNA, 23 nt, Shigella flexneri 2a str. 2457T
uccgcaggugacgcgggcagcag

SEQ ID NO: 3824436 - RNA, 14 nt, Shigella flexneri 2a str. 2457T
uccgccaauuucau

SEQ ID NO: 3824437 - RNA, 15 nt, Shigella flexneri 2a str. 2457T
uccgccagaccaauc

SEQ ID NO: 3824438 - RNA, 17 nt, Shigella flexneri 2a str. 2457T
uccgccagccuacagaa

SEQ ID NO: 3824439 - RNA, 11 nt, Shigella flexneri 2a str. 2457T
uccgccagcga

SEQ ID NO: 3824440 - RNA, 13 nt, Shigella flexneri 2a str. 2457T
uccgccagcggcg

SEQ ID NO: 3824441 - RNA, 18 nt, Shigella flexneri 2a str. 2457T
uccgccagcggcggcaaa

SEQ ID NO: 3824442 - RNA, 22 nt, Shigella flexneri 2a str. 2457T
uccgccaguucuuccaguuccg

SEQ ID NO: 3824443 - RNA, 16 nt, Shigella flexneri 2a str. 2457T
uccgccaguuuguagc

SEQ ID NO: 3824444 - RNA, 21 nt, Shigella flexneri 2a str. 2457T
uccgccauuuuaaucaucuga

SEQ ID NO: 3824445 - RNA, 18 nt, Shigella flexneri 2a str. 2457T
uccgcccggcaauauucu

SEQ ID NO: 3824446 - RNA, 13 nt, Shigella flexneri 2a str. 2457T
uccgccgcgcggu

SEQ ID NO: 3824447 - RNA, 19 nt, Shigella flexneri 2a str. 2457T
uccgccgcuguggcaggua

SEQ ID NO: 3824448 - RNA, 14 nt, Shigella flexneri 2a str. 2457T
uccgccggaucgaa

SEQ ID NO: 3824449 - RNA, 17 nt, Shigella flexneri 2a str. 2457T
uccgcgaacagcagcgg

SEQ ID NO: 3824450 - RNA, 14 nt, Shigella flexneri 2a str. 2457T
uccgcgaaggcggc

SEQ ID NO: 3824451 - RNA, 20 nt, Shigella flexneri 2a str. 2457T
uccgcgaauuaugcagccuu

SEQ ID NO: 3824452 - RNA, 15 nt, Shigella flexneri 2a str. 2457T
uccgcgccgcgguac

SEQ ID NO: 3824453 - RNA, 20 nt, Shigella flexneri 2a str. 2457T
uccgcgucaaucugcccgac

SEQ ID NO: 3824454 - RNA, 17 nt, Shigella flexneri 2a str. 2457T
uccgcgucuuaucaggc

SEQ ID NO: 3824455 - RNA, 15 nt, Shigella flexneri 2a str. 2457T
uccgcgugacgcugg

SEQ ID NO: 3824456 - RNA, 23 nt, Shigella flexneri 2a str. 2457T
uccgcgugacgcuggcagaaagu

SEQ ID NO: 3824457 - RNA, 17 nt, Shigella flexneri 2a str. 2457T
uccgcuaucaguucaga

SEQ ID NO: 3824458 - RNA, 18 nt, Shigella flexneri 2a str. 2457T
uccgcucgccgcagagau

SEQ ID NO: 3824459 - RNA, 13 nt, Shigella flexneri 2a str. 2457T
uccgcucuuucac

SEQ ID NO: 3824460 - RNA, 16 nt, Shigella flexneri 2a str. 2457T
uccgcugacagcgcgu

SEQ ID NO: 3824461 - RNA, 19 nt, Shigella flexneri 2a str. 2457T
uccgcuuucgguuuuucua

SEQ ID NO: 3824462 - RNA, 16 nt, Shigella flexneri 2a str. 2457T
uccggacguucagcca

SEQ ID NO: 3824463 - RNA, 16 nt, Shigella flexneri 2a str. 2457T
uccggaucgccaaagc

SEQ ID NO: 3824464 - RNA, 22 nt, Shigella flexneri 2a str. 2457T
uccggaucgccaaagcggcagu

SEQ ID NO: 3824465 - RNA, 14 nt, Shigella flexneri 2a str. 2457T
uccggcaaaaaagc

SEQ ID NO: 3824466 - RNA, 14 nt, Shigella flexneri 2a str. 2457T
uccggcaaaaacaa

SEQ ID NO: 3824467 - RNA, 15 nt, Shigella flexneri 2a str. 2457T
uccggcaaccaccgu

SEQ ID NO: 3824468 - RNA, 13 nt, Shigella flexneri 2a str. 2457T
uccggcaaggcgc

SEQ ID NO: 3824469 - RNA, 21 nt, Shigella flexneri 2a str. 2457T
uccggcaauaagcaacgcgca

SEQ ID NO: 3824470 - RNA, 21 nt, Shigella flexneri 2a str. 2457T
uccggcaaucggugcaaaugc

SEQ ID NO: 3824471 - RNA, 12 nt, Shigella flexneri 2a str. 2457T
uccggcaauucu

SEQ ID NO: 3824472 - RNA, 22 nt, Shigella flexneri 2a str. 2457T
uccggcaauugugauggucaga

SEQ ID NO: 3824473 - RNA, 12 nt, Shigella flexneri 2a str. 2457T
uccggcaccauu

SEQ ID NO: 3824474 - RNA, 20 nt, Shigella flexneri 2a str. 2457T
uccggcaccuuuucaucagg

SEQ ID NO: 3824475 - RNA, 14 nt, Shigella flexneri 2a str. 2457T
uccugccacuguuc

SEQ ID NO: 3824476 - RNA, 19 nt, Shigella flexneri 2a str. 2457T
uccugccaguuauagcgca

SEQ ID NO: 3824477 - RNA, 16 nt, Shigella flexneri 2a str. 2457T
uccugccaguuuuucc

SEQ ID NO: 3824478 - RNA, 14 nt, Shigella flexneri 2a str. 2457T
uccugccaugcgca

SEQ ID NO: 3824479 - RNA, 18 nt, Shigella flexneri 2a str. 2457T
uccugccgaucaacugcg

SEQ ID NO: 3824480 - RNA, 16 nt, Shigella flexneri 2a str. 2457T
uccugccgcaguuucu

SEQ ID NO: 3824481 - RNA, 21 nt, Shigella flexneri 2a str. 2457T
uccugccggacguguuuucac

SEQ ID NO: 3824482 - RNA, 13 nt, Shigella flexneri 2a str. 2457T
uccugcgccagcc

SEQ ID NO: 3824483 - RNA, 15 nt, Shigella flexneri 2a str. 2457T
uccugcgcugcguag

SEQ ID NO: 3824484 - RNA, 17 nt, Shigella flexneri 2a str. 2457T
uccugcgcugcguagcc

SEQ ID NO: 3824485 - RNA, 16 nt, Shigella flexneri 2a str. 2457T
uccugcggaugcgcca

SEQ ID NO: 3824486 - RNA, 17 nt, Shigella flexneri 2a str. 2457T
uccugcggcgacaaaug

SEQ ID NO: 3824487 - RNA, 23 nt, Shigella flexneri 2a str. 2457T
uccugcgggagcgcuuuuuuccu

SEQ ID NO: 3824488 - RNA, 19 nt, Shigella flexneri 2a str. 2457T
uccugcgugacuaaaaccc

SEQ ID NO: 3824489 - RNA, 18 nt, Shigella flexneri 2a str. 2457T
uccugcucaaguaauaaa

SEQ ID NO: 3824490 - RNA, 22 nt, Shigella flexneri 2a str. 2457T
uccugcucaaugucugucauau

SEQ ID NO: 3824491 - RNA, 13 nt, Shigella flexneri 2a str. 2457T
uccugcuccuguc

SEQ ID NO: 3824492 - RNA, 17 nt, Shigella flexneri 2a str. 2457T
uccugcugaacgugauu

SEQ ID NO: 3824493 - RNA, 22 nt, Shigella flexneri 2a str. 2457T
uccugcugcacgcccugauaaa

SEQ ID NO: 3824494 - RNA, 18 nt, Shigella flexneri 2a str. 2457T
uccugcuuacgguuacgc

SEQ ID NO: 3824495 - RNA, 19 nt, Shigella flexneri 2a str. 2457T
uccuggauuuccucggcug

SEQ ID NO: 3824496 - RNA, 22 nt, Shigella flexneri 2a str. 2457T
uccuggcaacggacgaccgauu

SEQ ID NO: 3824497 - RNA, 21 nt, Shigella flexneri 2a str. 2457T
uccuggccgcaguacugggcc

SEQ ID NO: 3824498 - RNA, 21 nt, Shigella flexneri 2a str. 2457T
uccuggccguuguugaacggc

SEQ ID NO: 3824499 - RNA, 16 nt, Shigella flexneri 2a str. 2457T
uccuggcgaaaacgcc

SEQ ID NO: 3824500 - RNA, 18 nt, Shigella flexneri 2a str. 2457T
uccuggcgaucgggcauu

SEQ ID NO: 3824501 - RNA, 13 nt, Shigella flexneri 2a str. 2457T
uccuggcgcuggc

SEQ ID NO: 3824502 - RNA, 21 nt, Shigella flexneri 2a str. 2457T
uccuggcgggaauaaaagcca

SEQ ID NO: 3824503 - RNA, 18 nt, Shigella flexneri 2a str. 2457T
uccuggcuugccagccau

SEQ ID NO: 3824504 - RNA, 16 nt, Shigella flexneri 2a str. 2457T
uccuggcuuggcuggc

SEQ ID NO: 3824505 - RNA, 23 nt, Shigella flexneri 2a str. 2457T
uccuggcuuggcuggcgugagcc

SEQ ID NO: 3824506 - RNA, 18 nt, Shigella flexneri 2a str. 2457T
uccuggucggcaaacugc

SEQ ID NO: 3824507 - RNA, 20 nt, Shigella flexneri 2a str. 2457T
uccuggucugaugaaugguu

SEQ ID NO: 3824508 - RNA, 17 nt, Shigella flexneri 2a str. 2457T
uccugguuucuggucau

SEQ ID NO: 3824509 - RNA, 13 nt, Shigella flexneri 2a str. 2457T
uccuguagcguua

SEQ ID NO: 3824510 - RNA, 20 nt, Shigella flexneri 2a str. 2457T
uccuguaucgucacugguuc

SEQ ID NO: 3824511 - RNA, 18 nt, Shigella flexneri 2a str. 2457T
uccuguauuguuccacuc

SEQ ID NO: 3824512 - RNA, 14 nt, Shigella flexneri 2a str. 2457T
uccugucuucccug

SEQ ID NO: 3824513 - RNA, 16 nt, Shigella flexneri 2a str. 2457T
uccugucuucccugcu

SEQ ID NO: 3824514 - RNA, 20 nt, Shigella flexneri 2a str. 2457T
uccuguggacgcagcucaua

SEQ ID NO: 3824515 - RNA, 17 nt, Shigella flexneri 2a str. 2457T
uccuguuccauggugua

SEQ ID NO: 3824516 - RNA, 15 nt, Shigella flexneri 2a str. 2457T
uccuguugaaaaacc

SEQ ID NO: 3824517 - RNA, 18 nt, Shigella flexneri 2a str. 2457T
uccuguugaaaaaccaga

SEQ ID NO: 3824518 - RNA, 17 nt, Shigella flexneri 2a str. 2457T
uccuguugcguuaagcc

SEQ ID NO: 3824519 - RNA, 18 nt, Shigella flexneri 2a str. 2457T
uccuguuuuuaagugaug

SEQ ID NO: 3824520 - RNA, 14 nt, Shigella flexneri 2a str. 2457T
uccuuaauaaaaau

SEQ ID NO: 3824521 - RNA, 15 nt, Shigella flexneri 2a str. 2457T
uccuuaauaaaaauu

SEQ ID NO: 3824522 - RNA, 23 nt, Shigella flexneri 2a str. 2457T
uccuuagcaacaggccaguucga

SEQ ID NO: 3824523 - RNA, 16 nt, Shigella flexneri 2a str. 2457T
uccuucacacugccuc

SEQ ID NO: 3824524 - RNA, 19 nt, Shigella flexneri 2a str. 2457T
uccuucacuuuugccagac

SEQ ID NO: 3824525 - RNA, 18 nt, Shigella flexneri 2a str. 2457T
uccuucaggaucaaccgc

SEQ ID NO: 3824526 - RNA, 12 nt, Shigella flexneri 2a str. 2457T
uccuuccagcuc

SEQ ID NO: 3824527 - RNA, 17 nt, Shigella flexneri 2a str. 2457T
uccuucggauuuccguu

SEQ ID NO: 3824528 - RNA, 16 nt, Shigella flexneri 2a str. 2457T
uccuucgggaagccuu

SEQ ID NO: 3824529 - RNA, 17 nt, Shigella flexneri 2a str. 2457T
uccuucuguucuuauaa

SEQ ID NO: 3824530 - RNA, 23 nt, Shigella flexneri 2a str. 2457T
uccuucuuguucgaagaguucca

SEQ ID NO: 3824531 - RNA, 14 nt, Shigella flexneri 2a str. 2457T
uccuugaaaaagag

SEQ ID NO: 3824532 - RNA, 21 nt, Shigella flexneri 2a str. 2457T
uccuugcgcuuucuuaaauua

SEQ ID NO: 3824533 - RNA, 18 nt, Shigella flexneri 2a str. 2457T
uccuugcguacaccaaca

SEQ ID NO: 3824534 - RNA, 17 nt, Shigella flexneri 2a str. 2457T
uccuuggauauuuuaau

SEQ ID NO: 3824535 - RNA, 18 nt, Shigella flexneri 2a str. 2457T
uccuuggauauuuuaauc

SEQ ID NO: 3824536 - RNA, 19 nt, Shigella flexneri 2a str. 2457T
uccuuggauauuuuaauca

SEQ ID NO: 3824537 - RNA, 18 nt, Shigella flexneri 2a str. 2457T
uccuuuacggugaacuca

SEQ ID NO: 3824538 - RNA, 17 nt, Shigella flexneri 2a str. 2457T
uccuuuccuuaagccag

SEQ ID NO: 3824539 - RNA, 23 nt, Shigella flexneri 2a str. 2457T
uccuuucgccgguagugucugga

SEQ ID NO: 3824540 - RNA, 12 nt, Shigella flexneri 2a str. 2457T
uccuuuguacca

SEQ ID NO: 3824541 - RNA, 14 nt, Shigella flexneri 2a str. 2457T
ucgaaaaucugccc

SEQ ID NO: 3824542 - RNA, 19 nt, Shigella flexneri 2a str. 2457T
ucgaaaauggccucggcua

SEQ ID NO: 3824543 - RNA, 16 nt, Shigella flexneri 2a str. 2457T
ucgaaagccacggaua

SEQ ID NO: 3824544 - RNA, 15 nt, Shigella flexneri 2a str. 2457T
ucgaaagccccagcc

SEQ ID NO: 3824545 - RNA, 22 nt, Shigella flexneri 2a str. 2457T
ucgaaauagagaaaguaaacca

SEQ ID NO: 3824546 - RNA, 21 nt, Shigella flexneri 2a str. 2457T
ucgaacauccccacagaaaca

SEQ ID NO: 3824547 - RNA, 14 nt, Shigella flexneri 2a str. 2457T
ucgaacaucugcgu

SEQ ID NO: 3824548 - RNA, 15 nt, Shigella flexneri 2a str. 2457T
ucgaacaugcggguc

SEQ ID NO: 3824549 - RNA, 19 nt, Shigella flexneri 2a str. 2457T
ucgaaccaaacagcgccag

SEQ ID NO: 3824550 - RNA, 22 nt, Shigella flexneri 2a str. 2457T
ucgaacggguuaaauccugucu

SEQ ID NO: 3824551 - RNA, 17 nt, Shigella flexneri 2a str. 2457T
ucgaacgguaacaggaa

SEQ ID NO: 3824552 - RNA, 17 nt, Shigella flexneri 2a str. 2457T
ucgaacucauacaccag

SEQ ID NO: 3824553 - RNA, 20 nt, Shigella flexneri 2a str. 2457T
ucgaagaaaacauggcgugg

SEQ ID NO: 3824554 - RNA, 14 nt, Shigella flexneri 2a str. 2457T
ucgaagaaaccgau

SEQ ID NO: 3824555 - RNA, 19 nt, Shigella flexneri 2a str. 2457T
ucgaagaacugcuggaagc

SEQ ID NO: 3824556 - RNA, 18 nt, Shigella flexneri 2a str. 2457T
ucgaagcgggcgcgcagg

SEQ ID NO: 3824557 - RNA, 14 nt, Shigella flexneri 2a str. 2457T
ucgaagcuucucau

SEQ ID NO: 3824558 - RNA, 17 nt, Shigella flexneri 2a str. 2457T
ucgaaguuuuccucagu

SEQ ID NO: 3824559 - RNA, 17 nt, Shigella flexneri 2a str. 2457T
ucgaauauaucagccug

SEQ ID NO: 3824560 - RNA, 15 nt, Shigella flexneri 2a str. 2457T
ucgaaugccgcagca

SEQ ID NO: 3824561 - RNA, 15 nt, Shigella flexneri 2a str. 2457T
ucgacaaaaacccug

SEQ ID NO: 3824562 - RNA, 17 nt, Shigella flexneri 2a str. 2457T
ucgacaaaaucggaaac

SEQ ID NO: 3824563 - RNA, 13 nt, Shigella flexneri 2a str. 2457T
ucgacaacugcug

SEQ ID NO: 3824564 - RNA, 12 nt, Shigella flexneri 2a str. 2457T
ucgacaccaucu

SEQ ID NO: 3824565 - RNA, 18 nt, Shigella flexneri 2a str. 2457T
ucgacagacgccagcgcu

SEQ ID NO: 3824566 - RNA, 21 nt, Shigella flexneri 2a str. 2457T
ucgacagacgccagcgcuuuu

SEQ ID NO: 3824567 - RNA, 12 nt, Shigella flexneri 2a str. 2457T
ucgacagcagcc

SEQ ID NO: 3824568 - RNA, 18 nt, Shigella flexneri 2a str. 2457T
ucgacagcgccuuuucuu

SEQ ID NO: 3824569 - RNA, 15 nt, Shigella flexneri 2a str. 2457T
ucgacaguugcugcg

SEQ ID NO: 3824570 - RNA, 18 nt, Shigella flexneri 2a str. 2457T
ucgacaguuucaccugcu

SEQ ID NO: 3824571 - RNA, 14 nt, Shigella flexneri 2a str. 2457T
ucgacaucugcaau

SEQ ID NO: 3824572 - RNA, 20 nt, Shigella flexneri 2a str. 2457T
ucgccaaguucgaacgccgc

SEQ ID NO: 3824573 - RNA, 14 nt, Shigella flexneri 2a str. 2457T
ucgccacaucaggu

SEQ ID NO: 3824574 - RNA, 20 nt, Shigella flexneri 2a str. 2457T
ucgccacggcaugaaagcga

SEQ ID NO: 3824575 - RNA, 22 nt, Shigella flexneri 2a str. 2457T
ucgccagauagauugcgcuggc

SEQ ID NO: 3824576 - RNA, 15 nt, Shigella flexneri 2a str. 2457T
ucgccagaucgguaa

SEQ ID NO: 3824577 - RNA, 14 nt, Shigella flexneri 2a str. 2457T
ucgccagcagccau

SEQ ID NO: 3824578 - RNA, 19 nt, Shigella flexneri 2a str. 2457T
ucgccagcccguagcuucc

SEQ ID NO: 3824579 - RNA, 23 nt, Shigella flexneri 2a str. 2457T
ucgccagcccguagcuucccaua

SEQ ID NO: 3824580 - RNA, 19 nt, Shigella flexneri 2a str. 2457T
ucgccagccucccagccau

SEQ ID NO: 3824581 - RNA, 12 nt, Shigella flexneri 2a str. 2457T
ucgccagcggca

SEQ ID NO: 3824582 - RNA, 15 nt, Shigella flexneri 2a str. 2457T
ucgccagcggcagcu

SEQ ID NO: 3824583 - RNA, 12 nt, Shigella flexneri 2a str. 2457T
ucgccagcucaa

SEQ ID NO: 3824584 - RNA, 20 nt, Shigella flexneri 2a str. 2457T
ucgccaggcguuugaaaaag

SEQ ID NO: 3824585 - RNA, 23 nt, Shigella flexneri 2a str. 2457T
ucgccaggcguuugaaaaagcca

SEQ ID NO: 3824586 - RNA, 17 nt, Shigella flexneri 2a str. 2457T
ucgccagguuaaacauc

SEQ ID NO: 3824587 - RNA, 21 nt, Shigella flexneri 2a str. 2457T
ucgccaguaaucggcugaacg

SEQ ID NO: 3824588 - RNA, 15 nt, Shigella flexneri 2a str. 2457T
ucgccagucccuuuc

SEQ ID NO: 3824589 - RNA, 20 nt, Shigella flexneri 2a str. 2457T
ucgccagugccgcccaccac

SEQ ID NO: 3824590 - RNA, 15 nt, Shigella flexneri 2a str. 2457T
ucgccaucaaaggcu

SEQ ID NO: 3824591 - RNA, 12 nt, Shigella flexneri 2a str. 2457T
ucgccaucaggc

SEQ ID NO: 3824592 - RNA, 18 nt, Shigella flexneri 2a str. 2457T
ucgccaucugccagaccc

SEQ ID NO: 3824593 - RNA, 18 nt, Shigella flexneri 2a str. 2457T
ucgccaucuuuacaccuu

SEQ ID NO: 3824594 - RNA, 21 nt, Shigella flexneri 2a str. 2457T
ucgccaugaagacauacccua

SEQ ID NO: 3824595 - RNA, 22 nt, Shigella flexneri 2a str. 2457T
ucgccauuccuggggucaucag

SEQ ID NO: 3824596 - RNA, 19 nt, Shigella flexneri 2a str. 2457T
ucgccauuuucugccgcau

SEQ ID NO: 3824597 - RNA, 18 nt, Shigella flexneri 2a str. 2457T
ucgccauuuugcgcggca

SEQ ID NO: 3824598 - RNA, 14 nt, Shigella flexneri 2a str. 2457T
ucgccauuuuucag

SEQ ID NO: 3824599 - RNA, 15 nt, Shigella flexneri 2a str. 2457T
ucgcccacaccagau

SEQ ID NO: 3824600 - RNA, 17 nt, Shigella flexneri 2a str. 2457T
ucgcccacgccagagau

SEQ ID NO: 3824601 - RNA, 13 nt, Shigella flexneri 2a str. 2457T
ucgcccagcagac

SEQ ID NO: 3824602 - RNA, 23 nt, Shigella flexneri 2a str. 2457T
ucgcccagcagacguaaaaauag

SEQ ID NO: 3824603 - RNA, 16 nt, Shigella flexneri 2a str. 2457T
ucgcccaggcgaccag

SEQ ID NO: 3824604 - RNA, 23 nt, Shigella flexneri 2a str. 2457T
ucgcccaguugaucaccagugcg

SEQ ID NO: 3824605 - RNA, 16 nt, Shigella flexneri 2a str. 2457T
ucgcccauuuuucaug

SEQ ID NO: 3824606 - RNA, 12 nt, Shigella flexneri 2a str. 2457T
ucgcccccucuu

SEQ ID NO: 3824607 - RNA, 16 nt, Shigella flexneri 2a str. 2457T
ucgccccgagaaaaau

SEQ ID NO: 3824608 - RNA, 20 nt, Shigella flexneri 2a str. 2457T
ucgccccgugaugaacugcg

SEQ ID NO: 3824609 - RNA, 17 nt, Shigella flexneri 2a str. 2457T
ucgccccucccccagca

SEQ ID NO: 3824610 - RNA, 17 nt, Shigella flexneri 2a str. 2457T
ucgccccugcccuuuca

SEQ ID NO: 3824611 - RNA, 22 nt, Shigella flexneri 2a str. 2457T
ucgcccgaccaucgccagcuca

SEQ ID NO: 3824612 - RNA, 15 nt, Shigella flexneri 2a str. 2457T
ucgcccgaggagggc

SEQ ID NO: 3824613 - RNA, 15 nt, Shigella flexneri 2a str. 2457T
ucgcccggauaucca

SEQ ID NO: 3824614 - RNA, 14 nt, Shigella flexneri 2a str. 2457T
ucgcccggauuaca

SEQ ID NO: 3824615 - RNA, 15 nt, Shigella flexneri 2a str. 2457T
ucgcccguucauccg

SEQ ID NO: 3824616 - RNA, 18 nt, Shigella flexneri 2a str. 2457T
ucgcccugccaaaucagu

SEQ ID NO: 3824617 - RNA, 16 nt, Shigella flexneri 2a str. 2457T
ucgcccuggaugcagu

SEQ ID NO: 3824618 - RNA, 16 nt, Shigella flexneri 2a str. 2457T
ucgcccuucaucuuug

SEQ ID NO: 3824619 - RNA, 21 nt, Shigella flexneri 2a str. 2457T
ucgccgaacacacauuuaucc

SEQ ID NO: 3824620 - RNA, 17 nt, Shigella flexneri 2a str. 2457T
ucgccgcacuuucuccu

SEQ ID NO: 3824621 - RNA, 23 nt, Shigella flexneri 2a str. 2457T
ucgccgcauaguaagccggauaa

SEQ ID NO: 3824622 - RNA, 13 nt, Shigella flexneri 2a str. 2457T
ucgccgcccagcc

SEQ ID NO: 3824623 - RNA, 13 nt, Shigella flexneri 2a str. 2457T
ucgccgccgcugg

SEQ ID NO: 3824624 - RNA, 20 nt, Shigella flexneri 2a str. 2457T
ucgccgcgacgcccccugcg

SEQ ID NO: 3824625 - RNA, 18 nt, Shigella flexneri 2a str. 2457T
ucgccgcugugauuucag

SEQ ID NO: 3824626 - RNA, 16 nt, Shigella flexneri 2a str. 2457T
ucgccggaauuucuuu

SEQ ID NO: 3824627 - RNA, 22 nt, Shigella flexneri 2a str. 2457T
ucgccggaauuucuuucagcag

SEQ ID NO: 3824628 - RNA, 17 nt, Shigella flexneri 2a str. 2457T
ucgccgggcuaaccgcu

SEQ ID NO: 3824629 - RNA, 22 nt, Shigella flexneri 2a str. 2457T
ucgccgguaguuucagcggcgu

SEQ ID NO: 3824630 - RNA, 15 nt, Shigella flexneri 2a str. 2457T
ucgccgguuccagcu

SEQ ID NO: 3824631 - RNA, 19 nt, Shigella flexneri 2a str. 2457T
ucgccguaagcaaacagcg

SEQ ID NO: 3824632 - RNA, 20 nt, Shigella flexneri 2a str. 2457T
ucgccgucaggcaagccgcu

SEQ ID NO: 3824633 - RNA, 15 nt, Shigella flexneri 2a str. 2457T
ucgccuccagcgcug

SEQ ID NO: 3824634 - RNA, 13 nt, Shigella flexneri 2a str. 2457T
ucgccuccuguuc

SEQ ID NO: 3824635 - RNA, 23 nt, Shigella flexneri 2a str. 2457T
ucgccugaaaguauuugacuguu

SEQ ID NO: 3824636 - RNA, 16 nt, Shigella flexneri 2a str. 2457T
ucgccugcaucaccau

SEQ ID NO: 3824637 - RNA, 17 nt, Shigella flexneri 2a str. 2457T
ucgccugcaucaccauc

SEQ ID NO: 3824638 - RNA, 18 nt, Shigella flexneri 2a str. 2457T
ucgccuggaccagcgggu

SEQ ID NO: 3824639 - RNA, 13 nt, Shigella flexneri 2a str. 2457T
ucgccuuaauaac

SEQ ID NO: 3824640 - RNA, 15 nt, Shigella flexneri 2a str. 2457T
ucgccuuccagcgau

SEQ ID NO: 3824641 - RNA, 20 nt, Shigella flexneri 2a str. 2457T
ucgccuuccggcaguuucau

SEQ ID NO: 3824642 - RNA, 19 nt, Shigella flexneri 2a str. 2457T
ucgccuuucggcugcagca

SEQ ID NO: 3824643 - RNA, 12 nt, Shigella flexneri 2a str. 2457T
ucgcgaaaugca

SEQ ID NO: 3824644 - RNA, 15 nt, Shigella flexneri 2a str. 2457T
ucgcgaaaugcagcg

SEQ ID NO: 3824645 - RNA, 22 nt, Shigella flexneri 2a str. 2457T
ucgcgaaccgccuggcgcugcu

SEQ ID NO: 3824646 - RNA, 23 nt, Shigella flexneri 2a str. 2457T
ucgcgaccgccucgcgccagcgu

SEQ ID NO: 3824647 - RNA, 18 nt, Shigella flexneri 2a str. 2457T
ucgcgacgaccacccacc

SEQ ID NO: 3824648 - RNA, 17 nt, Shigella flexneri 2a str. 2457T
ucgcgaggagaggccuu

SEQ ID NO: 3824649 - RNA, 21 nt, Shigella flexneri 2a str. 2457T
ucgcgauagccgcuuucuaac

SEQ ID NO: 3824650 - RNA, 15 nt, Shigella flexneri 2a str. 2457T
ucgcgauauugcugc

SEQ ID NO: 3824651 - RNA, 24 nt, Shigella flexneri 2a str. 2457T
ucgcgcaauugccagacaacauga

SEQ ID NO: 3824652 - RNA, 19 nt, Shigella flexneri 2a str. 2457T
ucgcgcacuaugugccagc

SEQ ID NO: 3824653 - RNA, 13 nt, Shigella flexneri 2a str. 2457T
ucgcgcagcacuu

SEQ ID NO: 3824654 - RNA, 15 nt, Shigella flexneri 2a str. 2457T
ucgcgccaaucagcg

SEQ ID NO: 3824655 - RNA, 17 nt, Shigella flexneri 2a str. 2457T
ucgcgccaucaaaucug

SEQ ID NO: 3824656 - RNA, 18 nt, Shigella flexneri 2a str. 2457T
ucgcgcccaaaccaccca

SEQ ID NO: 3824657 - RNA, 19 nt, Shigella flexneri 2a str. 2457T
ucgcgccgcauccggcauu

SEQ ID NO: 3824658 - RNA, 17 nt, Shigella flexneri 2a str. 2457T
ucgcgccuuacgcugcg

SEQ ID NO: 3824659 - RNA, 17 nt, Shigella flexneri 2a str. 2457T
ucgcgcguuaucccuua

SEQ ID NO: 3824660 - RNA, 15 nt, Shigella flexneri 2a str. 2457T
ucgcgcucaucagcg

SEQ ID NO: 3824661 - RNA, 20 nt, Shigella flexneri 2a str. 2457T
ucgcgcuuaucgccagcgcc

SEQ ID NO: 3824662 - RNA, 20 nt, Shigella flexneri 2a str. 2457T
ucgcggcaauuuuuaccggu

SEQ ID NO: 3824663 - RNA, 18 nt, Shigella flexneri 2a str. 2457T
ucgcggcgauauccagcg

SEQ ID NO: 3824664 - RNA, 17 nt, Shigella flexneri 2a str. 2457T
ucgcgguaaacugcaug

SEQ ID NO: 3824665 - RNA, 18 nt, Shigella flexneri 2a str. 2457T
ucgcgguaaacugcgucg

SEQ ID NO: 3824666 - RNA, 15 nt, Shigella flexneri 2a str. 2457T
ucgcggucaaccauc

SEQ ID NO: 3824667 - RNA, 23 nt, Shigella flexneri 2a str. 2457T
ucgcguaacugcugcucaaucug

SEQ ID NO: 3824668 - RNA, 17 nt, Shigella flexneri 2a str. 2457T
ucgcguaguaaagccuu

SEQ ID NO: 3824669 - RNA, 20 nt, Shigella flexneri 2a str. 2457T
ucggggcggcuaucccaaag

SEQ ID NO: 3824670 - RNA, 18 nt, Shigella flexneri 2a str. 2457T
ucggggcuaaugccaguc

SEQ ID NO: 3824671 - RNA, 18 nt, Shigella flexneri 2a str. 2457T
ucgggugcgacaggagcc

SEQ ID NO: 3824672 - RNA, 23 nt, Shigella flexneri 2a str. 2457T
ucggguuuacgugcacaggcaac

SEQ ID NO: 3824673 - RNA, 17 nt, Shigella flexneri 2a str. 2457T
ucgguacccagacgcag

SEQ ID NO: 3824674 - RNA, 16 nt, Shigella flexneri 2a str. 2457T
ucgguagcagcuuuca

SEQ ID NO: 3824675 - RNA, 14 nt, Shigella flexneri 2a str. 2457T
ucgguauuuccauu

SEQ ID NO: 3824676 - RNA, 17 nt, Shigella flexneri 2a str. 2457T
ucgguauuuccauuuuu

SEQ ID NO: 3824677 - RNA, 14 nt, Shigella flexneri 2a str. 2457T
ucggucaaguaauu

SEQ ID NO: 3824678 - RNA, 15 nt, Shigella flexneri 2a str. 2457T
ucggucagacccagu

SEQ ID NO: 3824679 - RNA, 15 nt, Shigella flexneri 2a str. 2457T
ucgguccaccacgua

SEQ ID NO: 3824680 - RNA, 16 nt, Shigella flexneri 2a str. 2457T
ucgguccgacgugcuc

SEQ ID NO: 3824681 - RNA, 19 nt, Shigella flexneri 2a str. 2457T
ucggucuuagcaaaggcuu

SEQ ID NO: 3824682 - RNA, 18 nt, Shigella flexneri 2a str. 2457T
ucggugaacgccugcgac

SEQ ID NO: 3824683 - RNA, 12 nt, Shigella flexneri 2a str. 2457T
ucggugauaacu

SEQ ID NO: 3824684 - RNA, 14 nt, Shigella flexneri 2a str. 2457T
ucggugaugaaccc

SEQ ID NO: 3824685 - RNA, 14 nt, Shigella flexneri 2a str. 2457T
ucggugcaaaugcc

SEQ ID NO: 3824686 - RNA, 15 nt, Shigella flexneri 2a str. 2457T
ucggugcaaaugcca

SEQ ID NO: 3824687 - RNA, 17 nt, Shigella flexneri 2a str. 2457T
ucggugcaaaugccaga

SEQ ID NO: 3824688 - RNA, 20 nt, Shigella flexneri 2a str. 2457T
ucggugcacaauugccggau

SEQ ID NO: 3824689 - RNA, 19 nt, Shigella flexneri 2a str. 2457T
ucggugcacuguaugaaac

SEQ ID NO: 3824690 - RNA, 20 nt, Shigella flexneri 2a str. 2457T
ucggugcgacaucaucagcg

SEQ ID NO: 3824691 - RNA, 15 nt, Shigella flexneri 2a str. 2457T
ucggugcgcugugug

SEQ ID NO: 3824692 - RNA, 18 nt, Shigella flexneri 2a str. 2457T
ucggugcucaucagcccg

SEQ ID NO: 3824693 - RNA, 14 nt, Shigella flexneri 2a str. 2457T
ucgguguccacuuc

SEQ ID NO: 3824694 - RNA, 19 nt, Shigella flexneri 2a str. 2457T
ucggugucguuacgccgca

SEQ ID NO: 3824695 - RNA, 20 nt, Shigella flexneri 2a str. 2457T
ucgguucaagauucaguuca

SEQ ID NO: 3824696 - RNA, 16 nt, Shigella flexneri 2a str. 2457T
ucgguucaauacccac

SEQ ID NO: 3824697 - RNA, 16 nt, Shigella flexneri 2a str. 2457T
ucgguugccauaaccu

SEQ ID NO: 3824698 - RNA, 14 nt, Shigella flexneri 2a str. 2457T
ucgguuucaucaca

SEQ ID NO: 3824699 - RNA, 18 nt, Shigella flexneri 2a str. 2457T
ucguaaaaacggauuuca

SEQ ID NO: 3824700 - RNA, 13 nt, Shigella flexneri 2a str. 2457T
ucguaagcaggag

SEQ ID NO: 3824701 - RNA, 18 nt, Shigella flexneri 2a str. 2457T
ucguaagcgccaggaauu

SEQ ID NO: 3824702 - RNA, 12 nt, Shigella flexneri 2a str. 2457T
ucguaaguaagc

SEQ ID NO: 3824703 - RNA, 15 nt, Shigella flexneri 2a str. 2457T
ucguaaugaauguuu

SEQ ID NO: 3824704 - RNA, 14 nt, Shigella flexneri 2a str. 2457T
ucguaauuuuucgg

SEQ ID NO: 3824705 - RNA, 21 nt, Shigella flexneri 2a str. 2457T
ucguaccguugcgcgucaacu

SEQ ID NO: 3824706 - RNA, 14 nt, Shigella flexneri 2a str. 2457T
ucguacgaaagugc

SEQ ID NO: 3824707 - RNA, 16 nt, Shigella flexneri 2a str. 2457T
ucguacucaccagaca

SEQ ID NO: 3824708 - RNA, 14 nt, Shigella flexneri 2a str. 2457T
ucguagccaccauc

SEQ ID NO: 3824709 - RNA, 16 nt, Shigella flexneri 2a str. 2457T
ucguagccaccaucuu

SEQ ID NO: 3824710 - RNA, 17 nt, Shigella flexneri 2a str. 2457T
ucguagcguuuuuucau

SEQ ID NO: 3824711 - RNA, 20 nt, Shigella flexneri 2a str. 2457T
ucguaggccagauaaggcgu

SEQ ID NO: 3824712 - RNA, 20 nt, Shigella flexneri 2a str. 2457T
ucguaggccggauaaggcgu

SEQ ID NO: 3824713 - RNA, 20 nt, Shigella flexneri 2a str. 2457T
ucguaggccugauaagacgc

SEQ ID NO: 3824714 - RNA, 15 nt, Shigella flexneri 2a str. 2457T
ucguagugaugccau

SEQ ID NO: 3824715 - RNA, 14 nt, Shigella flexneri 2a str. 2457T
ucguauagaucacu

SEQ ID NO: 3824716 - RNA, 15 nt, Shigella flexneri 2a str. 2457T
ucguauuuaaaaccc

SEQ ID NO: 3824717 - RNA, 13 nt, Shigella flexneri 2a str. 2457T
ucgucaaccugua

SEQ ID NO: 3824718 - RNA, 21 nt, Shigella flexneri 2a str. 2457T
ucgucacgcgcgccaagcccg

SEQ ID NO: 3824719 - RNA, 23 nt, Shigella flexneri 2a str. 2457T
ucgucaggaucagccauuuugca

SEQ ID NO: 3824720 - RNA, 14 nt, Shigella flexneri 2a str. 2457T
ucgucaguuuauac

SEQ ID NO: 3824721 - RNA, 16 nt, Shigella flexneri 2a str. 2457T
ucgucaucccagucuu

SEQ ID NO: 3824722 - RNA, 13 nt, Shigella flexneri 2a str. 2457T
ucgucauccgcca

SEQ ID NO: 3824723 - RNA, 15 nt, Shigella flexneri 2a str. 2457T
ucguccaugcugucg

SEQ ID NO: 3824724 - RNA, 16 nt, Shigella flexneri 2a str. 2457T
ucguccaugcugucgg

SEQ ID NO: 3824725 - RNA, 16 nt, Shigella flexneri 2a str. 2457T
ucgucccaaaagcucg

SEQ ID NO: 3824726 - RNA, 12 nt, Shigella flexneri 2a str. 2457T
ucgucccagucg

SEQ ID NO: 3824727 - RNA, 14 nt, Shigella flexneri 2a str. 2457T
ucguccuucacauu

SEQ ID NO: 3824728 - RNA, 15 nt, Shigella flexneri 2a str. 2457T
ucgucgcgcacgccc

SEQ ID NO: 3824729 - RNA, 18 nt, Shigella flexneri 2a str. 2457T
ucgucgguguccacuucc

SEQ ID NO: 3824730 - RNA, 16 nt, Shigella flexneri 2a str. 2457T
ucgucguacugaccgu

SEQ ID NO: 3824731 - RNA, 16 nt, Shigella flexneri 2a str. 2457T
ucgucguuuauauaga

SEQ ID NO: 3824732 - RNA, 17 nt, Shigella flexneri 2a str. 2457T
ucgucuggcgauuuuga

SEQ ID NO: 3824733 - RNA, 17 nt, Shigella flexneri 2a str. 2457T
ucgucuucgucccaguc

SEQ ID NO: 3824734 - RNA, 16 nt, Shigella flexneri 2a str. 2457T
ucgucuuuauccugac

SEQ ID NO: 3824735 - RNA, 22 nt, Shigella flexneri 2a str. 2457T
ucgugaacauguccuuucaggg

SEQ ID NO: 3824736 - RNA, 23 nt, Shigella flexneri 2a str. 2457T
ucgugaagagauggaucaacuug

SEQ ID NO: 3824737 - RNA, 22 nt, Shigella flexneri 2a str. 2457T
ucgugaagcuggcagaaguugu

SEQ ID NO: 3824738 - RNA, 22 nt, Shigella flexneri 2a str. 2457T
ucgugaauuuuaggaugcugca

SEQ ID NO: 3824739 - RNA, 13 nt, Shigella flexneri 2a str. 2457T
ucgugcaccaauu

SEQ ID NO: 3824740 - RNA, 10 nt, Shigella flexneri 2a str. 2457T
ucgugcagaa

SEQ ID NO: 3824741 - RNA, 18 nt, Shigella flexneri 2a str. 2457T
ucgugcggguaaccagcc

SEQ ID NO: 3824742 - RNA, 22 nt, Shigella flexneri 2a str. 2457T
ucgugcguuuguaggccggaua

SEQ ID NO: 3824743 - RNA, 14 nt, Shigella flexneri 2a str. 2457T
ucguggagaacaau

SEQ ID NO: 3824744 - RNA, 21 nt, Shigella flexneri 2a str. 2457T
ucguggcaaucguagcccagc

SEQ ID NO: 3824745 - RNA, 23 nt, Shigella flexneri 2a str. 2457T
ucguguugcaccgaguucuucac

SEQ ID NO: 3824746 - RNA, 16 nt, Shigella flexneri 2a str. 2457T
ucguuaaacucugccg

SEQ ID NO: 3824747 - RNA, 21 nt, Shigella flexneri 2a str. 2457T
ucguuaaacucugccgcaauc

SEQ ID NO: 3824748 - RNA, 16 nt, Shigella flexneri 2a str. 2457T
ucguuaaauucuaaug

SEQ ID NO: 3824749 - RNA, 19 nt, Shigella flexneri 2a str. 2457T
ucguuaacaacaacuucua

SEQ ID NO: 3824750 - RNA, 22 nt, Shigella flexneri 2a str. 2457T
ucguuacgccccgguuucucuu

SEQ ID NO: 3824751 - RNA, 22 nt, Shigella flexneri 2a str. 2457T
ucguucaaacgauucggcaauc

SEQ ID NO: 3824752 - RNA, 23 nt, Shigella flexneri 2a str. 2457T
ucguucacaugagagaaaaucac

SEQ ID NO: 3824753 - RNA, 13 nt, Shigella flexneri 2a str. 2457T
ucguucauauauu

SEQ ID NO: 3824754 - RNA, 15 nt, Shigella flexneri 2a str. 2457T
ucguuccugcaauuu

SEQ ID NO: 3824755 - RNA, 13 nt, Shigella flexneri 2a str. 2457T
ucguucgcugcau

SEQ ID NO: 3824756 - RNA, 12 nt, Shigella flexneri 2a str. 2457T
ucguucuucccu

SEQ ID NO: 3824757 - RNA, 22 nt, Shigella flexneri 2a str. 2457T
ucguugcgccgggaugauggcu

SEQ ID NO: 3824758 - RNA, 15 nt, Shigella flexneri 2a str. 2457T
ucguugcguugacca

SEQ ID NO: 3824759 - RNA, 21 nt, Shigella flexneri 2a str. 2457T
ucguugugggccgaaaugaga

SEQ ID NO: 3824760 - RNA, 21 nt, Shigella flexneri 2a str. 2457T
ucguuucaugccauccgcauc

SEQ ID NO: 3824761 - RNA, 17 nt, Shigella flexneri 2a str. 2457T
ucguuugcaggccugau

SEQ ID NO: 3824762 - RNA, 20 nt, Shigella flexneri 2a str. 2457T
ucuaaagcaacuccaucaag

SEQ ID NO: 3824763 - RNA, 17 nt, Shigella flexneri 2a str. 2457T
ucuaaaguauguaauaa

SEQ ID NO: 3824764 - RNA, 15 nt, Shigella flexneri 2a str. 2457T
ucuaaauguucaaua

SEQ ID NO: 3824765 - RNA, 19 nt, Shigella flexneri 2a str. 2457T
ucuaacagaucauccaucg

SEQ ID NO: 3824766 - RNA, 15 nt, Shigella flexneri 2a str. 2457T
ucuaacgaugccagc

SEQ ID NO: 3824767 - RNA, 21 nt, Shigella flexneri 2a str. 2457T
ucucgucgguaauuucacaag

SEQ ID NO: 3824768 - RNA, 13 nt, Shigella flexneri 2a str. 2457T
ucucgugccacca

SEQ ID NO: 3824769 - RNA, 20 nt, Shigella flexneri 2a str. 2457T
ucucgugccaccagugcagg

SEQ ID NO: 3824770 - RNA, 13 nt, Shigella flexneri 2a str. 2457T
ucucgugccgcca

SEQ ID NO: 3824771 - RNA, 17 nt, Shigella flexneri 2a str. 2457T
ucucguugaucacccac

SEQ ID NO: 3824772 - RNA, 14 nt, Shigella flexneri 2a str. 2457T
ucucuacaccauua

SEQ ID NO: 3824773 - RNA, 15 nt, Shigella flexneri 2a str. 2457T
ucucuauuucaccca

SEQ ID NO: 3824774 - RNA, 14 nt, Shigella flexneri 2a str. 2457T
ucucuccuuucggc

SEQ ID NO: 3824775 - RNA, 14 nt, Shigella flexneri 2a str. 2457T
ucucucuucagcuu

SEQ ID NO: 3824776 - RNA, 22 nt, Shigella flexneri 2a str. 2457T
ucucugaaguagccaguaccac

SEQ ID NO: 3824777 - RNA, 18 nt, Shigella flexneri 2a str. 2457T
ucucugcgcuauccagcg

SEQ ID NO: 3824778 - RNA, 15 nt, Shigella flexneri 2a str. 2457T
ucucugcuccugaug

SEQ ID NO: 3824779 - RNA, 12 nt, Shigella flexneri 2a str. 2457T
ucucuggaagag

SEQ ID NO: 3824780 - RNA, 22 nt, Shigella flexneri 2a str. 2457T
ucucuggccgcuuccagcauuu

SEQ ID NO: 3824781 - RNA, 18 nt, Shigella flexneri 2a str. 2457T
ucucuggcuguuucgcuu

SEQ ID NO: 3824782 - RNA, 21 nt, Shigella flexneri 2a str. 2457T
ucucuggcuguuucgcuucuu

SEQ ID NO: 3824783 - RNA, 21 nt, Shigella flexneri 2a str. 2457T
ucucuguuuccagauuuugcu

SEQ ID NO: 3824784 - RNA, 20 nt, Shigella flexneri 2a str. 2457T
ucucuucaacacggcgcauu

SEQ ID NO: 3824785 - RNA, 24 nt, Shigella flexneri 2a str. 2457T
ucucuucaacacggcgcauugcca

SEQ ID NO: 3824786 - RNA, 21 nt, Shigella flexneri 2a str. 2457T
ucucuucacgcuuugcaggcu

SEQ ID NO: 3824787 - RNA, 15 nt, Shigella flexneri 2a str. 2457T
ucucuuccggcuccc

SEQ ID NO: 3824788 - RNA, 17 nt, Shigella flexneri 2a str. 2457T
ucucuucgccugccugc

SEQ ID NO: 3824789 - RNA, 19 nt, Shigella flexneri 2a str. 2457T
ucucuucggcuucugccuu

SEQ ID NO: 3824790 - RNA, 13 nt, Shigella flexneri 2a str. 2457T
ucucuucuccuug

SEQ ID NO: 3824791 - RNA, 23 nt, Shigella flexneri 2a str. 2457T
ucucuugcuggcauuacaagaau

SEQ ID NO: 3824792 - RNA, 18 nt, Shigella flexneri 2a str. 2457T
ucucuuuaaaaaguaaaa

SEQ ID NO: 3824793 - RNA, 18 nt, Shigella flexneri 2a str. 2457T
ucucuuucggcagugcca

SEQ ID NO: 3824794 - RNA, 13 nt, Shigella flexneri 2a str. 2457T
ucugaaaaucaua

SEQ ID NO: 3824795 - RNA, 17 nt, Shigella flexneri 2a str. 2457T
ucugaaaucaucaauac

SEQ ID NO: 3824796 - RNA, 22 nt, Shigella flexneri 2a str. 2457T
ucugaaaucaucaauaccagcc

SEQ ID NO: 3824797 - RNA, 20 nt, Shigella flexneri 2a str. 2457T
ucugaaggauuagccggaua

SEQ ID NO: 3824798 - RNA, 19 nt, Shigella flexneri 2a str. 2457T
ucugaaguagccaguacca

SEQ ID NO: 3824799 - RNA, 17 nt, Shigella flexneri 2a str. 2457T
ucugaauaacacccaua

SEQ ID NO: 3824800 - RNA, 23 nt, Shigella flexneri 2a str. 2457T
ucugaauaucaucccccugcgau

SEQ ID NO: 3824801 - RNA, 18 nt, Shigella flexneri 2a str. 2457T
ucugaauggcugcauucc

SEQ ID NO: 3824802 - RNA, 20 nt, Shigella flexneri 2a str. 2457T
ucugaaugguggugugcuca

SEQ ID NO: 3824803 - RNA, 22 nt, Shigella flexneri 2a str. 2457T
ucugacaccaucacccaacaau

SEQ ID NO: 3824804 - RNA, 19 nt, Shigella flexneri 2a str. 2457T
ucugacauccgaccaaugc

SEQ ID NO: 3824805 - RNA, 15 nt, Shigella flexneri 2a str. 2457T
ucugaccggccagca

SEQ ID NO: 3824806 - RNA, 16 nt, Shigella flexneri 2a str. 2457T
ucugaccgucuuucau

SEQ ID NO: 3824807 - RNA, 14 nt, Shigella flexneri 2a str. 2457T
ucugacgaaaucaa

SEQ ID NO: 3824808 - RNA, 19 nt, Shigella flexneri 2a str. 2457T
ucugacgcgcauacucucc

SEQ ID NO: 3824809 - RNA, 18 nt, Shigella flexneri 2a str. 2457T
ucugacgcugaauacgca

SEQ ID NO: 3824810 - RNA, 16 nt, Shigella flexneri 2a str. 2457T
ucugagcaugaugccu

SEQ ID NO: 3824811 - RNA, 17 nt, Shigella flexneri 2a str. 2457T
ucugagcggccuuuucc

SEQ ID NO: 3824812 - RNA, 19 nt, Shigella flexneri 2a str. 2457T
ucugauacugcuccggcgc

SEQ ID NO: 3824813 - RNA, 17 nt, Shigella flexneri 2a str. 2457T
ucugaugauauuuuucc

SEQ ID NO: 3824814 - RNA, 21 nt, Shigella flexneri 2a str. 2457T
ucugaugauauuuuucccuga

SEQ ID NO: 3824815 - RNA, 22 nt, Shigella flexneri 2a str. 2457T
ucugauuacuuccuucaugggg

SEQ ID NO: 3824816 - RNA, 14 nt, Shigella flexneri 2a str. 2457T
ucugauugccuucc

SEQ ID NO: 3824817 - RNA, 20 nt, Shigella flexneri 2a str. 2457T
ucugauuuaaccaacaauaa

SEQ ID NO: 3824818 - RNA, 23 nt, Shigella flexneri 2a str. 2457T
ucugauuuaaccaacaauaaaau

SEQ ID NO: 3824819 - RNA, 22 nt, Shigella flexneri 2a str. 2457T
ucugcaaaauaccaauaaucaa

SEQ ID NO: 3824820 - RNA, 20 nt, Shigella flexneri 2a str. 2457T
ucugcaaaauagccaaucau

SEQ ID NO: 3824821 - RNA, 18 nt, Shigella flexneri 2a str. 2457T
ucugcaaauauuaauaau

SEQ ID NO: 3824822 - RNA, 17 nt, Shigella flexneri 2a str. 2457T
ucugcaagcaucauaaa

SEQ ID NO: 3824823 - RNA, 16 nt, Shigella flexneri 2a str. 2457T
ucugcaauuacugcau

SEQ ID NO: 3824824 - RNA, 15 nt, Shigella flexneri 2a str. 2457T
ucugcaauuuaccuu

SEQ ID NO: 3824825 - RNA, 17 nt, Shigella flexneri 2a str. 2457T
ucugcaauuuaccuuuc

SEQ ID NO: 3824826 - RNA, 18 nt, Shigella flexneri 2a str. 2457T
ucugcacaucuaaccauu

SEQ ID NO: 3824827 - RNA, 20 nt, Shigella flexneri 2a str. 2457T
ucugcacguuuugcugaugc

SEQ ID NO: 3824828 - RNA, 18 nt, Shigella flexneri 2a str. 2457T
ucugcagcgcggcgagag

SEQ ID NO: 3824829 - RNA, 12 nt, Shigella flexneri 2a str. 2457T
ucugcagcuuua

SEQ ID NO: 3824830 - RNA, 15 nt, Shigella flexneri 2a str. 2457T
ucugcaucgcgcuga

SEQ ID NO: 3824831 - RNA, 14 nt, Shigella flexneri 2a str. 2457T
ucugcaugacggcu

SEQ ID NO: 3824832 - RNA, 21 nt, Shigella flexneri 2a str. 2457T
ucugcauggucgauucuuaua

SEQ ID NO: 3824833 - RNA, 21 nt, Shigella flexneri 2a str. 2457T
ucugcauucaacuggauaaaa

SEQ ID NO: 3824834 - RNA, 14 nt, Shigella flexneri 2a str. 2457T
ucugcauuuucucg

SEQ ID NO: 3824835 - RNA, 12 nt, Shigella flexneri 2a str. 2457T
ucugccaaacgc

SEQ ID NO: 3824836 - RNA, 22 nt, Shigella flexneri 2a str. 2457T
ucugccaacuuugccgugaaca

SEQ ID NO: 3824837 - RNA, 21 nt, Shigella flexneri 2a str. 2457T
ucugccagacgguaaccccuc

SEQ ID NO: 3824838 - RNA, 22 nt, Shigella flexneri 2a str. 2457T
ucugcccaucauaccugagugg

SEQ ID NO: 3824839 - RNA, 14 nt, Shigella flexneri 2a str. 2457T
ucugcccaugcugg

SEQ ID NO: 3824840 - RNA, 15 nt, Shigella flexneri 2a str. 2457T
ucugcccgaccagau

SEQ ID NO: 3824841 - RNA, 12 nt, Shigella flexneri 2a str. 2457T
ucugccgcaauu

SEQ ID NO: 3824842 - RNA, 24 nt, Shigella flexneri 2a str. 2457T
ucugccgcauggaaccaguucacu

SEQ ID NO: 3824843 - RNA, 22 nt, Shigella flexneri 2a str. 2457T
ucugccggagggauguggccca

SEQ ID NO: 3824844 - RNA, 19 nt, Shigella flexneri 2a str. 2457T
ucugccguaccaucgccag

SEQ ID NO: 3824845 - RNA, 20 nt, Shigella flexneri 2a str. 2457T
ucugccguaccaucgccagc

SEQ ID NO: 3824846 - RNA, 14 nt, Shigella flexneri 2a str. 2457T
ucugccucugccag

SEQ ID NO: 3824847 - RNA, 21 nt, Shigella flexneri 2a str. 2457T
ucugccuguccaccacgcugc

SEQ ID NO: 3824848 - RNA, 17 nt, Shigella flexneri 2a str. 2457T
ucugccuguccggcaua

SEQ ID NO: 3824849 - RNA, 14 nt, Shigella flexneri 2a str. 2457T
ucugcgacuguucg

SEQ ID NO: 3824850 - RNA, 21 nt, Shigella flexneri 2a str. 2457T
ucugcgcauaacugccggaug

SEQ ID NO: 3824851 - RNA, 20 nt, Shigella flexneri 2a str. 2457T
ucugcgcauuucccagcaag

SEQ ID NO: 3824852 - RNA, 15 nt, Shigella flexneri 2a str. 2457T
ucugcgcccagcaac

SEQ ID NO: 3824853 - RNA, 14 nt, Shigella flexneri 2a str. 2457T
ucugcgccugcacg

SEQ ID NO: 3824854 - RNA, 23 nt, Shigella flexneri 2a str. 2457T
ucugcgcuauccagcgcauagcu

SEQ ID NO: 3824855 - RNA, 13 nt, Shigella flexneri 2a str. 2457T
ucugcgcuugguu

SEQ ID NO: 3824856 - RNA, 12 nt, Shigella flexneri 2a str. 2457T
ucugcgcuuugu

SEQ ID NO: 3824857 - RNA, 14 nt, Shigella flexneri 2a str. 2457T
ucugcggcaucaua

SEQ ID NO: 3824858 - RNA, 18 nt, Shigella flexneri 2a str. 2457T
ucugcggguuagucugca

SEQ ID NO: 3824859 - RNA, 20 nt, Shigella flexneri 2a str. 2457T
ucugcggguuagucugcauu

SEQ ID NO: 3824860 - RNA, 15 nt, Shigella flexneri 2a str. 2457T
ucugcguaauguuua

SEQ ID NO: 3824861 - RNA, 21 nt, Shigella flexneri 2a str. 2457T
ucugcgugaguuuuugucccc

SEQ ID NO: 3824862 - RNA, 22 nt, Shigella flexneri 2a str. 2457T
ucugcgugaucuaaaaucgcuu

SEQ ID NO: 3824863 - RNA, 19 nt, Shigella flexneri 2a str. 2457T
ucugcguuagaaaacgccu

SEQ ID NO: 3824864 - RNA, 16 nt, Shigella flexneri 2a str. 2457T
ucuuaucuaacaaccu

SEQ ID NO: 3824865 - RNA, 16 nt, Shigella flexneri 2a str. 2457T
ucuuaucuggccuacu

SEQ ID NO: 3824866 - RNA, 21 nt, Shigella flexneri 2a str. 2457T
ucuuaucuggccuacuuuaau

SEQ ID NO: 3824867 - RNA, 17 nt, Shigella flexneri 2a str. 2457T
ucuucaaaaaagucaga

SEQ ID NO: 3824868 - RNA, 15 nt, Shigella flexneri 2a str. 2457T
ucuucaaacggcaua

SEQ ID NO: 3824869 - RNA, 16 nt, Shigella flexneri 2a str. 2457T
ucuucaaacugaagau

SEQ ID NO: 3824870 - RNA, 18 nt, Shigella flexneri 2a str. 2457T
ucuucaacaauugaagaa

SEQ ID NO: 3824871 - RNA, 13 nt, Shigella flexneri 2a str. 2457T
ucuucaacacacu

SEQ ID NO: 3824872 - RNA, 16 nt, Shigella flexneri 2a str. 2457T
ucuucaacgaagaaaa

SEQ ID NO: 3824873 - RNA, 18 nt, Shigella flexneri 2a str. 2457T
ucuucaacuucagcagca

SEQ ID NO: 3824874 - RNA, 19 nt, Shigella flexneri 2a str. 2457T
ucuucaaggcagagucauu

SEQ ID NO: 3824875 - RNA, 22 nt, Shigella flexneri 2a str. 2457T
ucuucacaccaucaaagaagcu

SEQ ID NO: 3824876 - RNA, 15 nt, Shigella flexneri 2a str. 2457T
ucuucacgcccgccc

SEQ ID NO: 3824877 - RNA, 13 nt, Shigella flexneri 2a str. 2457T
ucuucacggaaaa

SEQ ID NO: 3824878 - RNA, 15 nt, Shigella flexneri 2a str. 2457T
ucuucacuucuucaa

SEQ ID NO: 3824879 - RNA, 14 nt, Shigella flexneri 2a str. 2457T
ucuucagcaguuca

SEQ ID NO: 3824880 - RNA, 14 nt, Shigella flexneri 2a str. 2457T
ucuucagccugcac

SEQ ID NO: 3824881 - RNA, 13 nt, Shigella flexneri 2a str. 2457T
ucuucaucaccga

SEQ ID NO: 3824882 - RNA, 13 nt, Shigella flexneri 2a str. 2457T
ucuucaucauccu

SEQ ID NO: 3824883 - RNA, 15 nt, Shigella flexneri 2a str. 2457T
ucuucaucauccucu

SEQ ID NO: 3824884 - RNA, 17 nt, Shigella flexneri 2a str. 2457T
ucuucaucauccucuuc

SEQ ID NO: 3824885 - RNA, 18 nt, Shigella flexneri 2a str. 2457T
ucuucaucgauacugcuc

SEQ ID NO: 3824886 - RNA, 20 nt, Shigella flexneri 2a str. 2457T
ucuucaugccucguuucccu

SEQ ID NO: 3824887 - RNA, 19 nt, Shigella flexneri 2a str. 2457T
ucuucauuaaaccagugcc

SEQ ID NO: 3824888 - RNA, 21 nt, Shigella flexneri 2a str. 2457T
ucuucauuaaauuuccgcgaa

SEQ ID NO: 3824889 - RNA, 13 nt, Shigella flexneri 2a str. 2457T
ucuucauuaccuu

SEQ ID NO: 3824890 - RNA, 22 nt, Shigella flexneri 2a str. 2457T
ucuucauuaugaauagcggaaa

SEQ ID NO: 3824891 - RNA, 14 nt, Shigella flexneri 2a str. 2457T
ucuuccacgccugc

SEQ ID NO: 3824892 - RNA, 16 nt, Shigella flexneri 2a str. 2457T
ucuuccagcaaaucca

SEQ ID NO: 3824893 - RNA, 23 nt, Shigella flexneri 2a str. 2457T
ucuuccagcgcaaggaaauaacg

SEQ ID NO: 3824894 - RNA, 22 nt, Shigella flexneri 2a str. 2457T
ucuuccagcguuucaaguguac

SEQ ID NO: 3824895 - RNA, 13 nt, Shigella flexneri 2a str. 2457T
ucuuccaguuccg

SEQ ID NO: 3824896 - RNA, 11 nt, Shigella flexneri 2a str. 2457T
ucuucccagcc

SEQ ID NO: 3824897 - RNA, 14 nt, Shigella flexneri 2a str. 2457T
ucuucccagccccc

SEQ ID NO: 3824898 - RNA, 20 nt, Shigella flexneri 2a str. 2457T
ucuuccccugcgauaacggu

SEQ ID NO: 3824899 - RNA, 20 nt, Shigella flexneri 2a str. 2457T
ucuucccgagacauuccuuu

SEQ ID NO: 3824900 - RNA, 15 nt, Shigella flexneri 2a str. 2457T
ucuucccgccuguca

SEQ ID NO: 3824901 - RNA, 13 nt, Shigella flexneri 2a str. 2457T
ucuucccuuucug

SEQ ID NO: 3824902 - RNA, 17 nt, Shigella flexneri 2a str. 2457T
ucuuccgcgccaaacau

SEQ ID NO: 3824903 - RNA, 11 nt, Shigella flexneri 2a str. 2457T
ucuuccggcag

SEQ ID NO: 3824904 - RNA, 17 nt, Shigella flexneri 2a str. 2457T
ucuuccggcgauucuuu

SEQ ID NO: 3824905 - RNA, 18 nt, Shigella flexneri 2a str. 2457T
ucuuccggcgauucuuug

SEQ ID NO: 3824906 - RNA, 21 nt, Shigella flexneri 2a str. 2457T
ucuuccggcgauucuuugcug

SEQ ID NO: 3824907 - RNA, 22 nt, Shigella flexneri 2a str. 2457T
ucuuccguagcggcucggaaua

SEQ ID NO: 3824908 - RNA, 18 nt, Shigella flexneri 2a str. 2457T
ucuuccuggcuuggcugg

SEQ ID NO: 3824909 - RNA, 16 nt, Shigella flexneri 2a str. 2457T
ucuuccuucagcuccc

SEQ ID NO: 3824910 - RNA, 20 nt, Shigella flexneri 2a str. 2457T
ucuucgacaaucgcaaauau

SEQ ID NO: 3824911 - RNA, 19 nt, Shigella flexneri 2a str. 2457T
ucuucgaguaaaaauauuu

SEQ ID NO: 3824912 - RNA, 18 nt, Shigella flexneri 2a str. 2457T
ucuucgccgaacacacau

SEQ ID NO: 3824913 - RNA, 13 nt, Shigella flexneri 2a str. 2457T
ucuucgccugccu

SEQ ID NO: 3824914 - RNA, 23 nt, Shigella flexneri 2a str. 2457T
ucuucgccugccugcagcugcuc

SEQ ID NO: 3824915 - RNA, 17 nt, Shigella flexneri 2a str. 2457T
ucuucggcaaguguugg

SEQ ID NO: 3824916 - RNA, 18 nt, Shigella flexneri 2a str. 2457T
ucuucggccauugaauau

SEQ ID NO: 3824917 - RNA, 17 nt, Shigella flexneri 2a str. 2457T
ucuucgguucaaguccc

SEQ ID NO: 3824918 - RNA, 20 nt, Shigella flexneri 2a str. 2457T
ucuucgguucguaagcaaga

SEQ ID NO: 3824919 - RNA, 15 nt, Shigella flexneri 2a str. 2457T
ucuucgucccagucg

SEQ ID NO: 3824920 - RNA, 13 nt, Shigella flexneri 2a str. 2457T
ucuucgucgucuu

SEQ ID NO: 3824921 - RNA, 14 nt, Shigella flexneri 2a str. 2457T
ucuucguucuucuu

SEQ ID NO: 3824922 - RNA, 20 nt, Shigella flexneri 2a str. 2457T
ucuucuaacgacauuuucug

SEQ ID NO: 3824923 - RNA, 17 nt, Shigella flexneri 2a str. 2457T
ucuucuaccggagagaa

SEQ ID NO: 3824924 - RNA, 15 nt, Shigella flexneri 2a str. 2457T
ucuucucgauaaaac

SEQ ID NO: 3824925 - RNA, 14 nt, Shigella flexneri 2a str. 2457T
ucuucugcaagcau

SEQ ID NO: 3824926 - RNA, 15 nt, Shigella flexneri 2a str. 2457T
ucuucugguuucagu

SEQ ID NO: 3824927 - RNA, 19 nt, Shigella flexneri 2a str. 2457T
ucuucugucgggcaucacu

SEQ ID NO: 3824928 - RNA, 14 nt, Shigella flexneri 2a str. 2457T
ucuucuucacucuc

SEQ ID NO: 3824929 - RNA, 18 nt, Shigella flexneri 2a str. 2457T
ucuucuucacuucuucaa

SEQ ID NO: 3824930 - RNA, 20 nt, Shigella flexneri 2a str. 2457T
ucuucuucacuucuucaaua

SEQ ID NO: 3824931 - RNA, 14 nt, Shigella flexneri 2a str. 2457T
ucuucuuccgcuuc

SEQ ID NO: 3824932 - RNA, 13 nt, Shigella flexneri 2a str. 2457T
ucuucuucgcugc

SEQ ID NO: 3824933 - RNA, 20 nt, Shigella flexneri 2a str. 2457T
ucuucuugcagcuuaaucau

SEQ ID NO: 3824934 - RNA, 14 nt, Shigella flexneri 2a str. 2457T
ucuucuuucaucau

SEQ ID NO: 3824935 - RNA, 13 nt, Shigella flexneri 2a str. 2457T
ucuugaaaccaga

SEQ ID NO: 3824936 - RNA, 13 nt, Shigella flexneri 2a str. 2457T
ucuugagaaaaac

SEQ ID NO: 3824937 - RNA, 16 nt, Shigella flexneri 2a str. 2457T
ucuugaguuggcaugc

SEQ ID NO: 3824938 - RNA, 20 nt, Shigella flexneri 2a str. 2457T
ucuugaguuggcaugcguau

SEQ ID NO: 3824939 - RNA, 13 nt, Shigella flexneri 2a str. 2457T
ucuugauaccaaa

SEQ ID NO: 3824940 - RNA, 14 nt, Shigella flexneri 2a str. 2457T
ucuugauuuacuac

SEQ ID NO: 3824941 - RNA, 22 nt, Shigella flexneri 2a str. 2457T
ucuugcagcucuugcagcagcu

SEQ ID NO: 3824942 - RNA, 16 nt, Shigella flexneri 2a str. 2457T
ucuugcagcuuaauca

SEQ ID NO: 3824943 - RNA, 18 nt, Shigella flexneri 2a str. 2457T
ucuugccaucaaucacuu

SEQ ID NO: 3824944 - RNA, 18 nt, Shigella flexneri 2a str. 2457T
ucuugcguuauuuucggc

SEQ ID NO: 3824945 - RNA, 23 nt, Shigella flexneri 2a str. 2457T
ucuugcuggcauuacaagaauca

SEQ ID NO: 3824946 - RNA, 15 nt, Shigella flexneri 2a str. 2457T
ucuuggguauaaaac

SEQ ID NO: 3824947 - RNA, 15 nt, Shigella flexneri 2a str. 2457T
ucuuguaggccugau

SEQ ID NO: 3824948 - RNA, 21 nt, Shigella flexneri 2a str. 2457T
ucuugucaggccggaauaacu

SEQ ID NO: 3824949 - RNA, 21 nt, Shigella flexneri 2a str. 2457T
ucuuguucauagugccugaug

SEQ ID NO: 3824950 - RNA, 19 nt, Shigella flexneri 2a str. 2457T
ucuuuaaaucacccgugag

SEQ ID NO: 3824951 - RNA, 13 nt, Shigella flexneri 2a str. 2457T
ucuuuacacacaa

SEQ ID NO: 3824952 - RNA, 16 nt, Shigella flexneri 2a str. 2457T
ucuuuacgcaaaauca

SEQ ID NO: 3824953 - RNA, 13 nt, Shigella flexneri 2a str. 2457T
ucuuuacuaaacg

SEQ ID NO: 3824954 - RNA, 16 nt, Shigella flexneri 2a str. 2457T
ucuuuacugauaauuu

SEQ ID NO: 3824955 - RNA, 16 nt, Shigella flexneri 2a str. 2457T
ucuuuaguuaauuucg

SEQ ID NO: 3824956 - RNA, 13 nt, Shigella flexneri 2a str. 2457T
ucuuuauaaauuc

SEQ ID NO: 3824957 - RNA, 19 nt, Shigella flexneri 2a str. 2457T
ucuuuauagagauuuuucc

SEQ ID NO: 3824958 - RNA, 13 nt, Shigella flexneri 2a str. 2457T
ucuuuauaugcaa

SEQ ID NO: 3824959 - RNA, 13 nt, Shigella flexneri 2a str. 2457T
ucuuuaucaauca

SEQ ID NO: 3824960 - RNA, 23 nt, Shigella flexneri 2a str. 2457T
ucuuuaucaccaaugauaaguuu

SEQ ID NO: 3824961 - RNA, 19 nt, Shigella flexneri 2a str. 2457T
ucuuuauggguuucuaauu

SEQ ID NO: 3824962 - RNA, 23 nt, Shigella flexneri 2a str. 2457T
ugaacaugaaaaaacuggcuacc

SEQ ID NO: 3824963 - RNA, 16 nt, Shigella flexneri 2a str. 2457T
ugaacauuacuuuccg

SEQ ID NO: 3824964 - RNA, 16 nt, Shigella flexneri 2a str. 2457T
ugaacauugcugcuga

SEQ ID NO: 3824965 - RNA, 18 nt, Shigella flexneri 2a str. 2457T
ugaacauuuucuucugcc

SEQ ID NO: 3824966 - RNA, 19 nt, Shigella flexneri 2a str. 2457T
ugaaccagccaacuugccc

SEQ ID NO: 3824967 - RNA, 16 nt, Shigella flexneri 2a str. 2457T
ugaaccgaaauggcug

SEQ ID NO: 3824968 - RNA, 15 nt, Shigella flexneri 2a str. 2457T
ugaaccgcacagguu

SEQ ID NO: 3824969 - RNA, 22 nt, Shigella flexneri 2a str. 2457T
ugaacgaccuccacucucgaaa

SEQ ID NO: 3824970 - RNA, 22 nt, Shigella flexneri 2a str. 2457T
ugaacgagaaaaugacgaugac

SEQ ID NO: 3824971 - RNA, 17 nt, Shigella flexneri 2a str. 2457T
ugaacgccaaauucuuu

SEQ ID NO: 3824972 - RNA, 20 nt, Shigella flexneri 2a str. 2457T
ugaacgccuuauccggccua

SEQ ID NO: 3824973 - RNA, 20 nt, Shigella flexneri 2a str. 2457T
ugaacgccuuauccggucua

SEQ ID NO: 3824974 - RNA, 20 nt, Shigella flexneri 2a str. 2457T
ugaacgccuuaucuggccua

SEQ ID NO: 3824975 - RNA, 19 nt, Shigella flexneri 2a str. 2457T
ugaacgcguuauccggcua

SEQ ID NO: 3824976 - RNA, 21 nt, Shigella flexneri 2a str. 2457T
ugaacgcuggcggcaggccua

SEQ ID NO: 3824977 - RNA, 16 nt, Shigella flexneri 2a str. 2457T
ugaacggcuucgccuc

SEQ ID NO: 3824978 - RNA, 18 nt, Shigella flexneri 2a str. 2457T
ugaacgugcaaaaucaaa

SEQ ID NO: 3824979 - RNA, 18 nt, Shigella flexneri 2a str. 2457T
ugaacguggcaacccgcg

SEQ ID NO: 3824980 - RNA, 14 nt, Shigella flexneri 2a str. 2457T
ugaacguggccaug

SEQ ID NO: 3824981 - RNA, 22 nt, Shigella flexneri 2a str. 2457T
ugaacgugggucugucccauuu

SEQ ID NO: 3824982 - RNA, 20 nt, Shigella flexneri 2a str. 2457T
ugaacucaacgccuucuucg

SEQ ID NO: 3824983 - RNA, 20 nt, Shigella flexneri 2a str. 2457T
ugaacucuuaagguucacuu

SEQ ID NO: 3824984 - RNA, 17 nt, Shigella flexneri 2a str. 2457T
ugaacucuucuuccggc

SEQ ID NO: 3824985 - RNA, 15 nt, Shigella flexneri 2a str. 2457T
ugaacugaacaaaaa

SEQ ID NO: 3824986 - RNA, 14 nt, Shigella flexneri 2a str. 2457T
ugaacugaauacga

SEQ ID NO: 3824987 - RNA, 12 nt, Shigella flexneri 2a str. 2457T
ugaacugacagc

SEQ ID NO: 3824988 - RNA, 19 nt, Shigella flexneri 2a str. 2457T
ugaacugcuuuuuaaucuc

SEQ ID NO: 3824989 - RNA, 16 nt, Shigella flexneri 2a str. 2457T
ugaacuggcuuuuuuc

SEQ ID NO: 3824990 - RNA, 20 nt, Shigella flexneri 2a str. 2457T
ugaacuggcuuuuuucaauu

SEQ ID NO: 3824991 - RNA, 22 nt, Shigella flexneri 2a str. 2457T
ugaacuggcuuuuuucaauuaa

SEQ ID NO: 3824992 - RNA, 16 nt, Shigella flexneri 2a str. 2457T
ugaacugggcgcggcc

SEQ ID NO: 3824993 - RNA, 19 nt, Shigella flexneri 2a str. 2457T
ugaacugggcgcggcccac

SEQ ID NO: 3824994 - RNA, 13 nt, Shigella flexneri 2a str. 2457T
ugaacuucacgua

SEQ ID NO: 3824995 - RNA, 13 nt, Shigella flexneri 2a str. 2457T
ugaacuucggccu

SEQ ID NO: 3824996 - RNA, 12 nt, Shigella flexneri 2a str. 2457T
ugaagaaaucag

SEQ ID NO: 3824997 - RNA, 19 nt, Shigella flexneri 2a str. 2457T
ugaagaacaaguucaagau

SEQ ID NO: 3824998 - RNA, 14 nt, Shigella flexneri 2a str. 2457T
ugaagaaccgcacc

SEQ ID NO: 3824999 - RNA, 18 nt, Shigella flexneri 2a str. 2457T
ugaagaaccgcaccaggc

SEQ ID NO: 3825000 - RNA, 18 nt, Shigella flexneri 2a str. 2457T
ugaagaagcggaaaucac

SEQ ID NO: 3825001 - RNA, 17 nt, Shigella flexneri 2a str. 2457T
ugaagaguuugaucaug

SEQ ID NO: 3825002 - RNA, 13 nt, Shigella flexneri 2a str. 2457T
ugaagauuagccg

SEQ ID NO: 3825003 - RNA, 17 nt, Shigella flexneri 2a str. 2457T
ugaagcacugcaucaau

SEQ ID NO: 3825004 - RNA, 17 nt, Shigella flexneri 2a str. 2457T
ugaagcaguuucaccag

SEQ ID NO: 3825005 - RNA, 20 nt, Shigella flexneri 2a str. 2457T
ugaagccaaccgggccgcag

SEQ ID NO: 3825006 - RNA, 22 nt, Shigella flexneri 2a str. 2457T
ugaagcccucgacauguucuau

SEQ ID NO: 3825007 - RNA, 19 nt, Shigella flexneri 2a str. 2457T
ugaagccuucgccuuucag

SEQ ID NO: 3825008 - RNA, 18 nt, Shigella flexneri 2a str. 2457T
ugaagcugauugcggaga

SEQ ID NO: 3825009 - RNA, 16 nt, Shigella flexneri 2a str. 2457T
ugaaggcaaacuucuc

SEQ ID NO: 3825010 - RNA, 15 nt, Shigella flexneri 2a str. 2457T
ugaaggcuaaugcug

SEQ ID NO: 3825011 - RNA, 23 nt, Shigella flexneri 2a str. 2457T
ugaagguguaauggauaaacacu

SEQ ID NO: 3825012 - RNA, 19 nt, Shigella flexneri 2a str. 2457T
ugaagguguuugacuguaa

SEQ ID NO: 3825013 - RNA, 20 nt, Shigella flexneri 2a str. 2457T
ugaagguuguuaaccaccag

SEQ ID NO: 3825014 - RNA, 20 nt, Shigella flexneri 2a str. 2457T
ugaagucagggucuuccagc

SEQ ID NO: 3825015 - RNA, 18 nt, Shigella flexneri 2a str. 2457T
ugaagucgcgcucaucag

SEQ ID NO: 3825016 - RNA, 17 nt, Shigella flexneri 2a str. 2457T
ugaagucucaauuagua

SEQ ID NO: 3825017 - RNA, 18 nt, Shigella flexneri 2a str. 2457T
ugaagugagaauuuuuca

SEQ ID NO: 3825018 - RNA, 22 nt, Shigella flexneri 2a str. 2457T
ugaagugugcaaacgauaaaag

SEQ ID NO: 3825019 - RNA, 23 nt, Shigella flexneri 2a str. 2457T
ugaaguuauaagcguuacgcagc

SEQ ID NO: 3825020 - RNA, 23 nt, Shigella flexneri 2a str. 2457T
ugaaguugccggauguguugcau

SEQ ID NO: 3825021 - RNA, 13 nt, Shigella flexneri 2a str. 2457T
ugaaguuuauacg

SEQ ID NO: 3825022 - RNA, 15 nt, Shigella flexneri 2a str. 2457T
ugaauaaauuuuauu

SEQ ID NO: 3825023 - RNA, 16 nt, Shigella flexneri 2a str. 2457T
ugaauaacaccagcca

SEQ ID NO: 3825024 - RNA, 18 nt, Shigella flexneri 2a str. 2457T
ugaauaacaccagccaga

SEQ ID NO: 3825025 - RNA, 13 nt, Shigella flexneri 2a str. 2457T
ugaauaaugacua

SEQ ID NO: 3825026 - RNA, 18 nt, Shigella flexneri 2a str. 2457T
ugaauaccaagucucaag

SEQ ID NO: 3825027 - RNA, 18 nt, Shigella flexneri 2a str. 2457T
ugaauagcgcaaaauuau

SEQ ID NO: 3825028 - RNA, 19 nt, Shigella flexneri 2a str. 2457T
ugaauagcgcaaaauuaug

SEQ ID NO: 3825029 - RNA, 16 nt, Shigella flexneri 2a str. 2457T
ugaauagcggaaaucu

SEQ ID NO: 3825030 - RNA, 17 nt, Shigella flexneri 2a str. 2457T
ugaauagcggaaaucuc

SEQ ID NO: 3825031 - RNA, 20 nt, Shigella flexneri 2a str. 2457T
ugaauagugccacaccagcu

SEQ ID NO: 3825032 - RNA, 21 nt, Shigella flexneri 2a str. 2457T
ugaauauaccauggaagaaaa

SEQ ID NO: 3825033 - RNA, 16 nt, Shigella flexneri 2a str. 2457T
ugaauauauaauuaaa

SEQ ID NO: 3825034 - RNA, 17 nt, Shigella flexneri 2a str. 2457T
ugaauaucuccucugcu

SEQ ID NO: 3825035 - RNA, 14 nt, Shigella flexneri 2a str. 2457T
ugaauaucuuucuc

SEQ ID NO: 3825036 - RNA, 17 nt, Shigella flexneri 2a str. 2457T
ugaauauucggcuccag

SEQ ID NO: 3825037 - RNA, 16 nt, Shigella flexneri 2a str. 2457T
ugaauauuuuagccgc

SEQ ID NO: 3825038 - RNA, 17 nt, Shigella flexneri 2a str. 2457T
ugaaucaccacaggccu

SEQ ID NO: 3825039 - RNA, 16 nt, Shigella flexneri 2a str. 2457T
ugaaucacgacaaaca

SEQ ID NO: 3825040 - RNA, 22 nt, Shigella flexneri 2a str. 2457T
ugaaucggcggcggcaguugcc

SEQ ID NO: 3825041 - RNA, 20 nt, Shigella flexneri 2a str. 2457T
ugaaucgggcgugauuccag

SEQ ID NO: 3825042 - RNA, 22 nt, Shigella flexneri 2a str. 2457T
ugaaucgucagacgaugcgucu

SEQ ID NO: 3825043 - RNA, 19 nt, Shigella flexneri 2a str. 2457T
ugaaucgucggaauggcau

SEQ ID NO: 3825044 - RNA, 12 nt, Shigella flexneri 2a str. 2457T
ugaaugaggcuu

SEQ ID NO: 3825045 - RNA, 15 nt, Shigella flexneri 2a str. 2457T
ugaaugccgcuaccg

SEQ ID NO: 3825046 - RNA, 13 nt, Shigella flexneri 2a str. 2457T
ugaaugccggaug

SEQ ID NO: 3825047 - RNA, 13 nt, Shigella flexneri 2a str. 2457T
ugaaugcggcagg

SEQ ID NO: 3825048 - RNA, 17 nt, Shigella flexneri 2a str. 2457T
ugaaugcggcaggcaca

SEQ ID NO: 3825049 - RNA, 14 nt, Shigella flexneri 2a str. 2457T
ugaaugcuuucaua

SEQ ID NO: 3825050 - RNA, 20 nt, Shigella flexneri 2a str. 2457T
ugaaugcuuucauauuccag

SEQ ID NO: 3825051 - RNA, 21 nt, Shigella flexneri 2a str. 2457T
ugaauuaaacacgggguuaaa

SEQ ID NO: 3825052 - RNA, 15 nt, Shigella flexneri 2a str. 2457T
ugaauuacuucucuu

SEQ ID NO: 3825053 - RNA, 23 nt, Shigella flexneri 2a str. 2457T
ugaauugaaaaguccaggcugca

SEQ ID NO: 3825054 - RNA, 20 nt, Shigella flexneri 2a str. 2457T
ugaauugcacgaaggugcau

SEQ ID NO: 3825055 - RNA, 18 nt, Shigella flexneri 2a str. 2457T
ugaauuugugaacagccu

SEQ ID NO: 3825056 - RNA, 23 nt, Shigella flexneri 2a str. 2457T
ugaauuuuaggaugcugcaauaa

SEQ ID NO: 3825057 - RNA, 16 nt, Shigella flexneri 2a str. 2457T
ugacaaacacaaaacu

SEQ ID NO: 3825058 - RNA, 16 nt, Shigella flexneri 2a str. 2457T
ugacaaagugcgcuuu

SEQ ID NO: 3825059 - RNA, 14 nt, Shigella flexneri 2a str. 2457T
ugacgucuggccuc

SEQ ID NO: 3825060 - RNA, 14 nt, Shigella flexneri 2a str. 2457T
ugacgugucuuauc

SEQ ID NO: 3825061 - RNA, 16 nt, Shigella flexneri 2a str. 2457T
ugacgugucuuaucag

SEQ ID NO: 3825062 - RNA, 20 nt, Shigella flexneri 2a str. 2457T
ugacgugucuuaucaggccu

SEQ ID NO: 3825063 - RNA, 14 nt, Shigella flexneri 2a str. 2457T
ugacguuaagaaaa

SEQ ID NO: 3825064 - RNA, 14 nt, Shigella flexneri 2a str. 2457T
ugacguuccuuucu

SEQ ID NO: 3825065 - RNA, 13 nt, Shigella flexneri 2a str. 2457T
ugacuaaaacccu

SEQ ID NO: 3825066 - RNA, 14 nt, Shigella flexneri 2a str. 2457T
ugacuaacacuuca

SEQ ID NO: 3825067 - RNA, 18 nt, Shigella flexneri 2a str. 2457T
ugacuacacuaaacgucu

SEQ ID NO: 3825068 - RNA, 20 nt, Shigella flexneri 2a str. 2457T
ugacuagaugugcaguuccu

SEQ ID NO: 3825069 - RNA, 17 nt, Shigella flexneri 2a str. 2457T
ugacuauccuggacuuu

SEQ ID NO: 3825070 - RNA, 23 nt, Shigella flexneri 2a str. 2457T
ugacuauuuccgauauucaggcg

SEQ ID NO: 3825071 - RNA, 19 nt, Shigella flexneri 2a str. 2457T
ugacucagaccauauuccc

SEQ ID NO: 3825072 - RNA, 17 nt, Shigella flexneri 2a str. 2457T
ugacucagcgucugaua

SEQ ID NO: 3825073 - RNA, 21 nt, Shigella flexneri 2a str. 2457T
ugacuccaacuuacugauagu

SEQ ID NO: 3825074 - RNA, 13 nt, Shigella flexneri 2a str. 2457T
ugacucgccugaa

SEQ ID NO: 3825075 - RNA, 16 nt, Shigella flexneri 2a str. 2457T
ugacucgccugaaagu

SEQ ID NO: 3825076 - RNA, 21 nt, Shigella flexneri 2a str. 2457T
ugacucggacgcguuucauuc

SEQ ID NO: 3825077 - RNA, 21 nt, Shigella flexneri 2a str. 2457T
ugacucggagucgacuucaga

SEQ ID NO: 3825078 - RNA, 14 nt, Shigella flexneri 2a str. 2457T
ugacucucauccaa

SEQ ID NO: 3825079 - RNA, 21 nt, Shigella flexneri 2a str. 2457T
ugacucuccccguuuuccggg

SEQ ID NO: 3825080 - RNA, 14 nt, Shigella flexneri 2a str. 2457T
ugacugaagaaauc

SEQ ID NO: 3825081 - RNA, 23 nt, Shigella flexneri 2a str. 2457T
ugacugaagaaaucccccagcau

SEQ ID NO: 3825082 - RNA, 21 nt, Shigella flexneri 2a str. 2457T
ugacugaaucaggaaccacaa

SEQ ID NO: 3825083 - RNA, 14 nt, Shigella flexneri 2a str. 2457T
ugacugacuucaac

SEQ ID NO: 3825084 - RNA, 17 nt, Shigella flexneri 2a str. 2457T
ugacugauaacgcggca

SEQ ID NO: 3825085 - RNA, 15 nt, Shigella flexneri 2a str. 2457T
ugacugccccaguuc

SEQ ID NO: 3825086 - RNA, 15 nt, Shigella flexneri 2a str. 2457T
ugacugcggcguggg

SEQ ID NO: 3825087 - RNA, 16 nt, Shigella flexneri 2a str. 2457T
ugacugcggcgugggc

SEQ ID NO: 3825088 - RNA, 14 nt, Shigella flexneri 2a str. 2457T
ugacuggcuacugu

SEQ ID NO: 3825089 - RNA, 16 nt, Shigella flexneri 2a str. 2457T
ugacugguagugcagu

SEQ ID NO: 3825090 - RNA, 19 nt, Shigella flexneri 2a str. 2457T
ugacugguagugcaguaca

SEQ ID NO: 3825091 - RNA, 21 nt, Shigella flexneri 2a str. 2457T
ugacugguagugcaguacauc

SEQ ID NO: 3825092 - RNA, 15 nt, Shigella flexneri 2a str. 2457T
ugacuuauaagucuc

SEQ ID NO: 3825093 - RNA, 15 nt, Shigella flexneri 2a str. 2457T
ugacuuccacuuccu

SEQ ID NO: 3825094 - RNA, 18 nt, Shigella flexneri 2a str. 2457T
ugacuuccguaccggccu

SEQ ID NO: 3825095 - RNA, 16 nt, Shigella flexneri 2a str. 2457T
ugacuucgccgugaaa

SEQ ID NO: 3825096 - RNA, 19 nt, Shigella flexneri 2a str. 2457T
ugacuucgccgugaaagug

SEQ ID NO: 3825097 - RNA, 17 nt, Shigella flexneri 2a str. 2457T
ugacuuugauccagcca

SEQ ID NO: 3825098 - RNA, 22 nt, Shigella flexneri 2a str. 2457T
ugacuuugccgauuuaacccug

SEQ ID NO: 3825099 - RNA, 16 nt, Shigella flexneri 2a str. 2457T
ugacuuuugcccggca

SEQ ID NO: 3825100 - RNA, 19 nt, Shigella flexneri 2a str. 2457T
ugacuuuugcccggcauga

SEQ ID NO: 3825101 - RNA, 10 nt, Shigella flexneri 2a str. 2457T
ugagaaaaag

SEQ ID NO: 3825102 - RNA, 16 nt, Shigella flexneri 2a str. 2457T
ugagaaaauuucauua

SEQ ID NO: 3825103 - RNA, 19 nt, Shigella flexneri 2a str. 2457T
ugagaaacucaguugauuc

SEQ ID NO: 3825104 - RNA, 21 nt, Shigella flexneri 2a str. 2457T
ugagaaauuaacgucaccauc

SEQ ID NO: 3825105 - RNA, 22 nt, Shigella flexneri 2a str. 2457T
ugagaacaagauugccugaugc

SEQ ID NO: 3825106 - RNA, 14 nt, Shigella flexneri 2a str. 2457T
ugagaacaccaccu

SEQ ID NO: 3825107 - RNA, 17 nt, Shigella flexneri 2a str. 2457T
ugagaacgacagugacu

SEQ ID NO: 3825108 - RNA, 18 nt, Shigella flexneri 2a str. 2457T
ugagaacgacagugacuu

SEQ ID NO: 3825109 - RNA, 14 nt, Shigella flexneri 2a str. 2457T
ugagaacgcccauc

SEQ ID NO: 3825110 - RNA, 20 nt, Shigella flexneri 2a str. 2457T
ugagaacggaguugagguuu

SEQ ID NO: 3825111 - RNA, 21 nt, Shigella flexneri 2a str. 2457T
ugagaauuccgacagagaaag

SEQ ID NO: 3825112 - RNA, 18 nt, Shigella flexneri 2a str. 2457T
ugagacaacaacaucagc

SEQ ID NO: 3825113 - RNA, 14 nt, Shigella flexneri 2a str. 2457T
ugagacgcacccuc

SEQ ID NO: 3825114 - RNA, 15 nt, Shigella flexneri 2a str. 2457T
ugagagcaugaaaug

SEQ ID NO: 3825115 - RNA, 19 nt, Shigella flexneri 2a str. 2457T
ugagagcaugaaaugaaaa

SEQ ID NO: 3825116 - RNA, 14 nt, Shigella flexneri 2a str. 2457T
ugagauaauucugu

SEQ ID NO: 3825117 - RNA, 23 nt, Shigella flexneri 2a str. 2457T
ugagauaauucuguaauccucuu

SEQ ID NO: 3825118 - RNA, 21 nt, Shigella flexneri 2a str. 2457T
ugagauaccaguugaucaaau

SEQ ID NO: 3825119 - RNA, 14 nt, Shigella flexneri 2a str. 2457T
ugagauauuuaaau

SEQ ID NO: 3825120 - RNA, 19 nt, Shigella flexneri 2a str. 2457T
ugagaucaaacucuuucaa

SEQ ID NO: 3825121 - RNA, 14 nt, Shigella flexneri 2a str. 2457T
ugagaucacugcaa

SEQ ID NO: 3825122 - RNA, 18 nt, Shigella flexneri 2a str. 2457T
ugagaucgugaaacucag

SEQ ID NO: 3825123 - RNA, 15 nt, Shigella flexneri 2a str. 2457T
ugagaugcuggagaa

SEQ ID NO: 3825124 - RNA, 15 nt, Shigella flexneri 2a str. 2457T
ugagauuucaccaau

SEQ ID NO: 3825125 - RNA, 20 nt, Shigella flexneri 2a str. 2457T
ugagcaaacaguucugcagc

SEQ ID NO: 3825126 - RNA, 21 nt, Shigella flexneri 2a str. 2457T
ugagcaaacaguucugcagcg

SEQ ID NO: 3825127 - RNA, 13 nt, Shigella flexneri 2a str. 2457T
ugagcacuggggc

SEQ ID NO: 3825128 - RNA, 13 nt, Shigella flexneri 2a str. 2457T
ugagcacuuuucu

SEQ ID NO: 3825129 - RNA, 19 nt, Shigella flexneri 2a str. 2457T
ugagcagaagguaaauugu

SEQ ID NO: 3825130 - RNA, 19 nt, Shigella flexneri 2a str. 2457T
ugagcaguggcaaacugag

SEQ ID NO: 3825131 - RNA, 18 nt, Shigella flexneri 2a str. 2457T
ugagcaguuuucacccuu

SEQ ID NO: 3825132 - RNA, 19 nt, Shigella flexneri 2a str. 2457T
ugagcaugaugccugaugc

SEQ ID NO: 3825133 - RNA, 19 nt, Shigella flexneri 2a str. 2457T
ugagccaaaaugccugaug

SEQ ID NO: 3825134 - RNA, 21 nt, Shigella flexneri 2a str. 2457T
ugagccagugccgaaaugucu

SEQ ID NO: 3825135 - RNA, 21 nt, Shigella flexneri 2a str. 2457T
ugagccggaguugcagauuug

SEQ ID NO: 3825136 - RNA, 18 nt, Shigella flexneri 2a str. 2457T
ugagcgaauaaaaaaaga

SEQ ID NO: 3825137 - RNA, 13 nt, Shigella flexneri 2a str. 2457T
ugagcgacaucuu

SEQ ID NO: 3825138 - RNA, 16 nt, Shigella flexneri 2a str. 2457T
ugagcgauaaacaagu

SEQ ID NO: 3825139 - RNA, 20 nt, Shigella flexneri 2a str. 2457T
ugagcgauacccauuuuauu

SEQ ID NO: 3825140 - RNA, 11 nt, Shigella flexneri 2a str. 2457T
ugagcgcaaau

SEQ ID NO: 3825141 - RNA, 21 nt, Shigella flexneri 2a str. 2457T
ugagcggacugaacgcggccc

SEQ ID NO: 3825142 - RNA, 19 nt, Shigella flexneri 2a str. 2457T
ugagcggcgggcuuuaauc

SEQ ID NO: 3825143 - RNA, 16 nt, Shigella flexneri 2a str. 2457T
ugagcgguacaccaaa

SEQ ID NO: 3825144 - RNA, 12 nt, Shigella flexneri 2a str. 2457T
ugagcguuaccc

SEQ ID NO: 3825145 - RNA, 14 nt, Shigella flexneri 2a str. 2457T
ugagcguuucaaaa

SEQ ID NO: 3825146 - RNA, 23 nt, Shigella flexneri 2a str. 2457T
ugagcuaaugcaaaucacgcugc

SEQ ID NO: 3825147 - RNA, 14 nt, Shigella flexneri 2a str. 2457T
ugagcucuaucucc

SEQ ID NO: 3825148 - RNA, 17 nt, Shigella flexneri 2a str. 2457T
ugagcucuaucucccug

SEQ ID NO: 3825149 - RNA, 15 nt, Shigella flexneri 2a str. 2457T
ugagcugcaucuguu

SEQ ID NO: 3825150 - RNA, 17 nt, Shigella flexneri 2a str. 2457T
ugaggaucacaaaacga

SEQ ID NO: 3825151 - RNA, 14 nt, Shigella flexneri 2a str. 2457T
ugaggaucaccagu

SEQ ID NO: 3825152 - RNA, 14 nt, Shigella flexneri 2a str. 2457T
ugaggaugcggguc

SEQ ID NO: 3825153 - RNA, 20 nt, Shigella flexneri 2a str. 2457T
ugaggauuacgucuuuacua

SEQ ID NO: 3825154 - RNA, 21 nt, Shigella flexneri 2a str. 2457T
ugaggauuacgucuuuacuaa

SEQ ID NO: 3825155 - RNA, 17 nt, Shigella flexneri 2a str. 2457T
ugaggcagcaaggaaaa

SEQ ID NO: 3825156 - RNA, 19 nt, Shigella flexneri 2a str. 2457T
ugaggcauaagcgacaucu

SEQ ID NO: 3825157 - RNA, 19 nt, Shigella flexneri 2a str. 2457T
ugaugaccagaucaggcuu

SEQ ID NO: 3825158 - RNA, 18 nt, Shigella flexneri 2a str. 2457T
ugaugacguaauccgccu

SEQ ID NO: 3825159 - RNA, 19 nt, Shigella flexneri 2a str. 2457T
ugaugacuugccuccagcg

SEQ ID NO: 3825160 - RNA, 19 nt, Shigella flexneri 2a str. 2457T
ugaugauuuccggcagcau

SEQ ID NO: 3825161 - RNA, 14 nt, Shigella flexneri 2a str. 2457T
ugaugcauaaaaaa

SEQ ID NO: 3825162 - RNA, 11 nt, Shigella flexneri 2a str. 2457T
ugaugccaucg

SEQ ID NO: 3825163 - RNA, 14 nt, Shigella flexneri 2a str. 2457T
ugaugccgccagaa

SEQ ID NO: 3825164 - RNA, 21 nt, Shigella flexneri 2a str. 2457T
ugaugccgccagacugcgaga

SEQ ID NO: 3825165 - RNA, 15 nt, Shigella flexneri 2a str. 2457T
ugaugccgugcagca

SEQ ID NO: 3825166 - RNA, 17 nt, Shigella flexneri 2a str. 2457T
ugaugcgacgcuugacg

SEQ ID NO: 3825167 - RNA, 21 nt, Shigella flexneri 2a str. 2457T
ugaugcgacgcuugacgcguc

SEQ ID NO: 3825168 - RNA, 16 nt, Shigella flexneri 2a str. 2457T
ugaugcgcggcuccag

SEQ ID NO: 3825169 - RNA, 22 nt, Shigella flexneri 2a str. 2457T
ugaugcgcuacgcucaucaggc

SEQ ID NO: 3825170 - RNA, 17 nt, Shigella flexneri 2a str. 2457T
ugaugcgcuacgcuuau

SEQ ID NO: 3825171 - RNA, 14 nt, Shigella flexneri 2a str. 2457T
ugaugcgcuaugcu

SEQ ID NO: 3825172 - RNA, 21 nt, Shigella flexneri 2a str. 2457T
ugaugcgcugcgcuuaucagg

SEQ ID NO: 3825173 - RNA, 23 nt, Shigella flexneri 2a str. 2457T
ugaugcgcuucgcuuaccaugcc

SEQ ID NO: 3825174 - RNA, 19 nt, Shigella flexneri 2a str. 2457T
ugaugcgcuucgcuuauca

SEQ ID NO: 3825175 - RNA, 18 nt, Shigella flexneri 2a str. 2457T
ugaugcggcgcuuucagc

SEQ ID NO: 3825176 - RNA, 16 nt, Shigella flexneri 2a str. 2457T
ugaugcucuugaaaug

SEQ ID NO: 3825177 - RNA, 22 nt, Shigella flexneri 2a str. 2457T
ugauggaaaauuguuccgucag

SEQ ID NO: 3825178 - RNA, 14 nt, Shigella flexneri 2a str. 2457T
ugauggaauuucau

SEQ ID NO: 3825179 - RNA, 21 nt, Shigella flexneri 2a str. 2457T
ugauggacauucuccggcagg

SEQ ID NO: 3825180 - RNA, 18 nt, Shigella flexneri 2a str. 2457T
ugauggaccgugccggac

SEQ ID NO: 3825181 - RNA, 20 nt, Shigella flexneri 2a str. 2457T
ugauggcauaacguugcagc

SEQ ID NO: 3825182 - RNA, 22 nt, Shigella flexneri 2a str. 2457T
ugauggccagauaacccagggg

SEQ ID NO: 3825183 - RNA, 17 nt, Shigella flexneri 2a str. 2457T
ugauggcgauaaucuuu

SEQ ID NO: 3825184 - RNA, 15 nt, Shigella flexneri 2a str. 2457T
ugauggcuauuagaa

SEQ ID NO: 3825185 - RNA, 18 nt, Shigella flexneri 2a str. 2457T
ugauggcuggcuuccagu

SEQ ID NO: 3825186 - RNA, 13 nt, Shigella flexneri 2a str. 2457T
ugaugggcagaau

SEQ ID NO: 3825187 - RNA, 15 nt, Shigella flexneri 2a str. 2457T
ugaugggcgaagaga

SEQ ID NO: 3825188 - RNA, 20 nt, Shigella flexneri 2a str. 2457T
ugaugggggcguuuuuauuu

SEQ ID NO: 3825189 - RNA, 16 nt, Shigella flexneri 2a str. 2457T
ugauggugguggggga

SEQ ID NO: 3825190 - RNA, 14 nt, Shigella flexneri 2a str. 2457T
ugaugucacagccg

SEQ ID NO: 3825191 - RNA, 22 nt, Shigella flexneri 2a str. 2457T
ugaugugaaaacucuuagcaaa

SEQ ID NO: 3825192 - RNA, 16 nt, Shigella flexneri 2a str. 2457T
ugaugugauccaucag

SEQ ID NO: 3825193 - RNA, 19 nt, Shigella flexneri 2a str. 2457T
ugauguggugcaaggaaau

SEQ ID NO: 3825194 - RNA, 14 nt, Shigella flexneri 2a str. 2457T
ugauuaacaggcug

SEQ ID NO: 3825195 - RNA, 23 nt, Shigella flexneri 2a str. 2457T
ugauuaacgcuuguaaaugaacu

SEQ ID NO: 3825196 - RNA, 14 nt, Shigella flexneri 2a str. 2457T
ugauuaacuguucu

SEQ ID NO: 3825197 - RNA, 16 nt, Shigella flexneri 2a str. 2457T
ugauuaagugaauaua

SEQ ID NO: 3825198 - RNA, 16 nt, Shigella flexneri 2a str. 2457T
ugauuaccaauaucaa

SEQ ID NO: 3825199 - RNA, 16 nt, Shigella flexneri 2a str. 2457T
ugauuaccgugaauca

SEQ ID NO: 3825200 - RNA, 15 nt, Shigella flexneri 2a str. 2457T
ugauuacuaaaugug

SEQ ID NO: 3825201 - RNA, 13 nt, Shigella flexneri 2a str. 2457T
ugauuaucggcau

SEQ ID NO: 3825202 - RNA, 15 nt, Shigella flexneri 2a str. 2457T
ugauuaugucaucau

SEQ ID NO: 3825203 - RNA, 15 nt, Shigella flexneri 2a str. 2457T
ugauucacguucgug

SEQ ID NO: 3825204 - RNA, 14 nt, Shigella flexneri 2a str. 2457T
ugauucacuggcaa

SEQ ID NO: 3825205 - RNA, 15 nt, Shigella flexneri 2a str. 2457T
ugauucacuggcaaa

SEQ ID NO: 3825206 - RNA, 12 nt, Shigella flexneri 2a str. 2457T
ugauucagauaa

SEQ ID NO: 3825207 - RNA, 20 nt, Shigella flexneri 2a str. 2457T
ugauucauaguaagcagauu

SEQ ID NO: 3825208 - RNA, 15 nt, Shigella flexneri 2a str. 2457T
ugauuccauuauuca

SEQ ID NO: 3825209 - RNA, 22 nt, Shigella flexneri 2a str. 2457T
ugauuccgccaguucuuccagu

SEQ ID NO: 3825210 - RNA, 18 nt, Shigella flexneri 2a str. 2457T
ugauuccggcaaauaaca

SEQ ID NO: 3825211 - RNA, 23 nt, Shigella flexneri 2a str. 2457T
ugauuccgggaauucgaagcugu

SEQ ID NO: 3825212 - RNA, 14 nt, Shigella flexneri 2a str. 2457T
ugauucgcgcguuc

SEQ ID NO: 3825213 - RNA, 13 nt, Shigella flexneri 2a str. 2457T
ugauucucccuca

SEQ ID NO: 3825214 - RNA, 17 nt, Shigella flexneri 2a str. 2457T
ugauucugagaaacuca

SEQ ID NO: 3825215 - RNA, 16 nt, Shigella flexneri 2a str. 2457T
ugauucugauccugca

SEQ ID NO: 3825216 - RNA, 19 nt, Shigella flexneri 2a str. 2457T
ugauugaaauagccaauac

SEQ ID NO: 3825217 - RNA, 22 nt, Shigella flexneri 2a str. 2457T
ugauugaaauagccaauacgau

SEQ ID NO: 3825218 - RNA, 15 nt, Shigella flexneri 2a str. 2457T
ugauugaagaaauca

SEQ ID NO: 3825219 - RNA, 16 nt, Shigella flexneri 2a str. 2457T
ugauugaagaaaucag

SEQ ID NO: 3825220 - RNA, 13 nt, Shigella flexneri 2a str. 2457T
ugauugccugaug

SEQ ID NO: 3825221 - RNA, 20 nt, Shigella flexneri 2a str. 2457T
ugauugcucugguuguggug

SEQ ID NO: 3825222 - RNA, 20 nt, Shigella flexneri 2a str. 2457T
ugauugcuuuaucaaucacc

SEQ ID NO: 3825223 - RNA, 18 nt, Shigella flexneri 2a str. 2457T
ugauugggucauuuccca

SEQ ID NO: 3825224 - RNA, 12 nt, Shigella flexneri 2a str. 2457T
ugauugucggug

SEQ ID NO: 3825225 - RNA, 18 nt, Shigella flexneri 2a str. 2457T
ugauuguggcaaucauau

SEQ ID NO: 3825226 - RNA, 23 nt, Shigella flexneri 2a str. 2457T
ugauuguugcgccaguaaauuua

SEQ ID NO: 3825227 - RNA, 20 nt, Shigella flexneri 2a str. 2457T
ugauuuaaaaaauggccaga

SEQ ID NO: 3825228 - RNA, 20 nt, Shigella flexneri 2a str. 2457T
ugauuuaaaaccacuaccca

SEQ ID NO: 3825229 - RNA, 22 nt, Shigella flexneri 2a str. 2457T
ugauuuaaccaacaauaaaauu

SEQ ID NO: 3825230 - RNA, 22 nt, Shigella flexneri 2a str. 2457T
ugauuuaccggaaggauuaucc

SEQ ID NO: 3825231 - RNA, 17 nt, Shigella flexneri 2a str. 2457T
ugauuuagcaccgacgu

SEQ ID NO: 3825232 - RNA, 12 nt, Shigella flexneri 2a str. 2457T
ugauuuauagau

SEQ ID NO: 3825233 - RNA, 14 nt, Shigella flexneri 2a str. 2457T
ugauuuauagauuu

SEQ ID NO: 3825234 - RNA, 16 nt, Shigella flexneri 2a str. 2457T
ugauuuauagauuuac

SEQ ID NO: 3825235 - RNA, 19 nt, Shigella flexneri 2a str. 2457T
ugauuucgucauccggugu

SEQ ID NO: 3825236 - RNA, 15 nt, Shigella flexneri 2a str. 2457T
ugauuuuauugcguc

SEQ ID NO: 3825237 - RNA, 18 nt, Shigella flexneri 2a str. 2457T
ugauuuucaccagcaucg

SEQ ID NO: 3825238 - RNA, 16 nt, Shigella flexneri 2a str. 2457T
ugauuuugcauuuuaa

SEQ ID NO: 3825239 - RNA, 17 nt, Shigella flexneri 2a str. 2457T
ugauuuuucguuuuaau

SEQ ID NO: 3825240 - RNA, 19 nt, Shigella flexneri 2a str. 2457T
ugauuuuucguuuuaaugc

SEQ ID NO: 3825241 - RNA, 21 nt, Shigella flexneri 2a str. 2457T
ugauuuuugagacgcagcguu

SEQ ID NO: 3825242 - RNA, 19 nt, Shigella flexneri 2a str. 2457T
ugauuuuuuccaacaggcg

SEQ ID NO: 3825243 - RNA, 12 nt, Shigella flexneri 2a str. 2457T
ugcaaaaaaacu

SEQ ID NO: 3825244 - RNA, 13 nt, Shigella flexneri 2a str. 2457T
ugcaaaaauucaa

SEQ ID NO: 3825245 - RNA, 22 nt, Shigella flexneri 2a str. 2457T
ugcaaaauagucaucucuuccg

SEQ ID NO: 3825246 - RNA, 23 nt, Shigella flexneri 2a str. 2457T
ugcaaaauuuucauugccgcauc

SEQ ID NO: 3825247 - RNA, 23 nt, Shigella flexneri 2a str. 2457T
ugcaaacguaaaacugccugaug

SEQ ID NO: 3825248 - RNA, 19 nt, Shigella flexneri 2a str. 2457T
ugcaaaggccagccaggca

SEQ ID NO: 3825249 - RNA, 17 nt, Shigella flexneri 2a str. 2457T
ugcaaauaaauaccguu

SEQ ID NO: 3825250 - RNA, 12 nt, Shigella flexneri 2a str. 2457T
ugcaaauauaca

SEQ ID NO: 3825251 - RNA, 13 nt, Shigella flexneri 2a str. 2457T
ugcaaauauuaau

SEQ ID NO: 3825252 - RNA, 14 nt, Shigella flexneri 2a str. 2457T
ugcaaauauuaaua

SEQ ID NO: 3825253 - RNA, 18 nt, Shigella flexneri 2a str. 2457T
ugcaaaucacgcugcuga

SEQ ID NO: 3825254 - RNA, 19 nt, Shigella flexneri 2a str. 2457T
ugcagauuugccaguaccg

SEQ ID NO: 3825255 - RNA, 20 nt, Shigella flexneri 2a str. 2457T
ugcagcaaacgauucaaaag

SEQ ID NO: 3825256 - RNA, 16 nt, Shigella flexneri 2a str. 2457T
ugcagcaacucuuuuu

SEQ ID NO: 3825257 - RNA, 23 nt, Shigella flexneri 2a str. 2457T
ugcagcacacauuauaggccuga

SEQ ID NO: 3825258 - RNA, 17 nt, Shigella flexneri 2a str. 2457T
ugcagcacggagagacg

SEQ ID NO: 3825259 - RNA, 14 nt, Shigella flexneri 2a str. 2457T
ugcagcacugauaa

SEQ ID NO: 3825260 - RNA, 14 nt, Shigella flexneri 2a str. 2457T
ugcagcaucaccgg

SEQ ID NO: 3825261 - RNA, 15 nt, Shigella flexneri 2a str. 2457T
ugcagcaugcacccu

SEQ ID NO: 3825262 - RNA, 16 nt, Shigella flexneri 2a str. 2457T
ugcagcaugcacccuc

SEQ ID NO: 3825263 - RNA, 16 nt, Shigella flexneri 2a str. 2457T
ugcagcccguaagcaa

SEQ ID NO: 3825264 - RNA, 15 nt, Shigella flexneri 2a str. 2457T
ugcagccggagcuuc

SEQ ID NO: 3825265 - RNA, 14 nt, Shigella flexneri 2a str. 2457T
ugcagccuucauuc

SEQ ID NO: 3825266 - RNA, 22 nt, Shigella flexneri 2a str. 2457T
ugcagccuucauucaggcauug

SEQ ID NO: 3825267 - RNA, 19 nt, Shigella flexneri 2a str. 2457T
ugcagcgcaaucgccucca

SEQ ID NO: 3825268 - RNA, 17 nt, Shigella flexneri 2a str. 2457T
ugcagcggguuaauuuc

SEQ ID NO: 3825269 - RNA, 20 nt, Shigella flexneri 2a str. 2457T
ugcagcguaaaccccuuauc

SEQ ID NO: 3825270 - RNA, 15 nt, Shigella flexneri 2a str. 2457T
ugcagcgucaucaac

SEQ ID NO: 3825271 - RNA, 20 nt, Shigella flexneri 2a str. 2457T
ugcagcguuaacugcuuauc

SEQ ID NO: 3825272 - RNA, 16 nt, Shigella flexneri 2a str. 2457T
ugcagcguuuccagcc

SEQ ID NO: 3825273 - RNA, 18 nt, Shigella flexneri 2a str. 2457T
ugcagcguuucgcgcgcg

SEQ ID NO: 3825274 - RNA, 14 nt, Shigella flexneri 2a str. 2457T
ugcagcuccaccga

SEQ ID NO: 3825275 - RNA, 21 nt, Shigella flexneri 2a str. 2457T
ugcagcuccaccgauuuugag

SEQ ID NO: 3825276 - RNA, 17 nt, Shigella flexneri 2a str. 2457T
ugcagcugccuggccca

SEQ ID NO: 3825277 - RNA, 13 nt, Shigella flexneri 2a str. 2457T
ugcagcugcucga

SEQ ID NO: 3825278 - RNA, 21 nt, Shigella flexneri 2a str. 2457T
ugcagcuucuuauccagcugc

SEQ ID NO: 3825279 - RNA, 20 nt, Shigella flexneri 2a str. 2457T
ugcagcuuuaacgaucacug

SEQ ID NO: 3825280 - RNA, 20 nt, Shigella flexneri 2a str. 2457T
ugcagcuuucccuucaggcg

SEQ ID NO: 3825281 - RNA, 16 nt, Shigella flexneri 2a str. 2457T
ugcaggaccauacuga

SEQ ID NO: 3825282 - RNA, 22 nt, Shigella flexneri 2a str. 2457T
ugcaggagcgauuaugaaacaa

SEQ ID NO: 3825283 - RNA, 16 nt, Shigella flexneri 2a str. 2457T
ugcaggcaacagggaa

SEQ ID NO: 3825284 - RNA, 16 nt, Shigella flexneri 2a str. 2457T
ugcaggcuauuucugg

SEQ ID NO: 3825285 - RNA, 11 nt, Shigella flexneri 2a str. 2457T
ugcaggcuggu

SEQ ID NO: 3825286 - RNA, 18 nt, Shigella flexneri 2a str. 2457T
ugcaggcuucuggcggcg

SEQ ID NO: 3825287 - RNA, 17 nt, Shigella flexneri 2a str. 2457T
ugcagucaccugcccuc

SEQ ID NO: 3825288 - RNA, 20 nt, Shigella flexneri 2a str. 2457T
ugcagucauaaccaguccau

SEQ ID NO: 3825289 - RNA, 16 nt, Shigella flexneri 2a str. 2457T
ugcagucauagguucu

SEQ ID NO: 3825290 - RNA, 21 nt, Shigella flexneri 2a str. 2457T
ugcagugaucgugugccacca

SEQ ID NO: 3825291 - RNA, 17 nt, Shigella flexneri 2a str. 2457T
ugcagugccgcugcucg

SEQ ID NO: 3825292 - RNA, 16 nt, Shigella flexneri 2a str. 2457T
ugcaguuaaaauagga

SEQ ID NO: 3825293 - RNA, 15 nt, Shigella flexneri 2a str. 2457T
ugcaguuaucugccg

SEQ ID NO: 3825294 - RNA, 13 nt, Shigella flexneri 2a str. 2457T
ugcaguuccugcc

SEQ ID NO: 3825295 - RNA, 17 nt, Shigella flexneri 2a str. 2457T
ugcaguuccugccagau

SEQ ID NO: 3825296 - RNA, 22 nt, Shigella flexneri 2a str. 2457T
ugcaguuccugccagauuugcu

SEQ ID NO: 3825297 - RNA, 18 nt, Shigella flexneri 2a str. 2457T
ugcauaaagcgguuuuca

SEQ ID NO: 3825298 - RNA, 15 nt, Shigella flexneri 2a str. 2457T
ugcauaaaugccgca

SEQ ID NO: 3825299 - RNA, 18 nt, Shigella flexneri 2a str. 2457T
ugcauaauccgccgcugu

SEQ ID NO: 3825300 - RNA, 13 nt, Shigella flexneri 2a str. 2457T
ugcauaauuucuu

SEQ ID NO: 3825301 - RNA, 17 nt, Shigella flexneri 2a str. 2457T
ugcauaauuucuucguu

SEQ ID NO: 3825302 - RNA, 16 nt, Shigella flexneri 2a str. 2457T
ugcauacaguacgugu

SEQ ID NO: 3825303 - RNA, 20 nt, Shigella flexneri 2a str. 2457T
ugcauacccagaacuaucau

SEQ ID NO: 3825304 - RNA, 16 nt, Shigella flexneri 2a str. 2457T
ugcauacggugaaagu

SEQ ID NO: 3825305 - RNA, 15 nt, Shigella flexneri 2a str. 2457T
ugcauagcgauaaga

SEQ ID NO: 3825306 - RNA, 17 nt, Shigella flexneri 2a str. 2457T
ugcauaucaguugggga

SEQ ID NO: 3825307 - RNA, 23 nt, Shigella flexneri 2a str. 2457T
ugcauaucaguuggggaaaaguu

SEQ ID NO: 3825308 - RNA, 11 nt, Shigella flexneri 2a str. 2457T
ugcaucaacca

SEQ ID NO: 3825309 - RNA, 18 nt, Shigella flexneri 2a str. 2457T
ugcaucaaguugauuuuu

SEQ ID NO: 3825310 - RNA, 22 nt, Shigella flexneri 2a str. 2457T
ugcaucacauccggcaauauuc

SEQ ID NO: 3825311 - RNA, 19 nt, Shigella flexneri 2a str. 2457T
ugcaucagcacgacuauua

SEQ ID NO: 3825312 - RNA, 22 nt, Shigella flexneri 2a str. 2457T
ugcaucaggcaaacuucacgca

SEQ ID NO: 3825313 - RNA, 13 nt, Shigella flexneri 2a str. 2457T
ugcaucagugaca

SEQ ID NO: 3825314 - RNA, 22 nt, Shigella flexneri 2a str. 2457T
ugcaucauaaccugcucugcca

SEQ ID NO: 3825315 - RNA, 15 nt, Shigella flexneri 2a str. 2457T
ugcaucaugaaaacc

SEQ ID NO: 3825316 - RNA, 19 nt, Shigella flexneri 2a str. 2457T
ugcauccacuuugguuaca

SEQ ID NO: 3825317 - RNA, 13 nt, Shigella flexneri 2a str. 2457T
ugcauccagcucg

SEQ ID NO: 3825318 - RNA, 21 nt, Shigella flexneri 2a str. 2457T
ugcaucccgccguaccggcaa

SEQ ID NO: 3825319 - RNA, 15 nt, Shigella flexneri 2a str. 2457T
ugcauccgcugcgca

SEQ ID NO: 3825320 - RNA, 20 nt, Shigella flexneri 2a str. 2457T
ugcauccgcuuacucaucca

SEQ ID NO: 3825321 - RNA, 16 nt, Shigella flexneri 2a str. 2457T
ugcaucgacagcgccu

SEQ ID NO: 3825322 - RNA, 17 nt, Shigella flexneri 2a str. 2457T
ugcaucgacagcgccuu

SEQ ID NO: 3825323 - RNA, 14 nt, Shigella flexneri 2a str. 2457T
ugcaucgccaaucu

SEQ ID NO: 3825324 - RNA, 23 nt, Shigella flexneri 2a str. 2457T
ugcaucgccauaauaagcgccau

SEQ ID NO: 3825325 - RNA, 12 nt, Shigella flexneri 2a str. 2457T
ugcaucgccuga

SEQ ID NO: 3825326 - RNA, 14 nt, Shigella flexneri 2a str. 2457T
ugcaucgccugauu

SEQ ID NO: 3825327 - RNA, 16 nt, Shigella flexneri 2a str. 2457T
ugcaucgccugcgcga

SEQ ID NO: 3825328 - RNA, 17 nt, Shigella flexneri 2a str. 2457T
ugcaucgcgaccaauca

SEQ ID NO: 3825329 - RNA, 11 nt, Shigella flexneri 2a str. 2457T
ugcaucggcaa

SEQ ID NO: 3825330 - RNA, 14 nt, Shigella flexneri 2a str. 2457T
ugcaucggcauaau

SEQ ID NO: 3825331 - RNA, 18 nt, Shigella flexneri 2a str. 2457T
ugcaucguauugguacau

SEQ ID NO: 3825332 - RNA, 23 nt, Shigella flexneri 2a str. 2457T
ugcaucuccggcgcauccaugau

SEQ ID NO: 3825333 - RNA, 15 nt, Shigella flexneri 2a str. 2457T
ugcaucuccugacac

SEQ ID NO: 3825334 - RNA, 13 nt, Shigella flexneri 2a str. 2457T
ugcaucugaaacu

SEQ ID NO: 3825335 - RNA, 13 nt, Shigella flexneri 2a str. 2457T
ugcaucuguuuuc

SEQ ID NO: 3825336 - RNA, 14 nt, Shigella flexneri 2a str. 2457T
ugcaugacagcgcc

SEQ ID NO: 3825337 - RNA, 23 nt, Shigella flexneri 2a str. 2457T
ugcaugacuuuguaggccggaua

SEQ ID NO: 3825338 - RNA, 18 nt, Shigella flexneri 2a str. 2457T
ugcaugcgaaugcagggc

SEQ ID NO: 3825339 - RNA, 23 nt, Shigella flexneri 2a str. 2457T
ugcauggucuuguaggccagaua

SEQ ID NO: 3825340 - RNA, 22 nt, Shigella flexneri 2a str. 2457T
ugcauguuggcgauugccguug

SEQ ID NO: 3825341 - RNA, 23 nt, Shigella flexneri 2a str. 2457T
ugcauuaaauugugaacgagaaa

SEQ ID NO: 3825342 - RNA, 14 nt, Shigella flexneri 2a str. 2457T
ugcauucgagccaa

SEQ ID NO: 3825343 - RNA, 18 nt, Shigella flexneri 2a str. 2457T
ugcauugauggaguaguu

SEQ ID NO: 3825344 - RNA, 16 nt, Shigella flexneri 2a str. 2457T
ugcauuuaagaaaaaa

SEQ ID NO: 3825345 - RNA, 17 nt, Shigella flexneri 2a str. 2457T
ugcauuuccauaaauug

SEQ ID NO: 3825346 - RNA, 13 nt, Shigella flexneri 2a str. 2457T
ugcauuuucucgc

SEQ ID NO: 3825347 - RNA, 15 nt, Shigella flexneri 2a str. 2457T
ugccaaaaugcugga

SEQ ID NO: 3825348 - RNA, 14 nt, Shigella flexneri 2a str. 2457T
ugccaaagucauca

SEQ ID NO: 3825349 - RNA, 18 nt, Shigella flexneri 2a str. 2457T
ugccaaagucaucaaucg

SEQ ID NO: 3825350 - RNA, 15 nt, Shigella flexneri 2a str. 2457T
ugccaaauauuucuu

SEQ ID NO: 3825351 - RNA, 20 nt, Shigella flexneri 2a str. 2457T
ugccaaauauuucuuuauca

SEQ ID NO: 3825352 - RNA, 14 nt, Shigella flexneri 2a str. 2457T
ugccaucucugcaa

SEQ ID NO: 3825353 - RNA, 19 nt, Shigella flexneri 2a str. 2457T
ugccaugaccgcuccgcca

SEQ ID NO: 3825354 - RNA, 20 nt, Shigella flexneri 2a str. 2457T
ugccaugacuuucuggcacg

SEQ ID NO: 3825355 - RNA, 18 nt, Shigella flexneri 2a str. 2457T
ugccaugcacgcaagaac

SEQ ID NO: 3825356 - RNA, 15 nt, Shigella flexneri 2a str. 2457T
ugccaugccaaucag

SEQ ID NO: 3825357 - RNA, 14 nt, Shigella flexneri 2a str. 2457T
ugccauuccacaaa

SEQ ID NO: 3825358 - RNA, 18 nt, Shigella flexneri 2a str. 2457T
ugccauucgccaguccuu

SEQ ID NO: 3825359 - RNA, 22 nt, Shigella flexneri 2a str. 2457T
ugccauuguuuucucacuguug

SEQ ID NO: 3825360 - RNA, 15 nt, Shigella flexneri 2a str. 2457T
ugcccaacaggcgcu

SEQ ID NO: 3825361 - RNA, 22 nt, Shigella flexneri 2a str. 2457T
ugcccaagcggggaaggaugag

SEQ ID NO: 3825362 - RNA, 21 nt, Shigella flexneri 2a str. 2457T
ugcccaccgacgcagucaugc

SEQ ID NO: 3825363 - RNA, 18 nt, Shigella flexneri 2a str. 2457T
ugcccaccgguuuccggg

SEQ ID NO: 3825364 - RNA, 19 nt, Shigella flexneri 2a str. 2457T
ugcccaccugcggcaccua

SEQ ID NO: 3825365 - RNA, 15 nt, Shigella flexneri 2a str. 2457T
ugcccacgccgcauu

SEQ ID NO: 3825366 - RNA, 22 nt, Shigella flexneri 2a str. 2457T
ugcccacgcgcacgcugguaac

SEQ ID NO: 3825367 - RNA, 18 nt, Shigella flexneri 2a str. 2457T
ugcccacgggcaggcuuu

SEQ ID NO: 3825368 - RNA, 13 nt, Shigella flexneri 2a str. 2457T
ugcccaucucuuc

SEQ ID NO: 3825369 - RNA, 22 nt, Shigella flexneri 2a str. 2457T
ugcccaugauaguguccauuaa

SEQ ID NO: 3825370 - RNA, 16 nt, Shigella flexneri 2a str. 2457T
ugcccauguaguaccc

SEQ ID NO: 3825371 - RNA, 13 nt, Shigella flexneri 2a str. 2457T
ugccccaguuccu

SEQ ID NO: 3825372 - RNA, 22 nt, Shigella flexneri 2a str. 2457T
ugcccccaacuuugugcaauug

SEQ ID NO: 3825373 - RNA, 14 nt, Shigella flexneri 2a str. 2457T
ugcccccagcagcg

SEQ ID NO: 3825374 - RNA, 16 nt, Shigella flexneri 2a str. 2457T
ugcccccucacaugag

SEQ ID NO: 3825375 - RNA, 19 nt, Shigella flexneri 2a str. 2457T
ugcccgaccagauaagaac

SEQ ID NO: 3825376 - RNA, 19 nt, Shigella flexneri 2a str. 2457T
ugcccgagauacaucaccg

SEQ ID NO: 3825377 - RNA, 18 nt, Shigella flexneri 2a str. 2457T
ugcccgaugaccuuguca

SEQ ID NO: 3825378 - RNA, 23 nt, Shigella flexneri 2a str. 2457T
ugcccgaugaccuugucaugcag

SEQ ID NO: 3825379 - RNA, 19 nt, Shigella flexneri 2a str. 2457T
ugcccgcaacggcugcuuc

SEQ ID NO: 3825380 - RNA, 13 nt, Shigella flexneri 2a str. 2457T
ugcccgcaucugc

SEQ ID NO: 3825381 - RNA, 16 nt, Shigella flexneri 2a str. 2457T
ugcccgccccggcgau

SEQ ID NO: 3825382 - RNA, 17 nt, Shigella flexneri 2a str. 2457T
ugcccgcccgacaaagc

SEQ ID NO: 3825383 - RNA, 20 nt, Shigella flexneri 2a str. 2457T
ugcccgcgagcguggaacuu

SEQ ID NO: 3825384 - RNA, 22 nt, Shigella flexneri 2a str. 2457T
ugcccgcuuaacguacugcuga

SEQ ID NO: 3825385 - RNA, 15 nt, Shigella flexneri 2a str. 2457T
ugcccgcuugagaca

SEQ ID NO: 3825386 - RNA, 17 nt, Shigella flexneri 2a str. 2457T
ugcccggagcagcaguc

SEQ ID NO: 3825387 - RNA, 14 nt, Shigella flexneri 2a str. 2457T
ugcccggucaggau

SEQ ID NO: 3825388 - RNA, 16 nt, Shigella flexneri 2a str. 2457T
ugcccgugacucccac

SEQ ID NO: 3825389 - RNA, 14 nt, Shigella flexneri 2a str. 2457T
ugcccgugcugaca

SEQ ID NO: 3825390 - RNA, 14 nt, Shigella flexneri 2a str. 2457T
ugcccguuccaggc

SEQ ID NO: 3825391 - RNA, 17 nt, Shigella flexneri 2a str. 2457T
ugcccguuccaggcgau

SEQ ID NO: 3825392 - RNA, 16 nt, Shigella flexneri 2a str. 2457T
ugcccguugccaggac

SEQ ID NO: 3825393 - RNA, 17 nt, Shigella flexneri 2a str. 2457T
ugcccucaauaucuuuc

SEQ ID NO: 3825394 - RNA, 15 nt, Shigella flexneri 2a str. 2457T
ugcccugcuaugcaa

SEQ ID NO: 3825395 - RNA, 13 nt, Shigella flexneri 2a str. 2457T
ugcccugcuggug

SEQ ID NO: 3825396 - RNA, 16 nt, Shigella flexneri 2a str. 2457T
ugcccuggcgcgaaac

SEQ ID NO: 3825397 - RNA, 22 nt, Shigella flexneri 2a str. 2457T
ugcccuguuugucgaucaucag

SEQ ID NO: 3825398 - RNA, 14 nt, Shigella flexneri 2a str. 2457T
ugcccuugccaacg

SEQ ID NO: 3825399 - RNA, 21 nt, Shigella flexneri 2a str. 2457T
ugccgaaaaaagucauuacca

SEQ ID NO: 3825400 - RNA, 14 nt, Shigella flexneri 2a str. 2457T
ugccgaaccacuga

SEQ ID NO: 3825401 - RNA, 16 nt, Shigella flexneri 2a str. 2457T
ugccgaagaacauaaa

SEQ ID NO: 3825402 - RNA, 17 nt, Shigella flexneri 2a str. 2457T
ugccgaagcagucaaca

SEQ ID NO: 3825403 - RNA, 13 nt, Shigella flexneri 2a str. 2457T
ugccgacaaaugc

SEQ ID NO: 3825404 - RNA, 23 nt, Shigella flexneri 2a str. 2457T
ugccgacaaaugcaguuuuuaau

SEQ ID NO: 3825405 - RNA, 15 nt, Shigella flexneri 2a str. 2457T
ugccgacaucgccac

SEQ ID NO: 3825406 - RNA, 18 nt, Shigella flexneri 2a str. 2457T
ugccgaucaccacggaaa

SEQ ID NO: 3825407 - RNA, 16 nt, Shigella flexneri 2a str. 2457T
ugccgauggcaaaagu

SEQ ID NO: 3825408 - RNA, 13 nt, Shigella flexneri 2a str. 2457T
ugccgcaauggcc

SEQ ID NO: 3825409 - RNA, 15 nt, Shigella flexneri 2a str. 2457T
ugccgcaauggccgu

SEQ ID NO: 3825410 - RNA, 13 nt, Shigella flexneri 2a str. 2457T
ugccgcacaucac

SEQ ID NO: 3825411 - RNA, 15 nt, Shigella flexneri 2a str. 2457T
ugccgcacaucaccg

SEQ ID NO: 3825412 - RNA, 15 nt, Shigella flexneri 2a str. 2457T
ugccgcacauuuccc

SEQ ID NO: 3825413 - RNA, 13 nt, Shigella flexneri 2a str. 2457T
ugccgcagcaccc

SEQ ID NO: 3825414 - RNA, 22 nt, Shigella flexneri 2a str. 2457T
ugccgcagcuucuguuauucca

SEQ ID NO: 3825415 - RNA, 15 nt, Shigella flexneri 2a str. 2457T
ugccgcauccggcau

SEQ ID NO: 3825416 - RNA, 16 nt, Shigella flexneri 2a str. 2457T
ugccgcauccggcaua

SEQ ID NO: 3825417 - RNA, 20 nt, Shigella flexneri 2a str. 2457T
ugccgcauuucgugcgggua

SEQ ID NO: 3825418 - RNA, 15 nt, Shigella flexneri 2a str. 2457T
ugccgcccagaagca

SEQ ID NO: 3825419 - RNA, 16 nt, Shigella flexneri 2a str. 2457T
ugccgcccguuuucuc

SEQ ID NO: 3825420 - RNA, 17 nt, Shigella flexneri 2a str. 2457T
ugccgcccuaaagggcg

SEQ ID NO: 3825421 - RNA, 18 nt, Shigella flexneri 2a str. 2457T
ugccgccggaaacauaaa

SEQ ID NO: 3825422 - RNA, 13 nt, Shigella flexneri 2a str. 2457T
ugccgccucugcc

SEQ ID NO: 3825423 - RNA, 16 nt, Shigella flexneri 2a str. 2457T
ugccgccucugccgca

SEQ ID NO: 3825424 - RNA, 22 nt, Shigella flexneri 2a str. 2457T
ugccgcgcagggacacucgcug

SEQ ID NO: 3825425 - RNA, 20 nt, Shigella flexneri 2a str. 2457T
ugccgcgccucuuacgcgaa

SEQ ID NO: 3825426 - RNA, 18 nt, Shigella flexneri 2a str. 2457T
ugccgcguuggcaauguc

SEQ ID NO: 3825427 - RNA, 22 nt, Shigella flexneri 2a str. 2457T
ugccgcuaauggugcgcgcacu

SEQ ID NO: 3825428 - RNA, 22 nt, Shigella flexneri 2a str. 2457T
ugccgcugguguugcugaccaa

SEQ ID NO: 3825429 - RNA, 13 nt, Shigella flexneri 2a str. 2457T
ugccgcuuccagc

SEQ ID NO: 3825430 - RNA, 17 nt, Shigella flexneri 2a str. 2457T
ugccgcuuccagcagac

SEQ ID NO: 3825431 - RNA, 19 nt, Shigella flexneri 2a str. 2457T
ugccgcuuuaugugcuucu

SEQ ID NO: 3825432 - RNA, 15 nt, Shigella flexneri 2a str. 2457T
ugccgcuuuuuccag

SEQ ID NO: 3825433 - RNA, 21 nt, Shigella flexneri 2a str. 2457T
ugccggaaggcagccuuucuc

SEQ ID NO: 3825434 - RNA, 15 nt, Shigella flexneri 2a str. 2457T
ugccggaauauauuc

SEQ ID NO: 3825435 - RNA, 21 nt, Shigella flexneri 2a str. 2457T
ugccggaggaguaucugcugu

SEQ ID NO: 3825436 - RNA, 18 nt, Shigella flexneri 2a str. 2457T
ugccggagucgcauuaac

SEQ ID NO: 3825437 - RNA, 16 nt, Shigella flexneri 2a str. 2457T
ugccggauaaauuaaa

SEQ ID NO: 3825438 - RNA, 15 nt, Shigella flexneri 2a str. 2457T
ugccggauagcgugu

SEQ ID NO: 3825439 - RNA, 15 nt, Shigella flexneri 2a str. 2457T
ugccggaucaggcgu

SEQ ID NO: 3825440 - RNA, 14 nt, Shigella flexneri 2a str. 2457T
ugccggaugacaga

SEQ ID NO: 3825441 - RNA, 15 nt, Shigella flexneri 2a str. 2457T
ugccggaugcaucgc

SEQ ID NO: 3825442 - RNA, 15 nt, Shigella flexneri 2a str. 2457T
ugccggaugcggcgu

SEQ ID NO: 3825443 - RNA, 17 nt, Shigella flexneri 2a str. 2457T
ugccggaugugaugcau

SEQ ID NO: 3825444 - RNA, 21 nt, Shigella flexneri 2a str. 2457T
ugccggcaucaaacgguugau

SEQ ID NO: 3825445 - RNA, 16 nt, Shigella flexneri 2a str. 2457T
ugccggccagcgccac

SEQ ID NO: 3825446 - RNA, 17 nt, Shigella flexneri 2a str. 2457T
ugccgguagaagccagu

SEQ ID NO: 3825447 - RNA, 18 nt, Shigella flexneri 2a str. 2457T
ugccgguagaagccaguc

SEQ ID NO: 3825448 - RNA, 19 nt, Shigella flexneri 2a str. 2457T
ugccgguagaagccaguca

SEQ ID NO: 3825449 - RNA, 21 nt, Shigella flexneri 2a str. 2457T
ugccggucgcgcgggaaauca

SEQ ID NO: 3825450 - RNA, 17 nt, Shigella flexneri 2a str. 2457T
ugcgcaucaugccaccc

SEQ ID NO: 3825451 - RNA, 20 nt, Shigella flexneri 2a str. 2457T
ugcgcaucaugccacccagg

SEQ ID NO: 3825452 - RNA, 17 nt, Shigella flexneri 2a str. 2457T
ugcgcauucuacuuugc

SEQ ID NO: 3825453 - RNA, 23 nt, Shigella flexneri 2a str. 2457T
ugcgccaaaugucagcugccagu

SEQ ID NO: 3825454 - RNA, 15 nt, Shigella flexneri 2a str. 2457T
ugcgccaauugccag

SEQ ID NO: 3825455 - RNA, 17 nt, Shigella flexneri 2a str. 2457T
ugcgccacaccacugcg

SEQ ID NO: 3825456 - RNA, 18 nt, Shigella flexneri 2a str. 2457T
ugcgccacaggucagcag

SEQ ID NO: 3825457 - RNA, 17 nt, Shigella flexneri 2a str. 2457T
ugcgccacuucccagcc

SEQ ID NO: 3825458 - RNA, 20 nt, Shigella flexneri 2a str. 2457T
ugcgccagacccagacgcuc

SEQ ID NO: 3825459 - RNA, 14 nt, Shigella flexneri 2a str. 2457T
ugcgccagagcgcg

SEQ ID NO: 3825460 - RNA, 13 nt, Shigella flexneri 2a str. 2457T
ugcgccagcaucg

SEQ ID NO: 3825461 - RNA, 17 nt, Shigella flexneri 2a str. 2457T
ugcgccagcaucgcauc

SEQ ID NO: 3825462 - RNA, 13 nt, Shigella flexneri 2a str. 2457T
ugcgccagcgcgc

SEQ ID NO: 3825463 - RNA, 17 nt, Shigella flexneri 2a str. 2457T
ugcgccagcgcgcguug

SEQ ID NO: 3825464 - RNA, 18 nt, Shigella flexneri 2a str. 2457T
ugcgccagcguuacuuca

SEQ ID NO: 3825465 - RNA, 12 nt, Shigella flexneri 2a str. 2457T
ugcgccagcucg

SEQ ID NO: 3825466 - RNA, 17 nt, Shigella flexneri 2a str. 2457T
ugcgccaguagggcguc

SEQ ID NO: 3825467 - RNA, 18 nt, Shigella flexneri 2a str. 2457T
ugcgccaucggcagcauc

SEQ ID NO: 3825468 - RNA, 20 nt, Shigella flexneri 2a str. 2457T
ugcgccaugcuucaauuucc

SEQ ID NO: 3825469 - RNA, 21 nt, Shigella flexneri 2a str. 2457T
ugcgccauuuuuuugucugcu

SEQ ID NO: 3825470 - RNA, 15 nt, Shigella flexneri 2a str. 2457T
ugcgcccugggcuuc

SEQ ID NO: 3825471 - RNA, 19 nt, Shigella flexneri 2a str. 2457T
ugcgccgccucugcgcuuu

SEQ ID NO: 3825472 - RNA, 16 nt, Shigella flexneri 2a str. 2457T
ugcgccguuuuuuuuc

SEQ ID NO: 3825473 - RNA, 20 nt, Shigella flexneri 2a str. 2457T
ugcgccuacggcauucugca

SEQ ID NO: 3825474 - RNA, 14 nt, Shigella flexneri 2a str. 2457T
ugcgccugcuaaac

SEQ ID NO: 3825475 - RNA, 17 nt, Shigella flexneri 2a str. 2457T
ugcgcgacuucauucag

SEQ ID NO: 3825476 - RNA, 13 nt, Shigella flexneri 2a str. 2457T
ugcgcgcaaucag

SEQ ID NO: 3825477 - RNA, 18 nt, Shigella flexneri 2a str. 2457T
ugcgcgcaaucagcaccg

SEQ ID NO: 3825478 - RNA, 19 nt, Shigella flexneri 2a str. 2457T
ugcgcggauccacaccuga

SEQ ID NO: 3825479 - RNA, 13 nt, Shigella flexneri 2a str. 2457T
ugcgcggcgacuu

SEQ ID NO: 3825480 - RNA, 22 nt, Shigella flexneri 2a str. 2457T
ugcgcguaacgaucgccuggua

SEQ ID NO: 3825481 - RNA, 13 nt, Shigella flexneri 2a str. 2457T
ugcgcgucuuauc

SEQ ID NO: 3825482 - RNA, 23 nt, Shigella flexneri 2a str. 2457T
ugcgcgucuuaucaggccugugg

SEQ ID NO: 3825483 - RNA, 14 nt, Shigella flexneri 2a str. 2457T
ugcgcgugcagugg

SEQ ID NO: 3825484 - RNA, 14 nt, Shigella flexneri 2a str. 2457T
ugcgcuaccaggaa

SEQ ID NO: 3825485 - RNA, 20 nt, Shigella flexneri 2a str. 2457T
ugcgcuacgcuuaucaggcc

SEQ ID NO: 3825486 - RNA, 17 nt, Shigella flexneri 2a str. 2457T
ugcgcuauccagcgcau

SEQ ID NO: 3825487 - RNA, 22 nt, Shigella flexneri 2a str. 2457T
ugcgcucuucaacuucagcagc

SEQ ID NO: 3825488 - RNA, 15 nt, Shigella flexneri 2a str. 2457T
ugcgcugcgcuuauc

SEQ ID NO: 3825489 - RNA, 13 nt, Shigella flexneri 2a str. 2457T
ugcgcuggcaguu

SEQ ID NO: 3825490 - RNA, 15 nt, Shigella flexneri 2a str. 2457T
ugcgcugugugugcu

SEQ ID NO: 3825491 - RNA, 22 nt, Shigella flexneri 2a str. 2457T
ugcgcuuauccggcccacauca

SEQ ID NO: 3825492 - RNA, 13 nt, Shigella flexneri 2a str. 2457T
ugcgcuucaccag

SEQ ID NO: 3825493 - RNA, 13 nt, Shigella flexneri 2a str. 2457T
ugcgcuuccagcu

SEQ ID NO: 3825494 - RNA, 13 nt, Shigella flexneri 2a str. 2457T
ugcgcuuccugca

SEQ ID NO: 3825495 - RNA, 16 nt, Shigella flexneri 2a str. 2457T
ugcgcuuccugcaacg

SEQ ID NO: 3825496 - RNA, 16 nt, Shigella flexneri 2a str. 2457T
ugcgcuuuauucagau

SEQ ID NO: 3825497 - RNA, 18 nt, Shigella flexneri 2a str. 2457T
ugcgcuuucgcaccaaca

SEQ ID NO: 3825498 - RNA, 19 nt, Shigella flexneri 2a str. 2457T
ugcggaagucgcagcugcc

SEQ ID NO: 3825499 - RNA, 15 nt, Shigella flexneri 2a str. 2457T
ugcggaaugagcgau

SEQ ID NO: 3825500 - RNA, 18 nt, Shigella flexneri 2a str. 2457T
ugcggagaaggugaagaa

SEQ ID NO: 3825501 - RNA, 17 nt, Shigella flexneri 2a str. 2457T
ugcggauauugccggau

SEQ ID NO: 3825502 - RNA, 18 nt, Shigella flexneri 2a str. 2457T
ugcggauugucauagcga

SEQ ID NO: 3825503 - RNA, 22 nt, Shigella flexneri 2a str. 2457T
ugcggcacccauuuauccagcg

SEQ ID NO: 3825504 - RNA, 13 nt, Shigella flexneri 2a str. 2457T
ugcggcagcucca

SEQ ID NO: 3825505 - RNA, 12 nt, Shigella flexneri 2a str. 2457T
ugcggccagcag

SEQ ID NO: 3825506 - RNA, 19 nt, Shigella flexneri 2a str. 2457T
ugcggcgaaaacgccacau

SEQ ID NO: 3825507 - RNA, 20 nt, Shigella flexneri 2a str. 2457T
ugcggcgaaaacgccuuauc

SEQ ID NO: 3825508 - RNA, 23 nt, Shigella flexneri 2a str. 2457T
ugcggcgacaaauguugcaucgc

SEQ ID NO: 3825509 - RNA, 14 nt, Shigella flexneri 2a str. 2457T
ugcggcgaggaauc

SEQ ID NO: 3825510 - RNA, 17 nt, Shigella flexneri 2a str. 2457T
ugcggcggcggaaaaag

SEQ ID NO: 3825511 - RNA, 16 nt, Shigella flexneri 2a str. 2457T
ugcggcguaaaugccu

SEQ ID NO: 3825512 - RNA, 17 nt, Shigella flexneri 2a str. 2457T
ugcggcgugaacgccuu

SEQ ID NO: 3825513 - RNA, 20 nt, Shigella flexneri 2a str. 2457T
ugcggcgugaacgccuuauc

SEQ ID NO: 3825514 - RNA, 20 nt, Shigella flexneri 2a str. 2457T
ugcggcgugaaugccuuauc

SEQ ID NO: 3825515 - RNA, 17 nt, Shigella flexneri 2a str. 2457T
ugcggcgugggcgcugu

SEQ ID NO: 3825516 - RNA, 20 nt, Shigella flexneri 2a str. 2457T
ugcggcguuaacgccuuauc

SEQ ID NO: 3825517 - RNA, 15 nt, Shigella flexneri 2a str. 2457T
ugcggcguucaucgc

SEQ ID NO: 3825518 - RNA, 19 nt, Shigella flexneri 2a str. 2457T
ugcggcucucuuucuccag

SEQ ID NO: 3825519 - RNA, 13 nt, Shigella flexneri 2a str. 2457T
ugcggcugcaucu

SEQ ID NO: 3825520 - RNA, 14 nt, Shigella flexneri 2a str. 2457T
ugcggcugcaucuc

SEQ ID NO: 3825521 - RNA, 20 nt, Shigella flexneri 2a str. 2457T
ugcggcugguuacucaccag

SEQ ID NO: 3825522 - RNA, 19 nt, Shigella flexneri 2a str. 2457T
ugcggcuuauucauuacuu

SEQ ID NO: 3825523 - RNA, 23 nt, Shigella flexneri 2a str. 2457T
ugcgggagcgcuuuuuuccugcc

SEQ ID NO: 3825524 - RNA, 15 nt, Shigella flexneri 2a str. 2457T
ugcgggaguggcgaa

SEQ ID NO: 3825525 - RNA, 15 nt, Shigella flexneri 2a str. 2457T
ugcgggcaucaucuu

SEQ ID NO: 3825526 - RNA, 17 nt, Shigella flexneri 2a str. 2457T
ugcgggcgcaagggcug

SEQ ID NO: 3825527 - RNA, 16 nt, Shigella flexneri 2a str. 2457T
ugcgggucaggccagg

SEQ ID NO: 3825528 - RNA, 17 nt, Shigella flexneri 2a str. 2457T
ugcgggucaggccagga

SEQ ID NO: 3825529 - RNA, 18 nt, Shigella flexneri 2a str. 2457T
ugcggguuagucugcauu

SEQ ID NO: 3825530 - RNA, 22 nt, Shigella flexneri 2a str. 2457T
ugcgguaagguugucgauacca

SEQ ID NO: 3825531 - RNA, 22 nt, Shigella flexneri 2a str. 2457T
ugcgguaguuucuccccaugga

SEQ ID NO: 3825532 - RNA, 17 nt, Shigella flexneri 2a str. 2457T
ugcggucaaaagcugca

SEQ ID NO: 3825533 - RNA, 20 nt, Shigella flexneri 2a str. 2457T
ugcgguccaugcgaagaccg

SEQ ID NO: 3825534 - RNA, 12 nt, Shigella flexneri 2a str. 2457T
ugcggucgcuga

SEQ ID NO: 3825535 - RNA, 20 nt, Shigella flexneri 2a str. 2457T
ugcggucguaugcuggaagc

SEQ ID NO: 3825536 - RNA, 22 nt, Shigella flexneri 2a str. 2457T
ugcggucguaugcuggaagcgc

SEQ ID NO: 3825537 - RNA, 21 nt, Shigella flexneri 2a str. 2457T
ugcggucuaaaucuuccgccg

SEQ ID NO: 3825538 - RNA, 19 nt, Shigella flexneri 2a str. 2457T
ugcggugccauuaaaccaa

SEQ ID NO: 3825539 - RNA, 13 nt, Shigella flexneri 2a str. 2457T
ugcgguggaguua

SEQ ID NO: 3825540 - RNA, 15 nt, Shigella flexneri 2a str. 2457T
ugcgguuaaugguug

SEQ ID NO: 3825541 - RNA, 16 nt, Shigella flexneri 2a str. 2457T
ugcguaaucgccgaac

SEQ ID NO: 3825542 - RNA, 14 nt, Shigella flexneri 2a str. 2457T
ugcguaauguuuag

SEQ ID NO: 3825543 - RNA, 15 nt, Shigella flexneri 2a str. 2457T
ugcguacaccaacau

SEQ ID NO: 3825544 - RNA, 17 nt, Shigella flexneri 2a str. 2457T
ugcguacaccaacauca

SEQ ID NO: 3825545 - RNA, 18 nt, Shigella flexneri 2a str. 2457T
ugcguacaccaacaucac

SEQ ID NO: 3825546 - RNA, 22 nt, Shigella flexneri 2a str. 2457T
ugcguacauugccgacauggca

SEQ ID NO: 3825547 - RNA, 17 nt, Shigella flexneri 2a str. 2457T
ugcguacuggcauuuau

SEQ ID NO: 3825548 - RNA, 22 nt, Shigella flexneri 2a str. 2457T
ugcucugccagacgguaacccc

SEQ ID NO: 3825549 - RNA, 13 nt, Shigella flexneri 2a str. 2457T
ugcucuggugcgg

SEQ ID NO: 3825550 - RNA, 16 nt, Shigella flexneri 2a str. 2457T
ugcucuguuuucucac

SEQ ID NO: 3825551 - RNA, 12 nt, Shigella flexneri 2a str. 2457T
ugcucuucuuuc

SEQ ID NO: 3825552 - RNA, 16 nt, Shigella flexneri 2a str. 2457T
ugcucuuuauaauuau

SEQ ID NO: 3825553 - RNA, 11 nt, Shigella flexneri 2a str. 2457T
ugcucuuucag

SEQ ID NO: 3825554 - RNA, 16 nt, Shigella flexneri 2a str. 2457T
ugcucuuucagcaccg

SEQ ID NO: 3825555 - RNA, 16 nt, Shigella flexneri 2a str. 2457T
ugcucuuuucuuuauc

SEQ ID NO: 3825556 - RNA, 13 nt, Shigella flexneri 2a str. 2457T
ugcugaaaucaca

SEQ ID NO: 3825557 - RNA, 19 nt, Shigella flexneri 2a str. 2457T
ugcugaacagcuuuuuccu

SEQ ID NO: 3825558 - RNA, 16 nt, Shigella flexneri 2a str. 2457T
ugcugaauccccuucu

SEQ ID NO: 3825559 - RNA, 15 nt, Shigella flexneri 2a str. 2457T
ugcugacaaugugcu

SEQ ID NO: 3825560 - RNA, 15 nt, Shigella flexneri 2a str. 2457T
ugcugaccaccagca

SEQ ID NO: 3825561 - RNA, 20 nt, Shigella flexneri 2a str. 2457T
ugcugacgcagauccugauu

SEQ ID NO: 3825562 - RNA, 15 nt, Shigella flexneri 2a str. 2457T
ugcugauaacgugca

SEQ ID NO: 3825563 - RNA, 17 nt, Shigella flexneri 2a str. 2457T
ugcugauaacgugcagc

SEQ ID NO: 3825564 - RNA, 14 nt, Shigella flexneri 2a str. 2457T
ugcugaugcacgau

SEQ ID NO: 3825565 - RNA, 16 nt, Shigella flexneri 2a str. 2457T
ugcugaugcacgcaga

SEQ ID NO: 3825566 - RNA, 22 nt, Shigella flexneri 2a str. 2457T
ugcugaugcaggcgaucgacgu

SEQ ID NO: 3825567 - RNA, 21 nt, Shigella flexneri 2a str. 2457T
ugcugauggcgggauguguaa

SEQ ID NO: 3825568 - RNA, 19 nt, Shigella flexneri 2a str. 2457T
ugcugauuaucggcaucac

SEQ ID NO: 3825569 - RNA, 17 nt, Shigella flexneri 2a str. 2457T
ugcugcacauacugcau

SEQ ID NO: 3825570 - RNA, 22 nt, Shigella flexneri 2a str. 2457T
ugcugcacauacugcaucagcg

SEQ ID NO: 3825571 - RNA, 21 nt, Shigella flexneri 2a str. 2457T
ugcugcaccaacaucaugcca

SEQ ID NO: 3825572 - RNA, 14 nt, Shigella flexneri 2a str. 2457T
ugcugcacgaaauu

SEQ ID NO: 3825573 - RNA, 20 nt, Shigella flexneri 2a str. 2457T
ugcugcauugagguaaacag

SEQ ID NO: 3825574 - RNA, 16 nt, Shigella flexneri 2a str. 2457T
ugcugccgccaguucu

SEQ ID NO: 3825575 - RNA, 16 nt, Shigella flexneri 2a str. 2457T
ugcugccguuuuuauu

SEQ ID NO: 3825576 - RNA, 16 nt, Shigella flexneri 2a str. 2457T
ugcugccuucacggcu

SEQ ID NO: 3825577 - RNA, 22 nt, Shigella flexneri 2a str. 2457T
ugcugcguuugcccuaaagcgc

SEQ ID NO: 3825578 - RNA, 12 nt, Shigella flexneri 2a str. 2457T
ugcugcucugaa

SEQ ID NO: 3825579 - RNA, 15 nt, Shigella flexneri 2a str. 2457T
ugcugcugauccagc

SEQ ID NO: 3825580 - RNA, 18 nt, Shigella flexneri 2a str. 2457T
ugcugcugauccagcuuc

SEQ ID NO: 3825581 - RNA, 20 nt, Shigella flexneri 2a str. 2457T
ugcugcuggaagguaaggau

SEQ ID NO: 3825582 - RNA, 18 nt, Shigella flexneri 2a str. 2457T
ugcugcuuuaucagauca

SEQ ID NO: 3825583 - RNA, 19 nt, Shigella flexneri 2a str. 2457T
ugcuggaacaaacugccgc

SEQ ID NO: 3825584 - RNA, 15 nt, Shigella flexneri 2a str. 2457T
ugcuggaagcuggca

SEQ ID NO: 3825585 - RNA, 22 nt, Shigella flexneri 2a str. 2457T
ugcuggaccuuaucgaagaggg

SEQ ID NO: 3825586 - RNA, 13 nt, Shigella flexneri 2a str. 2457T
ugcuggacgcauu

SEQ ID NO: 3825587 - RNA, 16 nt, Shigella flexneri 2a str. 2457T
ugcuggacgcauugca

SEQ ID NO: 3825588 - RNA, 14 nt, Shigella flexneri 2a str. 2457T
ugcuggauaagaug

SEQ ID NO: 3825589 - RNA, 22 nt, Shigella flexneri 2a str. 2457T
ugcuggcaacauggauucgaug

SEQ ID NO: 3825590 - RNA, 16 nt, Shigella flexneri 2a str. 2457T
ugcuggcagauaaauu

SEQ ID NO: 3825591 - RNA, 18 nt, Shigella flexneri 2a str. 2457T
ugcuggcaugaaugguca

SEQ ID NO: 3825592 - RNA, 12 nt, Shigella flexneri 2a str. 2457T
ugcuggcauuac

SEQ ID NO: 3825593 - RNA, 17 nt, Shigella flexneri 2a str. 2457T
ugcuggcguugucaucg

SEQ ID NO: 3825594 - RNA, 16 nt, Shigella flexneri 2a str. 2457T
ugcuggcuuacgcuga

SEQ ID NO: 3825595 - RNA, 21 nt, Shigella flexneri 2a str. 2457T
ugcuggggauucguuuuucuu

SEQ ID NO: 3825596 - RNA, 16 nt, Shigella flexneri 2a str. 2457T
ugcuggggccgucauu

SEQ ID NO: 3825597 - RNA, 17 nt, Shigella flexneri 2a str. 2457T
ugcuggguuauuucauu

SEQ ID NO: 3825598 - RNA, 15 nt, Shigella flexneri 2a str. 2457T
ugcugguagaagcug

SEQ ID NO: 3825599 - RNA, 16 nt, Shigella flexneri 2a str. 2457T
ugcugguagaagcugg

SEQ ID NO: 3825600 - RNA, 18 nt, Shigella flexneri 2a str. 2457T
ugcugguauuuccagucc

SEQ ID NO: 3825601 - RNA, 13 nt, Shigella flexneri 2a str. 2457T
ugcuggugguggu

SEQ ID NO: 3825602 - RNA, 21 nt, Shigella flexneri 2a str. 2457T
ugcugguucugcggguuaguc

SEQ ID NO: 3825603 - RNA, 11 nt, Shigella flexneri 2a str. 2457T
ugcugguuuug

SEQ ID NO: 3825604 - RNA, 18 nt, Shigella flexneri 2a str. 2457T
ugcugguuuugugcgcca

SEQ ID NO: 3825605 - RNA, 19 nt, Shigella flexneri 2a str. 2457T
ugcuguaaauucucaauau

SEQ ID NO: 3825606 - RNA, 18 nt, Shigella flexneri 2a str. 2457T
ugcuguaaauugccgucg

SEQ ID NO: 3825607 - RNA, 21 nt, Shigella flexneri 2a str. 2457T
ugcuguaauuucacaccauca

SEQ ID NO: 3825608 - RNA, 17 nt, Shigella flexneri 2a str. 2457T
ugcugucaccgaagcgg

SEQ ID NO: 3825609 - RNA, 13 nt, Shigella flexneri 2a str. 2457T
ugcugugccggaa

SEQ ID NO: 3825610 - RNA, 17 nt, Shigella flexneri 2a str. 2457T
ugcugugccggaagggg

SEQ ID NO: 3825611 - RNA, 17 nt, Shigella flexneri 2a str. 2457T
ugcuguggauucagcac

SEQ ID NO: 3825612 - RNA, 18 nt, Shigella flexneri 2a str. 2457T
ugcuguggauucagcacc

SEQ ID NO: 3825613 - RNA, 15 nt, Shigella flexneri 2a str. 2457T
ugcugugguuugccc

SEQ ID NO: 3825614 - RNA, 15 nt, Shigella flexneri 2a str. 2457T
ugcugugugccgcga

SEQ ID NO: 3825615 - RNA, 18 nt, Shigella flexneri 2a str. 2457T
ugcuguuaauucaggauu

SEQ ID NO: 3825616 - RNA, 15 nt, Shigella flexneri 2a str. 2457T
ugcuguugaugcgua

SEQ ID NO: 3825617 - RNA, 15 nt, Shigella flexneri 2a str. 2457T
ugcuguuuccaguaa

SEQ ID NO: 3825618 - RNA, 12 nt, Shigella flexneri 2a str. 2457T
ugcuguuuuaca

SEQ ID NO: 3825619 - RNA, 19 nt, Shigella flexneri 2a str. 2457T
ugcuguuuuuucaggcccu

SEQ ID NO: 3825620 - RNA, 18 nt, Shigella flexneri 2a str. 2457T
ugcuuaaauuucuuacca

SEQ ID NO: 3825621 - RNA, 23 nt, Shigella flexneri 2a str. 2457T
ugcuuaaauuucuuaccacugcc

SEQ ID NO: 3825622 - RNA, 15 nt, Shigella flexneri 2a str. 2457T
ugcuuaaggcagaaa

SEQ ID NO: 3825623 - RNA, 23 nt, Shigella flexneri 2a str. 2457T
ugcuuaaggcagaaacaaacgca

SEQ ID NO: 3825624 - RNA, 17 nt, Shigella flexneri 2a str. 2457T
ugcuuacgcaacugcca

SEQ ID NO: 3825625 - RNA, 12 nt, Shigella flexneri 2a str. 2457T
ugcuuacguugu

SEQ ID NO: 3825626 - RNA, 21 nt, Shigella flexneri 2a str. 2457T
ugcuuaguaaaaauagugcgu

SEQ ID NO: 3825627 - RNA, 23 nt, Shigella flexneri 2a str. 2457T
ugcuuaucgcccugcuccagcaa

SEQ ID NO: 3825628 - RNA, 16 nt, Shigella flexneri 2a str. 2457T
ugcuuauggagucugc

SEQ ID NO: 3825629 - RNA, 15 nt, Shigella flexneri 2a str. 2457T
ugcuucaagaugcca

SEQ ID NO: 3825630 - RNA, 14 nt, Shigella flexneri 2a str. 2457T
ugcuucacacuggg

SEQ ID NO: 3825631 - RNA, 18 nt, Shigella flexneri 2a str. 2457T
ugcuucacgcccagaucc

SEQ ID NO: 3825632 - RNA, 19 nt, Shigella flexneri 2a str. 2457T
ugcuucacgcccagaucca

SEQ ID NO: 3825633 - RNA, 21 nt, Shigella flexneri 2a str. 2457T
ugcuucacgcggguugccacc

SEQ ID NO: 3825634 - RNA, 19 nt, Shigella flexneri 2a str. 2457T
ugcuucaggacuucuuugc

SEQ ID NO: 3825635 - RNA, 17 nt, Shigella flexneri 2a str. 2457T
ugcuuccgccagcggcg

SEQ ID NO: 3825636 - RNA, 22 nt, Shigella flexneri 2a str. 2457T
ugcuuccugaguaauaacuucc

SEQ ID NO: 3825637 - RNA, 22 nt, Shigella flexneri 2a str. 2457T
ugcuucggucagaauuucgacu

SEQ ID NO: 3825638 - RNA, 15 nt, Shigella flexneri 2a str. 2457T
ugcuucggucagcac

SEQ ID NO: 3825639 - RNA, 16 nt, Shigella flexneri 2a str. 2457T
ugcuucggucagcacg

SEQ ID NO: 3825640 - RNA, 22 nt, Shigella flexneri 2a str. 2457T
ugcuucguccaguuucacuuuc

SEQ ID NO: 3825641 - RNA, 22 nt, Shigella flexneri 2a str. 2457T
ugcuucucuucagccaacgcau

SEQ ID NO: 3825642 - RNA, 14 nt, Shigella flexneri 2a str. 2457T
ugcuucugccggag

SEQ ID NO: 3825643 - RNA, 13 nt, Shigella flexneri 2a str. 2457T
ugcuucugcuuca

SEQ ID NO: 3825644 - RNA, 16 nt, Shigella flexneri 2a str. 2457T
ugcuugaagggcuggc

SEQ ID NO: 3825645 - RNA, 18 nt, Shigella flexneri 2a str. 2457T
ugcuugaagggcuggcug

SEQ ID NO: 3825646 - RNA, 16 nt, Shigella flexneri 2a str. 2457T
uggcaacuuuaauaau

SEQ ID NO: 3825647 - RNA, 19 nt, Shigella flexneri 2a str. 2457T
uggcaagcggugcgaugcc

SEQ ID NO: 3825648 - RNA, 16 nt, Shigella flexneri 2a str. 2457T
uggcaauaaagacauc

SEQ ID NO: 3825649 - RNA, 18 nt, Shigella flexneri 2a str. 2457T
uggcaauaaagacauccg

SEQ ID NO: 3825650 - RNA, 19 nt, Shigella flexneri 2a str. 2457T
uggcaauagcgggacacua

SEQ ID NO: 3825651 - RNA, 21 nt, Shigella flexneri 2a str. 2457T
uggcaauccagcucuuuucca

SEQ ID NO: 3825652 - RNA, 16 nt, Shigella flexneri 2a str. 2457T
uggcaaucuuccucgc

SEQ ID NO: 3825653 - RNA, 21 nt, Shigella flexneri 2a str. 2457T
uggcaaugacuagcgccauaa

SEQ ID NO: 3825654 - RNA, 20 nt, Shigella flexneri 2a str. 2457T
uggcaaugagcaguuugguu

SEQ ID NO: 3825655 - RNA, 20 nt, Shigella flexneri 2a str. 2457T
uggcaaugcccgguguuccc

SEQ ID NO: 3825656 - RNA, 16 nt, Shigella flexneri 2a str. 2457T
uggcaaugcgcuguuu

SEQ ID NO: 3825657 - RNA, 22 nt, Shigella flexneri 2a str. 2457T
uggcacaaaaaaucgugcugca

SEQ ID NO: 3825658 - RNA, 23 nt, Shigella flexneri 2a str. 2457T
uggcacaaaaaaucgugcugcaa

SEQ ID NO: 3825659 - RNA, 12 nt, Shigella flexneri 2a str. 2457T
uggcacaacucg

SEQ ID NO: 3825660 - RNA, 22 nt, Shigella flexneri 2a str. 2457T
uggcacaggcaauagggcaacu

SEQ ID NO: 3825661 - RNA, 19 nt, Shigella flexneri 2a str. 2457T
uggcacaugcauaaagcgg

SEQ ID NO: 3825662 - RNA, 20 nt, Shigella flexneri 2a str. 2457T
uggcacaugcauaaagcggu

SEQ ID NO: 3825663 - RNA, 15 nt, Shigella flexneri 2a str. 2457T
uggcaccaaagggca

SEQ ID NO: 3825664 - RNA, 22 nt, Shigella flexneri 2a str. 2457T
uggcaccaggcguucauaucua

SEQ ID NO: 3825665 - RNA, 13 nt, Shigella flexneri 2a str. 2457T
uggcaccgcagau

SEQ ID NO: 3825666 - RNA, 18 nt, Shigella flexneri 2a str. 2457T
uggcacguaccaugcgca

SEQ ID NO: 3825667 - RNA, 19 nt, Shigella flexneri 2a str. 2457T
uggcacguugcugcggcgu

SEQ ID NO: 3825668 - RNA, 15 nt, Shigella flexneri 2a str. 2457T
uggcacucaacaacc

SEQ ID NO: 3825669 - RNA, 18 nt, Shigella flexneri 2a str. 2457T
uggcacugggaucagcuu

SEQ ID NO: 3825670 - RNA, 20 nt, Shigella flexneri 2a str. 2457T
uggcagaagagcguaaaguc

SEQ ID NO: 3825671 - RNA, 22 nt, Shigella flexneri 2a str. 2457T
uggcagaauuugaggaagcugc

SEQ ID NO: 3825672 - RNA, 18 nt, Shigella flexneri 2a str. 2457T
uggcagagccuguuacau

SEQ ID NO: 3825673 - RNA, 19 nt, Shigella flexneri 2a str. 2457T
uggcagaguaucgccaucc

SEQ ID NO: 3825674 - RNA, 20 nt, Shigella flexneri 2a str. 2457T
uggcagaguaucgccauccg

SEQ ID NO: 3825675 - RNA, 14 nt, Shigella flexneri 2a str. 2457T
uggcagaguugcca

SEQ ID NO: 3825676 - RNA, 17 nt, Shigella flexneri 2a str. 2457T
uggcagaguugccaccc

SEQ ID NO: 3825677 - RNA, 17 nt, Shigella flexneri 2a str. 2457T
uggcagauacauugcca

SEQ ID NO: 3825678 - RNA, 16 nt, Shigella flexneri 2a str. 2457T
uggcagauuaugcacu

SEQ ID NO: 3825679 - RNA, 18 nt, Shigella flexneri 2a str. 2457T
uggcagccauaaucacuc

SEQ ID NO: 3825680 - RNA, 23 nt, Shigella flexneri 2a str. 2457T
uggcagccauaaucacucuuccc

SEQ ID NO: 3825681 - RNA, 18 nt, Shigella flexneri 2a str. 2457T
uggcagcugcuacgccgu

SEQ ID NO: 3825682 - RNA, 19 nt, Shigella flexneri 2a str. 2457T
uggcaggaguggcagcaug

SEQ ID NO: 3825683 - RNA, 14 nt, Shigella flexneri 2a str. 2457T
uggcagucuggccu

SEQ ID NO: 3825684 - RNA, 13 nt, Shigella flexneri 2a str. 2457T
uggcagucuuaau

SEQ ID NO: 3825685 - RNA, 22 nt, Shigella flexneri 2a str. 2457T
uggcauaaacaaagcgcacuau

SEQ ID NO: 3825686 - RNA, 14 nt, Shigella flexneri 2a str. 2457T
uggcauauuccgcc

SEQ ID NO: 3825687 - RNA, 22 nt, Shigella flexneri 2a str. 2457T
uggcaucaaacacugaaccgaa

SEQ ID NO: 3825688 - RNA, 14 nt, Shigella flexneri 2a str. 2457T
uggcaucacuucuu

SEQ ID NO: 3825689 - RNA, 15 nt, Shigella flexneri 2a str. 2457T
uggcauccuguuuuc

SEQ ID NO: 3825690 - RNA, 13 nt, Shigella flexneri 2a str. 2457T
uggcauccuugcu

SEQ ID NO: 3825691 - RNA, 22 nt, Shigella flexneri 2a str. 2457T
uggcauccuugcuaaccaacaa

SEQ ID NO: 3825692 - RNA, 17 nt, Shigella flexneri 2a str. 2457T
uggcaucgauaucaacc

SEQ ID NO: 3825693 - RNA, 13 nt, Shigella flexneri 2a str. 2457T
uggcaucggcaaa

SEQ ID NO: 3825694 - RNA, 19 nt, Shigella flexneri 2a str. 2457T
uggcaucugauaagcccag

SEQ ID NO: 3825695 - RNA, 19 nt, Shigella flexneri 2a str. 2457T
uggcaugccgguagaagcc

SEQ ID NO: 3825696 - RNA, 20 nt, Shigella flexneri 2a str. 2457T
uggcaugcuguccagcaggc

SEQ ID NO: 3825697 - RNA, 15 nt, Shigella flexneri 2a str. 2457T
uggcauggcgcuggc

SEQ ID NO: 3825698 - RNA, 17 nt, Shigella flexneri 2a str. 2457T
uggcauggcgcuggcag

SEQ ID NO: 3825699 - RNA, 18 nt, Shigella flexneri 2a str. 2457T
uggcauguccuucuucug

SEQ ID NO: 3825700 - RNA, 17 nt, Shigella flexneri 2a str. 2457T
uggcauuaauaugcuca

SEQ ID NO: 3825701 - RNA, 17 nt, Shigella flexneri 2a str. 2457T
uggcauucucacuccag

SEQ ID NO: 3825702 - RNA, 18 nt, Shigella flexneri 2a str. 2457T
uggcauucucacuccagc

SEQ ID NO: 3825703 - RNA, 18 nt, Shigella flexneri 2a str. 2457T
uggcauuggccguugcca

SEQ ID NO: 3825704 - RNA, 17 nt, Shigella flexneri 2a str. 2457T
uggcauuuugcaguaac

SEQ ID NO: 3825705 - RNA, 15 nt, Shigella flexneri 2a str. 2457T
uggccaauuggcugg

SEQ ID NO: 3825706 - RNA, 19 nt, Shigella flexneri 2a str. 2457T
uggccaauuggcuggcccu

SEQ ID NO: 3825707 - RNA, 20 nt, Shigella flexneri 2a str. 2457T
uggccaauuggcuggcccuu

SEQ ID NO: 3825708 - RNA, 14 nt, Shigella flexneri 2a str. 2457T
uggccagagugcgu

SEQ ID NO: 3825709 - RNA, 16 nt, Shigella flexneri 2a str. 2457T
uggccauuucugccag

SEQ ID NO: 3825710 - RNA, 14 nt, Shigella flexneri 2a str. 2457T
uggcccaaaaggca

SEQ ID NO: 3825711 - RNA, 14 nt, Shigella flexneri 2a str. 2457T
uggcccaucgccag

SEQ ID NO: 3825712 - RNA, 15 nt, Shigella flexneri 2a str. 2457T
uggcccaucgccagu

SEQ ID NO: 3825713 - RNA, 11 nt, Shigella flexneri 2a str. 2457T
uggcccgccgc

SEQ ID NO: 3825714 - RNA, 16 nt, Shigella flexneri 2a str. 2457T
uggccgagaggcugaa

SEQ ID NO: 3825715 - RNA, 14 nt, Shigella flexneri 2a str. 2457T
uggccgcuuccagc

SEQ ID NO: 3825716 - RNA, 14 nt, Shigella flexneri 2a str. 2457T
uggccgugcagacc

SEQ ID NO: 3825717 - RNA, 18 nt, Shigella flexneri 2a str. 2457T
uggccgugcagaccgcug

SEQ ID NO: 3825718 - RNA, 15 nt, Shigella flexneri 2a str. 2457T
uggccguuauccuga

SEQ ID NO: 3825719 - RNA, 20 nt, Shigella flexneri 2a str. 2457T
uggccguuguugaacggcaa

SEQ ID NO: 3825720 - RNA, 23 nt, Shigella flexneri 2a str. 2457T
uggccuacgguucgggcacagau

SEQ ID NO: 3825721 - RNA, 21 nt, Shigella flexneri 2a str. 2457T
uggccucucuggccgcuucca

SEQ ID NO: 3825722 - RNA, 18 nt, Shigella flexneri 2a str. 2457T
uggccuuuaauaugccac

SEQ ID NO: 3825723 - RNA, 22 nt, Shigella flexneri 2a str. 2457T
uggcgaauggcacguugcugcg

SEQ ID NO: 3825724 - RNA, 18 nt, Shigella flexneri 2a str. 2457T
uggcgaccaaagccuuuc

SEQ ID NO: 3825725 - RNA, 22 nt, Shigella flexneri 2a str. 2457T
uggcgacgccgcgguucuucca

SEQ ID NO: 3825726 - RNA, 12 nt, Shigella flexneri 2a str. 2457T
uggcgagagccg

SEQ ID NO: 3825727 - RNA, 20 nt, Shigella flexneri 2a str. 2457T
uggcgauaaucagcgccagc

SEQ ID NO: 3825728 - RNA, 12 nt, Shigella flexneri 2a str. 2457T
uggcgauagccc

SEQ ID NO: 3825729 - RNA, 14 nt, Shigella flexneri 2a str. 2457T
uggcgcacauugug

SEQ ID NO: 3825730 - RNA, 20 nt, Shigella flexneri 2a str. 2457T
uggcgcaccuuuuuuuaugc

SEQ ID NO: 3825731 - RNA, 22 nt, Shigella flexneri 2a str. 2457T
uggcgcaguggauagacgcagg

SEQ ID NO: 3825732 - RNA, 13 nt, Shigella flexneri 2a str. 2457T
uggcgcagugggc

SEQ ID NO: 3825733 - RNA, 13 nt, Shigella flexneri 2a str. 2457T
uggcgcauccagc

SEQ ID NO: 3825734 - RNA, 16 nt, Shigella flexneri 2a str. 2457T
uggcgcaucggucaga

SEQ ID NO: 3825735 - RNA, 19 nt, Shigella flexneri 2a str. 2457T
uggcgcaucggucagaccc

SEQ ID NO: 3825736 - RNA, 21 nt, Shigella flexneri 2a str. 2457T
uggcgcgaaaacaacuggcaa

SEQ ID NO: 3825737 - RNA, 19 nt, Shigella flexneri 2a str. 2457T
uggcgcgaaccaucaccuc

SEQ ID NO: 3825738 - RNA, 22 nt, Shigella flexneri 2a str. 2457T
uggcgcgaagcccucaaacaac

SEQ ID NO: 3825739 - RNA, 13 nt, Shigella flexneri 2a str. 2457T
uggcgcguuauca

SEQ ID NO: 3825740 - RNA, 17 nt, Shigella flexneri 2a str. 2457T
uggcgcguuaucagcaa

SEQ ID NO: 3825741 - RNA, 22 nt, Shigella flexneri 2a str. 2457T
uggcgcucugguagauaagcaa

SEQ ID NO: 3825742 - RNA, 17 nt, Shigella flexneri 2a str. 2457T
uggcggaaaucuuucau

SEQ ID NO: 3825743 - RNA, 18 nt, Shigella flexneri 2a str. 2457T
uggguacgaaaagggcug

SEQ ID NO: 3825744 - RNA, 20 nt, Shigella flexneri 2a str. 2457T
uggguacgaaaagggcugga

SEQ ID NO: 3825745 - RNA, 19 nt, Shigella flexneri 2a str. 2457T
uggguauauuucaggccaa

SEQ ID NO: 3825746 - RNA, 18 nt, Shigella flexneri 2a str. 2457T
ugggucggcgauaaccau

SEQ ID NO: 3825747 - RNA, 16 nt, Shigella flexneri 2a str. 2457T
ugggugagcgaugcug

SEQ ID NO: 3825748 - RNA, 21 nt, Shigella flexneri 2a str. 2457T
ugggugccagaauuaacgcug

SEQ ID NO: 3825749 - RNA, 16 nt, Shigella flexneri 2a str. 2457T
ugggugcuugaggcug

SEQ ID NO: 3825750 - RNA, 20 nt, Shigella flexneri 2a str. 2457T
ugggugcuuuaaaaaagaau

SEQ ID NO: 3825751 - RNA, 21 nt, Shigella flexneri 2a str. 2457T
uggguucacuuuccccggcau

SEQ ID NO: 3825752 - RNA, 19 nt, Shigella flexneri 2a str. 2457T
ugguaaaaccgacuuaaaa

SEQ ID NO: 3825753 - RNA, 21 nt, Shigella flexneri 2a str. 2457T
ugguaacaccagagugaccgc

SEQ ID NO: 3825754 - RNA, 19 nt, Shigella flexneri 2a str. 2457T
ugguaacgccccacaaacc

SEQ ID NO: 3825755 - RNA, 17 nt, Shigella flexneri 2a str. 2457T
ugguaaucaccacccau

SEQ ID NO: 3825756 - RNA, 16 nt, Shigella flexneri 2a str. 2457T
ugguaaugaucgccgu

SEQ ID NO: 3825757 - RNA, 15 nt, Shigella flexneri 2a str. 2457T
ugguacauaacacaa

SEQ ID NO: 3825758 - RNA, 20 nt, Shigella flexneri 2a str. 2457T
ugguacuucaaucgccacca

SEQ ID NO: 3825759 - RNA, 15 nt, Shigella flexneri 2a str. 2457T
ugguagcugcccccg

SEQ ID NO: 3825760 - RNA, 21 nt, Shigella flexneri 2a str. 2457T
ugguauaaggcgcaauaauca

SEQ ID NO: 3825761 - RNA, 19 nt, Shigella flexneri 2a str. 2457T
ugguaucgcgccagccagu

SEQ ID NO: 3825762 - RNA, 17 nt, Shigella flexneri 2a str. 2457T
ugguauuaaauuugcuu

SEQ ID NO: 3825763 - RNA, 16 nt, Shigella flexneri 2a str. 2457T
ugguauuggaagguua

SEQ ID NO: 3825764 - RNA, 19 nt, Shigella flexneri 2a str. 2457T
ugguauuggaagguuaaua

SEQ ID NO: 3825765 - RNA, 18 nt, Shigella flexneri 2a str. 2457T
ugguauuuccaguccagc

SEQ ID NO: 3825766 - RNA, 19 nt, Shigella flexneri 2a str. 2457T
uggucagaaaaguaaacca

SEQ ID NO: 3825767 - RNA, 14 nt, Shigella flexneri 2a str. 2457T
uggucagaacgacc

SEQ ID NO: 3825768 - RNA, 17 nt, Shigella flexneri 2a str. 2457T
uggucagcggauacagg

SEQ ID NO: 3825769 - RNA, 17 nt, Shigella flexneri 2a str. 2457T
uggucaguacgccgccg

SEQ ID NO: 3825770 - RNA, 22 nt, Shigella flexneri 2a str. 2457T
uggucauaucaauaguaaccag

SEQ ID NO: 3825771 - RNA, 16 nt, Shigella flexneri 2a str. 2457T
uggucauuaugaccgu

SEQ ID NO: 3825772 - RNA, 20 nt, Shigella flexneri 2a str. 2457T
uggucauugccaggcaggau

SEQ ID NO: 3825773 - RNA, 16 nt, Shigella flexneri 2a str. 2457T
uggucccgacaaccug

SEQ ID NO: 3825774 - RNA, 17 nt, Shigella flexneri 2a str. 2457T
uggucccgacaaccuga

SEQ ID NO: 3825775 - RNA, 22 nt, Shigella flexneri 2a str. 2457T
uggucgcguuggucucaagcaa

SEQ ID NO: 3825776 - RNA, 17 nt, Shigella flexneri 2a str. 2457T
uggucgguuaacuccac

SEQ ID NO: 3825777 - RNA, 17 nt, Shigella flexneri 2a str. 2457T
uggucgugaucaaugug

SEQ ID NO: 3825778 - RNA, 20 nt, Shigella flexneri 2a str. 2457T
uggucuguaccaccagaauc

SEQ ID NO: 3825779 - RNA, 21 nt, Shigella flexneri 2a str. 2457T
uggucuuguagguuuuggcgc

SEQ ID NO: 3825780 - RNA, 17 nt, Shigella flexneri 2a str. 2457T
uggugaaaaaaaggcga

SEQ ID NO: 3825781 - RNA, 17 nt, Shigella flexneri 2a str. 2457T
uggugaagccaccagca

SEQ ID NO: 3825782 - RNA, 14 nt, Shigella flexneri 2a str. 2457T
uggugaagcuuauc

SEQ ID NO: 3825783 - RNA, 21 nt, Shigella flexneri 2a str. 2457T
uggugaauuugucgauuucca

SEQ ID NO: 3825784 - RNA, 15 nt, Shigella flexneri 2a str. 2457T
uggugacaccaugcc

SEQ ID NO: 3825785 - RNA, 14 nt, Shigella flexneri 2a str. 2457T
uggugaccugcagc

SEQ ID NO: 3825786 - RNA, 19 nt, Shigella flexneri 2a str. 2457T
uggugacuggcaacaacgc

SEQ ID NO: 3825787 - RNA, 17 nt, Shigella flexneri 2a str. 2457T
uggugauaaaacgcagu

SEQ ID NO: 3825788 - RNA, 23 nt, Shigella flexneri 2a str. 2457T
uggugauggacaacgcuuuuugg

SEQ ID NO: 3825789 - RNA, 19 nt, Shigella flexneri 2a str. 2457T
uggugaugguauuguccug

SEQ ID NO: 3825790 - RNA, 13 nt, Shigella flexneri 2a str. 2457T
uggugauugccgg

SEQ ID NO: 3825791 - RNA, 20 nt, Shigella flexneri 2a str. 2457T
uggugauugccggaauggug

SEQ ID NO: 3825792 - RNA, 16 nt, Shigella flexneri 2a str. 2457T
uggugauuucaggcuu

SEQ ID NO: 3825793 - RNA, 17 nt, Shigella flexneri 2a str. 2457T
uggugauuuucgccgcg

SEQ ID NO: 3825794 - RNA, 22 nt, Shigella flexneri 2a str. 2457T
uggugcaaauugcaccauccau

SEQ ID NO: 3825795 - RNA, 17 nt, Shigella flexneri 2a str. 2457T
uggugcaaggaaauaau

SEQ ID NO: 3825796 - RNA, 19 nt, Shigella flexneri 2a str. 2457T
uggugcaauuucagcgucc

SEQ ID NO: 3825797 - RNA, 20 nt, Shigella flexneri 2a str. 2457T
uggugcaccgauugccggau

SEQ ID NO: 3825798 - RNA, 17 nt, Shigella flexneri 2a str. 2457T
uggugcgugcggcaaau

SEQ ID NO: 3825799 - RNA, 16 nt, Shigella flexneri 2a str. 2457T
ugguggacaaccauaa

SEQ ID NO: 3825800 - RNA, 14 nt, Shigella flexneri 2a str. 2457T
ugguggcagccagc

SEQ ID NO: 3825801 - RNA, 21 nt, Shigella flexneri 2a str. 2457T
ugguggccgccacgcgugagc

SEQ ID NO: 3825802 - RNA, 15 nt, Shigella flexneri 2a str. 2457T
ugguggucaccauga

SEQ ID NO: 3825803 - RNA, 18 nt, Shigella flexneri 2a str. 2457T
ugguguagggcaggcgug

SEQ ID NO: 3825804 - RNA, 20 nt, Shigella flexneri 2a str. 2457T
ugguguggagugcagcaugc

SEQ ID NO: 3825805 - RNA, 13 nt, Shigella flexneri 2a str. 2457T
ugguguuaaaucu

SEQ ID NO: 3825806 - RNA, 22 nt, Shigella flexneri 2a str. 2457T
ugguguuggcaaucagcggcag

SEQ ID NO: 3825807 - RNA, 21 nt, Shigella flexneri 2a str. 2457T
ugguguuuucgaacaggcagg

SEQ ID NO: 3825808 - RNA, 18 nt, Shigella flexneri 2a str. 2457T
ugguuaaauaaggcuuua

SEQ ID NO: 3825809 - RNA, 11 nt, Shigella flexneri 2a str. 2457T
ugguuaacaau

SEQ ID NO: 3825810 - RNA, 17 nt, Shigella flexneri 2a str. 2457T
ugguuaacgaaucaauc

SEQ ID NO: 3825811 - RNA, 18 nt, Shigella flexneri 2a str. 2457T
ugguuaaugcuucacacu

SEQ ID NO: 3825812 - RNA, 12 nt, Shigella flexneri 2a str. 2457T
ugguuacacggg

SEQ ID NO: 3825813 - RNA, 15 nt, Shigella flexneri 2a str. 2457T
ugguuaccaucaacc

SEQ ID NO: 3825814 - RNA, 21 nt, Shigella flexneri 2a str. 2457T
ugguuacgcauaaaaccagca

SEQ ID NO: 3825815 - RNA, 14 nt, Shigella flexneri 2a str. 2457T
ugguuauauuuccc

SEQ ID NO: 3825816 - RNA, 15 nt, Shigella flexneri 2a str. 2457T
ugguuauauuucccc

SEQ ID NO: 3825817 - RNA, 14 nt, Shigella flexneri 2a str. 2457T
ugguuauccagcaa

SEQ ID NO: 3825818 - RNA, 19 nt, Shigella flexneri 2a str. 2457T
ugguuaucuuccaccacca

SEQ ID NO: 3825819 - RNA, 22 nt, Shigella flexneri 2a str. 2457T
ugguuauuucacuucaaccaca

SEQ ID NO: 3825820 - RNA, 22 nt, Shigella flexneri 2a str. 2457T
ugguucagacgcuacuuuuuuc

SEQ ID NO: 3825821 - RNA, 16 nt, Shigella flexneri 2a str. 2457T
ugguucccaacaacag

SEQ ID NO: 3825822 - RNA, 16 nt, Shigella flexneri 2a str. 2457T
ugguuccgguuuaucc

SEQ ID NO: 3825823 - RNA, 14 nt, Shigella flexneri 2a str. 2457T
ugguuccugacucc

SEQ ID NO: 3825824 - RNA, 18 nt, Shigella flexneri 2a str. 2457T
ugguucgacggccaguca

SEQ ID NO: 3825825 - RNA, 14 nt, Shigella flexneri 2a str. 2457T
ugguugcaugauga

SEQ ID NO: 3825826 - RNA, 14 nt, Shigella flexneri 2a str. 2457T
ugguugccagccac

SEQ ID NO: 3825827 - RNA, 15 nt, Shigella flexneri 2a str. 2457T
ugguuguaauccacc

SEQ ID NO: 3825828 - RNA, 14 nt, Shigella flexneri 2a str. 2457T
ugguugucaccgcc

SEQ ID NO: 3825829 - RNA, 13 nt, Shigella flexneri 2a str. 2457T
ugguugucgcagg

SEQ ID NO: 3825830 - RNA, 21 nt, Shigella flexneri 2a str. 2457T
ugguuuaucuccguuaaaggc

SEQ ID NO: 3825831 - RNA, 15 nt, Shigella flexneri 2a str. 2457T
ugguuuauuucccag

SEQ ID NO: 3825832 - RNA, 14 nt, Shigella flexneri 2a str. 2457T
ugguuucaaagauu

SEQ ID NO: 3825833 - RNA, 17 nt, Shigella flexneri 2a str. 2457T
ugguuugauagcaauac

SEQ ID NO: 3825834 - RNA, 14 nt, Shigella flexneri 2a str. 2457T
ugguuuggaucugu

SEQ ID NO: 3825835 - RNA, 13 nt, Shigella flexneri 2a str. 2457T
ugguuuggcggcg

SEQ ID NO: 3825836 - RNA, 22 nt, Shigella flexneri 2a str. 2457T
ugguuuuaaagaaucgggcaac

SEQ ID NO: 3825837 - RNA, 17 nt, Shigella flexneri 2a str. 2457T
ugguuuucgccggaacc

SEQ ID NO: 3825838 - RNA, 20 nt, Shigella flexneri 2a str. 2457T
ugguuuuucgauuuaaauga

SEQ ID NO: 3825839 - RNA, 11 nt, Shigella flexneri 2a str. 2457T
uguaaaagaag

SEQ ID NO: 3825840 - RNA, 16 nt, Shigella flexneri 2a str. 2457T
ugucaugcagcuccac

SEQ ID NO: 3825841 - RNA, 22 nt, Shigella flexneri 2a str. 2457T
ugucauggcagucuuaaucgcu

SEQ ID NO: 3825842 - RNA, 21 nt, Shigella flexneri 2a str. 2457T
ugucauguauauuauccauca

SEQ ID NO: 3825843 - RNA, 22 nt, Shigella flexneri 2a str. 2457T
ugucauucgccugacgcaauaa

SEQ ID NO: 3825844 - RNA, 23 nt, Shigella flexneri 2a str. 2457T
uguccacaggaaaacuacacacu

SEQ ID NO: 3825845 - RNA, 17 nt, Shigella flexneri 2a str. 2457T
uguccaccacgcugcau

SEQ ID NO: 3825846 - RNA, 12 nt, Shigella flexneri 2a str. 2457T
uguccacuuccg

SEQ ID NO: 3825847 - RNA, 16 nt, Shigella flexneri 2a str. 2457T
uguccagguuauuaaa

SEQ ID NO: 3825848 - RNA, 15 nt, Shigella flexneri 2a str. 2457T
uguccaguaaugacc

SEQ ID NO: 3825849 - RNA, 16 nt, Shigella flexneri 2a str. 2457T
uguccauuauuucaau

SEQ ID NO: 3825850 - RNA, 13 nt, Shigella flexneri 2a str. 2457T
ugucccgcuggug

SEQ ID NO: 3825851 - RNA, 16 nt, Shigella flexneri 2a str. 2457T
uguccgcuucaccacc

SEQ ID NO: 3825852 - RNA, 18 nt, Shigella flexneri 2a str. 2457T
uguccucgccguuuucug

SEQ ID NO: 3825853 - RNA, 23 nt, Shigella flexneri 2a str. 2457T
uguccucgccguuuucuggggcg

SEQ ID NO: 3825854 - RNA, 17 nt, Shigella flexneri 2a str. 2457T
ugucgaaagccccagcc

SEQ ID NO: 3825855 - RNA, 19 nt, Shigella flexneri 2a str. 2457T
ugucgacggaauaaaccca

SEQ ID NO: 3825856 - RNA, 12 nt, Shigella flexneri 2a str. 2457T
ugucgagugaau

SEQ ID NO: 3825857 - RNA, 17 nt, Shigella flexneri 2a str. 2457T
ugucgaucgcauggccu

SEQ ID NO: 3825858 - RNA, 14 nt, Shigella flexneri 2a str. 2457T
ugucgcagccagcg

SEQ ID NO: 3825859 - RNA, 15 nt, Shigella flexneri 2a str. 2457T
ugucgcauccggcaa

SEQ ID NO: 3825860 - RNA, 13 nt, Shigella flexneri 2a str. 2457T
ugucgccauccag

SEQ ID NO: 3825861 - RNA, 14 nt, Shigella flexneri 2a str. 2457T
ugucgcgccaggcg

SEQ ID NO: 3825862 - RNA, 20 nt, Shigella flexneri 2a str. 2457T
ugucgcucaaugcgcugagu

SEQ ID NO: 3825863 - RNA, 15 nt, Shigella flexneri 2a str. 2457T
ugucggaugcggcgu

SEQ ID NO: 3825864 - RNA, 14 nt, Shigella flexneri 2a str. 2457T
ugucggauuucgca

SEQ ID NO: 3825865 - RNA, 15 nt, Shigella flexneri 2a str. 2457T
ugucggcaagauacu

SEQ ID NO: 3825866 - RNA, 13 nt, Shigella flexneri 2a str. 2457T
ugucggcacugac

SEQ ID NO: 3825867 - RNA, 20 nt, Shigella flexneri 2a str. 2457T
ugucggcccgcauuauucag

SEQ ID NO: 3825868 - RNA, 14 nt, Shigella flexneri 2a str. 2457T
ugucggcgauaaua

SEQ ID NO: 3825869 - RNA, 21 nt, Shigella flexneri 2a str. 2457T
ugucgggugcuuuuuucaauu

SEQ ID NO: 3825870 - RNA, 20 nt, Shigella flexneri 2a str. 2457T
ugucgguggcgggcaagcgg

SEQ ID NO: 3825871 - RNA, 14 nt, Shigella flexneri 2a str. 2457T
ugucguuauauaaa

SEQ ID NO: 3825872 - RNA, 22 nt, Shigella flexneri 2a str. 2457T
ugucguucaggcgcugaaagaa

SEQ ID NO: 3825873 - RNA, 18 nt, Shigella flexneri 2a str. 2457T
ugucguuuagacguugug

SEQ ID NO: 3825874 - RNA, 18 nt, Shigella flexneri 2a str. 2457T
ugucguuuccauggacga

SEQ ID NO: 3825875 - RNA, 23 nt, Shigella flexneri 2a str. 2457T
ugucuaacaugagguccagcgag

SEQ ID NO: 3825876 - RNA, 20 nt, Shigella flexneri 2a str. 2457T
ugucuacgccuuguuucuuc

SEQ ID NO: 3825877 - RNA, 13 nt, Shigella flexneri 2a str. 2457T
ugucuauuuccac

SEQ ID NO: 3825878 - RNA, 15 nt, Shigella flexneri 2a str. 2457T
ugucuauuuccaccc

SEQ ID NO: 3825879 - RNA, 16 nt, Shigella flexneri 2a str. 2457T
ugucuauuuccacccg

SEQ ID NO: 3825880 - RNA, 13 nt, Shigella flexneri 2a str. 2457T
ugucucucagcac

SEQ ID NO: 3825881 - RNA, 14 nt, Shigella flexneri 2a str. 2457T
ugucugccgcagga

SEQ ID NO: 3825882 - RNA, 16 nt, Shigella flexneri 2a str. 2457T
ugucugccgcaggaaa

SEQ ID NO: 3825883 - RNA, 17 nt, Shigella flexneri 2a str. 2457T
ugucugcuucugccugg

SEQ ID NO: 3825884 - RNA, 23 nt, Shigella flexneri 2a str. 2457T
ugucuggacgcucaggcuacuuu

SEQ ID NO: 3825885 - RNA, 15 nt, Shigella flexneri 2a str. 2457T
ugucuguacggcagu

SEQ ID NO: 3825886 - RNA, 17 nt, Shigella flexneri 2a str. 2457T
ugucuguacggcaguga

SEQ ID NO: 3825887 - RNA, 19 nt, Shigella flexneri 2a str. 2457T
ugucuguacggcagugaac

SEQ ID NO: 3825888 - RNA, 15 nt, Shigella flexneri 2a str. 2457T
ugucuuaucaggccu

SEQ ID NO: 3825889 - RNA, 14 nt, Shigella flexneri 2a str. 2457T
ugucuucccugcug

SEQ ID NO: 3825890 - RNA, 23 nt, Shigella flexneri 2a str. 2457T
ugucuuuaaauugcguaaagccu

SEQ ID NO: 3825891 - RNA, 22 nt, Shigella flexneri 2a str. 2457T
ugucuuucucaucuuucagaau

SEQ ID NO: 3825892 - RNA, 16 nt, Shigella flexneri 2a str. 2457T
ugugaaaucagcacau

SEQ ID NO: 3825893 - RNA, 20 nt, Shigella flexneri 2a str. 2457T
ugugaacgagaaaaugacga

SEQ ID NO: 3825894 - RNA, 23 nt, Shigella flexneri 2a str. 2457T
ugugaacucaggcugccagauca

SEQ ID NO: 3825895 - RNA, 17 nt, Shigella flexneri 2a str. 2457T
ugugacaacaacaucac

SEQ ID NO: 3825896 - RNA, 14 nt, Shigella flexneri 2a str. 2457T
ugugacagauuuug

SEQ ID NO: 3825897 - RNA, 16 nt, Shigella flexneri 2a str. 2457T
ugugacagcagcggca

SEQ ID NO: 3825898 - RNA, 17 nt, Shigella flexneri 2a str. 2457T
ugugacgacaccaucuc

SEQ ID NO: 3825899 - RNA, 17 nt, Shigella flexneri 2a str. 2457T
ugugacuuccgacagaa

SEQ ID NO: 3825900 - RNA, 19 nt, Shigella flexneri 2a str. 2457T
ugugauaaaaaucggcagg

SEQ ID NO: 3825901 - RNA, 15 nt, Shigella flexneri 2a str. 2457T
ugugauacuucuucg

SEQ ID NO: 3825902 - RNA, 13 nt, Shigella flexneri 2a str. 2457T
ugugaucuuuauc

SEQ ID NO: 3825903 - RNA, 14 nt, Shigella flexneri 2a str. 2457T
ugugaucuuuuucg

SEQ ID NO: 3825904 - RNA, 15 nt, Shigella flexneri 2a str. 2457T
ugugaucuuuuucgc

SEQ ID NO: 3825905 - RNA, 17 nt, Shigella flexneri 2a str. 2457T
ugugcaaauucaauaaa

SEQ ID NO: 3825906 - RNA, 15 nt, Shigella flexneri 2a str. 2457T
ugugcaaccuuuucc

SEQ ID NO: 3825907 - RNA, 14 nt, Shigella flexneri 2a str. 2457T
ugugcaccuuuucc

SEQ ID NO: 3825908 - RNA, 16 nt, Shigella flexneri 2a str. 2457T
ugugcacgaggcuggc

SEQ ID NO: 3825909 - RNA, 19 nt, Shigella flexneri 2a str. 2457T
ugugcacgugccagauguu

SEQ ID NO: 3825910 - RNA, 15 nt, Shigella flexneri 2a str. 2457T
ugugcaguuccugca

SEQ ID NO: 3825911 - RNA, 19 nt, Shigella flexneri 2a str. 2457T
ugugcauuuaagagaaacg

SEQ ID NO: 3825912 - RNA, 12 nt, Shigella flexneri 2a str. 2457T
ugugccagaacc

SEQ ID NO: 3825913 - RNA, 18 nt, Shigella flexneri 2a str. 2457T
ugugccagcucgugcaga

SEQ ID NO: 3825914 - RNA, 13 nt, Shigella flexneri 2a str. 2457T
ugugccaggacuu

SEQ ID NO: 3825915 - RNA, 15 nt, Shigella flexneri 2a str. 2457T
ugugccauuaauguc

SEQ ID NO: 3825916 - RNA, 16 nt, Shigella flexneri 2a str. 2457T
ugugcccguaaaaaau

SEQ ID NO: 3825917 - RNA, 20 nt, Shigella flexneri 2a str. 2457T
ugugccgcgaugauugggcu

SEQ ID NO: 3825918 - RNA, 19 nt, Shigella flexneri 2a str. 2457T
ugugccugaauauacgcca

SEQ ID NO: 3825919 - RNA, 14 nt, Shigella flexneri 2a str. 2457T
ugugcgcacauugc

SEQ ID NO: 3825920 - RNA, 20 nt, Shigella flexneri 2a str. 2457T
ugugcgccacauccggcaua

SEQ ID NO: 3825921 - RNA, 23 nt, Shigella flexneri 2a str. 2457T
ugugcgccaccgcggacagacuu

SEQ ID NO: 3825922 - RNA, 21 nt, Shigella flexneri 2a str. 2457T
ugugcgccauuuuuuugucug

SEQ ID NO: 3825923 - RNA, 21 nt, Shigella flexneri 2a str. 2457T
ugugcguuacccacaguuuca

SEQ ID NO: 3825924 - RNA, 17 nt, Shigella flexneri 2a str. 2457T
ugugcuauuuuagaaaa

SEQ ID NO: 3825925 - RNA, 18 nt, Shigella flexneri 2a str. 2457T
ugugcugguacuggugca

SEQ ID NO: 3825926 - RNA, 18 nt, Shigella flexneri 2a str. 2457T
ugugcuuuacaccaugcc

SEQ ID NO: 3825927 - RNA, 20 nt, Shigella flexneri 2a str. 2457T
ugugcuuuacaccaugccac

SEQ ID NO: 3825928 - RNA, 14 nt, Shigella flexneri 2a str. 2457T
ugugcuuuguucau

SEQ ID NO: 3825929 - RNA, 19 nt, Shigella flexneri 2a str. 2457T
uguggagugcagcaugcac

SEQ ID NO: 3825930 - RNA, 20 nt, Shigella flexneri 2a str. 2457T
uguggagugcagcaugcacc

SEQ ID NO: 3825931 - RNA, 17 nt, Shigella flexneri 2a str. 2457T
uguggaucgauuucaau

SEQ ID NO: 3825932 - RNA, 19 nt, Shigella flexneri 2a str. 2457T
uguggauuaaauugcgcca

SEQ ID NO: 3825933 - RNA, 18 nt, Shigella flexneri 2a str. 2457T
uguggcggcgcgaggcga

SEQ ID NO: 3825934 - RNA, 15 nt, Shigella flexneri 2a str. 2457T
ugugggauugcuuca

SEQ ID NO: 3825935 - RNA, 17 nt, Shigella flexneri 2a str. 2457T
ugugggauugcuucagu

SEQ ID NO: 3825936 - RNA, 23 nt, Shigella flexneri 2a str. 2457T
uguggggaacagaauguuugcca

SEQ ID NO: 3825937 - RNA, 17 nt, Shigella flexneri 2a str. 2457T
uguggugagauugcugc

SEQ ID NO: 3825938 - RNA, 18 nt, Shigella flexneri 2a str. 2457T
uguuugacaacucaucac

SEQ ID NO: 3825939 - RNA, 19 nt, Shigella flexneri 2a str. 2457T
uguuugcaggugaccagca

SEQ ID NO: 3825940 - RNA, 22 nt, Shigella flexneri 2a str. 2457T
uguuuuaacacacaauuaccuu

SEQ ID NO: 3825941 - RNA, 13 nt, Shigella flexneri 2a str. 2457T
uguuuuauauaac

SEQ ID NO: 3825942 - RNA, 16 nt, Shigella flexneri 2a str. 2457T
uguuuuauguucagau

SEQ ID NO: 3825943 - RNA, 17 nt, Shigella flexneri 2a str. 2457T
uguuuuccgaugagcga

SEQ ID NO: 3825944 - RNA, 11 nt, Shigella flexneri 2a str. 2457T
uguuuucucuc

SEQ ID NO: 3825945 - RNA, 14 nt, Shigella flexneri 2a str. 2457T
uguuuugaacuuca

SEQ ID NO: 3825946 - RNA, 17 nt, Shigella flexneri 2a str. 2457T
uguuuuuaguuaaaucg

SEQ ID NO: 3825947 - RNA, 12 nt, Shigella flexneri 2a str. 2457T
uuaaaaaaagca

SEQ ID NO: 3825948 - RNA, 14 nt, Shigella flexneri 2a str. 2457T
uuaaaaaagaauac

SEQ ID NO: 3825949 - RNA, 21 nt, Shigella flexneri 2a str. 2457T
uuaaaaaaggugcucaaugag

SEQ ID NO: 3825950 - RNA, 13 nt, Shigella flexneri 2a str. 2457T
uuaaaaacagcca

SEQ ID NO: 3825951 - RNA, 16 nt, Shigella flexneri 2a str. 2457T
uuaaaaacccugcaga

SEQ ID NO: 3825952 - RNA, 20 nt, Shigella flexneri 2a str. 2457T
uuaaaaagaaaaaacuaaca

SEQ ID NO: 3825953 - RNA, 16 nt, Shigella flexneri 2a str. 2457T
uuaaaaccgaggggcu

SEQ ID NO: 3825954 - RNA, 15 nt, Shigella flexneri 2a str. 2457T
uuaaaacguaaagcc

SEQ ID NO: 3825955 - RNA, 22 nt, Shigella flexneri 2a str. 2457T
uuaaacaauuucagaauagaca

SEQ ID NO: 3825956 - RNA, 17 nt, Shigella flexneri 2a str. 2457T
uuaaacagcuuggauuc

SEQ ID NO: 3825957 - RNA, 18 nt, Shigella flexneri 2a str. 2457T
uuaaacaugagcgaauaa

SEQ ID NO: 3825958 - RNA, 21 nt, Shigella flexneri 2a str. 2457T
uuaaacaugagcgaauaaaaa

SEQ ID NO: 3825959 - RNA, 22 nt, Shigella flexneri 2a str. 2457T
uuaaacaugagcgaauaaaaaa

SEQ ID NO: 3825960 - RNA, 23 nt, Shigella flexneri 2a str. 2457T
uuaaacaugagcgaauaaaaaaa

SEQ ID NO: 3825961 - RNA, 16 nt, Shigella flexneri 2a str. 2457T
uuaaaccuaaaaagaa

SEQ ID NO: 3825962 - RNA, 17 nt, Shigella flexneri 2a str. 2457T
uuaaacgggucaucaaa

SEQ ID NO: 3825963 - RNA, 13 nt, Shigella flexneri 2a str. 2457T
uuaaagaaaguaa

SEQ ID NO: 3825964 - RNA, 22 nt, Shigella flexneri 2a str. 2457T
uuaaagagacagaaucaggcca

SEQ ID NO: 3825965 - RNA, 22 nt, Shigella flexneri 2a str. 2457T
uuaaagagcauuacacgcggcu

SEQ ID NO: 3825966 - RNA, 17 nt, Shigella flexneri 2a str. 2457T
uuaaagcaaaaaaagaa

SEQ ID NO: 3825967 - RNA, 12 nt, Shigella flexneri 2a str. 2457T
uuaaagccggug

SEQ ID NO: 3825968 - RNA, 18 nt, Shigella flexneri 2a str. 2457T
uuaaaggaaggucaucca

SEQ ID NO: 3825969 - RNA, 16 nt, Shigella flexneri 2a str. 2457T
uuaaaggggugaaaaa

SEQ ID NO: 3825970 - RNA, 22 nt, Shigella flexneri 2a str. 2457T
uuaaaguacucuuugaacagcc

SEQ ID NO: 3825971 - RNA, 21 nt, Shigella flexneri 2a str. 2457T
uuaaagucuuuguauuuauuu

SEQ ID NO: 3825972 - RNA, 14 nt, Shigella flexneri 2a str. 2457T
uuaaaguuaucgcc

SEQ ID NO: 3825973 - RNA, 20 nt, Shigella flexneri 2a str. 2457T
uuaaaguugagcgaaaacga

SEQ ID NO: 3825974 - RNA, 13 nt, Shigella flexneri 2a str. 2457T
uuaaauacaccuu

SEQ ID NO: 3825975 - RNA, 17 nt, Shigella flexneri 2a str. 2457T
uuaaauacagcuuaauc

SEQ ID NO: 3825976 - RNA, 22 nt, Shigella flexneri 2a str. 2457T
uuaaauacauauaagcguuaau

SEQ ID NO: 3825977 - RNA, 12 nt, Shigella flexneri 2a str. 2457T
uuaaauauaaaa

SEQ ID NO: 3825978 - RNA, 17 nt, Shigella flexneri 2a str. 2457T
uuaaauaucaucaaaau

SEQ ID NO: 3825979 - RNA, 23 nt, Shigella flexneri 2a str. 2457T
uuaaauauuaaggguaaaaggau

SEQ ID NO: 3825980 - RNA, 21 nt, Shigella flexneri 2a str. 2457T
uuaaaucccgcuucaacgacc

SEQ ID NO: 3825981 - RNA, 18 nt, Shigella flexneri 2a str. 2457T
uuaaauccugucuggcga

SEQ ID NO: 3825982 - RNA, 17 nt, Shigella flexneri 2a str. 2457T
uuaaauggacgcaaaaa

SEQ ID NO: 3825983 - RNA, 12 nt, Shigella flexneri 2a str. 2457T
uuaaauuaauaa

SEQ ID NO: 3825984 - RNA, 14 nt, Shigella flexneri 2a str. 2457T
uuaaauuaauaauc

SEQ ID NO: 3825985 - RNA, 22 nt, Shigella flexneri 2a str. 2457T
uuaaauucgcugcggacaaaac

SEQ ID NO: 3825986 - RNA, 17 nt, Shigella flexneri 2a str. 2457T
uuaaauuucuuguauua

SEQ ID NO: 3825987 - RNA, 18 nt, Shigella flexneri 2a str. 2457T
uuaaauuucuuguauuaa

SEQ ID NO: 3825988 - RNA, 23 nt, Shigella flexneri 2a str. 2457T
uuaacaacacccggucagccauu

SEQ ID NO: 3825989 - RNA, 16 nt, Shigella flexneri 2a str. 2457T
uuaacacacaauuacc

SEQ ID NO: 3825990 - RNA, 15 nt, Shigella flexneri 2a str. 2457T
uuaacauccaucgcc

SEQ ID NO: 3825991 - RNA, 21 nt, Shigella flexneri 2a str. 2457T
uuaacaucuccacagucaggc

SEQ ID NO: 3825992 - RNA, 19 nt, Shigella flexneri 2a str. 2457T
uuaaccaaaaauuuccaca

SEQ ID NO: 3825993 - RNA, 17 nt, Shigella flexneri 2a str. 2457T
uuaaccaccuccacgcc

SEQ ID NO: 3825994 - RNA, 15 nt, Shigella flexneri 2a str. 2457T
uuaaccagcaccagc

SEQ ID NO: 3825995 - RNA, 19 nt, Shigella flexneri 2a str. 2457T
uuaaccgugggaaacagua

SEQ ID NO: 3825996 - RNA, 22 nt, Shigella flexneri 2a str. 2457T
uuaaccuuugcgguuaaaaaua

SEQ ID NO: 3825997 - RNA, 20 nt, Shigella flexneri 2a str. 2457T
uuaacgcagaaucuucuucu

SEQ ID NO: 3825998 - RNA, 21 nt, Shigella flexneri 2a str. 2457T
uuaacgccuucccuuucagca

SEQ ID NO: 3825999 - RNA, 19 nt, Shigella flexneri 2a str. 2457T
uuaacgcgaucgacgcguc

SEQ ID NO: 3826000 - RNA, 19 nt, Shigella flexneri 2a str. 2457T
uuaacgcgcugaugaccgc

SEQ ID NO: 3826001 - RNA, 18 nt, Shigella flexneri 2a str. 2457T
uuaacggccgaagaagaa

SEQ ID NO: 3826002 - RNA, 13 nt, Shigella flexneri 2a str. 2457T
uuaacguuaucug

SEQ ID NO: 3826003 - RNA, 18 nt, Shigella flexneri 2a str. 2457T
uuaacugcgcgauuauca

SEQ ID NO: 3826004 - RNA, 19 nt, Shigella flexneri 2a str. 2457T
uuaacugcgcgauuaucau

SEQ ID NO: 3826005 - RNA, 20 nt, Shigella flexneri 2a str. 2457T
uuaacugcgcgauuaucauu

SEQ ID NO: 3826006 - RNA, 18 nt, Shigella flexneri 2a str. 2457T
uuaacuuaauaaacauca

SEQ ID NO: 3826007 - RNA, 22 nt, Shigella flexneri 2a str. 2457T
uuaagaagaucguggagaacaa

SEQ ID NO: 3826008 - RNA, 20 nt, Shigella flexneri 2a str. 2457T
uuaagaagggcuggccaauu

SEQ ID NO: 3826009 - RNA, 14 nt, Shigella flexneri 2a str. 2457T
uuaagacacacuau

SEQ ID NO: 3826010 - RNA, 13 nt, Shigella flexneri 2a str. 2457T
uuaagcaaaaaaa

SEQ ID NO: 3826011 - RNA, 14 nt, Shigella flexneri 2a str. 2457T
uuaagcaaaaaaac

SEQ ID NO: 3826012 - RNA, 18 nt, Shigella flexneri 2a str. 2457T
uuaagcaaaaaaacauaa

SEQ ID NO: 3826013 - RNA, 19 nt, Shigella flexneri 2a str. 2457T
uuaagcaaaaaaacauaau

SEQ ID NO: 3826014 - RNA, 22 nt, Shigella flexneri 2a str. 2457T
uuaagcaacugacuggcucuuu

SEQ ID NO: 3826015 - RNA, 21 nt, Shigella flexneri 2a str. 2457T
uuaagcaagugcaaucuacaa

SEQ ID NO: 3826016 - RNA, 18 nt, Shigella flexneri 2a str. 2457T
uuaagccaguucucacca

SEQ ID NO: 3826017 - RNA, 20 nt, Shigella flexneri 2a str. 2457T
uuaagccaguucucaccaaa

SEQ ID NO: 3826018 - RNA, 18 nt, Shigella flexneri 2a str. 2457T
uuaagccaucaucaauau

SEQ ID NO: 3826019 - RNA, 20 nt, Shigella flexneri 2a str. 2457T
uuaagcccaguucagcggcu

SEQ ID NO: 3826020 - RNA, 14 nt, Shigella flexneri 2a str. 2457T
uuaagccgcugugu

SEQ ID NO: 3826021 - RNA, 13 nt, Shigella flexneri 2a str. 2457T
uuaagcucagaaa

SEQ ID NO: 3826022 - RNA, 19 nt, Shigella flexneri 2a str. 2457T
uuaagcuuuccggcaucac

SEQ ID NO: 3826023 - RNA, 18 nt, Shigella flexneri 2a str. 2457T
uuaaggcagaaacaaacg

SEQ ID NO: 3826024 - RNA, 13 nt, Shigella flexneri 2a str. 2457T
uuaaggguaaaaa

SEQ ID NO: 3826025 - RNA, 17 nt, Shigella flexneri 2a str. 2457T
uuaagucgacgguauaa

SEQ ID NO: 3826026 - RNA, 16 nt, Shigella flexneri 2a str. 2457T
uuaagucggucaagua

SEQ ID NO: 3826027 - RNA, 22 nt, Shigella flexneri 2a str. 2457T
uuaaguuauauugcgacgauaa

SEQ ID NO: 3826028 - RNA, 21 nt, Shigella flexneri 2a str. 2457T
uuaauaaaauuauccagcuuu

SEQ ID NO: 3826029 - RNA, 15 nt, Shigella flexneri 2a str. 2457T
uuaauaaauauuaau

SEQ ID NO: 3826030 - RNA, 20 nt, Shigella flexneri 2a str. 2457T
uuaauaacacauauauuaau

SEQ ID NO: 3826031 - RNA, 14 nt, Shigella flexneri 2a str. 2457T
uuaauaauaaguau

SEQ ID NO: 3826032 - RNA, 14 nt, Shigella flexneri 2a str. 2457T
uuaauaaucacaua

SEQ ID NO: 3826033 - RNA, 18 nt, Shigella flexneri 2a str. 2457T
uuaauaccgagcguucaa

SEQ ID NO: 3826034 - RNA, 15 nt, Shigella flexneri 2a str. 2457T
uuaauaccugccugg

SEQ ID NO: 3826035 - RNA, 12 nt, Shigella flexneri 2a str. 2457T
uuacugcauuca

SEQ ID NO: 3826036 - RNA, 20 nt, Shigella flexneri 2a str. 2457T
uuacugcauugaauuucuau

SEQ ID NO: 3826037 - RNA, 15 nt, Shigella flexneri 2a str. 2457T
uuacugccaccaucc

SEQ ID NO: 3826038 - RNA, 17 nt, Shigella flexneri 2a str. 2457T
uuacuggcuuucauuuu

SEQ ID NO: 3826039 - RNA, 15 nt, Shigella flexneri 2a str. 2457T
uuacugucugcuucu

SEQ ID NO: 3826040 - RNA, 23 nt, Shigella flexneri 2a str. 2457T
uuacuucugcugcacgaaauugc

SEQ ID NO: 3826041 - RNA, 15 nt, Shigella flexneri 2a str. 2457T
uuagaaacaaaaaaa

SEQ ID NO: 3826042 - RNA, 16 nt, Shigella flexneri 2a str. 2457T
uuagaaacaaaaaaac

SEQ ID NO: 3826043 - RNA, 23 nt, Shigella flexneri 2a str. 2457T
uuagaaacaaaaaaaccgccuca

SEQ ID NO: 3826044 - RNA, 19 nt, Shigella flexneri 2a str. 2457T
uuagacggcgcaacauccg

SEQ ID NO: 3826045 - RNA, 13 nt, Shigella flexneri 2a str. 2457T
uuagacuuuaguc

SEQ ID NO: 3826046 - RNA, 23 nt, Shigella flexneri 2a str. 2457T
uuagacuuuagucaucagucuga

SEQ ID NO: 3826047 - RNA, 14 nt, Shigella flexneri 2a str. 2457T
uuagagcacaucac

SEQ ID NO: 3826048 - RNA, 16 nt, Shigella flexneri 2a str. 2457T
uuagaggucaguuuga

SEQ ID NO: 3826049 - RNA, 15 nt, Shigella flexneri 2a str. 2457T
uuagauaaaaaugaa

SEQ ID NO: 3826050 - RNA, 16 nt, Shigella flexneri 2a str. 2457T
uuagaugauggcauuc

SEQ ID NO: 3826051 - RNA, 13 nt, Shigella flexneri 2a str. 2457T
uuagaugcuuuca

SEQ ID NO: 3826052 - RNA, 21 nt, Shigella flexneri 2a str. 2457T
uuagaugugggcaaucucacu

SEQ ID NO: 3826053 - RNA, 22 nt, Shigella flexneri 2a str. 2457T
uuagauucguuuuccagugcca

SEQ ID NO: 3826054 - RNA, 18 nt, Shigella flexneri 2a str. 2457T
uuagcaaaauagcuguuu

SEQ ID NO: 3826055 - RNA, 20 nt, Shigella flexneri 2a str. 2457T
uuagcaacaggccaguucga

SEQ ID NO: 3826056 - RNA, 16 nt, Shigella flexneri 2a str. 2457T
uuagcaauauuuuuau

SEQ ID NO: 3826057 - RNA, 21 nt, Shigella flexneri 2a str. 2457T
uuagcauaaaaacucgagccu

SEQ ID NO: 3826058 - RNA, 16 nt, Shigella flexneri 2a str. 2457T
uuagcaucagcgccac

SEQ ID NO: 3826059 - RNA, 21 nt, Shigella flexneri 2a str. 2457T
uuagcaucagcgccaccagcg

SEQ ID NO: 3826060 - RNA, 14 nt, Shigella flexneri 2a str. 2457T
uuagcaugcuggcu

SEQ ID NO: 3826061 - RNA, 14 nt, Shigella flexneri 2a str. 2457T
uuagcccaauaauc

SEQ ID NO: 3826062 - RNA, 19 nt, Shigella flexneri 2a str. 2457T
uuagccuguaaugucaucu

SEQ ID NO: 3826063 - RNA, 17 nt, Shigella flexneri 2a str. 2457T
uuagcgacgaacagcga

SEQ ID NO: 3826064 - RNA, 15 nt, Shigella flexneri 2a str. 2457T
uuagcgccagccaga

SEQ ID NO: 3826065 - RNA, 21 nt, Shigella flexneri 2a str. 2457T
uuagcgggucaggucgucaaa

SEQ ID NO: 3826066 - RNA, 16 nt, Shigella flexneri 2a str. 2457T
uuaggaauaaugucuu

SEQ ID NO: 3826067 - RNA, 18 nt, Shigella flexneri 2a str. 2457T
uuaggaugcugcaauaaa

SEQ ID NO: 3826068 - RNA, 18 nt, Shigella flexneri 2a str. 2457T
uuaggcacaguagcccac

SEQ ID NO: 3826069 - RNA, 15 nt, Shigella flexneri 2a str. 2457T
uuaggcacaucaaca

SEQ ID NO: 3826070 - RNA, 13 nt, Shigella flexneri 2a str. 2457T
uuagggugagggg

SEQ ID NO: 3826071 - RNA, 20 nt, Shigella flexneri 2a str. 2457T
uuagggugaggggaacccgu

SEQ ID NO: 3826072 - RNA, 21 nt, Shigella flexneri 2a str. 2457T
uuagggugagggggcguucac

SEQ ID NO: 3826073 - RNA, 14 nt, Shigella flexneri 2a str. 2457T
uuagguaaugacuc

SEQ ID NO: 3826074 - RNA, 16 nt, Shigella flexneri 2a str. 2457T
uuagguaaugacucca

SEQ ID NO: 3826075 - RNA, 12 nt, Shigella flexneri 2a str. 2457T
uuagguggaaga

SEQ ID NO: 3826076 - RNA, 12 nt, Shigella flexneri 2a str. 2457T
uuaguaucuauu

SEQ ID NO: 3826077 - RNA, 13 nt, Shigella flexneri 2a str. 2457T
uuaguaugaagaa

SEQ ID NO: 3826078 - RNA, 19 nt, Shigella flexneri 2a str. 2457T
uuaguauuguuaaauauua

SEQ ID NO: 3826079 - RNA, 21 nt, Shigella flexneri 2a str. 2457T
uuaguauuguuaaauauuaag

SEQ ID NO: 3826080 - RNA, 18 nt, Shigella flexneri 2a str. 2457T
uuagucccaaacagcaga

SEQ ID NO: 3826081 - RNA, 21 nt, Shigella flexneri 2a str. 2457T
uuagucgcccauuuugccacc

SEQ ID NO: 3826082 - RNA, 19 nt, Shigella flexneri 2a str. 2457T
uuagucgucgccgauaauu

SEQ ID NO: 3826083 - RNA, 12 nt, Shigella flexneri 2a str. 2457T
uuagucugcauu

SEQ ID NO: 3826084 - RNA, 18 nt, Shigella flexneri 2a str. 2457T
uuaguggcaaccacaacc

SEQ ID NO: 3826085 - RNA, 14 nt, Shigella flexneri 2a str. 2457T
uuaguuuaaacauu

SEQ ID NO: 3826086 - RNA, 13 nt, Shigella flexneri 2a str. 2457T
uuauaaaagaaaa

SEQ ID NO: 3826087 - RNA, 18 nt, Shigella flexneri 2a str. 2457T
uuauaagccaguaagaca

SEQ ID NO: 3826088 - RNA, 12 nt, Shigella flexneri 2a str. 2457T
uuauaagccaug

SEQ ID NO: 3826089 - RNA, 16 nt, Shigella flexneri 2a str. 2457T
uuauaagccauguuua

SEQ ID NO: 3826090 - RNA, 18 nt, Shigella flexneri 2a str. 2457T
uuauaaucuuuaaaaaaa

SEQ ID NO: 3826091 - RNA, 24 nt, Shigella flexneri 2a str. 2457T
uuauacacucuuucaauauugcac

SEQ ID NO: 3826092 - RNA, 21 nt, Shigella flexneri 2a str. 2457T
uuauacagacucaaaccaaug

SEQ ID NO: 3826093 - RNA, 19 nt, Shigella flexneri 2a str. 2457T
uuauacggcuggauuucgc

SEQ ID NO: 3826094 - RNA, 15 nt, Shigella flexneri 2a str. 2457T
uuauacucagucagg

SEQ ID NO: 3826095 - RNA, 12 nt, Shigella flexneri 2a str. 2457T
uuauacuuuuuc

SEQ ID NO: 3826096 - RNA, 14 nt, Shigella flexneri 2a str. 2457T
uuauagacaucuuu

SEQ ID NO: 3826097 - RNA, 22 nt, Shigella flexneri 2a str. 2457T
uuauagacaucuuuauaugcaa

SEQ ID NO: 3826098 - RNA, 18 nt, Shigella flexneri 2a str. 2457T
uuauagacuaaauuucac

SEQ ID NO: 3826099 - RNA, 19 nt, Shigella flexneri 2a str. 2457T
uuauagcaguaauugcagc

SEQ ID NO: 3826100 - RNA, 23 nt, Shigella flexneri 2a str. 2457T
uuauagcauagcguugauuagac

SEQ ID NO: 3826101 - RNA, 20 nt, Shigella flexneri 2a str. 2457T
uuauagccguaacuguaagc

SEQ ID NO: 3826102 - RNA, 15 nt, Shigella flexneri 2a str. 2457T
uuauauaauaugcau

SEQ ID NO: 3826103 - RNA, 16 nt, Shigella flexneri 2a str. 2457T
uuauaucagugauaua

SEQ ID NO: 3826104 - RNA, 19 nt, Shigella flexneri 2a str. 2457T
uuauaucagugauauauuu

SEQ ID NO: 3826105 - RNA, 14 nt, Shigella flexneri 2a str. 2457T
uuauaucccauuuu

SEQ ID NO: 3826106 - RNA, 18 nt, Shigella flexneri 2a str. 2457T
uuauauggaaaaauauuc

SEQ ID NO: 3826107 - RNA, 22 nt, Shigella flexneri 2a str. 2457T
uuauauggugagcgauauuuau

SEQ ID NO: 3826108 - RNA, 13 nt, Shigella flexneri 2a str. 2457T
uuaucaaaucacc

SEQ ID NO: 3826109 - RNA, 16 nt, Shigella flexneri 2a str. 2457T
uuaucaacuaucagau

SEQ ID NO: 3826110 - RNA, 12 nt, Shigella flexneri 2a str. 2457T
uuaucaauuccu

SEQ ID NO: 3826111 - RNA, 19 nt, Shigella flexneri 2a str. 2457T
uuaucaccuguugcccuuu

SEQ ID NO: 3826112 - RNA, 22 nt, Shigella flexneri 2a str. 2457T
uuaucacgcaaccacaacgcac

SEQ ID NO: 3826113 - RNA, 15 nt, Shigella flexneri 2a str. 2457T
uuaucacuuaaccca

SEQ ID NO: 3826114 - RNA, 17 nt, Shigella flexneri 2a str. 2457T
uuaucacuuaacccauu

SEQ ID NO: 3826115 - RNA, 17 nt, Shigella flexneri 2a str. 2457T
uuaucagaaccgcccag

SEQ ID NO: 3826116 - RNA, 13 nt, Shigella flexneri 2a str. 2457T
uuaucagaucacg

SEQ ID NO: 3826117 - RNA, 17 nt, Shigella flexneri 2a str. 2457T
uuaucagcaacuggcaa

SEQ ID NO: 3826118 - RNA, 21 nt, Shigella flexneri 2a str. 2457T
uuaucagcaacuggcaaaaac

SEQ ID NO: 3826119 - RNA, 11 nt, Shigella flexneri 2a str. 2457T
uuaucaggccu

SEQ ID NO: 3826120 - RNA, 22 nt, Shigella flexneri 2a str. 2457T
uuaucaggccuacaauguuucu

SEQ ID NO: 3826121 - RNA, 21 nt, Shigella flexneri 2a str. 2457T
uuaucaggccuacauuuucuc

SEQ ID NO: 3826122 - RNA, 20 nt, Shigella flexneri 2a str. 2457T
uuaucaggccuacgacuuuc

SEQ ID NO: 3826123 - RNA, 15 nt, Shigella flexneri 2a str. 2457T
uuaucaggccugcaa

SEQ ID NO: 3826124 - RNA, 11 nt, Shigella flexneri 2a str. 2457T
uuaucaucacc

SEQ ID NO: 3826125 - RNA, 15 nt, Shigella flexneri 2a str. 2457T
uuaucaucgggcuga

SEQ ID NO: 3826126 - RNA, 15 nt, Shigella flexneri 2a str. 2457T
uuauccaguuaucaa

SEQ ID NO: 3826127 - RNA, 20 nt, Shigella flexneri 2a str. 2457T
uuaucccaauuaucuggaau

SEQ ID NO: 3826128 - RNA, 17 nt, Shigella flexneri 2a str. 2457T
uuaucccaggcguuaau

SEQ ID NO: 3826129 - RNA, 16 nt, Shigella flexneri 2a str. 2457T
uuaucccucauauuua

SEQ ID NO: 3826130 - RNA, 17 nt, Shigella flexneri 2a str. 2457T
uuauccggcaugaaaac

SEQ ID NO: 3826131 - RNA, 11 nt, Shigella flexneri 2a str. 2457T
uuauccggccu

SEQ ID NO: 3826132 - RNA, 18 nt, Shigella flexneri 2a str. 2457T
uuauccggccuacaaaau

SEQ ID NO: 3826133 - RNA, 22 nt, Shigella flexneri 2a str. 2457T
uucaagccaaaacgcgcaacca

SEQ ID NO: 3826134 - RNA, 19 nt, Shigella flexneri 2a str. 2457T
uucaagccaggcuuuaaau

SEQ ID NO: 3826135 - RNA, 18 nt, Shigella flexneri 2a str. 2457T
uucaauaaauugcaggaa

SEQ ID NO: 3826136 - RNA, 16 nt, Shigella flexneri 2a str. 2457T
uucaauaaccugcaaa

SEQ ID NO: 3826137 - RNA, 15 nt, Shigella flexneri 2a str. 2457T
uucaauaacuccauc

SEQ ID NO: 3826138 - RNA, 21 nt, Shigella flexneri 2a str. 2457T
uucaauaccgccugcaaauaa

SEQ ID NO: 3826139 - RNA, 21 nt, Shigella flexneri 2a str. 2457T
uucaauauauugaauuugcau

SEQ ID NO: 3826140 - RNA, 14 nt, Shigella flexneri 2a str. 2457T
uucaauauauugca

SEQ ID NO: 3826141 - RNA, 18 nt, Shigella flexneri 2a str. 2457T
uucaauauggaaguuuug

SEQ ID NO: 3826142 - RNA, 18 nt, Shigella flexneri 2a str. 2457T
uucaaucccgccaaugca

SEQ ID NO: 3826143 - RNA, 15 nt, Shigella flexneri 2a str. 2457T
uucaaugccgccgau

SEQ ID NO: 3826144 - RNA, 20 nt, Shigella flexneri 2a str. 2457T
uucaauucacgaauauuucc

SEQ ID NO: 3826145 - RNA, 14 nt, Shigella flexneri 2a str. 2457T
uucaauuuguucua

SEQ ID NO: 3826146 - RNA, 17 nt, Shigella flexneri 2a str. 2457T
uucacaaaggcuugcug

SEQ ID NO: 3826147 - RNA, 19 nt, Shigella flexneri 2a str. 2457T
uucacaaccgggcauuuuu

SEQ ID NO: 3826148 - RNA, 17 nt, Shigella flexneri 2a str. 2457T
uucacagaaggccagga

SEQ ID NO: 3826149 - RNA, 23 nt, Shigella flexneri 2a str. 2457T
uucacaggccgccaggcagagcu

SEQ ID NO: 3826150 - RNA, 23 nt, Shigella flexneri 2a str. 2457T
uucacaguaaugauuuaaaacca

SEQ ID NO: 3826151 - RNA, 17 nt, Shigella flexneri 2a str. 2457T
uucaccaaucggcagaa

SEQ ID NO: 3826152 - RNA, 23 nt, Shigella flexneri 2a str. 2457T
uucaccagaccugaaaccgccuu

SEQ ID NO: 3826153 - RNA, 18 nt, Shigella flexneri 2a str. 2457T
uucaccagcacuucacug

SEQ ID NO: 3826154 - RNA, 14 nt, Shigella flexneri 2a str. 2457T
uucaccagcgcacg

SEQ ID NO: 3826155 - RNA, 23 nt, Shigella flexneri 2a str. 2457T
uucaccaguuguaaaucgcccac

SEQ ID NO: 3826156 - RNA, 22 nt, Shigella flexneri 2a str. 2457T
uucaccaucgcgaucaucagua

SEQ ID NO: 3826157 - RNA, 22 nt, Shigella flexneri 2a str. 2457T
uucaccauucugcgcugacucu

SEQ ID NO: 3826158 - RNA, 13 nt, Shigella flexneri 2a str. 2457T
uucaccauuuuuu

SEQ ID NO: 3826159 - RNA, 15 nt, Shigella flexneri 2a str. 2457T
uucacccaccggaau

SEQ ID NO: 3826160 - RNA, 19 nt, Shigella flexneri 2a str. 2457T
uucaccgauaaaagcccug

SEQ ID NO: 3826161 - RNA, 23 nt, Shigella flexneri 2a str. 2457T
uucaccggauaaucggcaauacu

SEQ ID NO: 3826162 - RNA, 12 nt, Shigella flexneri 2a str. 2457T
uucaccggugag

SEQ ID NO: 3826163 - RNA, 20 nt, Shigella flexneri 2a str. 2457T
uucaccguaauaguuucuga

SEQ ID NO: 3826164 - RNA, 20 nt, Shigella flexneri 2a str. 2457T
uucaccucuucauuaaacca

SEQ ID NO: 3826165 - RNA, 15 nt, Shigella flexneri 2a str. 2457T
uucacgaauauuucc

SEQ ID NO: 3826166 - RNA, 23 nt, Shigella flexneri 2a str. 2457T
uucacgacauaaacauuccacuu

SEQ ID NO: 3826167 - RNA, 22 nt, Shigella flexneri 2a str. 2457T
uucacgagagauacgcuugccg

SEQ ID NO: 3826168 - RNA, 17 nt, Shigella flexneri 2a str. 2457T
uucacgcaggcgagaau

SEQ ID NO: 3826169 - RNA, 15 nt, Shigella flexneri 2a str. 2457T
uucacgcagugcugc

SEQ ID NO: 3826170 - RNA, 22 nt, Shigella flexneri 2a str. 2457T
uucacgcauuuacacucgcccc

SEQ ID NO: 3826171 - RNA, 16 nt, Shigella flexneri 2a str. 2457T
uucacgcccagaucca

SEQ ID NO: 3826172 - RNA, 23 nt, Shigella flexneri 2a str. 2457T
uucacgccgcauccggcaguaau

SEQ ID NO: 3826173 - RNA, 22 nt, Shigella flexneri 2a str. 2457T
uucacgccgggaaauuuuuccg

SEQ ID NO: 3826174 - RNA, 18 nt, Shigella flexneri 2a str. 2457T
uucacgcgcuccaggagu

SEQ ID NO: 3826175 - RNA, 19 nt, Shigella flexneri 2a str. 2457T
uucacgcgcuccaggaguu

SEQ ID NO: 3826176 - RNA, 18 nt, Shigella flexneri 2a str. 2457T
uucacgcggguugccacc

SEQ ID NO: 3826177 - RNA, 21 nt, Shigella flexneri 2a str. 2457T
uucacggcgauaccaguaaua

SEQ ID NO: 3826178 - RNA, 20 nt, Shigella flexneri 2a str. 2457T
uucacgguauuauucaucgc

SEQ ID NO: 3826179 - RNA, 13 nt, Shigella flexneri 2a str. 2457T
uucacguucaccc

SEQ ID NO: 3826180 - RNA, 21 nt, Shigella flexneri 2a str. 2457T
uucacguugacgcauacagcc

SEQ ID NO: 3826181 - RNA, 17 nt, Shigella flexneri 2a str. 2457T
uucacucugcugccaca

SEQ ID NO: 3826182 - RNA, 19 nt, Shigella flexneri 2a str. 2457T
uucacugccaccagcagcg

SEQ ID NO: 3826183 - RNA, 22 nt, Shigella flexneri 2a str. 2457T
uucacugccaccagcagcguuu

SEQ ID NO: 3826184 - RNA, 19 nt, Shigella flexneri 2a str. 2457T
uucacugccguacaggcag

SEQ ID NO: 3826185 - RNA, 16 nt, Shigella flexneri 2a str. 2457T
uucacuggcaccgcac

SEQ ID NO: 3826186 - RNA, 13 nt, Shigella flexneri 2a str. 2457T
uucacuucgucag

SEQ ID NO: 3826187 - RNA, 17 nt, Shigella flexneri 2a str. 2457T
uucacuucuucaauaaa

SEQ ID NO: 3826188 - RNA, 14 nt, Shigella flexneri 2a str. 2457T
uucacuuucugaag

SEQ ID NO: 3826189 - RNA, 19 nt, Shigella flexneri 2a str. 2457T
uucacuuuugcugcaaaau

SEQ ID NO: 3826190 - RNA, 19 nt, Shigella flexneri 2a str. 2457T
uucagaaauuuggcuccuc

SEQ ID NO: 3826191 - RNA, 18 nt, Shigella flexneri 2a str. 2457T
uucagaacacaaaaccga

SEQ ID NO: 3826192 - RNA, 15 nt, Shigella flexneri 2a str. 2457T
uucagaagcugaagc

SEQ ID NO: 3826193 - RNA, 18 nt, Shigella flexneri 2a str. 2457T
uucagaauagacaaaaau

SEQ ID NO: 3826194 - RNA, 17 nt, Shigella flexneri 2a str. 2457T
uucagaauauucgaaau

SEQ ID NO: 3826195 - RNA, 13 nt, Shigella flexneri 2a str. 2457T
uucagaccaauaa

SEQ ID NO: 3826196 - RNA, 14 nt, Shigella flexneri 2a str. 2457T
uucagaccaauaau

SEQ ID NO: 3826197 - RNA, 21 nt, Shigella flexneri 2a str. 2457T
uucagauaaaucacgcuucac

SEQ ID NO: 3826198 - RNA, 23 nt, Shigella flexneri 2a str. 2457T
uucagauaauagguaaacauccg

SEQ ID NO: 3826199 - RNA, 23 nt, Shigella flexneri 2a str. 2457T
uucagauaaugcccgaugaccuu

SEQ ID NO: 3826200 - RNA, 13 nt, Shigella flexneri 2a str. 2457T
uucagaucuuuca

SEQ ID NO: 3826201 - RNA, 13 nt, Shigella flexneri 2a str. 2457T
uucagauguuccg

SEQ ID NO: 3826202 - RNA, 18 nt, Shigella flexneri 2a str. 2457T
uucagauguuccgccauu

SEQ ID NO: 3826203 - RNA, 12 nt, Shigella flexneri 2a str. 2457T
uucagcaaaugg

SEQ ID NO: 3826204 - RNA, 22 nt, Shigella flexneri 2a str. 2457T
uucagcaacgugcuucgcgcug

SEQ ID NO: 3826205 - RNA, 11 nt, Shigella flexneri 2a str. 2457T
uucagcaauac

SEQ ID NO: 3826206 - RNA, 20 nt, Shigella flexneri 2a str. 2457T
uucagcaauucucucuucag

SEQ ID NO: 3826207 - RNA, 11 nt, Shigella flexneri 2a str. 2457T
uucagcaccag

SEQ ID NO: 3826208 - RNA, 22 nt, Shigella flexneri 2a str. 2457T
uucagcaccgcgcuauuuuccu

SEQ ID NO: 3826209 - RNA, 14 nt, Shigella flexneri 2a str. 2457T
uucagcagcggcac

SEQ ID NO: 3826210 - RNA, 20 nt, Shigella flexneri 2a str. 2457T
uucagcagcggcucggucag

SEQ ID NO: 3826211 - RNA, 13 nt, Shigella flexneri 2a str. 2457T
uucagcaguuuuu

SEQ ID NO: 3826212 - RNA, 21 nt, Shigella flexneri 2a str. 2457T
uucagcaucuggaaagucuga

SEQ ID NO: 3826213 - RNA, 18 nt, Shigella flexneri 2a str. 2457T
uucagccaguugaucucu

SEQ ID NO: 3826214 - RNA, 20 nt, Shigella flexneri 2a str. 2457T
uucagcccggcaacguugcc

SEQ ID NO: 3826215 - RNA, 23 nt, Shigella flexneri 2a str. 2457T
uucagccgcaaaccuggcaacaa

SEQ ID NO: 3826216 - RNA, 16 nt, Shigella flexneri 2a str. 2457T
uucagccggaauaauc

SEQ ID NO: 3826217 - RNA, 15 nt, Shigella flexneri 2a str. 2457T
uucagccgucaucca

SEQ ID NO: 3826218 - RNA, 14 nt, Shigella flexneri 2a str. 2457T
uucagccucugccg

SEQ ID NO: 3826219 - RNA, 20 nt, Shigella flexneri 2a str. 2457T
uucagccugacagcacgccc

SEQ ID NO: 3826220 - RNA, 16 nt, Shigella flexneri 2a str. 2457T
uucagccugaccgcac

SEQ ID NO: 3826221 - RNA, 20 nt, Shigella flexneri 2a str. 2457T
uucagccugaccgcacaccc

SEQ ID NO: 3826222 - RNA, 21 nt, Shigella flexneri 2a str. 2457T
uucagcgaucgcuuucgcuuu

SEQ ID NO: 3826223 - RNA, 16 nt, Shigella flexneri 2a str. 2457T
uucagcgaucguuuuu

SEQ ID NO: 3826224 - RNA, 19 nt, Shigella flexneri 2a str. 2457T
uucagcgccugauacagcc

SEQ ID NO: 3826225 - RNA, 21 nt, Shigella flexneri 2a str. 2457T
uucagcggcgcaacccccaca

SEQ ID NO: 3826226 - RNA, 17 nt, Shigella flexneri 2a str. 2457T
uucagcgucgcgguugc

SEQ ID NO: 3826227 - RNA, 14 nt, Shigella flexneri 2a str. 2457T
uucagcgugcccac

SEQ ID NO: 3826228 - RNA, 14 nt, Shigella flexneri 2a str. 2457T
uucagcucaagaau

SEQ ID NO: 3826229 - RNA, 19 nt, Shigella flexneri 2a str. 2457T
uucagcucccgcugacggc

SEQ ID NO: 3826230 - RNA, 16 nt, Shigella flexneri 2a str. 2457T
uuccagcagaccagca

SEQ ID NO: 3826231 - RNA, 20 nt, Shigella flexneri 2a str. 2457T
uuccagcagaccagcaauaa

SEQ ID NO: 3826232 - RNA, 17 nt, Shigella flexneri 2a str. 2457T
uuccagcaguuccagca

SEQ ID NO: 3826233 - RNA, 16 nt, Shigella flexneri 2a str. 2457T
uuccagcauuucuucc

SEQ ID NO: 3826234 - RNA, 23 nt, Shigella flexneri 2a str. 2457T
uuccagcgcaaggaaauaacguu

SEQ ID NO: 3826235 - RNA, 22 nt, Shigella flexneri 2a str. 2457T
uuccagcgccgccagaagggaa

SEQ ID NO: 3826236 - RNA, 12 nt, Shigella flexneri 2a str. 2457T
uuccagcggcag

SEQ ID NO: 3826237 - RNA, 15 nt, Shigella flexneri 2a str. 2457T
uuccagcggcaggcc

SEQ ID NO: 3826238 - RNA, 21 nt, Shigella flexneri 2a str. 2457T
uuccagcguagugaaggcaaa

SEQ ID NO: 3826239 - RNA, 23 nt, Shigella flexneri 2a str. 2457T
uuccagcguagugaaggcaaacu

SEQ ID NO: 3826240 - RNA, 18 nt, Shigella flexneri 2a str. 2457T
uuccagcucaaccagauu

SEQ ID NO: 3826241 - RNA, 14 nt, Shigella flexneri 2a str. 2457T
uuccagcugugcca

SEQ ID NO: 3826242 - RNA, 19 nt, Shigella flexneri 2a str. 2457T
uuccagcuucgcuaccuga

SEQ ID NO: 3826243 - RNA, 22 nt, Shigella flexneri 2a str. 2457T
uuccaggcucauaccuuccacu

SEQ ID NO: 3826244 - RNA, 22 nt, Shigella flexneri 2a str. 2457T
uuccaggcuggcaggccucaug

SEQ ID NO: 3826245 - RNA, 14 nt, Shigella flexneri 2a str. 2457T
uuccagggcagcag

SEQ ID NO: 3826246 - RNA, 22 nt, Shigella flexneri 2a str. 2457T
uuccagguuauuuuauuucugu

SEQ ID NO: 3826247 - RNA, 17 nt, Shigella flexneri 2a str. 2457T
uuccaguagauucaaca

SEQ ID NO: 3826248 - RNA, 21 nt, Shigella flexneri 2a str. 2457T
uuccagucggcguaauccuga

SEQ ID NO: 3826249 - RNA, 18 nt, Shigella flexneri 2a str. 2457T
uuccagucuucuugcucc

SEQ ID NO: 3826250 - RNA, 20 nt, Shigella flexneri 2a str. 2457T
uuccagucuucuugcuccac

SEQ ID NO: 3826251 - RNA, 18 nt, Shigella flexneri 2a str. 2457T
uuccaguuccggcaucga

SEQ ID NO: 3826252 - RNA, 18 nt, Shigella flexneri 2a str. 2457T
uuccaguuccggcauuaa

SEQ ID NO: 3826253 - RNA, 17 nt, Shigella flexneri 2a str. 2457T
uuccaguugcacgccac

SEQ ID NO: 3826254 - RNA, 19 nt, Shigella flexneri 2a str. 2457T
uuccaguuugcucaaaucc

SEQ ID NO: 3826255 - RNA, 18 nt, Shigella flexneri 2a str. 2457T
uuccauaagcccagaaca

SEQ ID NO: 3826256 - RNA, 15 nt, Shigella flexneri 2a str. 2457T
uuccauaccuaaaaa

SEQ ID NO: 3826257 - RNA, 16 nt, Shigella flexneri 2a str. 2457T
uuccauaccuaaaaaa

SEQ ID NO: 3826258 - RNA, 14 nt, Shigella flexneri 2a str. 2457T
uuccauaucaagca

SEQ ID NO: 3826259 - RNA, 15 nt, Shigella flexneri 2a str. 2457T
uuccauaugaauucc

SEQ ID NO: 3826260 - RNA, 17 nt, Shigella flexneri 2a str. 2457T
uuccauauugucuucaa

SEQ ID NO: 3826261 - RNA, 17 nt, Shigella flexneri 2a str. 2457T
uuccaucagauucagca

SEQ ID NO: 3826262 - RNA, 23 nt, Shigella flexneri 2a str. 2457T
uuccauccggcaacaucaaauua

SEQ ID NO: 3826263 - RNA, 22 nt, Shigella flexneri 2a str. 2457T
uuccaucgaccaaccuugcgcc

SEQ ID NO: 3826264 - RNA, 13 nt, Shigella flexneri 2a str. 2457T
uuccauggcagga

SEQ ID NO: 3826265 - RNA, 22 nt, Shigella flexneri 2a str. 2457T
uuccauugagaaagcccuggcg

SEQ ID NO: 3826266 - RNA, 17 nt, Shigella flexneri 2a str. 2457T
uuccauuucccugacaa

SEQ ID NO: 3826267 - RNA, 13 nt, Shigella flexneri 2a str. 2457T
uucccaaagaucu

SEQ ID NO: 3826268 - RNA, 15 nt, Shigella flexneri 2a str. 2457T
uucccaacaacagcg

SEQ ID NO: 3826269 - RNA, 20 nt, Shigella flexneri 2a str. 2457T
uucccacgucagaccaaaac

SEQ ID NO: 3826270 - RNA, 20 nt, Shigella flexneri 2a str. 2457T
uucccacugcucaaucauca

SEQ ID NO: 3826271 - RNA, 19 nt, Shigella flexneri 2a str. 2457T
uucccagauagcaacagca

SEQ ID NO: 3826272 - RNA, 16 nt, Shigella flexneri 2a str. 2457T
uucccaucucaauauu

SEQ ID NO: 3826273 - RNA, 17 nt, Shigella flexneri 2a str. 2457T
uuccccccacaaucagc

SEQ ID NO: 3826274 - RNA, 19 nt, Shigella flexneri 2a str. 2457T
uuccccgcuucagcccgcg

SEQ ID NO: 3826275 - RNA, 17 nt, Shigella flexneri 2a str. 2457T
uuccccggaugaguaca

SEQ ID NO: 3826276 - RNA, 18 nt, Shigella flexneri 2a str. 2457T
uuccccuguugcaaacug

SEQ ID NO: 3826277 - RNA, 17 nt, Shigella flexneri 2a str. 2457T
uucccgauaagggagca

SEQ ID NO: 3826278 - RNA, 17 nt, Shigella flexneri 2a str. 2457T
uucccgcacguuggcgg

SEQ ID NO: 3826279 - RNA, 16 nt, Shigella flexneri 2a str. 2457T
uucccgcagauaaaua

SEQ ID NO: 3826280 - RNA, 15 nt, Shigella flexneri 2a str. 2457T
uucccgcagcuccag

SEQ ID NO: 3826281 - RNA, 22 nt, Shigella flexneri 2a str. 2457T
uucccgcagguugggcaauuca

SEQ ID NO: 3826282 - RNA, 21 nt, Shigella flexneri 2a str. 2457T
uucccgccagcggcccggaga

SEQ ID NO: 3826283 - RNA, 17 nt, Shigella flexneri 2a str. 2457T
uucccgccguugccgca

SEQ ID NO: 3826284 - RNA, 14 nt, Shigella flexneri 2a str. 2457T
uucccggaauaauu

SEQ ID NO: 3826285 - RNA, 20 nt, Shigella flexneri 2a str. 2457T
uucccggaauaauugcgguu

SEQ ID NO: 3826286 - RNA, 19 nt, Shigella flexneri 2a str. 2457T
uucccggguaguacuuaac

SEQ ID NO: 3826287 - RNA, 22 nt, Shigella flexneri 2a str. 2457T
uucccggucaguagaauaaucu

SEQ ID NO: 3826288 - RNA, 20 nt, Shigella flexneri 2a str. 2457T
uucccguccacugcgagaaa

SEQ ID NO: 3826289 - RNA, 20 nt, Shigella flexneri 2a str. 2457T
uucccucccguuucccuguc

SEQ ID NO: 3826290 - RNA, 21 nt, Shigella flexneri 2a str. 2457T
uucccugcagucaccugcccu

SEQ ID NO: 3826291 - RNA, 17 nt, Shigella flexneri 2a str. 2457T
uucccuguucagccuga

SEQ ID NO: 3826292 - RNA, 11 nt, Shigella flexneri 2a str. 2457T
uucccuuucag

SEQ ID NO: 3826293 - RNA, 19 nt, Shigella flexneri 2a str. 2457T
uuccgacagaauauaaguc

SEQ ID NO: 3826294 - RNA, 14 nt, Shigella flexneri 2a str. 2457T
uuccgcaccugcca

SEQ ID NO: 3826295 - RNA, 15 nt, Shigella flexneri 2a str. 2457T
uuccgcaccugccag

SEQ ID NO: 3826296 - RNA, 20 nt, Shigella flexneri 2a str. 2457T
uuccgcaccugccagcgccg

SEQ ID NO: 3826297 - RNA, 23 nt, Shigella flexneri 2a str. 2457T
uuccgcacguuagaaacaaaaaa

SEQ ID NO: 3826298 - RNA, 15 nt, Shigella flexneri 2a str. 2457T
uuccgccguacgccg

SEQ ID NO: 3826299 - RNA, 14 nt, Shigella flexneri 2a str. 2457T
uuccgcgaaacagg

SEQ ID NO: 3826300 - RNA, 16 nt, Shigella flexneri 2a str. 2457T
uuccgcgccaaacauu

SEQ ID NO: 3826301 - RNA, 19 nt, Shigella flexneri 2a str. 2457T
uuccgcgucaaucugcccg

SEQ ID NO: 3826302 - RNA, 14 nt, Shigella flexneri 2a str. 2457T
uuccgcuucugcuu

SEQ ID NO: 3826303 - RNA, 22 nt, Shigella flexneri 2a str. 2457T
uuccggaucgccaaagcggcag

SEQ ID NO: 3826304 - RNA, 17 nt, Shigella flexneri 2a str. 2457T
uuccggcaagcaaauga

SEQ ID NO: 3826305 - RNA, 15 nt, Shigella flexneri 2a str. 2457T
uuccggcaccacaaa

SEQ ID NO: 3826306 - RNA, 18 nt, Shigella flexneri 2a str. 2457T
uuccggcagcauguguaa

SEQ ID NO: 3826307 - RNA, 15 nt, Shigella flexneri 2a str. 2457T
uuccggccaucgccu

SEQ ID NO: 3826308 - RNA, 17 nt, Shigella flexneri 2a str. 2457T
uuccggcguccaccugc

SEQ ID NO: 3826309 - RNA, 18 nt, Shigella flexneri 2a str. 2457T
uuccgggagcaauuugua

SEQ ID NO: 3826310 - RNA, 19 nt, Shigella flexneri 2a str. 2457T
uuccgguuggccugccgga

SEQ ID NO: 3826311 - RNA, 18 nt, Shigella flexneri 2a str. 2457T
uuccgugagcggcaggac

SEQ ID NO: 3826312 - RNA, 14 nt, Shigella flexneri 2a str. 2457T
uuccuaaaguuguu

SEQ ID NO: 3826313 - RNA, 17 nt, Shigella flexneri 2a str. 2457T
uuccuaacauaaugcaa

SEQ ID NO: 3826314 - RNA, 14 nt, Shigella flexneri 2a str. 2457T
uuccuacugcuccu

SEQ ID NO: 3826315 - RNA, 18 nt, Shigella flexneri 2a str. 2457T
uuccuaucuucauggaga

SEQ ID NO: 3826316 - RNA, 13 nt, Shigella flexneri 2a str. 2457T
uuccuccauugaa

SEQ ID NO: 3826317 - RNA, 16 nt, Shigella flexneri 2a str. 2457T
uuccucccuuucaccc

SEQ ID NO: 3826318 - RNA, 21 nt, Shigella flexneri 2a str. 2457T
uuccuccggcaccgggcuuug

SEQ ID NO: 3826319 - RNA, 18 nt, Shigella flexneri 2a str. 2457T
uuccuccugucuucccug

SEQ ID NO: 3826320 - RNA, 12 nt, Shigella flexneri 2a str. 2457T
uuccucugcccu

SEQ ID NO: 3826321 - RNA, 14 nt, Shigella flexneri 2a str. 2457T
uuccugaagcgcug

SEQ ID NO: 3826322 - RNA, 14 nt, Shigella flexneri 2a str. 2457T
uuccugacccagca

SEQ ID NO: 3826323 - RNA, 17 nt, Shigella flexneri 2a str. 2457T
uuccugagcaauaaucu

SEQ ID NO: 3826324 - RNA, 18 nt, Shigella flexneri 2a str. 2457T
uuccugagcacuggggcu

SEQ ID NO: 3826325 - RNA, 16 nt, Shigella flexneri 2a str. 2457T
uuccugaguaauaacu

SEQ ID NO: 3826326 - RNA, 15 nt, Shigella flexneri 2a str. 2457T
uuccugagugaauau

SEQ ID NO: 3826327 - RNA, 15 nt, Shigella flexneri 2a str. 2457T
uucuacacccagccc

SEQ ID NO: 3826328 - RNA, 16 nt, Shigella flexneri 2a str. 2457T
uucuacagaaaugaaa

SEQ ID NO: 3826329 - RNA, 22 nt, Shigella flexneri 2a str. 2457T
uucuaccagguuucgcaauaac

SEQ ID NO: 3826330 - RNA, 21 nt, Shigella flexneri 2a str. 2457T
uucuaccgucuguaaccagau

SEQ ID NO: 3826331 - RNA, 17 nt, Shigella flexneri 2a str. 2457T
uucuacggguaaguguu

SEQ ID NO: 3826332 - RNA, 18 nt, Shigella flexneri 2a str. 2457T
uucuaugaagaacuggaa

SEQ ID NO: 3826333 - RNA, 17 nt, Shigella flexneri 2a str. 2457T
uucuauuuugcauuauu

SEQ ID NO: 3826334 - RNA, 16 nt, Shigella flexneri 2a str. 2457T
uucucaaucccuuucu

SEQ ID NO: 3826335 - RNA, 23 nt, Shigella flexneri 2a str. 2457T
uucucacccgcaaacaggaacac

SEQ ID NO: 3826336 - RNA, 22 nt, Shigella flexneri 2a str. 2457T
uucucaccuauguggaaacagu

SEQ ID NO: 3826337 - RNA, 15 nt, Shigella flexneri 2a str. 2457T
uucucaccuugcucu

SEQ ID NO: 3826338 - RNA, 20 nt, Shigella flexneri 2a str. 2457T
uucucacuccagccagagcc

SEQ ID NO: 3826339 - RNA, 22 nt, Shigella flexneri 2a str. 2457T
uucucagagacucuuaaaauau

SEQ ID NO: 3826340 - RNA, 15 nt, Shigella flexneri 2a str. 2457T
uucucagcaguuuuu

SEQ ID NO: 3826341 - RNA, 17 nt, Shigella flexneri 2a str. 2457T
uucucagcgguaauggu

SEQ ID NO: 3826342 - RNA, 20 nt, Shigella flexneri 2a str. 2457T
uucucagguagcgcauaagc

SEQ ID NO: 3826343 - RNA, 12 nt, Shigella flexneri 2a str. 2457T
uucucauaaaac

SEQ ID NO: 3826344 - RNA, 19 nt, Shigella flexneri 2a str. 2457T
uucuccacaccguugccgc

SEQ ID NO: 3826345 - RNA, 11 nt, Shigella flexneri 2a str. 2457T
uucuccagcuu

SEQ ID NO: 3826346 - RNA, 16 nt, Shigella flexneri 2a str. 2457T
uucuccucccuugucu

SEQ ID NO: 3826347 - RNA, 18 nt, Shigella flexneri 2a str. 2457T
uucuccucccuugucuga

SEQ ID NO: 3826348 - RNA, 16 nt, Shigella flexneri 2a str. 2457T
uucuccuucacucuau

SEQ ID NO: 3826349 - RNA, 21 nt, Shigella flexneri 2a str. 2457T
uucuccuuucuuucuggaaau

SEQ ID NO: 3826350 - RNA, 16 nt, Shigella flexneri 2a str. 2457T
uucucgauaaaaccuu

SEQ ID NO: 3826351 - RNA, 13 nt, Shigella flexneri 2a str. 2457T
uucucgccaccgg

SEQ ID NO: 3826352 - RNA, 18 nt, Shigella flexneri 2a str. 2457T
uucucgcgaaccgccugg

SEQ ID NO: 3826353 - RNA, 18 nt, Shigella flexneri 2a str. 2457T
uucucgcggacugccugg

SEQ ID NO: 3826354 - RNA, 21 nt, Shigella flexneri 2a str. 2457T
uucucgcuccauuccaucgcc

SEQ ID NO: 3826355 - RNA, 18 nt, Shigella flexneri 2a str. 2457T
uucucggugaacgccugc

SEQ ID NO: 3826356 - RNA, 15 nt, Shigella flexneri 2a str. 2457T
uucucuacgcccucg

SEQ ID NO: 3826357 - RNA, 18 nt, Shigella flexneri 2a str. 2457T
uucucucugauuacccuu

SEQ ID NO: 3826358 - RNA, 16 nt, Shigella flexneri 2a str. 2457T
uucucuuuccagcaac

SEQ ID NO: 3826359 - RNA, 20 nt, Shigella flexneri 2a str. 2457T
uucucuuuguuaaacagugc

SEQ ID NO: 3826360 - RNA, 19 nt, Shigella flexneri 2a str. 2457T
uucucuuuuguuacuuauu

SEQ ID NO: 3826361 - RNA, 22 nt, Shigella flexneri 2a str. 2457T
uucugaaaacggacaugccauu

SEQ ID NO: 3826362 - RNA, 22 nt, Shigella flexneri 2a str. 2457T
uucugaaaaucauacauccucu

SEQ ID NO: 3826363 - RNA, 18 nt, Shigella flexneri 2a str. 2457T
uucugaacugaacaaaaa

SEQ ID NO: 3826364 - RNA, 22 nt, Shigella flexneri 2a str. 2457T
uucugaaggauuagccggauau

SEQ ID NO: 3826365 - RNA, 21 nt, Shigella flexneri 2a str. 2457T
uucugagucaauuucugcaaa

SEQ ID NO: 3826366 - RNA, 19 nt, Shigella flexneri 2a str. 2457T
uucugcaagaggaaauaag

SEQ ID NO: 3826367 - RNA, 15 nt, Shigella flexneri 2a str. 2457T
uucugcacgcuugcc

SEQ ID NO: 3826368 - RNA, 14 nt, Shigella flexneri 2a str. 2457T
uucugccagcugcu

SEQ ID NO: 3826369 - RNA, 17 nt, Shigella flexneri 2a str. 2457T
uucugccaggcuggcag

SEQ ID NO: 3826370 - RNA, 15 nt, Shigella flexneri 2a str. 2457T
uucugccgcuuccag

SEQ ID NO: 3826371 - RNA, 22 nt, Shigella flexneri 2a str. 2457T
uucugccuguccaccacgcugc

SEQ ID NO: 3826372 - RNA, 20 nt, Shigella flexneri 2a str. 2457T
uucugcgcuugguuuugcca

SEQ ID NO: 3826373 - RNA, 20 nt, Shigella flexneri 2a str. 2457T
uucugcguucugauuuaauc

SEQ ID NO: 3826374 - RNA, 14 nt, Shigella flexneri 2a str. 2457T
uucugcugccuaca

SEQ ID NO: 3826375 - RNA, 16 nt, Shigella flexneri 2a str. 2457T
uucugcuucguuaacg

SEQ ID NO: 3826376 - RNA, 18 nt, Shigella flexneri 2a str. 2457T
uucugcuuuggcugccgc

SEQ ID NO: 3826377 - RNA, 16 nt, Shigella flexneri 2a str. 2457T
uucuggagcauggcug

SEQ ID NO: 3826378 - RNA, 13 nt, Shigella flexneri 2a str. 2457T
uucuggauaauca

SEQ ID NO: 3826379 - RNA, 14 nt, Shigella flexneri 2a str. 2457T
uucuggaugccauc

SEQ ID NO: 3826380 - RNA, 13 nt, Shigella flexneri 2a str. 2457T
uucuggcaccagu

SEQ ID NO: 3826381 - RNA, 22 nt, Shigella flexneri 2a str. 2457T
uucuggcaccggacgcuuguca

SEQ ID NO: 3826382 - RNA, 21 nt, Shigella flexneri 2a str. 2457T
uucuggcaccuguaccagccc

SEQ ID NO: 3826383 - RNA, 12 nt, Shigella flexneri 2a str. 2457T
uucuggcugcca

SEQ ID NO: 3826384 - RNA, 20 nt, Shigella flexneri 2a str. 2457T
uucuggguaaugacuccaac

SEQ ID NO: 3826385 - RNA, 14 nt, Shigella flexneri 2a str. 2457T
uucuggucauugcc

SEQ ID NO: 3826386 - RNA, 17 nt, Shigella flexneri 2a str. 2457T
uucugguuauauuuccc

SEQ ID NO: 3826387 - RNA, 15 nt, Shigella flexneri 2a str. 2457T
uucuguagauaaaac

SEQ ID NO: 3826388 - RNA, 22 nt, Shigella flexneri 2a str. 2457T
uucuguagauaaaacacucuuu

SEQ ID NO: 3826389 - RNA, 15 nt, Shigella flexneri 2a str. 2457T
uucugucggcaaaac

SEQ ID NO: 3826390 - RNA, 20 nt, Shigella flexneri 2a str. 2457T
uucugucuuaacgcaccaug

SEQ ID NO: 3826391 - RNA, 19 nt, Shigella flexneri 2a str. 2457T
uucugugcaaucgccgcug

SEQ ID NO: 3826392 - RNA, 13 nt, Shigella flexneri 2a str. 2457T
uucugugcaucug

SEQ ID NO: 3826393 - RNA, 12 nt, Shigella flexneri 2a str. 2457T
uucugugcgcca

SEQ ID NO: 3826394 - RNA, 16 nt, Shigella flexneri 2a str. 2457T
uucuguggcagggcag

SEQ ID NO: 3826395 - RNA, 21 nt, Shigella flexneri 2a str. 2457T
uucuguguaaaugccuuucuc

SEQ ID NO: 3826396 - RNA, 14 nt, Shigella flexneri 2a str. 2457T
uucuguugcugaaa

SEQ ID NO: 3826397 - RNA, 21 nt, Shigella flexneri 2a str. 2457T
uucuguugcugaaauuccauc

SEQ ID NO: 3826398 - RNA, 19 nt, Shigella flexneri 2a str. 2457T
uucuguuuucguaauaauu

SEQ ID NO: 3826399 - RNA, 17 nt, Shigella flexneri 2a str. 2457T
uucuuacgccgacuaau

SEQ ID NO: 3826400 - RNA, 14 nt, Shigella flexneri 2a str. 2457T
uucuuauaaagaaa

SEQ ID NO: 3826401 - RNA, 21 nt, Shigella flexneri 2a str. 2457T
uucuuauaaagaaaaucugaa

SEQ ID NO: 3826402 - RNA, 16 nt, Shigella flexneri 2a str. 2457T
uucuuauuaaauuguc

SEQ ID NO: 3826403 - RNA, 13 nt, Shigella flexneri 2a str. 2457T
uucuucaaaaaua

SEQ ID NO: 3826404 - RNA, 17 nt, Shigella flexneri 2a str. 2457T
uucuucaacaauugaag

SEQ ID NO: 3826405 - RNA, 17 nt, Shigella flexneri 2a str. 2457T
uucuucaagccaggcuu

SEQ ID NO: 3826406 - RNA, 21 nt, Shigella flexneri 2a str. 2457T
uucuucaagccaggcuuuaaa

SEQ ID NO: 3826407 - RNA, 19 nt, Shigella flexneri 2a str. 2457T
uucuucaaguguggccgcc

SEQ ID NO: 3826408 - RNA, 18 nt, Shigella flexneri 2a str. 2457T
uucuucacggaaaauauu

SEQ ID NO: 3826409 - RNA, 14 nt, Shigella flexneri 2a str. 2457T
uucuucacugacgc

SEQ ID NO: 3826410 - RNA, 15 nt, Shigella flexneri 2a str. 2457T
uucuucagcagccca

SEQ ID NO: 3826411 - RNA, 16 nt, Shigella flexneri 2a str. 2457T
uucuucaugccaaaag

SEQ ID NO: 3826412 - RNA, 21 nt, Shigella flexneri 2a str. 2457T
uucuucauucccggaaauugc

SEQ ID NO: 3826413 - RNA, 23 nt, Shigella flexneri 2a str. 2457T
uucuucauucccggaaauugcca

SEQ ID NO: 3826414 - RNA, 15 nt, Shigella flexneri 2a str. 2457T
uucuuccagcggcag

SEQ ID NO: 3826415 - RNA, 15 nt, Shigella flexneri 2a str. 2457T
uucuucccaaaucuu

SEQ ID NO: 3826416 - RNA, 20 nt, Shigella flexneri 2a str. 2457T
uucuuccucgucccaaaagc

SEQ ID NO: 3826417 - RNA, 20 nt, Shigella flexneri 2a str. 2457T
uucuucgcugacaguaccca

SEQ ID NO: 3826418 - RNA, 17 nt, Shigella flexneri 2a str. 2457T
uucuucggucagagaau

SEQ ID NO: 3826419 - RNA, 23 nt, Shigella flexneri 2a str. 2457T
uucuucgguucguaagcaagaac

SEQ ID NO: 3826420 - RNA, 22 nt, Shigella flexneri 2a str. 2457T
uucuucgucgucuucgucccag

SEQ ID NO: 3826421 - RNA, 19 nt, Shigella flexneri 2a str. 2457T
uucuucuccggcauccuua

SEQ ID NO: 3826422 - RNA, 22 nt, Shigella flexneri 2a str. 2457T
uucuucucgauaaaaccuuccu

SEQ ID NO: 3826423 - RNA, 15 nt, Shigella flexneri 2a str. 2457T
uucuucuucacuaag

SEQ ID NO: 3826424 - RNA, 16 nt, Shigella flexneri 2a str. 2457T
uugcacacuuuccaua

SEQ ID NO: 3826425 - RNA, 16 nt, Shigella flexneri 2a str. 2457T
uugcaccagcaacaag

SEQ ID NO: 3826426 - RNA, 17 nt, Shigella flexneri 2a str. 2457T
uugcaccgaggccaaaa

SEQ ID NO: 3826427 - RNA, 15 nt, Shigella flexneri 2a str. 2457T
uugcaccuaaagcgc

SEQ ID NO: 3826428 - RNA, 16 nt, Shigella flexneri 2a str. 2457T
uugcaccucugcugcu

SEQ ID NO: 3826429 - RNA, 20 nt, Shigella flexneri 2a str. 2457T
uugcacgaaggugcauugcu

SEQ ID NO: 3826430 - RNA, 17 nt, Shigella flexneri 2a str. 2457T
uugcagcacacauuaua

SEQ ID NO: 3826431 - RNA, 14 nt, Shigella flexneri 2a str. 2457T
uugcaggaaaaacu

SEQ ID NO: 3826432 - RNA, 20 nt, Shigella flexneri 2a str. 2457T
uugcaggccagauaaggcgu

SEQ ID NO: 3826433 - RNA, 23 nt, Shigella flexneri 2a str. 2457T
uugcaggcgauccuguucaaaca

SEQ ID NO: 3826434 - RNA, 21 nt, Shigella flexneri 2a str. 2457T
uugcaggucguccugcaaagc

SEQ ID NO: 3826435 - RNA, 14 nt, Shigella flexneri 2a str. 2457T
uugcagguucugcu

SEQ ID NO: 3826436 - RNA, 11 nt, Shigella flexneri 2a str. 2457T
uugcaguuccu

SEQ ID NO: 3826437 - RNA, 22 nt, Shigella flexneri 2a str. 2457T
uugcauaaaugccgcaaugugc

SEQ ID NO: 3826438 - RNA, 18 nt, Shigella flexneri 2a str. 2457T
uugcauagcggcgacuug

SEQ ID NO: 3826439 - RNA, 16 nt, Shigella flexneri 2a str. 2457T
uugcaucccagaaaaa

SEQ ID NO: 3826440 - RNA, 17 nt, Shigella flexneri 2a str. 2457T
uugcaucccagaaaaaa

SEQ ID NO: 3826441 - RNA, 13 nt, Shigella flexneri 2a str. 2457T
uugcauccgguca

SEQ ID NO: 3826442 - RNA, 12 nt, Shigella flexneri 2a str. 2457T
uugcaucgccau

SEQ ID NO: 3826443 - RNA, 16 nt, Shigella flexneri 2a str. 2457T
uugcaucgcuugaaaa

SEQ ID NO: 3826444 - RNA, 21 nt, Shigella flexneri 2a str. 2457T
uugcauuccaguccacaucaa

SEQ ID NO: 3826445 - RNA, 17 nt, Shigella flexneri 2a str. 2457T
uugcauuuccauaaauu

SEQ ID NO: 3826446 - RNA, 15 nt, Shigella flexneri 2a str. 2457T
uugcauuuuaaauga

SEQ ID NO: 3826447 - RNA, 15 nt, Shigella flexneri 2a str. 2457T
uugccaccaugcaaa

SEQ ID NO: 3826448 - RNA, 21 nt, Shigella flexneri 2a str. 2457T
uugccaccgguacaaacauca

SEQ ID NO: 3826449 - RNA, 23 nt, Shigella flexneri 2a str. 2457T
uugccaccgguacaaacaucauc

SEQ ID NO: 3826450 - RNA, 22 nt, Shigella flexneri 2a str. 2457T
uugccacugcccgagaacagca

SEQ ID NO: 3826451 - RNA, 14 nt, Shigella flexneri 2a str. 2457T
uugccacugccggu

SEQ ID NO: 3826452 - RNA, 21 nt, Shigella flexneri 2a str. 2457T
uugccagagcagcaacaagcc

SEQ ID NO: 3826453 - RNA, 18 nt, Shigella flexneri 2a str. 2457T
uugccagagcccaucaca

SEQ ID NO: 3826454 - RNA, 15 nt, Shigella flexneri 2a str. 2457T
uugccagauaaacau

SEQ ID NO: 3826455 - RNA, 14 nt, Shigella flexneri 2a str. 2457T
uugccagauaaaua

SEQ ID NO: 3826456 - RNA, 17 nt, Shigella flexneri 2a str. 2457T
uugccagcaugacuacc

SEQ ID NO: 3826457 - RNA, 12 nt, Shigella flexneri 2a str. 2457T
uugccagcgcca

SEQ ID NO: 3826458 - RNA, 10 nt, Shigella flexneri 2a str. 2457T
uugccaggac

SEQ ID NO: 3826459 - RNA, 18 nt, Shigella flexneri 2a str. 2457T
uugccagugaaaguuuuc

SEQ ID NO: 3826460 - RNA, 12 nt, Shigella flexneri 2a str. 2457T
uugccauaucuu

SEQ ID NO: 3826461 - RNA, 24 nt, Shigella flexneri 2a str. 2457T
uugccaugcaauauuguagcaacu

SEQ ID NO: 3826462 - RNA, 18 nt, Shigella flexneri 2a str. 2457T
uugcccagcgcaucaggc

SEQ ID NO: 3826463 - RNA, 21 nt, Shigella flexneri 2a str. 2457T
uugcccccugaagcaguuuca

SEQ ID NO: 3826464 - RNA, 17 nt, Shigella flexneri 2a str. 2457T
uugccccucuaacucuu

SEQ ID NO: 3826465 - RNA, 16 nt, Shigella flexneri 2a str. 2457T
uugcccgcaaagauga

SEQ ID NO: 3826466 - RNA, 20 nt, Shigella flexneri 2a str. 2457T
uugcccgcgcguuaacuccc

SEQ ID NO: 3826467 - RNA, 19 nt, Shigella flexneri 2a str. 2457T
uugcccgggcgagcaaugu

SEQ ID NO: 3826468 - RNA, 20 nt, Shigella flexneri 2a str. 2457T
uugcccuuuucaccaugggc

SEQ ID NO: 3826469 - RNA, 19 nt, Shigella flexneri 2a str. 2457T
uugccgaagauagcgucau

SEQ ID NO: 3826470 - RNA, 20 nt, Shigella flexneri 2a str. 2457T
uugccgagaaaaucgugcca

SEQ ID NO: 3826471 - RNA, 16 nt, Shigella flexneri 2a str. 2457T
uugccgaugauuccca

SEQ ID NO: 3826472 - RNA, 14 nt, Shigella flexneri 2a str. 2457T
uugccgcuacauca

SEQ ID NO: 3826473 - RNA, 19 nt, Shigella flexneri 2a str. 2457T
uugccgcuuaaauuuccac

SEQ ID NO: 3826474 - RNA, 17 nt, Shigella flexneri 2a str. 2457T
uugccggacgcugagca

SEQ ID NO: 3826475 - RNA, 17 nt, Shigella flexneri 2a str. 2457T
uugccgggcgcaucaga

SEQ ID NO: 3826476 - RNA, 18 nt, Shigella flexneri 2a str. 2457T
uugccgggcgugcugccg

SEQ ID NO: 3826477 - RNA, 16 nt, Shigella flexneri 2a str. 2457T
uugccguauacacacu

SEQ ID NO: 3826478 - RNA, 18 nt, Shigella flexneri 2a str. 2457T
uugccguccggcaucgca

SEQ ID NO: 3826479 - RNA, 19 nt, Shigella flexneri 2a str. 2457T
uugccguccggcaucgcaa

SEQ ID NO: 3826480 - RNA, 13 nt, Shigella flexneri 2a str. 2457T
uugccgugugccg

SEQ ID NO: 3826481 - RNA, 15 nt, Shigella flexneri 2a str. 2457T
uugccguucuucccg

SEQ ID NO: 3826482 - RNA, 13 nt, Shigella flexneri 2a str. 2457T
uugccguugaucu

SEQ ID NO: 3826483 - RNA, 18 nt, Shigella flexneri 2a str. 2457T
uugccucguucuucccuc

SEQ ID NO: 3826484 - RNA, 10 nt, Shigella flexneri 2a str. 2457T
uugccugaug

SEQ ID NO: 3826485 - RNA, 20 nt, Shigella flexneri 2a str. 2457T
uugccugaugcgcugggcaa

SEQ ID NO: 3826486 - RNA, 21 nt, Shigella flexneri 2a str. 2457T
uugccugauggccugcucaac

SEQ ID NO: 3826487 - RNA, 16 nt, Shigella flexneri 2a str. 2457T
uugccugauuuuauuu

SEQ ID NO: 3826488 - RNA, 18 nt, Shigella flexneri 2a str. 2457T
uugccugcgaagcucuuu

SEQ ID NO: 3826489 - RNA, 19 nt, Shigella flexneri 2a str. 2457T
uugccugcgaagcucuuuc

SEQ ID NO: 3826490 - RNA, 18 nt, Shigella flexneri 2a str. 2457T
uugccugugcaaccuuuu

SEQ ID NO: 3826491 - RNA, 19 nt, Shigella flexneri 2a str. 2457T
uugccugugcaaccuuuuc

SEQ ID NO: 3826492 - RNA, 21 nt, Shigella flexneri 2a str. 2457T
uugcgaacgcguucacugccg

SEQ ID NO: 3826493 - RNA, 16 nt, Shigella flexneri 2a str. 2457T
uugcgcauccagcgcu

SEQ ID NO: 3826494 - RNA, 21 nt, Shigella flexneri 2a str. 2457T
uugcgccgguuuaucuccgcu

SEQ ID NO: 3826495 - RNA, 15 nt, Shigella flexneri 2a str. 2457T
uugcgccugcuuaac

SEQ ID NO: 3826496 - RNA, 15 nt, Shigella flexneri 2a str. 2457T
uugcgcugaaguaau

SEQ ID NO: 3826497 - RNA, 18 nt, Shigella flexneri 2a str. 2457T
uugcgcuuuucuaccacc

SEQ ID NO: 3826498 - RNA, 19 nt, Shigella flexneri 2a str. 2457T
uugcggaaacugucaauaa

SEQ ID NO: 3826499 - RNA, 13 nt, Shigella flexneri 2a str. 2457T
uugcggcacccau

SEQ ID NO: 3826500 - RNA, 16 nt, Shigella flexneri 2a str. 2457T
uugcggcuauauucaa

SEQ ID NO: 3826501 - RNA, 18 nt, Shigella flexneri 2a str. 2457T
uugcgggccaaagaccag

SEQ ID NO: 3826502 - RNA, 15 nt, Shigella flexneri 2a str. 2457T
uugcgguuucaacug

SEQ ID NO: 3826503 - RNA, 12 nt, Shigella flexneri 2a str. 2457T
uugcguaacuga

SEQ ID NO: 3826504 - RNA, 13 nt, Shigella flexneri 2a str. 2457T
uugcgucaaugcc

SEQ ID NO: 3826505 - RNA, 13 nt, Shigella flexneri 2a str. 2457T
uugcgucacaucu

SEQ ID NO: 3826506 - RNA, 20 nt, Shigella flexneri 2a str. 2457T
uugcguuauuuucggcaccu

SEQ ID NO: 3826507 - RNA, 18 nt, Shigella flexneri 2a str. 2457T
uugcguucaucaguucca

SEQ ID NO: 3826508 - RNA, 19 nt, Shigella flexneri 2a str. 2457T
uugcuaaccaacaaugcaa

SEQ ID NO: 3826509 - RNA, 19 nt, Shigella flexneri 2a str. 2457T
uugcuaacuggaaaggaau

SEQ ID NO: 3826510 - RNA, 16 nt, Shigella flexneri 2a str. 2457T
uugcuaauuuagugac

SEQ ID NO: 3826511 - RNA, 23 nt, Shigella flexneri 2a str. 2457T
uugcuaccccugagacaguuauu

SEQ ID NO: 3826512 - RNA, 17 nt, Shigella flexneri 2a str. 2457T
uugcuaccgcgaugacc

SEQ ID NO: 3826513 - RNA, 23 nt, Shigella flexneri 2a str. 2457T
uugcuaccgcuucgcucacauca

SEQ ID NO: 3826514 - RNA, 14 nt, Shigella flexneri 2a str. 2457T
uugcuauggggaaa

SEQ ID NO: 3826515 - RNA, 16 nt, Shigella flexneri 2a str. 2457T
uugcucaaauccauca

SEQ ID NO: 3826516 - RNA, 23 nt, Shigella flexneri 2a str. 2457T
uugcucaggaguaaacuuucccu

SEQ ID NO: 3826517 - RNA, 13 nt, Shigella flexneri 2a str. 2457T
uugcuccauccau

SEQ ID NO: 3826518 - RNA, 20 nt, Shigella flexneri 2a str. 2457T
uugcucugguucaccauucu

SEQ ID NO: 3826519 - RNA, 13 nt, Shigella flexneri 2a str. 2457T
uugcucuguuuuc

SEQ ID NO: 3826520 - RNA, 15 nt, Shigella flexneri 2a str. 2457T
uugcugauucucccu

SEQ ID NO: 3826521 - RNA, 14 nt, Shigella flexneri 2a str. 2457T
uugcugcaccaggc

SEQ ID NO: 3826522 - RNA, 17 nt, Shigella flexneri 2a str. 2457T
uugugcaccagcuggcu

SEQ ID NO: 3826523 - RNA, 20 nt, Shigella flexneri 2a str. 2457T
uugugcacgauugccggaug

SEQ ID NO: 3826524 - RNA, 12 nt, Shigella flexneri 2a str. 2457T
uugugccagacc

SEQ ID NO: 3826525 - RNA, 14 nt, Shigella flexneri 2a str. 2457T
uugugccagaccaa

SEQ ID NO: 3826526 - RNA, 21 nt, Shigella flexneri 2a str. 2457T
uugugccagaccaaacagcau

SEQ ID NO: 3826527 - RNA, 13 nt, Shigella flexneri 2a str. 2457T
uugugccaguuca

SEQ ID NO: 3826528 - RNA, 13 nt, Shigella flexneri 2a str. 2457T
uugugcugaacga

SEQ ID NO: 3826529 - RNA, 16 nt, Shigella flexneri 2a str. 2457T
uugugcugugacagau

SEQ ID NO: 3826530 - RNA, 15 nt, Shigella flexneri 2a str. 2457T
uuguggcggaaagac

SEQ ID NO: 3826531 - RNA, 15 nt, Shigella flexneri 2a str. 2457T
uuguguaaguuuaac

SEQ ID NO: 3826532 - RNA, 16 nt, Shigella flexneri 2a str. 2457T
uugugugaaaucagca

SEQ ID NO: 3826533 - RNA, 15 nt, Shigella flexneri 2a str. 2457T
uuguuacgguguuca

SEQ ID NO: 3826534 - RNA, 16 nt, Shigella flexneri 2a str. 2457T
uuguuaugagauaauu

SEQ ID NO: 3826535 - RNA, 16 nt, Shigella flexneri 2a str. 2457T
uuguucaugccggaug

SEQ ID NO: 3826536 - RNA, 23 nt, Shigella flexneri 2a str. 2457T
uuguugcgcugaaacuuuaccaa

SEQ ID NO: 3826537 - RNA, 16 nt, Shigella flexneri 2a str. 2457T
uuguugcuauggggaa

SEQ ID NO: 3826538 - RNA, 17 nt, Shigella flexneri 2a str. 2457T
uuguugucuauuuccac

SEQ ID NO: 3826539 - RNA, 12 nt, Shigella flexneri 2a str. 2457T
uuguuuaaauau

SEQ ID NO: 3826540 - RNA, 22 nt, Shigella flexneri 2a str. 2457T
uuguuuuuugagcgguacacca

SEQ ID NO: 3826541 - RNA, 13 nt, Shigella flexneri 2a str. 2457T
uuuaaaaaagaau

SEQ ID NO: 3826542 - RNA, 12 nt, Shigella flexneri 2a str. 2457T
uuuaaacauuaa

SEQ ID NO: 3826543 - RNA, 23 nt, Shigella flexneri 2a str. 2457T
uuuaaagagacagaaucaggcca

SEQ ID NO: 3826544 - RNA, 13 nt, Shigella flexneri 2a str. 2457T
uuuaaauuuccca

SEQ ID NO: 3826545 - RNA, 11 nt, Shigella flexneri 2a str. 2457T
uuuaaccaaca

SEQ ID NO: 3826546 - RNA, 16 nt, Shigella flexneri 2a str. 2457T
uuuaaccagucgcuga

SEQ ID NO: 3826547 - RNA, 14 nt, Shigella flexneri 2a str. 2457T
uuuaaccguggugc

SEQ ID NO: 3826548 - RNA, 16 nt, Shigella flexneri 2a str. 2457T
uuuaacgcaugcacau

SEQ ID NO: 3826549 - RNA, 14 nt, Shigella flexneri 2a str. 2457T
uuuaacuuuaauuu

SEQ ID NO: 3826550 - RNA, 15 nt, Shigella flexneri 2a str. 2457T
uuuaagaaaaaagau

SEQ ID NO: 3826551 - RNA, 18 nt, Shigella flexneri 2a str. 2457T
uuuaagcuggguaaaugc

SEQ ID NO: 3826552 - RNA, 19 nt, Shigella flexneri 2a str. 2457T
uuuaagcuggguaaaugca

SEQ ID NO: 3826553 - RNA, 17 nt, Shigella flexneri 2a str. 2457T
uuuaaggaaaaacgaau

SEQ ID NO: 3826554 - RNA, 20 nt, Shigella flexneri 2a str. 2457T
uuuaagucggucaaguaauu

SEQ ID NO: 3826555 - RNA, 13 nt, Shigella flexneri 2a str. 2457T
uuuaaguuuaugg

SEQ ID NO: 3826556 - RNA, 23 nt, Shigella flexneri 2a str. 2457T
uuuaauaaucucgccuuaucaga

SEQ ID NO: 3826557 - RNA, 20 nt, Shigella flexneri 2a str. 2457T
uuuaauauccggugcauuca

SEQ ID NO: 3826558 - RNA, 15 nt, Shigella flexneri 2a str. 2457T
uuuaauauuaaacca

SEQ ID NO: 3826559 - RNA, 16 nt, Shigella flexneri 2a str. 2457T
uuuaauauuaaaccac

SEQ ID NO: 3826560 - RNA, 12 nt, Shigella flexneri 2a str. 2457T
uuuaaucaccug

SEQ ID NO: 3826561 - RNA, 16 nt, Shigella flexneri 2a str. 2457T
uuuaaugccaaucuuc

SEQ ID NO: 3826562 - RNA, 18 nt, Shigella flexneri 2a str. 2457T
uuuaauggcgacauaaaa

SEQ ID NO: 3826563 - RNA, 12 nt, Shigella flexneri 2a str. 2457T
uuuaauucagga

SEQ ID NO: 3826564 - RNA, 12 nt, Shigella flexneri 2a str. 2457T
uuuaauuccugc

SEQ ID NO: 3826565 - RNA, 13 nt, Shigella flexneri 2a str. 2457T
uuuaauugccauu

SEQ ID NO: 3826566 - RNA, 17 nt, Shigella flexneri 2a str. 2457T
uuuacagauuucccauu

SEQ ID NO: 3826567 - RNA, 22 nt, Shigella flexneri 2a str. 2457T
uuuacagccggacccacacccc

SEQ ID NO: 3826568 - RNA, 13 nt, Shigella flexneri 2a str. 2457T
uuuacaucaucag

SEQ ID NO: 3826569 - RNA, 22 nt, Shigella flexneri 2a str. 2457T
uuuacaugcgcgacaaaaauua

SEQ ID NO: 3826570 - RNA, 18 nt, Shigella flexneri 2a str. 2457T
uuuaccaccgucaaaaaa

SEQ ID NO: 3826571 - RNA, 16 nt, Shigella flexneri 2a str. 2457T
uuuacccaauccccca

SEQ ID NO: 3826572 - RNA, 13 nt, Shigella flexneri 2a str. 2457T
uuuacccaggccu

SEQ ID NO: 3826573 - RNA, 21 nt, Shigella flexneri 2a str. 2457T
uuuaccccacgucaucuguca

SEQ ID NO: 3826574 - RNA, 18 nt, Shigella flexneri 2a str. 2457T
uuuaccgcaacucauuua

SEQ ID NO: 3826575 - RNA, 23 nt, Shigella flexneri 2a str. 2457T
uuuaccggucaggauuuccagcu

SEQ ID NO: 3826576 - RNA, 21 nt, Shigella flexneri 2a str. 2457T
uuuaccguagcguucuuugag

SEQ ID NO: 3826577 - RNA, 14 nt, Shigella flexneri 2a str. 2457T
uuuaccgucaccga

SEQ ID NO: 3826578 - RNA, 16 nt, Shigella flexneri 2a str. 2457T
uuuaccucgaaaacca

SEQ ID NO: 3826579 - RNA, 15 nt, Shigella flexneri 2a str. 2457T
uuuaccucuuucuca

SEQ ID NO: 3826580 - RNA, 14 nt, Shigella flexneri 2a str. 2457T
uuuaccuucauuug

SEQ ID NO: 3826581 - RNA, 17 nt, Shigella flexneri 2a str. 2457T
uuuaccuugcucaucca

SEQ ID NO: 3826582 - RNA, 17 nt, Shigella flexneri 2a str. 2457T
uuuacgaagaaagcaau

SEQ ID NO: 3826583 - RNA, 21 nt, Shigella flexneri 2a str. 2457T
uuuacgaagaaagcaauauug

SEQ ID NO: 3826584 - RNA, 13 nt, Shigella flexneri 2a str. 2457T
uuuacgcaaccac

SEQ ID NO: 3826585 - RNA, 14 nt, Shigella flexneri 2a str. 2457T
uuuacgcaaccaca

SEQ ID NO: 3826586 - RNA, 19 nt, Shigella flexneri 2a str. 2457T
uuuacgccgcaucaggcau

SEQ ID NO: 3826587 - RNA, 14 nt, Shigella flexneri 2a str. 2457T
uuuacgccgcaucc

SEQ ID NO: 3826588 - RNA, 22 nt, Shigella flexneri 2a str. 2457T
uuuacgcgggucguugaucggc

SEQ ID NO: 3826589 - RNA, 18 nt, Shigella flexneri 2a str. 2457T
uuuacgcucccacggaau

SEQ ID NO: 3826590 - RNA, 17 nt, Shigella flexneri 2a str. 2457T
uuuacggcuugcgcgca

SEQ ID NO: 3826591 - RNA, 15 nt, Shigella flexneri 2a str. 2457T
uuuacuauuauuuuu

SEQ ID NO: 3826592 - RNA, 24 nt, Shigella flexneri 2a str. 2457T
uuuacuauuauuuuucauauggau

SEQ ID NO: 3826593 - RNA, 22 nt, Shigella flexneri 2a str. 2457T
uuuacucccguucauucaacuu

SEQ ID NO: 3826594 - RNA, 16 nt, Shigella flexneri 2a str. 2457T
uuuacugucugcuucu

SEQ ID NO: 3826595 - RNA, 17 nt, Shigella flexneri 2a str. 2457T
uuuacuuccccggcagu

SEQ ID NO: 3826596 - RNA, 11 nt, Shigella flexneri 2a str. 2457T
uuuacuuugcu

SEQ ID NO: 3826597 - RNA, 14 nt, Shigella flexneri 2a str. 2457T
uuuacuuuuuaacu

SEQ ID NO: 3826598 - RNA, 11 nt, Shigella flexneri 2a str. 2457T
uuuagaaaaac

SEQ ID NO: 3826599 - RNA, 16 nt, Shigella flexneri 2a str. 2457T
uuuagaaaaacuuaau

SEQ ID NO: 3826600 - RNA, 23 nt, Shigella flexneri 2a str. 2457T
uuuagcuaaucaaaucaaugccu

SEQ ID NO: 3826601 - RNA, 17 nt, Shigella flexneri 2a str. 2457T
uuuagguacaaagccaa

SEQ ID NO: 3826602 - RNA, 13 nt, Shigella flexneri 2a str. 2457T
uuuaguauuguua

SEQ ID NO: 3826603 - RNA, 12 nt, Shigella flexneri 2a str. 2457T
uuuauaaagaac

SEQ ID NO: 3826604 - RNA, 20 nt, Shigella flexneri 2a str. 2457T
uuuauaacggugcugcacau

SEQ ID NO: 3826605 - RNA, 14 nt, Shigella flexneri 2a str. 2457T
uuuauacucaguca

SEQ ID NO: 3826606 - RNA, 20 nt, Shigella flexneri 2a str. 2457T
uuuauagagauuuuucccca

SEQ ID NO: 3826607 - RNA, 17 nt, Shigella flexneri 2a str. 2457T
uuuauagcguugcccga

SEQ ID NO: 3826608 - RNA, 19 nt, Shigella flexneri 2a str. 2457T
uuuauagcuuauucuuauu

SEQ ID NO: 3826609 - RNA, 22 nt, Shigella flexneri 2a str. 2457T
uuuauaucugguuugccacguu

SEQ ID NO: 3826610 - RNA, 18 nt, Shigella flexneri 2a str. 2457T
uuuauauuacgaauauaa

SEQ ID NO: 3826611 - RNA, 15 nt, Shigella flexneri 2a str. 2457T
uuuaucaccaaugau

SEQ ID NO: 3826612 - RNA, 16 nt, Shigella flexneri 2a str. 2457T
uuuaucacugugaugg

SEQ ID NO: 3826613 - RNA, 21 nt, Shigella flexneri 2a str. 2457T
uuuaucagaccgcuucugcgu

SEQ ID NO: 3826614 - RNA, 13 nt, Shigella flexneri 2a str. 2457T
uuuaucaggccac

SEQ ID NO: 3826615 - RNA, 15 nt, Shigella flexneri 2a str. 2457T
uuuaucccaauuauc

SEQ ID NO: 3826616 - RNA, 13 nt, Shigella flexneri 2a str. 2457T
uuuaucgagaaua

SEQ ID NO: 3826617 - RNA, 20 nt, Shigella flexneri 2a str. 2457T
uuuaucgaucacauccagua

SEQ ID NO: 3826618 - RNA, 16 nt, Shigella flexneri 2a str. 2457T
uuuaucguuuucacga

SEQ ID NO: 3826619 - RNA, 21 nt, Shigella flexneri 2a str. 2457T
uuuaucuaucaggacgaaaaa

SEQ ID NO: 3826620 - RNA, 15 nt, Shigella flexneri 2a str. 2457T
uuuccagcauuucuu

SEQ ID NO: 3826621 - RNA, 16 nt, Shigella flexneri 2a str. 2457T
uuuccagggccucucc

SEQ ID NO: 3826622 - RNA, 15 nt, Shigella flexneri 2a str. 2457T
uuuccauauguacgc

SEQ ID NO: 3826623 - RNA, 20 nt, Shigella flexneri 2a str. 2457T
uuuccaucuccagcugcucg

SEQ ID NO: 3826624 - RNA, 16 nt, Shigella flexneri 2a str. 2457T
uuuccaugaccugcca

SEQ ID NO: 3826625 - RNA, 13 nt, Shigella flexneri 2a str. 2457T
uuuccauugcauc

SEQ ID NO: 3826626 - RNA, 13 nt, Shigella flexneri 2a str. 2457T
uuuccauuuuuca

SEQ ID NO: 3826627 - RNA, 14 nt, Shigella flexneri 2a str. 2457T
uuucccauucuugg

SEQ ID NO: 3826628 - RNA, 23 nt, Shigella flexneri 2a str. 2457T
uuucccccacagcucugcuguca

SEQ ID NO: 3826629 - RNA, 18 nt, Shigella flexneri 2a str. 2457T
uuuccccuaacucuuuca

SEQ ID NO: 3826630 - RNA, 15 nt, Shigella flexneri 2a str. 2457T
uuuccccuucuuuga

SEQ ID NO: 3826631 - RNA, 14 nt, Shigella flexneri 2a str. 2457T
uuucccuccacucc

SEQ ID NO: 3826632 - RNA, 22 nt, Shigella flexneri 2a str. 2457T
uuucccugacauugcguugaua

SEQ ID NO: 3826633 - RNA, 22 nt, Shigella flexneri 2a str. 2457T
uuucccuucacucugcugccac

SEQ ID NO: 3826634 - RNA, 13 nt, Shigella flexneri 2a str. 2457T
uuucccuucucgu

SEQ ID NO: 3826635 - RNA, 23 nt, Shigella flexneri 2a str. 2457T
uuuccgaccaggcguucugccug

SEQ ID NO: 3826636 - RNA, 23 nt, Shigella flexneri 2a str. 2457T
uuuccgccaccugauccaucguc

SEQ ID NO: 3826637 - RNA, 19 nt, Shigella flexneri 2a str. 2457T
uuuccgcgcaaucgcccag

SEQ ID NO: 3826638 - RNA, 18 nt, Shigella flexneri 2a str. 2457T
uuuccggaucgccaaagc

SEQ ID NO: 3826639 - RNA, 15 nt, Shigella flexneri 2a str. 2457T
uuuccggcagaagca

SEQ ID NO: 3826640 - RNA, 20 nt, Shigella flexneri 2a str. 2457T
uuuccggcggcggaaaguau

SEQ ID NO: 3826641 - RNA, 15 nt, Shigella flexneri 2a str. 2457T
uuuccgucagcggca

SEQ ID NO: 3826642 - RNA, 19 nt, Shigella flexneri 2a str. 2457T
uuuccguugugcgauccac

SEQ ID NO: 3826643 - RNA, 17 nt, Shigella flexneri 2a str. 2457T
uuuccuauugcugcuga

SEQ ID NO: 3826644 - RNA, 15 nt, Shigella flexneri 2a str. 2457T
uuuccugagcacugg

SEQ ID NO: 3826645 - RNA, 20 nt, Shigella flexneri 2a str. 2457T
uuuccugccagaccuuauca

SEQ ID NO: 3826646 - RNA, 21 nt, Shigella flexneri 2a str. 2457T
uuuccugcucaaugucuguca

SEQ ID NO: 3826647 - RNA, 16 nt, Shigella flexneri 2a str. 2457T
uuuccugguucucacu

SEQ ID NO: 3826648 - RNA, 13 nt, Shigella flexneri 2a str. 2457T
uuuccuuaacucc

SEQ ID NO: 3826649 - RNA, 17 nt, Shigella flexneri 2a str. 2457T
uuucgaacgccaguuca

SEQ ID NO: 3826650 - RNA, 15 nt, Shigella flexneri 2a str. 2457T
uuucgaauuuuccau

SEQ ID NO: 3826651 - RNA, 20 nt, Shigella flexneri 2a str. 2457T
uuucgaccggguuucuuauu

SEQ ID NO: 3826652 - RNA, 15 nt, Shigella flexneri 2a str. 2457T
uuucgauaaucauca

SEQ ID NO: 3826653 - RNA, 17 nt, Shigella flexneri 2a str. 2457T
uuucgauaucaagccau

SEQ ID NO: 3826654 - RNA, 12 nt, Shigella flexneri 2a str. 2457T
uuucgcaaacca

SEQ ID NO: 3826655 - RNA, 13 nt, Shigella flexneri 2a str. 2457T
uuucgccaggcac

SEQ ID NO: 3826656 - RNA, 18 nt, Shigella flexneri 2a str. 2457T
uuucgccgcauccggcaa

SEQ ID NO: 3826657 - RNA, 23 nt, Shigella flexneri 2a str. 2457T
uuucgccgcauccggcaauucuc

SEQ ID NO: 3826658 - RNA, 17 nt, Shigella flexneri 2a str. 2457T
uuucgcggcauaacaga

SEQ ID NO: 3826659 - RNA, 20 nt, Shigella flexneri 2a str. 2457T
uuucgcugacgaguggcgga

SEQ ID NO: 3826660 - RNA, 16 nt, Shigella flexneri 2a str. 2457T
uuucgcugucgguacu

SEQ ID NO: 3826661 - RNA, 21 nt, Shigella flexneri 2a str. 2457T
uuucgcuucaaccaccucagu

SEQ ID NO: 3826662 - RNA, 17 nt, Shigella flexneri 2a str. 2457T
uuucgcuucuucagccu

SEQ ID NO: 3826663 - RNA, 20 nt, Shigella flexneri 2a str. 2457T
uuucggaaacggcuuccauu

SEQ ID NO: 3826664 - RNA, 11 nt, Shigella flexneri 2a str. 2457T
uuucgucgcua

SEQ ID NO: 3826665 - RNA, 22 nt, Shigella flexneri 2a str. 2457T
uuucgucugguucgccaaaugu

SEQ ID NO: 3826666 - RNA, 14 nt, Shigella flexneri 2a str. 2457T
uuucguugugucgc

SEQ ID NO: 3826667 - RNA, 12 nt, Shigella flexneri 2a str. 2457T
uuucuacaagca

SEQ ID NO: 3826668 - RNA, 13 nt, Shigella flexneri 2a str. 2457T
uuucuaccagguu

SEQ ID NO: 3826669 - RNA, 17 nt, Shigella flexneri 2a str. 2457T
uuucucaagucugggua

SEQ ID NO: 3826670 - RNA, 11 nt, Shigella flexneri 2a str. 2457T
uuucucacccg

SEQ ID NO: 3826671 - RNA, 14 nt, Shigella flexneri 2a str. 2457T
uuucucauuuuuua

SEQ ID NO: 3826672 - RNA, 20 nt, Shigella flexneri 2a str. 2457T
uuucuccccauggacgcguc

SEQ ID NO: 3826673 - RNA, 22 nt, Shigella flexneri 2a str. 2457T
uuucucgccaccggcacaucca

SEQ ID NO: 3826674 - RNA, 17 nt, Shigella flexneri 2a str. 2457T
uuucucuuuaaacagau

SEQ ID NO: 3826675 - RNA, 12 nt, Shigella flexneri 2a str. 2457T
uuucucuuucag

SEQ ID NO: 3826676 - RNA, 12 nt, Shigella flexneri 2a str. 2457T
uuucucuuucuu

SEQ ID NO: 3826677 - RNA, 15 nt, Shigella flexneri 2a str. 2457T
uuucucuuucuucag

SEQ ID NO: 3826678 - RNA, 13 nt, Shigella flexneri 2a str. 2457T
uuucugaacugaa

SEQ ID NO: 3826679 - RNA, 13 nt, Shigella flexneri 2a str. 2457T
uuucugaauuuca

SEQ ID NO: 3826680 - RNA, 18 nt, Shigella flexneri 2a str. 2457T
uuucugaauuucagcgcc

SEQ ID NO: 3826681 - RNA, 15 nt, Shigella flexneri 2a str. 2457T
uuucugagcaucaca

SEQ ID NO: 3826682 - RNA, 21 nt, Shigella flexneri 2a str. 2457T
uuucugaugcauaaaaaaacg

SEQ ID NO: 3826683 - RNA, 11 nt, Shigella flexneri 2a str. 2457T
uuucugccuca

SEQ ID NO: 3826684 - RNA, 16 nt, Shigella flexneri 2a str. 2457T
uuucugccuugaguuu

SEQ ID NO: 3826685 - RNA, 15 nt, Shigella flexneri 2a str. 2457T
uuucugcuuuucccu

SEQ ID NO: 3826686 - RNA, 14 nt, Shigella flexneri 2a str. 2457T
uuucuggaguuaaa

SEQ ID NO: 3826687 - RNA, 18 nt, Shigella flexneri 2a str. 2457T
uuucuggaguuaaauuaa

SEQ ID NO: 3826688 - RNA, 19 nt, Shigella flexneri 2a str. 2457T
uuucuggcaccuguaccag

SEQ ID NO: 3826689 - RNA, 14 nt, Shigella flexneri 2a str. 2457T
uuucuggcgucaaa

SEQ ID NO: 3826690 - RNA, 21 nt, Shigella flexneri 2a str. 2457T
uuucuggguggcguuccagca

SEQ ID NO: 3826691 - RNA, 17 nt, Shigella flexneri 2a str. 2457T
uuucuggucauugccag

SEQ ID NO: 3826692 - RNA, 23 nt, Shigella flexneri 2a str. 2457T
uuucuggugggugcuuuaaaaaa

SEQ ID NO: 3826693 - RNA, 13 nt, Shigella flexneri 2a str. 2457T
uuucuuaaauuaa

SEQ ID NO: 3826694 - RNA, 14 nt, Shigella flexneri 2a str. 2457T
uuucuuauuucacu

SEQ ID NO: 3826695 - RNA, 12 nt, Shigella flexneri 2a str. 2457T
uuucuuauuuuu

SEQ ID NO: 3826696 - RNA, 13 nt, Shigella flexneri 2a str. 2457T
uuucuucaacacc

SEQ ID NO: 3826697 - RNA, 16 nt, Shigella flexneri 2a str. 2457T
uuucuucagccccucc

SEQ ID NO: 3826698 - RNA, 20 nt, Shigella flexneri 2a str. 2457T
uuucuucauuaaauuuccgc

SEQ ID NO: 3826699 - RNA, 14 nt, Shigella flexneri 2a str. 2457T
uuucuuccagcgcc

SEQ ID NO: 3826700 - RNA, 11 nt, Shigella flexneri 2a str. 2457T
uuucuucuucg

SEQ ID NO: 3826701 - RNA, 11 nt, Shigella flexneri 2a str. 2457T
uuucuuuaccg

SEQ ID NO: 3826702 - RNA, 17 nt, Shigella flexneri 2a str. 2457T
uuucuuuggcaucaauc

SEQ ID NO: 3826703 - RNA, 12 nt, Shigella flexneri 2a str. 2457T
uuucuuuuuaaa

SEQ ID NO: 3826704 - RNA, 14 nt, Shigella flexneri 2a str. 2457T
uuugaaaaaaccug

SEQ ID NO: 3826705 - RNA, 17 nt, Shigella flexneri 2a str. 2457T
uuugaauaucuccucug

SEQ ID NO: 3826706 - RNA, 17 nt, Shigella flexneri 2a str. 2457T
uuugacaacaucaucug

SEQ ID NO: 3826707 - RNA, 19 nt, Shigella flexneri 2a str. 2457T
uuugacagccccugugcca

SEQ ID NO: 3826708 - RNA, 11 nt, Shigella flexneri 2a str. 2457T
uuugagcagca

SEQ ID NO: 3826709 - RNA, 22 nt, Shigella flexneri 2a str. 2457T
uuugagcaucaaacuuuuaaau

SEQ ID NO: 3826710 - RNA, 17 nt, Shigella flexneri 2a str. 2457T
uuugagccaaaaugccu

SEQ ID NO: 3826711 - RNA, 15 nt, Shigella flexneri 2a str. 2457T
uuugaggaagcugcc

SEQ ID NO: 3826712 - RNA, 14 nt, Shigella flexneri 2a str. 2457T
uuugaguucacugc

SEQ ID NO: 3826713 - RNA, 22 nt, Shigella flexneri 2a str. 2457T
uuugauaaaccuccagcaucag

SEQ ID NO: 3826714 - RNA, 13 nt, Shigella flexneri 2a str. 2457T
uuugauauuuauu

SEQ ID NO: 3826715 - RNA, 12 nt, Shigella flexneri 2a str. 2457T
uuugauccagcc

SEQ ID NO: 3826716 - RNA, 20 nt, Shigella flexneri 2a str. 2457T
uuugaugaguugaaaaccuc

SEQ ID NO: 3826717 - RNA, 14 nt, Shigella flexneri 2a str. 2457T
uuugauuuugcauu

SEQ ID NO: 3826718 - RNA, 18 nt, Shigella flexneri 2a str. 2457T
uuugcaacgcuuugcuga

SEQ ID NO: 3826719 - RNA, 21 nt, Shigella flexneri 2a str. 2457T
uuuuacgcaaccacaaaacac

SEQ ID NO: 3826720 - RNA, 22 nt, Shigella flexneri 2a str. 2457T
uuuuacguugcauuuccauaaa

SEQ ID NO: 3826721 - RNA, 17 nt, Shigella flexneri 2a str. 2457T
uuuuacuaucuugccga

SEQ ID NO: 3826722 - RNA, 22 nt, Shigella flexneri 2a str. 2457T
uuuuacuccacuuccugccagu

SEQ ID NO: 3826723 - RNA, 13 nt, Shigella flexneri 2a str. 2457T
uuuuacuuguuuu

SEQ ID NO: 3826724 - RNA, 16 nt, Shigella flexneri 2a str. 2457T
uuuuacuuguuuuuca

SEQ ID NO: 3826725 - RNA, 12 nt, Shigella flexneri 2a str. 2457T
uuuuagaaaaac

SEQ ID NO: 3826726 - RNA, 17 nt, Shigella flexneri 2a str. 2457T
uuuuagaaaaacuuaau

SEQ ID NO: 3826727 - RNA, 23 nt, Shigella flexneri 2a str. 2457T
uuuuauacaagggaaauaagaaa

SEQ ID NO: 3826728 - RNA, 15 nt, Shigella flexneri 2a str. 2457T
uuuuauacacucuuu

SEQ ID NO: 3826729 - RNA, 14 nt, Shigella flexneri 2a str. 2457T
uuuuauaguacuuc

SEQ ID NO: 3826730 - RNA, 13 nt, Shigella flexneri 2a str. 2457T
uuuuaucccuucu

SEQ ID NO: 3826731 - RNA, 20 nt, Shigella flexneri 2a str. 2457T
uuuuaucucccuguauccca

SEQ ID NO: 3826732 - RNA, 15 nt, Shigella flexneri 2a str. 2457T
uuuuaucugugaacu

SEQ ID NO: 3826733 - RNA, 23 nt, Shigella flexneri 2a str. 2457T
uuuuaugauaggucauaucacaa

SEQ ID NO: 3826734 - RNA, 16 nt, Shigella flexneri 2a str. 2457T
uuuuauguucagauaa

SEQ ID NO: 3826735 - RNA, 17 nt, Shigella flexneri 2a str. 2457T
uuuuauuaaauguguuu

SEQ ID NO: 3826736 - RNA, 22 nt, Shigella flexneri 2a str. 2457T
uuuuauucauauuguuaucaau

SEQ ID NO: 3826737 - RNA, 14 nt, Shigella flexneri 2a str. 2457T
uuuuauugcaaaac

SEQ ID NO: 3826738 - RNA, 19 nt, Shigella flexneri 2a str. 2457T
uuuuauugcguaaucuuuu

SEQ ID NO: 3826739 - RNA, 19 nt, Shigella flexneri 2a str. 2457T
uuuuauugcuucaccagca

SEQ ID NO: 3826740 - RNA, 13 nt, Shigella flexneri 2a str. 2457T
uuuuauuuacacu

SEQ ID NO: 3826741 - RNA, 20 nt, Shigella flexneri 2a str. 2457T
uuuuauuugugguuggcgug

SEQ ID NO: 3826742 - RNA, 16 nt, Shigella flexneri 2a str. 2457T
uuuucaaauaucuauu

SEQ ID NO: 3826743 - RNA, 19 nt, Shigella flexneri 2a str. 2457T
uuuucaacgugucuuuuac

SEQ ID NO: 3826744 - RNA, 19 nt, Shigella flexneri 2a str. 2457T
uuuucaauaaccugcaaaa

SEQ ID NO: 3826745 - RNA, 19 nt, Shigella flexneri 2a str. 2457T
uuuucaauuaauugugaag

SEQ ID NO: 3826746 - RNA, 22 nt, Shigella flexneri 2a str. 2457T
uuuucaauucucuaaucaggaa

SEQ ID NO: 3826747 - RNA, 12 nt, Shigella flexneri 2a str. 2457T
uuuucacauguu

SEQ ID NO: 3826748 - RNA, 19 nt, Shigella flexneri 2a str. 2457T
uuuucaccaacgcaaaaag

SEQ ID NO: 3826749 - RNA, 16 nt, Shigella flexneri 2a str. 2457T
uuuucaccaucgccau

SEQ ID NO: 3826750 - RNA, 19 nt, Shigella flexneri 2a str. 2457T
uuuucacccacacuucaau

SEQ ID NO: 3826751 - RNA, 15 nt, Shigella flexneri 2a str. 2457T
uuuucagcaccagau

SEQ ID NO: 3826752 - RNA, 21 nt, Shigella flexneri 2a str. 2457T
uuuucauugaaugcggcaggc

SEQ ID NO: 3826753 - RNA, 15 nt, Shigella flexneri 2a str. 2457T
uuuuccagcugugcc

SEQ ID NO: 3826754 - RNA, 17 nt, Shigella flexneri 2a str. 2457T
uuuuccagcugugccag

SEQ ID NO: 3826755 - RNA, 12 nt, Shigella flexneri 2a str. 2457T
uuuuccagugcc

SEQ ID NO: 3826756 - RNA, 19 nt, Shigella flexneri 2a str. 2457T
uuuuccccaccucaucaga

SEQ ID NO: 3826757 - RNA, 16 nt, Shigella flexneri 2a str. 2457T
uuuucccgucaaagag

SEQ ID NO: 3826758 - RNA, 18 nt, Shigella flexneri 2a str. 2457T
uuuucccugguaaaaaau

SEQ ID NO: 3826759 - RNA, 21 nt, Shigella flexneri 2a str. 2457T
uuuuccgcacguuagaaacaa

SEQ ID NO: 3826760 - RNA, 22 nt, Shigella flexneri 2a str. 2457T
uuuuccuauugcugcugaucca

SEQ ID NO: 3826761 - RNA, 17 nt, Shigella flexneri 2a str. 2457T
uuuuccuugaaaaagag

SEQ ID NO: 3826762 - RNA, 20 nt, Shigella flexneri 2a str. 2457T
uuuucgaucacuuuuaaauu

SEQ ID NO: 3826763 - RNA, 21 nt, Shigella flexneri 2a str. 2457T
uuuucgaucuguuuuagagaa

SEQ ID NO: 3826764 - RNA, 12 nt, Shigella flexneri 2a str. 2457T
uuuucgccgcau

SEQ ID NO: 3826765 - RNA, 21 nt, Shigella flexneri 2a str. 2457T
uuuucgcuugaucuuccugau

SEQ ID NO: 3826766 - RNA, 15 nt, Shigella flexneri 2a str. 2457T
uuuucguucaggccu

SEQ ID NO: 3826767 - RNA, 13 nt, Shigella flexneri 2a str. 2457T
uuuucguuuuaau

SEQ ID NO: 3826768 - RNA, 18 nt, Shigella flexneri 2a str. 2457T
uuuucuauuuugcauuau

SEQ ID NO: 3826769 - RNA, 11 nt, Shigella flexneri 2a str. 2457T
uuuucucuauc

SEQ ID NO: 3826770 - RNA, 18 nt, Shigella flexneri 2a str. 2457T
uuuucugaaaaucauaca

SEQ ID NO: 3826771 - RNA, 17 nt, Shigella flexneri 2a str. 2457T
uuuucuguagauaaaac

SEQ ID NO: 3826772 - RNA, 12 nt, Shigella flexneri 2a str. 2457T
uuuucuucaguu

SEQ ID NO: 3826773 - RNA, 11 nt, Shigella flexneri 2a str. 2457T
uuuucuuucac

SEQ ID NO: 3826774 - RNA, 23 nt, Shigella flexneri 2a str. 2457T
uuuucuuugacaaauuccgucau

SEQ ID NO: 3826775 - RNA, 11 nt, Shigella flexneri 2a str. 2457T
uuuugaacaga

SEQ ID NO: 3826776 - RNA, 15 nt, Shigella flexneri 2a str. 2457T
uuuugagcgguacac

SEQ ID NO: 3826777 - RNA, 13 nt, Shigella flexneri 2a str. 2457T
uuuugcaauaaug

SEQ ID NO: 3826778 - RNA, 20 nt, Shigella flexneri 2a str. 2457T
uuuugcaggaaaaacugccc

SEQ ID NO: 3826779 - RNA, 22 nt, Shigella flexneri 2a str. 2457T
uuuugcaggaaaaacugcccgu

SEQ ID NO: 3826780 - RNA, 20 nt, Shigella flexneri 2a str. 2457T
uuuugcaguuaaaauaggaa

SEQ ID NO: 3826781 - RNA, 16 nt, Shigella flexneri 2a str. 2457T
uuuugcauaauuucca

SEQ ID NO: 3826782 - RNA, 20 nt, Shigella flexneri 2a str. 2457T
uuuugcccggcaacaacagg

SEQ ID NO: 3826783 - RNA, 21 nt, Shigella flexneri 2a str. 2457T
uuuugccgcccagucacggcu

SEQ ID NO: 3826784 - RNA, 22 nt, Shigella flexneri 2a str. 2457T
uuuugccggacggcuguaaaug

SEQ ID NO: 3826785 - RNA, 18 nt, Shigella flexneri 2a str. 2457T
uuuugcgcauccagcgcu

SEQ ID NO: 3826786 - RNA, 16 nt, Shigella flexneri 2a str. 2457T
uuuugcggaucugcuc

SEQ ID NO: 3826787 - RNA, 20 nt, Shigella flexneri 2a str. 2457T
uuuugcguccgguaauuuuu

SEQ ID NO: 3826788 - RNA, 11 nt, Shigella flexneri 2a str. 2457T
uuuugcugccg

SEQ ID NO: 3826789 - RNA, 20 nt, Shigella flexneri 2a str. 2457T
uuuugcuugcgauagcgcac

SEQ ID NO: 3826790 - RNA, 21 nt, Shigella flexneri 2a str. 2457T
uuuugcuuucuauaagauacu

SEQ ID NO: 3826791 - RNA, 23 nt, Shigella flexneri 2a str. 2457T
uuuugguccuggucugaugaaug

SEQ ID NO: 3826792 - RNA, 12 nt, Shigella flexneri 2a str. 2457T
uuuuguagaccu

SEQ ID NO: 3826793 - RNA, 15 nt, Shigella flexneri 2a str. 2457T
uuuuguaggccugau

SEQ ID NO: 3826794 - RNA, 18 nt, Shigella flexneri 2a str. 2457T
uuuuguaucgaacaagau

SEQ ID NO: 3826795 - RNA, 13 nt, Shigella flexneri 2a str. 2457T
uuuuguccccuca

SEQ ID NO: 3826796 - RNA, 11 nt, Shigella flexneri 2a str. 2457T
uuuugugggca

SEQ ID NO: 3826797 - RNA, 14 nt, Shigella flexneri 2a str. 2457T
uuuuguuuaaauau

SEQ ID NO: 3826798 - RNA, 16 nt, Shigella flexneri 2a str. 2457T
uuuuguuuaaauaucu

SEQ ID NO: 3826799 - RNA, 11 nt, Shigella flexneri 2a str. 2457T
uuuuuaaacau

SEQ ID NO: 3826800 - RNA, 16 nt, Shigella flexneri 2a str. 2457T
uuuuuaaacaucaaac

SEQ ID NO: 3826801 - RNA, 14 nt, Shigella flexneri 2a str. 2457T
uuuuuaaauuuccc

SEQ ID NO: 3826802 - RNA, 15 nt, Shigella flexneri 2a str. 2457T
uuuuuaaauuuccca

SEQ ID NO: 3826803 - RNA, 12 nt, Shigella flexneri 2a str. 2457T
uuuuuaauaaua

SEQ ID NO: 3826804 - RNA, 23 nt, Shigella flexneri 2a str. 2457T
uuuuuaguuguaaucauauuaaa

SEQ ID NO: 3826805 - RNA, 23 nt, Shigella flexneri 2a str. 2457T
uuuuuaugaguuuggugccacgc

SEQ ID NO: 3826806 - RNA, 12 nt, Shigella flexneri 2a str. 2457T
uuuuuaugcuuc

SEQ ID NO: 3826807 - RNA, 18 nt, Shigella flexneri 2a str. 2457T
uuuuuaugcuuccuuccu

SEQ ID NO: 3826808 - RNA, 22 nt, Shigella flexneri 2a str. 2457T
uuuuucaacauauccuucacac

SEQ ID NO: 3826809 - RNA, 21 nt, Shigella flexneri 2a str. 2457T
uuuuucaacauguugaaauuc

SEQ ID NO: 3826810 - RNA, 21 nt, Shigella flexneri 2a str. 2457T
uuuuucaagaaucggcuuugu

SEQ ID NO: 3826811 - RNA, 12 nt, Shigella flexneri 2a str. 2457T
uuuuucaucccu

SEQ ID NO: 3826812 - RNA, 23 nt, Shigella flexneri 2a str. 2457T
uuuuucaucgcuaauaauaagcc

SEQ ID NO: 3826813 - RNA, 23 nt, Shigella flexneri 2a str. 2457T
uuuuuccaacaggcgagaaacgc

SEQ ID NO: 3826814 - RNA, 12 nt, Shigella flexneri 2a str. 2457T
uuuuuccagcug

SEQ ID NO: 3826815 - RNA, 15 nt, Shigella flexneri 2a str. 2457T
uuuuuccgcaaaaac

SEQ ID NO: 3826816 - RNA, 12 nt, Shigella flexneri 2a str. 2457T
uuuuuccguuuu

SEQ ID NO: 3826817 - RNA, 22 nt, Shigella flexneri 2a str. 2457T
aaaaacuccgccgcaucuuccc

SEQ ID NO: 3826818 - RNA, 14 nt, Shigella flexneri 2a str. 2457T
aaaaacuugauacu

SEQ ID NO: 3826819 - RNA, 23 nt, Shigella flexneri 2a str. 2457T
aaaaacuugauacugaacaacuu

SEQ ID NO: 3826820 - RNA, 12 nt, Shigella flexneri 2a str. 2457T
aaaaagaaaaaa

SEQ ID NO: 3826821 - RNA, 19 nt, Shigella flexneri 2a str. 2457T
aaaaagagauuguauuuaa

SEQ ID NO: 3826822 - RNA, 21 nt, Shigella flexneri 2a str. 2457T
aaaaagagcagcugauugaaa

SEQ ID NO: 3826823 - RNA, 17 nt, Shigella flexneri 2a str. 2457T
aaaaagccaaucacaaa

SEQ ID NO: 3826824 - RNA, 19 nt, Shigella flexneri 2a str. 2457T
aaaaagccaaucacaaaaa

SEQ ID NO: 3826825 - RNA, 16 nt, Shigella flexneri 2a str. 2457T
aaaaagccuaagaagu

SEQ ID NO: 3826826 - RNA, 13 nt, Shigella flexneri 2a str. 2457T
aaaaaggcaugca

SEQ ID NO: 3826827 - RNA, 19 nt, Shigella flexneri 2a str. 2457T
aaaaaggcugacaaaucag

SEQ ID NO: 3826828 - RNA, 22 nt, Shigella flexneri 2a str. 2457T
aaaaaguagggcugauaaacaa

SEQ ID NO: 3826829 - RNA, 17 nt, Shigella flexneri 2a str. 2457T
aaaaaguaguuccagca

SEQ ID NO: 3826830 - RNA, 17 nt, Shigella flexneri 2a str. 2457T
aaaaagugcuuucugaa

SEQ ID NO: 3826831 - RNA, 22 nt, Shigella flexneri 2a str. 2457T
aaaaaguugcagcgucaucaac

SEQ ID NO: 3826832 - RNA, 14 nt, Shigella flexneri 2a str. 2457T
aaaaauaaucaucu

SEQ ID NO: 3826833 - RNA, 15 nt, Shigella flexneri 2a str. 2457T
aaaaauaaucugauu

SEQ ID NO: 3826834 - RNA, 14 nt, Shigella flexneri 2a str. 2457T
aaaaauaccgagca

SEQ ID NO: 3826835 - RNA, 16 nt, Shigella flexneri 2a str. 2457T
aaaaauaccgagcagc

SEQ ID NO: 3826836 - RNA, 20 nt, Shigella flexneri 2a str. 2457T
aaaaauauucaccaaacgcc

SEQ ID NO: 3826837 - RNA, 14 nt, Shigella flexneri 2a str. 2457T
aaaaaucaauauau

SEQ ID NO: 3826838 - RNA, 17 nt, Shigella flexneri 2a str. 2457T
aaaaaucacauaaauuc

SEQ ID NO: 3826839 - RNA, 20 nt, Shigella flexneri 2a str. 2457T
aaaaaucaugcaauaaauau

SEQ ID NO: 3826840 - RNA, 22 nt, Shigella flexneri 2a str. 2457T
aaaaauccagauuuauaaaaga

SEQ ID NO: 3826841 - RNA, 18 nt, Shigella flexneri 2a str. 2457T
aaaaaucgacaaaaucgg

SEQ ID NO: 3826842 - RNA, 22 nt, Shigella flexneri 2a str. 2457T
aaaaaucgugcugcaauaaaca

SEQ ID NO: 3826843 - RNA, 21 nt, Shigella flexneri 2a str. 2457T
aaaaaugaaacuggaagauuu

SEQ ID NO: 3826844 - RNA, 18 nt, Shigella flexneri 2a str. 2457T
aaaaaugcccgauaagca

SEQ ID NO: 3826845 - RNA, 21 nt, Shigella flexneri 2a str. 2457T
aaaaaugcccgauaagcaaaa

SEQ ID NO: 3826846 - RNA, 21 nt, Shigella flexneri 2a str. 2457T
aaaaaugcgcggucagaaaau

SEQ ID NO: 3826847 - RNA, 22 nt, Shigella flexneri 2a str. 2457T
aaaaauggccagacauuauaaa

SEQ ID NO: 3826848 - RNA, 13 nt, Shigella flexneri 2a str. 2457T
aaaaauggcgcac

SEQ ID NO: 3826849 - RNA, 21 nt, Shigella flexneri 2a str. 2457T
aaaaaugugaagaggaacaaa

SEQ ID NO: 3826850 - RNA, 22 nt, Shigella flexneri 2a str. 2457T
aaaaaugugcccggacaguccc

SEQ ID NO: 3826851 - RNA, 15 nt, Shigella flexneri 2a str. 2457T
aaaaauuacaaaaag

SEQ ID NO: 3826852 - RNA, 17 nt, Shigella flexneri 2a str. 2457T
aaaaauucagaugauga

SEQ ID NO: 3826853 - RNA, 22 nt, Shigella flexneri 2a str. 2457T
aaaaauuuuaguuuaaacauuu

SEQ ID NO: 3826854 - RNA, 15 nt, Shigella flexneri 2a str. 2457T
aaaacaacgagccaa

SEQ ID NO: 3826855 - RNA, 23 nt, Shigella flexneri 2a str. 2457T
aaaacacaacgcuuucaacaacc

SEQ ID NO: 3826856 - RNA, 15 nt, Shigella flexneri 2a str. 2457T
aaaacacucuucaac

SEQ ID NO: 3826857 - RNA, 14 nt, Shigella flexneri 2a str. 2457T
aaaacacucuuuuu

SEQ ID NO: 3826858 - RNA, 20 nt, Shigella flexneri 2a str. 2457T
aaaacagacgagggaaaaua

SEQ ID NO: 3826859 - RNA, 22 nt, Shigella flexneri 2a str. 2457T
aaaacagcaaagcgugcaaaua

SEQ ID NO: 3826860 - RNA, 18 nt, Shigella flexneri 2a str. 2457T
aaaacagcagggccugaa

SEQ ID NO: 3826861 - RNA, 19 nt, Shigella flexneri 2a str. 2457T
aaaacagccagcagcgaau

SEQ ID NO: 3826862 - RNA, 14 nt, Shigella flexneri 2a str. 2457T
aaaacagccagcgc

SEQ ID NO: 3826863 - RNA, 12 nt, Shigella flexneri 2a str. 2457T
aaaacagccccu

SEQ ID NO: 3826864 - RNA, 23 nt, Shigella flexneri 2a str. 2457T
aaaacagcgaguucaggcgcugc

SEQ ID NO: 3826865 - RNA, 22 nt, Shigella flexneri 2a str. 2457T
aaaacagcgcaccagaaacaau

SEQ ID NO: 3826866 - RNA, 20 nt, Shigella flexneri 2a str. 2457T
aaaacaggcagcugccagac

SEQ ID NO: 3826867 - RNA, 13 nt, Shigella flexneri 2a str. 2457T
aaaacaucuucgg

SEQ ID NO: 3826868 - RNA, 21 nt, Shigella flexneri 2a str. 2457T
aaaacauugauuaagugaaua

SEQ ID NO: 3826869 - RNA, 18 nt, Shigella flexneri 2a str. 2457T
aaaacauugccguaagca

SEQ ID NO: 3826870 - RNA, 22 nt, Shigella flexneri 2a str. 2457T
aaaaccacacuucuucagccag

SEQ ID NO: 3826871 - RNA, 21 nt, Shigella flexneri 2a str. 2457T
aaaaccagaaagggaagaaca

SEQ ID NO: 3826872 - RNA, 22 nt, Shigella flexneri 2a str. 2457T
aaaaccagaaagggaagaacau

SEQ ID NO: 3826873 - RNA, 13 nt, Shigella flexneri 2a str. 2457T
aaaaccagagaau

SEQ ID NO: 3826874 - RNA, 14 nt, Shigella flexneri 2a str. 2457T
aaaaccaguaauga

SEQ ID NO: 3826875 - RNA, 15 nt, Shigella flexneri 2a str. 2457T
aaaaccccaaaaaga

SEQ ID NO: 3826876 - RNA, 23 nt, Shigella flexneri 2a str. 2457T
aaaacccggccugcucccgaacc

SEQ ID NO: 3826877 - RNA, 15 nt, Shigella flexneri 2a str. 2457T
aaaaccgacuuaaaa

SEQ ID NO: 3826878 - RNA, 18 nt, Shigella flexneri 2a str. 2457T
aaaaccgagaagcagcaa

SEQ ID NO: 3826879 - RNA, 13 nt, Shigella flexneri 2a str. 2457T
aaaaccgcugauu

SEQ ID NO: 3826880 - RNA, 18 nt, Shigella flexneri 2a str. 2457T
aaaaccgggugcagagcc

SEQ ID NO: 3826881 - RNA, 17 nt, Shigella flexneri 2a str. 2457T
aaaaccucucuggaaga

SEQ ID NO: 3826882 - RNA, 20 nt, Shigella flexneri 2a str. 2457T
aaaaccucucuggaagaggc

SEQ ID NO: 3826883 - RNA, 13 nt, Shigella flexneri 2a str. 2457T
aaaaccucuucca

SEQ ID NO: 3826884 - RNA, 15 nt, Shigella flexneri 2a str. 2457T
aaaaccugacaacaa

SEQ ID NO: 3826885 - RNA, 21 nt, Shigella flexneri 2a str. 2457T
aaaaccugaccuagcaaacua

SEQ ID NO: 3826886 - RNA, 14 nt, Shigella flexneri 2a str. 2457T
aaaacgaaugacug

SEQ ID NO: 3826887 - RNA, 21 nt, Shigella flexneri 2a str. 2457T
aaaacgaccaccuucaacguu

SEQ ID NO: 3826888 - RNA, 19 nt, Shigella flexneri 2a str. 2457T
aaaacgcagucuucccagc

SEQ ID NO: 3826889 - RNA, 11 nt, Shigella flexneri 2a str. 2457T
aaaacgccugc

SEQ ID NO: 3826890 - RNA, 13 nt, Shigella flexneri 2a str. 2457T
aaaacgccugcuc

SEQ ID NO: 3826891 - RNA, 14 nt, Shigella flexneri 2a str. 2457T
aaaacgcucgacgu

SEQ ID NO: 3826892 - RNA, 18 nt, Shigella flexneri 2a str. 2457T
aaaacgggucaccuucug

SEQ ID NO: 3826893 - RNA, 17 nt, Shigella flexneri 2a str. 2457T
aaaacggugaucaaaac

SEQ ID NO: 3826894 - RNA, 22 nt, Shigella flexneri 2a str. 2457T
aaaacggugaucaaaacgggca

SEQ ID NO: 3826895 - RNA, 23 nt, Shigella flexneri 2a str. 2457T
aaaacgugacagcauaccuucac

SEQ ID NO: 3826896 - RNA, 22 nt, Shigella flexneri 2a str. 2457T
aaaacguugucaguucuuuuau

SEQ ID NO: 3826897 - RNA, 13 nt, Shigella flexneri 2a str. 2457T
aaaacuaaaaaca

SEQ ID NO: 3826898 - RNA, 23 nt, Shigella flexneri 2a str. 2457T
aaaacuaaacguuagcacgaacc

SEQ ID NO: 3826899 - RNA, 13 nt, Shigella flexneri 2a str. 2457T
aaaacuacaggca

SEQ ID NO: 3826900 - RNA, 19 nt, Shigella flexneri 2a str. 2457T
aaaacucgagccuuuacga

SEQ ID NO: 3826901 - RNA, 21 nt, Shigella flexneri 2a str. 2457T
aaaacugcccgugaugcaacu

SEQ ID NO: 3826902 - RNA, 14 nt, Shigella flexneri 2a str. 2457T
aaaacuggaaaaau

SEQ ID NO: 3826903 - RNA, 20 nt, Shigella flexneri 2a str. 2457T
aaaacuuacgccaaaugagg

SEQ ID NO: 3826904 - RNA, 22 nt, Shigella flexneri 2a str. 2457T
aaaacuuccauguguuuaucua

SEQ ID NO: 3826905 - RNA, 20 nt, Shigella flexneri 2a str. 2457T
aaaacuuccggcagaaauaa

SEQ ID NO: 3826906 - RNA, 17 nt, Shigella flexneri 2a str. 2457T
aaaacuucguuagguuc

SEQ ID NO: 3826907 - RNA, 21 nt, Shigella flexneri 2a str. 2457T
aaaacuucuucacaccaucaa

SEQ ID NO: 3826908 - RNA, 19 nt, Shigella flexneri 2a str. 2457T
aaaacuuuuagcaucuuau

SEQ ID NO: 3826909 - RNA, 11 nt, Shigella flexneri 2a str. 2457T
aaaagaaaaaa

SEQ ID NO: 3826910 - RNA, 12 nt, Shigella flexneri 2a str. 2457T
aaaagaaaaaac

SEQ ID NO: 3826911 - RNA, 12 nt, Shigella flexneri 2a str. 2457T
aaaagaaaaaau

SEQ ID NO: 3826912 - RNA, 14 nt, Shigella flexneri 2a str. 2457T
aaaagaaaaaauga

SEQ ID NO: 3826913 - RNA, 15 nt, Shigella flexneri 2a str. 2457T
aaaagaaaagaugau

SEQ ID NO: 3826914 - RNA, 22 nt, Shigella flexneri 2a str. 2457T
aaacacgacaugacccggcgua

SEQ ID NO: 3826915 - RNA, 14 nt, Shigella flexneri 2a str. 2457T
aaacacgcagccgg

SEQ ID NO: 3826916 - RNA, 19 nt, Shigella flexneri 2a str. 2457T
aaacacucuccaggaaacc

SEQ ID NO: 3826917 - RNA, 16 nt, Shigella flexneri 2a str. 2457T
aaacacugaaccgaaa

SEQ ID NO: 3826918 - RNA, 14 nt, Shigella flexneri 2a str. 2457T
aaacacuugcggca

SEQ ID NO: 3826919 - RNA, 21 nt, Shigella flexneri 2a str. 2457T
aaacagcaaagcgugcaaaua

SEQ ID NO: 3826920 - RNA, 21 nt, Shigella flexneri 2a str. 2457T
aaacagcagaacgaccagcgc

SEQ ID NO: 3826921 - RNA, 18 nt, Shigella flexneri 2a str. 2457T
aaacagcagggccugaag

SEQ ID NO: 3826922 - RNA, 14 nt, Shigella flexneri 2a str. 2457T
aaacagccagcagc

SEQ ID NO: 3826923 - RNA, 18 nt, Shigella flexneri 2a str. 2457T
aaacagcgacaccagcca

SEQ ID NO: 3826924 - RNA, 19 nt, Shigella flexneri 2a str. 2457T
aaacagcgcaccagaaaca

SEQ ID NO: 3826925 - RNA, 16 nt, Shigella flexneri 2a str. 2457T
aaacagcgcugcgaaa

SEQ ID NO: 3826926 - RNA, 23 nt, Shigella flexneri 2a str. 2457T
aaacagcguauuaauuccgguga

SEQ ID NO: 3826927 - RNA, 11 nt, Shigella flexneri 2a str. 2457T
aaacaggaaca

SEQ ID NO: 3826928 - RNA, 12 nt, Shigella flexneri 2a str. 2457T
aaacaggaacac

SEQ ID NO: 3826929 - RNA, 17 nt, Shigella flexneri 2a str. 2457T
aaacaggaacaccagca

SEQ ID NO: 3826930 - RNA, 13 nt, Shigella flexneri 2a str. 2457T
aaacaggauaaug

SEQ ID NO: 3826931 - RNA, 12 nt, Shigella flexneri 2a str. 2457T
aaacaggaucug

SEQ ID NO: 3826932 - RNA, 13 nt, Shigella flexneri 2a str. 2457T
aaacaggaucugg

SEQ ID NO: 3826933 - RNA, 16 nt, Shigella flexneri 2a str. 2457T
aaacaggcagcugcca

SEQ ID NO: 3826934 - RNA, 21 nt, Shigella flexneri 2a str. 2457T
aaacaggcgacgcguccgguu

SEQ ID NO: 3826935 - RNA, 17 nt, Shigella flexneri 2a str. 2457T
aaacagggcaauuaaaa

SEQ ID NO: 3826936 - RNA, 20 nt, Shigella flexneri 2a str. 2457T
aaacagggcuggaagaguuu

SEQ ID NO: 3826937 - RNA, 22 nt, Shigella flexneri 2a str. 2457T
aaacagguaaagaccauaaaua

SEQ ID NO: 3826938 - RNA, 21 nt, Shigella flexneri 2a str. 2457T
aaacaguacgagagaagagac

SEQ ID NO: 3826939 - RNA, 22 nt, Shigella flexneri 2a str. 2457T
aaacagucacuuucgagcaauu

SEQ ID NO: 3826940 - RNA, 18 nt, Shigella flexneri 2a str. 2457T
aaacagugauuacuaaau

SEQ ID NO: 3826941 - RNA, 21 nt, Shigella flexneri 2a str. 2457T
aaacagugcccauacccgaug

SEQ ID NO: 3826942 - RNA, 15 nt, Shigella flexneri 2a str. 2457T
aaacaguucugcagc

SEQ ID NO: 3826943 - RNA, 15 nt, Shigella flexneri 2a str. 2457T
aaacauaauauaaau

SEQ ID NO: 3826944 - RNA, 20 nt, Shigella flexneri 2a str. 2457T
aaacauaaucaauaaaaaua

SEQ ID NO: 3826945 - RNA, 12 nt, Shigella flexneri 2a str. 2457T
aaacaucaaacc

SEQ ID NO: 3826946 - RNA, 21 nt, Shigella flexneri 2a str. 2457T
aaacaucaccaaugaaagccc

SEQ ID NO: 3826947 - RNA, 16 nt, Shigella flexneri 2a str. 2457T
aaacaucauaauaauu

SEQ ID NO: 3826948 - RNA, 19 nt, Shigella flexneri 2a str. 2457T
aaacaucgcugauuucacc

SEQ ID NO: 3826949 - RNA, 23 nt, Shigella flexneri 2a str. 2457T
aaacaucgcugauuucaccaucu

SEQ ID NO: 3826950 - RNA, 17 nt, Shigella flexneri 2a str. 2457T
aaacaucgggacaugau

SEQ ID NO: 3826951 - RNA, 19 nt, Shigella flexneri 2a str. 2457T
aaacaugagcgaauaaaaa

SEQ ID NO: 3826952 - RNA, 19 nt, Shigella flexneri 2a str. 2457T
aaacaugccaacaaaaucu

SEQ ID NO: 3826953 - RNA, 15 nt, Shigella flexneri 2a str. 2457T
aaacauuaaaauucu

SEQ ID NO: 3826954 - RNA, 14 nt, Shigella flexneri 2a str. 2457T
aaacauuagcgcau

SEQ ID NO: 3826955 - RNA, 23 nt, Shigella flexneri 2a str. 2457T
aaacauuagcgcaugaccaguga

SEQ ID NO: 3826956 - RNA, 21 nt, Shigella flexneri 2a str. 2457T
aaacauuucacguucacguaa

SEQ ID NO: 3826957 - RNA, 20 nt, Shigella flexneri 2a str. 2457T
aaacauuuuugcagaaacau

SEQ ID NO: 3826958 - RNA, 22 nt, Shigella flexneri 2a str. 2457T
aaaccaacgcuguccggcgcac

SEQ ID NO: 3826959 - RNA, 18 nt, Shigella flexneri 2a str. 2457T
aaaccaacuccagcggcg

SEQ ID NO: 3826960 - RNA, 18 nt, Shigella flexneri 2a str. 2457T
aaaccaaucaccgccacu

SEQ ID NO: 3826961 - RNA, 17 nt, Shigella flexneri 2a str. 2457T
aaaccacgacuuuuugu

SEQ ID NO: 3826962 - RNA, 20 nt, Shigella flexneri 2a str. 2457T
aaaccacuauuauggcgcag

SEQ ID NO: 3826963 - RNA, 14 nt, Shigella flexneri 2a str. 2457T
aaaccacugacaca

SEQ ID NO: 3826964 - RNA, 19 nt, Shigella flexneri 2a str. 2457T
aaaccacugauaagcugag

SEQ ID NO: 3826965 - RNA, 15 nt, Shigella flexneri 2a str. 2457T
aaaccacuuaauuau

SEQ ID NO: 3826966 - RNA, 16 nt, Shigella flexneri 2a str. 2457T
aaaccacuuaauuauu

SEQ ID NO: 3826967 - RNA, 21 nt, Shigella flexneri 2a str. 2457T
aaaccacuuaauuauuaacaa

SEQ ID NO: 3826968 - RNA, 22 nt, Shigella flexneri 2a str. 2457T
aaaccacuuaauuauuaacaaa

SEQ ID NO: 3826969 - RNA, 19 nt, Shigella flexneri 2a str. 2457T
aaaccagaaagggaagaac

SEQ ID NO: 3826970 - RNA, 20 nt, Shigella flexneri 2a str. 2457T
aaaccagacagcacauuuca

SEQ ID NO: 3826971 - RNA, 18 nt, Shigella flexneri 2a str. 2457T
aaaccagaugaauagcgc

SEQ ID NO: 3826972 - RNA, 19 nt, Shigella flexneri 2a str. 2457T
aaaccagcaaacaggugcu

SEQ ID NO: 3826973 - RNA, 24 nt, Shigella flexneri 2a str. 2457T
aaaccagcaaccaacgccagcagc

SEQ ID NO: 3826974 - RNA, 12 nt, Shigella flexneri 2a str. 2457T
aaaccagcgcau

SEQ ID NO: 3826975 - RNA, 19 nt, Shigella flexneri 2a str. 2457T
aaaccagcgcauggcggua

SEQ ID NO: 3826976 - RNA, 14 nt, Shigella flexneri 2a str. 2457T
aaaccaguaaugau

SEQ ID NO: 3826977 - RNA, 18 nt, Shigella flexneri 2a str. 2457T
aaaccaguuuuuacgccc

SEQ ID NO: 3826978 - RNA, 18 nt, Shigella flexneri 2a str. 2457T
aaaccaucaggaugacaa

SEQ ID NO: 3826979 - RNA, 22 nt, Shigella flexneri 2a str. 2457T
aaaccaugacgcacuuucgcuu

SEQ ID NO: 3826980 - RNA, 13 nt, Shigella flexneri 2a str. 2457T
aaaccauguccau

SEQ ID NO: 3826981 - RNA, 13 nt, Shigella flexneri 2a str. 2457T
aaacccaacggca

SEQ ID NO: 3826982 - RNA, 16 nt, Shigella flexneri 2a str. 2457T
aaacccaccagcugau

SEQ ID NO: 3826983 - RNA, 19 nt, Shigella flexneri 2a str. 2457T
aaaccccaaaaagauuaaa

SEQ ID NO: 3826984 - RNA, 20 nt, Shigella flexneri 2a str. 2457T
aaaccccgggaacagaggca

SEQ ID NO: 3826985 - RNA, 18 nt, Shigella flexneri 2a str. 2457T
aaacccgauuuuuaaauu

SEQ ID NO: 3826986 - RNA, 15 nt, Shigella flexneri 2a str. 2457T
aaacccgcaggcgca

SEQ ID NO: 3826987 - RNA, 15 nt, Shigella flexneri 2a str. 2457T
aaacccgccagacca

SEQ ID NO: 3826988 - RNA, 11 nt, Shigella flexneri 2a str. 2457T
aaacccgcuca

SEQ ID NO: 3826989 - RNA, 16 nt, Shigella flexneri 2a str. 2457T
aaacccggccacagcg

SEQ ID NO: 3826990 - RNA, 19 nt, Shigella flexneri 2a str. 2457T
aaacccggccacagcgcca

SEQ ID NO: 3826991 - RNA, 18 nt, Shigella flexneri 2a str. 2457T
aaacccgguaagcauuua

SEQ ID NO: 3826992 - RNA, 20 nt, Shigella flexneri 2a str. 2457T
aaacccugaaacggaaucgc

SEQ ID NO: 3826993 - RNA, 19 nt, Shigella flexneri 2a str. 2457T
aaacccugccgucugggca

SEQ ID NO: 3826994 - RNA, 13 nt, Shigella flexneri 2a str. 2457T
aaacccugcgcac

SEQ ID NO: 3826995 - RNA, 13 nt, Shigella flexneri 2a str. 2457T
aaaccgaaggcac

SEQ ID NO: 3826996 - RNA, 23 nt, Shigella flexneri 2a str. 2457T
aaaccgaaguuguagcuggcuuc

SEQ ID NO: 3826997 - RNA, 14 nt, Shigella flexneri 2a str. 2457T
aaaccgaccaauca

SEQ ID NO: 3826998 - RNA, 13 nt, Shigella flexneri 2a str. 2457T
aaaccgacugccu

SEQ ID NO: 3826999 - RNA, 14 nt, Shigella flexneri 2a str. 2457T
aaaccgacuuaaaa

SEQ ID NO: 3827000 - RNA, 18 nt, Shigella flexneri 2a str. 2457T
aaaccgagaagcagcaac

SEQ ID NO: 3827001 - RNA, 17 nt, Shigella flexneri 2a str. 2457T
aaaccgaugcagugcgg

SEQ ID NO: 3827002 - RNA, 20 nt, Shigella flexneri 2a str. 2457T
aaaccgaugcagugcggcug

SEQ ID NO: 3827003 - RNA, 23 nt, Shigella flexneri 2a str. 2457T
aaaccgcaccguauugcgccggu

SEQ ID NO: 3827004 - RNA, 19 nt, Shigella flexneri 2a str. 2457T
aaaccgccucaggcaacau

SEQ ID NO: 3827005 - RNA, 15 nt, Shigella flexneri 2a str. 2457T
aaaccgccuucugcg

SEQ ID NO: 3827006 - RNA, 19 nt, Shigella flexneri 2a str. 2457T
aaaccgcucgugggcaucg

SEQ ID NO: 3827007 - RNA, 14 nt, Shigella flexneri 2a str. 2457T
aaaccggacgaucg

SEQ ID NO: 3827008 - RNA, 18 nt, Shigella flexneri 2a str. 2457T
aaaccguaagcgccccga

SEQ ID NO: 3827009 - RNA, 14 nt, Shigella flexneri 2a str. 2457T
aaaccguauccauc

SEQ ID NO: 3827010 - RNA, 18 nt, Shigella flexneri 2a str. 2457T
aaaccguguugaggccaa

SEQ ID NO: 3827011 - RNA, 23 nt, Shigella flexneri 2a str. 2457T
aaagauggauugcugaaauacag

SEQ ID NO: 3827012 - RNA, 23 nt, Shigella flexneri 2a str. 2457T
aaagauggcgcgcagaaagaggc

SEQ ID NO: 3827013 - RNA, 13 nt, Shigella flexneri 2a str. 2457T
aaagauuaaaaaa

SEQ ID NO: 3827014 - RNA, 21 nt, Shigella flexneri 2a str. 2457T
aaagauuacugacaauuugcc

SEQ ID NO: 3827015 - RNA, 22 nt, Shigella flexneri 2a str. 2457T
aaagauuugacccaucugccag

SEQ ID NO: 3827016 - RNA, 14 nt, Shigella flexneri 2a str. 2457T
aaagcaaaaaaaga

SEQ ID NO: 3827017 - RNA, 13 nt, Shigella flexneri 2a str. 2457T
aaagcaaauuuug

SEQ ID NO: 3827018 - RNA, 14 nt, Shigella flexneri 2a str. 2457T
aaagcaauagccgc

SEQ ID NO: 3827019 - RNA, 14 nt, Shigella flexneri 2a str. 2457T
aaagcaauuccagc

SEQ ID NO: 3827020 - RNA, 12 nt, Shigella flexneri 2a str. 2457T
aaagcacaaaau

SEQ ID NO: 3827021 - RNA, 21 nt, Shigella flexneri 2a str. 2457T
aaagcagacaacccacacauu

SEQ ID NO: 3827022 - RNA, 20 nt, Shigella flexneri 2a str. 2457T
aaagcagacuuuuugcggca

SEQ ID NO: 3827023 - RNA, 16 nt, Shigella flexneri 2a str. 2457T
aaagcagcauguagau

SEQ ID NO: 3827024 - RNA, 20 nt, Shigella flexneri 2a str. 2457T
aaagcaggcgauuuacuggc

SEQ ID NO: 3827025 - RNA, 18 nt, Shigella flexneri 2a str. 2457T
aaagcauagccccagcgc

SEQ ID NO: 3827026 - RNA, 15 nt, Shigella flexneri 2a str. 2457T
aaagccaacagcagc

SEQ ID NO: 3827027 - RNA, 22 nt, Shigella flexneri 2a str. 2457T
aaagccaauuaacgaaaucuca

SEQ ID NO: 3827028 - RNA, 18 nt, Shigella flexneri 2a str. 2457T
aaagcccccgcaacauug

SEQ ID NO: 3827029 - RNA, 13 nt, Shigella flexneri 2a str. 2457T
aaagcccgccauc

SEQ ID NO: 3827030 - RNA, 15 nt, Shigella flexneri 2a str. 2457T
aaagccgaagcuguc

SEQ ID NO: 3827031 - RNA, 16 nt, Shigella flexneri 2a str. 2457T
aaagccgccaucucuu

SEQ ID NO: 3827032 - RNA, 14 nt, Shigella flexneri 2a str. 2457T
aaagccgcgugcgc

SEQ ID NO: 3827033 - RNA, 23 nt, Shigella flexneri 2a str. 2457T
aaagccgcuuaacgguguuuagu

SEQ ID NO: 3827034 - RNA, 20 nt, Shigella flexneri 2a str. 2457T
aaagccggaugaucauccgg

SEQ ID NO: 3827035 - RNA, 23 nt, Shigella flexneri 2a str. 2457T
aaagccucucgcgaggagaggcc

SEQ ID NO: 3827036 - RNA, 14 nt, Shigella flexneri 2a str. 2457T
aaagccugcuggca

SEQ ID NO: 3827037 - RNA, 12 nt, Shigella flexneri 2a str. 2457T
aaagccugcuuc

SEQ ID NO: 3827038 - RNA, 23 nt, Shigella flexneri 2a str. 2457T
aaagccuggaccauauuagccgc

SEQ ID NO: 3827039 - RNA, 22 nt, Shigella flexneri 2a str. 2457T
aaagccuguaacgccuuuucca

SEQ ID NO: 3827040 - RNA, 16 nt, Shigella flexneri 2a str. 2457T
aaagccuuucacuucg

SEQ ID NO: 3827041 - RNA, 16 nt, Shigella flexneri 2a str. 2457T
aaagccuuuugccagu

SEQ ID NO: 3827042 - RNA, 13 nt, Shigella flexneri 2a str. 2457T
aaagcgaagcggc

SEQ ID NO: 3827043 - RNA, 16 nt, Shigella flexneri 2a str. 2457T
aaagcgacgcgcagua

SEQ ID NO: 3827044 - RNA, 15 nt, Shigella flexneri 2a str. 2457T
aaagcgacuuugccu

SEQ ID NO: 3827045 - RNA, 21 nt, Shigella flexneri 2a str. 2457T
aaagcgagcaguacagccgcc

SEQ ID NO: 3827046 - RNA, 18 nt, Shigella flexneri 2a str. 2457T
aaagcgagcgagcaauau

SEQ ID NO: 3827047 - RNA, 14 nt, Shigella flexneri 2a str. 2457T
aaagcgcaccugau

SEQ ID NO: 3827048 - RNA, 15 nt, Shigella flexneri 2a str. 2457T
aaagcgcaccugauc

SEQ ID NO: 3827049 - RNA, 19 nt, Shigella flexneri 2a str. 2457T
aaagcgcacuuugccagaa

SEQ ID NO: 3827050 - RNA, 21 nt, Shigella flexneri 2a str. 2457T
aaagcgcacuuugucaaaaau

SEQ ID NO: 3827051 - RNA, 14 nt, Shigella flexneri 2a str. 2457T
aaagcgccaaaucu

SEQ ID NO: 3827052 - RNA, 16 nt, Shigella flexneri 2a str. 2457T
aaagcgccagggcuua

SEQ ID NO: 3827053 - RNA, 16 nt, Shigella flexneri 2a str. 2457T
aaagcgcgucaccacc

SEQ ID NO: 3827054 - RNA, 18 nt, Shigella flexneri 2a str. 2457T
aaagcgcugaagaaaaug

SEQ ID NO: 3827055 - RNA, 20 nt, Shigella flexneri 2a str. 2457T
aaagcggaacugaagcugau

SEQ ID NO: 3827056 - RNA, 16 nt, Shigella flexneri 2a str. 2457T
aaagcggcccuuuuuu

SEQ ID NO: 3827057 - RNA, 21 nt, Shigella flexneri 2a str. 2457T
aaagcggcccuuuuuuuacuu

SEQ ID NO: 3827058 - RNA, 20 nt, Shigella flexneri 2a str. 2457T
aaagcguacccgccugauag

SEQ ID NO: 3827059 - RNA, 14 nt, Shigella flexneri 2a str. 2457T
aaagcguauuaugc

SEQ ID NO: 3827060 - RNA, 23 nt, Shigella flexneri 2a str. 2457T
aaagcgucaaguugacucucauc

SEQ ID NO: 3827061 - RNA, 13 nt, Shigella flexneri 2a str. 2457T
aaagcucccuaaa

SEQ ID NO: 3827062 - RNA, 14 nt, Shigella flexneri 2a str. 2457T
aaagcucccuaaaa

SEQ ID NO: 3827063 - RNA, 13 nt, Shigella flexneri 2a str. 2457T
aaagcucuucaug

SEQ ID NO: 3827064 - RNA, 15 nt, Shigella flexneri 2a str. 2457T
aaagcugcaagguga

SEQ ID NO: 3827065 - RNA, 20 nt, Shigella flexneri 2a str. 2457T
aaagcugcaaggugaaagca

SEQ ID NO: 3827066 - RNA, 21 nt, Shigella flexneri 2a str. 2457T
aaagcugcauacggugaaagu

SEQ ID NO: 3827067 - RNA, 15 nt, Shigella flexneri 2a str. 2457T
aaagcugcugaauca

SEQ ID NO: 3827068 - RNA, 21 nt, Shigella flexneri 2a str. 2457T
aaagcugcugaccaccagcac

SEQ ID NO: 3827069 - RNA, 18 nt, Shigella flexneri 2a str. 2457T
aaagcuucucagagaacu

SEQ ID NO: 3827070 - RNA, 18 nt, Shigella flexneri 2a str. 2457T
aaaggaaggucauccaaa

SEQ ID NO: 3827071 - RNA, 23 nt, Shigella flexneri 2a str. 2457T
aaaggacagugggauuaaaaagu

SEQ ID NO: 3827072 - RNA, 15 nt, Shigella flexneri 2a str. 2457T
aaaggaucaaccgaa

SEQ ID NO: 3827073 - RNA, 13 nt, Shigella flexneri 2a str. 2457T
aaaggauguuuau

SEQ ID NO: 3827074 - RNA, 13 nt, Shigella flexneri 2a str. 2457T
aaaggcaaccacg

SEQ ID NO: 3827075 - RNA, 23 nt, Shigella flexneri 2a str. 2457T
aaaggcaccaauauugacugaug

SEQ ID NO: 3827076 - RNA, 17 nt, Shigella flexneri 2a str. 2457T
aaaggccagcaaucccc

SEQ ID NO: 3827077 - RNA, 23 nt, Shigella flexneri 2a str. 2457T
aaaggccgcaggcuguuaccccu

SEQ ID NO: 3827078 - RNA, 21 nt, Shigella flexneri 2a str. 2457T
aaaggcgagguauaaaaugag

SEQ ID NO: 3827079 - RNA, 18 nt, Shigella flexneri 2a str. 2457T
aaaggcggcagaacagaa

SEQ ID NO: 3827080 - RNA, 19 nt, Shigella flexneri 2a str. 2457T
aaaggcggcagaacagaac

SEQ ID NO: 3827081 - RNA, 17 nt, Shigella flexneri 2a str. 2457T
aaaggcuuugacuaaca

SEQ ID NO: 3827082 - RNA, 14 nt, Shigella flexneri 2a str. 2457T
aaagggagcuaucu

SEQ ID NO: 3827083 - RNA, 14 nt, Shigella flexneri 2a str. 2457T
aaagggcaaaguca

SEQ ID NO: 3827084 - RNA, 17 nt, Shigella flexneri 2a str. 2457T
aaaggggugaaaaaaac

SEQ ID NO: 3827085 - RNA, 15 nt, Shigella flexneri 2a str. 2457T
aaagggucagggaga

SEQ ID NO: 3827086 - RNA, 17 nt, Shigella flexneri 2a str. 2457T
aaagguaggccugauaa

SEQ ID NO: 3827087 - RNA, 21 nt, Shigella flexneri 2a str. 2457T
aaaggugaacaucgcagggaa

SEQ ID NO: 3827088 - RNA, 17 nt, Shigella flexneri 2a str. 2457T
aaagguguguauccguu

SEQ ID NO: 3827089 - RNA, 14 nt, Shigella flexneri 2a str. 2457T
aaaguaaaaaagaa

SEQ ID NO: 3827090 - RNA, 21 nt, Shigella flexneri 2a str. 2457T
aaaguaagaauugauaaaaaa

SEQ ID NO: 3827091 - RNA, 18 nt, Shigella flexneri 2a str. 2457T
aaaguaagauugccugau

SEQ ID NO: 3827092 - RNA, 17 nt, Shigella flexneri 2a str. 2457T
aaaguaaucaagcccug

SEQ ID NO: 3827093 - RNA, 18 nt, Shigella flexneri 2a str. 2457T
aaaguaccaucguccagc

SEQ ID NO: 3827094 - RNA, 17 nt, Shigella flexneri 2a str. 2457T
aaaguacggacgcggca

SEQ ID NO: 3827095 - RNA, 16 nt, Shigella flexneri 2a str. 2457T
aaaguacuucacaauc

SEQ ID NO: 3827096 - RNA, 18 nt, Shigella flexneri 2a str. 2457T
aaaguagaaauuauuucu

SEQ ID NO: 3827097 - RNA, 14 nt, Shigella flexneri 2a str. 2457T
aaaguagcggccug

SEQ ID NO: 3827098 - RNA, 21 nt, Shigella flexneri 2a str. 2457T
aaaguagggcugauaaacaag

SEQ ID NO: 3827099 - RNA, 23 nt, Shigella flexneri 2a str. 2457T
aaaguagggcugauaaacaagcg

SEQ ID NO: 3827100 - RNA, 19 nt, Shigella flexneri 2a str. 2457T
aaaguagugucuaauuacc

SEQ ID NO: 3827101 - RNA, 20 nt, Shigella flexneri 2a str. 2457T
aaaguagugucuaauuaccc

SEQ ID NO: 3827102 - RNA, 18 nt, Shigella flexneri 2a str. 2457T
aaaguauauaaaaaacaa

SEQ ID NO: 3827103 - RNA, 20 nt, Shigella flexneri 2a str. 2457T
aaaguauauaaaaaacaaua

SEQ ID NO: 3827104 - RNA, 14 nt, Shigella flexneri 2a str. 2457T
aaaguauuugacug

SEQ ID NO: 3827105 - RNA, 19 nt, Shigella flexneri 2a str. 2457T
aaaguauuugacuguucua

SEQ ID NO: 3827106 - RNA, 15 nt, Shigella flexneri 2a str. 2457T
aaagucagauaaaaa

SEQ ID NO: 3827107 - RNA, 13 nt, Shigella flexneri 2a str. 2457T
aaagucaucaauc

SEQ ID NO: 3827108 - RNA, 21 nt, Shigella flexneri 2a str. 2457T
aaaucaccauauucagcagca

SEQ ID NO: 3827109 - RNA, 23 nt, Shigella flexneri 2a str. 2457T
aaaucaccauauucagcagcaga

SEQ ID NO: 3827110 - RNA, 17 nt, Shigella flexneri 2a str. 2457T
aaaucaccgccaccagc

SEQ ID NO: 3827111 - RNA, 18 nt, Shigella flexneri 2a str. 2457T
aaaucaccucaucaccac

SEQ ID NO: 3827112 - RNA, 16 nt, Shigella flexneri 2a str. 2457T
aaaucacgauugcugc

SEQ ID NO: 3827113 - RNA, 13 nt, Shigella flexneri 2a str. 2457T
aaaucacgcauca

SEQ ID NO: 3827114 - RNA, 13 nt, Shigella flexneri 2a str. 2457T
aaaucacgcgccu

SEQ ID NO: 3827115 - RNA, 18 nt, Shigella flexneri 2a str. 2457T
aaaucacgucgauuuuua

SEQ ID NO: 3827116 - RNA, 16 nt, Shigella flexneri 2a str. 2457T
aaaucacuaaacccga

SEQ ID NO: 3827117 - RNA, 18 nt, Shigella flexneri 2a str. 2457T
aaaucacuauuaaagaaa

SEQ ID NO: 3827118 - RNA, 14 nt, Shigella flexneri 2a str. 2457T
aaaucagcgugaug

SEQ ID NO: 3827119 - RNA, 22 nt, Shigella flexneri 2a str. 2457T
aaaucagcuuuggugaaaaaau

SEQ ID NO: 3827120 - RNA, 21 nt, Shigella flexneri 2a str. 2457T
aaaucauccagaccgcucagc

SEQ ID NO: 3827121 - RNA, 12 nt, Shigella flexneri 2a str. 2457T
aaaucauccagc

SEQ ID NO: 3827122 - RNA, 16 nt, Shigella flexneri 2a str. 2457T
aaaucauccugcugca

SEQ ID NO: 3827123 - RNA, 14 nt, Shigella flexneri 2a str. 2457T
aaaucaugcaauaa

SEQ ID NO: 3827124 - RNA, 14 nt, Shigella flexneri 2a str. 2457T
aaaucccagugccu

SEQ ID NO: 3827125 - RNA, 14 nt, Shigella flexneri 2a str. 2457T
aaaucccgccagcg

SEQ ID NO: 3827126 - RNA, 19 nt, Shigella flexneri 2a str. 2457T
aaaucccgcuucaacgacc

SEQ ID NO: 3827127 - RNA, 16 nt, Shigella flexneri 2a str. 2457T
aaauccgcacucaucu

SEQ ID NO: 3827128 - RNA, 13 nt, Shigella flexneri 2a str. 2457T
aaauccgccagaa

SEQ ID NO: 3827129 - RNA, 12 nt, Shigella flexneri 2a str. 2457T
aaauccgccauc

SEQ ID NO: 3827130 - RNA, 14 nt, Shigella flexneri 2a str. 2457T
aaauccggccagcg

SEQ ID NO: 3827131 - RNA, 14 nt, Shigella flexneri 2a str. 2457T
aaauccucaacaaa

SEQ ID NO: 3827132 - RNA, 14 nt, Shigella flexneri 2a str. 2457T
aaauccugccgcag

SEQ ID NO: 3827133 - RNA, 22 nt, Shigella flexneri 2a str. 2457T
aaauccugccgcaguuucugau

SEQ ID NO: 3827134 - RNA, 19 nt, Shigella flexneri 2a str. 2457T
aaauccuucacuuuugcca

SEQ ID NO: 3827135 - RNA, 16 nt, Shigella flexneri 2a str. 2457T
aaaucgaaaucaacau

SEQ ID NO: 3827136 - RNA, 20 nt, Shigella flexneri 2a str. 2457T
aaaucgauaaaacuucccgu

SEQ ID NO: 3827137 - RNA, 16 nt, Shigella flexneri 2a str. 2457T
aaaucgaucaucaccu

SEQ ID NO: 3827138 - RNA, 18 nt, Shigella flexneri 2a str. 2457T
aaaucgcaagaucucauu

SEQ ID NO: 3827139 - RNA, 23 nt, Shigella flexneri 2a str. 2457T
aaaucgccaacaaucucuuccag

SEQ ID NO: 3827140 - RNA, 14 nt, Shigella flexneri 2a str. 2457T
aaaucgccaagauu

SEQ ID NO: 3827141 - RNA, 14 nt, Shigella flexneri 2a str. 2457T
aaaucgcccagcaa

SEQ ID NO: 3827142 - RNA, 11 nt, Shigella flexneri 2a str. 2457T
aaaucgcccgg

SEQ ID NO: 3827143 - RNA, 21 nt, Shigella flexneri 2a str. 2457T
aaaucgcugaauaucuuucuc

SEQ ID NO: 3827144 - RNA, 14 nt, Shigella flexneri 2a str. 2457T
aaaucggugggcug

SEQ ID NO: 3827145 - RNA, 14 nt, Shigella flexneri 2a str. 2457T
aaaucguaagcagg

SEQ ID NO: 3827146 - RNA, 19 nt, Shigella flexneri 2a str. 2457T
aaaucguauccggcauuau

SEQ ID NO: 3827147 - RNA, 15 nt, Shigella flexneri 2a str. 2457T
aaaucgugcaaauuc

SEQ ID NO: 3827148 - RNA, 16 nt, Shigella flexneri 2a str. 2457T
aaaucuauugcaacau

SEQ ID NO: 3827149 - RNA, 21 nt, Shigella flexneri 2a str. 2457T
aaaucucagcccgaugauaaa

SEQ ID NO: 3827150 - RNA, 12 nt, Shigella flexneri 2a str. 2457T
aaaucuccagau

SEQ ID NO: 3827151 - RNA, 13 nt, Shigella flexneri 2a str. 2457T
aaaucuccagugg

SEQ ID NO: 3827152 - RNA, 11 nt, Shigella flexneri 2a str. 2457T
aaaucuccauu

SEQ ID NO: 3827153 - RNA, 15 nt, Shigella flexneri 2a str. 2457T
aaaucugaaaucauc

SEQ ID NO: 3827154 - RNA, 18 nt, Shigella flexneri 2a str. 2457T
aaaucugccgauuucaac

SEQ ID NO: 3827155 - RNA, 21 nt, Shigella flexneri 2a str. 2457T
aaaucugucagguaacaagcc

SEQ ID NO: 3827156 - RNA, 13 nt, Shigella flexneri 2a str. 2457T
aaaucuucguuau

SEQ ID NO: 3827157 - RNA, 11 nt, Shigella flexneri 2a str. 2457T
aaaucuuuaua

SEQ ID NO: 3827158 - RNA, 16 nt, Shigella flexneri 2a str. 2457T
aaaucuuuauaauuaa

SEQ ID NO: 3827159 - RNA, 17 nt, Shigella flexneri 2a str. 2457T
aaaugaaaaaauagaau

SEQ ID NO: 3827160 - RNA, 15 nt, Shigella flexneri 2a str. 2457T
aaaugaaacuggaag

SEQ ID NO: 3827161 - RNA, 21 nt, Shigella flexneri 2a str. 2457T
aaaugacaaacuuagauugca

SEQ ID NO: 3827162 - RNA, 23 nt, Shigella flexneri 2a str. 2457T
aaaugacauucacgcugucggca

SEQ ID NO: 3827163 - RNA, 16 nt, Shigella flexneri 2a str. 2457T
aaaugaccauaaaagg

SEQ ID NO: 3827164 - RNA, 19 nt, Shigella flexneri 2a str. 2457T
aaaugaccauaaaaggcac

SEQ ID NO: 3827165 - RNA, 22 nt, Shigella flexneri 2a str. 2457T
aaaugacucgccgcuguggaua

SEQ ID NO: 3827166 - RNA, 14 nt, Shigella flexneri 2a str. 2457T
aaaugacucguuau

SEQ ID NO: 3827167 - RNA, 14 nt, Shigella flexneri 2a str. 2457T
aaaugauagccagg

SEQ ID NO: 3827168 - RNA, 14 nt, Shigella flexneri 2a str. 2457T
aaaugaucgccgga

SEQ ID NO: 3827169 - RNA, 17 nt, Shigella flexneri 2a str. 2457T
aaaugcaaacgcaucgc

SEQ ID NO: 3827170 - RNA, 19 nt, Shigella flexneri 2a str. 2457T
aaaugcagcauugccugau

SEQ ID NO: 3827171 - RNA, 20 nt, Shigella flexneri 2a str. 2457T
aaaugcagcauugccugaug

SEQ ID NO: 3827172 - RNA, 23 nt, Shigella flexneri 2a str. 2457T
aaaugcaucagugacaaauuccg

SEQ ID NO: 3827173 - RNA, 14 nt, Shigella flexneri 2a str. 2457T
aaaugcaucggcau

SEQ ID NO: 3827174 - RNA, 21 nt, Shigella flexneri 2a str. 2457T
aaaugcaugcucagucacuuc

SEQ ID NO: 3827175 - RNA, 19 nt, Shigella flexneri 2a str. 2457T
aaaugccagauaagacacu

SEQ ID NO: 3827176 - RNA, 16 nt, Shigella flexneri 2a str. 2457T
aaaugccgcacaucac

SEQ ID NO: 3827177 - RNA, 13 nt, Shigella flexneri 2a str. 2457T
aaaugccuuucuc

SEQ ID NO: 3827178 - RNA, 14 nt, Shigella flexneri 2a str. 2457T
aaaugccuuucuca

SEQ ID NO: 3827179 - RNA, 14 nt, Shigella flexneri 2a str. 2457T
aaaugcgcaugaug

SEQ ID NO: 3827180 - RNA, 22 nt, Shigella flexneri 2a str. 2457T
aaauggcaaugacuagcgccau

SEQ ID NO: 3827181 - RNA, 18 nt, Shigella flexneri 2a str. 2457T
aaauggccagccagcaga

SEQ ID NO: 3827182 - RNA, 12 nt, Shigella flexneri 2a str. 2457T
aaauggccgaua

SEQ ID NO: 3827183 - RNA, 19 nt, Shigella flexneri 2a str. 2457T
aaauggcuggcuauacaca

SEQ ID NO: 3827184 - RNA, 14 nt, Shigella flexneri 2a str. 2457T
aaaugguaaagaag

SEQ ID NO: 3827185 - RNA, 16 nt, Shigella flexneri 2a str. 2457T
aaauggugugcauggu

SEQ ID NO: 3827186 - RNA, 14 nt, Shigella flexneri 2a str. 2457T
aaaugguuuugcgu

SEQ ID NO: 3827187 - RNA, 14 nt, Shigella flexneri 2a str. 2457T
aaauguauucugaa

SEQ ID NO: 3827188 - RNA, 17 nt, Shigella flexneri 2a str. 2457T
aaaugucagcugccagu

SEQ ID NO: 3827189 - RNA, 22 nt, Shigella flexneri 2a str. 2457T
aaaugugaagaggaacaaauuu

SEQ ID NO: 3827190 - RNA, 18 nt, Shigella flexneri 2a str. 2457T
aaaugugguuucacuuuc

SEQ ID NO: 3827191 - RNA, 21 nt, Shigella flexneri 2a str. 2457T
aaauguugucauuacaacaag

SEQ ID NO: 3827192 - RNA, 19 nt, Shigella flexneri 2a str. 2457T
aaauguuuaguauuguuaa

SEQ ID NO: 3827193 - RNA, 23 nt, Shigella flexneri 2a str. 2457T
aaauuaaacugucgucgcuuuca

SEQ ID NO: 3827194 - RNA, 12 nt, Shigella flexneri 2a str. 2457T
aaauuacgaucc

SEQ ID NO: 3827195 - RNA, 20 nt, Shigella flexneri 2a str. 2457T
aaauuacugccuugaugaaa

SEQ ID NO: 3827196 - RNA, 22 nt, Shigella flexneri 2a str. 2457T
aaauuacugccuugaugaaaaa

SEQ ID NO: 3827197 - RNA, 16 nt, Shigella flexneri 2a str. 2457T
aaauuaggucaaagaa

SEQ ID NO: 3827198 - RNA, 22 nt, Shigella flexneri 2a str. 2457T
aaauuauagggaugcagaauga

SEQ ID NO: 3827199 - RNA, 14 nt, Shigella flexneri 2a str. 2457T
aaauuauaucuuau

SEQ ID NO: 3827200 - RNA, 20 nt, Shigella flexneri 2a str. 2457T
aaauuauccagcuuuuccca

SEQ ID NO: 3827201 - RNA, 19 nt, Shigella flexneri 2a str. 2457T
aaauuaucucuguuuugca

SEQ ID NO: 3827202 - RNA, 14 nt, Shigella flexneri 2a str. 2457T
aaauuauuaccauc

SEQ ID NO: 3827203 - RNA, 15 nt, Shigella flexneri 2a str. 2457T
aaauuauuucuuuua

SEQ ID NO: 3827204 - RNA, 21 nt, Shigella flexneri 2a str. 2457T
aaauuauuucuuuuacauuau

SEQ ID NO: 3827205 - RNA, 15 nt, Shigella flexneri 2a str. 2457T
aaauuauuuuaaauu

SEQ ID NO: 3827206 - RNA, 13 nt, Shigella flexneri 2a str. 2457T
aacaccagcgaau

SEQ ID NO: 3827207 - RNA, 16 nt, Shigella flexneri 2a str. 2457T
aacacccgucgcggca

SEQ ID NO: 3827208 - RNA, 14 nt, Shigella flexneri 2a str. 2457T
aacaccgaaccaga

SEQ ID NO: 3827209 - RNA, 17 nt, Shigella flexneri 2a str. 2457T
aacaccgaaccagagau

SEQ ID NO: 3827210 - RNA, 21 nt, Shigella flexneri 2a str. 2457T
aacaccgauuuuguaaaagaa

SEQ ID NO: 3827211 - RNA, 23 nt, Shigella flexneri 2a str. 2457T
aacaccgauuuuguaaaagaagg

SEQ ID NO: 3827212 - RNA, 15 nt, Shigella flexneri 2a str. 2457T
aacaccgucgccuuc

SEQ ID NO: 3827213 - RNA, 23 nt, Shigella flexneri 2a str. 2457T
aacaccgugcauuucucacuuuu

SEQ ID NO: 3827214 - RNA, 16 nt, Shigella flexneri 2a str. 2457T
aacaccuggcaccagu

SEQ ID NO: 3827215 - RNA, 18 nt, Shigella flexneri 2a str. 2457T
aacaccuguuccaguggc

SEQ ID NO: 3827216 - RNA, 18 nt, Shigella flexneri 2a str. 2457T
aacaccuucauccagcau

SEQ ID NO: 3827217 - RNA, 20 nt, Shigella flexneri 2a str. 2457T
aacacgacauacaccgcagc

SEQ ID NO: 3827218 - RNA, 14 nt, Shigella flexneri 2a str. 2457T
aacacgaucagcca

SEQ ID NO: 3827219 - RNA, 15 nt, Shigella flexneri 2a str. 2457T
aacacgaucagccau

SEQ ID NO: 3827220 - RNA, 20 nt, Shigella flexneri 2a str. 2457T
aacacgaucucacgcugaaa

SEQ ID NO: 3827221 - RNA, 22 nt, Shigella flexneri 2a str. 2457T
aacacgaucucacgcugaaaga

SEQ ID NO: 3827222 - RNA, 23 nt, Shigella flexneri 2a str. 2457T
aacacgcccguuguuuuauuuau

SEQ ID NO: 3827223 - RNA, 20 nt, Shigella flexneri 2a str. 2457T
aacacggcagcaaccgcuuc

SEQ ID NO: 3827224 - RNA, 18 nt, Shigella flexneri 2a str. 2457T
aacacggcgcauugccau

SEQ ID NO: 3827225 - RNA, 19 nt, Shigella flexneri 2a str. 2457T
aacacgggguuaaauugau

SEQ ID NO: 3827226 - RNA, 19 nt, Shigella flexneri 2a str. 2457T
aacacgguuggagggccau

SEQ ID NO: 3827227 - RNA, 16 nt, Shigella flexneri 2a str. 2457T
aacacucucugaagua

SEQ ID NO: 3827228 - RNA, 15 nt, Shigella flexneri 2a str. 2457T
aacacucuuccaguc

SEQ ID NO: 3827229 - RNA, 23 nt, Shigella flexneri 2a str. 2457T
aacacucuuccagucgccugcuu

SEQ ID NO: 3827230 - RNA, 20 nt, Shigella flexneri 2a str. 2457T
aacacuguuaccgcugcugg

SEQ ID NO: 3827231 - RNA, 12 nt, Shigella flexneri 2a str. 2457T
aacacuugcggc

SEQ ID NO: 3827232 - RNA, 20 nt, Shigella flexneri 2a str. 2457T
aacacuuguuaugagauaau

SEQ ID NO: 3827233 - RNA, 17 nt, Shigella flexneri 2a str. 2457T
aacagaaacgccaucca

SEQ ID NO: 3827234 - RNA, 14 nt, Shigella flexneri 2a str. 2457T
aacagaacaauaau

SEQ ID NO: 3827235 - RNA, 14 nt, Shigella flexneri 2a str. 2457T
aacagaagaaagca

SEQ ID NO: 3827236 - RNA, 11 nt, Shigella flexneri 2a str. 2457T
aacagaauuac

SEQ ID NO: 3827237 - RNA, 13 nt, Shigella flexneri 2a str. 2457T
aacagacaaaaag

SEQ ID NO: 3827238 - RNA, 12 nt, Shigella flexneri 2a str. 2457T
aacagaccaaug

SEQ ID NO: 3827239 - RNA, 19 nt, Shigella flexneri 2a str. 2457T
aacagaccagcaccggugc

SEQ ID NO: 3827240 - RNA, 13 nt, Shigella flexneri 2a str. 2457T
aacagaccauaac

SEQ ID NO: 3827241 - RNA, 12 nt, Shigella flexneri 2a str. 2457T
aacagagauuac

SEQ ID NO: 3827242 - RNA, 20 nt, Shigella flexneri 2a str. 2457T
aacagauaguuaccguacuc

SEQ ID NO: 3827243 - RNA, 13 nt, Shigella flexneri 2a str. 2457T
aacagcacaucag

SEQ ID NO: 3827244 - RNA, 15 nt, Shigella flexneri 2a str. 2457T
aacagcaccagcagg

SEQ ID NO: 3827245 - RNA, 23 nt, Shigella flexneri 2a str. 2457T
aacagcaccagcaggugauacau

SEQ ID NO: 3827246 - RNA, 20 nt, Shigella flexneri 2a str. 2457T
aacagcagaacgaccagcgc

SEQ ID NO: 3827247 - RNA, 17 nt, Shigella flexneri 2a str. 2457T
aacagcaggcagaucca

SEQ ID NO: 3827248 - RNA, 16 nt, Shigella flexneri 2a str. 2457T
aacagcagggccugaa

SEQ ID NO: 3827249 - RNA, 18 nt, Shigella flexneri 2a str. 2457T
aacagcagggccugaagg

SEQ ID NO: 3827250 - RNA, 11 nt, Shigella flexneri 2a str. 2457T
aacagcaguug

SEQ ID NO: 3827251 - RNA, 13 nt, Shigella flexneri 2a str. 2457T
aacagccagaagc

SEQ ID NO: 3827252 - RNA, 15 nt, Shigella flexneri 2a str. 2457T
aacagccagaagccc

SEQ ID NO: 3827253 - RNA, 17 nt, Shigella flexneri 2a str. 2457T
aacagccagcagcgaau

SEQ ID NO: 3827254 - RNA, 22 nt, Shigella flexneri 2a str. 2457T
aacagccugugccugagccgga

SEQ ID NO: 3827255 - RNA, 22 nt, Shigella flexneri 2a str. 2457T
aacagccuuaaacucaauauua

SEQ ID NO: 3827256 - RNA, 20 nt, Shigella flexneri 2a str. 2457T
aacagcgacaccagccaucu

SEQ ID NO: 3827257 - RNA, 22 nt, Shigella flexneri 2a str. 2457T
aacagcgaguucaggcgcugca

SEQ ID NO: 3827258 - RNA, 17 nt, Shigella flexneri 2a str. 2457T
aacagcgcaaaacgcag

SEQ ID NO: 3827259 - RNA, 19 nt, Shigella flexneri 2a str. 2457T
aacagcgcaccagaaacaa

SEQ ID NO: 3827260 - RNA, 22 nt, Shigella flexneri 2a str. 2457T
aacagcgcaccagaaacaauaa

SEQ ID NO: 3827261 - RNA, 23 nt, Shigella flexneri 2a str. 2457T
aacagcgccuguuuaccgcucac

SEQ ID NO: 3827262 - RNA, 19 nt, Shigella flexneri 2a str. 2457T
aacagcgcgccagccacca

SEQ ID NO: 3827263 - RNA, 14 nt, Shigella flexneri 2a str. 2457T
aacaggaaguuuca

SEQ ID NO: 3827264 - RNA, 22 nt, Shigella flexneri 2a str. 2457T
aacaggaauaaaucuaaaagau

SEQ ID NO: 3827265 - RNA, 19 nt, Shigella flexneri 2a str. 2457T
aacaggcagggccaccagc

SEQ ID NO: 3827266 - RNA, 22 nt, Shigella flexneri 2a str. 2457T
aacaggcagggccaccagcgug

SEQ ID NO: 3827267 - RNA, 19 nt, Shigella flexneri 2a str. 2457T
aacaggcccaggcggccug

SEQ ID NO: 3827268 - RNA, 17 nt, Shigella flexneri 2a str. 2457T
aacaggcgaucuucccg

SEQ ID NO: 3827269 - RNA, 23 nt, Shigella flexneri 2a str. 2457T
aacaggcgcagaacuucacucuc

SEQ ID NO: 3827270 - RNA, 16 nt, Shigella flexneri 2a str. 2457T
aacaggcgcuggucag

SEQ ID NO: 3827271 - RNA, 22 nt, Shigella flexneri 2a str. 2457T
aacagguugcgcuggauuucaa

SEQ ID NO: 3827272 - RNA, 19 nt, Shigella flexneri 2a str. 2457T
aacaguaaacucgacuuuc

SEQ ID NO: 3827273 - RNA, 20 nt, Shigella flexneri 2a str. 2457T
aacaguacauuguuuuccag

SEQ ID NO: 3827274 - RNA, 19 nt, Shigella flexneri 2a str. 2457T
aacagucaguuaucgcauu

SEQ ID NO: 3827275 - RNA, 18 nt, Shigella flexneri 2a str. 2457T
aacagucuggagcaaaaa

SEQ ID NO: 3827276 - RNA, 20 nt, Shigella flexneri 2a str. 2457T
aacagugccaugccaaucag

SEQ ID NO: 3827277 - RNA, 23 nt, Shigella flexneri 2a str. 2457T
aacagugccgcacauagcaccac

SEQ ID NO: 3827278 - RNA, 21 nt, Shigella flexneri 2a str. 2457T
aacagugcugauccccggaau

SEQ ID NO: 3827279 - RNA, 14 nt, Shigella flexneri 2a str. 2457T
aacaguucagcagc

SEQ ID NO: 3827280 - RNA, 17 nt, Shigella flexneri 2a str. 2457T
aacaguucagcagcacu

SEQ ID NO: 3827281 - RNA, 16 nt, Shigella flexneri 2a str. 2457T
aacaguucugcagcgu

SEQ ID NO: 3827282 - RNA, 13 nt, Shigella flexneri 2a str. 2457T
aacaguuucgcca

SEQ ID NO: 3827283 - RNA, 13 nt, Shigella flexneri 2a str. 2457T
aacaguuucugca

SEQ ID NO: 3827284 - RNA, 23 nt, Shigella flexneri 2a str. 2457T
aacaguuuucaagacgccgucca

SEQ ID NO: 3827285 - RNA, 12 nt, Shigella flexneri 2a str. 2457T
aacauaaugcaa

SEQ ID NO: 3827286 - RNA, 14 nt, Shigella flexneri 2a str. 2457T
aacauaaugcaacg

SEQ ID NO: 3827287 - RNA, 22 nt, Shigella flexneri 2a str. 2457T
aacauaaugcaacgauccuuca

SEQ ID NO: 3827288 - RNA, 13 nt, Shigella flexneri 2a str. 2457T
aacauacaaauag

SEQ ID NO: 3827289 - RNA, 19 nt, Shigella flexneri 2a str. 2457T
aacauacaaauagccaauu

SEQ ID NO: 3827290 - RNA, 20 nt, Shigella flexneri 2a str. 2457T
aacauacaaauagccaauuc

SEQ ID NO: 3827291 - RNA, 22 nt, Shigella flexneri 2a str. 2457T
aacauacugcccgagcgccauu

SEQ ID NO: 3827292 - RNA, 22 nt, Shigella flexneri 2a str. 2457T
aacauacugcuccauaauugcc

SEQ ID NO: 3827293 - RNA, 15 nt, Shigella flexneri 2a str. 2457T
aacauagcuuggcag

SEQ ID NO: 3827294 - RNA, 20 nt, Shigella flexneri 2a str. 2457T
aacauagcuuggcagagcaa

SEQ ID NO: 3827295 - RNA, 17 nt, Shigella flexneri 2a str. 2457T
aacauauccuucacaca

SEQ ID NO: 3827296 - RNA, 13 nt, Shigella flexneri 2a str. 2457T
aacaucaaaccac

SEQ ID NO: 3827297 - RNA, 18 nt, Shigella flexneri 2a str. 2457T
aacaucacaccugcucag

SEQ ID NO: 3827298 - RNA, 20 nt, Shigella flexneri 2a str. 2457T
aacaucagcguggcgagaau

SEQ ID NO: 3827299 - RNA, 13 nt, Shigella flexneri 2a str. 2457T
aacaucaggcauu

SEQ ID NO: 3827300 - RNA, 12 nt, Shigella flexneri 2a str. 2457T
aacaucauaaua

SEQ ID NO: 3827301 - RNA, 20 nt, Shigella flexneri 2a str. 2457T
aacaucaugccggccagcgc

SEQ ID NO: 3827302 - RNA, 17 nt, Shigella flexneri 2a str. 2457T
aacaucccgguaauaau

SEQ ID NO: 3827303 - RNA, 22 nt, Shigella flexneri 2a str. 2457T
aaccgcaguguaguucuggccu

SEQ ID NO: 3827304 - RNA, 19 nt, Shigella flexneri 2a str. 2457T
aaccgcaucaacagugcca

SEQ ID NO: 3827305 - RNA, 20 nt, Shigella flexneri 2a str. 2457T
aaccgcaucaacagugccaa

SEQ ID NO: 3827306 - RNA, 21 nt, Shigella flexneri 2a str. 2457T
aaccgcaucaacagugccaau

SEQ ID NO: 3827307 - RNA, 14 nt, Shigella flexneri 2a str. 2457T
aaccgcgacuggga

SEQ ID NO: 3827308 - RNA, 17 nt, Shigella flexneri 2a str. 2457T
aaccgcgaugaccaaaa

SEQ ID NO: 3827309 - RNA, 19 nt, Shigella flexneri 2a str. 2457T
aaccgcuacauacuuaaau

SEQ ID NO: 3827310 - RNA, 15 nt, Shigella flexneri 2a str. 2457T
aaccgcucgucacau

SEQ ID NO: 3827311 - RNA, 22 nt, Shigella flexneri 2a str. 2457T
aaccgcuguugucugaaugaua

SEQ ID NO: 3827312 - RNA, 19 nt, Shigella flexneri 2a str. 2457T
aaccgcuuuagcggugaag

SEQ ID NO: 3827313 - RNA, 18 nt, Shigella flexneri 2a str. 2457T
aaccgcuuugccacggua

SEQ ID NO: 3827314 - RNA, 13 nt, Shigella flexneri 2a str. 2457T
aaccgcuuuucca

SEQ ID NO: 3827315 - RNA, 14 nt, Shigella flexneri 2a str. 2457T
aaccgcuuuuucaa

SEQ ID NO: 3827316 - RNA, 19 nt, Shigella flexneri 2a str. 2457T
aaccggaaauccaggucag

SEQ ID NO: 3827317 - RNA, 15 nt, Shigella flexneri 2a str. 2457T
aaccggaaccagcgc

SEQ ID NO: 3827318 - RNA, 17 nt, Shigella flexneri 2a str. 2457T
aaccggacugaaaguac

SEQ ID NO: 3827319 - RNA, 13 nt, Shigella flexneri 2a str. 2457T
aaccggagucaga

SEQ ID NO: 3827320 - RNA, 14 nt, Shigella flexneri 2a str. 2457T
aaccggauacccug

SEQ ID NO: 3827321 - RNA, 18 nt, Shigella flexneri 2a str. 2457T
aaccggaucgccaaugaa

SEQ ID NO: 3827322 - RNA, 17 nt, Shigella flexneri 2a str. 2457T
aaccggaucgcgaccug

SEQ ID NO: 3827323 - RNA, 23 nt, Shigella flexneri 2a str. 2457T
aaccggaucgcgaccuguucucc

SEQ ID NO: 3827324 - RNA, 16 nt, Shigella flexneri 2a str. 2457T
aaccggauuuucacca

SEQ ID NO: 3827325 - RNA, 16 nt, Shigella flexneri 2a str. 2457T
aaccggcacuucaacu

SEQ ID NO: 3827326 - RNA, 23 nt, Shigella flexneri 2a str. 2457T
aaccguaaacagauaggcaucag

SEQ ID NO: 3827327 - RNA, 13 nt, Shigella flexneri 2a str. 2457T
aaccguaaacgau

SEQ ID NO: 3827328 - RNA, 21 nt, Shigella flexneri 2a str. 2457T
aaccguaguggccacagauaa

SEQ ID NO: 3827329 - RNA, 12 nt, Shigella flexneri 2a str. 2457T
aaccgucagcac

SEQ ID NO: 3827330 - RNA, 15 nt, Shigella flexneri 2a str. 2457T
aaccgucagcaccag

SEQ ID NO: 3827331 - RNA, 13 nt, Shigella flexneri 2a str. 2457T
aaccgucgccggg

SEQ ID NO: 3827332 - RNA, 14 nt, Shigella flexneri 2a str. 2457T
aaccgugggaaaca

SEQ ID NO: 3827333 - RNA, 16 nt, Shigella flexneri 2a str. 2457T
aaccguuuacgucauu

SEQ ID NO: 3827334 - RNA, 16 nt, Shigella flexneri 2a str. 2457T
aaccuaacgcugucgg

SEQ ID NO: 3827335 - RNA, 18 nt, Shigella flexneri 2a str. 2457T
aaccuaagaaccagaauu

SEQ ID NO: 3827336 - RNA, 17 nt, Shigella flexneri 2a str. 2457T
aaccuacgugcgcaaua

SEQ ID NO: 3827337 - RNA, 17 nt, Shigella flexneri 2a str. 2457T
aaccuauaaaagauagu

SEQ ID NO: 3827338 - RNA, 21 nt, Shigella flexneri 2a str. 2457T
aaccucaaaggccuugaacaa

SEQ ID NO: 3827339 - RNA, 22 nt, Shigella flexneri 2a str. 2457T
aaccucacagaggucuuuucuc

SEQ ID NO: 3827340 - RNA, 18 nt, Shigella flexneri 2a str. 2457T
aaccugaauauuaguacu

SEQ ID NO: 3827341 - RNA, 14 nt, Shigella flexneri 2a str. 2457T
aaccugacaacaaa

SEQ ID NO: 3827342 - RNA, 21 nt, Shigella flexneri 2a str. 2457T
aaccugaccguaggccggaua

SEQ ID NO: 3827343 - RNA, 24 nt, Shigella flexneri 2a str. 2457T
aaccugaccuuuuuucagcggugc

SEQ ID NO: 3827344 - RNA, 19 nt, Shigella flexneri 2a str. 2457T
aaccugauuacgcaccggg

SEQ ID NO: 3827345 - RNA, 13 nt, Shigella flexneri 2a str. 2457T
aaccugcaaaaua

SEQ ID NO: 3827346 - RNA, 19 nt, Shigella flexneri 2a str. 2457T
aaccugcacgaaaccacug

SEQ ID NO: 3827347 - RNA, 21 nt, Shigella flexneri 2a str. 2457T
aaccugccgcgucgggcauca

SEQ ID NO: 3827348 - RNA, 12 nt, Shigella flexneri 2a str. 2457T
aaccugccuuac

SEQ ID NO: 3827349 - RNA, 18 nt, Shigella flexneri 2a str. 2457T
aaccugcggguuggcuuu

SEQ ID NO: 3827350 - RNA, 18 nt, Shigella flexneri 2a str. 2457T
aaccuggauauugcggaa

SEQ ID NO: 3827351 - RNA, 17 nt, Shigella flexneri 2a str. 2457T
aaccugguggugcugga

SEQ ID NO: 3827352 - RNA, 17 nt, Shigella flexneri 2a str. 2457T
aaccugugacagcagcg

SEQ ID NO: 3827353 - RNA, 18 nt, Shigella flexneri 2a str. 2457T
aaccuguugaaauuauug

SEQ ID NO: 3827354 - RNA, 19 nt, Shigella flexneri 2a str. 2457T
aaccuguugaaauuauugc

SEQ ID NO: 3827355 - RNA, 13 nt, Shigella flexneri 2a str. 2457T
aaccuguuuucac

SEQ ID NO: 3827356 - RNA, 20 nt, Shigella flexneri 2a str. 2457T
aaccuucacccucacgcauu

SEQ ID NO: 3827357 - RNA, 19 nt, Shigella flexneri 2a str. 2457T
aaccuucaucguuucugcu

SEQ ID NO: 3827358 - RNA, 18 nt, Shigella flexneri 2a str. 2457T
aaccuucuucauuaugaa

SEQ ID NO: 3827359 - RNA, 19 nt, Shigella flexneri 2a str. 2457T
aaccuugccauuccacaaa

SEQ ID NO: 3827360 - RNA, 16 nt, Shigella flexneri 2a str. 2457T
aaccuugcuggcgauu

SEQ ID NO: 3827361 - RNA, 13 nt, Shigella flexneri 2a str. 2457T
aaccuuuaaucag

SEQ ID NO: 3827362 - RNA, 16 nt, Shigella flexneri 2a str. 2457T
aaccuuuaugcagcuc

SEQ ID NO: 3827363 - RNA, 23 nt, Shigella flexneri 2a str. 2457T
aaccuuucagauguuccgccauu

SEQ ID NO: 3827364 - RNA, 20 nt, Shigella flexneri 2a str. 2457T
aaccuuugcgguuaaaaaua

SEQ ID NO: 3827365 - RNA, 21 nt, Shigella flexneri 2a str. 2457T
aaccuuugcgguuaaaaauaa

SEQ ID NO: 3827366 - RNA, 21 nt, Shigella flexneri 2a str. 2457T
aaccuuuucucaaucaaaaga

SEQ ID NO: 3827367 - RNA, 20 nt, Shigella flexneri 2a str. 2457T
aacgaaagcagggcggcagg

SEQ ID NO: 3827368 - RNA, 20 nt, Shigella flexneri 2a str. 2457T
aacgaaaguuaauccacagc

SEQ ID NO: 3827369 - RNA, 16 nt, Shigella flexneri 2a str. 2457T
aacgaagcgccauuca

SEQ ID NO: 3827370 - RNA, 14 nt, Shigella flexneri 2a str. 2457T
aacgaaucugcaaa

SEQ ID NO: 3827371 - RNA, 18 nt, Shigella flexneri 2a str. 2457T
aacgaaucugcaaaucug

SEQ ID NO: 3827372 - RNA, 18 nt, Shigella flexneri 2a str. 2457T
aacgacaaaaauaccacc

SEQ ID NO: 3827373 - RNA, 19 nt, Shigella flexneri 2a str. 2457T
aacgacaccguuaaauaac

SEQ ID NO: 3827374 - RNA, 22 nt, Shigella flexneri 2a str. 2457T
aacgacaccguuaaauaacugg

SEQ ID NO: 3827375 - RNA, 19 nt, Shigella flexneri 2a str. 2457T
aacgacagugacuuccguc

SEQ ID NO: 3827376 - RNA, 15 nt, Shigella flexneri 2a str. 2457T
aacgaccagaaaugc

SEQ ID NO: 3827377 - RNA, 18 nt, Shigella flexneri 2a str. 2457T
aacgaccaguucacacca

SEQ ID NO: 3827378 - RNA, 21 nt, Shigella flexneri 2a str. 2457T
aacgaccggccauuccagcac

SEQ ID NO: 3827379 - RNA, 18 nt, Shigella flexneri 2a str. 2457T
aacgacgagcgcugguga

SEQ ID NO: 3827380 - RNA, 19 nt, Shigella flexneri 2a str. 2457T
aacgacgcauacucuuuga

SEQ ID NO: 3827381 - RNA, 14 nt, Shigella flexneri 2a str. 2457T
aacgacggcguggu

SEQ ID NO: 3827382 - RNA, 19 nt, Shigella flexneri 2a str. 2457T
aacgacgggccaguuucau

SEQ ID NO: 3827383 - RNA, 18 nt, Shigella flexneri 2a str. 2457T
aacgacugcgagcaaaau

SEQ ID NO: 3827384 - RNA, 15 nt, Shigella flexneri 2a str. 2457T
aacgagagucgacac

SEQ ID NO: 3827385 - RNA, 16 nt, Shigella flexneri 2a str. 2457T
aacgagccaauaaaaa

SEQ ID NO: 3827386 - RNA, 17 nt, Shigella flexneri 2a str. 2457T
aacgagccaauaaaaau

SEQ ID NO: 3827387 - RNA, 15 nt, Shigella flexneri 2a str. 2457T
aacgagcgcaaugaa

SEQ ID NO: 3827388 - RNA, 16 nt, Shigella flexneri 2a str. 2457T
aacgauaacggugcaa

SEQ ID NO: 3827389 - RNA, 17 nt, Shigella flexneri 2a str. 2457T
aacgaucgcuuucaacg

SEQ ID NO: 3827390 - RNA, 19 nt, Shigella flexneri 2a str. 2457T
aacgaugacaucgcagcaa

SEQ ID NO: 3827391 - RNA, 12 nt, Shigella flexneri 2a str. 2457T
aacgauggcgcg

SEQ ID NO: 3827392 - RNA, 19 nt, Shigella flexneri 2a str. 2457T
aacgauuuggccgaagagg

SEQ ID NO: 3827393 - RNA, 16 nt, Shigella flexneri 2a str. 2457T
aacgauuuuuuccgca

SEQ ID NO: 3827394 - RNA, 14 nt, Shigella flexneri 2a str. 2457T
aacgcaaagagaga

SEQ ID NO: 3827395 - RNA, 16 nt, Shigella flexneri 2a str. 2457T
aacgcaaauacugacu

SEQ ID NO: 3827396 - RNA, 15 nt, Shigella flexneri 2a str. 2457T
aacgcaagcggcauc

SEQ ID NO: 3827397 - RNA, 13 nt, Shigella flexneri 2a str. 2457T
aacgcaccaauag

SEQ ID NO: 3827398 - RNA, 16 nt, Shigella flexneri 2a str. 2457T
aacgcaccgccaccac

SEQ ID NO: 3827399 - RNA, 18 nt, Shigella flexneri 2a str. 2457T
aacgcacgucugauguaa

SEQ ID NO: 3827400 - RNA, 18 nt, Shigella flexneri 2a str. 2457T
aacgucgguuucaucaca

SEQ ID NO: 3827401 - RNA, 18 nt, Shigella flexneri 2a str. 2457T
aacgucucuauuucaccc

SEQ ID NO: 3827402 - RNA, 17 nt, Shigella flexneri 2a str. 2457T
aacgucuuugcguucca

SEQ ID NO: 3827403 - RNA, 16 nt, Shigella flexneri 2a str. 2457T
aacgugaucaaaucau

SEQ ID NO: 3827404 - RNA, 16 nt, Shigella flexneri 2a str. 2457T
aacgugcaaaaucaaa

SEQ ID NO: 3827405 - RNA, 20 nt, Shigella flexneri 2a str. 2457T
aacgugccgggaaaguggcg

SEQ ID NO: 3827406 - RNA, 20 nt, Shigella flexneri 2a str. 2457T
aacgugcgguuucccggcag

SEQ ID NO: 3827407 - RNA, 16 nt, Shigella flexneri 2a str. 2457T
aacgugcuucgcgcug

SEQ ID NO: 3827408 - RNA, 15 nt, Shigella flexneri 2a str. 2457T
aacguggccaugagc

SEQ ID NO: 3827409 - RNA, 21 nt, Shigella flexneri 2a str. 2457T
aacguggccuccaaaaaacaa

SEQ ID NO: 3827410 - RNA, 21 nt, Shigella flexneri 2a str. 2457T
aacguguuuauauuugaacau

SEQ ID NO: 3827411 - RNA, 13 nt, Shigella flexneri 2a str. 2457T
aacguuauauccc

SEQ ID NO: 3827412 - RNA, 18 nt, Shigella flexneri 2a str. 2457T
aacguucggcagugguga

SEQ ID NO: 3827413 - RNA, 19 nt, Shigella flexneri 2a str. 2457T
aacguugagaauggccaau

SEQ ID NO: 3827414 - RNA, 13 nt, Shigella flexneri 2a str. 2457T
aacguugccugau

SEQ ID NO: 3827415 - RNA, 21 nt, Shigella flexneri 2a str. 2457T
aacguugcucaaggguuucgc

SEQ ID NO: 3827416 - RNA, 16 nt, Shigella flexneri 2a str. 2457T
aacguugggaucagua

SEQ ID NO: 3827417 - RNA, 17 nt, Shigella flexneri 2a str. 2457T
aacguuuacagggaugg

SEQ ID NO: 3827418 - RNA, 19 nt, Shigella flexneri 2a str. 2457T
aacguuuacagggauggcu

SEQ ID NO: 3827419 - RNA, 13 nt, Shigella flexneri 2a str. 2457T
aacguuuuuaaaa

SEQ ID NO: 3827420 - RNA, 12 nt, Shigella flexneri 2a str. 2457T
aacuaaacaacg

SEQ ID NO: 3827421 - RNA, 18 nt, Shigella flexneri 2a str. 2457T
aacuaagcgcacuuuguc

SEQ ID NO: 3827422 - RNA, 20 nt, Shigella flexneri 2a str. 2457T
aacuaccagcaguuugguaa

SEQ ID NO: 3827423 - RNA, 23 nt, Shigella flexneri 2a str. 2457T
aacuacggcuccgcaagcgaaug

SEQ ID NO: 3827424 - RNA, 20 nt, Shigella flexneri 2a str. 2457T
aacuauauucucaaaauaca

SEQ ID NO: 3827425 - RNA, 22 nt, Shigella flexneri 2a str. 2457T
aacuauuguuuugaugaaucag

SEQ ID NO: 3827426 - RNA, 14 nt, Shigella flexneri 2a str. 2457T
aacucaacgccuuc

SEQ ID NO: 3827427 - RNA, 14 nt, Shigella flexneri 2a str. 2457T
aacucaauaccuga

SEQ ID NO: 3827428 - RNA, 16 nt, Shigella flexneri 2a str. 2457T
aacucaaucaggcuau

SEQ ID NO: 3827429 - RNA, 13 nt, Shigella flexneri 2a str. 2457T
aacucaaucgccu

SEQ ID NO: 3827430 - RNA, 19 nt, Shigella flexneri 2a str. 2457T
aacucaaucgccucgccga

SEQ ID NO: 3827431 - RNA, 16 nt, Shigella flexneri 2a str. 2457T
aacucaauuaccaacu

SEQ ID NO: 3827432 - RNA, 17 nt, Shigella flexneri 2a str. 2457T
aacucaauuaccaacuc

SEQ ID NO: 3827433 - RNA, 12 nt, Shigella flexneri 2a str. 2457T
aacucacacagc

SEQ ID NO: 3827434 - RNA, 14 nt, Shigella flexneri 2a str. 2457T
aacucaccgaugau

SEQ ID NO: 3827435 - RNA, 18 nt, Shigella flexneri 2a str. 2457T
aacucaccggcauuuuuu

SEQ ID NO: 3827436 - RNA, 18 nt, Shigella flexneri 2a str. 2457T
aacucacgccccagauug

SEQ ID NO: 3827437 - RNA, 19 nt, Shigella flexneri 2a str. 2457T
aacucauacaccagcggca

SEQ ID NO: 3827438 - RNA, 14 nt, Shigella flexneri 2a str. 2457T
aacucauaugcagc

SEQ ID NO: 3827439 - RNA, 18 nt, Shigella flexneri 2a str. 2457T
aacucauugccaguccua

SEQ ID NO: 3827440 - RNA, 18 nt, Shigella flexneri 2a str. 2457T
aacucauuuacagaaacu

SEQ ID NO: 3827441 - RNA, 14 nt, Shigella flexneri 2a str. 2457T
aacuccaccagcac

SEQ ID NO: 3827442 - RNA, 20 nt, Shigella flexneri 2a str. 2457T
aacuccacgcgcggacgaga

SEQ ID NO: 3827443 - RNA, 12 nt, Shigella flexneri 2a str. 2457T
aacuccacuuca

SEQ ID NO: 3827444 - RNA, 22 nt, Shigella flexneri 2a str. 2457T
aacuccacuucaccgcgaauau

SEQ ID NO: 3827445 - RNA, 18 nt, Shigella flexneri 2a str. 2457T
aacuccagaauaccgcca

SEQ ID NO: 3827446 - RNA, 16 nt, Shigella flexneri 2a str. 2457T
aacuccagcggcgcgu

SEQ ID NO: 3827447 - RNA, 20 nt, Shigella flexneri 2a str. 2457T
aacuccauacaucuucauca

SEQ ID NO: 3827448 - RNA, 17 nt, Shigella flexneri 2a str. 2457T
aacuccccgagaaauac

SEQ ID NO: 3827449 - RNA, 22 nt, Shigella flexneri 2a str. 2457T
aacucccgcgcggguaauugcu

SEQ ID NO: 3827450 - RNA, 15 nt, Shigella flexneri 2a str. 2457T
aacuccggcgaaaau

SEQ ID NO: 3827451 - RNA, 15 nt, Shigella flexneri 2a str. 2457T
aacuccgugaagcuc

SEQ ID NO: 3827452 - RNA, 14 nt, Shigella flexneri 2a str. 2457T
aacuccguugaaau

SEQ ID NO: 3827453 - RNA, 16 nt, Shigella flexneri 2a str. 2457T
aacucgaccagcagcu

SEQ ID NO: 3827454 - RNA, 19 nt, Shigella flexneri 2a str. 2457T
aacucgaggauaaauuuuc

SEQ ID NO: 3827455 - RNA, 22 nt, Shigella flexneri 2a str. 2457T
aacucgcguaaauccagcggca

SEQ ID NO: 3827456 - RNA, 22 nt, Shigella flexneri 2a str. 2457T
aacucgcuuaagccaucaucaa

SEQ ID NO: 3827457 - RNA, 22 nt, Shigella flexneri 2a str. 2457T
aacucuaaucccuuagcuaauu

SEQ ID NO: 3827458 - RNA, 19 nt, Shigella flexneri 2a str. 2457T
aacucucuuuugcuugaca

SEQ ID NO: 3827459 - RNA, 22 nt, Shigella flexneri 2a str. 2457T
aacucugccgcaaucaucgacc

SEQ ID NO: 3827460 - RNA, 17 nt, Shigella flexneri 2a str. 2457T
aacucuuccuuaacauc

SEQ ID NO: 3827461 - RNA, 21 nt, Shigella flexneri 2a str. 2457T
aacugaaaggcgcucauuuuc

SEQ ID NO: 3827462 - RNA, 13 nt, Shigella flexneri 2a str. 2457T
aacugaacaaaaa

SEQ ID NO: 3827463 - RNA, 11 nt, Shigella flexneri 2a str. 2457T
aacugaagcug

SEQ ID NO: 3827464 - RNA, 15 nt, Shigella flexneri 2a str. 2457T
aacugaauaauacac

SEQ ID NO: 3827465 - RNA, 12 nt, Shigella flexneri 2a str. 2457T
aacugacaauuc

SEQ ID NO: 3827466 - RNA, 15 nt, Shigella flexneri 2a str. 2457T
aacugacgaaucaaa

SEQ ID NO: 3827467 - RNA, 17 nt, Shigella flexneri 2a str. 2457T
aacugacggcaugacca

SEQ ID NO: 3827468 - RNA, 15 nt, Shigella flexneri 2a str. 2457T
aacugacuggcucuu

SEQ ID NO: 3827469 - RNA, 15 nt, Shigella flexneri 2a str. 2457T
aacugauccugacaa

SEQ ID NO: 3827470 - RNA, 20 nt, Shigella flexneri 2a str. 2457T
aacugauggcaaaugcagca

SEQ ID NO: 3827471 - RNA, 19 nt, Shigella flexneri 2a str. 2457T
aacugauuuagcaucagcg

SEQ ID NO: 3827472 - RNA, 16 nt, Shigella flexneri 2a str. 2457T
aacugauuuucaucuu

SEQ ID NO: 3827473 - RNA, 20 nt, Shigella flexneri 2a str. 2457T
aacugauuuucaucuucuuc

SEQ ID NO: 3827474 - RNA, 14 nt, Shigella flexneri 2a str. 2457T
aacugcacaccgcg

SEQ ID NO: 3827475 - RNA, 21 nt, Shigella flexneri 2a str. 2457T
aacugcacaccgcggaacgca

SEQ ID NO: 3827476 - RNA, 17 nt, Shigella flexneri 2a str. 2457T
aacugccaguaaagcag

SEQ ID NO: 3827477 - RNA, 16 nt, Shigella flexneri 2a str. 2457T
aacugcccgaucaacg

SEQ ID NO: 3827478 - RNA, 22 nt, Shigella flexneri 2a str. 2457T
aacugccggaaggcgauuaaac

SEQ ID NO: 3827479 - RNA, 15 nt, Shigella flexneri 2a str. 2457T
aacugccguugcugc

SEQ ID NO: 3827480 - RNA, 21 nt, Shigella flexneri 2a str. 2457T
aacugcgccacucgauaccag

SEQ ID NO: 3827481 - RNA, 16 nt, Shigella flexneri 2a str. 2457T
aacugcgccagaccca

SEQ ID NO: 3827482 - RNA, 21 nt, Shigella flexneri 2a str. 2457T
aacugcgcuauaucgcugaua

SEQ ID NO: 3827483 - RNA, 15 nt, Shigella flexneri 2a str. 2457T
aacugcgguuucggc

SEQ ID NO: 3827484 - RNA, 15 nt, Shigella flexneri 2a str. 2457T
aacugcguucugucg

SEQ ID NO: 3827485 - RNA, 20 nt, Shigella flexneri 2a str. 2457T
aacugcuauucaccagcaaa

SEQ ID NO: 3827486 - RNA, 19 nt, Shigella flexneri 2a str. 2457T
aacugcucguucagcggcc

SEQ ID NO: 3827487 - RNA, 16 nt, Shigella flexneri 2a str. 2457T
aacugcuguuaauuca

SEQ ID NO: 3827488 - RNA, 13 nt, Shigella flexneri 2a str. 2457T
aacuggaaaaaua

SEQ ID NO: 3827489 - RNA, 17 nt, Shigella flexneri 2a str. 2457T
aacuggaaaaauaauuu

SEQ ID NO: 3827490 - RNA, 16 nt, Shigella flexneri 2a str. 2457T
aacuggagcaggaacu

SEQ ID NO: 3827491 - RNA, 15 nt, Shigella flexneri 2a str. 2457T
aacuggaugaaaaaa

SEQ ID NO: 3827492 - RNA, 18 nt, Shigella flexneri 2a str. 2457T
aacuggauuacaaauaaa

SEQ ID NO: 3827493 - RNA, 17 nt, Shigella flexneri 2a str. 2457T
aacuggcaaccagaaga

SEQ ID NO: 3827494 - RNA, 15 nt, Shigella flexneri 2a str. 2457T
aacuggcaggaaaca

SEQ ID NO: 3827495 - RNA, 17 nt, Shigella flexneri 2a str. 2457T
aacuggcguguuucauu

SEQ ID NO: 3827496 - RNA, 21 nt, Shigella flexneri 2a str. 2457T
aacuggcguguuucauuagcc

SEQ ID NO: 3827497 - RNA, 18 nt, Shigella flexneri 2a str. 2457T
aacuggcuuucacaaggc

SEQ ID NO: 3827498 - RNA, 18 nt, Shigella flexneri 2a str. 2457T
aagacuuaccagcccuaa

SEQ ID NO: 3827499 - RNA, 14 nt, Shigella flexneri 2a str. 2457T
aagagaaaaccccc

SEQ ID NO: 3827500 - RNA, 20 nt, Shigella flexneri 2a str. 2457T
aagagaaagaacgaguaaaa

SEQ ID NO: 3827501 - RNA, 15 nt, Shigella flexneri 2a str. 2457T
aagagaacucuuuuu

SEQ ID NO: 3827502 - RNA, 23 nt, Shigella flexneri 2a str. 2457T
aagagacagccgaaaagguagaa

SEQ ID NO: 3827503 - RNA, 15 nt, Shigella flexneri 2a str. 2457T
aagagagaagccaga

SEQ ID NO: 3827504 - RNA, 19 nt, Shigella flexneri 2a str. 2457T
aagagauaaacgaccacuc

SEQ ID NO: 3827505 - RNA, 13 nt, Shigella flexneri 2a str. 2457T
aagagcaaauaaa

SEQ ID NO: 3827506 - RNA, 16 nt, Shigella flexneri 2a str. 2457T
aagagcaaauaaaaca

SEQ ID NO: 3827507 - RNA, 16 nt, Shigella flexneri 2a str. 2457T
aagagcagcugauuga

SEQ ID NO: 3827508 - RNA, 17 nt, Shigella flexneri 2a str. 2457T
aagagcgacaaucccug

SEQ ID NO: 3827509 - RNA, 18 nt, Shigella flexneri 2a str. 2457T
aagagcgggacaacaaac

SEQ ID NO: 3827510 - RNA, 13 nt, Shigella flexneri 2a str. 2457T
aagaggaaauaag

SEQ ID NO: 3827511 - RNA, 16 nt, Shigella flexneri 2a str. 2457T
aagaggaaauaagcau

SEQ ID NO: 3827512 - RNA, 15 nt, Shigella flexneri 2a str. 2457T
aagaggcgcagauga

SEQ ID NO: 3827513 - RNA, 21 nt, Shigella flexneri 2a str. 2457T
aagaggcggagguuuuuuccu

SEQ ID NO: 3827514 - RNA, 14 nt, Shigella flexneri 2a str. 2457T
aagaguaaauugca

SEQ ID NO: 3827515 - RNA, 15 nt, Shigella flexneri 2a str. 2457T
aagaguaaccaaacg

SEQ ID NO: 3827516 - RNA, 15 nt, Shigella flexneri 2a str. 2457T
aagaguucaaagccg

SEQ ID NO: 3827517 - RNA, 17 nt, Shigella flexneri 2a str. 2457T
aagaguucaaagccgaa

SEQ ID NO: 3827518 - RNA, 13 nt, Shigella flexneri 2a str. 2457T
aagaguuccaacg

SEQ ID NO: 3827519 - RNA, 23 nt, Shigella flexneri 2a str. 2457T
aagaguugccccucuaacucuuc

SEQ ID NO: 3827520 - RNA, 15 nt, Shigella flexneri 2a str. 2457T
aagaguuuaucuguu

SEQ ID NO: 3827521 - RNA, 22 nt, Shigella flexneri 2a str. 2457T
aagauaaaucgcacguugucag

SEQ ID NO: 3827522 - RNA, 18 nt, Shigella flexneri 2a str. 2457T
aagauacggauucuuaac

SEQ ID NO: 3827523 - RNA, 18 nt, Shigella flexneri 2a str. 2457T
aagauagcgucauuucua

SEQ ID NO: 3827524 - RNA, 19 nt, Shigella flexneri 2a str. 2457T
aagauagcgucauuucuac

SEQ ID NO: 3827525 - RNA, 18 nt, Shigella flexneri 2a str. 2457T
aagauaguuggcagcgcg

SEQ ID NO: 3827526 - RNA, 17 nt, Shigella flexneri 2a str. 2457T
aagauaugcauccgcug

SEQ ID NO: 3827527 - RNA, 22 nt, Shigella flexneri 2a str. 2457T
aagauauuguuuuccguugugc

SEQ ID NO: 3827528 - RNA, 18 nt, Shigella flexneri 2a str. 2457T
aagauauuucaccagcgc

SEQ ID NO: 3827529 - RNA, 20 nt, Shigella flexneri 2a str. 2457T
aagauauuucaccagcgcac

SEQ ID NO: 3827530 - RNA, 24 nt, Shigella flexneri 2a str. 2457T
aagauauuuugggaucggugcaga

SEQ ID NO: 3827531 - RNA, 16 nt, Shigella flexneri 2a str. 2457T
aagaucaucggccaga

SEQ ID NO: 3827532 - RNA, 22 nt, Shigella flexneri 2a str. 2457T
aagauccagguuacgcaccaga

SEQ ID NO: 3827533 - RNA, 14 nt, Shigella flexneri 2a str. 2457T
aagaucgccacugc

SEQ ID NO: 3827534 - RNA, 14 nt, Shigella flexneri 2a str. 2457T
aagaugaaacuuau

SEQ ID NO: 3827535 - RNA, 16 nt, Shigella flexneri 2a str. 2457T
aagaugcacccgccag

SEQ ID NO: 3827536 - RNA, 14 nt, Shigella flexneri 2a str. 2457T
aagaugccugaugc

SEQ ID NO: 3827537 - RNA, 15 nt, Shigella flexneri 2a str. 2457T
aagaugcgccagcau

SEQ ID NO: 3827538 - RNA, 19 nt, Shigella flexneri 2a str. 2457T
aagaugcggaauuugauga

SEQ ID NO: 3827539 - RNA, 21 nt, Shigella flexneri 2a str. 2457T
aagaugcgucagcaucgcauc

SEQ ID NO: 3827540 - RNA, 14 nt, Shigella flexneri 2a str. 2457T
aagaugcuacaaca

SEQ ID NO: 3827541 - RNA, 23 nt, Shigella flexneri 2a str. 2457T
aagauggauugcugaaauacaga

SEQ ID NO: 3827542 - RNA, 20 nt, Shigella flexneri 2a str. 2457T
aagauggcauacaacgccau

SEQ ID NO: 3827543 - RNA, 22 nt, Shigella flexneri 2a str. 2457T
aagaugugagcgauacccauuu

SEQ ID NO: 3827544 - RNA, 12 nt, Shigella flexneri 2a str. 2457T
aagauuacugac

SEQ ID NO: 3827545 - RNA, 22 nt, Shigella flexneri 2a str. 2457T
aagauuacugacaauuugccca

SEQ ID NO: 3827546 - RNA, 14 nt, Shigella flexneri 2a str. 2457T
aagauuagccugaa

SEQ ID NO: 3827547 - RNA, 22 nt, Shigella flexneri 2a str. 2457T
aagauuagcgacgaacagcgau

SEQ ID NO: 3827548 - RNA, 19 nt, Shigella flexneri 2a str. 2457T
aagauuauauaauaugcau

SEQ ID NO: 3827549 - RNA, 15 nt, Shigella flexneri 2a str. 2457T
aagauuccagugccg

SEQ ID NO: 3827550 - RNA, 21 nt, Shigella flexneri 2a str. 2457T
aagauugccggggauaucccc

SEQ ID NO: 3827551 - RNA, 19 nt, Shigella flexneri 2a str. 2457T
aagauuguuggcaaaaaaa

SEQ ID NO: 3827552 - RNA, 22 nt, Shigella flexneri 2a str. 2457T
aagauuugacccaucugccagc

SEQ ID NO: 3827553 - RNA, 12 nt, Shigella flexneri 2a str. 2457T
aagcaaaaaaac

SEQ ID NO: 3827554 - RNA, 14 nt, Shigella flexneri 2a str. 2457T
aagcaaaaacgcau

SEQ ID NO: 3827555 - RNA, 22 nt, Shigella flexneri 2a str. 2457T
aagcaaaaauaaaugcuugacu

SEQ ID NO: 3827556 - RNA, 13 nt, Shigella flexneri 2a str. 2457T
aagcaaaauguua

SEQ ID NO: 3827557 - RNA, 13 nt, Shigella flexneri 2a str. 2457T
aagcaaauuguga

SEQ ID NO: 3827558 - RNA, 12 nt, Shigella flexneri 2a str. 2457T
aagcaacaaagu

SEQ ID NO: 3827559 - RNA, 12 nt, Shigella flexneri 2a str. 2457T
aagcaacuccau

SEQ ID NO: 3827560 - RNA, 18 nt, Shigella flexneri 2a str. 2457T
aagcaacugacuggcucu

SEQ ID NO: 3827561 - RNA, 16 nt, Shigella flexneri 2a str. 2457T
aagcaauaccgcgaau

SEQ ID NO: 3827562 - RNA, 15 nt, Shigella flexneri 2a str. 2457T
aagcaauuaacagug

SEQ ID NO: 3827563 - RNA, 15 nt, Shigella flexneri 2a str. 2457T
aagcacaugcugaca

SEQ ID NO: 3827564 - RNA, 15 nt, Shigella flexneri 2a str. 2457T
aagcacccagcaauc

SEQ ID NO: 3827565 - RNA, 16 nt, Shigella flexneri 2a str. 2457T
aagcacccagcaaucc

SEQ ID NO: 3827566 - RNA, 18 nt, Shigella flexneri 2a str. 2457T
aagcaccugcgcaggcau

SEQ ID NO: 3827567 - RNA, 19 nt, Shigella flexneri 2a str. 2457T
aagcacgauuuguaggccg

SEQ ID NO: 3827568 - RNA, 21 nt, Shigella flexneri 2a str. 2457T
aagcacuacucuauacaggau

SEQ ID NO: 3827569 - RNA, 20 nt, Shigella flexneri 2a str. 2457T
aagcacucugacggauagua

SEQ ID NO: 3827570 - RNA, 16 nt, Shigella flexneri 2a str. 2457T
aagcacugcaucaaug

SEQ ID NO: 3827571 - RNA, 20 nt, Shigella flexneri 2a str. 2457T
aagcacugcaucaaugccgg

SEQ ID NO: 3827572 - RNA, 24 nt, Shigella flexneri 2a str. 2457T
aagcacuggcggcagcaggugcgc

SEQ ID NO: 3827573 - RNA, 19 nt, Shigella flexneri 2a str. 2457T
aagcagacaacccacacau

SEQ ID NO: 3827574 - RNA, 16 nt, Shigella flexneri 2a str. 2457T
aagcagagcagggaag

SEQ ID NO: 3827575 - RNA, 17 nt, Shigella flexneri 2a str. 2457T
aagcagcauacccaccg

SEQ ID NO: 3827576 - RNA, 19 nt, Shigella flexneri 2a str. 2457T
aagcagcauguagaugccg

SEQ ID NO: 3827577 - RNA, 13 nt, Shigella flexneri 2a str. 2457T
aagcagccaucug

SEQ ID NO: 3827578 - RNA, 21 nt, Shigella flexneri 2a str. 2457T
aagcagcgaugcuuugcgcuu

SEQ ID NO: 3827579 - RNA, 20 nt, Shigella flexneri 2a str. 2457T
aagcagcgcgcagaacauau

SEQ ID NO: 3827580 - RNA, 12 nt, Shigella flexneri 2a str. 2457T
aagcagcuugcu

SEQ ID NO: 3827581 - RNA, 22 nt, Shigella flexneri 2a str. 2457T
aagcaggucggcucagccgaug

SEQ ID NO: 3827582 - RNA, 12 nt, Shigella flexneri 2a str. 2457T
aagcaguccagc

SEQ ID NO: 3827583 - RNA, 20 nt, Shigella flexneri 2a str. 2457T
aagcaguccagcgccugacg

SEQ ID NO: 3827584 - RNA, 17 nt, Shigella flexneri 2a str. 2457T
aagcaguuucaccagca

SEQ ID NO: 3827585 - RNA, 18 nt, Shigella flexneri 2a str. 2457T
aagcaguuucaccagcag

SEQ ID NO: 3827586 - RNA, 13 nt, Shigella flexneri 2a str. 2457T
aagcauagcccca

SEQ ID NO: 3827587 - RNA, 21 nt, Shigella flexneri 2a str. 2457T
aagcaugaucgaggcaaagag

SEQ ID NO: 3827588 - RNA, 20 nt, Shigella flexneri 2a str. 2457T
aagcaugucauacaugguuu

SEQ ID NO: 3827589 - RNA, 17 nt, Shigella flexneri 2a str. 2457T
aagcauucacgccgcau

SEQ ID NO: 3827590 - RNA, 14 nt, Shigella flexneri 2a str. 2457T
aagcauucgcgagg

SEQ ID NO: 3827591 - RNA, 17 nt, Shigella flexneri 2a str. 2457T
aagcauucguaaugaau

SEQ ID NO: 3827592 - RNA, 11 nt, Shigella flexneri 2a str. 2457T
aagcauuuaau

SEQ ID NO: 3827593 - RNA, 18 nt, Shigella flexneri 2a str. 2457T
aagcauuuuuucacaugu

SEQ ID NO: 3827594 - RNA, 15 nt, Shigella flexneri 2a str. 2457T
aagccaaaucaucca

SEQ ID NO: 3827595 - RNA, 14 nt, Shigella flexneri 2a str. 2457T
aagccaacagcagc

SEQ ID NO: 3827596 - RNA, 19 nt, Shigella flexneri 2a str. 2457T
aagcucuucaugcagcaug

SEQ ID NO: 3827597 - RNA, 19 nt, Shigella flexneri 2a str. 2457T
aagcugacaggcgcugaug

SEQ ID NO: 3827598 - RNA, 23 nt, Shigella flexneri 2a str. 2457T
aagcugauucgcgacguaagaaa

SEQ ID NO: 3827599 - RNA, 20 nt, Shigella flexneri 2a str. 2457T
aagcugcaaguauucacucu

SEQ ID NO: 3827600 - RNA, 22 nt, Shigella flexneri 2a str. 2457T
aagcugcugacggugauaauca

SEQ ID NO: 3827601 - RNA, 13 nt, Shigella flexneri 2a str. 2457T
aagcuggaagggu

SEQ ID NO: 3827602 - RNA, 20 nt, Shigella flexneri 2a str. 2457T
aagcuggaaggguugaaaua

SEQ ID NO: 3827603 - RNA, 13 nt, Shigella flexneri 2a str. 2457T
aagcuggcaaagu

SEQ ID NO: 3827604 - RNA, 16 nt, Shigella flexneri 2a str. 2457T
aagcuggcagaaguug

SEQ ID NO: 3827605 - RNA, 18 nt, Shigella flexneri 2a str. 2457T
aagcuggcagaaguuguc

SEQ ID NO: 3827606 - RNA, 11 nt, Shigella flexneri 2a str. 2457T
aagcuggcauu

SEQ ID NO: 3827607 - RNA, 14 nt, Shigella flexneri 2a str. 2457T
aagcuguaucccag

SEQ ID NO: 3827608 - RNA, 18 nt, Shigella flexneri 2a str. 2457T
aagcuguaucccagccca

SEQ ID NO: 3827609 - RNA, 17 nt, Shigella flexneri 2a str. 2457T
aagcugucaccaaucag

SEQ ID NO: 3827610 - RNA, 13 nt, Shigella flexneri 2a str. 2457T
aaggaaaguaaau

SEQ ID NO: 3827611 - RNA, 19 nt, Shigella flexneri 2a str. 2457T
aaggaaccuccauguccag

SEQ ID NO: 3827612 - RNA, 23 nt, Shigella flexneri 2a str. 2457T
aaggaagccugacagggaaggga

SEQ ID NO: 3827613 - RNA, 19 nt, Shigella flexneri 2a str. 2457T
aaggaauuuuacagcccug

SEQ ID NO: 3827614 - RNA, 15 nt, Shigella flexneri 2a str. 2457T
aaggacauuauucag

SEQ ID NO: 3827615 - RNA, 20 nt, Shigella flexneri 2a str. 2457T
aaggagcuaauaaugagcag

SEQ ID NO: 3827616 - RNA, 13 nt, Shigella flexneri 2a str. 2457T
aaggauaaaaaag

SEQ ID NO: 3827617 - RNA, 13 nt, Shigella flexneri 2a str. 2457T
aaggauaugugaa

SEQ ID NO: 3827618 - RNA, 16 nt, Shigella flexneri 2a str. 2457T
aaggaugagaagcuuc

SEQ ID NO: 3827619 - RNA, 16 nt, Shigella flexneri 2a str. 2457T
aaggauggucgcuuug

SEQ ID NO: 3827620 - RNA, 18 nt, Shigella flexneri 2a str. 2457T
aaggauugcagcacugau

SEQ ID NO: 3827621 - RNA, 19 nt, Shigella flexneri 2a str. 2457T
aaggauugcgauguugcgu

SEQ ID NO: 3827622 - RNA, 13 nt, Shigella flexneri 2a str. 2457T
aaggcaagaaaau

SEQ ID NO: 3827623 - RNA, 17 nt, Shigella flexneri 2a str. 2457T
aaggcacaacugcgacc

SEQ ID NO: 3827624 - RNA, 19 nt, Shigella flexneri 2a str. 2457T
aaggcaccaauauugacug

SEQ ID NO: 3827625 - RNA, 15 nt, Shigella flexneri 2a str. 2457T
aaggcagaaacaaac

SEQ ID NO: 3827626 - RNA, 19 nt, Shigella flexneri 2a str. 2457T
aaggcagaaacaaacgcaa

SEQ ID NO: 3827627 - RNA, 22 nt, Shigella flexneri 2a str. 2457T
aaggcagacguauccuggaaca

SEQ ID NO: 3827628 - RNA, 20 nt, Shigella flexneri 2a str. 2457T
aaggcagccuuucucagaga

SEQ ID NO: 3827629 - RNA, 12 nt, Shigella flexneri 2a str. 2457T
aaggcaguucag

SEQ ID NO: 3827630 - RNA, 16 nt, Shigella flexneri 2a str. 2457T
aaggcauuaaacgcau

SEQ ID NO: 3827631 - RNA, 18 nt, Shigella flexneri 2a str. 2457T
aaggcauuuacgccgcau

SEQ ID NO: 3827632 - RNA, 23 nt, Shigella flexneri 2a str. 2457T
aaggccagaccguggucagaaaa

SEQ ID NO: 3827633 - RNA, 23 nt, Shigella flexneri 2a str. 2457T
aaggccgacagcaggcucagaag

SEQ ID NO: 3827634 - RNA, 15 nt, Shigella flexneri 2a str. 2457T
aaggccggagcaugc

SEQ ID NO: 3827635 - RNA, 20 nt, Shigella flexneri 2a str. 2457T
aaggccguuuucaacaccgc

SEQ ID NO: 3827636 - RNA, 15 nt, Shigella flexneri 2a str. 2457T
aaggccuuaguagaa

SEQ ID NO: 3827637 - RNA, 13 nt, Shigella flexneri 2a str. 2457T
aaggcgagcgcgg

SEQ ID NO: 3827638 - RNA, 18 nt, Shigella flexneri 2a str. 2457T
aaggcgcgagguuuuccu

SEQ ID NO: 3827639 - RNA, 18 nt, Shigella flexneri 2a str. 2457T
aaggcgcucauuuucucu

SEQ ID NO: 3827640 - RNA, 15 nt, Shigella flexneri 2a str. 2457T
aaggcggcagaacag

SEQ ID NO: 3827641 - RNA, 14 nt, Shigella flexneri 2a str. 2457T
aaggcguucacgcc

SEQ ID NO: 3827642 - RNA, 20 nt, Shigella flexneri 2a str. 2457T
aaggcguuuacgccgcaucc

SEQ ID NO: 3827643 - RNA, 18 nt, Shigella flexneri 2a str. 2457T
aaggcguuuucgccgcau

SEQ ID NO: 3827644 - RNA, 17 nt, Shigella flexneri 2a str. 2457T
aaggcuagguugaccug

SEQ ID NO: 3827645 - RNA, 16 nt, Shigella flexneri 2a str. 2457T
aaggcugacaaaucag

SEQ ID NO: 3827646 - RNA, 12 nt, Shigella flexneri 2a str. 2457T
aaggcugaugaa

SEQ ID NO: 3827647 - RNA, 18 nt, Shigella flexneri 2a str. 2457T
aaggcugaugaagcaagc

SEQ ID NO: 3827648 - RNA, 13 nt, Shigella flexneri 2a str. 2457T
aaggcuguuccca

SEQ ID NO: 3827649 - RNA, 12 nt, Shigella flexneri 2a str. 2457T
aaggcuucaacg

SEQ ID NO: 3827650 - RNA, 22 nt, Shigella flexneri 2a str. 2457T
aaggcuucguaaguggcguuua

SEQ ID NO: 3827651 - RNA, 15 nt, Shigella flexneri 2a str. 2457T
aagggcggcgagaaa

SEQ ID NO: 3827652 - RNA, 14 nt, Shigella flexneri 2a str. 2457T
aagggcuaacgugc

SEQ ID NO: 3827653 - RNA, 15 nt, Shigella flexneri 2a str. 2457T
aaggggugaaaaaaa

SEQ ID NO: 3827654 - RNA, 15 nt, Shigella flexneri 2a str. 2457T
aagggucagggagaa

SEQ ID NO: 3827655 - RNA, 16 nt, Shigella flexneri 2a str. 2457T
aaggguuucgcgguug

SEQ ID NO: 3827656 - RNA, 17 nt, Shigella flexneri 2a str. 2457T
aaggguuuuauaaucgc

SEQ ID NO: 3827657 - RNA, 21 nt, Shigella flexneri 2a str. 2457T
aaggguuuuugagucacauuu

SEQ ID NO: 3827658 - RNA, 18 nt, Shigella flexneri 2a str. 2457T
aagguaaggauaaaaaag

SEQ ID NO: 3827659 - RNA, 20 nt, Shigella flexneri 2a str. 2457T
aagguaaugcgcgagccaua

SEQ ID NO: 3827660 - RNA, 13 nt, Shigella flexneri 2a str. 2457T
aagguacgaaaaa

SEQ ID NO: 3827661 - RNA, 13 nt, Shigella flexneri 2a str. 2457T
aagguagaauaag

SEQ ID NO: 3827662 - RNA, 17 nt, Shigella flexneri 2a str. 2457T
aagguaucgcgaaaaaa

SEQ ID NO: 3827663 - RNA, 23 nt, Shigella flexneri 2a str. 2457T
aaggucacucccggauaaaucuc

SEQ ID NO: 3827664 - RNA, 18 nt, Shigella flexneri 2a str. 2457T
aaggucaucaaucauuuu

SEQ ID NO: 3827665 - RNA, 22 nt, Shigella flexneri 2a str. 2457T
aaggucaucaaucauuuuuuga

SEQ ID NO: 3827666 - RNA, 16 nt, Shigella flexneri 2a str. 2457T
aaggucgacagcagcc

SEQ ID NO: 3827667 - RNA, 23 nt, Shigella flexneri 2a str. 2457T
aaggucggcuuugaauaucuccu

SEQ ID NO: 3827668 - RNA, 20 nt, Shigella flexneri 2a str. 2457T
aaggucuccgcccagcguac

SEQ ID NO: 3827669 - RNA, 12 nt, Shigella flexneri 2a str. 2457T
aaggugaagaag

SEQ ID NO: 3827670 - RNA, 17 nt, Shigella flexneri 2a str. 2457T
aaggugauuuuugagac

SEQ ID NO: 3827671 - RNA, 18 nt, Shigella flexneri 2a str. 2457T
aaggugccggaauauauu

SEQ ID NO: 3827672 - RNA, 13 nt, Shigella flexneri 2a str. 2457T
aaggugcgcgaug

SEQ ID NO: 3827673 - RNA, 18 nt, Shigella flexneri 2a str. 2457T
aagguggcauaaauuucu

SEQ ID NO: 3827674 - RNA, 14 nt, Shigella flexneri 2a str. 2457T
aaggugggaggcgg

SEQ ID NO: 3827675 - RNA, 19 nt, Shigella flexneri 2a str. 2457T
aagguguucacgccgcauc

SEQ ID NO: 3827676 - RNA, 17 nt, Shigella flexneri 2a str. 2457T
aagguuaacuguggcgu

SEQ ID NO: 3827677 - RNA, 19 nt, Shigella flexneri 2a str. 2457T
aagguucacuuaaucucug

SEQ ID NO: 3827678 - RNA, 14 nt, Shigella flexneri 2a str. 2457T
aagguugccugucu

SEQ ID NO: 3827679 - RNA, 14 nt, Shigella flexneri 2a str. 2457T
aagguuggcgucgg

SEQ ID NO: 3827680 - RNA, 22 nt, Shigella flexneri 2a str. 2457T
aagguuuaauacgcuuaaucug

SEQ ID NO: 3827681 - RNA, 15 nt, Shigella flexneri 2a str. 2457T
aagguuucaguaaca

SEQ ID NO: 3827682 - RNA, 12 nt, Shigella flexneri 2a str. 2457T
aagguuucugca

SEQ ID NO: 3827683 - RNA, 16 nt, Shigella flexneri 2a str. 2457T
aaguaaaaaagaagga

SEQ ID NO: 3827684 - RNA, 18 nt, Shigella flexneri 2a str. 2457T
aaguaaaaaagaaggaaa

SEQ ID NO: 3827685 - RNA, 19 nt, Shigella flexneri 2a str. 2457T
aaguaacaauagcgaacag

SEQ ID NO: 3827686 - RNA, 16 nt, Shigella flexneri 2a str. 2457T
aaguaagcaacauaag

SEQ ID NO: 3827687 - RNA, 18 nt, Shigella flexneri 2a str. 2457T
aaguaaggcgggaauaau

SEQ ID NO: 3827688 - RNA, 14 nt, Shigella flexneri 2a str. 2457T
aaguaauucauuca

SEQ ID NO: 3827689 - RNA, 22 nt, Shigella flexneri 2a str. 2457T
aaguacacauaaacagguaaag

SEQ ID NO: 3827690 - RNA, 15 nt, Shigella flexneri 2a str. 2457T
aaguacgauacagaa

SEQ ID NO: 3827691 - RNA, 18 nt, Shigella flexneri 2a str. 2457T
aaguacgauacagaagca

SEQ ID NO: 3827692 - RNA, 20 nt, Shigella flexneri 2a str. 2457T
aaguagagcgaaacgaaagu

SEQ ID NO: 3827693 - RNA, 14 nt, Shigella flexneri 2a str. 2457T
aaguagcagguaau

SEQ ID NO: 3827694 - RNA, 22 nt, Shigella flexneri 2a str. 2457T
aauaagccccuuucgaaaucau

SEQ ID NO: 3827695 - RNA, 15 nt, Shigella flexneri 2a str. 2457T
aauaagcuauaaaaa

SEQ ID NO: 3827696 - RNA, 13 nt, Shigella flexneri 2a str. 2457T
aauaagcuuuuuc

SEQ ID NO: 3827697 - RNA, 16 nt, Shigella flexneri 2a str. 2457T
aauaaggccaugcugc

SEQ ID NO: 3827698 - RNA, 13 nt, Shigella flexneri 2a str. 2457T
aauaagguuaauu

SEQ ID NO: 3827699 - RNA, 23 nt, Shigella flexneri 2a str. 2457T
aauaaguuaucaaguauuuuuaa

SEQ ID NO: 3827700 - RNA, 15 nt, Shigella flexneri 2a str. 2457T
aauaauaucuccagc

SEQ ID NO: 3827701 - RNA, 14 nt, Shigella flexneri 2a str. 2457T
aauaaucaacgcga

SEQ ID NO: 3827702 - RNA, 20 nt, Shigella flexneri 2a str. 2457T
aauaaucaacgcggcaauaa

SEQ ID NO: 3827703 - RNA, 22 nt, Shigella flexneri 2a str. 2457T
aauaaucacauaauccagacac

SEQ ID NO: 3827704 - RNA, 22 nt, Shigella flexneri 2a str. 2457T
aauaaucaccacacaaccgagg

SEQ ID NO: 3827705 - RNA, 11 nt, Shigella flexneri 2a str. 2457T
aauaaucagau

SEQ ID NO: 3827706 - RNA, 22 nt, Shigella flexneri 2a str. 2457T
aauaaucgaucgcguaauaaaa

SEQ ID NO: 3827707 - RNA, 22 nt, Shigella flexneri 2a str. 2457T
aauaaucgcgcuaauuccaguc

SEQ ID NO: 3827708 - RNA, 22 nt, Shigella flexneri 2a str. 2457T
aauaaucgggaauacagaaaau

SEQ ID NO: 3827709 - RNA, 18 nt, Shigella flexneri 2a str. 2457T
aauaaucguaaucagcau

SEQ ID NO: 3827710 - RNA, 24 nt, Shigella flexneri 2a str. 2457T
aauaaucucuuuacccagcggaug

SEQ ID NO: 3827711 - RNA, 14 nt, Shigella flexneri 2a str. 2457T
aauaaugagcagaa

SEQ ID NO: 3827712 - RNA, 17 nt, Shigella flexneri 2a str. 2457T
aauaaugcgacaacaga

SEQ ID NO: 3827713 - RNA, 20 nt, Shigella flexneri 2a str. 2457T
aauaaugcgacaacagaaau

SEQ ID NO: 3827714 - RNA, 21 nt, Shigella flexneri 2a str. 2457T
aauaaugcgacaacagaaaua

SEQ ID NO: 3827715 - RNA, 23 nt, Shigella flexneri 2a str. 2457T
aauaaugcgacaacagaaauaau

SEQ ID NO: 3827716 - RNA, 15 nt, Shigella flexneri 2a str. 2457T
aauaauggccuuuuc

SEQ ID NO: 3827717 - RNA, 14 nt, Shigella flexneri 2a str. 2457T
aauaauggugaauu

SEQ ID NO: 3827718 - RNA, 15 nt, Shigella flexneri 2a str. 2457T
aauaaugucuuuaau

SEQ ID NO: 3827719 - RNA, 17 nt, Shigella flexneri 2a str. 2457T
aauaauuaucauuaaaa

SEQ ID NO: 3827720 - RNA, 16 nt, Shigella flexneri 2a str. 2457T
aauaauucaaaaaccu

SEQ ID NO: 3827721 - RNA, 15 nt, Shigella flexneri 2a str. 2457T
aauaauuuuaaauau

SEQ ID NO: 3827722 - RNA, 16 nt, Shigella flexneri 2a str. 2457T
aauaauuuuuucgcca

SEQ ID NO: 3827723 - RNA, 20 nt, Shigella flexneri 2a str. 2457T
aauacaaaauuuaacaccau

SEQ ID NO: 3827724 - RNA, 14 nt, Shigella flexneri 2a str. 2457T
aauacaaccugcug

SEQ ID NO: 3827725 - RNA, 20 nt, Shigella flexneri 2a str. 2457T
aauacaaggccaauccagcc

SEQ ID NO: 3827726 - RNA, 19 nt, Shigella flexneri 2a str. 2457T
aauacacuaacagaacaau

SEQ ID NO: 3827727 - RNA, 15 nt, Shigella flexneri 2a str. 2457T
aauacagcaauggaa

SEQ ID NO: 3827728 - RNA, 18 nt, Shigella flexneri 2a str. 2457T
aauacagcaauggaaaaa

SEQ ID NO: 3827729 - RNA, 19 nt, Shigella flexneri 2a str. 2457T
aauacagcaauggaaaaag

SEQ ID NO: 3827730 - RNA, 14 nt, Shigella flexneri 2a str. 2457T
aauacagccagcca

SEQ ID NO: 3827731 - RNA, 21 nt, Shigella flexneri 2a str. 2457T
aauacaggcgacgaguugcuu

SEQ ID NO: 3827732 - RNA, 17 nt, Shigella flexneri 2a str. 2457T
aauacauacgcaaaaaa

SEQ ID NO: 3827733 - RNA, 20 nt, Shigella flexneri 2a str. 2457T
aauacauacgcaaaaaacau

SEQ ID NO: 3827734 - RNA, 19 nt, Shigella flexneri 2a str. 2457T
aauacauauauuacaacgu

SEQ ID NO: 3827735 - RNA, 23 nt, Shigella flexneri 2a str. 2457T
aauacaucaauuuucccuucuga

SEQ ID NO: 3827736 - RNA, 13 nt, Shigella flexneri 2a str. 2457T
aauacaucuuuuc

SEQ ID NO: 3827737 - RNA, 12 nt, Shigella flexneri 2a str. 2457T
aauaccaauaau

SEQ ID NO: 3827738 - RNA, 22 nt, Shigella flexneri 2a str. 2457T
aauaccacccgucgggcagaaa

SEQ ID NO: 3827739 - RNA, 18 nt, Shigella flexneri 2a str. 2457T
aauaccaucggcagcgcc

SEQ ID NO: 3827740 - RNA, 19 nt, Shigella flexneri 2a str. 2457T
aauaccaucggcagcgcca

SEQ ID NO: 3827741 - RNA, 17 nt, Shigella flexneri 2a str. 2457T
aauaccauggcucacca

SEQ ID NO: 3827742 - RNA, 19 nt, Shigella flexneri 2a str. 2457T
aauaccauggcucaccagc

SEQ ID NO: 3827743 - RNA, 15 nt, Shigella flexneri 2a str. 2457T
aauacccaaaaaaua

SEQ ID NO: 3827744 - RNA, 21 nt, Shigella flexneri 2a str. 2457T
aauacccuguauaauaggaaa

SEQ ID NO: 3827745 - RNA, 23 nt, Shigella flexneri 2a str. 2457T
aauaccgaagaguaaccaaacgu

SEQ ID NO: 3827746 - RNA, 18 nt, Shigella flexneri 2a str. 2457T
aauaccgacuucggccag

SEQ ID NO: 3827747 - RNA, 15 nt, Shigella flexneri 2a str. 2457T
aauaccgauaucgcc

SEQ ID NO: 3827748 - RNA, 14 nt, Shigella flexneri 2a str. 2457T
aauaccgcccacca

SEQ ID NO: 3827749 - RNA, 14 nt, Shigella flexneri 2a str. 2457T
aauaccgcccagac

SEQ ID NO: 3827750 - RNA, 20 nt, Shigella flexneri 2a str. 2457T
aauaccgccugacggugaug

SEQ ID NO: 3827751 - RNA, 15 nt, Shigella flexneri 2a str. 2457T
aauaccggaugccaa

SEQ ID NO: 3827752 - RNA, 19 nt, Shigella flexneri 2a str. 2457T
aauaccggcgucccaucgg

SEQ ID NO: 3827753 - RNA, 22 nt, Shigella flexneri 2a str. 2457T
aauaccguucauuaacgcccca

SEQ ID NO: 3827754 - RNA, 13 nt, Shigella flexneri 2a str. 2457T
aauaccugccugu

SEQ ID NO: 3827755 - RNA, 21 nt, Shigella flexneri 2a str. 2457T
aauaccugccugucacgcagg

SEQ ID NO: 3827756 - RNA, 14 nt, Shigella flexneri 2a str. 2457T
aauaccuucuuccu

SEQ ID NO: 3827757 - RNA, 19 nt, Shigella flexneri 2a str. 2457T
aauaccuucuuccugcgcc

SEQ ID NO: 3827758 - RNA, 19 nt, Shigella flexneri 2a str. 2457T
aauaccuuucgauuucucu

SEQ ID NO: 3827759 - RNA, 19 nt, Shigella flexneri 2a str. 2457T
aauacgauccugagcagcc

SEQ ID NO: 3827760 - RNA, 22 nt, Shigella flexneri 2a str. 2457T
aauacgcaccgggcuuccggca

SEQ ID NO: 3827761 - RNA, 17 nt, Shigella flexneri 2a str. 2457T
aauacgcgaggcgcuaa

SEQ ID NO: 3827762 - RNA, 20 nt, Shigella flexneri 2a str. 2457T
aauacgcucacgcgcugccu

SEQ ID NO: 3827763 - RNA, 15 nt, Shigella flexneri 2a str. 2457T
aauacgcucaucugg

SEQ ID NO: 3827764 - RNA, 18 nt, Shigella flexneri 2a str. 2457T
aauacgcucgaacagcug

SEQ ID NO: 3827765 - RNA, 23 nt, Shigella flexneri 2a str. 2457T
aauacgcuggcugaacauuaaau

SEQ ID NO: 3827766 - RNA, 17 nt, Shigella flexneri 2a str. 2457T
aauacguuucauauccg

SEQ ID NO: 3827767 - RNA, 22 nt, Shigella flexneri 2a str. 2457T
aauacugaagucgaacuucucu

SEQ ID NO: 3827768 - RNA, 17 nt, Shigella flexneri 2a str. 2457T
aauacugacaucagcau

SEQ ID NO: 3827769 - RNA, 15 nt, Shigella flexneri 2a str. 2457T
aauacugaucaucau

SEQ ID NO: 3827770 - RNA, 17 nt, Shigella flexneri 2a str. 2457T
aauacuuucacaaaaau

SEQ ID NO: 3827771 - RNA, 19 nt, Shigella flexneri 2a str. 2457T
aauacuuucacaaaaauaa

SEQ ID NO: 3827772 - RNA, 16 nt, Shigella flexneri 2a str. 2457T
aauagaauccgcgacu

SEQ ID NO: 3827773 - RNA, 16 nt, Shigella flexneri 2a str. 2457T
aauagaauggcaucag

SEQ ID NO: 3827774 - RNA, 17 nt, Shigella flexneri 2a str. 2457T
aauagacacaagaaaua

SEQ ID NO: 3827775 - RNA, 22 nt, Shigella flexneri 2a str. 2457T
aauagagaaaguaaaccaccag

SEQ ID NO: 3827776 - RNA, 15 nt, Shigella flexneri 2a str. 2457T
aauagagauagaaug

SEQ ID NO: 3827777 - RNA, 15 nt, Shigella flexneri 2a str. 2457T
aauagaguguuccuc

SEQ ID NO: 3827778 - RNA, 16 nt, Shigella flexneri 2a str. 2457T
aauagcaacugauuua

SEQ ID NO: 3827779 - RNA, 17 nt, Shigella flexneri 2a str. 2457T
aauagcaacugauuuau

SEQ ID NO: 3827780 - RNA, 22 nt, Shigella flexneri 2a str. 2457T
aauagcaacugauuuauagauu

SEQ ID NO: 3827781 - RNA, 16 nt, Shigella flexneri 2a str. 2457T
aauagcacugcuuucc

SEQ ID NO: 3827782 - RNA, 21 nt, Shigella flexneri 2a str. 2457T
aauagccaauacgauaaugcc

SEQ ID NO: 3827783 - RNA, 14 nt, Shigella flexneri 2a str. 2457T
aauagccaaucauu

SEQ ID NO: 3827784 - RNA, 17 nt, Shigella flexneri 2a str. 2457T
aauagccacauugcugc

SEQ ID NO: 3827785 - RNA, 20 nt, Shigella flexneri 2a str. 2457T
aauagccagcagagcaaaaa

SEQ ID NO: 3827786 - RNA, 16 nt, Shigella flexneri 2a str. 2457T
aauagcccucgccgcu

SEQ ID NO: 3827787 - RNA, 24 nt, Shigella flexneri 2a str. 2457T
aauagccgcagccaucagcgagac

SEQ ID NO: 3827788 - RNA, 22 nt, Shigella flexneri 2a str. 2457T
aauagccgccauacggaaaauc

SEQ ID NO: 3827789 - RNA, 18 nt, Shigella flexneri 2a str. 2457T
aauagccugccagaggag

SEQ ID NO: 3827790 - RNA, 15 nt, Shigella flexneri 2a str. 2457T
aauagcgcaaaauua

SEQ ID NO: 3827791 - RNA, 16 nt, Shigella flexneri 2a str. 2457T
aaucacaucaccauaa

SEQ ID NO: 3827792 - RNA, 14 nt, Shigella flexneri 2a str. 2457T
aaucaccacacaac

SEQ ID NO: 3827793 - RNA, 22 nt, Shigella flexneri 2a str. 2457T
aaucaccacaggccugauaaga

SEQ ID NO: 3827794 - RNA, 11 nt, Shigella flexneri 2a str. 2457T
aaucaccagau

SEQ ID NO: 3827795 - RNA, 19 nt, Shigella flexneri 2a str. 2457T
aaucaccaggucaccagac

SEQ ID NO: 3827796 - RNA, 16 nt, Shigella flexneri 2a str. 2457T
aaucaccaucagcagc

SEQ ID NO: 3827797 - RNA, 17 nt, Shigella flexneri 2a str. 2457T
aaucaccaucagcagca

SEQ ID NO: 3827798 - RNA, 15 nt, Shigella flexneri 2a str. 2457T
aaucacccagcgaag

SEQ ID NO: 3827799 - RNA, 20 nt, Shigella flexneri 2a str. 2457T
aaucacccgugagaacugcu

SEQ ID NO: 3827800 - RNA, 16 nt, Shigella flexneri 2a str. 2457T
aaucaccgcaaacaua

SEQ ID NO: 3827801 - RNA, 17 nt, Shigella flexneri 2a str. 2457T
aaucaccgcaaacauaa

SEQ ID NO: 3827802 - RNA, 19 nt, Shigella flexneri 2a str. 2457T
aaucaccgccaccagcguc

SEQ ID NO: 3827803 - RNA, 21 nt, Shigella flexneri 2a str. 2457T
aaucaccgccacgcccuccug

SEQ ID NO: 3827804 - RNA, 15 nt, Shigella flexneri 2a str. 2457T
aaucaccgccagcaa

SEQ ID NO: 3827805 - RNA, 17 nt, Shigella flexneri 2a str. 2457T
aaucaccgccagcaagg

SEQ ID NO: 3827806 - RNA, 22 nt, Shigella flexneri 2a str. 2457T
aaucaccgcuucacucccugcc

SEQ ID NO: 3827807 - RNA, 17 nt, Shigella flexneri 2a str. 2457T
aaucaccucaucaccac

SEQ ID NO: 3827808 - RNA, 19 nt, Shigella flexneri 2a str. 2457T
aaucaccucaucaccacag

SEQ ID NO: 3827809 - RNA, 15 nt, Shigella flexneri 2a str. 2457T
aaucaccuuuaaccu

SEQ ID NO: 3827810 - RNA, 14 nt, Shigella flexneri 2a str. 2457T
aaucacgcaucacu

SEQ ID NO: 3827811 - RNA, 13 nt, Shigella flexneri 2a str. 2457T
aaucacucaucau

SEQ ID NO: 3827812 - RNA, 13 nt, Shigella flexneri 2a str. 2457T
aaucacugccaga

SEQ ID NO: 3827813 - RNA, 14 nt, Shigella flexneri 2a str. 2457T
aaucacugccagaa

SEQ ID NO: 3827814 - RNA, 15 nt, Shigella flexneri 2a str. 2457T
aaucacugccagaau

SEQ ID NO: 3827815 - RNA, 20 nt, Shigella flexneri 2a str. 2457T
aaucacuucuucuuguucau

SEQ ID NO: 3827816 - RNA, 14 nt, Shigella flexneri 2a str. 2457T
aaucagaauuuuuc

SEQ ID NO: 3827817 - RNA, 16 nt, Shigella flexneri 2a str. 2457T
aaucagauaaaauaca

SEQ ID NO: 3827818 - RNA, 23 nt, Shigella flexneri 2a str. 2457T
aaucagauaaaauacacuuuaau

SEQ ID NO: 3827819 - RNA, 22 nt, Shigella flexneri 2a str. 2457T
aaucagcaaggaaagccacugu

SEQ ID NO: 3827820 - RNA, 13 nt, Shigella flexneri 2a str. 2457T
aaucagcaauaaa

SEQ ID NO: 3827821 - RNA, 24 nt, Shigella flexneri 2a str. 2457T
aaucagcaauuuuuccugguucuc

SEQ ID NO: 3827822 - RNA, 14 nt, Shigella flexneri 2a str. 2457T
aaucagcacaauaa

SEQ ID NO: 3827823 - RNA, 20 nt, Shigella flexneri 2a str. 2457T
aaucagcaucucauccauca

SEQ ID NO: 3827824 - RNA, 11 nt, Shigella flexneri 2a str. 2457T
aaucagcgcca

SEQ ID NO: 3827825 - RNA, 15 nt, Shigella flexneri 2a str. 2457T
aaucagcgccagcgc

SEQ ID NO: 3827826 - RNA, 12 nt, Shigella flexneri 2a str. 2457T
aaucagcggcag

SEQ ID NO: 3827827 - RNA, 17 nt, Shigella flexneri 2a str. 2457T
aaucagcuuuggugaaa

SEQ ID NO: 3827828 - RNA, 21 nt, Shigella flexneri 2a str. 2457T
aaucaggaacuggaagcugcc

SEQ ID NO: 3827829 - RNA, 14 nt, Shigella flexneri 2a str. 2457T
aaucaggccgaggc

SEQ ID NO: 3827830 - RNA, 22 nt, Shigella flexneri 2a str. 2457T
aaucagguaagcgauaaaaaua

SEQ ID NO: 3827831 - RNA, 21 nt, Shigella flexneri 2a str. 2457T
aaucaguaaauugcagcacac

SEQ ID NO: 3827832 - RNA, 23 nt, Shigella flexneri 2a str. 2457T
aaucaguugauuaugaucgccac

SEQ ID NO: 3827833 - RNA, 18 nt, Shigella flexneri 2a str. 2457T
aaucaguugccgaauacc

SEQ ID NO: 3827834 - RNA, 22 nt, Shigella flexneri 2a str. 2457T
aaucauacaagcggaaacguaa

SEQ ID NO: 3827835 - RNA, 14 nt, Shigella flexneri 2a str. 2457T
aaucauauuaaauu

SEQ ID NO: 3827836 - RNA, 15 nt, Shigella flexneri 2a str. 2457T
aaucaucaaugccag

SEQ ID NO: 3827837 - RNA, 15 nt, Shigella flexneri 2a str. 2457T
aaucaucacgccaau

SEQ ID NO: 3827838 - RNA, 22 nt, Shigella flexneri 2a str. 2457T
aaucaucacgcgguuacgcacc

SEQ ID NO: 3827839 - RNA, 13 nt, Shigella flexneri 2a str. 2457T
aaucaucaucagu

SEQ ID NO: 3827840 - RNA, 23 nt, Shigella flexneri 2a str. 2457T
aaucaucauugcuguuuuacagc

SEQ ID NO: 3827841 - RNA, 19 nt, Shigella flexneri 2a str. 2457T
aaucaucccacaugaauuc

SEQ ID NO: 3827842 - RNA, 12 nt, Shigella flexneri 2a str. 2457T
aaucauccgcuc

SEQ ID NO: 3827843 - RNA, 13 nt, Shigella flexneri 2a str. 2457T
aaucaucgccuua

SEQ ID NO: 3827844 - RNA, 21 nt, Shigella flexneri 2a str. 2457T
aaucaucgcggcacacagcac

SEQ ID NO: 3827845 - RNA, 16 nt, Shigella flexneri 2a str. 2457T
aaucaucgcguacuca

SEQ ID NO: 3827846 - RNA, 17 nt, Shigella flexneri 2a str. 2457T
aaucaucuuaauggcga

SEQ ID NO: 3827847 - RNA, 17 nt, Shigella flexneri 2a str. 2457T
aaucaugccaaaaauaa

SEQ ID NO: 3827848 - RNA, 17 nt, Shigella flexneri 2a str. 2457T
aaucauuacaguuucgg

SEQ ID NO: 3827849 - RNA, 17 nt, Shigella flexneri 2a str. 2457T
aaucauucccauuuauu

SEQ ID NO: 3827850 - RNA, 17 nt, Shigella flexneri 2a str. 2457T
aaucauucgcaguugca

SEQ ID NO: 3827851 - RNA, 23 nt, Shigella flexneri 2a str. 2457T
aaucauucgccgguuccagcuuc

SEQ ID NO: 3827852 - RNA, 15 nt, Shigella flexneri 2a str. 2457T
aauccaaacauggca

SEQ ID NO: 3827853 - RNA, 14 nt, Shigella flexneri 2a str. 2457T
aauccacgguuuau

SEQ ID NO: 3827854 - RNA, 16 nt, Shigella flexneri 2a str. 2457T
aauccacguuccagau

SEQ ID NO: 3827855 - RNA, 12 nt, Shigella flexneri 2a str. 2457T
aauccagaacac

SEQ ID NO: 3827856 - RNA, 13 nt, Shigella flexneri 2a str. 2457T
aauccagaacacc

SEQ ID NO: 3827857 - RNA, 21 nt, Shigella flexneri 2a str. 2457T
aauccagauccugauccugca

SEQ ID NO: 3827858 - RNA, 11 nt, Shigella flexneri 2a str. 2457T
aauccagcaau

SEQ ID NO: 3827859 - RNA, 12 nt, Shigella flexneri 2a str. 2457T
aauccagcaaua

SEQ ID NO: 3827860 - RNA, 14 nt, Shigella flexneri 2a str. 2457T
aauccagcaauaau

SEQ ID NO: 3827861 - RNA, 21 nt, Shigella flexneri 2a str. 2457T
aauccagcgguugggcaucgg

SEQ ID NO: 3827862 - RNA, 21 nt, Shigella flexneri 2a str. 2457T
aauccagcucggcgcuaauca

SEQ ID NO: 3827863 - RNA, 22 nt, Shigella flexneri 2a str. 2457T
aauccaggcccgcauuaaaagu

SEQ ID NO: 3827864 - RNA, 15 nt, Shigella flexneri 2a str. 2457T
aauccaguacaugaa

SEQ ID NO: 3827865 - RNA, 20 nt, Shigella flexneri 2a str. 2457T
aauccaguguaaaacagcac

SEQ ID NO: 3827866 - RNA, 20 nt, Shigella flexneri 2a str. 2457T
aauccaucccgcucuguaag

SEQ ID NO: 3827867 - RNA, 14 nt, Shigella flexneri 2a str. 2457T
aaucccacauccua

SEQ ID NO: 3827868 - RNA, 13 nt, Shigella flexneri 2a str. 2457T
aaucccagacuua

SEQ ID NO: 3827869 - RNA, 20 nt, Shigella flexneri 2a str. 2457T
aaucccauccgcgcugaugc

SEQ ID NO: 3827870 - RNA, 20 nt, Shigella flexneri 2a str. 2457T
aaucccaucuucgaguaaaa

SEQ ID NO: 3827871 - RNA, 14 nt, Shigella flexneri 2a str. 2457T
aauccccgcgccaa

SEQ ID NO: 3827872 - RNA, 13 nt, Shigella flexneri 2a str. 2457T
aauccccggccuu

SEQ ID NO: 3827873 - RNA, 12 nt, Shigella flexneri 2a str. 2457T
aaucccgccaua

SEQ ID NO: 3827874 - RNA, 16 nt, Shigella flexneri 2a str. 2457T
aaucccgcgcaacaaa

SEQ ID NO: 3827875 - RNA, 21 nt, Shigella flexneri 2a str. 2457T
aaucccgcugcaaucuuuaac

SEQ ID NO: 3827876 - RNA, 14 nt, Shigella flexneri 2a str. 2457T
aaucccggcaccaa

SEQ ID NO: 3827877 - RNA, 19 nt, Shigella flexneri 2a str. 2457T
aaucccugcgaacugcgca

SEQ ID NO: 3827878 - RNA, 16 nt, Shigella flexneri 2a str. 2457T
aaucccuggauuugcc

SEQ ID NO: 3827879 - RNA, 19 nt, Shigella flexneri 2a str. 2457T
aaucccuuucucuucaaac

SEQ ID NO: 3827880 - RNA, 22 nt, Shigella flexneri 2a str. 2457T
aauccgagaaucguacucacca

SEQ ID NO: 3827881 - RNA, 19 nt, Shigella flexneri 2a str. 2457T
aauccgccagaaaucagcu

SEQ ID NO: 3827882 - RNA, 20 nt, Shigella flexneri 2a str. 2457T
aauccgcgacuggcaugccg

SEQ ID NO: 3827883 - RNA, 13 nt, Shigella flexneri 2a str. 2457T
aauccggaagaau

SEQ ID NO: 3827884 - RNA, 15 nt, Shigella flexneri 2a str. 2457T
aauccggcagcgaac

SEQ ID NO: 3827885 - RNA, 21 nt, Shigella flexneri 2a str. 2457T
aauccggugccauagacugga

SEQ ID NO: 3827886 - RNA, 19 nt, Shigella flexneri 2a str. 2457T
aauccguaauauucgccuc

SEQ ID NO: 3827887 - RNA, 23 nt, Shigella flexneri 2a str. 2457T
aauccucaacaaaauagaauccg

SEQ ID NO: 3827888 - RNA, 23 nt, Shigella flexneri 2a str. 2457T
aauccucuuugcuuccugaguaa

SEQ ID NO: 3827889 - RNA, 17 nt, Shigella flexneri 2a str. 2457T
aaugagauauuucagag

SEQ ID NO: 3827890 - RNA, 19 nt, Shigella flexneri 2a str. 2457T
aaugagccggaccucuuuc

SEQ ID NO: 3827891 - RNA, 15 nt, Shigella flexneri 2a str. 2457T
aaugaggcagcaagg

SEQ ID NO: 3827892 - RNA, 13 nt, Shigella flexneri 2a str. 2457T
aaugaguauuacu

SEQ ID NO: 3827893 - RNA, 15 nt, Shigella flexneri 2a str. 2457T
aaugaguuauacaga

SEQ ID NO: 3827894 - RNA, 15 nt, Shigella flexneri 2a str. 2457T
aaugauagccaggcg

SEQ ID NO: 3827895 - RNA, 15 nt, Shigella flexneri 2a str. 2457T
aaugauauuuucugc

SEQ ID NO: 3827896 - RNA, 13 nt, Shigella flexneri 2a str. 2457T
aaugaucagugga

SEQ ID NO: 3827897 - RNA, 22 nt, Shigella flexneri 2a str. 2457T
aaugaucggauaucuccuauug

SEQ ID NO: 3827898 - RNA, 23 nt, Shigella flexneri 2a str. 2457T
aaugaugccgccagaaauggaga

SEQ ID NO: 3827899 - RNA, 15 nt, Shigella flexneri 2a str. 2457T
aaugaugcggcgcuu

SEQ ID NO: 3827900 - RNA, 21 nt, Shigella flexneri 2a str. 2457T
aaugaugcggcgcuuucagca

SEQ ID NO: 3827901 - RNA, 16 nt, Shigella flexneri 2a str. 2457T
aaugauguaaaaauac

SEQ ID NO: 3827902 - RNA, 17 nt, Shigella flexneri 2a str. 2457T
aaugauuuaaaaccacu

SEQ ID NO: 3827903 - RNA, 16 nt, Shigella flexneri 2a str. 2457T
aaugauuuacggaaau

SEQ ID NO: 3827904 - RNA, 22 nt, Shigella flexneri 2a str. 2457T
aaugauuuccugcgugacuaaa

SEQ ID NO: 3827905 - RNA, 20 nt, Shigella flexneri 2a str. 2457T
aaugauuuugauggaagaaa

SEQ ID NO: 3827906 - RNA, 20 nt, Shigella flexneri 2a str. 2457T
aaugcaaucaaaaauggcuu

SEQ ID NO: 3827907 - RNA, 14 nt, Shigella flexneri 2a str. 2457T
aaugcacauauucu

SEQ ID NO: 3827908 - RNA, 17 nt, Shigella flexneri 2a str. 2457T
aaugcaccaacaaauag

SEQ ID NO: 3827909 - RNA, 18 nt, Shigella flexneri 2a str. 2457T
aaugcacuuccagcggcc

SEQ ID NO: 3827910 - RNA, 14 nt, Shigella flexneri 2a str. 2457T
aaugcaggcaccug

SEQ ID NO: 3827911 - RNA, 22 nt, Shigella flexneri 2a str. 2457T
aaugcaggggcguccagaugcg

SEQ ID NO: 3827912 - RNA, 23 nt, Shigella flexneri 2a str. 2457T
aaugcagucgcguagguaaucau

SEQ ID NO: 3827913 - RNA, 23 nt, Shigella flexneri 2a str. 2457T
aaugcaguuccauaugaauuccu

SEQ ID NO: 3827914 - RNA, 22 nt, Shigella flexneri 2a str. 2457T
aaugcaucagugacaaauuccg

SEQ ID NO: 3827915 - RNA, 22 nt, Shigella flexneri 2a str. 2457T
aaugcaucgcgaccaaucacac

SEQ ID NO: 3827916 - RNA, 17 nt, Shigella flexneri 2a str. 2457T
aaugcauuaucagagau

SEQ ID NO: 3827917 - RNA, 19 nt, Shigella flexneri 2a str. 2457T
aaugccaaauauuucuuua

SEQ ID NO: 3827918 - RNA, 21 nt, Shigella flexneri 2a str. 2457T
aaugccaaauauuucuuuauc

SEQ ID NO: 3827919 - RNA, 22 nt, Shigella flexneri 2a str. 2457T
aaugccaaucuucacaucauca

SEQ ID NO: 3827920 - RNA, 23 nt, Shigella flexneri 2a str. 2457T
aaugccacaaacgccgugcacac

SEQ ID NO: 3827921 - RNA, 19 nt, Shigella flexneri 2a str. 2457T
aaugccacauuagauaaaa

SEQ ID NO: 3827922 - RNA, 17 nt, Shigella flexneri 2a str. 2457T
aaugccaccagggauaa

SEQ ID NO: 3827923 - RNA, 17 nt, Shigella flexneri 2a str. 2457T
aaugccacugaauaaag

SEQ ID NO: 3827924 - RNA, 13 nt, Shigella flexneri 2a str. 2457T
aaugccagauaag

SEQ ID NO: 3827925 - RNA, 16 nt, Shigella flexneri 2a str. 2457T
aaugccagauaagaca

SEQ ID NO: 3827926 - RNA, 17 nt, Shigella flexneri 2a str. 2457T
aaugccagauaagacac

SEQ ID NO: 3827927 - RNA, 13 nt, Shigella flexneri 2a str. 2457T
aaugcccacgccg

SEQ ID NO: 3827928 - RNA, 17 nt, Shigella flexneri 2a str. 2457T
aaugcccacgccgcauu

SEQ ID NO: 3827929 - RNA, 16 nt, Shigella flexneri 2a str. 2457T
aaugcccagaaaccag

SEQ ID NO: 3827930 - RNA, 14 nt, Shigella flexneri 2a str. 2457T
aaugccgccgauac

SEQ ID NO: 3827931 - RNA, 18 nt, Shigella flexneri 2a str. 2457T
aaugccgguggugaccug

SEQ ID NO: 3827932 - RNA, 22 nt, Shigella flexneri 2a str. 2457T
aaugccgguuccugcaucgccu

SEQ ID NO: 3827933 - RNA, 13 nt, Shigella flexneri 2a str. 2457T
aaugccgucacca

SEQ ID NO: 3827934 - RNA, 16 nt, Shigella flexneri 2a str. 2457T
aaugccgucaccagca

SEQ ID NO: 3827935 - RNA, 17 nt, Shigella flexneri 2a str. 2457T
aaugccgucgaggaaca

SEQ ID NO: 3827936 - RNA, 16 nt, Shigella flexneri 2a str. 2457T
aaugccguucucuggc

SEQ ID NO: 3827937 - RNA, 18 nt, Shigella flexneri 2a str. 2457T
aaugccucagagcuaacu

SEQ ID NO: 3827938 - RNA, 23 nt, Shigella flexneri 2a str. 2457T
aaugccucgugcucagagcuaca

SEQ ID NO: 3827939 - RNA, 23 nt, Shigella flexneri 2a str. 2457T
aaugccugagacagacagccuca

SEQ ID NO: 3827940 - RNA, 11 nt, Shigella flexneri 2a str. 2457T
aaugccugaug

SEQ ID NO: 3827941 - RNA, 13 nt, Shigella flexneri 2a str. 2457T
aaugccuuauccg

SEQ ID NO: 3827942 - RNA, 22 nt, Shigella flexneri 2a str. 2457T
aaugccuucuggaaaucaggaa

SEQ ID NO: 3827943 - RNA, 15 nt, Shigella flexneri 2a str. 2457T
aaugccuuugaaauc

SEQ ID NO: 3827944 - RNA, 11 nt, Shigella flexneri 2a str. 2457T
aaugcgaaaac

SEQ ID NO: 3827945 - RNA, 14 nt, Shigella flexneri 2a str. 2457T
aaugcgaaaauccu

SEQ ID NO: 3827946 - RNA, 16 nt, Shigella flexneri 2a str. 2457T
aaugcgacaacagaaa

SEQ ID NO: 3827947 - RNA, 18 nt, Shigella flexneri 2a str. 2457T
aaugcgacaacagaaaua

SEQ ID NO: 3827948 - RNA, 20 nt, Shigella flexneri 2a str. 2457T
aaugcgauccugagccaguu

SEQ ID NO: 3827949 - RNA, 16 nt, Shigella flexneri 2a str. 2457T
aaugcgauggcaaaag

SEQ ID NO: 3827950 - RNA, 14 nt, Shigella flexneri 2a str. 2457T
aaugcgcaguugca

SEQ ID NO: 3827951 - RNA, 17 nt, Shigella flexneri 2a str. 2457T
aaugcgcaucaaagcca

SEQ ID NO: 3827952 - RNA, 20 nt, Shigella flexneri 2a str. 2457T
aaugcgcccagcgucagcau

SEQ ID NO: 3827953 - RNA, 18 nt, Shigella flexneri 2a str. 2457T
aaugcgccgaaaucgcau

SEQ ID NO: 3827954 - RNA, 13 nt, Shigella flexneri 2a str. 2457T
aaugcgcgagcca

SEQ ID NO: 3827955 - RNA, 17 nt, Shigella flexneri 2a str. 2457T
aaugcgcggucagaaaa

SEQ ID NO: 3827956 - RNA, 18 nt, Shigella flexneri 2a str. 2457T
aaugcgcggucagaaaau

SEQ ID NO: 3827957 - RNA, 17 nt, Shigella flexneri 2a str. 2457T
aaugcgcguaauuugcg

SEQ ID NO: 3827958 - RNA, 14 nt, Shigella flexneri 2a str. 2457T
aaugcgcucagggu

SEQ ID NO: 3827959 - RNA, 20 nt, Shigella flexneri 2a str. 2457T
aaugcgcuccucgccguuaa

SEQ ID NO: 3827960 - RNA, 19 nt, Shigella flexneri 2a str. 2457T
aaugcggagguuucuuuuu

SEQ ID NO: 3827961 - RNA, 23 nt, Shigella flexneri 2a str. 2457T
aaugcggccuuuuuauuuauuca

SEQ ID NO: 3827962 - RNA, 16 nt, Shigella flexneri 2a str. 2457T
aaugcgggugcaauca

SEQ ID NO: 3827963 - RNA, 20 nt, Shigella flexneri 2a str. 2457T
aaugcucugcacguuuugcu

SEQ ID NO: 3827964 - RNA, 15 nt, Shigella flexneri 2a str. 2457T
aaugcuggaucacuu

SEQ ID NO: 3827965 - RNA, 22 nt, Shigella flexneri 2a str. 2457T
aaugcugguuuugugcgccaca

SEQ ID NO: 3827966 - RNA, 19 nt, Shigella flexneri 2a str. 2457T
aaugcuguaaccagcgcag

SEQ ID NO: 3827967 - RNA, 19 nt, Shigella flexneri 2a str. 2457T
aaugcuguuccagaccaua

SEQ ID NO: 3827968 - RNA, 19 nt, Shigella flexneri 2a str. 2457T
aaugcuuuuuccugcguca

SEQ ID NO: 3827969 - RNA, 12 nt, Shigella flexneri 2a str. 2457T
aauggaaaacug

SEQ ID NO: 3827970 - RNA, 16 nt, Shigella flexneri 2a str. 2457T
aauggaaacagcacca

SEQ ID NO: 3827971 - RNA, 17 nt, Shigella flexneri 2a str. 2457T
aauggaaacagcaccau

SEQ ID NO: 3827972 - RNA, 13 nt, Shigella flexneri 2a str. 2457T
aauggaaauuguu

SEQ ID NO: 3827973 - RNA, 20 nt, Shigella flexneri 2a str. 2457T
aauggaaucgcucucagaga

SEQ ID NO: 3827974 - RNA, 17 nt, Shigella flexneri 2a str. 2457T
aauggcacaaauggcaa

SEQ ID NO: 3827975 - RNA, 14 nt, Shigella flexneri 2a str. 2457T
aauggcagauaauc

SEQ ID NO: 3827976 - RNA, 17 nt, Shigella flexneri 2a str. 2457T
aauggcaggcucagacu

SEQ ID NO: 3827977 - RNA, 17 nt, Shigella flexneri 2a str. 2457T
aauggcaucugauaagc

SEQ ID NO: 3827978 - RNA, 20 nt, Shigella flexneri 2a str. 2457T
aauggcaucugauaagccca

SEQ ID NO: 3827979 - RNA, 12 nt, Shigella flexneri 2a str. 2457T
aauggcaugcuc

SEQ ID NO: 3827980 - RNA, 17 nt, Shigella flexneri 2a str. 2457T
aauggcccaaaaggcag

SEQ ID NO: 3827981 - RNA, 23 nt, Shigella flexneri 2a str. 2457T
aauggccggaacgcuuucuuugg

SEQ ID NO: 3827982 - RNA, 19 nt, Shigella flexneri 2a str. 2457T
aauggccgucgccacaacc

SEQ ID NO: 3827983 - RNA, 13 nt, Shigella flexneri 2a str. 2457T
aauggccugcgcg

SEQ ID NO: 3827984 - RNA, 19 nt, Shigella flexneri 2a str. 2457T
aauggcgacauaaaauaac

SEQ ID NO: 3827985 - RNA, 17 nt, Shigella flexneri 2a str. 2457T
aauggcgcgaaaacaac

SEQ ID NO: 3827986 - RNA, 23 nt, Shigella flexneri 2a str. 2457T
aauugagaaccacaaugaagaaa

SEQ ID NO: 3827987 - RNA, 22 nt, Shigella flexneri 2a str. 2457T
aauugaggcccggcguauauug

SEQ ID NO: 3827988 - RNA, 23 nt, Shigella flexneri 2a str. 2457T
aauugauccgcgauaagucuuug

SEQ ID NO: 3827989 - RNA, 16 nt, Shigella flexneri 2a str. 2457T
aauugauggaaaauug

SEQ ID NO: 3827990 - RNA, 17 nt, Shigella flexneri 2a str. 2457T
aauugaugugaaaacuc

SEQ ID NO: 3827991 - RNA, 19 nt, Shigella flexneri 2a str. 2457T
aauugauucacauccggcc

SEQ ID NO: 3827992 - RNA, 23 nt, Shigella flexneri 2a str. 2457T
aauugcaccauccauuuuucacg

SEQ ID NO: 3827993 - RNA, 13 nt, Shigella flexneri 2a str. 2457T
aauugcagcagcu

SEQ ID NO: 3827994 - RNA, 19 nt, Shigella flexneri 2a str. 2457T
aauugcauauuucaacgac

SEQ ID NO: 3827995 - RNA, 18 nt, Shigella flexneri 2a str. 2457T
aauugccaccaugcaaaa

SEQ ID NO: 3827996 - RNA, 14 nt, Shigella flexneri 2a str. 2457T
aauugccagacaac

SEQ ID NO: 3827997 - RNA, 21 nt, Shigella flexneri 2a str. 2457T
aauugccauuucuggcgucaa

SEQ ID NO: 3827998 - RNA, 18 nt, Shigella flexneri 2a str. 2457T
aauugcccgaagccaauu

SEQ ID NO: 3827999 - RNA, 18 nt, Shigella flexneri 2a str. 2457T
aauugccugauggccugc

SEQ ID NO: 3828000 - RNA, 15 nt, Shigella flexneri 2a str. 2457T
aauugcgaacugugc

SEQ ID NO: 3828001 - RNA, 23 nt, Shigella flexneri 2a str. 2457T
aauugcgagccuguaccacaacc

SEQ ID NO: 3828002 - RNA, 19 nt, Shigella flexneri 2a str. 2457T
aauugcgcgacuuuuuccu

SEQ ID NO: 3828003 - RNA, 20 nt, Shigella flexneri 2a str. 2457T
aauugcgggccaaagaccag

SEQ ID NO: 3828004 - RNA, 19 nt, Shigella flexneri 2a str. 2457T
aauugcgguuuucucuugu

SEQ ID NO: 3828005 - RNA, 14 nt, Shigella flexneri 2a str. 2457T
aauugcgucaguau

SEQ ID NO: 3828006 - RNA, 22 nt, Shigella flexneri 2a str. 2457T
aauugcucaguacaggccgcac

SEQ ID NO: 3828007 - RNA, 17 nt, Shigella flexneri 2a str. 2457T
aauugcucccugaauaa

SEQ ID NO: 3828008 - RNA, 23 nt, Shigella flexneri 2a str. 2457T
aauugcugguuuuguaggccgga

SEQ ID NO: 3828009 - RNA, 16 nt, Shigella flexneri 2a str. 2457T
aauuggaauacauaua

SEQ ID NO: 3828010 - RNA, 18 nt, Shigella flexneri 2a str. 2457T
aauugguagaccagagcu

SEQ ID NO: 3828011 - RNA, 23 nt, Shigella flexneri 2a str. 2457T
aauugguauucugggaacuauau

SEQ ID NO: 3828012 - RNA, 20 nt, Shigella flexneri 2a str. 2457T
aauugguugccggauauucc

SEQ ID NO: 3828013 - RNA, 12 nt, Shigella flexneri 2a str. 2457T
aauuguaaaucu

SEQ ID NO: 3828014 - RNA, 20 nt, Shigella flexneri 2a str. 2457T
aauugugagaagcgguuaaa

SEQ ID NO: 3828015 - RNA, 22 nt, Shigella flexneri 2a str. 2457T
aauuguuccgucagccgcccgc

SEQ ID NO: 3828016 - RNA, 14 nt, Shigella flexneri 2a str. 2457T
aauuguucgacagu

SEQ ID NO: 3828017 - RNA, 12 nt, Shigella flexneri 2a str. 2457T
aauuguuuuaua

SEQ ID NO: 3828018 - RNA, 16 nt, Shigella flexneri 2a str. 2457T
aauuuacgcuuuucuu

SEQ ID NO: 3828019 - RNA, 17 nt, Shigella flexneri 2a str. 2457T
aauuuagugaccaauca

SEQ ID NO: 3828020 - RNA, 12 nt, Shigella flexneri 2a str. 2457T
aauuucacacca

SEQ ID NO: 3828021 - RNA, 19 nt, Shigella flexneri 2a str. 2457T
aauuucacaccaucaacaa

SEQ ID NO: 3828022 - RNA, 21 nt, Shigella flexneri 2a str. 2457T
aauuucacaguaaugauuuaa

SEQ ID NO: 3828023 - RNA, 17 nt, Shigella flexneri 2a str. 2457T
aauuucagcgccugaua

SEQ ID NO: 3828024 - RNA, 19 nt, Shigella flexneri 2a str. 2457T
aauuucagguucugaccgg

SEQ ID NO: 3828025 - RNA, 23 nt, Shigella flexneri 2a str. 2457T
aauuucaucaucacgaaauccca

SEQ ID NO: 3828026 - RNA, 21 nt, Shigella flexneri 2a str. 2457T
aauuucaucgcuacaccaauc

SEQ ID NO: 3828027 - RNA, 14 nt, Shigella flexneri 2a str. 2457T
aauuucauuuugau

SEQ ID NO: 3828028 - RNA, 17 nt, Shigella flexneri 2a str. 2457T
aauuuccagaaagugag

SEQ ID NO: 3828029 - RNA, 13 nt, Shigella flexneri 2a str. 2457T
aauuuccauugcu

SEQ ID NO: 3828030 - RNA, 14 nt, Shigella flexneri 2a str. 2457T
aauuuccgucgcau

SEQ ID NO: 3828031 - RNA, 17 nt, Shigella flexneri 2a str. 2457T
aauuucggcagcgcgcu

SEQ ID NO: 3828032 - RNA, 18 nt, Shigella flexneri 2a str. 2457T
aauuucguuaagcucaga

SEQ ID NO: 3828033 - RNA, 18 nt, Shigella flexneri 2a str. 2457T
aauuucuccgccggaauc

SEQ ID NO: 3828034 - RNA, 22 nt, Shigella flexneri 2a str. 2457T
aauuucucgcccagaucaccaa

SEQ ID NO: 3828035 - RNA, 16 nt, Shigella flexneri 2a str. 2457T
aauuucugcaaaauag

SEQ ID NO: 3828036 - RNA, 21 nt, Shigella flexneri 2a str. 2457T
aauuucugugcagccaaaaau

SEQ ID NO: 3828037 - RNA, 19 nt, Shigella flexneri 2a str. 2457T
aauuucuucugguuucagu

SEQ ID NO: 3828038 - RNA, 17 nt, Shigella flexneri 2a str. 2457T
aauuugcaggucauggu

SEQ ID NO: 3828039 - RNA, 19 nt, Shigella flexneri 2a str. 2457T
aauuugccaucucugcaac

SEQ ID NO: 3828040 - RNA, 15 nt, Shigella flexneri 2a str. 2457T
aauuuggggccgucc

SEQ ID NO: 3828041 - RNA, 17 nt, Shigella flexneri 2a str. 2457T
aauuugguccugaggau

SEQ ID NO: 3828042 - RNA, 12 nt, Shigella flexneri 2a str. 2457T
aauuuguaacug

SEQ ID NO: 3828043 - RNA, 14 nt, Shigella flexneri 2a str. 2457T
aauuuguaacuguc

SEQ ID NO: 3828044 - RNA, 18 nt, Shigella flexneri 2a str. 2457T
aauuuguaggcuaaaaac

SEQ ID NO: 3828045 - RNA, 22 nt, Shigella flexneri 2a str. 2457T
aauuuuaaauaucaucaaaauu

SEQ ID NO: 3828046 - RNA, 12 nt, Shigella flexneri 2a str. 2457T
aauuuuacagcc

SEQ ID NO: 3828047 - RNA, 20 nt, Shigella flexneri 2a str. 2457T
aauuuuaccuagcacuguaa

SEQ ID NO: 3828048 - RNA, 12 nt, Shigella flexneri 2a str. 2457T
aauuuuaggaug

SEQ ID NO: 3828049 - RNA, 17 nt, Shigella flexneri 2a str. 2457T
aauuuuaggaugcugca

SEQ ID NO: 3828050 - RNA, 12 nt, Shigella flexneri 2a str. 2457T
aauuuuauguuu

SEQ ID NO: 3828051 - RNA, 18 nt, Shigella flexneri 2a str. 2457T
aauuuuauguuucgcauc

SEQ ID NO: 3828052 - RNA, 20 nt, Shigella flexneri 2a str. 2457T
aauuuuccuugaaaaagagg

SEQ ID NO: 3828053 - RNA, 13 nt, Shigella flexneri 2a str. 2457T
aauuuucucuuuc

SEQ ID NO: 3828054 - RNA, 21 nt, Shigella flexneri 2a str. 2457T
aauuuucuuaucaguuucagc

SEQ ID NO: 3828055 - RNA, 19 nt, Shigella flexneri 2a str. 2457T
aauuuugcauucacccggg

SEQ ID NO: 3828056 - RNA, 14 nt, Shigella flexneri 2a str. 2457T
aauuuugugcagca

SEQ ID NO: 3828057 - RNA, 21 nt, Shigella flexneri 2a str. 2457T
aauuuuuccagcauuucuucc

SEQ ID NO: 3828058 - RNA, 22 nt, Shigella flexneri 2a str. 2457T
aauuuuucguuuaugaucauca

SEQ ID NO: 3828059 - RNA, 12 nt, Shigella flexneri 2a str. 2457T
aauuuuuucgcc

SEQ ID NO: 3828060 - RNA, 22 nt, Shigella flexneri 2a str. 2457T
acaaaaaaaacagcgcccaaca

SEQ ID NO: 3828061 - RNA, 22 nt, Shigella flexneri 2a str. 2457T
acaaaaaagccaaucacaaaaa

SEQ ID NO: 3828062 - RNA, 13 nt, Shigella flexneri 2a str. 2457T
acaaaaacucaua

SEQ ID NO: 3828063 - RNA, 15 nt, Shigella flexneri 2a str. 2457T
acaaaaacucauaaa

SEQ ID NO: 3828064 - RNA, 16 nt, Shigella flexneri 2a str. 2457T
acaaaaauaccaccaa

SEQ ID NO: 3828065 - RNA, 21 nt, Shigella flexneri 2a str. 2457T
acaaaacagcgaguucaggcg

SEQ ID NO: 3828066 - RNA, 12 nt, Shigella flexneri 2a str. 2457T
acaaaaccugcc

SEQ ID NO: 3828067 - RNA, 12 nt, Shigella flexneri 2a str. 2457T
acaaaaccugcu

SEQ ID NO: 3828068 - RNA, 21 nt, Shigella flexneri 2a str. 2457T
acaaaagaauggcuguagggu

SEQ ID NO: 3828069 - RNA, 16 nt, Shigella flexneri 2a str. 2457T
acaaaagcgaagcgaa

SEQ ID NO: 3828070 - RNA, 17 nt, Shigella flexneri 2a str. 2457T
acaaaagcggugauaaa

SEQ ID NO: 3828071 - RNA, 15 nt, Shigella flexneri 2a str. 2457T
acaaaauaaccuaua

SEQ ID NO: 3828072 - RNA, 14 nt, Shigella flexneri 2a str. 2457T
acaaaauccugcca

SEQ ID NO: 3828073 - RNA, 21 nt, Shigella flexneri 2a str. 2457T
acaaaauccugccagcgugag

SEQ ID NO: 3828074 - RNA, 22 nt, Shigella flexneri 2a str. 2457T
acaaaaucgugaaaaaucaaua

SEQ ID NO: 3828075 - RNA, 16 nt, Shigella flexneri 2a str. 2457T
acaaaauuuucagcgu

SEQ ID NO: 3828076 - RNA, 13 nt, Shigella flexneri 2a str. 2457T
acaaacacaauau

SEQ ID NO: 3828077 - RNA, 22 nt, Shigella flexneri 2a str. 2457T
acaaacagcucgacaccaaaca

SEQ ID NO: 3828078 - RNA, 14 nt, Shigella flexneri 2a str. 2457T
acaaacaggaaguu

SEQ ID NO: 3828079 - RNA, 13 nt, Shigella flexneri 2a str. 2457T
acaaacaucaucc

SEQ ID NO: 3828080 - RNA, 20 nt, Shigella flexneri 2a str. 2457T
acaaacaucauccagugccg

SEQ ID NO: 3828081 - RNA, 18 nt, Shigella flexneri 2a str. 2457T
acaaaccauaagguggga

SEQ ID NO: 3828082 - RNA, 22 nt, Shigella flexneri 2a str. 2457T
acaaaccgaguuaguccacacg

SEQ ID NO: 3828083 - RNA, 13 nt, Shigella flexneri 2a str. 2457T
acaaucaaauccu

SEQ ID NO: 3828084 - RNA, 18 nt, Shigella flexneri 2a str. 2457T
acaaucacgauagccaga

SEQ ID NO: 3828085 - RNA, 13 nt, Shigella flexneri 2a str. 2457T
acaaucagccaga

SEQ ID NO: 3828086 - RNA, 23 nt, Shigella flexneri 2a str. 2457T
acaaucagccagaacagcggugc

SEQ ID NO: 3828087 - RNA, 21 nt, Shigella flexneri 2a str. 2457T
acaaucccgcuuacaucaacu

SEQ ID NO: 3828088 - RNA, 20 nt, Shigella flexneri 2a str. 2457T
acaaucccugcauaucggua

SEQ ID NO: 3828089 - RNA, 16 nt, Shigella flexneri 2a str. 2457T
acaauccgcucuuuca

SEQ ID NO: 3828090 - RNA, 18 nt, Shigella flexneri 2a str. 2457T
acaauccgguagguucaa

SEQ ID NO: 3828091 - RNA, 23 nt, Shigella flexneri 2a str. 2457T
acaaucgcuucaucgcccacauc

SEQ ID NO: 3828092 - RNA, 23 nt, Shigella flexneri 2a str. 2457T
acaaucgggaaaaucugcgggaa

SEQ ID NO: 3828093 - RNA, 18 nt, Shigella flexneri 2a str. 2457T
acaaucguugccugaugc

SEQ ID NO: 3828094 - RNA, 17 nt, Shigella flexneri 2a str. 2457T
acaaucguuucaugcca

SEQ ID NO: 3828095 - RNA, 18 nt, Shigella flexneri 2a str. 2457T
acaaucucaauuuucacu

SEQ ID NO: 3828096 - RNA, 14 nt, Shigella flexneri 2a str. 2457T
acaaucucacccgc

SEQ ID NO: 3828097 - RNA, 19 nt, Shigella flexneri 2a str. 2457T
acaaucucacccgcuucau

SEQ ID NO: 3828098 - RNA, 16 nt, Shigella flexneri 2a str. 2457T
acaaucugcgcuggaa

SEQ ID NO: 3828099 - RNA, 14 nt, Shigella flexneri 2a str. 2457T
acaaugaagaaagu

SEQ ID NO: 3828100 - RNA, 14 nt, Shigella flexneri 2a str. 2457T
acaaugagauauuu

SEQ ID NO: 3828101 - RNA, 18 nt, Shigella flexneri 2a str. 2457T
acaaugcgacaaacagga

SEQ ID NO: 3828102 - RNA, 22 nt, Shigella flexneri 2a str. 2457T
acaaugcggugugcggguuuuc

SEQ ID NO: 3828103 - RNA, 17 nt, Shigella flexneri 2a str. 2457T
acaaugcuguaaccagc

SEQ ID NO: 3828104 - RNA, 20 nt, Shigella flexneri 2a str. 2457T
acaauggagcuaaacagcgc

SEQ ID NO: 3828105 - RNA, 21 nt, Shigella flexneri 2a str. 2457T
acaauggcauuuaucuucugg

SEQ ID NO: 3828106 - RNA, 16 nt, Shigella flexneri 2a str. 2457T
acaauggcggugaucc

SEQ ID NO: 3828107 - RNA, 21 nt, Shigella flexneri 2a str. 2457T
acaauggcggugaucccaaua

SEQ ID NO: 3828108 - RNA, 20 nt, Shigella flexneri 2a str. 2457T
acaauggucaacauucccug

SEQ ID NO: 3828109 - RNA, 21 nt, Shigella flexneri 2a str. 2457T
acaauggucaacauucccugc

SEQ ID NO: 3828110 - RNA, 22 nt, Shigella flexneri 2a str. 2457T
acaaugucauggcagucuuaau

SEQ ID NO: 3828111 - RNA, 16 nt, Shigella flexneri 2a str. 2457T
acaauguuucugcaau

SEQ ID NO: 3828112 - RNA, 18 nt, Shigella flexneri 2a str. 2457T
acaauucccaguuacugc

SEQ ID NO: 3828113 - RNA, 22 nt, Shigella flexneri 2a str. 2457T
acaauucgcguaguaaagccuu

SEQ ID NO: 3828114 - RNA, 19 nt, Shigella flexneri 2a str. 2457T
acaauugaagaauaucuuc

SEQ ID NO: 3828115 - RNA, 20 nt, Shigella flexneri 2a str. 2457T
acaauugccccccauaacgc

SEQ ID NO: 3828116 - RNA, 19 nt, Shigella flexneri 2a str. 2457T
acaauugccgccagcucac

SEQ ID NO: 3828117 - RNA, 20 nt, Shigella flexneri 2a str. 2457T
acaauugcgggccaaagacc

SEQ ID NO: 3828118 - RNA, 15 nt, Shigella flexneri 2a str. 2457T
acaauugucgccaca

SEQ ID NO: 3828119 - RNA, 23 nt, Shigella flexneri 2a str. 2457T
acaauugucgccacaaacgccag

SEQ ID NO: 3828120 - RNA, 21 nt, Shigella flexneri 2a str. 2457T
acaauuuaccgacgcugcuca

SEQ ID NO: 3828121 - RNA, 18 nt, Shigella flexneri 2a str. 2457T
acaauuuacguuuuaaac

SEQ ID NO: 3828122 - RNA, 15 nt, Shigella flexneri 2a str. 2457T
acaauuucagcaaua

SEQ ID NO: 3828123 - RNA, 16 nt, Shigella flexneri 2a str. 2457T
acaauuucagcaauaa

SEQ ID NO: 3828124 - RNA, 17 nt, Shigella flexneri 2a str. 2457T
acacaacagacauuacc

SEQ ID NO: 3828125 - RNA, 14 nt, Shigella flexneri 2a str. 2457T
acacaacgcuuuca

SEQ ID NO: 3828126 - RNA, 21 nt, Shigella flexneri 2a str. 2457T
acacaagcguaagagaacaga

SEQ ID NO: 3828127 - RNA, 22 nt, Shigella flexneri 2a str. 2457T
acacaagguauccagacggcgc

SEQ ID NO: 3828128 - RNA, 19 nt, Shigella flexneri 2a str. 2457T
acacaauauugcggauaaa

SEQ ID NO: 3828129 - RNA, 14 nt, Shigella flexneri 2a str. 2457T
acacacauuuaucc

SEQ ID NO: 3828130 - RNA, 21 nt, Shigella flexneri 2a str. 2457T
acacacccggccuaucaacgu

SEQ ID NO: 3828131 - RNA, 15 nt, Shigella flexneri 2a str. 2457T
acacacuucauuuuc

SEQ ID NO: 3828132 - RNA, 20 nt, Shigella flexneri 2a str. 2457T
acacacuucauuuuccacaa

SEQ ID NO: 3828133 - RNA, 19 nt, Shigella flexneri 2a str. 2457T
acacacuuuuauuaacuca

SEQ ID NO: 3828134 - RNA, 19 nt, Shigella flexneri 2a str. 2457T
acacagauugauaaaaaua

SEQ ID NO: 3828135 - RNA, 21 nt, Shigella flexneri 2a str. 2457T
acacagauugauaaaaauagu

SEQ ID NO: 3828136 - RNA, 17 nt, Shigella flexneri 2a str. 2457T
acacagcgugcauagca

SEQ ID NO: 3828137 - RNA, 15 nt, Shigella flexneri 2a str. 2457T
acacaggcagcaauc

SEQ ID NO: 3828138 - RNA, 16 nt, Shigella flexneri 2a str. 2457T
acacagguaacuuaaa

SEQ ID NO: 3828139 - RNA, 20 nt, Shigella flexneri 2a str. 2457T
acacaguucuucaaaaauaa

SEQ ID NO: 3828140 - RNA, 19 nt, Shigella flexneri 2a str. 2457T
acacauaacgccaauucau

SEQ ID NO: 3828141 - RNA, 15 nt, Shigella flexneri 2a str. 2457T
acacauauauuaauu

SEQ ID NO: 3828142 - RNA, 14 nt, Shigella flexneri 2a str. 2457T
acacauuacgccag

SEQ ID NO: 3828143 - RNA, 16 nt, Shigella flexneri 2a str. 2457T
acacauuaucucaaca

SEQ ID NO: 3828144 - RNA, 20 nt, Shigella flexneri 2a str. 2457T
acacauugugaaugaucagc

SEQ ID NO: 3828145 - RNA, 13 nt, Shigella flexneri 2a str. 2457T
acaccaaacagac

SEQ ID NO: 3828146 - RNA, 13 nt, Shigella flexneri 2a str. 2457T
acaccaacaucac

SEQ ID NO: 3828147 - RNA, 15 nt, Shigella flexneri 2a str. 2457T
acaccaacaucacgc

SEQ ID NO: 3828148 - RNA, 14 nt, Shigella flexneri 2a str. 2457T
acaccaacgccccg

SEQ ID NO: 3828149 - RNA, 20 nt, Shigella flexneri 2a str. 2457T
acaccaccaauggcuggccu

SEQ ID NO: 3828150 - RNA, 17 nt, Shigella flexneri 2a str. 2457T
acaccaccuaacccgcu

SEQ ID NO: 3828151 - RNA, 14 nt, Shigella flexneri 2a str. 2457T
acaccaccugccag

SEQ ID NO: 3828152 - RNA, 17 nt, Shigella flexneri 2a str. 2457T
acaccacugcgcauaau

SEQ ID NO: 3828153 - RNA, 16 nt, Shigella flexneri 2a str. 2457T
acaccagaaugcccca

SEQ ID NO: 3828154 - RNA, 17 nt, Shigella flexneri 2a str. 2457T
acaccagcacaucauca

SEQ ID NO: 3828155 - RNA, 18 nt, Shigella flexneri 2a str. 2457T
acaccagcaguaaaccac

SEQ ID NO: 3828156 - RNA, 21 nt, Shigella flexneri 2a str. 2457T
acaccauaaaacaaauccgcu

SEQ ID NO: 3828157 - RNA, 22 nt, Shigella flexneri 2a str. 2457T
acaccauaacagaggccacccu

SEQ ID NO: 3828158 - RNA, 22 nt, Shigella flexneri 2a str. 2457T
acaccauaucuaugguuuuuuc

SEQ ID NO: 3828159 - RNA, 12 nt, Shigella flexneri 2a str. 2457T
acaccaucaaca

SEQ ID NO: 3828160 - RNA, 15 nt, Shigella flexneri 2a str. 2457T
acaccaugccgguga

SEQ ID NO: 3828161 - RNA, 20 nt, Shigella flexneri 2a str. 2457T
acaccauugauaauccauca

SEQ ID NO: 3828162 - RNA, 12 nt, Shigella flexneri 2a str. 2457T
acacccacauca

SEQ ID NO: 3828163 - RNA, 18 nt, Shigella flexneri 2a str. 2457T
acacccauggggaugcug

SEQ ID NO: 3828164 - RNA, 21 nt, Shigella flexneri 2a str. 2457T
acaccccgcgccgcugagaaa

SEQ ID NO: 3828165 - RNA, 15 nt, Shigella flexneri 2a str. 2457T
acaccccuucauuca

SEQ ID NO: 3828166 - RNA, 22 nt, Shigella flexneri 2a str. 2457T
acacccgacgugcagcaucgau

SEQ ID NO: 3828167 - RNA, 17 nt, Shigella flexneri 2a str. 2457T
acacccgguaucaaacc

SEQ ID NO: 3828168 - RNA, 20 nt, Shigella flexneri 2a str. 2457T
acacccgguaucaaacccuu

SEQ ID NO: 3828169 - RNA, 15 nt, Shigella flexneri 2a str. 2457T
acaccgauugccccu

SEQ ID NO: 3828170 - RNA, 16 nt, Shigella flexneri 2a str. 2457T
acaccgauugccccug

SEQ ID NO: 3828171 - RNA, 23 nt, Shigella flexneri 2a str. 2457T
acaccgauuuuguaaaagaaggc

SEQ ID NO: 3828172 - RNA, 22 nt, Shigella flexneri 2a str. 2457T
acaccgcagccgccacaauaaa

SEQ ID NO: 3828173 - RNA, 22 nt, Shigella flexneri 2a str. 2457T
acaccgcugacuuucaaacgcc

SEQ ID NO: 3828174 - RNA, 23 nt, Shigella flexneri 2a str. 2457T
acaccguccggcgggcaaauucu

SEQ ID NO: 3828175 - RNA, 16 nt, Shigella flexneri 2a str. 2457T
acaccgucgcaauacc

SEQ ID NO: 3828176 - RNA, 17 nt, Shigella flexneri 2a str. 2457T
acaccgugcauuucuca

SEQ ID NO: 3828177 - RNA, 17 nt, Shigella flexneri 2a str. 2457T
acaccugacgauguggu

SEQ ID NO: 3828178 - RNA, 19 nt, Shigella flexneri 2a str. 2457T
acaccugcauucgagccaa

SEQ ID NO: 3828179 - RNA, 22 nt, Shigella flexneri 2a str. 2457T
acaccugggcaauggugaacug

SEQ ID NO: 3828180 - RNA, 22 nt, Shigella flexneri 2a str. 2457T
acagcacgccccggcugccgga

SEQ ID NO: 3828181 - RNA, 19 nt, Shigella flexneri 2a str. 2457T
acagcacgcuuuucagugc

SEQ ID NO: 3828182 - RNA, 17 nt, Shigella flexneri 2a str. 2457T
acagcacggcagcaacg

SEQ ID NO: 3828183 - RNA, 16 nt, Shigella flexneri 2a str. 2457T
acagcagaacgaccag

SEQ ID NO: 3828184 - RNA, 18 nt, Shigella flexneri 2a str. 2457T
acagcagcccuugugccg

SEQ ID NO: 3828185 - RNA, 13 nt, Shigella flexneri 2a str. 2457T
acagcaguccagc

SEQ ID NO: 3828186 - RNA, 19 nt, Shigella flexneri 2a str. 2457T
acagcaguuguuuaauggc

SEQ ID NO: 3828187 - RNA, 21 nt, Shigella flexneri 2a str. 2457T
acagcaucaggcuaaucgcca

SEQ ID NO: 3828188 - RNA, 17 nt, Shigella flexneri 2a str. 2457T
acagcaucaucgcaaug

SEQ ID NO: 3828189 - RNA, 18 nt, Shigella flexneri 2a str. 2457T
acagcaucaucgcaauga

SEQ ID NO: 3828190 - RNA, 21 nt, Shigella flexneri 2a str. 2457T
acagcauggcuucuuccccgg

SEQ ID NO: 3828191 - RNA, 15 nt, Shigella flexneri 2a str. 2457T
acagccaaaucauca

SEQ ID NO: 3828192 - RNA, 18 nt, Shigella flexneri 2a str. 2457T
acagccaaaucaucagua

SEQ ID NO: 3828193 - RNA, 20 nt, Shigella flexneri 2a str. 2457T
acagccaaaucaucaguacc

SEQ ID NO: 3828194 - RNA, 14 nt, Shigella flexneri 2a str. 2457T
acagccaacacauu

SEQ ID NO: 3828195 - RNA, 13 nt, Shigella flexneri 2a str. 2457T
acagccaacugga

SEQ ID NO: 3828196 - RNA, 22 nt, Shigella flexneri 2a str. 2457T
acagccacacaccgcaaacugc

SEQ ID NO: 3828197 - RNA, 22 nt, Shigella flexneri 2a str. 2457T
acagccacagggugaucaccag

SEQ ID NO: 3828198 - RNA, 23 nt, Shigella flexneri 2a str. 2457T
acagccacagggugaucaccagu

SEQ ID NO: 3828199 - RNA, 18 nt, Shigella flexneri 2a str. 2457T
acagccagauuaaaagug

SEQ ID NO: 3828200 - RNA, 12 nt, Shigella flexneri 2a str. 2457T
acagccagccaa

SEQ ID NO: 3828201 - RNA, 12 nt, Shigella flexneri 2a str. 2457T
acagccagccag

SEQ ID NO: 3828202 - RNA, 18 nt, Shigella flexneri 2a str. 2457T
acagccauccgucaucca

SEQ ID NO: 3828203 - RNA, 17 nt, Shigella flexneri 2a str. 2457T
acagccgacaaugccac

SEQ ID NO: 3828204 - RNA, 19 nt, Shigella flexneri 2a str. 2457T
acagccggacccacacccc

SEQ ID NO: 3828205 - RNA, 20 nt, Shigella flexneri 2a str. 2457T
acagccugauacaggaaggc

SEQ ID NO: 3828206 - RNA, 18 nt, Shigella flexneri 2a str. 2457T
acagcgacagacgacgac

SEQ ID NO: 3828207 - RNA, 22 nt, Shigella flexneri 2a str. 2457T
acagcgacucucugagccagcu

SEQ ID NO: 3828208 - RNA, 19 nt, Shigella flexneri 2a str. 2457T
acagcgagggccguauuga

SEQ ID NO: 3828209 - RNA, 15 nt, Shigella flexneri 2a str. 2457T
acagcgauuccaguu

SEQ ID NO: 3828210 - RNA, 17 nt, Shigella flexneri 2a str. 2457T
acagcgcaccagaaaca

SEQ ID NO: 3828211 - RNA, 22 nt, Shigella flexneri 2a str. 2457T
acagcgcaccagaaacaauaag

SEQ ID NO: 3828212 - RNA, 15 nt, Shigella flexneri 2a str. 2457T
acagcgcauucggca

SEQ ID NO: 3828213 - RNA, 14 nt, Shigella flexneri 2a str. 2457T
acagcgccagaagg

SEQ ID NO: 3828214 - RNA, 23 nt, Shigella flexneri 2a str. 2457T
acagcgccagacaaaccacgccu

SEQ ID NO: 3828215 - RNA, 23 nt, Shigella flexneri 2a str. 2457T
acagcgccuguuuaccgcucacc

SEQ ID NO: 3828216 - RNA, 16 nt, Shigella flexneri 2a str. 2457T
acagcgccuuuucuuu

SEQ ID NO: 3828217 - RNA, 13 nt, Shigella flexneri 2a str. 2457T
acagcgcgccagc

SEQ ID NO: 3828218 - RNA, 15 nt, Shigella flexneri 2a str. 2457T
acagcgcgcugacau

SEQ ID NO: 3828219 - RNA, 19 nt, Shigella flexneri 2a str. 2457T
acagcggcauuacgcgccc

SEQ ID NO: 3828220 - RNA, 17 nt, Shigella flexneri 2a str. 2457T
acagcggccagccaucc

SEQ ID NO: 3828221 - RNA, 20 nt, Shigella flexneri 2a str. 2457T
acagcggccagccauccguc

SEQ ID NO: 3828222 - RNA, 20 nt, Shigella flexneri 2a str. 2457T
acagcggcgaauguuccauc

SEQ ID NO: 3828223 - RNA, 22 nt, Shigella flexneri 2a str. 2457T
acagcgggugcauuuucacuuc

SEQ ID NO: 3828224 - RNA, 23 nt, Shigella flexneri 2a str. 2457T
acagcggugauuuccgccgccag

SEQ ID NO: 3828225 - RNA, 14 nt, Shigella flexneri 2a str. 2457T
acagcguuucgcca

SEQ ID NO: 3828226 - RNA, 19 nt, Shigella flexneri 2a str. 2457T
acagcuaaucaucaucagu

SEQ ID NO: 3828227 - RNA, 22 nt, Shigella flexneri 2a str. 2457T
acagcucacggcccugugccug

SEQ ID NO: 3828228 - RNA, 22 nt, Shigella flexneri 2a str. 2457T
acagcucgguauggccuuucug

SEQ ID NO: 3828229 - RNA, 18 nt, Shigella flexneri 2a str. 2457T
acagcucuugcuccacaa

SEQ ID NO: 3828230 - RNA, 21 nt, Shigella flexneri 2a str. 2457T
acagcuggaguacggccuugg

SEQ ID NO: 3828231 - RNA, 18 nt, Shigella flexneri 2a str. 2457T
acagcuggaguagauaau

SEQ ID NO: 3828232 - RNA, 11 nt, Shigella flexneri 2a str. 2457T
acagcugggcg

SEQ ID NO: 3828233 - RNA, 19 nt, Shigella flexneri 2a str. 2457T
acagcuuaaucaccagcgc

SEQ ID NO: 3828234 - RNA, 15 nt, Shigella flexneri 2a str. 2457T
acagcuuagacagcg

SEQ ID NO: 3828235 - RNA, 15 nt, Shigella flexneri 2a str. 2457T
acagcuuagcgccuu

SEQ ID NO: 3828236 - RNA, 17 nt, Shigella flexneri 2a str. 2457T
acagcuuuuacagccaa

SEQ ID NO: 3828237 - RNA, 20 nt, Shigella flexneri 2a str. 2457T
acagcuuuuacagccaaugc

SEQ ID NO: 3828238 - RNA, 16 nt, Shigella flexneri 2a str. 2457T
acagcuuuuuccugcg

SEQ ID NO: 3828239 - RNA, 15 nt, Shigella flexneri 2a str. 2457T
acaggaacagccacu

SEQ ID NO: 3828240 - RNA, 20 nt, Shigella flexneri 2a str. 2457T
acaggaacagccacugguga

SEQ ID NO: 3828241 - RNA, 17 nt, Shigella flexneri 2a str. 2457T
acaggaagcagcuugcu

SEQ ID NO: 3828242 - RNA, 14 nt, Shigella flexneri 2a str. 2457T
acaggauaaugcaa

SEQ ID NO: 3828243 - RNA, 23 nt, Shigella flexneri 2a str. 2457T
acaggauaaugcaauggaauggc

SEQ ID NO: 3828244 - RNA, 18 nt, Shigella flexneri 2a str. 2457T
acaggauaauuagagguc

SEQ ID NO: 3828245 - RNA, 21 nt, Shigella flexneri 2a str. 2457T
acaggauaauuagaggucagu

SEQ ID NO: 3828246 - RNA, 22 nt, Shigella flexneri 2a str. 2457T
acaggauggcguucgcaacacc

SEQ ID NO: 3828247 - RNA, 22 nt, Shigella flexneri 2a str. 2457T
acaggauuuucuaauauuagau

SEQ ID NO: 3828248 - RNA, 19 nt, Shigella flexneri 2a str. 2457T
acaggcaaccgauagcugg

SEQ ID NO: 3828249 - RNA, 20 nt, Shigella flexneri 2a str. 2457T
acaggcaagcauaugacgaa

SEQ ID NO: 3828250 - RNA, 16 nt, Shigella flexneri 2a str. 2457T
acaggcagcuuagaaa

SEQ ID NO: 3828251 - RNA, 19 nt, Shigella flexneri 2a str. 2457T
acaggcagggccaccagcg

SEQ ID NO: 3828252 - RNA, 16 nt, Shigella flexneri 2a str. 2457T
acaggcgaucuucccg

SEQ ID NO: 3828253 - RNA, 13 nt, Shigella flexneri 2a str. 2457T
acaggcgaugcca

SEQ ID NO: 3828254 - RNA, 20 nt, Shigella flexneri 2a str. 2457T
acaggcgcugaugagcaaau

SEQ ID NO: 3828255 - RNA, 21 nt, Shigella flexneri 2a str. 2457T
acaggcggguaaucuuuccag

SEQ ID NO: 3828256 - RNA, 21 nt, Shigella flexneri 2a str. 2457T
acaggcuuuccugauaaucca

SEQ ID NO: 3828257 - RNA, 22 nt, Shigella flexneri 2a str. 2457T
acagggccaggaaucgcaaacc

SEQ ID NO: 3828258 - RNA, 15 nt, Shigella flexneri 2a str. 2457T
acagguaaggcgcga

SEQ ID NO: 3828259 - RNA, 18 nt, Shigella flexneri 2a str. 2457T
acagguaucgacaauguc

SEQ ID NO: 3828260 - RNA, 22 nt, Shigella flexneri 2a str. 2457T
acaggucgccagucccuuucag

SEQ ID NO: 3828261 - RNA, 12 nt, Shigella flexneri 2a str. 2457T
acaggucuguau

SEQ ID NO: 3828262 - RNA, 16 nt, Shigella flexneri 2a str. 2457T
acaggugcuccagggu

SEQ ID NO: 3828263 - RNA, 17 nt, Shigella flexneri 2a str. 2457T
acaggugcucgcauauc

SEQ ID NO: 3828264 - RNA, 23 nt, Shigella flexneri 2a str. 2457T
acagguggcaaauggcgaaggau

SEQ ID NO: 3828265 - RNA, 23 nt, Shigella flexneri 2a str. 2457T
acagguugccgaugauucccagu

SEQ ID NO: 3828266 - RNA, 20 nt, Shigella flexneri 2a str. 2457T
acagguuuaaacagagauua

SEQ ID NO: 3828267 - RNA, 20 nt, Shigella flexneri 2a str. 2457T
acaguaagcacucugacgga

SEQ ID NO: 3828268 - RNA, 20 nt, Shigella flexneri 2a str. 2457T
acaguaaugcgccagguucu

SEQ ID NO: 3828269 - RNA, 15 nt, Shigella flexneri 2a str. 2457T
acaguacaucuucca

SEQ ID NO: 3828270 - RNA, 20 nt, Shigella flexneri 2a str. 2457T
acaguacgguaaagccgugc

SEQ ID NO: 3828271 - RNA, 18 nt, Shigella flexneri 2a str. 2457T
acaguacguguuguucca

SEQ ID NO: 3828272 - RNA, 15 nt, Shigella flexneri 2a str. 2457T
acaguacugggauuc

SEQ ID NO: 3828273 - RNA, 15 nt, Shigella flexneri 2a str. 2457T
acaguaucaucauua

SEQ ID NO: 3828274 - RNA, 21 nt, Shigella flexneri 2a str. 2457T
acaguaucaucauuauuaaua

SEQ ID NO: 3828275 - RNA, 13 nt, Shigella flexneri 2a str. 2457T
acagucaggcugu

SEQ ID NO: 3828276 - RNA, 18 nt, Shigella flexneri 2a str. 2457T
acaugagcgaauaaaaaa

SEQ ID NO: 3828277 - RNA, 19 nt, Shigella flexneri 2a str. 2457T
acaugagguccagcgagcc

SEQ ID NO: 3828278 - RNA, 14 nt, Shigella flexneri 2a str. 2457T
acaugaguugcugg

SEQ ID NO: 3828279 - RNA, 16 nt, Shigella flexneri 2a str. 2457T
acaugaguugcuggac

SEQ ID NO: 3828280 - RNA, 14 nt, Shigella flexneri 2a str. 2457T
acaugauaugccug

SEQ ID NO: 3828281 - RNA, 22 nt, Shigella flexneri 2a str. 2457T
acaugauguggugcaaggaaau

SEQ ID NO: 3828282 - RNA, 18 nt, Shigella flexneri 2a str. 2457T
acaugcauaaagcgguuu

SEQ ID NO: 3828283 - RNA, 14 nt, Shigella flexneri 2a str. 2457T
acaugccacuggcc

SEQ ID NO: 3828284 - RNA, 18 nt, Shigella flexneri 2a str. 2457T
acaugccgaauccgggaa

SEQ ID NO: 3828285 - RNA, 12 nt, Shigella flexneri 2a str. 2457T
acaugcgauaaa

SEQ ID NO: 3828286 - RNA, 17 nt, Shigella flexneri 2a str. 2457T
acaugcgcgacaaaaau

SEQ ID NO: 3828287 - RNA, 16 nt, Shigella flexneri 2a str. 2457T
acaugcggugauuuug

SEQ ID NO: 3828288 - RNA, 19 nt, Shigella flexneri 2a str. 2457T
acaugcggugauuuugccu

SEQ ID NO: 3828289 - RNA, 21 nt, Shigella flexneri 2a str. 2457T
acaugcgguucacgcgccaga

SEQ ID NO: 3828290 - RNA, 23 nt, Shigella flexneri 2a str. 2457T
acaugcgguucacgcgccagaga

SEQ ID NO: 3828291 - RNA, 16 nt, Shigella flexneri 2a str. 2457T
acauggauucgaugau

SEQ ID NO: 3828292 - RNA, 22 nt, Shigella flexneri 2a str. 2457T
acauggugggcggguggaguau

SEQ ID NO: 3828293 - RNA, 15 nt, Shigella flexneri 2a str. 2457T
acauguacauggugc

SEQ ID NO: 3828294 - RNA, 19 nt, Shigella flexneri 2a str. 2457T
acauguacauggugcacau

SEQ ID NO: 3828295 - RNA, 13 nt, Shigella flexneri 2a str. 2457T
acauguucauuua

SEQ ID NO: 3828296 - RNA, 14 nt, Shigella flexneri 2a str. 2457T
acauguugaaauuc

SEQ ID NO: 3828297 - RNA, 15 nt, Shigella flexneri 2a str. 2457T
acauguugaaauucg

SEQ ID NO: 3828298 - RNA, 16 nt, Shigella flexneri 2a str. 2457T
acauguugaaucuucg

SEQ ID NO: 3828299 - RNA, 23 nt, Shigella flexneri 2a str. 2457T
acauguugaaucuucgugcguuu

SEQ ID NO: 3828300 - RNA, 13 nt, Shigella flexneri 2a str. 2457T
acauuaaaauucu

SEQ ID NO: 3828301 - RNA, 14 nt, Shigella flexneri 2a str. 2457T
acauuaaauugaua

SEQ ID NO: 3828302 - RNA, 17 nt, Shigella flexneri 2a str. 2457T
acauuaacgugaucaaa

SEQ ID NO: 3828303 - RNA, 21 nt, Shigella flexneri 2a str. 2457T
acauuaacgugaucaaaucau

SEQ ID NO: 3828304 - RNA, 19 nt, Shigella flexneri 2a str. 2457T
acauuacguccaucacaau

SEQ ID NO: 3828305 - RNA, 16 nt, Shigella flexneri 2a str. 2457T
acauuagauaaaaaug

SEQ ID NO: 3828306 - RNA, 12 nt, Shigella flexneri 2a str. 2457T
acauucaaugau

SEQ ID NO: 3828307 - RNA, 16 nt, Shigella flexneri 2a str. 2457T
acauucauagagggaa

SEQ ID NO: 3828308 - RNA, 23 nt, Shigella flexneri 2a str. 2457T
acauuccaggcccgcguggauaa

SEQ ID NO: 3828309 - RNA, 14 nt, Shigella flexneri 2a str. 2457T
acauucccugcagu

SEQ ID NO: 3828310 - RNA, 17 nt, Shigella flexneri 2a str. 2457T
acauuccugcugacggc

SEQ ID NO: 3828311 - RNA, 20 nt, Shigella flexneri 2a str. 2457T
acauucgagaagcccauacc

SEQ ID NO: 3828312 - RNA, 14 nt, Shigella flexneri 2a str. 2457T
acauucuccggcag

SEQ ID NO: 3828313 - RNA, 14 nt, Shigella flexneri 2a str. 2457T
acauucugacuggu

SEQ ID NO: 3828314 - RNA, 21 nt, Shigella flexneri 2a str. 2457T
acauucugcaucgcgcugaac

SEQ ID NO: 3828315 - RNA, 13 nt, Shigella flexneri 2a str. 2457T
acauugauauaca

SEQ ID NO: 3828316 - RNA, 15 nt, Shigella flexneri 2a str. 2457T
acauugauguuuuca

SEQ ID NO: 3828317 - RNA, 16 nt, Shigella flexneri 2a str. 2457T
acauugcaucugauaa

SEQ ID NO: 3828318 - RNA, 17 nt, Shigella flexneri 2a str. 2457T
acauugcaucugauaac

SEQ ID NO: 3828319 - RNA, 21 nt, Shigella flexneri 2a str. 2457T
acauugccguaagcaacgcca

SEQ ID NO: 3828320 - RNA, 21 nt, Shigella flexneri 2a str. 2457T
acauugccugaugcgacgcug

SEQ ID NO: 3828321 - RNA, 19 nt, Shigella flexneri 2a str. 2457T
acauugcguaaccaaucac

SEQ ID NO: 3828322 - RNA, 15 nt, Shigella flexneri 2a str. 2457T
acauugcugcacauc

SEQ ID NO: 3828323 - RNA, 14 nt, Shigella flexneri 2a str. 2457T
acauuggugccgga

SEQ ID NO: 3828324 - RNA, 21 nt, Shigella flexneri 2a str. 2457T
acauuuaccgcaacucauuua

SEQ ID NO: 3828325 - RNA, 19 nt, Shigella flexneri 2a str. 2457T
acauuucagaaaguauaua

SEQ ID NO: 3828326 - RNA, 20 nt, Shigella flexneri 2a str. 2457T
acauuucagaaaguauauaa

SEQ ID NO: 3828327 - RNA, 21 nt, Shigella flexneri 2a str. 2457T
acauuucagaaaguauauaaa

SEQ ID NO: 3828328 - RNA, 12 nt, Shigella flexneri 2a str. 2457T
acauuucugcug

SEQ ID NO: 3828329 - RNA, 14 nt, Shigella flexneri 2a str. 2457T
acauuucugcugcc

SEQ ID NO: 3828330 - RNA, 19 nt, Shigella flexneri 2a str. 2457T
acauuucugcugccuacac

SEQ ID NO: 3828331 - RNA, 12 nt, Shigella flexneri 2a str. 2457T
acauuucuuuug

SEQ ID NO: 3828332 - RNA, 12 nt, Shigella flexneri 2a str. 2457T
acauuuucucua

SEQ ID NO: 3828333 - RNA, 16 nt, Shigella flexneri 2a str. 2457T
accaaaaaaucaaugc

SEQ ID NO: 3828334 - RNA, 15 nt, Shigella flexneri 2a str. 2457T
accaaaaacgccaug

SEQ ID NO: 3828335 - RNA, 12 nt, Shigella flexneri 2a str. 2457T
accaaaaucauc

SEQ ID NO: 3828336 - RNA, 16 nt, Shigella flexneri 2a str. 2457T
accaaaaucaucaauu

SEQ ID NO: 3828337 - RNA, 20 nt, Shigella flexneri 2a str. 2457T
accaaaaucaucaauugcca

SEQ ID NO: 3828338 - RNA, 14 nt, Shigella flexneri 2a str. 2457T
accaaacagcgcca

SEQ ID NO: 3828339 - RNA, 13 nt, Shigella flexneri 2a str. 2457T
accaaacgggcaa

SEQ ID NO: 3828340 - RNA, 14 nt, Shigella flexneri 2a str. 2457T
accaaagaaaucag

SEQ ID NO: 3828341 - RNA, 15 nt, Shigella flexneri 2a str. 2457T
accaaagaaugacac

SEQ ID NO: 3828342 - RNA, 17 nt, Shigella flexneri 2a str. 2457T
accaaagccuuucacuu

SEQ ID NO: 3828343 - RNA, 15 nt, Shigella flexneri 2a str. 2457T
accaaaggcgaugcu

SEQ ID NO: 3828344 - RNA, 22 nt, Shigella flexneri 2a str. 2457T
accaaaucuccaguggugauac

SEQ ID NO: 3828345 - RNA, 21 nt, Shigella flexneri 2a str. 2457T
accaaaucugauuaauauuga

SEQ ID NO: 3828346 - RNA, 14 nt, Shigella flexneri 2a str. 2457T
accaacaaagccac

SEQ ID NO: 3828347 - RNA, 13 nt, Shigella flexneri 2a str. 2457T
accaacaucacgc

SEQ ID NO: 3828348 - RNA, 15 nt, Shigella flexneri 2a str. 2457T
accaacgacggccag

SEQ ID NO: 3828349 - RNA, 13 nt, Shigella flexneri 2a str. 2457T
accaacgcacaca

SEQ ID NO: 3828350 - RNA, 24 nt, Shigella flexneri 2a str. 2457T
accaacggacgagucgcuucaugc

SEQ ID NO: 3828351 - RNA, 19 nt, Shigella flexneri 2a str. 2457T
accaacggcgagccagcgc

SEQ ID NO: 3828352 - RNA, 16 nt, Shigella flexneri 2a str. 2457T
accaagucucaagagu

SEQ ID NO: 3828353 - RNA, 22 nt, Shigella flexneri 2a str. 2457T
accaauaacaggauuuucuaau

SEQ ID NO: 3828354 - RNA, 17 nt, Shigella flexneri 2a str. 2457T
accaauaacuacggcuc

SEQ ID NO: 3828355 - RNA, 12 nt, Shigella flexneri 2a str. 2457T
accaauaauccc

SEQ ID NO: 3828356 - RNA, 19 nt, Shigella flexneri 2a str. 2457T
accaauaccgcccaccacc

SEQ ID NO: 3828357 - RNA, 22 nt, Shigella flexneri 2a str. 2457T
accaauaccgcccaccaccagc

SEQ ID NO: 3828358 - RNA, 23 nt, Shigella flexneri 2a str. 2457T
accaauagcccaugcaucggcca

SEQ ID NO: 3828359 - RNA, 16 nt, Shigella flexneri 2a str. 2457T
accaauaucaaauaaa

SEQ ID NO: 3828360 - RNA, 20 nt, Shigella flexneri 2a str. 2457T
accaauaucaaauaaaaagg

SEQ ID NO: 3828361 - RNA, 14 nt, Shigella flexneri 2a str. 2457T
accaauauccugaa

SEQ ID NO: 3828362 - RNA, 12 nt, Shigella flexneri 2a str. 2457T
accaaucaccac

SEQ ID NO: 3828363 - RNA, 15 nt, Shigella flexneri 2a str. 2457T
accaaucaccgccag

SEQ ID NO: 3828364 - RNA, 19 nt, Shigella flexneri 2a str. 2457T
accaaucaccgccagcaag

SEQ ID NO: 3828365 - RNA, 20 nt, Shigella flexneri 2a str. 2457T
accaaucaccgccagcaagg

SEQ ID NO: 3828366 - RNA, 18 nt, Shigella flexneri 2a str. 2457T
accaaucacgucgcccac

SEQ ID NO: 3828367 - RNA, 20 nt, Shigella flexneri 2a str. 2457T
accaaucgcggcgauaucca

SEQ ID NO: 3828368 - RNA, 17 nt, Shigella flexneri 2a str. 2457T
accaaucggcagaacgg

SEQ ID NO: 3828369 - RNA, 17 nt, Shigella flexneri 2a str. 2457T
accaaucucccagccgg

SEQ ID NO: 3828370 - RNA, 16 nt, Shigella flexneri 2a str. 2457T
accaaugccgcggcgc

SEQ ID NO: 3828371 - RNA, 16 nt, Shigella flexneri 2a str. 2457T
accaauguaauacgcu

SEQ ID NO: 3828372 - RNA, 12 nt, Shigella flexneri 2a str. 2457T
accaaugucagg

SEQ ID NO: 3828373 - RNA, 23 nt, Shigella flexneri 2a str. 2457T
accaaugucgaaagccccagccc

SEQ ID NO: 3828374 - RNA, 16 nt, Shigella flexneri 2a str. 2457T
accagauuauaagcca

SEQ ID NO: 3828375 - RNA, 16 nt, Shigella flexneri 2a str. 2457T
accagauuccucucau

SEQ ID NO: 3828376 - RNA, 17 nt, Shigella flexneri 2a str. 2457T
accagcaaauauugcau

SEQ ID NO: 3828377 - RNA, 12 nt, Shigella flexneri 2a str. 2457T
accagcaacaaa

SEQ ID NO: 3828378 - RNA, 22 nt, Shigella flexneri 2a str. 2457T
accagcaacaaauaaccgccug

SEQ ID NO: 3828379 - RNA, 19 nt, Shigella flexneri 2a str. 2457T
accagcaaccaacgccagc

SEQ ID NO: 3828380 - RNA, 23 nt, Shigella flexneri 2a str. 2457T
accagcaacgcuucguagaagcc

SEQ ID NO: 3828381 - RNA, 17 nt, Shigella flexneri 2a str. 2457T
accagcaauaacaacac

SEQ ID NO: 3828382 - RNA, 18 nt, Shigella flexneri 2a str. 2457T
accagcaauuuacgcuuu

SEQ ID NO: 3828383 - RNA, 15 nt, Shigella flexneri 2a str. 2457T
accagcacaucauca

SEQ ID NO: 3828384 - RNA, 22 nt, Shigella flexneri 2a str. 2457T
accagcacaucaucaaagccaa

SEQ ID NO: 3828385 - RNA, 18 nt, Shigella flexneri 2a str. 2457T
accagcaccguguucuca

SEQ ID NO: 3828386 - RNA, 14 nt, Shigella flexneri 2a str. 2457T
accagcacuucacu

SEQ ID NO: 3828387 - RNA, 10 nt, Shigella flexneri 2a str. 2457T
accagcagca

SEQ ID NO: 3828388 - RNA, 13 nt, Shigella flexneri 2a str. 2457T
accagcagcugcu

SEQ ID NO: 3828389 - RNA, 13 nt, Shigella flexneri 2a str. 2457T
accagcaguaaac

SEQ ID NO: 3828390 - RNA, 16 nt, Shigella flexneri 2a str. 2457T
accagccaggccgcca

SEQ ID NO: 3828391 - RNA, 17 nt, Shigella flexneri 2a str. 2457T
accagccauuaaccagc

SEQ ID NO: 3828392 - RNA, 21 nt, Shigella flexneri 2a str. 2457T
accagccauuaaccagccacu

SEQ ID NO: 3828393 - RNA, 24 nt, Shigella flexneri 2a str. 2457T
accagccccagaauucacgcacuu

SEQ ID NO: 3828394 - RNA, 20 nt, Shigella flexneri 2a str. 2457T
accagccgcgacaucuucuc

SEQ ID NO: 3828395 - RNA, 22 nt, Shigella flexneri 2a str. 2457T
accagccgcuaccagcgcggca

SEQ ID NO: 3828396 - RNA, 23 nt, Shigella flexneri 2a str. 2457T
accagccgcuaccagcgcggcac

SEQ ID NO: 3828397 - RNA, 15 nt, Shigella flexneri 2a str. 2457T
accagccuucuucau

SEQ ID NO: 3828398 - RNA, 22 nt, Shigella flexneri 2a str. 2457T
accagcgaaaguaacaccaucc

SEQ ID NO: 3828399 - RNA, 21 nt, Shigella flexneri 2a str. 2457T
accagcgaauggguaaaaccg

SEQ ID NO: 3828400 - RNA, 19 nt, Shigella flexneri 2a str. 2457T
accagcgacaucaccgccg

SEQ ID NO: 3828401 - RNA, 19 nt, Shigella flexneri 2a str. 2457T
accagcgacggaugacacg

SEQ ID NO: 3828402 - RNA, 20 nt, Shigella flexneri 2a str. 2457T
accagcgcagauagcccgga

SEQ ID NO: 3828403 - RNA, 18 nt, Shigella flexneri 2a str. 2457T
accagcgccugcgcggca

SEQ ID NO: 3828404 - RNA, 23 nt, Shigella flexneri 2a str. 2457T
accagcggccggaugcgccgcca

SEQ ID NO: 3828405 - RNA, 16 nt, Shigella flexneri 2a str. 2457T
accagcgucaucggau

SEQ ID NO: 3828406 - RNA, 17 nt, Shigella flexneri 2a str. 2457T
accagcgucgcaucagg

SEQ ID NO: 3828407 - RNA, 13 nt, Shigella flexneri 2a str. 2457T
accagcguuucca

SEQ ID NO: 3828408 - RNA, 16 nt, Shigella flexneri 2a str. 2457T
accagcuaccacgccg

SEQ ID NO: 3828409 - RNA, 14 nt, Shigella flexneri 2a str. 2457T
accagcuccggcac

SEQ ID NO: 3828410 - RNA, 13 nt, Shigella flexneri 2a str. 2457T
accagcugacgua

SEQ ID NO: 3828411 - RNA, 14 nt, Shigella flexneri 2a str. 2457T
accagcugccacau

SEQ ID NO: 3828412 - RNA, 17 nt, Shigella flexneri 2a str. 2457T
accagcuuaugccuguc

SEQ ID NO: 3828413 - RNA, 14 nt, Shigella flexneri 2a str. 2457T
accaggaaacccaa

SEQ ID NO: 3828414 - RNA, 20 nt, Shigella flexneri 2a str. 2457T
accaggaagauguacgccag

SEQ ID NO: 3828415 - RNA, 17 nt, Shigella flexneri 2a str. 2457T
accaggaagcgacccgg

SEQ ID NO: 3828416 - RNA, 14 nt, Shigella flexneri 2a str. 2457T
accaggccagcgca

SEQ ID NO: 3828417 - RNA, 17 nt, Shigella flexneri 2a str. 2457T
accaggccggugaugau

SEQ ID NO: 3828418 - RNA, 15 nt, Shigella flexneri 2a str. 2457T
accaggcguggauac

SEQ ID NO: 3828419 - RNA, 20 nt, Shigella flexneri 2a str. 2457T
accaggcucuuuaaacaguu

SEQ ID NO: 3828420 - RNA, 13 nt, Shigella flexneri 2a str. 2457T
accaguaaggcau

SEQ ID NO: 3828421 - RNA, 14 nt, Shigella flexneri 2a str. 2457T
accaguaccgccac

SEQ ID NO: 3828422 - RNA, 16 nt, Shigella flexneri 2a str. 2457T
accaguaccgccacca

SEQ ID NO: 3828423 - RNA, 18 nt, Shigella flexneri 2a str. 2457T
accaguacgcccacgcca

SEQ ID NO: 3828424 - RNA, 19 nt, Shigella flexneri 2a str. 2457T
accaguacgcccacgccag

SEQ ID NO: 3828425 - RNA, 14 nt, Shigella flexneri 2a str. 2457T
accaguagcgucau

SEQ ID NO: 3828426 - RNA, 23 nt, Shigella flexneri 2a str. 2457T
accagucagcgaacaccagcagu

SEQ ID NO: 3828427 - RNA, 16 nt, Shigella flexneri 2a str. 2457T
accaguccaucggcau

SEQ ID NO: 3828428 - RNA, 17 nt, Shigella flexneri 2a str. 2457T
accaguccuacacacgc

SEQ ID NO: 3828429 - RNA, 20 nt, Shigella flexneri 2a str. 2457T
accaguccuacacacgccag

SEQ ID NO: 3828430 - RNA, 16 nt, Shigella flexneri 2a str. 2457T
accagucgcugacacu

SEQ ID NO: 3828431 - RNA, 18 nt, Shigella flexneri 2a str. 2457T
accagugaauuucacuuc

SEQ ID NO: 3828432 - RNA, 20 nt, Shigella flexneri 2a str. 2457T
accagugcggauaccaccag

SEQ ID NO: 3828433 - RNA, 16 nt, Shigella flexneri 2a str. 2457T
accaguugcuccagca

SEQ ID NO: 3828434 - RNA, 19 nt, Shigella flexneri 2a str. 2457T
accaguugcuccagcaaua

SEQ ID NO: 3828435 - RNA, 22 nt, Shigella flexneri 2a str. 2457T
accaguugguagguccagccgc

SEQ ID NO: 3828436 - RNA, 21 nt, Shigella flexneri 2a str. 2457T
accauaaaacaaauccgcuug

SEQ ID NO: 3828437 - RNA, 22 nt, Shigella flexneri 2a str. 2457T
accauaaaacgcgcuacugaau

SEQ ID NO: 3828438 - RNA, 18 nt, Shigella flexneri 2a str. 2457T
accauaaauauggugaaa

SEQ ID NO: 3828439 - RNA, 22 nt, Shigella flexneri 2a str. 2457T
accauaaauauggugaaaguaa

SEQ ID NO: 3828440 - RNA, 14 nt, Shigella flexneri 2a str. 2457T
accauaaaucagau

SEQ ID NO: 3828441 - RNA, 19 nt, Shigella flexneri 2a str. 2457T
accauaaccaauaacagga

SEQ ID NO: 3828442 - RNA, 15 nt, Shigella flexneri 2a str. 2457T
accauacagcagcaa

SEQ ID NO: 3828443 - RNA, 19 nt, Shigella flexneri 2a str. 2457T
accauacggucugccaguc

SEQ ID NO: 3828444 - RNA, 23 nt, Shigella flexneri 2a str. 2457T
accauaguauuuauccauaauuu

SEQ ID NO: 3828445 - RNA, 16 nt, Shigella flexneri 2a str. 2457T
accauauagcgcacau

SEQ ID NO: 3828446 - RNA, 19 nt, Shigella flexneri 2a str. 2457T
accauauagcgcacaugca

SEQ ID NO: 3828447 - RNA, 18 nt, Shigella flexneri 2a str. 2457T
accauauguguuugugcc

SEQ ID NO: 3828448 - RNA, 15 nt, Shigella flexneri 2a str. 2457T
accauauucagcagc

SEQ ID NO: 3828449 - RNA, 17 nt, Shigella flexneri 2a str. 2457T
accauauucagcagcag

SEQ ID NO: 3828450 - RNA, 19 nt, Shigella flexneri 2a str. 2457T
accaucaaagaagcucuuu

SEQ ID NO: 3828451 - RNA, 18 nt, Shigella flexneri 2a str. 2457T
accaucaacaaacgccag

SEQ ID NO: 3828452 - RNA, 17 nt, Shigella flexneri 2a str. 2457T
accaucaaguagcaggu

SEQ ID NO: 3828453 - RNA, 22 nt, Shigella flexneri 2a str. 2457T
accaucaaguagcagguaaucu

SEQ ID NO: 3828454 - RNA, 20 nt, Shigella flexneri 2a str. 2457T
accaucacuuucaaaagccc

SEQ ID NO: 3828455 - RNA, 22 nt, Shigella flexneri 2a str. 2457T
accaucacuuucaaaagccccg

SEQ ID NO: 3828456 - RNA, 13 nt, Shigella flexneri 2a str. 2457T
accaucagcagca

SEQ ID NO: 3828457 - RNA, 13 nt, Shigella flexneri 2a str. 2457T
accaucagcauga

SEQ ID NO: 3828458 - RNA, 17 nt, Shigella flexneri 2a str. 2457T
accaucagcugccaggg

SEQ ID NO: 3828459 - RNA, 18 nt, Shigella flexneri 2a str. 2457T
accaucaggaugacaaac

SEQ ID NO: 3828460 - RNA, 21 nt, Shigella flexneri 2a str. 2457T
accaucauaccgaucaccgau

SEQ ID NO: 3828461 - RNA, 14 nt, Shigella flexneri 2a str. 2457T
accauccaggagau

SEQ ID NO: 3828462 - RNA, 11 nt, Shigella flexneri 2a str. 2457T
accauccauac

SEQ ID NO: 3828463 - RNA, 16 nt, Shigella flexneri 2a str. 2457T
accauccauucagugc

SEQ ID NO: 3828464 - RNA, 21 nt, Shigella flexneri 2a str. 2457T
accauccauucagugcgucgc

SEQ ID NO: 3828465 - RNA, 15 nt, Shigella flexneri 2a str. 2457T
accauccauuuuuca

SEQ ID NO: 3828466 - RNA, 14 nt, Shigella flexneri 2a str. 2457T
accaucccgccgau

SEQ ID NO: 3828467 - RNA, 12 nt, Shigella flexneri 2a str. 2457T
accauccggcau

SEQ ID NO: 3828468 - RNA, 14 nt, Shigella flexneri 2a str. 2457T
accauccuaaaaaa

SEQ ID NO: 3828469 - RNA, 18 nt, Shigella flexneri 2a str. 2457T
accaucgcaaacaguaca

SEQ ID NO: 3828470 - RNA, 14 nt, Shigella flexneri 2a str. 2457T
accaucgccagccc

SEQ ID NO: 3828471 - RNA, 15 nt, Shigella flexneri 2a str. 2457T
acccgcgacgcgcuu

SEQ ID NO: 3828472 - RNA, 16 nt, Shigella flexneri 2a str. 2457T
acccgcgacgcgcuuu

SEQ ID NO: 3828473 - RNA, 18 nt, Shigella flexneri 2a str. 2457T
acccgcgaggcgcauaag

SEQ ID NO: 3828474 - RNA, 17 nt, Shigella flexneri 2a str. 2457T
acccgcgcuucgagauu

SEQ ID NO: 3828475 - RNA, 20 nt, Shigella flexneri 2a str. 2457T
acccgcuguaaaugcugcuc

SEQ ID NO: 3828476 - RNA, 12 nt, Shigella flexneri 2a str. 2457T
acccgcuucagu

SEQ ID NO: 3828477 - RNA, 23 nt, Shigella flexneri 2a str. 2457T
acccgcuugaguauuuaccagaa

SEQ ID NO: 3828478 - RNA, 16 nt, Shigella flexneri 2a str. 2457T
acccggaccgucuuuu

SEQ ID NO: 3828479 - RNA, 15 nt, Shigella flexneri 2a str. 2457T
acccggcaucaacca

SEQ ID NO: 3828480 - RNA, 18 nt, Shigella flexneri 2a str. 2457T
acccggccacagcgccag

SEQ ID NO: 3828481 - RNA, 14 nt, Shigella flexneri 2a str. 2457T
acccggccugcucc

SEQ ID NO: 3828482 - RNA, 16 nt, Shigella flexneri 2a str. 2457T
acccggccugcucccg

SEQ ID NO: 3828483 - RNA, 14 nt, Shigella flexneri 2a str. 2457T
acccggcggcgcgc

SEQ ID NO: 3828484 - RNA, 20 nt, Shigella flexneri 2a str. 2457T
acccgguacaucaauaccau

SEQ ID NO: 3828485 - RNA, 16 nt, Shigella flexneri 2a str. 2457T
acccguacuucugacc

SEQ ID NO: 3828486 - RNA, 21 nt, Shigella flexneri 2a str. 2457T
acccguagcuguucaggagaa

SEQ ID NO: 3828487 - RNA, 24 nt, Shigella flexneri 2a str. 2457T
acccguaggccggauaagaugcgc

SEQ ID NO: 3828488 - RNA, 19 nt, Shigella flexneri 2a str. 2457T
acccguauguucccaccag

SEQ ID NO: 3828489 - RNA, 23 nt, Shigella flexneri 2a str. 2457T
acccguauguucccaccagccac

SEQ ID NO: 3828490 - RNA, 18 nt, Shigella flexneri 2a str. 2457T
acccguugguuugauagc

SEQ ID NO: 3828491 - RNA, 22 nt, Shigella flexneri 2a str. 2457T
acccguugguuugauagcaaua

SEQ ID NO: 3828492 - RNA, 17 nt, Shigella flexneri 2a str. 2457T
acccuaaauccgccauc

SEQ ID NO: 3828493 - RNA, 15 nt, Shigella flexneri 2a str. 2457T
acccuaacccucucc

SEQ ID NO: 3828494 - RNA, 17 nt, Shigella flexneri 2a str. 2457T
acccuaacccucucccc

SEQ ID NO: 3828495 - RNA, 13 nt, Shigella flexneri 2a str. 2457T
acccuauccccaa

SEQ ID NO: 3828496 - RNA, 22 nt, Shigella flexneri 2a str. 2457T
acccuaugugaucuuuaucaca

SEQ ID NO: 3828497 - RNA, 14 nt, Shigella flexneri 2a str. 2457T
acccucaacaacag

SEQ ID NO: 3828498 - RNA, 21 nt, Shigella flexneri 2a str. 2457T
acccucacgcauucucuuuuc

SEQ ID NO: 3828499 - RNA, 23 nt, Shigella flexneri 2a str. 2457T
acccucgaccaucuccuuacugc

SEQ ID NO: 3828500 - RNA, 14 nt, Shigella flexneri 2a str. 2457T
acccucuccccaag

SEQ ID NO: 3828501 - RNA, 23 nt, Shigella flexneri 2a str. 2457T
acccucucccgaaugaccgcccc

SEQ ID NO: 3828502 - RNA, 17 nt, Shigella flexneri 2a str. 2457T
acccugaguuuucagua

SEQ ID NO: 3828503 - RNA, 17 nt, Shigella flexneri 2a str. 2457T
acccugcucuuucagca

SEQ ID NO: 3828504 - RNA, 21 nt, Shigella flexneri 2a str. 2457T
acccuguccgccauggcuucu

SEQ ID NO: 3828505 - RNA, 21 nt, Shigella flexneri 2a str. 2457T
acccuuacucacuaaauuagg

SEQ ID NO: 3828506 - RNA, 21 nt, Shigella flexneri 2a str. 2457T
acccuuccuuagcaaaauagc

SEQ ID NO: 3828507 - RNA, 17 nt, Shigella flexneri 2a str. 2457T
acccuucgucaaucagc

SEQ ID NO: 3828508 - RNA, 21 nt, Shigella flexneri 2a str. 2457T
acccuugaucaccguaaugau

SEQ ID NO: 3828509 - RNA, 17 nt, Shigella flexneri 2a str. 2457T
acccuugauguggcgga

SEQ ID NO: 3828510 - RNA, 18 nt, Shigella flexneri 2a str. 2457T
acccuugccggaugcggc

SEQ ID NO: 3828511 - RNA, 14 nt, Shigella flexneri 2a str. 2457T
acccuugugcucaa

SEQ ID NO: 3828512 - RNA, 23 nt, Shigella flexneri 2a str. 2457T
acccuuucguuaaauucuucuga

SEQ ID NO: 3828513 - RNA, 13 nt, Shigella flexneri 2a str. 2457T
acccuuuuuuaaa

SEQ ID NO: 3828514 - RNA, 13 nt, Shigella flexneri 2a str. 2457T
accgaacagauca

SEQ ID NO: 3828515 - RNA, 16 nt, Shigella flexneri 2a str. 2457T
accgaacagaucacgu

SEQ ID NO: 3828516 - RNA, 15 nt, Shigella flexneri 2a str. 2457T
accgaacggagucgg

SEQ ID NO: 3828517 - RNA, 18 nt, Shigella flexneri 2a str. 2457T
accgaacggagucggguc

SEQ ID NO: 3828518 - RNA, 18 nt, Shigella flexneri 2a str. 2457T
accgaagcccaucaguac

SEQ ID NO: 3828519 - RNA, 16 nt, Shigella flexneri 2a str. 2457T
accgaaggcaccauua

SEQ ID NO: 3828520 - RNA, 20 nt, Shigella flexneri 2a str. 2457T
accgaaggcgauaucuggau

SEQ ID NO: 3828521 - RNA, 24 nt, Shigella flexneri 2a str. 2457T
accgaaucccgcugcaaucuuuaa

SEQ ID NO: 3828522 - RNA, 16 nt, Shigella flexneri 2a str. 2457T
accgaauucaaauccu

SEQ ID NO: 3828523 - RNA, 15 nt, Shigella flexneri 2a str. 2457T
accgacaaauuucau

SEQ ID NO: 3828524 - RNA, 17 nt, Shigella flexneri 2a str. 2457T
accgacaauauugaugc

SEQ ID NO: 3828525 - RNA, 22 nt, Shigella flexneri 2a str. 2457T
accgacaauccgguagguucaa

SEQ ID NO: 3828526 - RNA, 18 nt, Shigella flexneri 2a str. 2457T
accgacauggugcgauua

SEQ ID NO: 3828527 - RNA, 14 nt, Shigella flexneri 2a str. 2457T
accgaccagaaugu

SEQ ID NO: 3828528 - RNA, 15 nt, Shigella flexneri 2a str. 2457T
accgaccaucggcac

SEQ ID NO: 3828529 - RNA, 15 nt, Shigella flexneri 2a str. 2457T
accgacgcugcucaa

SEQ ID NO: 3828530 - RNA, 17 nt, Shigella flexneri 2a str. 2457T
accgacguagccccaau

SEQ ID NO: 3828531 - RNA, 15 nt, Shigella flexneri 2a str. 2457T
accgacgucgauaua

SEQ ID NO: 3828532 - RNA, 22 nt, Shigella flexneri 2a str. 2457T
accgacuccguagaaccuugcu

SEQ ID NO: 3828533 - RNA, 15 nt, Shigella flexneri 2a str. 2457T
accgagaagcagcaa

SEQ ID NO: 3828534 - RNA, 17 nt, Shigella flexneri 2a str. 2457T
accgagauaaugguuuc

SEQ ID NO: 3828535 - RNA, 22 nt, Shigella flexneri 2a str. 2457T
accgagauaaugguuuccagca

SEQ ID NO: 3828536 - RNA, 19 nt, Shigella flexneri 2a str. 2457T
accgagcagccacugcggc

SEQ ID NO: 3828537 - RNA, 17 nt, Shigella flexneri 2a str. 2457T
accgaggcauucagcca

SEQ ID NO: 3828538 - RNA, 22 nt, Shigella flexneri 2a str. 2457T
accgaggcauucagccaguucu

SEQ ID NO: 3828539 - RNA, 14 nt, Shigella flexneri 2a str. 2457T
accgauaaaagccc

SEQ ID NO: 3828540 - RNA, 17 nt, Shigella flexneri 2a str. 2457T
accgauauucgccgcga

SEQ ID NO: 3828541 - RNA, 21 nt, Shigella flexneri 2a str. 2457T
accgauauucgccgcgacaca

SEQ ID NO: 3828542 - RNA, 20 nt, Shigella flexneri 2a str. 2457T
accgauccugaaguggcguu

SEQ ID NO: 3828543 - RNA, 12 nt, Shigella flexneri 2a str. 2457T
accgaucgccag

SEQ ID NO: 3828544 - RNA, 23 nt, Shigella flexneri 2a str. 2457T
accgaugaucgccaucagugcca

SEQ ID NO: 3828545 - RNA, 18 nt, Shigella flexneri 2a str. 2457T
accgcaaaaccaacgccu

SEQ ID NO: 3828546 - RNA, 17 nt, Shigella flexneri 2a str. 2457T
accgcaaagguugcugc

SEQ ID NO: 3828547 - RNA, 18 nt, Shigella flexneri 2a str. 2457T
accgcaauaaccaucagc

SEQ ID NO: 3828548 - RNA, 22 nt, Shigella flexneri 2a str. 2457T
accgcaaucgaucuguuuauca

SEQ ID NO: 3828549 - RNA, 14 nt, Shigella flexneri 2a str. 2457T
accgcaaucgccag

SEQ ID NO: 3828550 - RNA, 16 nt, Shigella flexneri 2a str. 2457T
accgcaccaccagcag

SEQ ID NO: 3828551 - RNA, 14 nt, Shigella flexneri 2a str. 2457T
accgcaccgcccgu

SEQ ID NO: 3828552 - RNA, 15 nt, Shigella flexneri 2a str. 2457T
accgcacgacgaauc

SEQ ID NO: 3828553 - RNA, 15 nt, Shigella flexneri 2a str. 2457T
accgcacgcagaauc

SEQ ID NO: 3828554 - RNA, 20 nt, Shigella flexneri 2a str. 2457T
accgcagaagcgauaaccuu

SEQ ID NO: 3828555 - RNA, 15 nt, Shigella flexneri 2a str. 2457T
accgcagcauugcuc

SEQ ID NO: 3828556 - RNA, 16 nt, Shigella flexneri 2a str. 2457T
accgcagccgccacaa

SEQ ID NO: 3828557 - RNA, 18 nt, Shigella flexneri 2a str. 2457T
accgcaguaaucggcgaa

SEQ ID NO: 3828558 - RNA, 16 nt, Shigella flexneri 2a str. 2457T
accgcagugaaauuuc

SEQ ID NO: 3828559 - RNA, 21 nt, Shigella flexneri 2a str. 2457T
accgcaucacgacagcaccac

SEQ ID NO: 3828560 - RNA, 19 nt, Shigella flexneri 2a str. 2457T
accgcauccgcuugcguau

SEQ ID NO: 3828561 - RNA, 13 nt, Shigella flexneri 2a str. 2457T
accgcaucggcau

SEQ ID NO: 3828562 - RNA, 14 nt, Shigella flexneri 2a str. 2457T
accgcaucggcauc

SEQ ID NO: 3828563 - RNA, 21 nt, Shigella flexneri 2a str. 2457T
accgcaucggcaucaaaccau

SEQ ID NO: 3828564 - RNA, 22 nt, Shigella flexneri 2a str. 2457T
accgcaucggcaucaaaccauu

SEQ ID NO: 3828565 - RNA, 22 nt, Shigella flexneri 2a str. 2457T
accgccaccaggaacgcgccaa

SEQ ID NO: 3828566 - RNA, 15 nt, Shigella flexneri 2a str. 2457T
accgccagcaggaac

SEQ ID NO: 3828567 - RNA, 15 nt, Shigella flexneri 2a str. 2457T
accgccagcaucggc

SEQ ID NO: 3828568 - RNA, 23 nt, Shigella flexneri 2a str. 2457T
accgucugugugccugucgggac

SEQ ID NO: 3828569 - RNA, 16 nt, Shigella flexneri 2a str. 2457T
accgucuucccgcagc

SEQ ID NO: 3828570 - RNA, 19 nt, Shigella flexneri 2a str. 2457T
accgucuucccgcagccac

SEQ ID NO: 3828571 - RNA, 14 nt, Shigella flexneri 2a str. 2457T
accgugauccgccg

SEQ ID NO: 3828572 - RNA, 18 nt, Shigella flexneri 2a str. 2457T
accgugaucguggccaug

SEQ ID NO: 3828573 - RNA, 15 nt, Shigella flexneri 2a str. 2457T
accgugcaucuguug

SEQ ID NO: 3828574 - RNA, 17 nt, Shigella flexneri 2a str. 2457T
accgugcauuucucacu

SEQ ID NO: 3828575 - RNA, 20 nt, Shigella flexneri 2a str. 2457T
accgugcgggcaucaucuuc

SEQ ID NO: 3828576 - RNA, 20 nt, Shigella flexneri 2a str. 2457T
accgugggaaacaguaagca

SEQ ID NO: 3828577 - RNA, 18 nt, Shigella flexneri 2a str. 2457T
accguguaaaaugacucg

SEQ ID NO: 3828578 - RNA, 18 nt, Shigella flexneri 2a str. 2457T
accguucagcuugcgucc

SEQ ID NO: 3828579 - RNA, 14 nt, Shigella flexneri 2a str. 2457T
accguuccauucaa

SEQ ID NO: 3828580 - RNA, 19 nt, Shigella flexneri 2a str. 2457T
accguugaggauggcgucg

SEQ ID NO: 3828581 - RNA, 21 nt, Shigella flexneri 2a str. 2457T
accguugguuaauuuuucaaa

SEQ ID NO: 3828582 - RNA, 12 nt, Shigella flexneri 2a str. 2457T
accguuuccuca

SEQ ID NO: 3828583 - RNA, 22 nt, Shigella flexneri 2a str. 2457T
accguuucuuugccgaggaaga

SEQ ID NO: 3828584 - RNA, 22 nt, Shigella flexneri 2a str. 2457T
accguuugccccggcugcgcga

SEQ ID NO: 3828585 - RNA, 15 nt, Shigella flexneri 2a str. 2457T
accguuuuuucugcc

SEQ ID NO: 3828586 - RNA, 16 nt, Shigella flexneri 2a str. 2457T
accuaaaaaaucccac

SEQ ID NO: 3828587 - RNA, 15 nt, Shigella flexneri 2a str. 2457T
accuaaaaagaaaau

SEQ ID NO: 3828588 - RNA, 21 nt, Shigella flexneri 2a str. 2457T
accuaaaaagaaaaucgucaa

SEQ ID NO: 3828589 - RNA, 19 nt, Shigella flexneri 2a str. 2457T
accuaaaaaguuauaaaua

SEQ ID NO: 3828590 - RNA, 19 nt, Shigella flexneri 2a str. 2457T
accuaaacguuuaaaaacu

SEQ ID NO: 3828591 - RNA, 13 nt, Shigella flexneri 2a str. 2457T
accuaacagcauc

SEQ ID NO: 3828592 - RNA, 18 nt, Shigella flexneri 2a str. 2457T
accuacaaacguugcuga

SEQ ID NO: 3828593 - RNA, 19 nt, Shigella flexneri 2a str. 2457T
accuacgugcgcaauaacc

SEQ ID NO: 3828594 - RNA, 15 nt, Shigella flexneri 2a str. 2457T
accuagcacuguaaa

SEQ ID NO: 3828595 - RNA, 20 nt, Shigella flexneri 2a str. 2457T
accuagcacuguaaaccucu

SEQ ID NO: 3828596 - RNA, 12 nt, Shigella flexneri 2a str. 2457T
accuauaaaaga

SEQ ID NO: 3828597 - RNA, 22 nt, Shigella flexneri 2a str. 2457T
accuaugcgugggccgcgucgg

SEQ ID NO: 3828598 - RNA, 21 nt, Shigella flexneri 2a str. 2457T
accucaccgggcuuggcacca

SEQ ID NO: 3828599 - RNA, 13 nt, Shigella flexneri 2a str. 2457T
accucacugaaaa

SEQ ID NO: 3828600 - RNA, 17 nt, Shigella flexneri 2a str. 2457T
accucacuuucuggcag

SEQ ID NO: 3828601 - RNA, 20 nt, Shigella flexneri 2a str. 2457T
accucagcgaacaggaccuu

SEQ ID NO: 3828602 - RNA, 23 nt, Shigella flexneri 2a str. 2457T
accucaguacccgcguucuggau

SEQ ID NO: 3828603 - RNA, 17 nt, Shigella flexneri 2a str. 2457T
accucaucaccacagac

SEQ ID NO: 3828604 - RNA, 22 nt, Shigella flexneri 2a str. 2457T
accucaucaccacagacaaaca

SEQ ID NO: 3828605 - RNA, 21 nt, Shigella flexneri 2a str. 2457T
accucauuaagaugcauuuau

SEQ ID NO: 3828606 - RNA, 18 nt, Shigella flexneri 2a str. 2457T
accuccacgcccagcgca

SEQ ID NO: 3828607 - RNA, 14 nt, Shigella flexneri 2a str. 2457T
accuccagcaucag

SEQ ID NO: 3828608 - RNA, 18 nt, Shigella flexneri 2a str. 2457T
accuccauguccagcuug

SEQ ID NO: 3828609 - RNA, 18 nt, Shigella flexneri 2a str. 2457T
accuccggcguuucagau

SEQ ID NO: 3828610 - RNA, 17 nt, Shigella flexneri 2a str. 2457T
accucgcccauuuuuca

SEQ ID NO: 3828611 - RNA, 23 nt, Shigella flexneri 2a str. 2457T
accucgccccgugaugaacugcg

SEQ ID NO: 3828612 - RNA, 23 nt, Shigella flexneri 2a str. 2457T
accucguccuguugaaaaaccag

SEQ ID NO: 3828613 - RNA, 23 nt, Shigella flexneri 2a str. 2457T
accucuggcgaauagaaagcaag

SEQ ID NO: 3828614 - RNA, 11 nt, Shigella flexneri 2a str. 2457T
accucuuccag

SEQ ID NO: 3828615 - RNA, 23 nt, Shigella flexneri 2a str. 2457T
accucuucggcagucacuuuuuu

SEQ ID NO: 3828616 - RNA, 13 nt, Shigella flexneri 2a str. 2457T
accucuuucuaga

SEQ ID NO: 3828617 - RNA, 12 nt, Shigella flexneri 2a str. 2457T
accugaauauua

SEQ ID NO: 3828618 - RNA, 15 nt, Shigella flexneri 2a str. 2457T
accugaauuaauuua

SEQ ID NO: 3828619 - RNA, 13 nt, Shigella flexneri 2a str. 2457T
accugacaacaaa

SEQ ID NO: 3828620 - RNA, 14 nt, Shigella flexneri 2a str. 2457T
accugaccagugaa

SEQ ID NO: 3828621 - RNA, 18 nt, Shigella flexneri 2a str. 2457T
accugacuguuccagcac

SEQ ID NO: 3828622 - RNA, 13 nt, Shigella flexneri 2a str. 2457T
accugagagugau

SEQ ID NO: 3828623 - RNA, 15 nt, Shigella flexneri 2a str. 2457T
accugaucagcaauc

SEQ ID NO: 3828624 - RNA, 13 nt, Shigella flexneri 2a str. 2457T
accugauccaucg

SEQ ID NO: 3828625 - RNA, 14 nt, Shigella flexneri 2a str. 2457T
accugaugagaugc

SEQ ID NO: 3828626 - RNA, 16 nt, Shigella flexneri 2a str. 2457T
accugaugagaugcug

SEQ ID NO: 3828627 - RNA, 23 nt, Shigella flexneri 2a str. 2457T
accugauuaaacgggucaucaaa

SEQ ID NO: 3828628 - RNA, 20 nt, Shigella flexneri 2a str. 2457T
accugauugaccgccagcgc

SEQ ID NO: 3828629 - RNA, 17 nt, Shigella flexneri 2a str. 2457T
accugcacgaaaccacu

SEQ ID NO: 3828630 - RNA, 22 nt, Shigella flexneri 2a str. 2457T
accugcacgaaaccacugcaac

SEQ ID NO: 3828631 - RNA, 16 nt, Shigella flexneri 2a str. 2457T
accugcauacaaauaa

SEQ ID NO: 3828632 - RNA, 23 nt, Shigella flexneri 2a str. 2457T
accugccagcgccgacagcagcc

SEQ ID NO: 3828633 - RNA, 22 nt, Shigella flexneri 2a str. 2457T
accugccagggagcgaaaaagc

SEQ ID NO: 3828634 - RNA, 17 nt, Shigella flexneri 2a str. 2457T
accugcgcaggcauuca

SEQ ID NO: 3828635 - RNA, 15 nt, Shigella flexneri 2a str. 2457T
accugcggugcagcc

SEQ ID NO: 3828636 - RNA, 16 nt, Shigella flexneri 2a str. 2457T
accugcggugcagccg

SEQ ID NO: 3828637 - RNA, 23 nt, Shigella flexneri 2a str. 2457T
accugcguucagcaguucugcca

SEQ ID NO: 3828638 - RNA, 11 nt, Shigella flexneri 2a str. 2457T
accugcucagc

SEQ ID NO: 3828639 - RNA, 15 nt, Shigella flexneri 2a str. 2457T
accugcucgucaucc

SEQ ID NO: 3828640 - RNA, 21 nt, Shigella flexneri 2a str. 2457T
accugcugauuauccgcauca

SEQ ID NO: 3828641 - RNA, 22 nt, Shigella flexneri 2a str. 2457T
accugcugauuaucggcaucgc

SEQ ID NO: 3828642 - RNA, 23 nt, Shigella flexneri 2a str. 2457T
accugcugauuaucggcaucgcu

SEQ ID NO: 3828643 - RNA, 22 nt, Shigella flexneri 2a str. 2457T
accugcuuaaggcagaaacaaa

SEQ ID NO: 3828644 - RNA, 18 nt, Shigella flexneri 2a str. 2457T
accuggaaauuuugcuga

SEQ ID NO: 3828645 - RNA, 14 nt, Shigella flexneri 2a str. 2457T
accuggauugccug

SEQ ID NO: 3828646 - RNA, 20 nt, Shigella flexneri 2a str. 2457T
accugggcgaugcuggcaga

SEQ ID NO: 3828647 - RNA, 21 nt, Shigella flexneri 2a str. 2457T
accuguaacguugcugcgccg

SEQ ID NO: 3828648 - RNA, 22 nt, Shigella flexneri 2a str. 2457T
accuguaguguguugcaauaca

SEQ ID NO: 3828649 - RNA, 19 nt, Shigella flexneri 2a str. 2457T
accuguccuguaggccuga

SEQ ID NO: 3828650 - RNA, 22 nt, Shigella flexneri 2a str. 2457T
accuguccuguaggccugauaa

SEQ ID NO: 3828651 - RNA, 15 nt, Shigella flexneri 2a str. 2457T
accugugccagccau

SEQ ID NO: 3828652 - RNA, 12 nt, Shigella flexneri 2a str. 2457T
accuguuuucac

SEQ ID NO: 3828653 - RNA, 21 nt, Shigella flexneri 2a str. 2457T
accuuaaucagaauuuuucgc

SEQ ID NO: 3828654 - RNA, 20 nt, Shigella flexneri 2a str. 2457T
accuuaccuguguuuugcau

SEQ ID NO: 3828655 - RNA, 21 nt, Shigella flexneri 2a str. 2457T
accuuacggcacuccucuuca

SEQ ID NO: 3828656 - RNA, 20 nt, Shigella flexneri 2a str. 2457T
accuuacuuaauuugccgca

SEQ ID NO: 3828657 - RNA, 23 nt, Shigella flexneri 2a str. 2457T
accuuacuuccgguuacgccacc

SEQ ID NO: 3828658 - RNA, 14 nt, Shigella flexneri 2a str. 2457T
accuuaucaaucuc

SEQ ID NO: 3828659 - RNA, 21 nt, Shigella flexneri 2a str. 2457T
accuuaucaaucucagcaaga

SEQ ID NO: 3828660 - RNA, 14 nt, Shigella flexneri 2a str. 2457T
accuuaucgaagag

SEQ ID NO: 3828661 - RNA, 15 nt, Shigella flexneri 2a str. 2457T
accuuaucgacaugc

SEQ ID NO: 3828662 - RNA, 23 nt, Shigella flexneri 2a str. 2457T
accuucaacacuggcaaaaucaa

SEQ ID NO: 3828663 - RNA, 12 nt, Shigella flexneri 2a str. 2457T
accuucacgcgc

SEQ ID NO: 3828664 - RNA, 20 nt, Shigella flexneri 2a str. 2457T
accuucacgcgcuccaggag

SEQ ID NO: 3828665 - RNA, 12 nt, Shigella flexneri 2a str. 2457T
acgcaaccacaa

SEQ ID NO: 3828666 - RNA, 22 nt, Shigella flexneri 2a str. 2457T
acgcaaccacaacgcacuggcg

SEQ ID NO: 3828667 - RNA, 18 nt, Shigella flexneri 2a str. 2457T
acgcaaccgcaaaugauu

SEQ ID NO: 3828668 - RNA, 15 nt, Shigella flexneri 2a str. 2457T
acgcaacuuccccuc

SEQ ID NO: 3828669 - RNA, 18 nt, Shigella flexneri 2a str. 2457T
acgcaagcggcauccagg

SEQ ID NO: 3828670 - RNA, 13 nt, Shigella flexneri 2a str. 2457T
acgcaauaccugg

SEQ ID NO: 3828671 - RNA, 15 nt, Shigella flexneri 2a str. 2457T
acgcaauauccgcca

SEQ ID NO: 3828672 - RNA, 15 nt, Shigella flexneri 2a str. 2457T
acgcaaucaaaaaag

SEQ ID NO: 3828673 - RNA, 20 nt, Shigella flexneri 2a str. 2457T
acgcaauccccucuucagcc

SEQ ID NO: 3828674 - RNA, 22 nt, Shigella flexneri 2a str. 2457T
acgcacacaugcgauaaagcau

SEQ ID NO: 3828675 - RNA, 16 nt, Shigella flexneri 2a str. 2457T
acgcacagaacaaaau

SEQ ID NO: 3828676 - RNA, 20 nt, Shigella flexneri 2a str. 2457T
acgcacagcccgccgccauc

SEQ ID NO: 3828677 - RNA, 12 nt, Shigella flexneri 2a str. 2457T
acgcaccaugca

SEQ ID NO: 3828678 - RNA, 21 nt, Shigella flexneri 2a str. 2457T
acgcacccguaacauggcggu

SEQ ID NO: 3828679 - RNA, 17 nt, Shigella flexneri 2a str. 2457T
acgcaccgccaccaccg

SEQ ID NO: 3828680 - RNA, 15 nt, Shigella flexneri 2a str. 2457T
acgcacgccugcauc

SEQ ID NO: 3828681 - RNA, 17 nt, Shigella flexneri 2a str. 2457T
acgcacgcgggugccug

SEQ ID NO: 3828682 - RNA, 14 nt, Shigella flexneri 2a str. 2457T
acgcacgcugucac

SEQ ID NO: 3828683 - RNA, 23 nt, Shigella flexneri 2a str. 2457T
acgcacuggcgagcgccagcaug

SEQ ID NO: 3828684 - RNA, 16 nt, Shigella flexneri 2a str. 2457T
acgcagaaucucugcg

SEQ ID NO: 3828685 - RNA, 22 nt, Shigella flexneri 2a str. 2457T
acgcagaaucuucuucucagcc

SEQ ID NO: 3828686 - RNA, 14 nt, Shigella flexneri 2a str. 2457T
acgcagacacugcu

SEQ ID NO: 3828687 - RNA, 23 nt, Shigella flexneri 2a str. 2457T
acgcagacacugcugauaaucca

SEQ ID NO: 3828688 - RNA, 13 nt, Shigella flexneri 2a str. 2457T
acgcagaccaaag

SEQ ID NO: 3828689 - RNA, 14 nt, Shigella flexneri 2a str. 2457T
acgcagacuggauu

SEQ ID NO: 3828690 - RNA, 16 nt, Shigella flexneri 2a str. 2457T
acgcagagacaucacc

SEQ ID NO: 3828691 - RNA, 18 nt, Shigella flexneri 2a str. 2457T
acgcagcgguauaaucug

SEQ ID NO: 3828692 - RNA, 17 nt, Shigella flexneri 2a str. 2457T
acgcagcgucagcacca

SEQ ID NO: 3828693 - RNA, 21 nt, Shigella flexneri 2a str. 2457T
acgcagcgucucauaccggau

SEQ ID NO: 3828694 - RNA, 19 nt, Shigella flexneri 2a str. 2457T
acgcaggaugcaauuguug

SEQ ID NO: 3828695 - RNA, 16 nt, Shigella flexneri 2a str. 2457T
acgcaggcgagaauca

SEQ ID NO: 3828696 - RNA, 21 nt, Shigella flexneri 2a str. 2457T
acgcagggaguuaccgugugc

SEQ ID NO: 3828697 - RNA, 22 nt, Shigella flexneri 2a str. 2457T
acgcaggucgucuuuuacagcg

SEQ ID NO: 3828698 - RNA, 15 nt, Shigella flexneri 2a str. 2457T
acgcagucuucccag

SEQ ID NO: 3828699 - RNA, 22 nt, Shigella flexneri 2a str. 2457T
acgcaguggguaaugcugugaa

SEQ ID NO: 3828700 - RNA, 16 nt, Shigella flexneri 2a str. 2457T
acgcagugguuaacaa

SEQ ID NO: 3828701 - RNA, 23 nt, Shigella flexneri 2a str. 2457T
acgcagugguuaacaaucacaau

SEQ ID NO: 3828702 - RNA, 23 nt, Shigella flexneri 2a str. 2457T
acgcaguuaacgcggauccccug

SEQ ID NO: 3828703 - RNA, 22 nt, Shigella flexneri 2a str. 2457T
acgcauaaugcgccccgcaacg

SEQ ID NO: 3828704 - RNA, 21 nt, Shigella flexneri 2a str. 2457T
acgcauacucuuugacaacau

SEQ ID NO: 3828705 - RNA, 15 nt, Shigella flexneri 2a str. 2457T
acgcauaugcaucag

SEQ ID NO: 3828706 - RNA, 21 nt, Shigella flexneri 2a str. 2457T
acgcauccgaucgcgcaucag

SEQ ID NO: 3828707 - RNA, 21 nt, Shigella flexneri 2a str. 2457T
acgcauccgcuggcccaucag

SEQ ID NO: 3828708 - RNA, 16 nt, Shigella flexneri 2a str. 2457T
acgcaucgccaaacag

SEQ ID NO: 3828709 - RNA, 15 nt, Shigella flexneri 2a str. 2457T
acgcaucgcccgguu

SEQ ID NO: 3828710 - RNA, 17 nt, Shigella flexneri 2a str. 2457T
acgcaucggcuaaacca

SEQ ID NO: 3828711 - RNA, 18 nt, Shigella flexneri 2a str. 2457T
acgcaucggcuaaaccau

SEQ ID NO: 3828712 - RNA, 17 nt, Shigella flexneri 2a str. 2457T
acgcaucuucuccggcc

SEQ ID NO: 3828713 - RNA, 22 nt, Shigella flexneri 2a str. 2457T
acgcauggacacugccggaaga

SEQ ID NO: 3828714 - RNA, 11 nt, Shigella flexneri 2a str. 2457T
acgcauucucg

SEQ ID NO: 3828715 - RNA, 21 nt, Shigella flexneri 2a str. 2457T
acgcauucucuuuucacgcaa

SEQ ID NO: 3828716 - RNA, 18 nt, Shigella flexneri 2a str. 2457T
acgccaauaccgcccaga

SEQ ID NO: 3828717 - RNA, 21 nt, Shigella flexneri 2a str. 2457T
acgccaaucugcaaaauacca

SEQ ID NO: 3828718 - RNA, 14 nt, Shigella flexneri 2a str. 2457T
acgccacaaucuca

SEQ ID NO: 3828719 - RNA, 16 nt, Shigella flexneri 2a str. 2457T
acgccacgacucaaau

SEQ ID NO: 3828720 - RNA, 13 nt, Shigella flexneri 2a str. 2457T
acgccacgcucac

SEQ ID NO: 3828721 - RNA, 17 nt, Shigella flexneri 2a str. 2457T
acgccagaacagcuaca

SEQ ID NO: 3828722 - RNA, 12 nt, Shigella flexneri 2a str. 2457T
acgccagcagca

SEQ ID NO: 3828723 - RNA, 19 nt, Shigella flexneri 2a str. 2457T
acgccagcagcagcgccaa

SEQ ID NO: 3828724 - RNA, 15 nt, Shigella flexneri 2a str. 2457T
acgccaggccacgcu

SEQ ID NO: 3828725 - RNA, 12 nt, Shigella flexneri 2a str. 2457T
acgccagucacg

SEQ ID NO: 3828726 - RNA, 17 nt, Shigella flexneri 2a str. 2457T
acgccauaccugcacaa

SEQ ID NO: 3828727 - RNA, 18 nt, Shigella flexneri 2a str. 2457T
acgccauacggcuaugaa

SEQ ID NO: 3828728 - RNA, 23 nt, Shigella flexneri 2a str. 2457T
acgccauacggcuaugaaagaaa

SEQ ID NO: 3828729 - RNA, 16 nt, Shigella flexneri 2a str. 2457T
acgccaucaucggcaa

SEQ ID NO: 3828730 - RNA, 17 nt, Shigella flexneri 2a str. 2457T
acgccaucgccagcagc

SEQ ID NO: 3828731 - RNA, 14 nt, Shigella flexneri 2a str. 2457T
acgccaucucuuua

SEQ ID NO: 3828732 - RNA, 14 nt, Shigella flexneri 2a str. 2457T
acgccaugaagaug

SEQ ID NO: 3828733 - RNA, 18 nt, Shigella flexneri 2a str. 2457T
acgccaugagcggacuga

SEQ ID NO: 3828734 - RNA, 16 nt, Shigella flexneri 2a str. 2457T
acgcccaaugcccaga

SEQ ID NO: 3828735 - RNA, 18 nt, Shigella flexneri 2a str. 2457T
acgcccacgccagccugc

SEQ ID NO: 3828736 - RNA, 14 nt, Shigella flexneri 2a str. 2457T
acgccccaacacaa

SEQ ID NO: 3828737 - RNA, 13 nt, Shigella flexneri 2a str. 2457T
acgccccggccuu

SEQ ID NO: 3828738 - RNA, 17 nt, Shigella flexneri 2a str. 2457T
acgccccuucugccgca

SEQ ID NO: 3828739 - RNA, 16 nt, Shigella flexneri 2a str. 2457T
acgcccguuguuuuau

SEQ ID NO: 3828740 - RNA, 21 nt, Shigella flexneri 2a str. 2457T
acgccgaagugcgcgcagcug

SEQ ID NO: 3828741 - RNA, 16 nt, Shigella flexneri 2a str. 2457T
acgccgaaugccgggu

SEQ ID NO: 3828742 - RNA, 13 nt, Shigella flexneri 2a str. 2457T
acgccgacggguc

SEQ ID NO: 3828743 - RNA, 19 nt, Shigella flexneri 2a str. 2457T
acgccgacgggucagcggg

SEQ ID NO: 3828744 - RNA, 15 nt, Shigella flexneri 2a str. 2457T
acgccgagcgccagc

SEQ ID NO: 3828745 - RNA, 20 nt, Shigella flexneri 2a str. 2457T
acgccgaggugcucuccacg

SEQ ID NO: 3828746 - RNA, 19 nt, Shigella flexneri 2a str. 2457T
acgccgauaaucaacgcgc

SEQ ID NO: 3828747 - RNA, 15 nt, Shigella flexneri 2a str. 2457T
acgccgcaucaggca

SEQ ID NO: 3828748 - RNA, 18 nt, Shigella flexneri 2a str. 2457T
acgccgcauccggcauaa

SEQ ID NO: 3828749 - RNA, 20 nt, Shigella flexneri 2a str. 2457T
acgccgcauccggcauuuug

SEQ ID NO: 3828750 - RNA, 15 nt, Shigella flexneri 2a str. 2457T
acgccgcccagagaa

SEQ ID NO: 3828751 - RNA, 20 nt, Shigella flexneri 2a str. 2457T
acgccgccggaaguauuuca

SEQ ID NO: 3828752 - RNA, 22 nt, Shigella flexneri 2a str. 2457T
acgccgccggaaguauuucaau

SEQ ID NO: 3828753 - RNA, 19 nt, Shigella flexneri 2a str. 2457T
acgccgccguuagcuucag

SEQ ID NO: 3828754 - RNA, 20 nt, Shigella flexneri 2a str. 2457T
acgccgccguuagcuucagc

SEQ ID NO: 3828755 - RNA, 23 nt, Shigella flexneri 2a str. 2457T
acgccgcgcccgcuaaugcgacc

SEQ ID NO: 3828756 - RNA, 19 nt, Shigella flexneri 2a str. 2457T
acgccgcuuuuuuuacguc

SEQ ID NO: 3828757 - RNA, 23 nt, Shigella flexneri 2a str. 2457T
acgccggugaccaucagcaugac

SEQ ID NO: 3828758 - RNA, 12 nt, Shigella flexneri 2a str. 2457T
acgccgguugcg

SEQ ID NO: 3828759 - RNA, 17 nt, Shigella flexneri 2a str. 2457T
acgccgucaucacaccg

SEQ ID NO: 3828760 - RNA, 20 nt, Shigella flexneri 2a str. 2457T
acgccguuauuaaaaagccu

SEQ ID NO: 3828761 - RNA, 19 nt, Shigella flexneri 2a str. 2457T
acgccguucuucagcgucc

SEQ ID NO: 3828762 - RNA, 17 nt, Shigella flexneri 2a str. 2457T
acgcugucggcaagaua

SEQ ID NO: 3828763 - RNA, 13 nt, Shigella flexneri 2a str. 2457T
acgcugucggcac

SEQ ID NO: 3828764 - RNA, 18 nt, Shigella flexneri 2a str. 2457T
acgcugucuuuugaucaa

SEQ ID NO: 3828765 - RNA, 21 nt, Shigella flexneri 2a str. 2457T
acgcuguucaucccgaccaau

SEQ ID NO: 3828766 - RNA, 15 nt, Shigella flexneri 2a str. 2457T
acgcuuaacaacccg

SEQ ID NO: 3828767 - RNA, 18 nt, Shigella flexneri 2a str. 2457T
acgcuuaucaggccuaca

SEQ ID NO: 3828768 - RNA, 19 nt, Shigella flexneri 2a str. 2457T
acgcuuaucaggccuacaa

SEQ ID NO: 3828769 - RNA, 19 nt, Shigella flexneri 2a str. 2457T
acgcuucaaucugauauuu

SEQ ID NO: 3828770 - RNA, 17 nt, Shigella flexneri 2a str. 2457T
acgcuucucccagccgc

SEQ ID NO: 3828771 - RNA, 20 nt, Shigella flexneri 2a str. 2457T
acgcuugauucuguucagua

SEQ ID NO: 3828772 - RNA, 22 nt, Shigella flexneri 2a str. 2457T
acgcuuucaacaaccuugcguu

SEQ ID NO: 3828773 - RNA, 14 nt, Shigella flexneri 2a str. 2457T
acgcuuucacccgg

SEQ ID NO: 3828774 - RNA, 13 nt, Shigella flexneri 2a str. 2457T
acgcuuucuuugg

SEQ ID NO: 3828775 - RNA, 16 nt, Shigella flexneri 2a str. 2457T
acgcuuugcaggcugg

SEQ ID NO: 3828776 - RNA, 22 nt, Shigella flexneri 2a str. 2457T
acgcuuuuucccugguaaaaaa

SEQ ID NO: 3828777 - RNA, 19 nt, Shigella flexneri 2a str. 2457T
acggaaaucauccagcacg

SEQ ID NO: 3828778 - RNA, 14 nt, Shigella flexneri 2a str. 2457T
acggaacguugccu

SEQ ID NO: 3828779 - RNA, 23 nt, Shigella flexneri 2a str. 2457T
acggaacguugccugauuuuauu

SEQ ID NO: 3828780 - RNA, 11 nt, Shigella flexneri 2a str. 2457T
acggacaugaa

SEQ ID NO: 3828781 - RNA, 13 nt, Shigella flexneri 2a str. 2457T
acggaccaauaaa

SEQ ID NO: 3828782 - RNA, 23 nt, Shigella flexneri 2a str. 2457T
acggacguccggugauaucggcc

SEQ ID NO: 3828783 - RNA, 22 nt, Shigella flexneri 2a str. 2457T
acggacucggcgucgguaaaga

SEQ ID NO: 3828784 - RNA, 20 nt, Shigella flexneri 2a str. 2457T
acggagauauccagcgccga

SEQ ID NO: 3828785 - RNA, 22 nt, Shigella flexneri 2a str. 2457T
acggagcaggcguuaaaacagg

SEQ ID NO: 3828786 - RNA, 17 nt, Shigella flexneri 2a str. 2457T
acggaguugaccagcuc

SEQ ID NO: 3828787 - RNA, 13 nt, Shigella flexneri 2a str. 2457T
acggaugcgaaug

SEQ ID NO: 3828788 - RNA, 15 nt, Shigella flexneri 2a str. 2457T
acggauucagugagc

SEQ ID NO: 3828789 - RNA, 22 nt, Shigella flexneri 2a str. 2457T
acggauugcuuguucgaugccu

SEQ ID NO: 3828790 - RNA, 11 nt, Shigella flexneri 2a str. 2457T
acggcaagauc

SEQ ID NO: 3828791 - RNA, 13 nt, Shigella flexneri 2a str. 2457T
acggcaauaccug

SEQ ID NO: 3828792 - RNA, 17 nt, Shigella flexneri 2a str. 2457T
acggcaauucccagaau

SEQ ID NO: 3828793 - RNA, 19 nt, Shigella flexneri 2a str. 2457T
acggcaauucccagaaugu

SEQ ID NO: 3828794 - RNA, 22 nt, Shigella flexneri 2a str. 2457T
acggcaauucccagaauguuaa

SEQ ID NO: 3828795 - RNA, 21 nt, Shigella flexneri 2a str. 2457T
acggcaauuuuaccuagcacu

SEQ ID NO: 3828796 - RNA, 12 nt, Shigella flexneri 2a str. 2457T
acggcaccaccc

SEQ ID NO: 3828797 - RNA, 13 nt, Shigella flexneri 2a str. 2457T
acggcacgauaaa

SEQ ID NO: 3828798 - RNA, 18 nt, Shigella flexneri 2a str. 2457T
acggcacggaaagcagca

SEQ ID NO: 3828799 - RNA, 18 nt, Shigella flexneri 2a str. 2457T
acggcacucgcuggcacu

SEQ ID NO: 3828800 - RNA, 21 nt, Shigella flexneri 2a str. 2457T
acggcagaaguaguugcuguc

SEQ ID NO: 3828801 - RNA, 15 nt, Shigella flexneri 2a str. 2457T
acggcagagaucgcc

SEQ ID NO: 3828802 - RNA, 18 nt, Shigella flexneri 2a str. 2457T
acggcagagaucgccgcu

SEQ ID NO: 3828803 - RNA, 19 nt, Shigella flexneri 2a str. 2457T
acggcagcaacggcaguuu

SEQ ID NO: 3828804 - RNA, 13 nt, Shigella flexneri 2a str. 2457T
acggcagugaaca

SEQ ID NO: 3828805 - RNA, 13 nt, Shigella flexneri 2a str. 2457T
acggcagugaacg

SEQ ID NO: 3828806 - RNA, 18 nt, Shigella flexneri 2a str. 2457T
acggcaucccaacucauu

SEQ ID NO: 3828807 - RNA, 13 nt, Shigella flexneri 2a str. 2457T
acggcaucgccau

SEQ ID NO: 3828808 - RNA, 13 nt, Shigella flexneri 2a str. 2457T
acggcauuauuca

SEQ ID NO: 3828809 - RNA, 19 nt, Shigella flexneri 2a str. 2457T
acggcauuuccgccaauca

SEQ ID NO: 3828810 - RNA, 16 nt, Shigella flexneri 2a str. 2457T
acggcauuuugcugau

SEQ ID NO: 3828811 - RNA, 18 nt, Shigella flexneri 2a str. 2457T
acggcauuuugcugaugc

SEQ ID NO: 3828812 - RNA, 16 nt, Shigella flexneri 2a str. 2457T
acggccacagccagcc

SEQ ID NO: 3828813 - RNA, 18 nt, Shigella flexneri 2a str. 2457T
acggcccugugccugcgu

SEQ ID NO: 3828814 - RNA, 18 nt, Shigella flexneri 2a str. 2457T
acggcgaaucaaccgcgc

SEQ ID NO: 3828815 - RNA, 17 nt, Shigella flexneri 2a str. 2457T
acggcgagccagcgcau

SEQ ID NO: 3828816 - RNA, 23 nt, Shigella flexneri 2a str. 2457T
acggcgcagcuucacaaaggcuu

SEQ ID NO: 3828817 - RNA, 14 nt, Shigella flexneri 2a str. 2457T
acggcgcauugcca

SEQ ID NO: 3828818 - RNA, 15 nt, Shigella flexneri 2a str. 2457T
acggcgcauugccag

SEQ ID NO: 3828819 - RNA, 11 nt, Shigella flexneri 2a str. 2457T
acggcgcuaaa

SEQ ID NO: 3828820 - RNA, 19 nt, Shigella flexneri 2a str. 2457T
acggcgcuaaaaagcgccg

SEQ ID NO: 3828821 - RNA, 23 nt, Shigella flexneri 2a str. 2457T
acggcgcuuuuuuugugccugaa

SEQ ID NO: 3828822 - RNA, 14 nt, Shigella flexneri 2a str. 2457T
acggcguauugcau

SEQ ID NO: 3828823 - RNA, 19 nt, Shigella flexneri 2a str. 2457T
acggcgugcugaugcacga

SEQ ID NO: 3828824 - RNA, 17 nt, Shigella flexneri 2a str. 2457T
acggcguggcaucaaua

SEQ ID NO: 3828825 - RNA, 17 nt, Shigella flexneri 2a str. 2457T
acggcguuuccagcucg

SEQ ID NO: 3828826 - RNA, 13 nt, Shigella flexneri 2a str. 2457T
acggcuaaaaaaa

SEQ ID NO: 3828827 - RNA, 14 nt, Shigella flexneri 2a str. 2457T
acggcuaaagccgu

SEQ ID NO: 3828828 - RNA, 17 nt, Shigella flexneri 2a str. 2457T
acggcucacgcccauca

SEQ ID NO: 3828829 - RNA, 14 nt, Shigella flexneri 2a str. 2457T
acggcucagcucug

SEQ ID NO: 3828830 - RNA, 18 nt, Shigella flexneri 2a str. 2457T
acggcugauggcgccagu

SEQ ID NO: 3828831 - RNA, 15 nt, Shigella flexneri 2a str. 2457T
acggcugcauuauga

SEQ ID NO: 3828832 - RNA, 22 nt, Shigella flexneri 2a str. 2457T
acggcugcugcuuucgccgcga

SEQ ID NO: 3828833 - RNA, 18 nt, Shigella flexneri 2a str. 2457T
acggcugcuucggucagc

SEQ ID NO: 3828834 - RNA, 19 nt, Shigella flexneri 2a str. 2457T
acggcugucauccagcagc

SEQ ID NO: 3828835 - RNA, 18 nt, Shigella flexneri 2a str. 2457T
acggcuucgccaaaucgc

SEQ ID NO: 3828836 - RNA, 20 nt, Shigella flexneri 2a str. 2457T
acggcuucgccuccuguucu

SEQ ID NO: 3828837 - RNA, 19 nt, Shigella flexneri 2a str. 2457T
acggcuugcgcgcaaucag

SEQ ID NO: 3828838 - RNA, 18 nt, Shigella flexneri 2a str. 2457T
acgggaaacucugcuggc

SEQ ID NO: 3828839 - RNA, 20 nt, Shigella flexneri 2a str. 2457T
acgggagaaacccggccaca

SEQ ID NO: 3828840 - RNA, 17 nt, Shigella flexneri 2a str. 2457T
acgggcaagccagcaua

SEQ ID NO: 3828841 - RNA, 14 nt, Shigella flexneri 2a str. 2457T
acgggcaaucucau

SEQ ID NO: 3828842 - RNA, 14 nt, Shigella flexneri 2a str. 2457T
acgggcaaucuccu

SEQ ID NO: 3828843 - RNA, 22 nt, Shigella flexneri 2a str. 2457T
acgggcaauuucacguucaccc

SEQ ID NO: 3828844 - RNA, 13 nt, Shigella flexneri 2a str. 2457T
acgggcauggugu

SEQ ID NO: 3828845 - RNA, 15 nt, Shigella flexneri 2a str. 2457T
acgggccauccauca

SEQ ID NO: 3828846 - RNA, 19 nt, Shigella flexneri 2a str. 2457T
acggggcugccagcucuca

SEQ ID NO: 3828847 - RNA, 17 nt, Shigella flexneri 2a str. 2457T
acggggugcgguaaaac

SEQ ID NO: 3828848 - RNA, 16 nt, Shigella flexneri 2a str. 2457T
acggguauuuacaucu

SEQ ID NO: 3828849 - RNA, 18 nt, Shigella flexneri 2a str. 2457T
acgggugauuaaagaaaa

SEQ ID NO: 3828850 - RNA, 14 nt, Shigella flexneri 2a str. 2457T
acggguucaagucc

SEQ ID NO: 3828851 - RNA, 23 nt, Shigella flexneri 2a str. 2457T
acgguaaccccucuucagccccg

SEQ ID NO: 3828852 - RNA, 16 nt, Shigella flexneri 2a str. 2457T
acgguacucaucacgu

SEQ ID NO: 3828853 - RNA, 16 nt, Shigella flexneri 2a str. 2457T
acgguaggucacuuuu

SEQ ID NO: 3828854 - RNA, 21 nt, Shigella flexneri 2a str. 2457T
acgguaguggcaaccagcaga

SEQ ID NO: 3828855 - RNA, 17 nt, Shigella flexneri 2a str. 2457T
acgguaucuuuccagcc

SEQ ID NO: 3828856 - RNA, 14 nt, Shigella flexneri 2a str. 2457T
acggucacggcugu

SEQ ID NO: 3828857 - RNA, 17 nt, Shigella flexneri 2a str. 2457T
acggucaggcuaaagaa

SEQ ID NO: 3828858 - RNA, 20 nt, Shigella flexneri 2a str. 2457T
acggucaggcuaaagaaaac

SEQ ID NO: 3828859 - RNA, 22 nt, Shigella flexneri 2a str. 2457T
acggucccucaacaacagucuc

SEQ ID NO: 3828860 - RNA, 15 nt, Shigella flexneri 2a str. 2457T
acguucuccugaagu

SEQ ID NO: 3828861 - RNA, 19 nt, Shigella flexneri 2a str. 2457T
acguucucuuucaggccgc

SEQ ID NO: 3828862 - RNA, 20 nt, Shigella flexneri 2a str. 2457T
acguucugaucuuucuucag

SEQ ID NO: 3828863 - RNA, 19 nt, Shigella flexneri 2a str. 2457T
acguucugcguaauguuua

SEQ ID NO: 3828864 - RNA, 16 nt, Shigella flexneri 2a str. 2457T
acguucuuacauuccg

SEQ ID NO: 3828865 - RNA, 17 nt, Shigella flexneri 2a str. 2457T
acguucuuccuguggau

SEQ ID NO: 3828866 - RNA, 20 nt, Shigella flexneri 2a str. 2457T
acguugcauaaaugccgcaa

SEQ ID NO: 3828867 - RNA, 22 nt, Shigella flexneri 2a str. 2457T
acguugccguaugcgccacagg

SEQ ID NO: 3828868 - RNA, 14 nt, Shigella flexneri 2a str. 2457T
acguugcgcuuccc

SEQ ID NO: 3828869 - RNA, 18 nt, Shigella flexneri 2a str. 2457T
acguugcguugcagcagg

SEQ ID NO: 3828870 - RNA, 18 nt, Shigella flexneri 2a str. 2457T
acguugcucaaggguuuc

SEQ ID NO: 3828871 - RNA, 17 nt, Shigella flexneri 2a str. 2457T
acguuggcgcauaacuc

SEQ ID NO: 3828872 - RNA, 16 nt, Shigella flexneri 2a str. 2457T
acguugucaguucuuu

SEQ ID NO: 3828873 - RNA, 22 nt, Shigella flexneri 2a str. 2457T
acguuguuccuuccagcuggcu

SEQ ID NO: 3828874 - RNA, 17 nt, Shigella flexneri 2a str. 2457T
acguuuaacacgcucug

SEQ ID NO: 3828875 - RNA, 14 nt, Shigella flexneri 2a str. 2457T
acguuuacuucgcu

SEQ ID NO: 3828876 - RNA, 18 nt, Shigella flexneri 2a str. 2457T
acguuucaaacaggcugc

SEQ ID NO: 3828877 - RNA, 19 nt, Shigella flexneri 2a str. 2457T
acguuucaaccugcacauc

SEQ ID NO: 3828878 - RNA, 17 nt, Shigella flexneri 2a str. 2457T
acguuucacugccggac

SEQ ID NO: 3828879 - RNA, 15 nt, Shigella flexneri 2a str. 2457T
acguuucuggugugc

SEQ ID NO: 3828880 - RNA, 16 nt, Shigella flexneri 2a str. 2457T
acguuucuggugugca

SEQ ID NO: 3828881 - RNA, 17 nt, Shigella flexneri 2a str. 2457T
acguuuggucagaucag

SEQ ID NO: 3828882 - RNA, 19 nt, Shigella flexneri 2a str. 2457T
acguuuuaaaccuacgugc

SEQ ID NO: 3828883 - RNA, 20 nt, Shigella flexneri 2a str. 2457T
acguuuugcaauuucccuga

SEQ ID NO: 3828884 - RNA, 13 nt, Shigella flexneri 2a str. 2457T
acguuuugcugau

SEQ ID NO: 3828885 - RNA, 14 nt, Shigella flexneri 2a str. 2457T
acguuuuucgaaaa

SEQ ID NO: 3828886 - RNA, 16 nt, Shigella flexneri 2a str. 2457T
acuaaaacuuuauuca

SEQ ID NO: 3828887 - RNA, 17 nt, Shigella flexneri 2a str. 2457T
acuaaacccgaccacuu

SEQ ID NO: 3828888 - RNA, 18 nt, Shigella flexneri 2a str. 2457T
acuaaagccuuuugccag

SEQ ID NO: 3828889 - RNA, 17 nt, Shigella flexneri 2a str. 2457T
acuaaauacauuaguaa

SEQ ID NO: 3828890 - RNA, 13 nt, Shigella flexneri 2a str. 2457T
acuaaaugugcaa

SEQ ID NO: 3828891 - RNA, 13 nt, Shigella flexneri 2a str. 2457T
acuaacagaacaa

SEQ ID NO: 3828892 - RNA, 16 nt, Shigella flexneri 2a str. 2457T
acuaacggaauugcca

SEQ ID NO: 3828893 - RNA, 23 nt, Shigella flexneri 2a str. 2457T
acuaacuucugaucuacagccuu

SEQ ID NO: 3828894 - RNA, 17 nt, Shigella flexneri 2a str. 2457T
acuaaggcgaacauaag

SEQ ID NO: 3828895 - RNA, 23 nt, Shigella flexneri 2a str. 2457T
acuaauccguaaaguuaccugug

SEQ ID NO: 3828896 - RNA, 23 nt, Shigella flexneri 2a str. 2457T
acuaaucgacaguugcugcguga

SEQ ID NO: 3828897 - RNA, 16 nt, Shigella flexneri 2a str. 2457T
acuacaaauccaacac

SEQ ID NO: 3828898 - RNA, 15 nt, Shigella flexneri 2a str. 2457T
acuacaaccgggauc

SEQ ID NO: 3828899 - RNA, 17 nt, Shigella flexneri 2a str. 2457T
acuacaggacaucuuga

SEQ ID NO: 3828900 - RNA, 15 nt, Shigella flexneri 2a str. 2457T
acuaccauccgaguu

SEQ ID NO: 3828901 - RNA, 19 nt, Shigella flexneri 2a str. 2457T
acuaccauuuguucuuuuu

SEQ ID NO: 3828902 - RNA, 20 nt, Shigella flexneri 2a str. 2457T
acuaccauuuguucuuuuuu

SEQ ID NO: 3828903 - RNA, 18 nt, Shigella flexneri 2a str. 2457T
acuacgccaacagaagug

SEQ ID NO: 3828904 - RNA, 22 nt, Shigella flexneri 2a str. 2457T
acuacggcuucugacauaacca

SEQ ID NO: 3828905 - RNA, 23 nt, Shigella flexneri 2a str. 2457T
acuacggcuucugacauaaccac

SEQ ID NO: 3828906 - RNA, 20 nt, Shigella flexneri 2a str. 2457T
acuacgguguaaccugccug

SEQ ID NO: 3828907 - RNA, 21 nt, Shigella flexneri 2a str. 2457T
acuacgugaucgucuucaacc

SEQ ID NO: 3828908 - RNA, 14 nt, Shigella flexneri 2a str. 2457T
acuacguucaauca

SEQ ID NO: 3828909 - RNA, 19 nt, Shigella flexneri 2a str. 2457T
acuagacgaugaaaaagaa

SEQ ID NO: 3828910 - RNA, 14 nt, Shigella flexneri 2a str. 2457T
acuauccgccgcuu

SEQ ID NO: 3828911 - RNA, 17 nt, Shigella flexneri 2a str. 2457T
acuauccuggacuuuaa

SEQ ID NO: 3828912 - RNA, 19 nt, Shigella flexneri 2a str. 2457T
acuaucgaaaguuuaccag

SEQ ID NO: 3828913 - RNA, 18 nt, Shigella flexneri 2a str. 2457T
acuaucgcugagauacuc

SEQ ID NO: 3828914 - RNA, 19 nt, Shigella flexneri 2a str. 2457T
acuaugacugccacaaggg

SEQ ID NO: 3828915 - RNA, 23 nt, Shigella flexneri 2a str. 2457T
acuauuaguuuguugaaguuuau

SEQ ID NO: 3828916 - RNA, 12 nt, Shigella flexneri 2a str. 2457T
acuauucagcuc

SEQ ID NO: 3828917 - RNA, 13 nt, Shigella flexneri 2a str. 2457T
acuauucagcucu

SEQ ID NO: 3828918 - RNA, 14 nt, Shigella flexneri 2a str. 2457T
acuauuucuuugua

SEQ ID NO: 3828919 - RNA, 18 nt, Shigella flexneri 2a str. 2457T
acucaaaaauaaucaucu

SEQ ID NO: 3828920 - RNA, 17 nt, Shigella flexneri 2a str. 2457T
acucaaaccccgcagca

SEQ ID NO: 3828921 - RNA, 13 nt, Shigella flexneri 2a str. 2457T
acucaaagucgag

SEQ ID NO: 3828922 - RNA, 13 nt, Shigella flexneri 2a str. 2457T
acucaaaucacgc

SEQ ID NO: 3828923 - RNA, 17 nt, Shigella flexneri 2a str. 2457T
acucaacaaccagaagg

SEQ ID NO: 3828924 - RNA, 14 nt, Shigella flexneri 2a str. 2457T
acucaaccccagcc

SEQ ID NO: 3828925 - RNA, 13 nt, Shigella flexneri 2a str. 2457T
acucaaccgccac

SEQ ID NO: 3828926 - RNA, 17 nt, Shigella flexneri 2a str. 2457T
acucaacuuuaccuuca

SEQ ID NO: 3828927 - RNA, 12 nt, Shigella flexneri 2a str. 2457T
acucaauaccug

SEQ ID NO: 3828928 - RNA, 16 nt, Shigella flexneri 2a str. 2457T
acucaauaccugauga

SEQ ID NO: 3828929 - RNA, 12 nt, Shigella flexneri 2a str. 2457T
acucacagggcu

SEQ ID NO: 3828930 - RNA, 21 nt, Shigella flexneri 2a str. 2457T
acucaccagacaucccagugc

SEQ ID NO: 3828931 - RNA, 17 nt, Shigella flexneri 2a str. 2457T
acucaccgagcagcaca

SEQ ID NO: 3828932 - RNA, 14 nt, Shigella flexneri 2a str. 2457T
acucaccgaugauc

SEQ ID NO: 3828933 - RNA, 19 nt, Shigella flexneri 2a str. 2457T
acucaccgaugaucgccau

SEQ ID NO: 3828934 - RNA, 18 nt, Shigella flexneri 2a str. 2457T
acucaccgggcaucucag

SEQ ID NO: 3828935 - RNA, 13 nt, Shigella flexneri 2a str. 2457T
acucaccuuuaaa

SEQ ID NO: 3828936 - RNA, 21 nt, Shigella flexneri 2a str. 2457T
acucaccuuuuuuguuguuau

SEQ ID NO: 3828937 - RNA, 16 nt, Shigella flexneri 2a str. 2457T
acucacgauuguuaau

SEQ ID NO: 3828938 - RNA, 15 nt, Shigella flexneri 2a str. 2457T
acucacgccagcagc

SEQ ID NO: 3828939 - RNA, 22 nt, Shigella flexneri 2a str. 2457T
acucagccaaaucccgugaugc

SEQ ID NO: 3828940 - RNA, 12 nt, Shigella flexneri 2a str. 2457T
acucagcgcugc

SEQ ID NO: 3828941 - RNA, 13 nt, Shigella flexneri 2a str. 2457T
acucagcggcugc

SEQ ID NO: 3828942 - RNA, 18 nt, Shigella flexneri 2a str. 2457T
acucagcggcugccagca

SEQ ID NO: 3828943 - RNA, 16 nt, Shigella flexneri 2a str. 2457T
acucauaaauacucca

SEQ ID NO: 3828944 - RNA, 19 nt, Shigella flexneri 2a str. 2457T
acucauaaauucaaagugu

SEQ ID NO: 3828945 - RNA, 19 nt, Shigella flexneri 2a str. 2457T
acucaucaacguuuuuuug

SEQ ID NO: 3828946 - RNA, 17 nt, Shigella flexneri 2a str. 2457T
acucaucacuguaggcc

SEQ ID NO: 3828947 - RNA, 15 nt, Shigella flexneri 2a str. 2457T
acucauccacugccu

SEQ ID NO: 3828948 - RNA, 20 nt, Shigella flexneri 2a str. 2457T
acucaucuuauugaucaucc

SEQ ID NO: 3828949 - RNA, 16 nt, Shigella flexneri 2a str. 2457T
acucaugggucugcgg

SEQ ID NO: 3828950 - RNA, 14 nt, Shigella flexneri 2a str. 2457T
acucauugccaguc

SEQ ID NO: 3828951 - RNA, 13 nt, Shigella flexneri 2a str. 2457T
acucauuuacaga

SEQ ID NO: 3828952 - RNA, 14 nt, Shigella flexneri 2a str. 2457T
acucauuuuuuaau

SEQ ID NO: 3828953 - RNA, 14 nt, Shigella flexneri 2a str. 2457T
acuccaacccggca

SEQ ID NO: 3828954 - RNA, 14 nt, Shigella flexneri 2a str. 2457T
acuccaccagcacc

SEQ ID NO: 3828955 - RNA, 16 nt, Shigella flexneri 2a str. 2457T
acuccacuccugcuau

SEQ ID NO: 3828956 - RNA, 15 nt, Shigella flexneri 2a str. 2457T
acuccacuuccugcc

SEQ ID NO: 3828957 - RNA, 12 nt, Shigella flexneri 2a str. 2457T
acuccagaauac

SEQ ID NO: 3828958 - RNA, 13 nt, Shigella flexneri 2a str. 2457T
acugccaccaucc

SEQ ID NO: 3828959 - RNA, 22 nt, Shigella flexneri 2a str. 2457T
acugccagaauagccgcagcca

SEQ ID NO: 3828960 - RNA, 14 nt, Shigella flexneri 2a str. 2457T
acugccaucuuccg

SEQ ID NO: 3828961 - RNA, 23 nt, Shigella flexneri 2a str. 2457T
acugccaugaccgcuccgccauc

SEQ ID NO: 3828962 - RNA, 13 nt, Shigella flexneri 2a str. 2457T
acugccggaagag

SEQ ID NO: 3828963 - RNA, 15 nt, Shigella flexneri 2a str. 2457T
acugccggaugcggc

SEQ ID NO: 3828964 - RNA, 20 nt, Shigella flexneri 2a str. 2457T
acugccggaugcggcgugaa

SEQ ID NO: 3828965 - RNA, 19 nt, Shigella flexneri 2a str. 2457T
acugcgaccguacaaccaa

SEQ ID NO: 3828966 - RNA, 17 nt, Shigella flexneri 2a str. 2457T
acugcgacguggaucaa

SEQ ID NO: 3828967 - RNA, 20 nt, Shigella flexneri 2a str. 2457T
acugcgagaaguucugcagc

SEQ ID NO: 3828968 - RNA, 13 nt, Shigella flexneri 2a str. 2457T
acugcgagcaaaa

SEQ ID NO: 3828969 - RNA, 14 nt, Shigella flexneri 2a str. 2457T
acugcgagcaaaau

SEQ ID NO: 3828970 - RNA, 17 nt, Shigella flexneri 2a str. 2457T
acugcgaugggagcagc

SEQ ID NO: 3828971 - RNA, 23 nt, Shigella flexneri 2a str. 2457T
acugcgaugggagcagccagcca

SEQ ID NO: 3828972 - RNA, 18 nt, Shigella flexneri 2a str. 2457T
acugcgccacgguguugu

SEQ ID NO: 3828973 - RNA, 16 nt, Shigella flexneri 2a str. 2457T
acugcgccagcgucau

SEQ ID NO: 3828974 - RNA, 18 nt, Shigella flexneri 2a str. 2457T
acugcgccagcgucauca

SEQ ID NO: 3828975 - RNA, 15 nt, Shigella flexneri 2a str. 2457T
acugcgccaucaaug

SEQ ID NO: 3828976 - RNA, 14 nt, Shigella flexneri 2a str. 2457T
acugcgccgcucag

SEQ ID NO: 3828977 - RNA, 16 nt, Shigella flexneri 2a str. 2457T
acugcgccgcucagua

SEQ ID NO: 3828978 - RNA, 19 nt, Shigella flexneri 2a str. 2457T
acugcgccucaacauacaa

SEQ ID NO: 3828979 - RNA, 17 nt, Shigella flexneri 2a str. 2457T
acugcgccugcaggauc

SEQ ID NO: 3828980 - RNA, 22 nt, Shigella flexneri 2a str. 2457T
acugcgcgagcgucauauagcc

SEQ ID NO: 3828981 - RNA, 19 nt, Shigella flexneri 2a str. 2457T
acugcgcgauuaucauuuu

SEQ ID NO: 3828982 - RNA, 18 nt, Shigella flexneri 2a str. 2457T
acugcgcgccgcgcugcu

SEQ ID NO: 3828983 - RNA, 20 nt, Shigella flexneri 2a str. 2457T
acugcgcguuaaagagcauu

SEQ ID NO: 3828984 - RNA, 15 nt, Shigella flexneri 2a str. 2457T
acugcgcuaccagga

SEQ ID NO: 3828985 - RNA, 16 nt, Shigella flexneri 2a str. 2457T
acugcgcugcauuacu

SEQ ID NO: 3828986 - RNA, 13 nt, Shigella flexneri 2a str. 2457T
acugcgggauuuc

SEQ ID NO: 3828987 - RNA, 23 nt, Shigella flexneri 2a str. 2457T
acugcgggcgaaaguguaaagca

SEQ ID NO: 3828988 - RNA, 20 nt, Shigella flexneri 2a str. 2457T
acugcggucuaaaucuuccg

SEQ ID NO: 3828989 - RNA, 15 nt, Shigella flexneri 2a str. 2457T
acugcgguucagcuu

SEQ ID NO: 3828990 - RNA, 21 nt, Shigella flexneri 2a str. 2457T
acugcgugucguaagccaccg

SEQ ID NO: 3828991 - RNA, 22 nt, Shigella flexneri 2a str. 2457T
acugcgugucguaagccaccgc

SEQ ID NO: 3828992 - RNA, 20 nt, Shigella flexneri 2a str. 2457T
acugcguuucuggcuuaaac

SEQ ID NO: 3828993 - RNA, 19 nt, Shigella flexneri 2a str. 2457T
acugcucagcuccucuuuc

SEQ ID NO: 3828994 - RNA, 17 nt, Shigella flexneri 2a str. 2457T
acugcuccauaauugcc

SEQ ID NO: 3828995 - RNA, 18 nt, Shigella flexneri 2a str. 2457T
acugcuccggcuuuuuag

SEQ ID NO: 3828996 - RNA, 18 nt, Shigella flexneri 2a str. 2457T
acugcuccuguaugaccc

SEQ ID NO: 3828997 - RNA, 14 nt, Shigella flexneri 2a str. 2457T
acugcugacgcaga

SEQ ID NO: 3828998 - RNA, 21 nt, Shigella flexneri 2a str. 2457T
acugcugauguuguuucucuu

SEQ ID NO: 3828999 - RNA, 13 nt, Shigella flexneri 2a str. 2457T
acugcugcauccg

SEQ ID NO: 3829000 - RNA, 16 nt, Shigella flexneri 2a str. 2457T
acugcuggaagcuggc

SEQ ID NO: 3829001 - RNA, 15 nt, Shigella flexneri 2a str. 2457T
acugcuuaacugcgc

SEQ ID NO: 3829002 - RNA, 14 nt, Shigella flexneri 2a str. 2457T
acugcuuaauauua

SEQ ID NO: 3829003 - RNA, 14 nt, Shigella flexneri 2a str. 2457T
acugcuuacaggcu

SEQ ID NO: 3829004 - RNA, 16 nt, Shigella flexneri 2a str. 2457T
acugcuuacaggcugg

SEQ ID NO: 3829005 - RNA, 14 nt, Shigella flexneri 2a str. 2457T
acugcuuaucauca

SEQ ID NO: 3829006 - RNA, 22 nt, Shigella flexneri 2a str. 2457T
acugcuuaucaucacgcaucac

SEQ ID NO: 3829007 - RNA, 13 nt, Shigella flexneri 2a str. 2457T
acugcuugaagcg

SEQ ID NO: 3829008 - RNA, 14 nt, Shigella flexneri 2a str. 2457T
acugcuugaagcgc

SEQ ID NO: 3829009 - RNA, 17 nt, Shigella flexneri 2a str. 2457T
acugcuuuuuaaucucc

SEQ ID NO: 3829010 - RNA, 13 nt, Shigella flexneri 2a str. 2457T
acuggaaaucaaa

SEQ ID NO: 3829011 - RNA, 13 nt, Shigella flexneri 2a str. 2457T
acuggauagauau

SEQ ID NO: 3829012 - RNA, 14 nt, Shigella flexneri 2a str. 2457T
acuggaugaaaaaa

SEQ ID NO: 3829013 - RNA, 11 nt, Shigella flexneri 2a str. 2457T
acuggcaaaag

SEQ ID NO: 3829014 - RNA, 16 nt, Shigella flexneri 2a str. 2457T
acuggcaaaugacaua

SEQ ID NO: 3829015 - RNA, 14 nt, Shigella flexneri 2a str. 2457T
acuggcaaccagaa

SEQ ID NO: 3829016 - RNA, 13 nt, Shigella flexneri 2a str. 2457T
acuggcaauccag

SEQ ID NO: 3829017 - RNA, 23 nt, Shigella flexneri 2a str. 2457T
acuggcaaucgccagcggcagcu

SEQ ID NO: 3829018 - RNA, 12 nt, Shigella flexneri 2a str. 2457T
acuggcaaugac

SEQ ID NO: 3829019 - RNA, 18 nt, Shigella flexneri 2a str. 2457T
acuggcaaugacgggcuu

SEQ ID NO: 3829020 - RNA, 17 nt, Shigella flexneri 2a str. 2457T
acuggcagagaaagaaa

SEQ ID NO: 3829021 - RNA, 18 nt, Shigella flexneri 2a str. 2457T
acuggcagccaggcgcga

SEQ ID NO: 3829022 - RNA, 23 nt, Shigella flexneri 2a str. 2457T
acuggcaugccgguagaagccag

SEQ ID NO: 3829023 - RNA, 17 nt, Shigella flexneri 2a str. 2457T
acuggcgacgcguaugu

SEQ ID NO: 3829024 - RNA, 18 nt, Shigella flexneri 2a str. 2457T
acuggcgcgagccuguuu

SEQ ID NO: 3829025 - RNA, 19 nt, Shigella flexneri 2a str. 2457T
acuggcggaugugcuggau

SEQ ID NO: 3829026 - RNA, 12 nt, Shigella flexneri 2a str. 2457T
acuggcggcaaa

SEQ ID NO: 3829027 - RNA, 14 nt, Shigella flexneri 2a str. 2457T
acuggcggcaaaaa

SEQ ID NO: 3829028 - RNA, 23 nt, Shigella flexneri 2a str. 2457T
acuggcggcaaaacuggguuauc

SEQ ID NO: 3829029 - RNA, 13 nt, Shigella flexneri 2a str. 2457T
acuggcgugggca

SEQ ID NO: 3829030 - RNA, 14 nt, Shigella flexneri 2a str. 2457T
acuggcuaagaagc

SEQ ID NO: 3829031 - RNA, 18 nt, Shigella flexneri 2a str. 2457T
acuggcuacugucuaaaa

SEQ ID NO: 3829032 - RNA, 14 nt, Shigella flexneri 2a str. 2457T
acuggcucuuuuuc

SEQ ID NO: 3829033 - RNA, 18 nt, Shigella flexneri 2a str. 2457T
acuggcuggcuaaauauu

SEQ ID NO: 3829034 - RNA, 13 nt, Shigella flexneri 2a str. 2457T
acuggcuugguaa

SEQ ID NO: 3829035 - RNA, 22 nt, Shigella flexneri 2a str. 2457T
acugggaaauuggccgacggau

SEQ ID NO: 3829036 - RNA, 13 nt, Shigella flexneri 2a str. 2457T
acugggcgauuaa

SEQ ID NO: 3829037 - RNA, 17 nt, Shigella flexneri 2a str. 2457T
acugggcgauuaauaaa

SEQ ID NO: 3829038 - RNA, 16 nt, Shigella flexneri 2a str. 2457T
acugggucaguaugga

SEQ ID NO: 3829039 - RNA, 22 nt, Shigella flexneri 2a str. 2457T
acugggucaguauggaucaaau

SEQ ID NO: 3829040 - RNA, 13 nt, Shigella flexneri 2a str. 2457T
acugguacucaac

SEQ ID NO: 3829041 - RNA, 19 nt, Shigella flexneri 2a str. 2457T
acugguagcuguagguaaa

SEQ ID NO: 3829042 - RNA, 21 nt, Shigella flexneri 2a str. 2457T
acuggugacuuuugcccggca

SEQ ID NO: 3829043 - RNA, 14 nt, Shigella flexneri 2a str. 2457T
acuggugagcggug

SEQ ID NO: 3829044 - RNA, 18 nt, Shigella flexneri 2a str. 2457T
acugguggcaggaaaaca

SEQ ID NO: 3829045 - RNA, 20 nt, Shigella flexneri 2a str. 2457T
acugguggcaggaaaacaau

SEQ ID NO: 3829046 - RNA, 19 nt, Shigella flexneri 2a str. 2457T
acugguucccaacaacagc

SEQ ID NO: 3829047 - RNA, 20 nt, Shigella flexneri 2a str. 2457T
acugguucccaacaacagcg

SEQ ID NO: 3829048 - RNA, 21 nt, Shigella flexneri 2a str. 2457T
acugguucccaacaacagcgc

SEQ ID NO: 3829049 - RNA, 15 nt, Shigella flexneri 2a str. 2457T
acugguuuuccugag

SEQ ID NO: 3829050 - RNA, 19 nt, Shigella flexneri 2a str. 2457T
acugguuuuccugagcaau

SEQ ID NO: 3829051 - RNA, 16 nt, Shigella flexneri 2a str. 2457T
acuguaaaucgccaug

SEQ ID NO: 3829052 - RNA, 14 nt, Shigella flexneri 2a str. 2457T
acuguaaaucugcc

SEQ ID NO: 3829053 - RNA, 22 nt, Shigella flexneri 2a str. 2457T
acuguaggccggauaaggcauu

SEQ ID NO: 3829054 - RNA, 15 nt, Shigella flexneri 2a str. 2457T
acuguagugaucaaa

SEQ ID NO: 3829055 - RNA, 17 nt, Shigella flexneri 2a str. 2457T
acuguagugaucaaaca

SEQ ID NO: 3829056 - RNA, 15 nt, Shigella flexneri 2a str. 2457T
acuuucacgcccaua

SEQ ID NO: 3829057 - RNA, 17 nt, Shigella flexneri 2a str. 2457T
acuuucacgccgccaaa

SEQ ID NO: 3829058 - RNA, 16 nt, Shigella flexneri 2a str. 2457T
acuuucagaccgccaa

SEQ ID NO: 3829059 - RNA, 13 nt, Shigella flexneri 2a str. 2457T
acuuucagcgcag

SEQ ID NO: 3829060 - RNA, 21 nt, Shigella flexneri 2a str. 2457T
acuuucaucgcggucagcugc

SEQ ID NO: 3829061 - RNA, 13 nt, Shigella flexneri 2a str. 2457T
acuuuccagccac

SEQ ID NO: 3829062 - RNA, 15 nt, Shigella flexneri 2a str. 2457T
acuuuccagccacag

SEQ ID NO: 3829063 - RNA, 21 nt, Shigella flexneri 2a str. 2457T
acuuuccaugccaucugccag

SEQ ID NO: 3829064 - RNA, 23 nt, Shigella flexneri 2a str. 2457T
acuuucgccugcggcgcaugcau

SEQ ID NO: 3829065 - RNA, 19 nt, Shigella flexneri 2a str. 2457T
acuuucggcaaccucgccc

SEQ ID NO: 3829066 - RNA, 22 nt, Shigella flexneri 2a str. 2457T
acuuucggcagaaaauccacca

SEQ ID NO: 3829067 - RNA, 12 nt, Shigella flexneri 2a str. 2457T
acuuucggcagc

SEQ ID NO: 3829068 - RNA, 17 nt, Shigella flexneri 2a str. 2457T
acuuucggugacuucaa

SEQ ID NO: 3829069 - RNA, 24 nt, Shigella flexneri 2a str. 2457T
acuuucugagauucaauuauagua

SEQ ID NO: 3829070 - RNA, 20 nt, Shigella flexneri 2a str. 2457T
acuuucuggcacgaccuggc

SEQ ID NO: 3829071 - RNA, 15 nt, Shigella flexneri 2a str. 2457T
acuuucuggcagcug

SEQ ID NO: 3829072 - RNA, 17 nt, Shigella flexneri 2a str. 2457T
acuuugcaguuccugcc

SEQ ID NO: 3829073 - RNA, 21 nt, Shigella flexneri 2a str. 2457T
acuuugcaguuccugccagau

SEQ ID NO: 3829074 - RNA, 18 nt, Shigella flexneri 2a str. 2457T
acuuugccgucagccacu

SEQ ID NO: 3829075 - RNA, 20 nt, Shigella flexneri 2a str. 2457T
acuuugugcaauugcucccu

SEQ ID NO: 3829076 - RNA, 18 nt, Shigella flexneri 2a str. 2457T
acuuuguuagcgaauaaa

SEQ ID NO: 3829077 - RNA, 16 nt, Shigella flexneri 2a str. 2457T
acuuuuacagcuuagc

SEQ ID NO: 3829078 - RNA, 23 nt, Shigella flexneri 2a str. 2457T
acuuuuacaugcgcgacaaaaau

SEQ ID NO: 3829079 - RNA, 13 nt, Shigella flexneri 2a str. 2457T
acuuuuaccugcu

SEQ ID NO: 3829080 - RNA, 14 nt, Shigella flexneri 2a str. 2457T
acuuuuauuucacc

SEQ ID NO: 3829081 - RNA, 22 nt, Shigella flexneri 2a str. 2457T
acuuuucggcaaccgcauccag

SEQ ID NO: 3829082 - RNA, 20 nt, Shigella flexneri 2a str. 2457T
acuuuugagccaaaaugccu

SEQ ID NO: 3829083 - RNA, 13 nt, Shigella flexneri 2a str. 2457T
acuuuugcccggc

SEQ ID NO: 3829084 - RNA, 15 nt, Shigella flexneri 2a str. 2457T
acuuuugcccggcau

SEQ ID NO: 3829085 - RNA, 22 nt, Shigella flexneri 2a str. 2457T
acuuuuuccaguccacguucaa

SEQ ID NO: 3829086 - RNA, 22 nt, Shigella flexneri 2a str. 2457T
acuuuuuccuuaaacaccuggc

SEQ ID NO: 3829087 - RNA, 13 nt, Shigella flexneri 2a str. 2457T
agaaaaaaaguag

SEQ ID NO: 3829088 - RNA, 22 nt, Shigella flexneri 2a str. 2457T
agaaaaaaugaccggccagcau

SEQ ID NO: 3829089 - RNA, 23 nt, Shigella flexneri 2a str. 2457T
agaaaaaaugaccgggcuugaaa

SEQ ID NO: 3829090 - RNA, 16 nt, Shigella flexneri 2a str. 2457T
agaaaaacuuaauccu

SEQ ID NO: 3829091 - RNA, 16 nt, Shigella flexneri 2a str. 2457T
agaaaagccaaccugc

SEQ ID NO: 3829092 - RNA, 23 nt, Shigella flexneri 2a str. 2457T
agaaaagcgagaguuacagcucu

SEQ ID NO: 3829093 - RNA, 22 nt, Shigella flexneri 2a str. 2457T
agaaaauccagaucugaaucau

SEQ ID NO: 3829094 - RNA, 22 nt, Shigella flexneri 2a str. 2457T
agaaaaugcccauggcaagaau

SEQ ID NO: 3829095 - RNA, 17 nt, Shigella flexneri 2a str. 2457T
agaaaauuauuuuaaau

SEQ ID NO: 3829096 - RNA, 22 nt, Shigella flexneri 2a str. 2457T
agaaacaaaaaaaacagcgccc

SEQ ID NO: 3829097 - RNA, 12 nt, Shigella flexneri 2a str. 2457T
agaaacaauaag

SEQ ID NO: 3829098 - RNA, 14 nt, Shigella flexneri 2a str. 2457T
agaaacagaaugau

SEQ ID NO: 3829099 - RNA, 16 nt, Shigella flexneri 2a str. 2457T
agaaacagucuggagc

SEQ ID NO: 3829100 - RNA, 21 nt, Shigella flexneri 2a str. 2457T
agaaacagucuggagcaaaaa

SEQ ID NO: 3829101 - RNA, 14 nt, Shigella flexneri 2a str. 2457T
agaaacccggccac

SEQ ID NO: 3829102 - RNA, 13 nt, Shigella flexneri 2a str. 2457T
agaaaccgcuauu

SEQ ID NO: 3829103 - RNA, 15 nt, Shigella flexneri 2a str. 2457T
agaaacgccagcagc

SEQ ID NO: 3829104 - RNA, 17 nt, Shigella flexneri 2a str. 2457T
agaaacgccagcagcag

SEQ ID NO: 3829105 - RNA, 16 nt, Shigella flexneri 2a str. 2457T
agaaacgccaucugaa

SEQ ID NO: 3829106 - RNA, 18 nt, Shigella flexneri 2a str. 2457T
agaaacggaccugggaga

SEQ ID NO: 3829107 - RNA, 17 nt, Shigella flexneri 2a str. 2457T
agaaagaggcggauaaa

SEQ ID NO: 3829108 - RNA, 16 nt, Shigella flexneri 2a str. 2457T
agaaagcaaugaaauu

SEQ ID NO: 3829109 - RNA, 12 nt, Shigella flexneri 2a str. 2457T
agaaagcccugg

SEQ ID NO: 3829110 - RNA, 15 nt, Shigella flexneri 2a str. 2457T
agaaagcccuggcgc

SEQ ID NO: 3829111 - RNA, 22 nt, Shigella flexneri 2a str. 2457T
agaaagcggaucaguuccagca

SEQ ID NO: 3829112 - RNA, 23 nt, Shigella flexneri 2a str. 2457T
agaaagcugcugaccaccagcac

SEQ ID NO: 3829113 - RNA, 24 nt, Shigella flexneri 2a str. 2457T
agaaagcugcugaccaccagcacg

SEQ ID NO: 3829114 - RNA, 17 nt, Shigella flexneri 2a str. 2457T
agaaaggcagagugcaa

SEQ ID NO: 3829115 - RNA, 17 nt, Shigella flexneri 2a str. 2457T
agaaaggcguuguccuu

SEQ ID NO: 3829116 - RNA, 11 nt, Shigella flexneri 2a str. 2457T
agaaaggggga

SEQ ID NO: 3829117 - RNA, 19 nt, Shigella flexneri 2a str. 2457T
agaaaguugccagauaaau

SEQ ID NO: 3829118 - RNA, 22 nt, Shigella flexneri 2a str. 2457T
agaaauaaucgcaauuacccag

SEQ ID NO: 3829119 - RNA, 9 nt, Shigella flexneri 2a str. 2457T
agaaaucag

SEQ ID NO: 3829120 - RNA, 20 nt, Shigella flexneri 2a str. 2457T
agaaaucagcuuuggugaaa

SEQ ID NO: 3829121 - RNA, 16 nt, Shigella flexneri 2a str. 2457T
agaaaucauucaauac

SEQ ID NO: 3829122 - RNA, 17 nt, Shigella flexneri 2a str. 2457T
agaaaucauucaauacu

SEQ ID NO: 3829123 - RNA, 23 nt, Shigella flexneri 2a str. 2457T
agaaauccaggcccgcauuaaaa

SEQ ID NO: 3829124 - RNA, 22 nt, Shigella flexneri 2a str. 2457T
agaaaucccccagcaucacgcc

SEQ ID NO: 3829125 - RNA, 14 nt, Shigella flexneri 2a str. 2457T
agaaaugaaaaaau

SEQ ID NO: 3829126 - RNA, 14 nt, Shigella flexneri 2a str. 2457T
agaaaugccaguaa

SEQ ID NO: 3829127 - RNA, 16 nt, Shigella flexneri 2a str. 2457T
agaaaugccaguaacu

SEQ ID NO: 3829128 - RNA, 15 nt, Shigella flexneri 2a str. 2457T
agaaauggcccaaaa

SEQ ID NO: 3829129 - RNA, 16 nt, Shigella flexneri 2a str. 2457T
agaaaugguaaagaag

SEQ ID NO: 3829130 - RNA, 17 nt, Shigella flexneri 2a str. 2457T
agaaauuuggcuccucu

SEQ ID NO: 3829131 - RNA, 14 nt, Shigella flexneri 2a str. 2457T
agaaauuuuuauua

SEQ ID NO: 3829132 - RNA, 14 nt, Shigella flexneri 2a str. 2457T
agaacaaauaaaua

SEQ ID NO: 3829133 - RNA, 17 nt, Shigella flexneri 2a str. 2457T
agaacaaauaaauagau

SEQ ID NO: 3829134 - RNA, 20 nt, Shigella flexneri 2a str. 2457T
agaacaacccggcgaaagag

SEQ ID NO: 3829135 - RNA, 22 nt, Shigella flexneri 2a str. 2457T
agaacaacccggcgaaagagcu

SEQ ID NO: 3829136 - RNA, 17 nt, Shigella flexneri 2a str. 2457T
agaacaacugcauuauu

SEQ ID NO: 3829137 - RNA, 17 nt, Shigella flexneri 2a str. 2457T
agaacaaggcuuuaaua

SEQ ID NO: 3829138 - RNA, 17 nt, Shigella flexneri 2a str. 2457T
agaacaccaccugccag

SEQ ID NO: 3829139 - RNA, 19 nt, Shigella flexneri 2a str. 2457T
agaacacuguuaccgcugc

SEQ ID NO: 3829140 - RNA, 18 nt, Shigella flexneri 2a str. 2457T
agaacacuucuucugucg

SEQ ID NO: 3829141 - RNA, 16 nt, Shigella flexneri 2a str. 2457T
agaacaguucagcagc

SEQ ID NO: 3829142 - RNA, 19 nt, Shigella flexneri 2a str. 2457T
agaacaguucagcagcacu

SEQ ID NO: 3829143 - RNA, 23 nt, Shigella flexneri 2a str. 2457T
agaaccacggaauaaccagcgaa

SEQ ID NO: 3829144 - RNA, 13 nt, Shigella flexneri 2a str. 2457T
agaaccagcugcc

SEQ ID NO: 3829145 - RNA, 11 nt, Shigella flexneri 2a str. 2457T
agaaccaugca

SEQ ID NO: 3829146 - RNA, 15 nt, Shigella flexneri 2a str. 2457T
agaaccuaagaacca

SEQ ID NO: 3829147 - RNA, 19 nt, Shigella flexneri 2a str. 2457T
agaaccuaagaaccagaau

SEQ ID NO: 3829148 - RNA, 22 nt, Shigella flexneri 2a str. 2457T
agaaccucaacaggcuaccagc

SEQ ID NO: 3829149 - RNA, 15 nt, Shigella flexneri 2a str. 2457T
agaaccugaacgccg

SEQ ID NO: 3829150 - RNA, 13 nt, Shigella flexneri 2a str. 2457T
agaaccuuccaug

SEQ ID NO: 3829151 - RNA, 19 nt, Shigella flexneri 2a str. 2457T
agaacgccuguguccuguu

SEQ ID NO: 3829152 - RNA, 17 nt, Shigella flexneri 2a str. 2457T
agaacggauucagugag

SEQ ID NO: 3829153 - RNA, 11 nt, Shigella flexneri 2a str. 2457T
agaacggcaga

SEQ ID NO: 3829154 - RNA, 21 nt, Shigella flexneri 2a str. 2457T
agaacgugccgggaaaguggc

SEQ ID NO: 3829155 - RNA, 22 nt, Shigella flexneri 2a str. 2457T
agaacuauuaguuuguugaagu

SEQ ID NO: 3829156 - RNA, 14 nt, Shigella flexneri 2a str. 2457T
agaacucggaagca

SEQ ID NO: 3829157 - RNA, 22 nt, Shigella flexneri 2a str. 2457T
agaacucguucagcgcauucca

SEQ ID NO: 3829158 - RNA, 19 nt, Shigella flexneri 2a str. 2457T
agaacugagcgaucauuag

SEQ ID NO: 3829159 - RNA, 20 nt, Shigella flexneri 2a str. 2457T
agaacugcaacucaccuuua

SEQ ID NO: 3829160 - RNA, 14 nt, Shigella flexneri 2a str. 2457T
agaacugcgccaga

SEQ ID NO: 3829161 - RNA, 15 nt, Shigella flexneri 2a str. 2457T
agaacugcuggaagc

SEQ ID NO: 3829162 - RNA, 17 nt, Shigella flexneri 2a str. 2457T
agaacuguagacaaaau

SEQ ID NO: 3829163 - RNA, 19 nt, Shigella flexneri 2a str. 2457T
agaacuguagacaaaaugu

SEQ ID NO: 3829164 - RNA, 21 nt, Shigella flexneri 2a str. 2457T
agaacuguagacaaaauguuc

SEQ ID NO: 3829165 - RNA, 13 nt, Shigella flexneri 2a str. 2457T
agaacuucugcaa

SEQ ID NO: 3829166 - RNA, 15 nt, Shigella flexneri 2a str. 2457T
agaacuucugcaacg

SEQ ID NO: 3829167 - RNA, 19 nt, Shigella flexneri 2a str. 2457T
agaacuuuaucgaucacau

SEQ ID NO: 3829168 - RNA, 20 nt, Shigella flexneri 2a str. 2457T
agaagaaagcaaugaaauuc

SEQ ID NO: 3829169 - RNA, 17 nt, Shigella flexneri 2a str. 2457T
agaagacgccauucacu

SEQ ID NO: 3829170 - RNA, 18 nt, Shigella flexneri 2a str. 2457T
agaagagcggcaaacgua

SEQ ID NO: 3829171 - RNA, 21 nt, Shigella flexneri 2a str. 2457T
agaagagcucguacgaaagug

SEQ ID NO: 3829172 - RNA, 23 nt, Shigella flexneri 2a str. 2457T
agaagauaccgaacauaccaccg

SEQ ID NO: 3829173 - RNA, 22 nt, Shigella flexneri 2a str. 2457T
agaagaucagaaauuuccugag

SEQ ID NO: 3829174 - RNA, 20 nt, Shigella flexneri 2a str. 2457T
agaagaucguggagaacaau

SEQ ID NO: 3829175 - RNA, 21 nt, Shigella flexneri 2a str. 2457T
agaagaucguggagaacaaua

SEQ ID NO: 3829176 - RNA, 19 nt, Shigella flexneri 2a str. 2457T
agaagauuuuuugccagca

SEQ ID NO: 3829177 - RNA, 22 nt, Shigella flexneri 2a str. 2457T
agaagcaccguugcccggagca

SEQ ID NO: 3829178 - RNA, 19 nt, Shigella flexneri 2a str. 2457T
agaagcacguucaucccac

SEQ ID NO: 3829179 - RNA, 19 nt, Shigella flexneri 2a str. 2457T
agaagcagcaacacaauca

SEQ ID NO: 3829180 - RNA, 22 nt, Shigella flexneri 2a str. 2457T
agaagcagcaacacaaucagac

SEQ ID NO: 3829181 - RNA, 21 nt, Shigella flexneri 2a str. 2457T
agaagcaugaacauugcugcu

SEQ ID NO: 3829182 - RNA, 20 nt, Shigella flexneri 2a str. 2457T
agaagcggaaaucacgcauc

SEQ ID NO: 3829183 - RNA, 16 nt, Shigella flexneri 2a str. 2457T
agaagcguaaauccca

SEQ ID NO: 3829184 - RNA, 20 nt, Shigella flexneri 2a str. 2457T
agaagcguaauauccaggcc

SEQ ID NO: 3829185 - RNA, 23 nt, Shigella flexneri 2a str. 2457T
agaagcguagguguuacgcggau

SEQ ID NO: 3829186 - RNA, 13 nt, Shigella flexneri 2a str. 2457T
agaagcugcagga

SEQ ID NO: 3829187 - RNA, 19 nt, Shigella flexneri 2a str. 2457T
agaagcugcaggaccauac

SEQ ID NO: 3829188 - RNA, 23 nt, Shigella flexneri 2a str. 2457T
agaagcugcugccgcuguugcgu

SEQ ID NO: 3829189 - RNA, 13 nt, Shigella flexneri 2a str. 2457T
agaagcuggaagg

SEQ ID NO: 3829190 - RNA, 23 nt, Shigella flexneri 2a str. 2457T
agaaggaaaauacagcaauggaa

SEQ ID NO: 3829191 - RNA, 23 nt, Shigella flexneri 2a str. 2457T
agaaggauugaucaauucuaaau

SEQ ID NO: 3829192 - RNA, 14 nt, Shigella flexneri 2a str. 2457T
agaagggcuggcca

SEQ ID NO: 3829193 - RNA, 23 nt, Shigella flexneri 2a str. 2457T
agaaguaaucuacugcaccgcag

SEQ ID NO: 3829194 - RNA, 20 nt, Shigella flexneri 2a str. 2457T
agaaguacguagcguaagga

SEQ ID NO: 3829195 - RNA, 19 nt, Shigella flexneri 2a str. 2457T
agaaguauucuuuuaaugg

SEQ ID NO: 3829196 - RNA, 23 nt, Shigella flexneri 2a str. 2457T
agaagucgcaaugaguauuacuu

SEQ ID NO: 3829197 - RNA, 13 nt, Shigella flexneri 2a str. 2457T
agaaguucugcag

SEQ ID NO: 3829198 - RNA, 13 nt, Shigella flexneri 2a str. 2457T
agaauaaaacagg

SEQ ID NO: 3829199 - RNA, 23 nt, Shigella flexneri 2a str. 2457T
agaauaaaacaggcagcugccag

SEQ ID NO: 3829200 - RNA, 22 nt, Shigella flexneri 2a str. 2457T
agaauaacggcugauaacaaua

SEQ ID NO: 3829201 - RNA, 15 nt, Shigella flexneri 2a str. 2457T
agaauaauaccgucc

SEQ ID NO: 3829202 - RNA, 23 nt, Shigella flexneri 2a str. 2457T
agaauaccugccugucacgcagg

SEQ ID NO: 3829203 - RNA, 22 nt, Shigella flexneri 2a str. 2457T
agaauaccuugcugcuccagcg

SEQ ID NO: 3829204 - RNA, 18 nt, Shigella flexneri 2a str. 2457T
agaauagucggcccggcg

SEQ ID NO: 3829205 - RNA, 18 nt, Shigella flexneri 2a str. 2457T
agaauaucgguaucagcc

SEQ ID NO: 3829206 - RNA, 15 nt, Shigella flexneri 2a str. 2457T
agaauaucuucuguu

SEQ ID NO: 3829207 - RNA, 18 nt, Shigella flexneri 2a str. 2457T
agaauaugcuuugccuua

SEQ ID NO: 3829208 - RNA, 15 nt, Shigella flexneri 2a str. 2457T
agaauauguauuacc

SEQ ID NO: 3829209 - RNA, 19 nt, Shigella flexneri 2a str. 2457T
agaauauugccgaagacca

SEQ ID NO: 3829210 - RNA, 15 nt, Shigella flexneri 2a str. 2457T
agaauauugugcuca

SEQ ID NO: 3829211 - RNA, 13 nt, Shigella flexneri 2a str. 2457T
agaauauuugauu

SEQ ID NO: 3829212 - RNA, 14 nt, Shigella flexneri 2a str. 2457T
agaaucaagucuau

SEQ ID NO: 3829213 - RNA, 16 nt, Shigella flexneri 2a str. 2457T
agaaucaagucuauuu

SEQ ID NO: 3829214 - RNA, 16 nt, Shigella flexneri 2a str. 2457T
agaaucaaucccauca

SEQ ID NO: 3829215 - RNA, 15 nt, Shigella flexneri 2a str. 2457T
agaaucaaucucagc

SEQ ID NO: 3829216 - RNA, 20 nt, Shigella flexneri 2a str. 2457T
agaaucaccucuuuuuccac

SEQ ID NO: 3829217 - RNA, 17 nt, Shigella flexneri 2a str. 2457T
agaaucacgccaacaaa

SEQ ID NO: 3829218 - RNA, 18 nt, Shigella flexneri 2a str. 2457T
agaaucagcgagacaaca

SEQ ID NO: 3829219 - RNA, 15 nt, Shigella flexneri 2a str. 2457T
agaauccaggaaagc

SEQ ID NO: 3829220 - RNA, 18 nt, Shigella flexneri 2a str. 2457T
agaauccaggaaagccau

SEQ ID NO: 3829221 - RNA, 18 nt, Shigella flexneri 2a str. 2457T
agaauccgcgacuggcau

SEQ ID NO: 3829222 - RNA, 17 nt, Shigella flexneri 2a str. 2457T
agaaucgggaaauaaca

SEQ ID NO: 3829223 - RNA, 18 nt, Shigella flexneri 2a str. 2457T
agaaucuaagaucccugc

SEQ ID NO: 3829224 - RNA, 19 nt, Shigella flexneri 2a str. 2457T
agaaucucuuuuguuuccc

SEQ ID NO: 3829225 - RNA, 20 nt, Shigella flexneri 2a str. 2457T
agaaucugcguaaauauggc

SEQ ID NO: 3829226 - RNA, 11 nt, Shigella flexneri 2a str. 2457T
agaaugcccca

SEQ ID NO: 3829227 - RNA, 18 nt, Shigella flexneri 2a str. 2457T
agaaugccugugcgacag

SEQ ID NO: 3829228 - RNA, 21 nt, Shigella flexneri 2a str. 2457T
agaauggacaccagcucagug

SEQ ID NO: 3829229 - RNA, 18 nt, Shigella flexneri 2a str. 2457T
agaauggcaucagaagga

SEQ ID NO: 3829230 - RNA, 19 nt, Shigella flexneri 2a str. 2457T
agaauggcaucagaaggag

SEQ ID NO: 3829231 - RNA, 20 nt, Shigella flexneri 2a str. 2457T
agaauggcaucugauaagcc

SEQ ID NO: 3829232 - RNA, 20 nt, Shigella flexneri 2a str. 2457T
agaaugggaugguuuugcuu

SEQ ID NO: 3829233 - RNA, 19 nt, Shigella flexneri 2a str. 2457T
agaaugguaacaccagagu

SEQ ID NO: 3829234 - RNA, 17 nt, Shigella flexneri 2a str. 2457T
agaaugguuucauucca

SEQ ID NO: 3829235 - RNA, 19 nt, Shigella flexneri 2a str. 2457T
agaauguccauuauuucaa

SEQ ID NO: 3829236 - RNA, 22 nt, Shigella flexneri 2a str. 2457T
agaauguuaacgccaauuaaug

SEQ ID NO: 3829237 - RNA, 16 nt, Shigella flexneri 2a str. 2457T
agaauuaaaauaucag

SEQ ID NO: 3829238 - RNA, 14 nt, Shigella flexneri 2a str. 2457T
agaauuaacgcuga

SEQ ID NO: 3829239 - RNA, 19 nt, Shigella flexneri 2a str. 2457T
agaauucccccauugaaac

SEQ ID NO: 3829240 - RNA, 17 nt, Shigella flexneri 2a str. 2457T
agaauugauaaaaaaaa

SEQ ID NO: 3829241 - RNA, 21 nt, Shigella flexneri 2a str. 2457T
agaauugcagauaccacauca

SEQ ID NO: 3829242 - RNA, 16 nt, Shigella flexneri 2a str. 2457T
agaauuuguaggccgg

SEQ ID NO: 3829243 - RNA, 13 nt, Shigella flexneri 2a str. 2457T
agaauuuuucacu

SEQ ID NO: 3829244 - RNA, 14 nt, Shigella flexneri 2a str. 2457T
agaauuuuucacuc

SEQ ID NO: 3829245 - RNA, 17 nt, Shigella flexneri 2a str. 2457T
agacaaaauccugccag

SEQ ID NO: 3829246 - RNA, 13 nt, Shigella flexneri 2a str. 2457T
agacaaaauguuc

SEQ ID NO: 3829247 - RNA, 12 nt, Shigella flexneri 2a str. 2457T
agacaaaguaac

SEQ ID NO: 3829248 - RNA, 14 nt, Shigella flexneri 2a str. 2457T
agacaaaugaacac

SEQ ID NO: 3829249 - RNA, 16 nt, Shigella flexneri 2a str. 2457T
agacaaaugucacugc

SEQ ID NO: 3829250 - RNA, 14 nt, Shigella flexneri 2a str. 2457T
agacugaugacaaa

SEQ ID NO: 3829251 - RNA, 18 nt, Shigella flexneri 2a str. 2457T
agacugaugacaaacaca

SEQ ID NO: 3829252 - RNA, 16 nt, Shigella flexneri 2a str. 2457T
agacugaugacuaaag

SEQ ID NO: 3829253 - RNA, 14 nt, Shigella flexneri 2a str. 2457T
agacugcaagaaua

SEQ ID NO: 3829254 - RNA, 23 nt, Shigella flexneri 2a str. 2457T
agacugcagcggucacauguucc

SEQ ID NO: 3829255 - RNA, 15 nt, Shigella flexneri 2a str. 2457T
agacugcgcuaccag

SEQ ID NO: 3829256 - RNA, 15 nt, Shigella flexneri 2a str. 2457T
agacugcuccuguau

SEQ ID NO: 3829257 - RNA, 22 nt, Shigella flexneri 2a str. 2457T
agacuggaaacucacgccagca

SEQ ID NO: 3829258 - RNA, 16 nt, Shigella flexneri 2a str. 2457T
agacuggagcacugcg

SEQ ID NO: 3829259 - RNA, 16 nt, Shigella flexneri 2a str. 2457T
agacuggauugccagc

SEQ ID NO: 3829260 - RNA, 14 nt, Shigella flexneri 2a str. 2457T
agacugggcaagau

SEQ ID NO: 3829261 - RNA, 20 nt, Shigella flexneri 2a str. 2457T
agacuguagaugaucgccgc

SEQ ID NO: 3829262 - RNA, 14 nt, Shigella flexneri 2a str. 2457T
agacugugaaucau

SEQ ID NO: 3829263 - RNA, 15 nt, Shigella flexneri 2a str. 2457T
agacuuaagccuguu

SEQ ID NO: 3829264 - RNA, 15 nt, Shigella flexneri 2a str. 2457T
agacuuaauccgggc

SEQ ID NO: 3829265 - RNA, 17 nt, Shigella flexneri 2a str. 2457T
agacuuggcuuucucuu

SEQ ID NO: 3829266 - RNA, 16 nt, Shigella flexneri 2a str. 2457T
agacuuugcugccuuu

SEQ ID NO: 3829267 - RNA, 21 nt, Shigella flexneri 2a str. 2457T
agacuuuuugcggcagcaaug

SEQ ID NO: 3829268 - RNA, 23 nt, Shigella flexneri 2a str. 2457T
agacuuuuuucauggguaccaga

SEQ ID NO: 3829269 - RNA, 13 nt, Shigella flexneri 2a str. 2457T
agagaaaaucaca

SEQ ID NO: 3829270 - RNA, 14 nt, Shigella flexneri 2a str. 2457T
agagaaaaucacac

SEQ ID NO: 3829271 - RNA, 22 nt, Shigella flexneri 2a str. 2457T
agagaaaaugccgcacaucacc

SEQ ID NO: 3829272 - RNA, 15 nt, Shigella flexneri 2a str. 2457T
agagaaagcaaaaau

SEQ ID NO: 3829273 - RNA, 12 nt, Shigella flexneri 2a str. 2457T
agagaaaguaaa

SEQ ID NO: 3829274 - RNA, 13 nt, Shigella flexneri 2a str. 2457T
agagaaccagcug

SEQ ID NO: 3829275 - RNA, 20 nt, Shigella flexneri 2a str. 2457T
agagacagccgaaaagguag

SEQ ID NO: 3829276 - RNA, 16 nt, Shigella flexneri 2a str. 2457T
agagacgcugaaaagc

SEQ ID NO: 3829277 - RNA, 21 nt, Shigella flexneri 2a str. 2457T
agagacguucgcguacugcug

SEQ ID NO: 3829278 - RNA, 13 nt, Shigella flexneri 2a str. 2457T
agagagccagccc

SEQ ID NO: 3829279 - RNA, 13 nt, Shigella flexneri 2a str. 2457T
agagagcgccaga

SEQ ID NO: 3829280 - RNA, 20 nt, Shigella flexneri 2a str. 2457T
agagagugacgucauagcag

SEQ ID NO: 3829281 - RNA, 14 nt, Shigella flexneri 2a str. 2457T
agagauaauaaaac

SEQ ID NO: 3829282 - RNA, 15 nt, Shigella flexneri 2a str. 2457T
agagauaauucagca

SEQ ID NO: 3829283 - RNA, 22 nt, Shigella flexneri 2a str. 2457T
agagauagcacgacguuucuuu

SEQ ID NO: 3829284 - RNA, 21 nt, Shigella flexneri 2a str. 2457T
agagauaguguugguaaauaa

SEQ ID NO: 3829285 - RNA, 13 nt, Shigella flexneri 2a str. 2457T
agagaucagauaa

SEQ ID NO: 3829286 - RNA, 16 nt, Shigella flexneri 2a str. 2457T
agagaucauacagaug

SEQ ID NO: 3829287 - RNA, 15 nt, Shigella flexneri 2a str. 2457T
agagauguugaagaa

SEQ ID NO: 3829288 - RNA, 22 nt, Shigella flexneri 2a str. 2457T
agagauuacuuuauuuauauca

SEQ ID NO: 3829289 - RNA, 17 nt, Shigella flexneri 2a str. 2457T
agagauuugcuccagcg

SEQ ID NO: 3829290 - RNA, 13 nt, Shigella flexneri 2a str. 2457T
agagcaaauaaaa

SEQ ID NO: 3829291 - RNA, 19 nt, Shigella flexneri 2a str. 2457T
agagcaaauaaaacaucac

SEQ ID NO: 3829292 - RNA, 14 nt, Shigella flexneri 2a str. 2457T
agagcaacauacag

SEQ ID NO: 3829293 - RNA, 21 nt, Shigella flexneri 2a str. 2457T
agagcaacccacuggcaauca

SEQ ID NO: 3829294 - RNA, 15 nt, Shigella flexneri 2a str. 2457T
agagcaaugcgcauc

SEQ ID NO: 3829295 - RNA, 13 nt, Shigella flexneri 2a str. 2457T
agagcacaucacu

SEQ ID NO: 3829296 - RNA, 11 nt, Shigella flexneri 2a str. 2457T
agagcagcacg

SEQ ID NO: 3829297 - RNA, 22 nt, Shigella flexneri 2a str. 2457T
agagcaucaguuaacggcacca

SEQ ID NO: 3829298 - RNA, 14 nt, Shigella flexneri 2a str. 2457T
agagcaucaugaau

SEQ ID NO: 3829299 - RNA, 19 nt, Shigella flexneri 2a str. 2457T
agagcaucaugaauauaua

SEQ ID NO: 3829300 - RNA, 20 nt, Shigella flexneri 2a str. 2457T
agagcaucgguaucuuccca

SEQ ID NO: 3829301 - RNA, 18 nt, Shigella flexneri 2a str. 2457T
agagcaugaaaugaaaau

SEQ ID NO: 3829302 - RNA, 23 nt, Shigella flexneri 2a str. 2457T
agagccaccaacucugggcugaa

SEQ ID NO: 3829303 - RNA, 16 nt, Shigella flexneri 2a str. 2457T
agagccggacugacau

SEQ ID NO: 3829304 - RNA, 22 nt, Shigella flexneri 2a str. 2457T
agagccucgucggcgguuuuca

SEQ ID NO: 3829305 - RNA, 10 nt, Shigella flexneri 2a str. 2457T
agagccugaa

SEQ ID NO: 3829306 - RNA, 22 nt, Shigella flexneri 2a str. 2457T
agagccugccaauggcaggcuc

SEQ ID NO: 3829307 - RNA, 14 nt, Shigella flexneri 2a str. 2457T
agagcggagcaaug

SEQ ID NO: 3829308 - RNA, 19 nt, Shigella flexneri 2a str. 2457T
agagcuacaaaguguuguu

SEQ ID NO: 3829309 - RNA, 19 nt, Shigella flexneri 2a str. 2457T
agagcugaauaucacgggc

SEQ ID NO: 3829310 - RNA, 20 nt, Shigella flexneri 2a str. 2457T
agagcuggaaguuacucaaa

SEQ ID NO: 3829311 - RNA, 20 nt, Shigella flexneri 2a str. 2457T
agagcuggcgaacgugcagg

SEQ ID NO: 3829312 - RNA, 16 nt, Shigella flexneri 2a str. 2457T
agagcuugugcaccag

SEQ ID NO: 3829313 - RNA, 23 nt, Shigella flexneri 2a str. 2457T
agagcuuuucagccugaagauca

SEQ ID NO: 3829314 - RNA, 13 nt, Shigella flexneri 2a str. 2457T
agaggaaucgcug

SEQ ID NO: 3829315 - RNA, 17 nt, Shigella flexneri 2a str. 2457T
agaggagccaucaccau

SEQ ID NO: 3829316 - RNA, 16 nt, Shigella flexneri 2a str. 2457T
agaggcgcagaugaag

SEQ ID NO: 3829317 - RNA, 20 nt, Shigella flexneri 2a str. 2457T
agagggcgauaaaucuccac

SEQ ID NO: 3829318 - RNA, 14 nt, Shigella flexneri 2a str. 2457T
agaggggaaguuuu

SEQ ID NO: 3829319 - RNA, 21 nt, Shigella flexneri 2a str. 2457T
agaggguuagggugaggggaa

SEQ ID NO: 3829320 - RNA, 20 nt, Shigella flexneri 2a str. 2457T
agagguaaaaccugacaaca

SEQ ID NO: 3829321 - RNA, 14 nt, Shigella flexneri 2a str. 2457T
agaggucuuuucuc

SEQ ID NO: 3829322 - RNA, 17 nt, Shigella flexneri 2a str. 2457T
agagguuauaaauaaaa

SEQ ID NO: 3829323 - RNA, 19 nt, Shigella flexneri 2a str. 2457T
agaguaggcuggaucagac

SEQ ID NO: 3829324 - RNA, 15 nt, Shigella flexneri 2a str. 2457T
agagucgacacagau

SEQ ID NO: 3829325 - RNA, 20 nt, Shigella flexneri 2a str. 2457T
agagucggcgcugaaauucu

SEQ ID NO: 3829326 - RNA, 18 nt, Shigella flexneri 2a str. 2457T
agagugacgucauagcag

SEQ ID NO: 3829327 - RNA, 21 nt, Shigella flexneri 2a str. 2457T
agagugacgucauagcaguac

SEQ ID NO: 3829328 - RNA, 21 nt, Shigella flexneri 2a str. 2457T
agagugaggggggauguuggc

SEQ ID NO: 3829329 - RNA, 18 nt, Shigella flexneri 2a str. 2457T
agagugauuaacuguucu

SEQ ID NO: 3829330 - RNA, 18 nt, Shigella flexneri 2a str. 2457T
agaguggauuaucuucac

SEQ ID NO: 3829331 - RNA, 20 nt, Shigella flexneri 2a str. 2457T
agagugguuagagcacagau

SEQ ID NO: 3829332 - RNA, 22 nt, Shigella flexneri 2a str. 2457T
agagugguuagccggauaaaca

SEQ ID NO: 3829333 - RNA, 22 nt, Shigella flexneri 2a str. 2457T
agaguuccggcccuaaacucuu

SEQ ID NO: 3829334 - RNA, 19 nt, Shigella flexneri 2a str. 2457T
agaguugaaaaacaugucu

SEQ ID NO: 3829335 - RNA, 23 nt, Shigella flexneri 2a str. 2457T
agaguugagcaguccccacauca

SEQ ID NO: 3829336 - RNA, 15 nt, Shigella flexneri 2a str. 2457T
agaguugcaccagca

SEQ ID NO: 3829337 - RNA, 16 nt, Shigella flexneri 2a str. 2457T
agaguuuuaaacgcag

SEQ ID NO: 3829338 - RNA, 17 nt, Shigella flexneri 2a str. 2457T
agauaaaacgacaccac

SEQ ID NO: 3829339 - RNA, 18 nt, Shigella flexneri 2a str. 2457T
agauaaaauacacuuuaa

SEQ ID NO: 3829340 - RNA, 15 nt, Shigella flexneri 2a str. 2457T
agauaaaaugcgaaa

SEQ ID NO: 3829341 - RNA, 21 nt, Shigella flexneri 2a str. 2457T
agauaaacgaccacucuuucg

SEQ ID NO: 3829342 - RNA, 14 nt, Shigella flexneri 2a str. 2457T
agauaaauaucaau

SEQ ID NO: 3829343 - RNA, 14 nt, Shigella flexneri 2a str. 2457T
agauaaaucacgcu

SEQ ID NO: 3829344 - RNA, 22 nt, Shigella flexneri 2a str. 2457T
agauaaaucacgcuucacccuu

SEQ ID NO: 3829345 - RNA, 13 nt, Shigella flexneri 2a str. 2457T
agauaaauuacug

SEQ ID NO: 3829346 - RNA, 15 nt, Shigella flexneri 2a str. 2457T
agauaaauuacugcc

SEQ ID NO: 3829347 - RNA, 17 nt, Shigella flexneri 2a str. 2457T
agauuaacgugaccgcc

SEQ ID NO: 3829348 - RNA, 20 nt, Shigella flexneri 2a str. 2457T
agauuaagagaaccagcugc

SEQ ID NO: 3829349 - RNA, 17 nt, Shigella flexneri 2a str. 2457T
agauuaaucagcagaua

SEQ ID NO: 3829350 - RNA, 18 nt, Shigella flexneri 2a str. 2457T
agauuaaucagcagauau

SEQ ID NO: 3829351 - RNA, 14 nt, Shigella flexneri 2a str. 2457T
agauuagccgguaa

SEQ ID NO: 3829352 - RNA, 23 nt, Shigella flexneri 2a str. 2457T
agauuagccgguaaaucaccagc

SEQ ID NO: 3829353 - RNA, 18 nt, Shigella flexneri 2a str. 2457T
agauuagccguuaaguuu

SEQ ID NO: 3829354 - RNA, 17 nt, Shigella flexneri 2a str. 2457T
agauuauaagccaguaa

SEQ ID NO: 3829355 - RNA, 22 nt, Shigella flexneri 2a str. 2457T
agauucagcagcguggugcuga

SEQ ID NO: 3829356 - RNA, 14 nt, Shigella flexneri 2a str. 2457T
agauucagccacau

SEQ ID NO: 3829357 - RNA, 16 nt, Shigella flexneri 2a str. 2457T
agauucaggcgcagca

SEQ ID NO: 3829358 - RNA, 16 nt, Shigella flexneri 2a str. 2457T
agauucaugcugcggc

SEQ ID NO: 3829359 - RNA, 14 nt, Shigella flexneri 2a str. 2457T
agauucgauagaga

SEQ ID NO: 3829360 - RNA, 13 nt, Shigella flexneri 2a str. 2457T
agauucgccagau

SEQ ID NO: 3829361 - RNA, 23 nt, Shigella flexneri 2a str. 2457T
agauucgcggguaagcgcggagg

SEQ ID NO: 3829362 - RNA, 15 nt, Shigella flexneri 2a str. 2457T
agauucgguaaccau

SEQ ID NO: 3829363 - RNA, 19 nt, Shigella flexneri 2a str. 2457T
agauucguauuuaaaaccc

SEQ ID NO: 3829364 - RNA, 14 nt, Shigella flexneri 2a str. 2457T
agauugaagugaac

SEQ ID NO: 3829365 - RNA, 16 nt, Shigella flexneri 2a str. 2457T
agauugaauuagcaag

SEQ ID NO: 3829366 - RNA, 15 nt, Shigella flexneri 2a str. 2457T
agauugauccccgcu

SEQ ID NO: 3829367 - RNA, 22 nt, Shigella flexneri 2a str. 2457T
agauugccugaugcgcugggca

SEQ ID NO: 3829368 - RNA, 21 nt, Shigella flexneri 2a str. 2457T
agauuggcuucauugauuaac

SEQ ID NO: 3829369 - RNA, 15 nt, Shigella flexneri 2a str. 2457T
agauuguugacaaag

SEQ ID NO: 3829370 - RNA, 20 nt, Shigella flexneri 2a str. 2457T
agauuuacuauuauuuuuca

SEQ ID NO: 3829371 - RNA, 19 nt, Shigella flexneri 2a str. 2457T
agauuuaugacaaacgcaa

SEQ ID NO: 3829372 - RNA, 12 nt, Shigella flexneri 2a str. 2457T
agauuucaccaa

SEQ ID NO: 3829373 - RNA, 17 nt, Shigella flexneri 2a str. 2457T
agauuucccauucuugg

SEQ ID NO: 3829374 - RNA, 12 nt, Shigella flexneri 2a str. 2457T
agauuuugccag

SEQ ID NO: 3829375 - RNA, 13 nt, Shigella flexneri 2a str. 2457T
agauuuugccagc

SEQ ID NO: 3829376 - RNA, 11 nt, Shigella flexneri 2a str. 2457T
agauuuugcuu

SEQ ID NO: 3829377 - RNA, 13 nt, Shigella flexneri 2a str. 2457T
agcaaaacgcccc

SEQ ID NO: 3829378 - RNA, 12 nt, Shigella flexneri 2a str. 2457T
agcaaaaucacc

SEQ ID NO: 3829379 - RNA, 14 nt, Shigella flexneri 2a str. 2457T
agcaaaaucaccau

SEQ ID NO: 3829380 - RNA, 21 nt, Shigella flexneri 2a str. 2457T
agcaaaaucguaagcaggaga

SEQ ID NO: 3829381 - RNA, 15 nt, Shigella flexneri 2a str. 2457T
agcaaacaggauaau

SEQ ID NO: 3829382 - RNA, 18 nt, Shigella flexneri 2a str. 2457T
agcaaacaggauaaugca

SEQ ID NO: 3829383 - RNA, 17 nt, Shigella flexneri 2a str. 2457T
agcaaacaguucugcag

SEQ ID NO: 3829384 - RNA, 22 nt, Shigella flexneri 2a str. 2457T
agcaaacaugccaacaaaaucu

SEQ ID NO: 3829385 - RNA, 14 nt, Shigella flexneri 2a str. 2457T
agcaaacgaaagca

SEQ ID NO: 3829386 - RNA, 22 nt, Shigella flexneri 2a str. 2457T
agcaaacuugaacuuaucauca

SEQ ID NO: 3829387 - RNA, 21 nt, Shigella flexneri 2a str. 2457T
agcaaagcggucuucugugau

SEQ ID NO: 3829388 - RNA, 22 nt, Shigella flexneri 2a str. 2457T
agcaaaggugccuuuaauacca

SEQ ID NO: 3829389 - RNA, 18 nt, Shigella flexneri 2a str. 2457T
agcaaaguaauaaugauc

SEQ ID NO: 3829390 - RNA, 22 nt, Shigella flexneri 2a str. 2457T
agcaaauaaaacaucaccaaug

SEQ ID NO: 3829391 - RNA, 22 nt, Shigella flexneri 2a str. 2457T
agcaaaucaaauaauuacuucg

SEQ ID NO: 3829392 - RNA, 16 nt, Shigella flexneri 2a str. 2457T
agcaaauccaucauau

SEQ ID NO: 3829393 - RNA, 12 nt, Shigella flexneri 2a str. 2457T
agcaaauuuuua

SEQ ID NO: 3829394 - RNA, 11 nt, Shigella flexneri 2a str. 2457T
agcaacaacag

SEQ ID NO: 3829395 - RNA, 19 nt, Shigella flexneri 2a str. 2457T
agcaacaagccaguccaga

SEQ ID NO: 3829396 - RNA, 22 nt, Shigella flexneri 2a str. 2457T
agcaacacaaacgaauuaucac

SEQ ID NO: 3829397 - RNA, 15 nt, Shigella flexneri 2a str. 2457T
agcaacacaaucaga

SEQ ID NO: 3829398 - RNA, 22 nt, Shigella flexneri 2a str. 2457T
agcaacacgccagcguuauccc

SEQ ID NO: 3829399 - RNA, 13 nt, Shigella flexneri 2a str. 2457T
agcaacaggccag

SEQ ID NO: 3829400 - RNA, 17 nt, Shigella flexneri 2a str. 2457T
agcaacaggccaguucg

SEQ ID NO: 3829401 - RNA, 21 nt, Shigella flexneri 2a str. 2457T
agcaacaggccaguucgaaau

SEQ ID NO: 3829402 - RNA, 13 nt, Shigella flexneri 2a str. 2457T
agcaacaguaaua

SEQ ID NO: 3829403 - RNA, 17 nt, Shigella flexneri 2a str. 2457T
agcaacaugcggugauu

SEQ ID NO: 3829404 - RNA, 15 nt, Shigella flexneri 2a str. 2457T
agcaaccaacgccag

SEQ ID NO: 3829405 - RNA, 17 nt, Shigella flexneri 2a str. 2457T
agcaaccaacgccagca

SEQ ID NO: 3829406 - RNA, 18 nt, Shigella flexneri 2a str. 2457T
agcaaccaacgccagcag

SEQ ID NO: 3829407 - RNA, 21 nt, Shigella flexneri 2a str. 2457T
agcaaccaaugccaccaggga

SEQ ID NO: 3829408 - RNA, 18 nt, Shigella flexneri 2a str. 2457T
agcaaccggcgcggcagc

SEQ ID NO: 3829409 - RNA, 17 nt, Shigella flexneri 2a str. 2457T
agcaaccgguaaagaag

SEQ ID NO: 3829410 - RNA, 18 nt, Shigella flexneri 2a str. 2457T
agcaaccgguaaagaaga

SEQ ID NO: 3829411 - RNA, 17 nt, Shigella flexneri 2a str. 2457T
agcaaccggugucauca

SEQ ID NO: 3829412 - RNA, 21 nt, Shigella flexneri 2a str. 2457T
agcaaccugcacguuaucaga

SEQ ID NO: 3829413 - RNA, 15 nt, Shigella flexneri 2a str. 2457T
agcaacgaaacgccg

SEQ ID NO: 3829414 - RNA, 13 nt, Shigella flexneri 2a str. 2457T
agcaacgccaaau

SEQ ID NO: 3829415 - RNA, 13 nt, Shigella flexneri 2a str. 2457T
agcaacgcggcgg

SEQ ID NO: 3829416 - RNA, 16 nt, Shigella flexneri 2a str. 2457T
agcaacuccaucaagc

SEQ ID NO: 3829417 - RNA, 17 nt, Shigella flexneri 2a str. 2457T
agcaacucgaugcugcc

SEQ ID NO: 3829418 - RNA, 17 nt, Shigella flexneri 2a str. 2457T
agcaacugacugacuuc

SEQ ID NO: 3829419 - RNA, 21 nt, Shigella flexneri 2a str. 2457T
agcaacugacugacuucaaca

SEQ ID NO: 3829420 - RNA, 20 nt, Shigella flexneri 2a str. 2457T
agcaacugcgacguggauca

SEQ ID NO: 3829421 - RNA, 12 nt, Shigella flexneri 2a str. 2457T
agcaacuggcaa

SEQ ID NO: 3829422 - RNA, 23 nt, Shigella flexneri 2a str. 2457T
agcaacuuaaucaucaaugccag

SEQ ID NO: 3829423 - RNA, 13 nt, Shigella flexneri 2a str. 2457T
agcaagagcaaau

SEQ ID NO: 3829424 - RNA, 16 nt, Shigella flexneri 2a str. 2457T
agcaagagcaaauaaa

SEQ ID NO: 3829425 - RNA, 18 nt, Shigella flexneri 2a str. 2457T
agcaagccgucgugaaug

SEQ ID NO: 3829426 - RNA, 22 nt, Shigella flexneri 2a str. 2457T
agcaagcgucgccagcgcgcag

SEQ ID NO: 3829427 - RNA, 15 nt, Shigella flexneri 2a str. 2457T
agcaaggaaaaccag

SEQ ID NO: 3829428 - RNA, 15 nt, Shigella flexneri 2a str. 2457T
agcaaggcaaucugc

SEQ ID NO: 3829429 - RNA, 14 nt, Shigella flexneri 2a str. 2457T
agcaaggccagguu

SEQ ID NO: 3829430 - RNA, 19 nt, Shigella flexneri 2a str. 2457T
agcaaggguuuguaggccg

SEQ ID NO: 3829431 - RNA, 18 nt, Shigella flexneri 2a str. 2457T
agcaagucggcaucgcca

SEQ ID NO: 3829432 - RNA, 22 nt, Shigella flexneri 2a str. 2457T
agcaagugcggcgcaccagcag

SEQ ID NO: 3829433 - RNA, 22 nt, Shigella flexneri 2a str. 2457T
agcaauaaacgguagauaauug

SEQ ID NO: 3829434 - RNA, 22 nt, Shigella flexneri 2a str. 2457T
agcaauaacuaagauaauccag

SEQ ID NO: 3829435 - RNA, 23 nt, Shigella flexneri 2a str. 2457T
agcaauaaucagauggcggcugg

SEQ ID NO: 3829436 - RNA, 14 nt, Shigella flexneri 2a str. 2457T
agcaauaaugccag

SEQ ID NO: 3829437 - RNA, 14 nt, Shigella flexneri 2a str. 2457T
agcaauaccgcgaa

SEQ ID NO: 3829438 - RNA, 19 nt, Shigella flexneri 2a str. 2457T
agcaauaccgcgaaucaua

SEQ ID NO: 3829439 - RNA, 23 nt, Shigella flexneri 2a str. 2457T
agcaauagccgccauacggaaaa

SEQ ID NO: 3829440 - RNA, 12 nt, Shigella flexneri 2a str. 2457T
agcaaucaccag

SEQ ID NO: 3829441 - RNA, 20 nt, Shigella flexneri 2a str. 2457T
agcaaucaucccaguggaua

SEQ ID NO: 3829442 - RNA, 16 nt, Shigella flexneri 2a str. 2457T
agcaauccugcaugua

SEQ ID NO: 3829443 - RNA, 22 nt, Shigella flexneri 2a str. 2457T
agcaaucggcuuuuuaugacgc

SEQ ID NO: 3829444 - RNA, 17 nt, Shigella flexneri 2a str. 2457T
agcaggagaagcaaauu

SEQ ID NO: 3829445 - RNA, 12 nt, Shigella flexneri 2a str. 2457T
agcaggagucau

SEQ ID NO: 3829446 - RNA, 16 nt, Shigella flexneri 2a str. 2457T
agcaggaugccugaug

SEQ ID NO: 3829447 - RNA, 20 nt, Shigella flexneri 2a str. 2457T
agcaggcguuaaaacagguc

SEQ ID NO: 3829448 - RNA, 20 nt, Shigella flexneri 2a str. 2457T
agcaggcuaguaaaaagcau

SEQ ID NO: 3829449 - RNA, 13 nt, Shigella flexneri 2a str. 2457T
agcaggcucagaa

SEQ ID NO: 3829450 - RNA, 13 nt, Shigella flexneri 2a str. 2457T
agcaggcuggcua

SEQ ID NO: 3829451 - RNA, 14 nt, Shigella flexneri 2a str. 2457T
agcagggcaaacag

SEQ ID NO: 3829452 - RNA, 17 nt, Shigella flexneri 2a str. 2457T
agcagggcaaacagcac

SEQ ID NO: 3829453 - RNA, 15 nt, Shigella flexneri 2a str. 2457T
agcagguaaucugcc

SEQ ID NO: 3829454 - RNA, 22 nt, Shigella flexneri 2a str. 2457T
agcagguccccgagcacaugca

SEQ ID NO: 3829455 - RNA, 19 nt, Shigella flexneri 2a str. 2457T
agcaguaaaccacccacca

SEQ ID NO: 3829456 - RNA, 19 nt, Shigella flexneri 2a str. 2457T
agcaguaaggucaucaauc

SEQ ID NO: 3829457 - RNA, 20 nt, Shigella flexneri 2a str. 2457T
agcaguaauugcagcagcug

SEQ ID NO: 3829458 - RNA, 13 nt, Shigella flexneri 2a str. 2457T
agcaguacagccg

SEQ ID NO: 3829459 - RNA, 23 nt, Shigella flexneri 2a str. 2457T
agcaguacgccgagaauaaaaca

SEQ ID NO: 3829460 - RNA, 21 nt, Shigella flexneri 2a str. 2457T
agcaguagcgucgccagcagu

SEQ ID NO: 3829461 - RNA, 17 nt, Shigella flexneri 2a str. 2457T
agcagugaauacccaga

SEQ ID NO: 3829462 - RNA, 20 nt, Shigella flexneri 2a str. 2457T
agcagugaauacccagaauc

SEQ ID NO: 3829463 - RNA, 18 nt, Shigella flexneri 2a str. 2457T
agcagugacucacgaauc

SEQ ID NO: 3829464 - RNA, 18 nt, Shigella flexneri 2a str. 2457T
agcaguucaccgccgagg

SEQ ID NO: 3829465 - RNA, 13 nt, Shigella flexneri 2a str. 2457T
agcaguucacgca

SEQ ID NO: 3829466 - RNA, 17 nt, Shigella flexneri 2a str. 2457T
agcaguucacgcagcuu

SEQ ID NO: 3829467 - RNA, 19 nt, Shigella flexneri 2a str. 2457T
agcaguucagucagcagug

SEQ ID NO: 3829468 - RNA, 16 nt, Shigella flexneri 2a str. 2457T
agcaguucaugcacuu

SEQ ID NO: 3829469 - RNA, 14 nt, Shigella flexneri 2a str. 2457T
agcaguuccagcau

SEQ ID NO: 3829470 - RNA, 15 nt, Shigella flexneri 2a str. 2457T
agcaguuccagcauc

SEQ ID NO: 3829471 - RNA, 22 nt, Shigella flexneri 2a str. 2457T
agcaguucuacuggaauuucau

SEQ ID NO: 3829472 - RNA, 18 nt, Shigella flexneri 2a str. 2457T
agcaguuuauaaaauucu

SEQ ID NO: 3829473 - RNA, 17 nt, Shigella flexneri 2a str. 2457T
agcaguuucaccagcag

SEQ ID NO: 3829474 - RNA, 18 nt, Shigella flexneri 2a str. 2457T
agcaguuucaccagcagu

SEQ ID NO: 3829475 - RNA, 13 nt, Shigella flexneri 2a str. 2457T
agcauaaaaauau

SEQ ID NO: 3829476 - RNA, 21 nt, Shigella flexneri 2a str. 2457T
agcauaaucaccaucagcagc

SEQ ID NO: 3829477 - RNA, 18 nt, Shigella flexneri 2a str. 2457T
agcauaaugugcgcacau

SEQ ID NO: 3829478 - RNA, 15 nt, Shigella flexneri 2a str. 2457T
agcauaccgccgagg

SEQ ID NO: 3829479 - RNA, 20 nt, Shigella flexneri 2a str. 2457T
agcauaccgccgaggaacau

SEQ ID NO: 3829480 - RNA, 20 nt, Shigella flexneri 2a str. 2457T
agcauaccggacgacggcau

SEQ ID NO: 3829481 - RNA, 15 nt, Shigella flexneri 2a str. 2457T
agcauaccuuccagc

SEQ ID NO: 3829482 - RNA, 18 nt, Shigella flexneri 2a str. 2457T
agcauagccccagcgcag

SEQ ID NO: 3829483 - RNA, 18 nt, Shigella flexneri 2a str. 2457T
agcauaggcauuaaacau

SEQ ID NO: 3829484 - RNA, 21 nt, Shigella flexneri 2a str. 2457T
agcauaucgacgaaccauuuc

SEQ ID NO: 3829485 - RNA, 17 nt, Shigella flexneri 2a str. 2457T
agcaucaaacuuuuaaa

SEQ ID NO: 3829486 - RNA, 21 nt, Shigella flexneri 2a str. 2457T
agcaucaacaacaauuucacu

SEQ ID NO: 3829487 - RNA, 23 nt, Shigella flexneri 2a str. 2457T
agcaucaacccgcucauaauaca

SEQ ID NO: 3829488 - RNA, 12 nt, Shigella flexneri 2a str. 2457T
agcaucaaugac

SEQ ID NO: 3829489 - RNA, 20 nt, Shigella flexneri 2a str. 2457T
agcaucaaugaccugacuuc

SEQ ID NO: 3829490 - RNA, 14 nt, Shigella flexneri 2a str. 2457T
agcaucaauugcua

SEQ ID NO: 3829491 - RNA, 22 nt, Shigella flexneri 2a str. 2457T
agcaucacauaaucgaaaacau

SEQ ID NO: 3829492 - RNA, 13 nt, Shigella flexneri 2a str. 2457T
agcaucagcgcca

SEQ ID NO: 3829493 - RNA, 16 nt, Shigella flexneri 2a str. 2457T
agcaucagcgccacca

SEQ ID NO: 3829494 - RNA, 22 nt, Shigella flexneri 2a str. 2457T
agcaucaguucggaaacagugc

SEQ ID NO: 3829495 - RNA, 14 nt, Shigella flexneri 2a str. 2457T
agcaucauaagacu

SEQ ID NO: 3829496 - RNA, 16 nt, Shigella flexneri 2a str. 2457T
agcaucccaccugaaa

SEQ ID NO: 3829497 - RNA, 22 nt, Shigella flexneri 2a str. 2457T
agcauccccggcaaccacaccc

SEQ ID NO: 3829498 - RNA, 19 nt, Shigella flexneri 2a str. 2457T
agcaucccggcagccccaa

SEQ ID NO: 3829499 - RNA, 23 nt, Shigella flexneri 2a str. 2457T
agcaucccguuaugguuauccac

SEQ ID NO: 3829500 - RNA, 20 nt, Shigella flexneri 2a str. 2457T
agcaucgaccaggauuugau

SEQ ID NO: 3829501 - RNA, 14 nt, Shigella flexneri 2a str. 2457T
agcaucgcaacaug

SEQ ID NO: 3829502 - RNA, 13 nt, Shigella flexneri 2a str. 2457T
agcaucgcaucaa

SEQ ID NO: 3829503 - RNA, 20 nt, Shigella flexneri 2a str. 2457T
agcaucgucaucagcuccau

SEQ ID NO: 3829504 - RNA, 16 nt, Shigella flexneri 2a str. 2457T
agcaucucauccauca

SEQ ID NO: 3829505 - RNA, 19 nt, Shigella flexneri 2a str. 2457T
agcaucucauccaucaaau

SEQ ID NO: 3829506 - RNA, 18 nt, Shigella flexneri 2a str. 2457T
agcaucucuacagcgccc

SEQ ID NO: 3829507 - RNA, 17 nt, Shigella flexneri 2a str. 2457T
agcaucugcaaaauuuc

SEQ ID NO: 3829508 - RNA, 16 nt, Shigella flexneri 2a str. 2457T
agcaucuuaucacgau

SEQ ID NO: 3829509 - RNA, 18 nt, Shigella flexneri 2a str. 2457T
agcaugaaaugaaaauca

SEQ ID NO: 3829510 - RNA, 18 nt, Shigella flexneri 2a str. 2457T
agcaugaacauugcugcu

SEQ ID NO: 3829511 - RNA, 21 nt, Shigella flexneri 2a str. 2457T
agcaugacuaccggggacagg

SEQ ID NO: 3829512 - RNA, 14 nt, Shigella flexneri 2a str. 2457T
agcaugauauucac

SEQ ID NO: 3829513 - RNA, 19 nt, Shigella flexneri 2a str. 2457T
agcaugauauucacgggga

SEQ ID NO: 3829514 - RNA, 24 nt, Shigella flexneri 2a str. 2457T
agcaugauauucacggggaauagc

SEQ ID NO: 3829515 - RNA, 23 nt, Shigella flexneri 2a str. 2457T
agcaugauuuuguaggccggaua

SEQ ID NO: 3829516 - RNA, 16 nt, Shigella flexneri 2a str. 2457T
agcaugcaucccgccg

SEQ ID NO: 3829517 - RNA, 12 nt, Shigella flexneri 2a str. 2457T
agcaugcuggcu

SEQ ID NO: 3829518 - RNA, 14 nt, Shigella flexneri 2a str. 2457T
agcauggacuggcu

SEQ ID NO: 3829519 - RNA, 17 nt, Shigella flexneri 2a str. 2457T
agcauuaaggcaagaaa

SEQ ID NO: 3829520 - RNA, 16 nt, Shigella flexneri 2a str. 2457T
agcauuaaugcgccca

SEQ ID NO: 3829521 - RNA, 13 nt, Shigella flexneri 2a str. 2457T
agcauuauuuuua

SEQ ID NO: 3829522 - RNA, 15 nt, Shigella flexneri 2a str. 2457T
agcauuauuuuuaaa

SEQ ID NO: 3829523 - RNA, 20 nt, Shigella flexneri 2a str. 2457T
agcauuauuuuuaaacauca

SEQ ID NO: 3829524 - RNA, 22 nt, Shigella flexneri 2a str. 2457T
agcauuauuuuuaaacaucaaa

SEQ ID NO: 3829525 - RNA, 12 nt, Shigella flexneri 2a str. 2457T
agcauuccagau

SEQ ID NO: 3829526 - RNA, 14 nt, Shigella flexneri 2a str. 2457T
agcauucgccgcau

SEQ ID NO: 3829527 - RNA, 18 nt, Shigella flexneri 2a str. 2457T
agcauugcgccugcaggu

SEQ ID NO: 3829528 - RNA, 14 nt, Shigella flexneri 2a str. 2457T
agcauuggguaaaa

SEQ ID NO: 3829529 - RNA, 21 nt, Shigella flexneri 2a str. 2457T
agcauuggguaaaauggccga

SEQ ID NO: 3829530 - RNA, 23 nt, Shigella flexneri 2a str. 2457T
agcauuucaaaacggucacggcu

SEQ ID NO: 3829531 - RNA, 20 nt, Shigella flexneri 2a str. 2457T
agcauuuccuuaaaagugag

SEQ ID NO: 3829532 - RNA, 19 nt, Shigella flexneri 2a str. 2457T
agcauuucgcgauauugcu

SEQ ID NO: 3829533 - RNA, 14 nt, Shigella flexneri 2a str. 2457T
agcauuuuuucaca

SEQ ID NO: 3829534 - RNA, 12 nt, Shigella flexneri 2a str. 2457T
agccaaaaauga

SEQ ID NO: 3829535 - RNA, 13 nt, Shigella flexneri 2a str. 2457T
agccaaaacugca

SEQ ID NO: 3829536 - RNA, 17 nt, Shigella flexneri 2a str. 2457T
agccaaaacugcacugg

SEQ ID NO: 3829537 - RNA, 13 nt, Shigella flexneri 2a str. 2457T
agccaaaaugccu

SEQ ID NO: 3829538 - RNA, 21 nt, Shigella flexneri 2a str. 2457T
agccaaagggcuggcaaugac

SEQ ID NO: 3829539 - RNA, 14 nt, Shigella flexneri 2a str. 2457T
agccaaauaaaauc

SEQ ID NO: 3829540 - RNA, 13 nt, Shigella flexneri 2a str. 2457T
agccaaaucaucc

SEQ ID NO: 3829541 - RNA, 15 nt, Shigella flexneri 2a str. 2457T
agccgaugccgcugc

SEQ ID NO: 3829542 - RNA, 20 nt, Shigella flexneri 2a str. 2457T
agccgauuaaaaucagaauc

SEQ ID NO: 3829543 - RNA, 17 nt, Shigella flexneri 2a str. 2457T
agccgauuaaucuucca

SEQ ID NO: 3829544 - RNA, 21 nt, Shigella flexneri 2a str. 2457T
agccgauuaaucuuccagauc

SEQ ID NO: 3829545 - RNA, 13 nt, Shigella flexneri 2a str. 2457T
agccgcacgcugg

SEQ ID NO: 3829546 - RNA, 16 nt, Shigella flexneri 2a str. 2457T
agccgcagccaucagc

SEQ ID NO: 3829547 - RNA, 17 nt, Shigella flexneri 2a str. 2457T
agccgcagccaucagcg

SEQ ID NO: 3829548 - RNA, 19 nt, Shigella flexneri 2a str. 2457T
agccgcaucaccgcaccag

SEQ ID NO: 3829549 - RNA, 14 nt, Shigella flexneri 2a str. 2457T
agccgcauuuuuuc

SEQ ID NO: 3829550 - RNA, 14 nt, Shigella flexneri 2a str. 2457T
agccgccagcucuu

SEQ ID NO: 3829551 - RNA, 15 nt, Shigella flexneri 2a str. 2457T
agccgccaucucuuc

SEQ ID NO: 3829552 - RNA, 13 nt, Shigella flexneri 2a str. 2457T
agccgcccuguuu

SEQ ID NO: 3829553 - RNA, 23 nt, Shigella flexneri 2a str. 2457T
agccgccgagcaaaccacaggcc

SEQ ID NO: 3829554 - RNA, 17 nt, Shigella flexneri 2a str. 2457T
agccgcgccgagcggga

SEQ ID NO: 3829555 - RNA, 23 nt, Shigella flexneri 2a str. 2457T
agccgcgcuuucuucuucgcgac

SEQ ID NO: 3829556 - RNA, 17 nt, Shigella flexneri 2a str. 2457T
agccgcuaacagcagca

SEQ ID NO: 3829557 - RNA, 13 nt, Shigella flexneri 2a str. 2457T
agccgcuacggaa

SEQ ID NO: 3829558 - RNA, 17 nt, Shigella flexneri 2a str. 2457T
agccgcuuuuucugcgc

SEQ ID NO: 3829559 - RNA, 21 nt, Shigella flexneri 2a str. 2457T
agccggaaaaccaccacuccc

SEQ ID NO: 3829560 - RNA, 14 nt, Shigella flexneri 2a str. 2457T
agccggaauuuucc

SEQ ID NO: 3829561 - RNA, 16 nt, Shigella flexneri 2a str. 2457T
agccggaccucuuucu

SEQ ID NO: 3829562 - RNA, 17 nt, Shigella flexneri 2a str. 2457T
agccggacugggcgcgc

SEQ ID NO: 3829563 - RNA, 20 nt, Shigella flexneri 2a str. 2457T
agccggagaaauaccacccg

SEQ ID NO: 3829564 - RNA, 14 nt, Shigella flexneri 2a str. 2457T
agccggagcuucac

SEQ ID NO: 3829565 - RNA, 15 nt, Shigella flexneri 2a str. 2457T
agccggaugccucuc

SEQ ID NO: 3829566 - RNA, 13 nt, Shigella flexneri 2a str. 2457T
agccgggaagaau

SEQ ID NO: 3829567 - RNA, 23 nt, Shigella flexneri 2a str. 2457T
agccgguugccugaugcgacgcu

SEQ ID NO: 3829568 - RNA, 12 nt, Shigella flexneri 2a str. 2457T
agccgguuuugg

SEQ ID NO: 3829569 - RNA, 21 nt, Shigella flexneri 2a str. 2457T
agccgguuuugguuuucuguc

SEQ ID NO: 3829570 - RNA, 15 nt, Shigella flexneri 2a str. 2457T
agccgucauucugca

SEQ ID NO: 3829571 - RNA, 22 nt, Shigella flexneri 2a str. 2457T
agccgugaaaacagcaaccucc

SEQ ID NO: 3829572 - RNA, 18 nt, Shigella flexneri 2a str. 2457T
agccgugaaucacuccau

SEQ ID NO: 3829573 - RNA, 23 nt, Shigella flexneri 2a str. 2457T
agccguuucgaauuacacagcca

SEQ ID NO: 3829574 - RNA, 22 nt, Shigella flexneri 2a str. 2457T
agccuaagaagucauuggcuga

SEQ ID NO: 3829575 - RNA, 18 nt, Shigella flexneri 2a str. 2457T
agccuaagccauuuaacu

SEQ ID NO: 3829576 - RNA, 13 nt, Shigella flexneri 2a str. 2457T
agccuaccagacc

SEQ ID NO: 3829577 - RNA, 18 nt, Shigella flexneri 2a str. 2457T
agccuaccagaccgcaca

SEQ ID NO: 3829578 - RNA, 14 nt, Shigella flexneri 2a str. 2457T
agccuauaacgaaa

SEQ ID NO: 3829579 - RNA, 14 nt, Shigella flexneri 2a str. 2457T
agccucccauuucc

SEQ ID NO: 3829580 - RNA, 19 nt, Shigella flexneri 2a str. 2457T
agccucccugccuccauga

SEQ ID NO: 3829581 - RNA, 13 nt, Shigella flexneri 2a str. 2457T
agccucgccgagc

SEQ ID NO: 3829582 - RNA, 22 nt, Shigella flexneri 2a str. 2457T
agccugaacuaaagccuuuugc

SEQ ID NO: 3829583 - RNA, 21 nt, Shigella flexneri 2a str. 2457T
agccugacgcccguuuucacc

SEQ ID NO: 3829584 - RNA, 18 nt, Shigella flexneri 2a str. 2457T
agccugcaaacgcuggug

SEQ ID NO: 3829585 - RNA, 12 nt, Shigella flexneri 2a str. 2457T
agccugccagag

SEQ ID NO: 3829586 - RNA, 19 nt, Shigella flexneri 2a str. 2457T
agccugccagaggagccau

SEQ ID NO: 3829587 - RNA, 19 nt, Shigella flexneri 2a str. 2457T
agccugccaucuggcaggc

SEQ ID NO: 3829588 - RNA, 22 nt, Shigella flexneri 2a str. 2457T
agccugccauuggcaggcucug

SEQ ID NO: 3829589 - RNA, 16 nt, Shigella flexneri 2a str. 2457T
agccuggcuaagccac

SEQ ID NO: 3829590 - RNA, 15 nt, Shigella flexneri 2a str. 2457T
agccuguaccacaac

SEQ ID NO: 3829591 - RNA, 21 nt, Shigella flexneri 2a str. 2457T
agccuguuacauaugcgcugg

SEQ ID NO: 3829592 - RNA, 22 nt, Shigella flexneri 2a str. 2457T
agccuucgcgcaaccaacggcc

SEQ ID NO: 3829593 - RNA, 13 nt, Shigella flexneri 2a str. 2457T
agccuugccagau

SEQ ID NO: 3829594 - RNA, 14 nt, Shigella flexneri 2a str. 2457T
agccuuuccggcaa

SEQ ID NO: 3829595 - RNA, 12 nt, Shigella flexneri 2a str. 2457T
agccuuucgcaa

SEQ ID NO: 3829596 - RNA, 15 nt, Shigella flexneri 2a str. 2457T
agccuuuuucagccg

SEQ ID NO: 3829597 - RNA, 18 nt, Shigella flexneri 2a str. 2457T
agccuuuuucagccgcaa

SEQ ID NO: 3829598 - RNA, 18 nt, Shigella flexneri 2a str. 2457T
agccuuuuuuauuuuuua

SEQ ID NO: 3829599 - RNA, 18 nt, Shigella flexneri 2a str. 2457T
agcgaaaacgaauacgcc

SEQ ID NO: 3829600 - RNA, 13 nt, Shigella flexneri 2a str. 2457T
agcgaaacagcug

SEQ ID NO: 3829601 - RNA, 17 nt, Shigella flexneri 2a str. 2457T
agcgaaaguaacaccau

SEQ ID NO: 3829602 - RNA, 23 nt, Shigella flexneri 2a str. 2457T
agcgaaagucaggauagauagau

SEQ ID NO: 3829603 - RNA, 13 nt, Shigella flexneri 2a str. 2457T
agcgaacaccagc

SEQ ID NO: 3829604 - RNA, 21 nt, Shigella flexneri 2a str. 2457T
agcgaacaggaguagcucugg

SEQ ID NO: 3829605 - RNA, 15 nt, Shigella flexneri 2a str. 2457T
agcgaagcccacgcc

SEQ ID NO: 3829606 - RNA, 16 nt, Shigella flexneri 2a str. 2457T
agcgaagcgaacaucg

SEQ ID NO: 3829607 - RNA, 17 nt, Shigella flexneri 2a str. 2457T
agcgaagcggcacugcu

SEQ ID NO: 3829608 - RNA, 15 nt, Shigella flexneri 2a str. 2457T
agcgaaggaucaccc

SEQ ID NO: 3829609 - RNA, 15 nt, Shigella flexneri 2a str. 2457T
agcgaauccagcaug

SEQ ID NO: 3829610 - RNA, 16 nt, Shigella flexneri 2a str. 2457T
agcgaauccagcaugc

SEQ ID NO: 3829611 - RNA, 23 nt, Shigella flexneri 2a str. 2457T
agcgaauccagcaugcucaccac

SEQ ID NO: 3829612 - RNA, 14 nt, Shigella flexneri 2a str. 2457T
agcgaauuccaguu

SEQ ID NO: 3829613 - RNA, 16 nt, Shigella flexneri 2a str. 2457T
agcgacaaacgccuga

SEQ ID NO: 3829614 - RNA, 23 nt, Shigella flexneri 2a str. 2457T
agcgacaccucccagcgcgguga

SEQ ID NO: 3829615 - RNA, 20 nt, Shigella flexneri 2a str. 2457T
agcgacaggucagcgccugg

SEQ ID NO: 3829616 - RNA, 18 nt, Shigella flexneri 2a str. 2457T
agcgaccauacagcagca

SEQ ID NO: 3829617 - RNA, 16 nt, Shigella flexneri 2a str. 2457T
agcgacgggcuaaucg

SEQ ID NO: 3829618 - RNA, 13 nt, Shigella flexneri 2a str. 2457T
agcgacguaaaaa

SEQ ID NO: 3829619 - RNA, 23 nt, Shigella flexneri 2a str. 2457T
agcgacuccaguuuguucagcug

SEQ ID NO: 3829620 - RNA, 19 nt, Shigella flexneri 2a str. 2457T
agcgacucgguugcacaga

SEQ ID NO: 3829621 - RNA, 16 nt, Shigella flexneri 2a str. 2457T
agcgacucucugagcc

SEQ ID NO: 3829622 - RNA, 23 nt, Shigella flexneri 2a str. 2457T
agcgacugcgggcgcaagggcug

SEQ ID NO: 3829623 - RNA, 14 nt, Shigella flexneri 2a str. 2457T
agcgacuugggcga

SEQ ID NO: 3829624 - RNA, 21 nt, Shigella flexneri 2a str. 2457T
agcgagcuggcgcugauaaau

SEQ ID NO: 3829625 - RNA, 21 nt, Shigella flexneri 2a str. 2457T
agcgagguauuuucugaaacg

SEQ ID NO: 3829626 - RNA, 14 nt, Shigella flexneri 2a str. 2457T
agcgaguugaucac

SEQ ID NO: 3829627 - RNA, 23 nt, Shigella flexneri 2a str. 2457T
agcgaguuugaucucgaugccgc

SEQ ID NO: 3829628 - RNA, 12 nt, Shigella flexneri 2a str. 2457T
agcgaguuuuuc

SEQ ID NO: 3829629 - RNA, 19 nt, Shigella flexneri 2a str. 2457T
agcgauaaaaauaccgagc

SEQ ID NO: 3829630 - RNA, 20 nt, Shigella flexneri 2a str. 2457T
agcgauaacguguuccaguu

SEQ ID NO: 3829631 - RNA, 15 nt, Shigella flexneri 2a str. 2457T
agcgauaagaacuau

SEQ ID NO: 3829632 - RNA, 22 nt, Shigella flexneri 2a str. 2457T
agcgauauccagugccagaaug

SEQ ID NO: 3829633 - RNA, 23 nt, Shigella flexneri 2a str. 2457T
agcgaucauguaccguugcugcc

SEQ ID NO: 3829634 - RNA, 22 nt, Shigella flexneri 2a str. 2457T
agcgaucauuagcccaauaauc

SEQ ID NO: 3829635 - RNA, 16 nt, Shigella flexneri 2a str. 2457T
agcgaugagagaucga

SEQ ID NO: 3829636 - RNA, 19 nt, Shigella flexneri 2a str. 2457T
agcgaugcccagugaccaa

SEQ ID NO: 3829637 - RNA, 22 nt, Shigella flexneri 2a str. 2457T
agcgaugcugauguacccgcug

SEQ ID NO: 3829638 - RNA, 11 nt, Shigella flexneri 2a str. 2457T
agcgaugcugc

SEQ ID NO: 3829639 - RNA, 22 nt, Shigella flexneri 2a str. 2457T
agcgaugguacuucaaucgcca

SEQ ID NO: 3829640 - RNA, 23 nt, Shigella flexneri 2a str. 2457T
agcgaugguacuucaaucgccac

SEQ ID NO: 3829641 - RNA, 16 nt, Shigella flexneri 2a str. 2457T
agcgauuaugaaacaa

SEQ ID NO: 3829642 - RNA, 21 nt, Shigella flexneri 2a str. 2457T
agcgauucccguuuauggucg

SEQ ID NO: 3829643 - RNA, 19 nt, Shigella flexneri 2a str. 2457T
agcgauucucgccgcccug

SEQ ID NO: 3829644 - RNA, 16 nt, Shigella flexneri 2a str. 2457T
agcgauuuaugauauu

SEQ ID NO: 3829645 - RNA, 20 nt, Shigella flexneri 2a str. 2457T
agcgauuuguaggccugaua

SEQ ID NO: 3829646 - RNA, 17 nt, Shigella flexneri 2a str. 2457T
agcgcaaaggccagcaa

SEQ ID NO: 3829647 - RNA, 19 nt, Shigella flexneri 2a str. 2457T
agcgcaaaggccagcaauc

SEQ ID NO: 3829648 - RNA, 15 nt, Shigella flexneri 2a str. 2457T
agcgcaaauggugac

SEQ ID NO: 3829649 - RNA, 17 nt, Shigella flexneri 2a str. 2457T
agcgcaagggccgcagc

SEQ ID NO: 3829650 - RNA, 14 nt, Shigella flexneri 2a str. 2457T
agcgcaaucaccac

SEQ ID NO: 3829651 - RNA, 11 nt, Shigella flexneri 2a str. 2457T
agcgcacaugc

SEQ ID NO: 3829652 - RNA, 14 nt, Shigella flexneri 2a str. 2457T
agcgcaccaauuca

SEQ ID NO: 3829653 - RNA, 14 nt, Shigella flexneri 2a str. 2457T
agcgcagacaccag

SEQ ID NO: 3829654 - RNA, 13 nt, Shigella flexneri 2a str. 2457T
agcgcagcaccca

SEQ ID NO: 3829655 - RNA, 17 nt, Shigella flexneri 2a str. 2457T
agcgcagcgaguaaaaa

SEQ ID NO: 3829656 - RNA, 13 nt, Shigella flexneri 2a str. 2457T
agcgcagcgcauc

SEQ ID NO: 3829657 - RNA, 15 nt, Shigella flexneri 2a str. 2457T
agcgcagcgcaucag

SEQ ID NO: 3829658 - RNA, 18 nt, Shigella flexneri 2a str. 2457T
agcgcagucaccagcauc

SEQ ID NO: 3829659 - RNA, 14 nt, Shigella flexneri 2a str. 2457T
agcgcauaaaagcu

SEQ ID NO: 3829660 - RNA, 15 nt, Shigella flexneri 2a str. 2457T
agcgcauaagccacc

SEQ ID NO: 3829661 - RNA, 17 nt, Shigella flexneri 2a str. 2457T
agcgcauaagccaccuc

SEQ ID NO: 3829662 - RNA, 21 nt, Shigella flexneri 2a str. 2457T
agcgcaucaggcaaucuuguu

SEQ ID NO: 3829663 - RNA, 16 nt, Shigella flexneri 2a str. 2457T
agcgcaucaggcaaug

SEQ ID NO: 3829664 - RNA, 19 nt, Shigella flexneri 2a str. 2457T
agcgcaucaggcaauguug

SEQ ID NO: 3829665 - RNA, 18 nt, Shigella flexneri 2a str. 2457T
agcgcaucaggcaguuuu

SEQ ID NO: 3829666 - RNA, 15 nt, Shigella flexneri 2a str. 2457T
agcgcaucugccgga

SEQ ID NO: 3829667 - RNA, 22 nt, Shigella flexneri 2a str. 2457T
agcgcaugaucguucaccuaaa

SEQ ID NO: 3829668 - RNA, 19 nt, Shigella flexneri 2a str. 2457T
agcgcauggcguccgucau

SEQ ID NO: 3829669 - RNA, 17 nt, Shigella flexneri 2a str. 2457T
agcgcauucggcaagau

SEQ ID NO: 3829670 - RNA, 16 nt, Shigella flexneri 2a str. 2457T
agcgcauuuccaagau

SEQ ID NO: 3829671 - RNA, 19 nt, Shigella flexneri 2a str. 2457T
agcgcauuuccaagauuaa

SEQ ID NO: 3829672 - RNA, 12 nt, Shigella flexneri 2a str. 2457T
agcgccaacggu

SEQ ID NO: 3829673 - RNA, 20 nt, Shigella flexneri 2a str. 2457T
agcgccaccacaaaagcggu

SEQ ID NO: 3829674 - RNA, 16 nt, Shigella flexneri 2a str. 2457T
agcgccaccaccagca

SEQ ID NO: 3829675 - RNA, 17 nt, Shigella flexneri 2a str. 2457T
agcgccaccaccagcac

SEQ ID NO: 3829676 - RNA, 20 nt, Shigella flexneri 2a str. 2457T
agcgccaccaccagcacacu

SEQ ID NO: 3829677 - RNA, 21 nt, Shigella flexneri 2a str. 2457T
agcgccaccgguuuauuauug

SEQ ID NO: 3829678 - RNA, 16 nt, Shigella flexneri 2a str. 2457T
agcgccacgcaacaga

SEQ ID NO: 3829679 - RNA, 21 nt, Shigella flexneri 2a str. 2457T
agcgccacgcuguucgcaacc

SEQ ID NO: 3829680 - RNA, 16 nt, Shigella flexneri 2a str. 2457T
agcgccagaagggaca

SEQ ID NO: 3829681 - RNA, 20 nt, Shigella flexneri 2a str. 2457T
agcgccagaaguugcucaag

SEQ ID NO: 3829682 - RNA, 21 nt, Shigella flexneri 2a str. 2457T
agcgccagaaguugcucaagc

SEQ ID NO: 3829683 - RNA, 20 nt, Shigella flexneri 2a str. 2457T
agcgccagcaagagcaaaua

SEQ ID NO: 3829684 - RNA, 19 nt, Shigella flexneri 2a str. 2457T
agcgccagggcaugguacc

SEQ ID NO: 3829685 - RNA, 19 nt, Shigella flexneri 2a str. 2457T
agcgccaguugcucgacac

SEQ ID NO: 3829686 - RNA, 14 nt, Shigella flexneri 2a str. 2457T
agcgcccgccagca

SEQ ID NO: 3829687 - RNA, 16 nt, Shigella flexneri 2a str. 2457T
agcgcccugcaauguc

SEQ ID NO: 3829688 - RNA, 19 nt, Shigella flexneri 2a str. 2457T
agcgccgacagcagcccuu

SEQ ID NO: 3829689 - RNA, 20 nt, Shigella flexneri 2a str. 2457T
agcgccgcaacuaccagcag

SEQ ID NO: 3829690 - RNA, 23 nt, Shigella flexneri 2a str. 2457T
agcgccgccagaaucaccucuuu

SEQ ID NO: 3829691 - RNA, 23 nt, Shigella flexneri 2a str. 2457T
agcgccgucaguuuuucacccgc

SEQ ID NO: 3829692 - RNA, 16 nt, Shigella flexneri 2a str. 2457T
agcgccuaaauccacc

SEQ ID NO: 3829693 - RNA, 17 nt, Shigella flexneri 2a str. 2457T
agcgccuaaauccaccg

SEQ ID NO: 3829694 - RNA, 23 nt, Shigella flexneri 2a str. 2457T
agcgccucggggccacagguaua

SEQ ID NO: 3829695 - RNA, 21 nt, Shigella flexneri 2a str. 2457T
agcgccucgucguuguucuac

SEQ ID NO: 3829696 - RNA, 21 nt, Shigella flexneri 2a str. 2457T
agcgccugcgcggcaaugcgc

SEQ ID NO: 3829697 - RNA, 14 nt, Shigella flexneri 2a str. 2457T
agcgccugcugcug

SEQ ID NO: 3829698 - RNA, 15 nt, Shigella flexneri 2a str. 2457T
agcgccuuauccugc

SEQ ID NO: 3829699 - RNA, 16 nt, Shigella flexneri 2a str. 2457T
agcgccuuauccugcc

SEQ ID NO: 3829700 - RNA, 20 nt, Shigella flexneri 2a str. 2457T
agcgccuucuacagcuucac

SEQ ID NO: 3829701 - RNA, 18 nt, Shigella flexneri 2a str. 2457T
agcgcgaagcuggcggcg

SEQ ID NO: 3829702 - RNA, 15 nt, Shigella flexneri 2a str. 2457T
agcgcgcaguugcaa

SEQ ID NO: 3829703 - RNA, 20 nt, Shigella flexneri 2a str. 2457T
agcgcgcgaauauggcggcg

SEQ ID NO: 3829704 - RNA, 22 nt, Shigella flexneri 2a str. 2457T
agcgcgcugacauuacgcgcuu

SEQ ID NO: 3829705 - RNA, 15 nt, Shigella flexneri 2a str. 2457T
agcgcggcgcaggca

SEQ ID NO: 3829706 - RNA, 17 nt, Shigella flexneri 2a str. 2457T
agcgcggcgcaggcaau

SEQ ID NO: 3829707 - RNA, 19 nt, Shigella flexneri 2a str. 2457T
agcgcggggaucacuggca

SEQ ID NO: 3829708 - RNA, 23 nt, Shigella flexneri 2a str. 2457T
agcgcgugaccgaaauggagccg

SEQ ID NO: 3829709 - RNA, 13 nt, Shigella flexneri 2a str. 2457T
agcgcguucuguu

SEQ ID NO: 3829710 - RNA, 22 nt, Shigella flexneri 2a str. 2457T
agcgcguucuguucaaaugcgc

SEQ ID NO: 3829711 - RNA, 13 nt, Shigella flexneri 2a str. 2457T
agcgcguugcgcc

SEQ ID NO: 3829712 - RNA, 21 nt, Shigella flexneri 2a str. 2457T
agcgcuaauacgaugcaaccg

SEQ ID NO: 3829713 - RNA, 14 nt, Shigella flexneri 2a str. 2457T
agcgcuaccgccga

SEQ ID NO: 3829714 - RNA, 18 nt, Shigella flexneri 2a str. 2457T
agcgcugaagaaaauggc

SEQ ID NO: 3829715 - RNA, 20 nt, Shigella flexneri 2a str. 2457T
agcgcugaagaaaauggcca

SEQ ID NO: 3829716 - RNA, 15 nt, Shigella flexneri 2a str. 2457T
agcgcugagacgcgc

SEQ ID NO: 3829717 - RNA, 14 nt, Shigella flexneri 2a str. 2457T
agcgcugcaaacca

SEQ ID NO: 3829718 - RNA, 19 nt, Shigella flexneri 2a str. 2457T
agcgcugcugcacauacug

SEQ ID NO: 3829719 - RNA, 23 nt, Shigella flexneri 2a str. 2457T
agcgcugcugcacauacugcauc

SEQ ID NO: 3829720 - RNA, 19 nt, Shigella flexneri 2a str. 2457T
agcgcuggugacaucgcca

SEQ ID NO: 3829721 - RNA, 22 nt, Shigella flexneri 2a str. 2457T
agcgcuggugacaucgccagag

SEQ ID NO: 3829722 - RNA, 23 nt, Shigella flexneri 2a str. 2457T
agcgcuggugacaucgccagaga

SEQ ID NO: 3829723 - RNA, 20 nt, Shigella flexneri 2a str. 2457T
agcgcuuuugcuacuuuuuu

SEQ ID NO: 3829724 - RNA, 14 nt, Shigella flexneri 2a str. 2457T
agcgcuuuuuuccu

SEQ ID NO: 3829725 - RNA, 15 nt, Shigella flexneri 2a str. 2457T
agcgcuuuuuuccug

SEQ ID NO: 3829726 - RNA, 17 nt, Shigella flexneri 2a str. 2457T
agcgcuuuuuuccugcc

SEQ ID NO: 3829727 - RNA, 20 nt, Shigella flexneri 2a str. 2457T
agcggaaauuaccgcaccac

SEQ ID NO: 3829728 - RNA, 17 nt, Shigella flexneri 2a str. 2457T
agcggaacugaagcuga

SEQ ID NO: 3829729 - RNA, 21 nt, Shigella flexneri 2a str. 2457T
agcggacucaccgagcagcac

SEQ ID NO: 3829730 - RNA, 22 nt, Shigella flexneri 2a str. 2457T
agcggauacaggaagcgaauca

SEQ ID NO: 3829731 - RNA, 14 nt, Shigella flexneri 2a str. 2457T
agcggaugacccag

SEQ ID NO: 3829732 - RNA, 24 nt, Shigella flexneri 2a str. 2457T
agcggaugacccagcgcgaucgca

SEQ ID NO: 3829733 - RNA, 20 nt, Shigella flexneri 2a str. 2457T
agcggcaaugcguuccagca

SEQ ID NO: 3829734 - RNA, 17 nt, Shigella flexneri 2a str. 2457T
agcggccaaagggagca

SEQ ID NO: 3829735 - RNA, 17 nt, Shigella flexneri 2a str. 2457T
agcucggcaaucuguua

SEQ ID NO: 3829736 - RNA, 19 nt, Shigella flexneri 2a str. 2457T
agcucgguauggccuuucu

SEQ ID NO: 3829737 - RNA, 19 nt, Shigella flexneri 2a str. 2457T
agcucgguggcgauguaau

SEQ ID NO: 3829738 - RNA, 14 nt, Shigella flexneri 2a str. 2457T
agcucucagccagc

SEQ ID NO: 3829739 - RNA, 21 nt, Shigella flexneri 2a str. 2457T
agcucucagccagcuggcaga

SEQ ID NO: 3829740 - RNA, 17 nt, Shigella flexneri 2a str. 2457T
agcucucuuccaguucg

SEQ ID NO: 3829741 - RNA, 11 nt, Shigella flexneri 2a str. 2457T
agcucugccac

SEQ ID NO: 3829742 - RNA, 18 nt, Shigella flexneri 2a str. 2457T
agcucugguguggagugc

SEQ ID NO: 3829743 - RNA, 14 nt, Shigella flexneri 2a str. 2457T
agcucuucuucacu

SEQ ID NO: 3829744 - RNA, 22 nt, Shigella flexneri 2a str. 2457T
agcucuucuucacucucaccac

SEQ ID NO: 3829745 - RNA, 15 nt, Shigella flexneri 2a str. 2457T
agcucuuucgacagc

SEQ ID NO: 3829746 - RNA, 19 nt, Shigella flexneri 2a str. 2457T
agcucuuucgacagcgauu

SEQ ID NO: 3829747 - RNA, 16 nt, Shigella flexneri 2a str. 2457T
agcucuuuuccagcca

SEQ ID NO: 3829748 - RNA, 16 nt, Shigella flexneri 2a str. 2457T
agcugaaaaucagauc

SEQ ID NO: 3829749 - RNA, 17 nt, Shigella flexneri 2a str. 2457T
agcugaacagggcguca

SEQ ID NO: 3829750 - RNA, 18 nt, Shigella flexneri 2a str. 2457T
agcugaagcucguuguuu

SEQ ID NO: 3829751 - RNA, 22 nt, Shigella flexneri 2a str. 2457T
agcugaauaucacgggcgcgga

SEQ ID NO: 3829752 - RNA, 13 nt, Shigella flexneri 2a str. 2457T
agcugaauuucau

SEQ ID NO: 3829753 - RNA, 21 nt, Shigella flexneri 2a str. 2457T
agcugaauuucaucaccagcu

SEQ ID NO: 3829754 - RNA, 13 nt, Shigella flexneri 2a str. 2457T
agcugagaaaaag

SEQ ID NO: 3829755 - RNA, 16 nt, Shigella flexneri 2a str. 2457T
agcugagcacaaaaca

SEQ ID NO: 3829756 - RNA, 15 nt, Shigella flexneri 2a str. 2457T
agcugauucagauaa

SEQ ID NO: 3829757 - RNA, 20 nt, Shigella flexneri 2a str. 2457T
agcugauugaaauagccaau

SEQ ID NO: 3829758 - RNA, 14 nt, Shigella flexneri 2a str. 2457T
agcugauugcggag

SEQ ID NO: 3829759 - RNA, 15 nt, Shigella flexneri 2a str. 2457T
agcugcacgaugacu

SEQ ID NO: 3829760 - RNA, 21 nt, Shigella flexneri 2a str. 2457T
agcugcacgaugacugaacag

SEQ ID NO: 3829761 - RNA, 17 nt, Shigella flexneri 2a str. 2457T
agcugcauacggugaaa

SEQ ID NO: 3829762 - RNA, 13 nt, Shigella flexneri 2a str. 2457T
agcugccaguugu

SEQ ID NO: 3829763 - RNA, 19 nt, Shigella flexneri 2a str. 2457T
agcugccgaaccacugaug

SEQ ID NO: 3829764 - RNA, 14 nt, Shigella flexneri 2a str. 2457T
agcugccgccaggc

SEQ ID NO: 3829765 - RNA, 15 nt, Shigella flexneri 2a str. 2457T
agcugccgccaggcu

SEQ ID NO: 3829766 - RNA, 18 nt, Shigella flexneri 2a str. 2457T
agcugccuguacggcagu

SEQ ID NO: 3829767 - RNA, 17 nt, Shigella flexneri 2a str. 2457T
agcugcucccagcgcau

SEQ ID NO: 3829768 - RNA, 14 nt, Shigella flexneri 2a str. 2457T
agcugcucgcggug

SEQ ID NO: 3829769 - RNA, 20 nt, Shigella flexneri 2a str. 2457T
agcugcugacggugauaauc

SEQ ID NO: 3829770 - RNA, 23 nt, Shigella flexneri 2a str. 2457T
agcugcuuuuccggucagcaauc

SEQ ID NO: 3829771 - RNA, 17 nt, Shigella flexneri 2a str. 2457T
agcuggcagaaguuguc

SEQ ID NO: 3829772 - RNA, 22 nt, Shigella flexneri 2a str. 2457T
agcuggcaucagcaaacaugcc

SEQ ID NO: 3829773 - RNA, 16 nt, Shigella flexneri 2a str. 2457T
agcuggcgauauuauc

SEQ ID NO: 3829774 - RNA, 21 nt, Shigella flexneri 2a str. 2457T
agcuggugaacauuuuaaccg

SEQ ID NO: 3829775 - RNA, 18 nt, Shigella flexneri 2a str. 2457T
agcugguguaacugcgcc

SEQ ID NO: 3829776 - RNA, 13 nt, Shigella flexneri 2a str. 2457T
agcuguacggagc

SEQ ID NO: 3829777 - RNA, 15 nt, Shigella flexneri 2a str. 2457T
agcuguaucccagcc

SEQ ID NO: 3829778 - RNA, 14 nt, Shigella flexneri 2a str. 2457T
agcugucagaacgg

SEQ ID NO: 3829779 - RNA, 15 nt, Shigella flexneri 2a str. 2457T
agcugucgaaaagau

SEQ ID NO: 3829780 - RNA, 11 nt, Shigella flexneri 2a str. 2457T
agcugugccug

SEQ ID NO: 3829781 - RNA, 23 nt, Shigella flexneri 2a str. 2457T
agcuguuuauuuauacagugagu

SEQ ID NO: 3829782 - RNA, 20 nt, Shigella flexneri 2a str. 2457T
agcuuaccguccucuuccca

SEQ ID NO: 3829783 - RNA, 22 nt, Shigella flexneri 2a str. 2457T
agcuuaccguccucuucccaga

SEQ ID NO: 3829784 - RNA, 14 nt, Shigella flexneri 2a str. 2457T
agcuuacgcugaua

SEQ ID NO: 3829785 - RNA, 20 nt, Shigella flexneri 2a str. 2457T
agcuuacguuacccagcacg

SEQ ID NO: 3829786 - RNA, 13 nt, Shigella flexneri 2a str. 2457T
agcuuagcauccc

SEQ ID NO: 3829787 - RNA, 23 nt, Shigella flexneri 2a str. 2457T
agcuuauccauaauuuugguugc

SEQ ID NO: 3829788 - RNA, 14 nt, Shigella flexneri 2a str. 2457T
agcuuaucuuuuuc

SEQ ID NO: 3829789 - RNA, 15 nt, Shigella flexneri 2a str. 2457T
agcuuauuucuguga

SEQ ID NO: 3829790 - RNA, 19 nt, Shigella flexneri 2a str. 2457T
agcuuauuuguugagcugg

SEQ ID NO: 3829791 - RNA, 21 nt, Shigella flexneri 2a str. 2457T
agcuucaaauagugccuggcu

SEQ ID NO: 3829792 - RNA, 19 nt, Shigella flexneri 2a str. 2457T
agcuucacgcgccagcuua

SEQ ID NO: 3829793 - RNA, 14 nt, Shigella flexneri 2a str. 2457T
agcuucccaaagau

SEQ ID NO: 3829794 - RNA, 16 nt, Shigella flexneri 2a str. 2457T
agcuucccccgcaucg

SEQ ID NO: 3829795 - RNA, 19 nt, Shigella flexneri 2a str. 2457T
agcuucuuauccagcugcg

SEQ ID NO: 3829796 - RNA, 11 nt, Shigella flexneri 2a str. 2457T
agcuucuuccu

SEQ ID NO: 3829797 - RNA, 17 nt, Shigella flexneri 2a str. 2457T
agcuugaaggguuuuau

SEQ ID NO: 3829798 - RNA, 16 nt, Shigella flexneri 2a str. 2457T
agcuugcgauccugca

SEQ ID NO: 3829799 - RNA, 18 nt, Shigella flexneri 2a str. 2457T
agcuugcuuuccagcuuc

SEQ ID NO: 3829800 - RNA, 14 nt, Shigella flexneri 2a str. 2457T
agcuuguuugaagu

SEQ ID NO: 3829801 - RNA, 20 nt, Shigella flexneri 2a str. 2457T
agcuuguuugaagucaacgc

SEQ ID NO: 3829802 - RNA, 12 nt, Shigella flexneri 2a str. 2457T
agcuuucaacgc

SEQ ID NO: 3829803 - RNA, 14 nt, Shigella flexneri 2a str. 2457T
agcuuucauuucaa

SEQ ID NO: 3829804 - RNA, 16 nt, Shigella flexneri 2a str. 2457T
agcuuucgaccagcca

SEQ ID NO: 3829805 - RNA, 18 nt, Shigella flexneri 2a str. 2457T
agcuuucgaccagccagg

SEQ ID NO: 3829806 - RNA, 19 nt, Shigella flexneri 2a str. 2457T
agcuuucgcuuaacgccca

SEQ ID NO: 3829807 - RNA, 19 nt, Shigella flexneri 2a str. 2457T
agcuuucuugcagcucuug

SEQ ID NO: 3829808 - RNA, 15 nt, Shigella flexneri 2a str. 2457T
agcuuuggugaaaaa

SEQ ID NO: 3829809 - RNA, 20 nt, Shigella flexneri 2a str. 2457T
agcuuuuccauaucaagcau

SEQ ID NO: 3829810 - RNA, 22 nt, Shigella flexneri 2a str. 2457T
agcuuuuccauaucaagcauga

SEQ ID NO: 3829811 - RNA, 22 nt, Shigella flexneri 2a str. 2457T
agcuuuucgcccuggacaacau

SEQ ID NO: 3829812 - RNA, 19 nt, Shigella flexneri 2a str. 2457T
agcuuuuguaggccugaua

SEQ ID NO: 3829813 - RNA, 13 nt, Shigella flexneri 2a str. 2457T
aggaaaaaaauua

SEQ ID NO: 3829814 - RNA, 22 nt, Shigella flexneri 2a str. 2457T
aggaaaaaaauuaacgcagaau

SEQ ID NO: 3829815 - RNA, 23 nt, Shigella flexneri 2a str. 2457T
aggaaaacaauguucaucugcau

SEQ ID NO: 3829816 - RNA, 15 nt, Shigella flexneri 2a str. 2457T
aggaaaacuacaggc

SEQ ID NO: 3829817 - RNA, 14 nt, Shigella flexneri 2a str. 2457T
aggaaaauaagcau

SEQ ID NO: 3829818 - RNA, 15 nt, Shigella flexneri 2a str. 2457T
aggaaaauacagcaa

SEQ ID NO: 3829819 - RNA, 18 nt, Shigella flexneri 2a str. 2457T
aggaaaauacagcaaugg

SEQ ID NO: 3829820 - RNA, 14 nt, Shigella flexneri 2a str. 2457T
aggaaacuccagcc

SEQ ID NO: 3829821 - RNA, 20 nt, Shigella flexneri 2a str. 2457T
aggaaagcagccacacguua

SEQ ID NO: 3829822 - RNA, 13 nt, Shigella flexneri 2a str. 2457T
aggaaauaagcau

SEQ ID NO: 3829823 - RNA, 15 nt, Shigella flexneri 2a str. 2457T
aggaaauaauauagu

SEQ ID NO: 3829824 - RNA, 20 nt, Shigella flexneri 2a str. 2457T
aggaaauacguaggccugau

SEQ ID NO: 3829825 - RNA, 21 nt, Shigella flexneri 2a str. 2457T
aggaaauacguaggccugaua

SEQ ID NO: 3829826 - RNA, 17 nt, Shigella flexneri 2a str. 2457T
aggaaauguuccggguu

SEQ ID NO: 3829827 - RNA, 17 nt, Shigella flexneri 2a str. 2457T
aggaaauugcgaauucc

SEQ ID NO: 3829828 - RNA, 18 nt, Shigella flexneri 2a str. 2457T
aggaacagaagaaagcaa

SEQ ID NO: 3829829 - RNA, 21 nt, Shigella flexneri 2a str. 2457T
aggaacaucccuugugcacug

SEQ ID NO: 3829830 - RNA, 16 nt, Shigella flexneri 2a str. 2457T
aggaaccacaaccacu

SEQ ID NO: 3829831 - RNA, 20 nt, Shigella flexneri 2a str. 2457T
aggaacgaucccagcgugga

SEQ ID NO: 3829832 - RNA, 23 nt, Shigella flexneri 2a str. 2457T
aggaacgcgccaagauagaacca

SEQ ID NO: 3829833 - RNA, 15 nt, Shigella flexneri 2a str. 2457T
agggaauccagcaau

SEQ ID NO: 3829834 - RNA, 12 nt, Shigella flexneri 2a str. 2457T
agggaauuaaac

SEQ ID NO: 3829835 - RNA, 22 nt, Shigella flexneri 2a str. 2457T
agggagagggccgggguggggg

SEQ ID NO: 3829836 - RNA, 11 nt, Shigella flexneri 2a str. 2457T
agggagcgccg

SEQ ID NO: 3829837 - RNA, 19 nt, Shigella flexneri 2a str. 2457T
agggaggggugcaugaaaa

SEQ ID NO: 3829838 - RNA, 13 nt, Shigella flexneri 2a str. 2457T
agggauauuucac

SEQ ID NO: 3829839 - RNA, 14 nt, Shigella flexneri 2a str. 2457T
agggauauuucacc

SEQ ID NO: 3829840 - RNA, 13 nt, Shigella flexneri 2a str. 2457T
agggaucacgcgg

SEQ ID NO: 3829841 - RNA, 15 nt, Shigella flexneri 2a str. 2457T
agggauugugcaggc

SEQ ID NO: 3829842 - RNA, 14 nt, Shigella flexneri 2a str. 2457T
agggcaaacagcac

SEQ ID NO: 3829843 - RNA, 21 nt, Shigella flexneri 2a str. 2457T
agggcaagcgccuaaauccac

SEQ ID NO: 3829844 - RNA, 14 nt, Shigella flexneri 2a str. 2457T
agggcaauuaaaaa

SEQ ID NO: 3829845 - RNA, 17 nt, Shigella flexneri 2a str. 2457T
agggcaugacacagaau

SEQ ID NO: 3829846 - RNA, 11 nt, Shigella flexneri 2a str. 2457T
agggcauggcg

SEQ ID NO: 3829847 - RNA, 14 nt, Shigella flexneri 2a str. 2457T
agggcggcaggcag

SEQ ID NO: 3829848 - RNA, 18 nt, Shigella flexneri 2a str. 2457T
agggcuacaaguccggga

SEQ ID NO: 3829849 - RNA, 15 nt, Shigella flexneri 2a str. 2457T
agggcugauaaacaa

SEQ ID NO: 3829850 - RNA, 14 nt, Shigella flexneri 2a str. 2457T
agggcuuccaccug

SEQ ID NO: 3829851 - RNA, 20 nt, Shigella flexneri 2a str. 2457T
agggcuuuuucaauuccauu

SEQ ID NO: 3829852 - RNA, 21 nt, Shigella flexneri 2a str. 2457T
aggggccgaaaaaugcuggau

SEQ ID NO: 3829853 - RNA, 22 nt, Shigella flexneri 2a str. 2457T
aggggcggguuuuuuuauaucu

SEQ ID NO: 3829854 - RNA, 15 nt, Shigella flexneri 2a str. 2457T
aggggcguccagaug

SEQ ID NO: 3829855 - RNA, 15 nt, Shigella flexneri 2a str. 2457T
agggggauuuucacu

SEQ ID NO: 3829856 - RNA, 13 nt, Shigella flexneri 2a str. 2457T
aggguaaaaggau

SEQ ID NO: 3829857 - RNA, 15 nt, Shigella flexneri 2a str. 2457T
aggguauuuuucuau

SEQ ID NO: 3829858 - RNA, 21 nt, Shigella flexneri 2a str. 2457T
agggucuuccagcaaauccau

SEQ ID NO: 3829859 - RNA, 14 nt, Shigella flexneri 2a str. 2457T
agggugaucaccag

SEQ ID NO: 3829860 - RNA, 18 nt, Shigella flexneri 2a str. 2457T
agggugcagaaucaaucu

SEQ ID NO: 3829861 - RNA, 12 nt, Shigella flexneri 2a str. 2457T
agggugccggga

SEQ ID NO: 3829862 - RNA, 22 nt, Shigella flexneri 2a str. 2457T
aggguuauuuguucagcaaaug

SEQ ID NO: 3829863 - RNA, 23 nt, Shigella flexneri 2a str. 2457T
agguaaaaccugacaacaaaacg

SEQ ID NO: 3829864 - RNA, 14 nt, Shigella flexneri 2a str. 2457T
agguaaacagaaau

SEQ ID NO: 3829865 - RNA, 22 nt, Shigella flexneri 2a str. 2457T
agguaacgucgguuucaucaca

SEQ ID NO: 3829866 - RNA, 15 nt, Shigella flexneri 2a str. 2457T
agguaagagugaauu

SEQ ID NO: 3829867 - RNA, 19 nt, Shigella flexneri 2a str. 2457T
agguaagaguuucaacauc

SEQ ID NO: 3829868 - RNA, 13 nt, Shigella flexneri 2a str. 2457T
agguaagcaaagg

SEQ ID NO: 3829869 - RNA, 20 nt, Shigella flexneri 2a str. 2457T
agguaaggauaaaaaagggu

SEQ ID NO: 3829870 - RNA, 12 nt, Shigella flexneri 2a str. 2457T
agguacaaagcc

SEQ ID NO: 3829871 - RNA, 14 nt, Shigella flexneri 2a str. 2457T
agguacaaagccaa

SEQ ID NO: 3829872 - RNA, 19 nt, Shigella flexneri 2a str. 2457T
agguacaaagccaacagca

SEQ ID NO: 3829873 - RNA, 19 nt, Shigella flexneri 2a str. 2457T
agguacaaccgcaaagguu

SEQ ID NO: 3829874 - RNA, 15 nt, Shigella flexneri 2a str. 2457T
agguacgcuccagca

SEQ ID NO: 3829875 - RNA, 19 nt, Shigella flexneri 2a str. 2457T
agguagaacccuaccagcu

SEQ ID NO: 3829876 - RNA, 20 nt, Shigella flexneri 2a str. 2457T
agguagaacccuaccagcug

SEQ ID NO: 3829877 - RNA, 18 nt, Shigella flexneri 2a str. 2457T
agguagccugaguuuaac

SEQ ID NO: 3829878 - RNA, 23 nt, Shigella flexneri 2a str. 2457T
agguauaccggaccaauaacgcu

SEQ ID NO: 3829879 - RNA, 14 nt, Shigella flexneri 2a str. 2457T
agguauuggcggca

SEQ ID NO: 3829880 - RNA, 14 nt, Shigella flexneri 2a str. 2457T
agguauuuucugaa

SEQ ID NO: 3829881 - RNA, 16 nt, Shigella flexneri 2a str. 2457T
aggucaaccuagccuu

SEQ ID NO: 3829882 - RNA, 21 nt, Shigella flexneri 2a str. 2457T
aggucacagaagagagauaau

SEQ ID NO: 3829883 - RNA, 13 nt, Shigella flexneri 2a str. 2457T
aggucagagagcc

SEQ ID NO: 3829884 - RNA, 16 nt, Shigella flexneri 2a str. 2457T
aggucagagagccagc

SEQ ID NO: 3829885 - RNA, 17 nt, Shigella flexneri 2a str. 2457T
aggucagagagccagcc

SEQ ID NO: 3829886 - RNA, 22 nt, Shigella flexneri 2a str. 2457T
aggucagcaggagcagccccug

SEQ ID NO: 3829887 - RNA, 19 nt, Shigella flexneri 2a str. 2457T
aggucagcgccuggcugca

SEQ ID NO: 3829888 - RNA, 14 nt, Shigella flexneri 2a str. 2457T
aggucaggcggcga

SEQ ID NO: 3829889 - RNA, 18 nt, Shigella flexneri 2a str. 2457T
agguccccgagcacaugc

SEQ ID NO: 3829890 - RNA, 13 nt, Shigella flexneri 2a str. 2457T
agguccuccagcu

SEQ ID NO: 3829891 - RNA, 22 nt, Shigella flexneri 2a str. 2457T
agguccuccuguaccuucacgc

SEQ ID NO: 3829892 - RNA, 15 nt, Shigella flexneri 2a str. 2457T
aggucgacagcagcc

SEQ ID NO: 3829893 - RNA, 14 nt, Shigella flexneri 2a str. 2457T
aggucggcuuugaa

SEQ ID NO: 3829894 - RNA, 17 nt, Shigella flexneri 2a str. 2457T
aggucgucaaaaaacuu

SEQ ID NO: 3829895 - RNA, 17 nt, Shigella flexneri 2a str. 2457T
aggucguugggaggagg

SEQ ID NO: 3829896 - RNA, 20 nt, Shigella flexneri 2a str. 2457T
aggucuuugacgucgaaacu

SEQ ID NO: 3829897 - RNA, 14 nt, Shigella flexneri 2a str. 2457T
aggugaaauugucg

SEQ ID NO: 3829898 - RNA, 15 nt, Shigella flexneri 2a str. 2457T
aggugaacaucgcag

SEQ ID NO: 3829899 - RNA, 18 nt, Shigella flexneri 2a str. 2457T
aggugaacaucgcaggga

SEQ ID NO: 3829900 - RNA, 21 nt, Shigella flexneri 2a str. 2457T
aggugacacuucauuaaccac

SEQ ID NO: 3829901 - RNA, 18 nt, Shigella flexneri 2a str. 2457T
aggugacgcgggcagcag

SEQ ID NO: 3829902 - RNA, 20 nt, Shigella flexneri 2a str. 2457T
aggugagggcuuaaaugaca

SEQ ID NO: 3829903 - RNA, 14 nt, Shigella flexneri 2a str. 2457T
aggugauacaucaa

SEQ ID NO: 3829904 - RNA, 14 nt, Shigella flexneri 2a str. 2457T
aggugcaaaaaaac

SEQ ID NO: 3829905 - RNA, 15 nt, Shigella flexneri 2a str. 2457T
aggugcaaaaaaacu

SEQ ID NO: 3829906 - RNA, 19 nt, Shigella flexneri 2a str. 2457T
aggugcaaaaaaacuugau

SEQ ID NO: 3829907 - RNA, 21 nt, Shigella flexneri 2a str. 2457T
aggugcagcccguaagcaaaa

SEQ ID NO: 3829908 - RNA, 14 nt, Shigella flexneri 2a str. 2457T
aggugcauugcugg

SEQ ID NO: 3829909 - RNA, 16 nt, Shigella flexneri 2a str. 2457T
aggugccuuaccacuc

SEQ ID NO: 3829910 - RNA, 17 nt, Shigella flexneri 2a str. 2457T
agguggccgagaggcug

SEQ ID NO: 3829911 - RNA, 15 nt, Shigella flexneri 2a str. 2457T
aggugguagcugccc

SEQ ID NO: 3829912 - RNA, 14 nt, Shigella flexneri 2a str. 2457T
agguguacuggcaa

SEQ ID NO: 3829913 - RNA, 14 nt, Shigella flexneri 2a str. 2457T
aggugucacaugca

SEQ ID NO: 3829914 - RNA, 20 nt, Shigella flexneri 2a str. 2457T
aggugucuggcagcgugacg

SEQ ID NO: 3829915 - RNA, 21 nt, Shigella flexneri 2a str. 2457T
aggugugaaaccuuuaugcag

SEQ ID NO: 3829916 - RNA, 21 nt, Shigella flexneri 2a str. 2457T
agguuaacucccccuuucuga

SEQ ID NO: 3829917 - RNA, 12 nt, Shigella flexneri 2a str. 2457T
agguuaacugug

SEQ ID NO: 3829918 - RNA, 18 nt, Shigella flexneri 2a str. 2457T
agguuaauaaauauuaau

SEQ ID NO: 3829919 - RNA, 23 nt, Shigella flexneri 2a str. 2457T
agguuaauaaauauuaauacaac

SEQ ID NO: 3829920 - RNA, 13 nt, Shigella flexneri 2a str. 2457T
agguuaauauuuu

SEQ ID NO: 3829921 - RNA, 17 nt, Shigella flexneri 2a str. 2457T
agguuaauauuuucgcc

SEQ ID NO: 3829922 - RNA, 12 nt, Shigella flexneri 2a str. 2457T
agguuaaugcug

SEQ ID NO: 3829923 - RNA, 22 nt, Shigella flexneri 2a str. 2457T
agguuaaugcuguuccagacca

SEQ ID NO: 3829924 - RNA, 21 nt, Shigella flexneri 2a str. 2457T
agguuacgcaccagauaagca

SEQ ID NO: 3829925 - RNA, 17 nt, Shigella flexneri 2a str. 2457T
agguuagaauaaacaaa

SEQ ID NO: 3829926 - RNA, 22 nt, Shigella flexneri 2a str. 2457T
agguuagcaaugccuucuggaa

SEQ ID NO: 3829927 - RNA, 15 nt, Shigella flexneri 2a str. 2457T
agguuauaaauaaaa

SEQ ID NO: 3829928 - RNA, 21 nt, Shigella flexneri 2a str. 2457T
agguuccacggaauauuucac

SEQ ID NO: 3829929 - RNA, 22 nt, Shigella flexneri 2a str. 2457T
agguucggaguggcagccccag

SEQ ID NO: 3829930 - RNA, 18 nt, Shigella flexneri 2a str. 2457T
agguucguaagcgauaac

SEQ ID NO: 3829931 - RNA, 17 nt, Shigella flexneri 2a str. 2457T
aguauacgccacaucau

SEQ ID NO: 3829932 - RNA, 17 nt, Shigella flexneri 2a str. 2457T
aguauauaaaaaacaau

SEQ ID NO: 3829933 - RNA, 18 nt, Shigella flexneri 2a str. 2457T
aguauccacacagacaau

SEQ ID NO: 3829934 - RNA, 13 nt, Shigella flexneri 2a str. 2457T
aguauccacacca

SEQ ID NO: 3829935 - RNA, 14 nt, Shigella flexneri 2a str. 2457T
aguaucuauucauc

SEQ ID NO: 3829936 - RNA, 16 nt, Shigella flexneri 2a str. 2457T
aguaucuauucaucaa

SEQ ID NO: 3829937 - RNA, 17 nt, Shigella flexneri 2a str. 2457T
aguaucugacagcaaau

SEQ ID NO: 3829938 - RNA, 21 nt, Shigella flexneri 2a str. 2457T
aguaugauacguuuauuacca

SEQ ID NO: 3829939 - RNA, 13 nt, Shigella flexneri 2a str. 2457T
aguaugaucuugc

SEQ ID NO: 3829940 - RNA, 15 nt, Shigella flexneri 2a str. 2457T
aguaugcucagaaua

SEQ ID NO: 3829941 - RNA, 18 nt, Shigella flexneri 2a str. 2457T
aguauguaauaacaggga

SEQ ID NO: 3829942 - RNA, 14 nt, Shigella flexneri 2a str. 2457T
aguauuaagccagu

SEQ ID NO: 3829943 - RNA, 22 nt, Shigella flexneri 2a str. 2457T
aguauuaagccaguucucacca

SEQ ID NO: 3829944 - RNA, 19 nt, Shigella flexneri 2a str. 2457T
aguauuaucugggcugccu

SEQ ID NO: 3829945 - RNA, 18 nt, Shigella flexneri 2a str. 2457T
aguauugcgcaaauguuu

SEQ ID NO: 3829946 - RNA, 22 nt, Shigella flexneri 2a str. 2457T
aguauugucuccgcugagacgc

SEQ ID NO: 3829947 - RNA, 16 nt, Shigella flexneri 2a str. 2457T
aguauuugacuguucu

SEQ ID NO: 3829948 - RNA, 23 nt, Shigella flexneri 2a str. 2457T
aguauuuucuuugacaaauuccg

SEQ ID NO: 3829949 - RNA, 23 nt, Shigella flexneri 2a str. 2457T
aguauuuuuaaccguauuuuggu

SEQ ID NO: 3829950 - RNA, 21 nt, Shigella flexneri 2a str. 2457T
agucaaaaugcccgaucuagg

SEQ ID NO: 3829951 - RNA, 15 nt, Shigella flexneri 2a str. 2457T
agucaaucauccaua

SEQ ID NO: 3829952 - RNA, 14 nt, Shigella flexneri 2a str. 2457T
agucaaugaaauua

SEQ ID NO: 3829953 - RNA, 23 nt, Shigella flexneri 2a str. 2457T
agucaaugaaauuacuuuccauc

SEQ ID NO: 3829954 - RNA, 14 nt, Shigella flexneri 2a str. 2457T
agucaauuucugca

SEQ ID NO: 3829955 - RNA, 15 nt, Shigella flexneri 2a str. 2457T
agucaauuucugcaa

SEQ ID NO: 3829956 - RNA, 19 nt, Shigella flexneri 2a str. 2457T
agucaauuucugcaaaaua

SEQ ID NO: 3829957 - RNA, 18 nt, Shigella flexneri 2a str. 2457T
agucacaaacaucaugcc

SEQ ID NO: 3829958 - RNA, 14 nt, Shigella flexneri 2a str. 2457T
agucacaaaucucc

SEQ ID NO: 3829959 - RNA, 12 nt, Shigella flexneri 2a str. 2457T
agucacaucagc

SEQ ID NO: 3829960 - RNA, 20 nt, Shigella flexneri 2a str. 2457T
agucacauuuuuagcagaca

SEQ ID NO: 3829961 - RNA, 14 nt, Shigella flexneri 2a str. 2457T
agucaccagcauca

SEQ ID NO: 3829962 - RNA, 16 nt, Shigella flexneri 2a str. 2457T
agucaccugcggugca

SEQ ID NO: 3829963 - RNA, 14 nt, Shigella flexneri 2a str. 2457T
agucacuuuuuucc

SEQ ID NO: 3829964 - RNA, 14 nt, Shigella flexneri 2a str. 2457T
agucagaaacugua

SEQ ID NO: 3829965 - RNA, 23 nt, Shigella flexneri 2a str. 2457T
agucagaaacuguaauugagaac

SEQ ID NO: 3829966 - RNA, 22 nt, Shigella flexneri 2a str. 2457T
agucagacccugcucuuucagc

SEQ ID NO: 3829967 - RNA, 22 nt, Shigella flexneri 2a str. 2457T
agucagaugccucguuggucag

SEQ ID NO: 3829968 - RNA, 16 nt, Shigella flexneri 2a str. 2457T
agucaggcgcgcggug

SEQ ID NO: 3829969 - RNA, 18 nt, Shigella flexneri 2a str. 2457T
agucagugguuugcccuu

SEQ ID NO: 3829970 - RNA, 14 nt, Shigella flexneri 2a str. 2457T
agucaguuaagcaa

SEQ ID NO: 3829971 - RNA, 20 nt, Shigella flexneri 2a str. 2457T
agucauagguucuuuuaaau

SEQ ID NO: 3829972 - RNA, 12 nt, Shigella flexneri 2a str. 2457T
agucauaucagc

SEQ ID NO: 3829973 - RNA, 16 nt, Shigella flexneri 2a str. 2457T
agucaucacuuucaga

SEQ ID NO: 3829974 - RNA, 14 nt, Shigella flexneri 2a str. 2457T
agucaucaguugca

SEQ ID NO: 3829975 - RNA, 20 nt, Shigella flexneri 2a str. 2457T
agucaucaguugcaccugau

SEQ ID NO: 3829976 - RNA, 13 nt, Shigella flexneri 2a str. 2457T
agucaucaucagg

SEQ ID NO: 3829977 - RNA, 13 nt, Shigella flexneri 2a str. 2457T
agucauccggcgu

SEQ ID NO: 3829978 - RNA, 21 nt, Shigella flexneri 2a str. 2457T
agucaucgcauacaaaaacac

SEQ ID NO: 3829979 - RNA, 19 nt, Shigella flexneri 2a str. 2457T
agucaucgcuuucggaaag

SEQ ID NO: 3829980 - RNA, 20 nt, Shigella flexneri 2a str. 2457T
agucauguuguuccuuuuau

SEQ ID NO: 3829981 - RNA, 18 nt, Shigella flexneri 2a str. 2457T
agucauugagcuucucga

SEQ ID NO: 3829982 - RNA, 15 nt, Shigella flexneri 2a str. 2457T
aguccaaaagguccu

SEQ ID NO: 3829983 - RNA, 16 nt, Shigella flexneri 2a str. 2457T
aguccaaaagguccuu

SEQ ID NO: 3829984 - RNA, 22 nt, Shigella flexneri 2a str. 2457T
aguccagacuccgagaaucaua

SEQ ID NO: 3829985 - RNA, 21 nt, Shigella flexneri 2a str. 2457T
aguccagcugccguccccauc

SEQ ID NO: 3829986 - RNA, 15 nt, Shigella flexneri 2a str. 2457T
agucccaaacagcag

SEQ ID NO: 3829987 - RNA, 12 nt, Shigella flexneri 2a str. 2457T
agucccaguuca

SEQ ID NO: 3829988 - RNA, 23 nt, Shigella flexneri 2a str. 2457T
aguccccacgccauaccugcaca

SEQ ID NO: 3829989 - RNA, 14 nt, Shigella flexneri 2a str. 2457T
aguccccaguaauc

SEQ ID NO: 3829990 - RNA, 18 nt, Shigella flexneri 2a str. 2457T
agucccggcaagauucca

SEQ ID NO: 3829991 - RNA, 18 nt, Shigella flexneri 2a str. 2457T
agucccguacccagcaag

SEQ ID NO: 3829992 - RNA, 14 nt, Shigella flexneri 2a str. 2457T
agucccuuucaggu

SEQ ID NO: 3829993 - RNA, 14 nt, Shigella flexneri 2a str. 2457T
aguccgccuucaac

SEQ ID NO: 3829994 - RNA, 19 nt, Shigella flexneri 2a str. 2457T
aguccgcgcuugccgccgg

SEQ ID NO: 3829995 - RNA, 17 nt, Shigella flexneri 2a str. 2457T
aguccggcuuuucgaca

SEQ ID NO: 3829996 - RNA, 21 nt, Shigella flexneri 2a str. 2457T
aguccguugaaaaugcugguu

SEQ ID NO: 3829997 - RNA, 20 nt, Shigella flexneri 2a str. 2457T
aguccugaccgucaccccau

SEQ ID NO: 3829998 - RNA, 21 nt, Shigella flexneri 2a str. 2457T
aguccugaccgucaccccauu

SEQ ID NO: 3829999 - RNA, 17 nt, Shigella flexneri 2a str. 2457T
aguccuguugucuuucc

SEQ ID NO: 3830000 - RNA, 21 nt, Shigella flexneri 2a str. 2457T
aguccuguugucuuuccagac

SEQ ID NO: 3830001 - RNA, 22 nt, Shigella flexneri 2a str. 2457T
agucgaugaugcagccagugau

SEQ ID NO: 3830002 - RNA, 16 nt, Shigella flexneri 2a str. 2457T
agucgcacacaacaga

SEQ ID NO: 3830003 - RNA, 14 nt, Shigella flexneri 2a str. 2457T
agucgcccaguauc

SEQ ID NO: 3830004 - RNA, 17 nt, Shigella flexneri 2a str. 2457T
agucgccggcggauuca

SEQ ID NO: 3830005 - RNA, 12 nt, Shigella flexneri 2a str. 2457T
agucgccugcuu

SEQ ID NO: 3830006 - RNA, 21 nt, Shigella flexneri 2a str. 2457T
agucgcgcucaucagcggcga

SEQ ID NO: 3830007 - RNA, 23 nt, Shigella flexneri 2a str. 2457T
agucgcuucaugcuuaaucaucg

SEQ ID NO: 3830008 - RNA, 16 nt, Shigella flexneri 2a str. 2457T
agucgcuugcaggauc

SEQ ID NO: 3830009 - RNA, 18 nt, Shigella flexneri 2a str. 2457T
agucgcuuucauucagaa

SEQ ID NO: 3830010 - RNA, 18 nt, Shigella flexneri 2a str. 2457T
agucggcgcugaaauucu

SEQ ID NO: 3830011 - RNA, 16 nt, Shigella flexneri 2a str. 2457T
agucgggaccagcauu

SEQ ID NO: 3830012 - RNA, 19 nt, Shigella flexneri 2a str. 2457T
agucgggaccagcauucca

SEQ ID NO: 3830013 - RNA, 19 nt, Shigella flexneri 2a str. 2457T
agucgggauauucagcuca

SEQ ID NO: 3830014 - RNA, 13 nt, Shigella flexneri 2a str. 2457T
agucggggccagc

SEQ ID NO: 3830015 - RNA, 19 nt, Shigella flexneri 2a str. 2457T
agucggggccagcauucca

SEQ ID NO: 3830016 - RNA, 12 nt, Shigella flexneri 2a str. 2457T
agucguaaacaa

SEQ ID NO: 3830017 - RNA, 16 nt, Shigella flexneri 2a str. 2457T
agucguaggccugaua

SEQ ID NO: 3830018 - RNA, 14 nt, Shigella flexneri 2a str. 2457T
agucgucaccauua

SEQ ID NO: 3830019 - RNA, 20 nt, Shigella flexneri 2a str. 2457T
agucguguuaucgcgcugaa

SEQ ID NO: 3830020 - RNA, 17 nt, Shigella flexneri 2a str. 2457T
agucguuuuaguaacaa

SEQ ID NO: 3830021 - RNA, 16 nt, Shigella flexneri 2a str. 2457T
agucuccauuuuuuug

SEQ ID NO: 3830022 - RNA, 14 nt, Shigella flexneri 2a str. 2457T
agucucugaaauuc

SEQ ID NO: 3830023 - RNA, 16 nt, Shigella flexneri 2a str. 2457T
agucucugccggguuc

SEQ ID NO: 3830024 - RNA, 21 nt, Shigella flexneri 2a str. 2457T
agucucuucuuugcagggagg

SEQ ID NO: 3830025 - RNA, 12 nt, Shigella flexneri 2a str. 2457T
agucugcauuuu

SEQ ID NO: 3830026 - RNA, 17 nt, Shigella flexneri 2a str. 2457T
agucugccguugccacg

SEQ ID NO: 3830027 - RNA, 18 nt, Shigella flexneri 2a str. 2457T
agucugcugaccaccugu

SEQ ID NO: 3830028 - RNA, 17 nt, Shigella flexneri 2a str. 2457T
agucuggaagccaguca

SEQ ID NO: 3830029 - RNA, 18 nt, Shigella flexneri 2a str. 2457T
aguuacugccaucuuccg

SEQ ID NO: 3830030 - RNA, 16 nt, Shigella flexneri 2a str. 2457T
aguuagagccagggau

SEQ ID NO: 3830031 - RNA, 20 nt, Shigella flexneri 2a str. 2457T
aguuagcaaggauguggcua

SEQ ID NO: 3830032 - RNA, 22 nt, Shigella flexneri 2a str. 2457T
aguuaguccacacgccaggcca

SEQ ID NO: 3830033 - RNA, 15 nt, Shigella flexneri 2a str. 2457T
aguuagucgcuuuca

SEQ ID NO: 3830034 - RNA, 17 nt, Shigella flexneri 2a str. 2457T
aguuagucgcuuucauu

SEQ ID NO: 3830035 - RNA, 15 nt, Shigella flexneri 2a str. 2457T
aguuagucugggcga

SEQ ID NO: 3830036 - RNA, 14 nt, Shigella flexneri 2a str. 2457T
aguuauaaauaaaa

SEQ ID NO: 3830037 - RNA, 16 nt, Shigella flexneri 2a str. 2457T
aguuauaaauaaaaag

SEQ ID NO: 3830038 - RNA, 18 nt, Shigella flexneri 2a str. 2457T
aguuauaaauaaaaagag

SEQ ID NO: 3830039 - RNA, 13 nt, Shigella flexneri 2a str. 2457T
aguuaucaagcca

SEQ ID NO: 3830040 - RNA, 21 nt, Shigella flexneri 2a str. 2457T
aguuaucgcgauacaccagau

SEQ ID NO: 3830041 - RNA, 22 nt, Shigella flexneri 2a str. 2457T
aguuauuacaaucccgcuuaca

SEQ ID NO: 3830042 - RNA, 11 nt, Shigella flexneri 2a str. 2457T
aguuauucauu

SEQ ID NO: 3830043 - RNA, 15 nt, Shigella flexneri 2a str. 2457T
aguuauugcgcugcu

SEQ ID NO: 3830044 - RNA, 16 nt, Shigella flexneri 2a str. 2457T
aguucaagaugucugc

SEQ ID NO: 3830045 - RNA, 12 nt, Shigella flexneri 2a str. 2457T
aguucaagugcu

SEQ ID NO: 3830046 - RNA, 23 nt, Shigella flexneri 2a str. 2457T
aguucaauuggccugauaagaca

SEQ ID NO: 3830047 - RNA, 19 nt, Shigella flexneri 2a str. 2457T
aguucacaccagccaccgc

SEQ ID NO: 3830048 - RNA, 17 nt, Shigella flexneri 2a str. 2457T
aguucacgcagcuucuc

SEQ ID NO: 3830049 - RNA, 20 nt, Shigella flexneri 2a str. 2457T
aguucacugccguacaggca

SEQ ID NO: 3830050 - RNA, 16 nt, Shigella flexneri 2a str. 2457T
aguucaggcgcugcau

SEQ ID NO: 3830051 - RNA, 16 nt, Shigella flexneri 2a str. 2457T
aguucauccccucuuc

SEQ ID NO: 3830052 - RNA, 22 nt, Shigella flexneri 2a str. 2457T
aguucaugauuuaaaugaagau

SEQ ID NO: 3830053 - RNA, 20 nt, Shigella flexneri 2a str. 2457T
aguuccagggcagcaguuca

SEQ ID NO: 3830054 - RNA, 13 nt, Shigella flexneri 2a str. 2457T
aguucccccugcc

SEQ ID NO: 3830055 - RNA, 15 nt, Shigella flexneri 2a str. 2457T
aguucccuacucucg

SEQ ID NO: 3830056 - RNA, 22 nt, Shigella flexneri 2a str. 2457T
aguucccuacucucgcaugggg

SEQ ID NO: 3830057 - RNA, 21 nt, Shigella flexneri 2a str. 2457T
aguuccgcaaagcccaucacc

SEQ ID NO: 3830058 - RNA, 14 nt, Shigella flexneri 2a str. 2457T
aguuccggcaucga

SEQ ID NO: 3830059 - RNA, 12 nt, Shigella flexneri 2a str. 2457T
aguuccugcaac

SEQ ID NO: 3830060 - RNA, 22 nt, Shigella flexneri 2a str. 2457T
aguuccugcaacuucucuuucg

SEQ ID NO: 3830061 - RNA, 13 nt, Shigella flexneri 2a str. 2457T
aguuccuggauga

SEQ ID NO: 3830062 - RNA, 13 nt, Shigella flexneri 2a str. 2457T
aguucgagaaaaa

SEQ ID NO: 3830063 - RNA, 14 nt, Shigella flexneri 2a str. 2457T
aguucgagaaaaau

SEQ ID NO: 3830064 - RNA, 13 nt, Shigella flexneri 2a str. 2457T
aguucgauuuccc

SEQ ID NO: 3830065 - RNA, 15 nt, Shigella flexneri 2a str. 2457T
aguucgccaucaaau

SEQ ID NO: 3830066 - RNA, 21 nt, Shigella flexneri 2a str. 2457T
aguucgguugggaucgccagg

SEQ ID NO: 3830067 - RNA, 18 nt, Shigella flexneri 2a str. 2457T
aguucgucgcguuugccc

SEQ ID NO: 3830068 - RNA, 18 nt, Shigella flexneri 2a str. 2457T
aguucuacaaucugcccg

SEQ ID NO: 3830069 - RNA, 23 nt, Shigella flexneri 2a str. 2457T
aguucugaacguugcgcuucccg

SEQ ID NO: 3830070 - RNA, 20 nt, Shigella flexneri 2a str. 2457T
aguucugcagcccgaacggu

SEQ ID NO: 3830071 - RNA, 16 nt, Shigella flexneri 2a str. 2457T
aguucugccaggcugg

SEQ ID NO: 3830072 - RNA, 13 nt, Shigella flexneri 2a str. 2457T
aguucugcgcauc

SEQ ID NO: 3830073 - RNA, 14 nt, Shigella flexneri 2a str. 2457T
aguucuucaaaaau

SEQ ID NO: 3830074 - RNA, 20 nt, Shigella flexneri 2a str. 2457T
aguucuucgguggucauuuu

SEQ ID NO: 3830075 - RNA, 20 nt, Shigella flexneri 2a str. 2457T
aguucuuucucugcaaauau

SEQ ID NO: 3830076 - RNA, 23 nt, Shigella flexneri 2a str. 2457T
aguucuuuuauuguuaaguuuau

SEQ ID NO: 3830077 - RNA, 21 nt, Shigella flexneri 2a str. 2457T
aguugagcaguccccacauca

SEQ ID NO: 3830078 - RNA, 18 nt, Shigella flexneri 2a str. 2457T
aguugagguuuuugacga

SEQ ID NO: 3830079 - RNA, 13 nt, Shigella flexneri 2a str. 2457T
aguugaucgccaa

SEQ ID NO: 3830080 - RNA, 17 nt, Shigella flexneri 2a str. 2457T
aguugaucucuuuccac

SEQ ID NO: 3830081 - RNA, 17 nt, Shigella flexneri 2a str. 2457T
aguugauuaauuucauu

SEQ ID NO: 3830082 - RNA, 18 nt, Shigella flexneri 2a str. 2457T
aguugauuaauuucauuu

SEQ ID NO: 3830083 - RNA, 23 nt, Shigella flexneri 2a str. 2457T
aguugauuaugaucgccacgcgg

SEQ ID NO: 3830084 - RNA, 18 nt, Shigella flexneri 2a str. 2457T
aguugauucggccaguaa

SEQ ID NO: 3830085 - RNA, 21 nt, Shigella flexneri 2a str. 2457T
aguugauuggcgcgaaccauc

SEQ ID NO: 3830086 - RNA, 17 nt, Shigella flexneri 2a str. 2457T
aguugcacacuuuccau

SEQ ID NO: 3830087 - RNA, 16 nt, Shigella flexneri 2a str. 2457T
aguugcagacugaaua

SEQ ID NO: 3830088 - RNA, 16 nt, Shigella flexneri 2a str. 2457T
aguugcagcaagccau

SEQ ID NO: 3830089 - RNA, 17 nt, Shigella flexneri 2a str. 2457T
aguugcagcgucaucaa

SEQ ID NO: 3830090 - RNA, 17 nt, Shigella flexneri 2a str. 2457T
aguugcauuccagucca

SEQ ID NO: 3830091 - RNA, 12 nt, Shigella flexneri 2a str. 2457T
aguugccacccg

SEQ ID NO: 3830092 - RNA, 14 nt, Shigella flexneri 2a str. 2457T
aguugcuccacugc

SEQ ID NO: 3830093 - RNA, 16 nt, Shigella flexneri 2a str. 2457T
aguugcuccagcaaua

SEQ ID NO: 3830094 - RNA, 14 nt, Shigella flexneri 2a str. 2457T
aguugcucucaaag

SEQ ID NO: 3830095 - RNA, 18 nt, Shigella flexneri 2a str. 2457T
aguugcucugcagcagcc

SEQ ID NO: 3830096 - RNA, 17 nt, Shigella flexneri 2a str. 2457T
aguugcugacucgaacg

SEQ ID NO: 3830097 - RNA, 15 nt, Shigella flexneri 2a str. 2457T
aguugcuucaucuca

SEQ ID NO: 3830098 - RNA, 19 nt, Shigella flexneri 2a str. 2457T
aguugcuucaucucaguga

SEQ ID NO: 3830099 - RNA, 15 nt, Shigella flexneri 2a str. 2457T
aguuggcagaauuug

SEQ ID NO: 3830100 - RNA, 16 nt, Shigella flexneri 2a str. 2457T
aguuggggaaaaguug

SEQ ID NO: 3830101 - RNA, 19 nt, Shigella flexneri 2a str. 2457T
aguuggggccagcauucca

SEQ ID NO: 3830102 - RNA, 16 nt, Shigella flexneri 2a str. 2457T
aguugguuaaucuuuu

SEQ ID NO: 3830103 - RNA, 23 nt, Shigella flexneri 2a str. 2457T
aguuguaaucauauuaaauuuuu

SEQ ID NO: 3830104 - RNA, 14 nt, Shigella flexneri 2a str. 2457T
aguuguaugcguuu

SEQ ID NO: 3830105 - RNA, 17 nt, Shigella flexneri 2a str. 2457T
aguuguccaugugcugg

SEQ ID NO: 3830106 - RNA, 16 nt, Shigella flexneri 2a str. 2457T
aguugugcaccaccaa

SEQ ID NO: 3830107 - RNA, 14 nt, Shigella flexneri 2a str. 2457T
aguugugcugaacg

SEQ ID NO: 3830108 - RNA, 16 nt, Shigella flexneri 2a str. 2457T
aguuguucaacaguaa

SEQ ID NO: 3830109 - RNA, 23 nt, Shigella flexneri 2a str. 2457T
aguuguugauaauuagugcugcu

SEQ ID NO: 3830110 - RNA, 12 nt, Shigella flexneri 2a str. 2457T
aguuuaaacauu

SEQ ID NO: 3830111 - RNA, 18 nt, Shigella flexneri 2a str. 2457T
aguuuaauugccauuucu

SEQ ID NO: 3830112 - RNA, 15 nt, Shigella flexneri 2a str. 2457T
aguuuacugucugcu

SEQ ID NO: 3830113 - RNA, 17 nt, Shigella flexneri 2a str. 2457T
aguuucagccccaucaa

SEQ ID NO: 3830114 - RNA, 16 nt, Shigella flexneri 2a str. 2457T
aguuucagccucugcc

SEQ ID NO: 3830115 - RNA, 13 nt, Shigella flexneri 2a str. 2457T
aguuucagcggcg

SEQ ID NO: 3830116 - RNA, 21 nt, Shigella flexneri 2a str. 2457T
aguuucauaucugccagauaa

SEQ ID NO: 3830117 - RNA, 20 nt, Shigella flexneri 2a str. 2457T
aguuucggcaucagcagaau

SEQ ID NO: 3830118 - RNA, 13 nt, Shigella flexneri 2a str. 2457T
aguuucugcagcu

SEQ ID NO: 3830119 - RNA, 14 nt, Shigella flexneri 2a str. 2457T
aguuucuuaccuac

SEQ ID NO: 3830120 - RNA, 21 nt, Shigella flexneri 2a str. 2457T
aguuugaacauaucagcgcaa

SEQ ID NO: 3830121 - RNA, 15 nt, Shigella flexneri 2a str. 2457T
aguuugaucaguucu

SEQ ID NO: 3830122 - RNA, 15 nt, Shigella flexneri 2a str. 2457T
aguuugauuaacgca

SEQ ID NO: 3830123 - RNA, 21 nt, Shigella flexneri 2a str. 2457T
aguuugauuauucacaauuca

SEQ ID NO: 3830124 - RNA, 16 nt, Shigella flexneri 2a str. 2457T
aguuugccguugaucu

SEQ ID NO: 3830125 - RNA, 19 nt, Shigella flexneri 2a str. 2457T
aguuugccguugaucucuc

SEQ ID NO: 3830126 - RNA, 22 nt, Shigella flexneri 2a str. 2457T
aguuuggucuggcaaaaauaag

SEQ ID NO: 3830127 - RNA, 19 nt, Shigella flexneri 2a str. 2457T
aguuuggugagaacaccaa

SEQ ID NO: 3830128 - RNA, 18 nt, Shigella flexneri 2a str. 2457T
aguuuguucagcugcgug

SEQ ID NO: 3830129 - RNA, 23 nt, Shigella flexneri 2a str. 2457T
aguuuuaguugccguucuucccg

SEQ ID NO: 3830130 - RNA, 22 nt, Shigella flexneri 2a str. 2457T
aguuuuauacucagucaggcuu

SEQ ID NO: 3830131 - RNA, 15 nt, Shigella flexneri 2a str. 2457T
aguuuucauauaccg

SEQ ID NO: 3830132 - RNA, 14 nt, Shigella flexneri 2a str. 2457T
aguuuucuuugcca

SEQ ID NO: 3830133 - RNA, 16 nt, Shigella flexneri 2a str. 2457T
aguuuuggggagaugu

SEQ ID NO: 3830134 - RNA, 21 nt, Shigella flexneri 2a str. 2457T
aguuuugucuucggccauuga

SEQ ID NO: 3830135 - RNA, 17 nt, Shigella flexneri 2a str. 2457T
aguuuuucaucccucuc

SEQ ID NO: 3830136 - RNA, 23 nt, Shigella flexneri 2a str. 2457T
aguuuuugcaaucagauaaaaua

SEQ ID NO: 3830137 - RNA, 22 nt, Shigella flexneri 2a str. 2457T
aguuuuuucgcuugaucuuccu

SEQ ID NO: 3830138 - RNA, 17 nt, Shigella flexneri 2a str. 2457T
aguuuuuucuucccaag

SEQ ID NO: 3830139 - RNA, 13 nt, Shigella flexneri 2a str. 2457T
auaaaaaaagaaa

SEQ ID NO: 3830140 - RNA, 21 nt, Shigella flexneri 2a str. 2457T
auaaaaaaagagcggucgcaa

SEQ ID NO: 3830141 - RNA, 14 nt, Shigella flexneri 2a str. 2457T
auaaaaauuaaauc

SEQ ID NO: 3830142 - RNA, 22 nt, Shigella flexneri 2a str. 2457T
auaaaacaacggaacgaaaaaa

SEQ ID NO: 3830143 - RNA, 11 nt, Shigella flexneri 2a str. 2457T
auaaaacacuc

SEQ ID NO: 3830144 - RNA, 19 nt, Shigella flexneri 2a str. 2457T
auaaaacgcagucuuccca

SEQ ID NO: 3830145 - RNA, 21 nt, Shigella flexneri 2a str. 2457T
auaaaacgcagucuucccagc

SEQ ID NO: 3830146 - RNA, 12 nt, Shigella flexneri 2a str. 2457T
auaaaacuuccc

SEQ ID NO: 3830147 - RNA, 13 nt, Shigella flexneri 2a str. 2457T
auaaaagaaaaaa

SEQ ID NO: 3830148 - RNA, 16 nt, Shigella flexneri 2a str. 2457T
auaaaagaaaaaauga

SEQ ID NO: 3830149 - RNA, 17 nt, Shigella flexneri 2a str. 2457T
auaaaagauaguaagau

SEQ ID NO: 3830150 - RNA, 22 nt, Shigella flexneri 2a str. 2457T
auaaaaucuauuauuauuuuug

SEQ ID NO: 3830151 - RNA, 17 nt, Shigella flexneri 2a str. 2457T
auaaaaugaguuuuuuu

SEQ ID NO: 3830152 - RNA, 19 nt, Shigella flexneri 2a str. 2457T
auaaaauggccguaauaga

SEQ ID NO: 3830153 - RNA, 20 nt, Shigella flexneri 2a str. 2457T
auaaaauguacaugucgcug

SEQ ID NO: 3830154 - RNA, 22 nt, Shigella flexneri 2a str. 2457T
auaaacaaagcgcacuuugcca

SEQ ID NO: 3830155 - RNA, 12 nt, Shigella flexneri 2a str. 2457T
auaaacaacgag

SEQ ID NO: 3830156 - RNA, 13 nt, Shigella flexneri 2a str. 2457T
auaaacaccagca

SEQ ID NO: 3830157 - RNA, 15 nt, Shigella flexneri 2a str. 2457T
auaaacaccagcaau

SEQ ID NO: 3830158 - RNA, 16 nt, Shigella flexneri 2a str. 2457T
auaaacaccagcaaua

SEQ ID NO: 3830159 - RNA, 17 nt, Shigella flexneri 2a str. 2457T
auaaacaccagcaauaa

SEQ ID NO: 3830160 - RNA, 12 nt, Shigella flexneri 2a str. 2457T
auaaacagcagg

SEQ ID NO: 3830161 - RNA, 15 nt, Shigella flexneri 2a str. 2457T
auaaacaucagcuau

SEQ ID NO: 3830162 - RNA, 19 nt, Shigella flexneri 2a str. 2457T
auaaacaucgggacaugau

SEQ ID NO: 3830163 - RNA, 22 nt, Shigella flexneri 2a str. 2457T
auaaaccagugccaaaccagau

SEQ ID NO: 3830164 - RNA, 20 nt, Shigella flexneri 2a str. 2457T
auaaaccgcucgugggcauc

SEQ ID NO: 3830165 - RNA, 22 nt, Shigella flexneri 2a str. 2457T
auaaaccugccuuacauaucaa

SEQ ID NO: 3830166 - RNA, 18 nt, Shigella flexneri 2a str. 2457T
auaaaccugcuggcgcac

SEQ ID NO: 3830167 - RNA, 20 nt, Shigella flexneri 2a str. 2457T
auaaacgaaucugcaaaucu

SEQ ID NO: 3830168 - RNA, 14 nt, Shigella flexneri 2a str. 2457T
auaaacgccagguu

SEQ ID NO: 3830169 - RNA, 22 nt, Shigella flexneri 2a str. 2457T
auaaacgccagguucaucaauu

SEQ ID NO: 3830170 - RNA, 20 nt, Shigella flexneri 2a str. 2457T
auaaacgcgaccgccgccaa

SEQ ID NO: 3830171 - RNA, 13 nt, Shigella flexneri 2a str. 2457T
auaaacuauccug

SEQ ID NO: 3830172 - RNA, 16 nt, Shigella flexneri 2a str. 2457T
auaaacuccugcacgc

SEQ ID NO: 3830173 - RNA, 16 nt, Shigella flexneri 2a str. 2457T
auaaacugagccaaac

SEQ ID NO: 3830174 - RNA, 21 nt, Shigella flexneri 2a str. 2457T
auaaacuuuucccuacugcug

SEQ ID NO: 3830175 - RNA, 16 nt, Shigella flexneri 2a str. 2457T
auaaagaaaaucugaa

SEQ ID NO: 3830176 - RNA, 22 nt, Shigella flexneri 2a str. 2457T
auaaagacguuaacuacaauca

SEQ ID NO: 3830177 - RNA, 16 nt, Shigella flexneri 2a str. 2457T
auaaagaguuuaucug

SEQ ID NO: 3830178 - RNA, 21 nt, Shigella flexneri 2a str. 2457T
auaaagcccccuguuugucua

SEQ ID NO: 3830179 - RNA, 23 nt, Shigella flexneri 2a str. 2457T
auaaagccugcuucaaacgcuga

SEQ ID NO: 3830180 - RNA, 15 nt, Shigella flexneri 2a str. 2457T
auaaagcgguuuuca

SEQ ID NO: 3830181 - RNA, 19 nt, Shigella flexneri 2a str. 2457T
auaaagcugaucacauaac

SEQ ID NO: 3830182 - RNA, 12 nt, Shigella flexneri 2a str. 2457T
auaaagcuguga

SEQ ID NO: 3830183 - RNA, 14 nt, Shigella flexneri 2a str. 2457T
auaaaggcggccca

SEQ ID NO: 3830184 - RNA, 17 nt, Shigella flexneri 2a str. 2457T
auaaaggucgacagcag

SEQ ID NO: 3830185 - RNA, 18 nt, Shigella flexneri 2a str. 2457T
auaaaggucgacagcagc

SEQ ID NO: 3830186 - RNA, 22 nt, Shigella flexneri 2a str. 2457T
auaaaggucgacagcagccccg

SEQ ID NO: 3830187 - RNA, 16 nt, Shigella flexneri 2a str. 2457T
auaaaguagaaauuau

SEQ ID NO: 3830188 - RNA, 17 nt, Shigella flexneri 2a str. 2457T
auaaagucgauuugcaa

SEQ ID NO: 3830189 - RNA, 14 nt, Shigella flexneri 2a str. 2457T
auaaagucuuucuu

SEQ ID NO: 3830190 - RNA, 18 nt, Shigella flexneri 2a str. 2457T
auaaauacuccauaacua

SEQ ID NO: 3830191 - RNA, 23 nt, Shigella flexneri 2a str. 2457T
auaaauagauccaggaacagaag

SEQ ID NO: 3830192 - RNA, 20 nt, Shigella flexneri 2a str. 2457T
auaaauauauaaaaaaacaa

SEQ ID NO: 3830193 - RNA, 20 nt, Shigella flexneri 2a str. 2457T
auaaauauggugaaaguaaa

SEQ ID NO: 3830194 - RNA, 23 nt, Shigella flexneri 2a str. 2457T
auaaauauggugaaaguaaaaaa

SEQ ID NO: 3830195 - RNA, 15 nt, Shigella flexneri 2a str. 2457T
auaaauauuaauaca

SEQ ID NO: 3830196 - RNA, 21 nt, Shigella flexneri 2a str. 2457T
auaaauauuaauacaacaaca

SEQ ID NO: 3830197 - RNA, 11 nt, Shigella flexneri 2a str. 2457T
auaaaucagau

SEQ ID NO: 3830198 - RNA, 16 nt, Shigella flexneri 2a str. 2457T
auaaauccaucgggcu

SEQ ID NO: 3830199 - RNA, 23 nt, Shigella flexneri 2a str. 2457T
auaaauugcuguaaauucucaau

SEQ ID NO: 3830200 - RNA, 23 nt, Shigella flexneri 2a str. 2457T
auaaauuucugccauuuugcuuu

SEQ ID NO: 3830201 - RNA, 19 nt, Shigella flexneri 2a str. 2457T
auaacaccagccagaauua

SEQ ID NO: 3830202 - RNA, 20 nt, Shigella flexneri 2a str. 2457T
auaacaccgauuuuguaaaa

SEQ ID NO: 3830203 - RNA, 22 nt, Shigella flexneri 2a str. 2457T
auaacaccgauuuuguaaaaga

SEQ ID NO: 3830204 - RNA, 23 nt, Shigella flexneri 2a str. 2457T
auaacaccgauuuuguaaaagaa

SEQ ID NO: 3830205 - RNA, 21 nt, Shigella flexneri 2a str. 2457T
auaacacgcccguuguuuuau

SEQ ID NO: 3830206 - RNA, 23 nt, Shigella flexneri 2a str. 2457T
auaacagaaugcgggcgaaaaca

SEQ ID NO: 3830207 - RNA, 13 nt, Shigella flexneri 2a str. 2457T
auaacaucgccag

SEQ ID NO: 3830208 - RNA, 14 nt, Shigella flexneri 2a str. 2457T
auaacauuuuucuc

SEQ ID NO: 3830209 - RNA, 10 nt, Shigella flexneri 2a str. 2457T
auaaccaaau

SEQ ID NO: 3830210 - RNA, 16 nt, Shigella flexneri 2a str. 2457T
auaaccaaauaaaaua

SEQ ID NO: 3830211 - RNA, 23 nt, Shigella flexneri 2a str. 2457T
auaaccacguucauuucauacag

SEQ ID NO: 3830212 - RNA, 15 nt, Shigella flexneri 2a str. 2457T
auaaccauauaugau

SEQ ID NO: 3830213 - RNA, 14 nt, Shigella flexneri 2a str. 2457T
auaacccagcgcac

SEQ ID NO: 3830214 - RNA, 20 nt, Shigella flexneri 2a str. 2457T
auaacccagcgcacuaugcg

SEQ ID NO: 3830215 - RNA, 15 nt, Shigella flexneri 2a str. 2457T
auaacccagggguca

SEQ ID NO: 3830216 - RNA, 15 nt, Shigella flexneri 2a str. 2457T
auaacccaguacaac

SEQ ID NO: 3830217 - RNA, 14 nt, Shigella flexneri 2a str. 2457T
auaacccccuccuu

SEQ ID NO: 3830218 - RNA, 20 nt, Shigella flexneri 2a str. 2457T
auaacccgcuguaaaugcug

SEQ ID NO: 3830219 - RNA, 16 nt, Shigella flexneri 2a str. 2457T
auaaccgcaaaaccaa

SEQ ID NO: 3830220 - RNA, 20 nt, Shigella flexneri 2a str. 2457T
auaaccgcaaaaccaacgcc

SEQ ID NO: 3830221 - RNA, 15 nt, Shigella flexneri 2a str. 2457T
auaaccggaugacgu

SEQ ID NO: 3830222 - RNA, 21 nt, Shigella flexneri 2a str. 2457T
auaaccggcaagcaaauacuu

SEQ ID NO: 3830223 - RNA, 20 nt, Shigella flexneri 2a str. 2457T
auaaccgguauuacuccaga

SEQ ID NO: 3830224 - RNA, 22 nt, Shigella flexneri 2a str. 2457T
auaaugaugucucuguuuugaa

SEQ ID NO: 3830225 - RNA, 12 nt, Shigella flexneri 2a str. 2457T
auaaugcaacau

SEQ ID NO: 3830226 - RNA, 13 nt, Shigella flexneri 2a str. 2457T
auaaugcccagca

SEQ ID NO: 3830227 - RNA, 22 nt, Shigella flexneri 2a str. 2457T
auaaugccguuuggcaaauaca

SEQ ID NO: 3830228 - RNA, 13 nt, Shigella flexneri 2a str. 2457T
auaaugcgccacc

SEQ ID NO: 3830229 - RNA, 16 nt, Shigella flexneri 2a str. 2457T
auaaugcugacaaaac

SEQ ID NO: 3830230 - RNA, 13 nt, Shigella flexneri 2a str. 2457T
auaaugucugaug

SEQ ID NO: 3830231 - RNA, 15 nt, Shigella flexneri 2a str. 2457T
auaaugucuuuaaug

SEQ ID NO: 3830232 - RNA, 22 nt, Shigella flexneri 2a str. 2457T
auaauguuucaguguuaaacgc

SEQ ID NO: 3830233 - RNA, 18 nt, Shigella flexneri 2a str. 2457T
auaauuacgcuguucauc

SEQ ID NO: 3830234 - RNA, 18 nt, Shigella flexneri 2a str. 2457T
auaauuacuucgccggaa

SEQ ID NO: 3830235 - RNA, 20 nt, Shigella flexneri 2a str. 2457T
auaauuaugccgaucaucau

SEQ ID NO: 3830236 - RNA, 12 nt, Shigella flexneri 2a str. 2457T
auaauuauuaua

SEQ ID NO: 3830237 - RNA, 19 nt, Shigella flexneri 2a str. 2457T
auaauuccggcuuggugug

SEQ ID NO: 3830238 - RNA, 20 nt, Shigella flexneri 2a str. 2457T
auaauuccugcgcugcguag

SEQ ID NO: 3830239 - RNA, 17 nt, Shigella flexneri 2a str. 2457T
auaauugucaacggcac

SEQ ID NO: 3830240 - RNA, 21 nt, Shigella flexneri 2a str. 2457T
auaauuuaugccugauacgca

SEQ ID NO: 3830241 - RNA, 21 nt, Shigella flexneri 2a str. 2457T
auaauuucugcacaucuaacc

SEQ ID NO: 3830242 - RNA, 22 nt, Shigella flexneri 2a str. 2457T
auaauuucuucguucgcugcau

SEQ ID NO: 3830243 - RNA, 13 nt, Shigella flexneri 2a str. 2457T
auaauuuuaaaua

SEQ ID NO: 3830244 - RNA, 20 nt, Shigella flexneri 2a str. 2457T
auaauuuucgguaaugacuc

SEQ ID NO: 3830245 - RNA, 21 nt, Shigella flexneri 2a str. 2457T
auaauuuucgguaaugacucc

SEQ ID NO: 3830246 - RNA, 22 nt, Shigella flexneri 2a str. 2457T
auaauuuucuuaucaguuucag

SEQ ID NO: 3830247 - RNA, 18 nt, Shigella flexneri 2a str. 2457T
auacaaccagauaaccau

SEQ ID NO: 3830248 - RNA, 20 nt, Shigella flexneri 2a str. 2457T
auacaacucgcuuaagccau

SEQ ID NO: 3830249 - RNA, 20 nt, Shigella flexneri 2a str. 2457T
auacaacugccgcgccugaa

SEQ ID NO: 3830250 - RNA, 15 nt, Shigella flexneri 2a str. 2457T
auacacgaggcauau

SEQ ID NO: 3830251 - RNA, 20 nt, Shigella flexneri 2a str. 2457T
auacacgcccgucaugccgu

SEQ ID NO: 3830252 - RNA, 17 nt, Shigella flexneri 2a str. 2457T
auacacgccgccgagca

SEQ ID NO: 3830253 - RNA, 17 nt, Shigella flexneri 2a str. 2457T
auacacuaacagaacaa

SEQ ID NO: 3830254 - RNA, 18 nt, Shigella flexneri 2a str. 2457T
auacacuucacacacuuu

SEQ ID NO: 3830255 - RNA, 18 nt, Shigella flexneri 2a str. 2457T
auacagaugcugcucuuc

SEQ ID NO: 3830256 - RNA, 17 nt, Shigella flexneri 2a str. 2457T
auacagcaauggaaaaa

SEQ ID NO: 3830257 - RNA, 23 nt, Shigella flexneri 2a str. 2457T
auacagcaauggaaaaaguuuua

SEQ ID NO: 3830258 - RNA, 20 nt, Shigella flexneri 2a str. 2457T
auacagccgacaaugccaca

SEQ ID NO: 3830259 - RNA, 22 nt, Shigella flexneri 2a str. 2457T
auacagcgcggaccccacgcuc

SEQ ID NO: 3830260 - RNA, 15 nt, Shigella flexneri 2a str. 2457T
auacagcucagguuc

SEQ ID NO: 3830261 - RNA, 18 nt, Shigella flexneri 2a str. 2457T
auacagcucaugggcuuu

SEQ ID NO: 3830262 - RNA, 22 nt, Shigella flexneri 2a str. 2457T
auacaggaacagccacugguga

SEQ ID NO: 3830263 - RNA, 23 nt, Shigella flexneri 2a str. 2457T
auacaggaacagccacuggugag

SEQ ID NO: 3830264 - RNA, 15 nt, Shigella flexneri 2a str. 2457T
auacaggaagcgaau

SEQ ID NO: 3830265 - RNA, 14 nt, Shigella flexneri 2a str. 2457T
auacaggugcagcc

SEQ ID NO: 3830266 - RNA, 20 nt, Shigella flexneri 2a str. 2457T
auacaguuaucccguacucg

SEQ ID NO: 3830267 - RNA, 12 nt, Shigella flexneri 2a str. 2457T
auacaguuuuug

SEQ ID NO: 3830268 - RNA, 16 nt, Shigella flexneri 2a str. 2457T
auacauagaaacucau

SEQ ID NO: 3830269 - RNA, 18 nt, Shigella flexneri 2a str. 2457T
auacauagaaacucauau

SEQ ID NO: 3830270 - RNA, 17 nt, Shigella flexneri 2a str. 2457T
auacauagcacaacagg

SEQ ID NO: 3830271 - RNA, 15 nt, Shigella flexneri 2a str. 2457T
auacaucagcgacaa

SEQ ID NO: 3830272 - RNA, 21 nt, Shigella flexneri 2a str. 2457T
auacaucgcgcuuaucgccag

SEQ ID NO: 3830273 - RNA, 22 nt, Shigella flexneri 2a str. 2457T
auacaucgcgcuuaucgccagc

SEQ ID NO: 3830274 - RNA, 14 nt, Shigella flexneri 2a str. 2457T
auacaugcuuagca

SEQ ID NO: 3830275 - RNA, 19 nt, Shigella flexneri 2a str. 2457T
auacauugcguaaccaauc

SEQ ID NO: 3830276 - RNA, 14 nt, Shigella flexneri 2a str. 2457T
auaccaaugauugg

SEQ ID NO: 3830277 - RNA, 16 nt, Shigella flexneri 2a str. 2457T
auaccaccagugccau

SEQ ID NO: 3830278 - RNA, 17 nt, Shigella flexneri 2a str. 2457T
auaccacgccaucaacg

SEQ ID NO: 3830279 - RNA, 15 nt, Shigella flexneri 2a str. 2457T
auaccacgucugaag

SEQ ID NO: 3830280 - RNA, 16 nt, Shigella flexneri 2a str. 2457T
auaccacuuccagcag

SEQ ID NO: 3830281 - RNA, 17 nt, Shigella flexneri 2a str. 2457T
auaccagauuaauuauu

SEQ ID NO: 3830282 - RNA, 18 nt, Shigella flexneri 2a str. 2457T
auaccagcccgucucagc

SEQ ID NO: 3830283 - RNA, 11 nt, Shigella flexneri 2a str. 2457T
auaccagccuu

SEQ ID NO: 3830284 - RNA, 17 nt, Shigella flexneri 2a str. 2457T
auaccagccuucuucau

SEQ ID NO: 3830285 - RNA, 23 nt, Shigella flexneri 2a str. 2457T
auaccagccuucuucauccagcg

SEQ ID NO: 3830286 - RNA, 22 nt, Shigella flexneri 2a str. 2457T
auaccauccggcauaaacgcua

SEQ ID NO: 3830287 - RNA, 12 nt, Shigella flexneri 2a str. 2457T
auaccaugcacc

SEQ ID NO: 3830288 - RNA, 21 nt, Shigella flexneri 2a str. 2457T
auaccaugccguucugggugg

SEQ ID NO: 3830289 - RNA, 12 nt, Shigella flexneri 2a str. 2457T
auacccaaaaaa

SEQ ID NO: 3830290 - RNA, 19 nt, Shigella flexneri 2a str. 2457T
auacccaaaaaauagcaaa

SEQ ID NO: 3830291 - RNA, 13 nt, Shigella flexneri 2a str. 2457T
auaccccagcgca

SEQ ID NO: 3830292 - RNA, 18 nt, Shigella flexneri 2a str. 2457T
auaccgaagaguaaccaa

SEQ ID NO: 3830293 - RNA, 22 nt, Shigella flexneri 2a str. 2457T
auaccgagcagccacugcggca

SEQ ID NO: 3830294 - RNA, 17 nt, Shigella flexneri 2a str. 2457T
auaccgauuacucagca

SEQ ID NO: 3830295 - RNA, 17 nt, Shigella flexneri 2a str. 2457T
auaccgcacgcucaaag

SEQ ID NO: 3830296 - RNA, 14 nt, Shigella flexneri 2a str. 2457T
auaccgcaucagca

SEQ ID NO: 3830297 - RNA, 19 nt, Shigella flexneri 2a str. 2457T
auaccgccaauagcuauuc

SEQ ID NO: 3830298 - RNA, 15 nt, Shigella flexneri 2a str. 2457T
auaccgcgaaucaua

SEQ ID NO: 3830299 - RNA, 14 nt, Shigella flexneri 2a str. 2457T
auaccggacacacu

SEQ ID NO: 3830300 - RNA, 21 nt, Shigella flexneri 2a str. 2457T
auaccggcgucccaucggcaa

SEQ ID NO: 3830301 - RNA, 20 nt, Shigella flexneri 2a str. 2457T
auaccgucaggauaaacucc

SEQ ID NO: 3830302 - RNA, 16 nt, Shigella flexneri 2a str. 2457T
auaccgugcacaauau

SEQ ID NO: 3830303 - RNA, 13 nt, Shigella flexneri 2a str. 2457T
auaccguucagac

SEQ ID NO: 3830304 - RNA, 18 nt, Shigella flexneri 2a str. 2457T
auaccguucucuuuaaaa

SEQ ID NO: 3830305 - RNA, 22 nt, Shigella flexneri 2a str. 2457T
auaccguuucgcagucgccagc

SEQ ID NO: 3830306 - RNA, 13 nt, Shigella flexneri 2a str. 2457T
auaccuaaaaaau

SEQ ID NO: 3830307 - RNA, 14 nt, Shigella flexneri 2a str. 2457T
auaccuaaaagcac

SEQ ID NO: 3830308 - RNA, 17 nt, Shigella flexneri 2a str. 2457T
auaccuaacauuuuacu

SEQ ID NO: 3830309 - RNA, 23 nt, Shigella flexneri 2a str. 2457T
auaccugaguggcaauagaauaa

SEQ ID NO: 3830310 - RNA, 21 nt, Shigella flexneri 2a str. 2457T
auaccugaugagaugcuggag

SEQ ID NO: 3830311 - RNA, 22 nt, Shigella flexneri 2a str. 2457T
auaccugaugagaugcuggaga

SEQ ID NO: 3830312 - RNA, 13 nt, Shigella flexneri 2a str. 2457T
auaccugccuggu

SEQ ID NO: 3830313 - RNA, 17 nt, Shigella flexneri 2a str. 2457T
auacgaccguuccauuc

SEQ ID NO: 3830314 - RNA, 18 nt, Shigella flexneri 2a str. 2457T
auacgcaccgcuccaucg

SEQ ID NO: 3830315 - RNA, 21 nt, Shigella flexneri 2a str. 2457T
auacgcaccgcuccaucgccu

SEQ ID NO: 3830316 - RNA, 22 nt, Shigella flexneri 2a str. 2457T
auacgcaccgggcuuccggcaa

SEQ ID NO: 3830317 - RNA, 16 nt, Shigella flexneri 2a str. 2457T
auacgcaccuuuacca

SEQ ID NO: 3830318 - RNA, 18 nt, Shigella flexneri 2a str. 2457T
auacgcauaugcaucaga

SEQ ID NO: 3830319 - RNA, 19 nt, Shigella flexneri 2a str. 2457T
auacgccaucgccagcagc

SEQ ID NO: 3830320 - RNA, 15 nt, Shigella flexneri 2a str. 2457T
auacgccccacagac

SEQ ID NO: 3830321 - RNA, 14 nt, Shigella flexneri 2a str. 2457T
auagguggcaaaga

SEQ ID NO: 3830322 - RNA, 19 nt, Shigella flexneri 2a str. 2457T
auagguuauauuguuuuaa

SEQ ID NO: 3830323 - RNA, 16 nt, Shigella flexneri 2a str. 2457T
auagguucuuuuaaau

SEQ ID NO: 3830324 - RNA, 18 nt, Shigella flexneri 2a str. 2457T
auagguugaaauaaaccg

SEQ ID NO: 3830325 - RNA, 13 nt, Shigella flexneri 2a str. 2457T
auaguaaccagac

SEQ ID NO: 3830326 - RNA, 15 nt, Shigella flexneri 2a str. 2457T
auaguaagauuauau

SEQ ID NO: 3830327 - RNA, 15 nt, Shigella flexneri 2a str. 2457T
auaguagccagccag

SEQ ID NO: 3830328 - RNA, 16 nt, Shigella flexneri 2a str. 2457T
auaguagccagccaga

SEQ ID NO: 3830329 - RNA, 21 nt, Shigella flexneri 2a str. 2457T
auaguagccagccagaaucau

SEQ ID NO: 3830330 - RNA, 15 nt, Shigella flexneri 2a str. 2457T
auagucaucucuucc

SEQ ID NO: 3830331 - RNA, 21 nt, Shigella flexneri 2a str. 2457T
auagucccuucgguagcagcu

SEQ ID NO: 3830332 - RNA, 22 nt, Shigella flexneri 2a str. 2457T
auaguccugagucagaaacugu

SEQ ID NO: 3830333 - RNA, 19 nt, Shigella flexneri 2a str. 2457T
auagucggcccggcgacua

SEQ ID NO: 3830334 - RNA, 12 nt, Shigella flexneri 2a str. 2457T
auagucuuuucg

SEQ ID NO: 3830335 - RNA, 16 nt, Shigella flexneri 2a str. 2457T
auagugccuggcugcg

SEQ ID NO: 3830336 - RNA, 22 nt, Shigella flexneri 2a str. 2457T
auaguguccacaggaaaacuac

SEQ ID NO: 3830337 - RNA, 16 nt, Shigella flexneri 2a str. 2457T
auaguguuuuauguuc

SEQ ID NO: 3830338 - RNA, 22 nt, Shigella flexneri 2a str. 2457T
auaguguuuuauguucagauaa

SEQ ID NO: 3830339 - RNA, 20 nt, Shigella flexneri 2a str. 2457T
auaguuaaaauucaagacau

SEQ ID NO: 3830340 - RNA, 22 nt, Shigella flexneri 2a str. 2457T
auaguucuguugcugaaauucc

SEQ ID NO: 3830341 - RNA, 19 nt, Shigella flexneri 2a str. 2457T
auaguugauuaauuucauu

SEQ ID NO: 3830342 - RNA, 20 nt, Shigella flexneri 2a str. 2457T
auaguugcauuccaguccac

SEQ ID NO: 3830343 - RNA, 16 nt, Shigella flexneri 2a str. 2457T
auauaaaccaucggcg

SEQ ID NO: 3830344 - RNA, 19 nt, Shigella flexneri 2a str. 2457T
auauaaauauuuucugaaa

SEQ ID NO: 3830345 - RNA, 17 nt, Shigella flexneri 2a str. 2457T
auauaacagucauacaa

SEQ ID NO: 3830346 - RNA, 14 nt, Shigella flexneri 2a str. 2457T
auauaauaaaccug

SEQ ID NO: 3830347 - RNA, 17 nt, Shigella flexneri 2a str. 2457T
auauaauaugcauuaua

SEQ ID NO: 3830348 - RNA, 13 nt, Shigella flexneri 2a str. 2457T
auauaauuaaaaa

SEQ ID NO: 3830349 - RNA, 14 nt, Shigella flexneri 2a str. 2457T
auauaauuaaaaau

SEQ ID NO: 3830350 - RNA, 22 nt, Shigella flexneri 2a str. 2457T
auauaauuccauucaccauuuu

SEQ ID NO: 3830351 - RNA, 19 nt, Shigella flexneri 2a str. 2457T
auauacauaaagucuuucu

SEQ ID NO: 3830352 - RNA, 19 nt, Shigella flexneri 2a str. 2457T
auauaccauggaagaaaaa

SEQ ID NO: 3830353 - RNA, 17 nt, Shigella flexneri 2a str. 2457T
auauacccgccaaacca

SEQ ID NO: 3830354 - RNA, 20 nt, Shigella flexneri 2a str. 2457T
auauacgccaucgccagcag

SEQ ID NO: 3830355 - RNA, 16 nt, Shigella flexneri 2a str. 2457T
auauagaaugccugug

SEQ ID NO: 3830356 - RNA, 14 nt, Shigella flexneri 2a str. 2457T
auauagauaucaau

SEQ ID NO: 3830357 - RNA, 13 nt, Shigella flexneri 2a str. 2457T
auauagauaucau

SEQ ID NO: 3830358 - RNA, 15 nt, Shigella flexneri 2a str. 2457T
auauagccaaagcac

SEQ ID NO: 3830359 - RNA, 17 nt, Shigella flexneri 2a str. 2457T
auauauaaaaaaacaau

SEQ ID NO: 3830360 - RNA, 18 nt, Shigella flexneri 2a str. 2457T
auauauaauuaaaaauag

SEQ ID NO: 3830361 - RNA, 19 nt, Shigella flexneri 2a str. 2457T
auauauccguggcuuuuua

SEQ ID NO: 3830362 - RNA, 22 nt, Shigella flexneri 2a str. 2457T
auauaugggucguuggugauau

SEQ ID NO: 3830363 - RNA, 22 nt, Shigella flexneri 2a str. 2457T
auauauuacaacguauuauaua

SEQ ID NO: 3830364 - RNA, 22 nt, Shigella flexneri 2a str. 2457T
auauauuccuuacucauaaaua

SEQ ID NO: 3830365 - RNA, 21 nt, Shigella flexneri 2a str. 2457T
auauauucguuacuggcaugu

SEQ ID NO: 3830366 - RNA, 14 nt, Shigella flexneri 2a str. 2457T
auauauucucuuuu

SEQ ID NO: 3830367 - RNA, 23 nt, Shigella flexneri 2a str. 2457T
auauauugaauuagcaauauuuu

SEQ ID NO: 3830368 - RNA, 17 nt, Shigella flexneri 2a str. 2457T
auauauugcugaaauaa

SEQ ID NO: 3830369 - RNA, 17 nt, Shigella flexneri 2a str. 2457T
auauauuucaucaacug

SEQ ID NO: 3830370 - RNA, 17 nt, Shigella flexneri 2a str. 2457T
auauauuuuuaaauaua

SEQ ID NO: 3830371 - RNA, 19 nt, Shigella flexneri 2a str. 2457T
auaucaacguaauggaugc

SEQ ID NO: 3830372 - RNA, 20 nt, Shigella flexneri 2a str. 2457T
auaucaagaucaucaaacuu

SEQ ID NO: 3830373 - RNA, 21 nt, Shigella flexneri 2a str. 2457T
auaucacucggggcuuuucuc

SEQ ID NO: 3830374 - RNA, 22 nt, Shigella flexneri 2a str. 2457T
auaucagccugaaugcuuucau

SEQ ID NO: 3830375 - RNA, 23 nt, Shigella flexneri 2a str. 2457T
auaucagugauauauuuuuaaau

SEQ ID NO: 3830376 - RNA, 14 nt, Shigella flexneri 2a str. 2457T
auaucaucaaaauu

SEQ ID NO: 3830377 - RNA, 15 nt, Shigella flexneri 2a str. 2457T
auaucaucaaaauua

SEQ ID NO: 3830378 - RNA, 12 nt, Shigella flexneri 2a str. 2457T
auaucaucauuu

SEQ ID NO: 3830379 - RNA, 13 nt, Shigella flexneri 2a str. 2457T
auaucauuaaagu

SEQ ID NO: 3830380 - RNA, 22 nt, Shigella flexneri 2a str. 2457T
auaucauuuugcugccauguca

SEQ ID NO: 3830381 - RNA, 18 nt, Shigella flexneri 2a str. 2457T
auauccacccgcagccau

SEQ ID NO: 3830382 - RNA, 18 nt, Shigella flexneri 2a str. 2457T
auauccaccgcguucagc

SEQ ID NO: 3830383 - RNA, 21 nt, Shigella flexneri 2a str. 2457T
auauccaccgggguaaaucca

SEQ ID NO: 3830384 - RNA, 13 nt, Shigella flexneri 2a str. 2457T
auauccagauaga

SEQ ID NO: 3830385 - RNA, 19 nt, Shigella flexneri 2a str. 2457T
auauccagauccagcaccu

SEQ ID NO: 3830386 - RNA, 16 nt, Shigella flexneri 2a str. 2457T
auauccagauggcuau

SEQ ID NO: 3830387 - RNA, 13 nt, Shigella flexneri 2a str. 2457T
auauccagcgaua

SEQ ID NO: 3830388 - RNA, 19 nt, Shigella flexneri 2a str. 2457T
auauccagcgccgagguug

SEQ ID NO: 3830389 - RNA, 22 nt, Shigella flexneri 2a str. 2457T
auauccagcgcggcgaaggugc

SEQ ID NO: 3830390 - RNA, 14 nt, Shigella flexneri 2a str. 2457T
auauccgcgcuaag

SEQ ID NO: 3830391 - RNA, 12 nt, Shigella flexneri 2a str. 2457T
auauccugcgcu

SEQ ID NO: 3830392 - RNA, 20 nt, Shigella flexneri 2a str. 2457T
auauccugcgcuuccugcaa

SEQ ID NO: 3830393 - RNA, 22 nt, Shigella flexneri 2a str. 2457T
auauccugcgcuuccugcaacg

SEQ ID NO: 3830394 - RNA, 17 nt, Shigella flexneri 2a str. 2457T
auaucgacgaaccauuu

SEQ ID NO: 3830395 - RNA, 17 nt, Shigella flexneri 2a str. 2457T
auaucgagcauauuuag

SEQ ID NO: 3830396 - RNA, 20 nt, Shigella flexneri 2a str. 2457T
auaucgauuucuacacccag

SEQ ID NO: 3830397 - RNA, 22 nt, Shigella flexneri 2a str. 2457T
auaucgcauaccauccaggaga

SEQ ID NO: 3830398 - RNA, 14 nt, Shigella flexneri 2a str. 2457T
auaucguuaucacc

SEQ ID NO: 3830399 - RNA, 23 nt, Shigella flexneri 2a str. 2457T
auaucuaugguuuuuucuacaca

SEQ ID NO: 3830400 - RNA, 14 nt, Shigella flexneri 2a str. 2457T
auaucuccuauugu

SEQ ID NO: 3830401 - RNA, 19 nt, Shigella flexneri 2a str. 2457T
auaucuccuccgaugacgg

SEQ ID NO: 3830402 - RNA, 13 nt, Shigella flexneri 2a str. 2457T
auaucuccucugc

SEQ ID NO: 3830403 - RNA, 22 nt, Shigella flexneri 2a str. 2457T
auaucuuauagacuaaauuuca

SEQ ID NO: 3830404 - RNA, 11 nt, Shigella flexneri 2a str. 2457T
auaucuucccg

SEQ ID NO: 3830405 - RNA, 18 nt, Shigella flexneri 2a str. 2457T
auaucuucuguugcaggg

SEQ ID NO: 3830406 - RNA, 23 nt, Shigella flexneri 2a str. 2457T
auaucuuucccuuucgauaagac

SEQ ID NO: 3830407 - RNA, 13 nt, Shigella flexneri 2a str. 2457T
auaucuuuucuua

SEQ ID NO: 3830408 - RNA, 20 nt, Shigella flexneri 2a str. 2457T
auaucuuuucuuaacaaaaa

SEQ ID NO: 3830409 - RNA, 21 nt, Shigella flexneri 2a str. 2457T
auaugaaauccggcaccuguc

SEQ ID NO: 3830410 - RNA, 15 nt, Shigella flexneri 2a str. 2457T
auaugacgaaagcgc

SEQ ID NO: 3830411 - RNA, 22 nt, Shigella flexneri 2a str. 2457T
auaugagguuagcaaugccuuc

SEQ ID NO: 3830412 - RNA, 17 nt, Shigella flexneri 2a str. 2457T
auaugauaauuauuaua

SEQ ID NO: 3830413 - RNA, 14 nt, Shigella flexneri 2a str. 2457T
auaugauucuuacu

SEQ ID NO: 3830414 - RNA, 15 nt, Shigella flexneri 2a str. 2457T
auaugauuuaaaaaa

SEQ ID NO: 3830415 - RNA, 14 nt, Shigella flexneri 2a str. 2457T
auaugcauaaaccg

SEQ ID NO: 3830416 - RNA, 17 nt, Shigella flexneri 2a str. 2457T
auaugcaucaugaaaac

SEQ ID NO: 3830417 - RNA, 22 nt, Shigella flexneri 2a str. 2457T
auaugccagccccagcgucagc

SEQ ID NO: 3830418 - RNA, 22 nt, Shigella flexneri 2a str. 2457T
aucaacgcaccgacaaauuuca

SEQ ID NO: 3830419 - RNA, 14 nt, Shigella flexneri 2a str. 2457T
aucaacuccgccag

SEQ ID NO: 3830420 - RNA, 18 nt, Shigella flexneri 2a str. 2457T
aucaacuccgccagcaac

SEQ ID NO: 3830421 - RNA, 15 nt, Shigella flexneri 2a str. 2457T
aucaacucugcaaug

SEQ ID NO: 3830422 - RNA, 15 nt, Shigella flexneri 2a str. 2457T
aucaacugcgcuaua

SEQ ID NO: 3830423 - RNA, 20 nt, Shigella flexneri 2a str. 2457T
aucaacugcguucugucgau

SEQ ID NO: 3830424 - RNA, 18 nt, Shigella flexneri 2a str. 2457T
aucaacuggcaaccagaa

SEQ ID NO: 3830425 - RNA, 21 nt, Shigella flexneri 2a str. 2457T
aucaacuggcaaccagaagag

SEQ ID NO: 3830426 - RNA, 21 nt, Shigella flexneri 2a str. 2457T
aucaacuuauugguaaacuca

SEQ ID NO: 3830427 - RNA, 13 nt, Shigella flexneri 2a str. 2457T
aucaagaaaugca

SEQ ID NO: 3830428 - RNA, 20 nt, Shigella flexneri 2a str. 2457T
aucaagacaugauguuuuaa

SEQ ID NO: 3830429 - RNA, 13 nt, Shigella flexneri 2a str. 2457T
aucaagcacaauc

SEQ ID NO: 3830430 - RNA, 15 nt, Shigella flexneri 2a str. 2457T
aucaagccauagcgc

SEQ ID NO: 3830431 - RNA, 18 nt, Shigella flexneri 2a str. 2457T
aucaagccccagcaggau

SEQ ID NO: 3830432 - RNA, 19 nt, Shigella flexneri 2a str. 2457T
aucaaggcauauaccacac

SEQ ID NO: 3830433 - RNA, 24 nt, Shigella flexneri 2a str. 2457T
aucaaguagcagguaaucugccau

SEQ ID NO: 3830434 - RNA, 15 nt, Shigella flexneri 2a str. 2457T
aucaaguauuuuuaa

SEQ ID NO: 3830435 - RNA, 16 nt, Shigella flexneri 2a str. 2457T
aucaaguauuuuuaau

SEQ ID NO: 3830436 - RNA, 14 nt, Shigella flexneri 2a str. 2457T
aucaagucauugau

SEQ ID NO: 3830437 - RNA, 21 nt, Shigella flexneri 2a str. 2457T
aucaauaaguuacacaucauu

SEQ ID NO: 3830438 - RNA, 23 nt, Shigella flexneri 2a str. 2457T
aucaauacaggcgacgaguugcu

SEQ ID NO: 3830439 - RNA, 13 nt, Shigella flexneri 2a str. 2457T
aucaauaccagcc

SEQ ID NO: 3830440 - RNA, 20 nt, Shigella flexneri 2a str. 2457T
aucaauaccauuaucauuga

SEQ ID NO: 3830441 - RNA, 22 nt, Shigella flexneri 2a str. 2457T
aucaauaccugguccuucaucu

SEQ ID NO: 3830442 - RNA, 23 nt, Shigella flexneri 2a str. 2457T
aucaauaccugguccuucaucuu

SEQ ID NO: 3830443 - RNA, 18 nt, Shigella flexneri 2a str. 2457T
aucaauagcaguaauuuu

SEQ ID NO: 3830444 - RNA, 15 nt, Shigella flexneri 2a str. 2457T
aucaauauuuucaau

SEQ ID NO: 3830445 - RNA, 17 nt, Shigella flexneri 2a str. 2457T
aucaauauuuucaaucu

SEQ ID NO: 3830446 - RNA, 22 nt, Shigella flexneri 2a str. 2457T
aucaaucacccguuuucuccau

SEQ ID NO: 3830447 - RNA, 14 nt, Shigella flexneri 2a str. 2457T
aucaaucaccgcuu

SEQ ID NO: 3830448 - RNA, 16 nt, Shigella flexneri 2a str. 2457T
aucaaucaccgcuuca

SEQ ID NO: 3830449 - RNA, 13 nt, Shigella flexneri 2a str. 2457T
aucaauccaaaca

SEQ ID NO: 3830450 - RNA, 17 nt, Shigella flexneri 2a str. 2457T
aucaaucgcaaucuggc

SEQ ID NO: 3830451 - RNA, 13 nt, Shigella flexneri 2a str. 2457T
aucaaucgccccu

SEQ ID NO: 3830452 - RNA, 15 nt, Shigella flexneri 2a str. 2457T
aucaaucucagcaag

SEQ ID NO: 3830453 - RNA, 16 nt, Shigella flexneri 2a str. 2457T
aucaaucucagcgaug

SEQ ID NO: 3830454 - RNA, 13 nt, Shigella flexneri 2a str. 2457T
aucaaucugcugc

SEQ ID NO: 3830455 - RNA, 15 nt, Shigella flexneri 2a str. 2457T
aucaaucugcugccu

SEQ ID NO: 3830456 - RNA, 13 nt, Shigella flexneri 2a str. 2457T
aucaaugccagca

SEQ ID NO: 3830457 - RNA, 15 nt, Shigella flexneri 2a str. 2457T
aucaaugccagcaua

SEQ ID NO: 3830458 - RNA, 21 nt, Shigella flexneri 2a str. 2457T
aucaaugccgcaacuuuagcc

SEQ ID NO: 3830459 - RNA, 18 nt, Shigella flexneri 2a str. 2457T
aucaauggcugcaaagca

SEQ ID NO: 3830460 - RNA, 22 nt, Shigella flexneri 2a str. 2457T
aucaaugugcugagaacaagau

SEQ ID NO: 3830461 - RNA, 22 nt, Shigella flexneri 2a str. 2457T
aucaauucggaaauaaucaccu

SEQ ID NO: 3830462 - RNA, 21 nt, Shigella flexneri 2a str. 2457T
aucaauuuaucguauuggccg

SEQ ID NO: 3830463 - RNA, 21 nt, Shigella flexneri 2a str. 2457T
aucaauuuauugaauuuacac

SEQ ID NO: 3830464 - RNA, 12 nt, Shigella flexneri 2a str. 2457T
aucaauuucaca

SEQ ID NO: 3830465 - RNA, 13 nt, Shigella flexneri 2a str. 2457T
aucaauuucacag

SEQ ID NO: 3830466 - RNA, 23 nt, Shigella flexneri 2a str. 2457T
aucaauuuccggcuuaccaaaua

SEQ ID NO: 3830467 - RNA, 13 nt, Shigella flexneri 2a str. 2457T
aucaauuugccca

SEQ ID NO: 3830468 - RNA, 20 nt, Shigella flexneri 2a str. 2457T
aucaauuugcuucuggcugg

SEQ ID NO: 3830469 - RNA, 21 nt, Shigella flexneri 2a str. 2457T
aucaauuuucccuucugagau

SEQ ID NO: 3830470 - RNA, 21 nt, Shigella flexneri 2a str. 2457T
aucaauuuugaugauaucagc

SEQ ID NO: 3830471 - RNA, 15 nt, Shigella flexneri 2a str. 2457T
aucacaauaaucgcc

SEQ ID NO: 3830472 - RNA, 16 nt, Shigella flexneri 2a str. 2457T
aucacaauagaaauau

SEQ ID NO: 3830473 - RNA, 17 nt, Shigella flexneri 2a str. 2457T
aucacaauagaaauauu

SEQ ID NO: 3830474 - RNA, 18 nt, Shigella flexneri 2a str. 2457T
aucacaaucggcuuucac

SEQ ID NO: 3830475 - RNA, 19 nt, Shigella flexneri 2a str. 2457T
aucacaccgcgaucuucca

SEQ ID NO: 3830476 - RNA, 18 nt, Shigella flexneri 2a str. 2457T
aucacaccugcucagccc

SEQ ID NO: 3830477 - RNA, 17 nt, Shigella flexneri 2a str. 2457T
aucacaguuaagcaaua

SEQ ID NO: 3830478 - RNA, 18 nt, Shigella flexneri 2a str. 2457T
aucacauaaucgaaaaca

SEQ ID NO: 3830479 - RNA, 18 nt, Shigella flexneri 2a str. 2457T
aucacaucaaauccccac

SEQ ID NO: 3830480 - RNA, 15 nt, Shigella flexneri 2a str. 2457T
aucacaucagcgcau

SEQ ID NO: 3830481 - RNA, 16 nt, Shigella flexneri 2a str. 2457T
aucacaucccagcaga

SEQ ID NO: 3830482 - RNA, 15 nt, Shigella flexneri 2a str. 2457T
aucacauccugauag

SEQ ID NO: 3830483 - RNA, 12 nt, Shigella flexneri 2a str. 2457T
aucacaucgccg

SEQ ID NO: 3830484 - RNA, 21 nt, Shigella flexneri 2a str. 2457T
aucacaugcuggaaccacagc

SEQ ID NO: 3830485 - RNA, 18 nt, Shigella flexneri 2a str. 2457T
aucaccaacgauuuuuuc

SEQ ID NO: 3830486 - RNA, 13 nt, Shigella flexneri 2a str. 2457T
aucaccaaucaca

SEQ ID NO: 3830487 - RNA, 20 nt, Shigella flexneri 2a str. 2457T
aucaccaguaccgccgccau

SEQ ID NO: 3830488 - RNA, 18 nt, Shigella flexneri 2a str. 2457T
aucaccauauucagcagc

SEQ ID NO: 3830489 - RNA, 19 nt, Shigella flexneri 2a str. 2457T
aucaccauauucagcagca

SEQ ID NO: 3830490 - RNA, 13 nt, Shigella flexneri 2a str. 2457T
aucaccaucagca

SEQ ID NO: 3830491 - RNA, 16 nt, Shigella flexneri 2a str. 2457T
aucaccaucagcagca

SEQ ID NO: 3830492 - RNA, 13 nt, Shigella flexneri 2a str. 2457T
aucaccauccacg

SEQ ID NO: 3830493 - RNA, 14 nt, Shigella flexneri 2a str. 2457T
aucaccaucuugag

SEQ ID NO: 3830494 - RNA, 16 nt, Shigella flexneri 2a str. 2457T
aucaccaugauuucug

SEQ ID NO: 3830495 - RNA, 19 nt, Shigella flexneri 2a str. 2457T
aucacccacaucagcggca

SEQ ID NO: 3830496 - RNA, 15 nt, Shigella flexneri 2a str. 2457T
aucaccguaacgaac

SEQ ID NO: 3830497 - RNA, 19 nt, Shigella flexneri 2a str. 2457T
aucaccuccagcgaaggau

SEQ ID NO: 3830498 - RNA, 11 nt, Shigella flexneri 2a str. 2457T
aucaccucuuc

SEQ ID NO: 3830499 - RNA, 16 nt, Shigella flexneri 2a str. 2457T
aucaccugaugcccgu

SEQ ID NO: 3830500 - RNA, 19 nt, Shigella flexneri 2a str. 2457T
aucaccugauugaccgcca

SEQ ID NO: 3830501 - RNA, 14 nt, Shigella flexneri 2a str. 2457T
aucaccugcacaug

SEQ ID NO: 3830502 - RNA, 14 nt, Shigella flexneri 2a str. 2457T
aucaccugcuggac

SEQ ID NO: 3830503 - RNA, 15 nt, Shigella flexneri 2a str. 2457T
aucaccuuacggcac

SEQ ID NO: 3830504 - RNA, 15 nt, Shigella flexneri 2a str. 2457T
aucacgacagcacca

SEQ ID NO: 3830505 - RNA, 14 nt, Shigella flexneri 2a str. 2457T
aucacgaugcuaaa

SEQ ID NO: 3830506 - RNA, 17 nt, Shigella flexneri 2a str. 2457T
aucacgaugcuaaaaac

SEQ ID NO: 3830507 - RNA, 18 nt, Shigella flexneri 2a str. 2457T
aucacgaugcuaaaaaca

SEQ ID NO: 3830508 - RNA, 14 nt, Shigella flexneri 2a str. 2457T
aucacgauugcugc

SEQ ID NO: 3830509 - RNA, 17 nt, Shigella flexneri 2a str. 2457T
aucacgcagcaagccgu

SEQ ID NO: 3830510 - RNA, 12 nt, Shigella flexneri 2a str. 2457T
aucacgcagcug

SEQ ID NO: 3830511 - RNA, 13 nt, Shigella flexneri 2a str. 2457T
aucacgcaucacu

SEQ ID NO: 3830512 - RNA, 13 nt, Shigella flexneri 2a str. 2457T
aucacgcauggac

SEQ ID NO: 3830513 - RNA, 21 nt, Shigella flexneri 2a str. 2457T
aucacgccaauaccgcccaga

SEQ ID NO: 3830514 - RNA, 14 nt, Shigella flexneri 2a str. 2457T
aucacgcccgccag

SEQ ID NO: 3830515 - RNA, 16 nt, Shigella flexneri 2a str. 2457T
aucacgcgaccaucgc

SEQ ID NO: 3830516 - RNA, 20 nt, Shigella flexneri 2a str. 2457T
aucagguaagcgauaaaaau

SEQ ID NO: 3830517 - RNA, 15 nt, Shigella flexneri 2a str. 2457T
aucagguauaccgaa

SEQ ID NO: 3830518 - RNA, 22 nt, Shigella flexneri 2a str. 2457T
aucaggucaucaaucaguucau

SEQ ID NO: 3830519 - RNA, 22 nt, Shigella flexneri 2a str. 2457T
aucagguugaugcgaguaauca

SEQ ID NO: 3830520 - RNA, 14 nt, Shigella flexneri 2a str. 2457T
aucagucucaaacc

SEQ ID NO: 3830521 - RNA, 20 nt, Shigella flexneri 2a str. 2457T
aucagucugagccugccauu

SEQ ID NO: 3830522 - RNA, 17 nt, Shigella flexneri 2a str. 2457T
aucaguggcuugguugu

SEQ ID NO: 3830523 - RNA, 14 nt, Shigella flexneri 2a str. 2457T
aucaguuccagcag

SEQ ID NO: 3830524 - RNA, 18 nt, Shigella flexneri 2a str. 2457T
aucaguuguucagaaugc

SEQ ID NO: 3830525 - RNA, 19 nt, Shigella flexneri 2a str. 2457T
aucaguuguucagaaugcc

SEQ ID NO: 3830526 - RNA, 13 nt, Shigella flexneri 2a str. 2457T
aucauaaaaauua

SEQ ID NO: 3830527 - RNA, 14 nt, Shigella flexneri 2a str. 2457T
aucauaaaaauuaa

SEQ ID NO: 3830528 - RNA, 16 nt, Shigella flexneri 2a str. 2457T
aucauaaccugcucug

SEQ ID NO: 3830529 - RNA, 22 nt, Shigella flexneri 2a str. 2457T
aucauaccuccgcaauaugcgc

SEQ ID NO: 3830530 - RNA, 11 nt, Shigella flexneri 2a str. 2457T
aucauauuaaa

SEQ ID NO: 3830531 - RNA, 17 nt, Shigella flexneri 2a str. 2457T
aucauauugcucuggau

SEQ ID NO: 3830532 - RNA, 19 nt, Shigella flexneri 2a str. 2457T
aucauauuuccuuccuugg

SEQ ID NO: 3830533 - RNA, 14 nt, Shigella flexneri 2a str. 2457T
aucaucaaaauuaa

SEQ ID NO: 3830534 - RNA, 16 nt, Shigella flexneri 2a str. 2457T
aucaucaaacuuuaau

SEQ ID NO: 3830535 - RNA, 14 nt, Shigella flexneri 2a str. 2457T
aucaucaaagccaa

SEQ ID NO: 3830536 - RNA, 15 nt, Shigella flexneri 2a str. 2457T
aucaucaacuggcaa

SEQ ID NO: 3830537 - RNA, 20 nt, Shigella flexneri 2a str. 2457T
aucaucaauaccagcccguc

SEQ ID NO: 3830538 - RNA, 12 nt, Shigella flexneri 2a str. 2457T
aucaucaauaug

SEQ ID NO: 3830539 - RNA, 19 nt, Shigella flexneri 2a str. 2457T
aucaucacgccaauaccgc

SEQ ID NO: 3830540 - RNA, 12 nt, Shigella flexneri 2a str. 2457T
aucaucacuccc

SEQ ID NO: 3830541 - RNA, 22 nt, Shigella flexneri 2a str. 2457T
aucaucagcauuuucuauuucu

SEQ ID NO: 3830542 - RNA, 19 nt, Shigella flexneri 2a str. 2457T
aucaucaggggcagcacca

SEQ ID NO: 3830543 - RNA, 20 nt, Shigella flexneri 2a str. 2457T
aucaucaggggcagcaccau

SEQ ID NO: 3830544 - RNA, 22 nt, Shigella flexneri 2a str. 2457T
aucaucaggggcagcaccauca

SEQ ID NO: 3830545 - RNA, 17 nt, Shigella flexneri 2a str. 2457T
aucaucagugcuuuauc

SEQ ID NO: 3830546 - RNA, 14 nt, Shigella flexneri 2a str. 2457T
aucaucaucgccag

SEQ ID NO: 3830547 - RNA, 14 nt, Shigella flexneri 2a str. 2457T
aucaucauuauuaa

SEQ ID NO: 3830548 - RNA, 20 nt, Shigella flexneri 2a str. 2457T
aucauccacccgcagcaagc

SEQ ID NO: 3830549 - RNA, 23 nt, Shigella flexneri 2a str. 2457T
aucauccagaccgcucagcuccu

SEQ ID NO: 3830550 - RNA, 15 nt, Shigella flexneri 2a str. 2457T
aucauccagacugcu

SEQ ID NO: 3830551 - RNA, 12 nt, Shigella flexneri 2a str. 2457T
aucauccagcac

SEQ ID NO: 3830552 - RNA, 15 nt, Shigella flexneri 2a str. 2457T
aucauccauauuuuc

SEQ ID NO: 3830553 - RNA, 23 nt, Shigella flexneri 2a str. 2457T
aucauccauauuuucagcagugg

SEQ ID NO: 3830554 - RNA, 12 nt, Shigella flexneri 2a str. 2457T
aucauccauccg

SEQ ID NO: 3830555 - RNA, 16 nt, Shigella flexneri 2a str. 2457T
aucauccauccggcug

SEQ ID NO: 3830556 - RNA, 20 nt, Shigella flexneri 2a str. 2457T
aucauccccguaucuucaug

SEQ ID NO: 3830557 - RNA, 15 nt, Shigella flexneri 2a str. 2457T
aucauccgcacaauc

SEQ ID NO: 3830558 - RNA, 21 nt, Shigella flexneri 2a str. 2457T
aucauccgcucccuggcccau

SEQ ID NO: 3830559 - RNA, 16 nt, Shigella flexneri 2a str. 2457T
aucauccggcaccuuu

SEQ ID NO: 3830560 - RNA, 22 nt, Shigella flexneri 2a str. 2457T
aucauccugcggcagcuccagc

SEQ ID NO: 3830561 - RNA, 17 nt, Shigella flexneri 2a str. 2457T
aucaucgagaucgauac

SEQ ID NO: 3830562 - RNA, 20 nt, Shigella flexneri 2a str. 2457T
aucaucgcccagccggacug

SEQ ID NO: 3830563 - RNA, 23 nt, Shigella flexneri 2a str. 2457T
aucaucgcccaguugaucaccag

SEQ ID NO: 3830564 - RNA, 23 nt, Shigella flexneri 2a str. 2457T
aucaucgccgucacgguaauaac

SEQ ID NO: 3830565 - RNA, 17 nt, Shigella flexneri 2a str. 2457T
aucaucgcggcacacag

SEQ ID NO: 3830566 - RNA, 18 nt, Shigella flexneri 2a str. 2457T
aucaucgcggcacacagc

SEQ ID NO: 3830567 - RNA, 19 nt, Shigella flexneri 2a str. 2457T
aucaucgcggcacacagca

SEQ ID NO: 3830568 - RNA, 20 nt, Shigella flexneri 2a str. 2457T
aucaucgcuuucaggucagc

SEQ ID NO: 3830569 - RNA, 22 nt, Shigella flexneri 2a str. 2457T
aucaucgucguuucuuuuuuau

SEQ ID NO: 3830570 - RNA, 16 nt, Shigella flexneri 2a str. 2457T
aucaucuauccggcau

SEQ ID NO: 3830571 - RNA, 16 nt, Shigella flexneri 2a str. 2457T
aucaucugccacuucu

SEQ ID NO: 3830572 - RNA, 22 nt, Shigella flexneri 2a str. 2457T
aucaucuuccgguagaugccag

SEQ ID NO: 3830573 - RNA, 23 nt, Shigella flexneri 2a str. 2457T
aucaugagguuguggcauuagau

SEQ ID NO: 3830574 - RNA, 15 nt, Shigella flexneri 2a str. 2457T
aucaugauucacagu

SEQ ID NO: 3830575 - RNA, 15 nt, Shigella flexneri 2a str. 2457T
aucaugcacuccgcu

SEQ ID NO: 3830576 - RNA, 17 nt, Shigella flexneri 2a str. 2457T
aucaugccaaaaauaau

SEQ ID NO: 3830577 - RNA, 11 nt, Shigella flexneri 2a str. 2457T
aucaugccacc

SEQ ID NO: 3830578 - RNA, 22 nt, Shigella flexneri 2a str. 2457T
aucaugccgaucgucugggcau

SEQ ID NO: 3830579 - RNA, 19 nt, Shigella flexneri 2a str. 2457T
aucaugccggccagcgcca

SEQ ID NO: 3830580 - RNA, 21 nt, Shigella flexneri 2a str. 2457T
aucaugccugaugcgacgcuu

SEQ ID NO: 3830581 - RNA, 20 nt, Shigella flexneri 2a str. 2457T
aucaugccugcgacaagaau

SEQ ID NO: 3830582 - RNA, 21 nt, Shigella flexneri 2a str. 2457T
aucauggcauccuguuuucug

SEQ ID NO: 3830583 - RNA, 17 nt, Shigella flexneri 2a str. 2457T
aucaugguaucgggcag

SEQ ID NO: 3830584 - RNA, 22 nt, Shigella flexneri 2a str. 2457T
aucaugguaucgggcaguuuac

SEQ ID NO: 3830585 - RNA, 17 nt, Shigella flexneri 2a str. 2457T
aucaugucgcccacgcc

SEQ ID NO: 3830586 - RNA, 19 nt, Shigella flexneri 2a str. 2457T
aucaugucgcccacgccag

SEQ ID NO: 3830587 - RNA, 19 nt, Shigella flexneri 2a str. 2457T
aucauuaaaguuaucgccg

SEQ ID NO: 3830588 - RNA, 14 nt, Shigella flexneri 2a str. 2457T
aucauuacaaccgc

SEQ ID NO: 3830589 - RNA, 13 nt, Shigella flexneri 2a str. 2457T
aucauuacaauca

SEQ ID NO: 3830590 - RNA, 14 nt, Shigella flexneri 2a str. 2457T
aucauuacaaucac

SEQ ID NO: 3830591 - RNA, 13 nt, Shigella flexneri 2a str. 2457T
aucauuacgccag

SEQ ID NO: 3830592 - RNA, 13 nt, Shigella flexneri 2a str. 2457T
aucauuagcccaa

SEQ ID NO: 3830593 - RNA, 23 nt, Shigella flexneri 2a str. 2457T
aucauuagcccaauaaucaccgu

SEQ ID NO: 3830594 - RNA, 15 nt, Shigella flexneri 2a str. 2457T
aucauuagucacaaa

SEQ ID NO: 3830595 - RNA, 13 nt, Shigella flexneri 2a str. 2457T
aucauucccauuu

SEQ ID NO: 3830596 - RNA, 21 nt, Shigella flexneri 2a str. 2457T
aucauucccauuuauuuuucc

SEQ ID NO: 3830597 - RNA, 16 nt, Shigella flexneri 2a str. 2457T
aucauucccggucagu

SEQ ID NO: 3830598 - RNA, 20 nt, Shigella flexneri 2a str. 2457T
aucauugccgguuggcgacu

SEQ ID NO: 3830599 - RNA, 20 nt, Shigella flexneri 2a str. 2457T
aucauuggccggaauaccac

SEQ ID NO: 3830600 - RNA, 22 nt, Shigella flexneri 2a str. 2457T
aucauuggcgcuuguggaauua

SEQ ID NO: 3830601 - RNA, 13 nt, Shigella flexneri 2a str. 2457T
aucauuuaaaaag

SEQ ID NO: 3830602 - RNA, 20 nt, Shigella flexneri 2a str. 2457T
aucauuuaaaaagaaaaaac

SEQ ID NO: 3830603 - RNA, 21 nt, Shigella flexneri 2a str. 2457T
aucauuuaaaaagaaaaaacu

SEQ ID NO: 3830604 - RNA, 22 nt, Shigella flexneri 2a str. 2457T
aucauuuuacguugcauuucca

SEQ ID NO: 3830605 - RNA, 14 nt, Shigella flexneri 2a str. 2457T
aucauuuuuuuaau

SEQ ID NO: 3830606 - RNA, 15 nt, Shigella flexneri 2a str. 2457T
auccaaacauggcac

SEQ ID NO: 3830607 - RNA, 21 nt, Shigella flexneri 2a str. 2457T
auccaacccgcgaauaucagc

SEQ ID NO: 3830608 - RNA, 21 nt, Shigella flexneri 2a str. 2457T
auccaacugauguagucauac

SEQ ID NO: 3830609 - RNA, 17 nt, Shigella flexneri 2a str. 2457T
auccaacugauuuucau

SEQ ID NO: 3830610 - RNA, 12 nt, Shigella flexneri 2a str. 2457T
auccaaugccgc

SEQ ID NO: 3830611 - RNA, 21 nt, Shigella flexneri 2a str. 2457T
auccacaacggcauuauucau

SEQ ID NO: 3830612 - RNA, 14 nt, Shigella flexneri 2a str. 2457T
auccacagcaaugc

SEQ ID NO: 3830613 - RNA, 13 nt, Shigella flexneri 2a str. 2457T
auccgaugaguuc

SEQ ID NO: 3830614 - RNA, 17 nt, Shigella flexneri 2a str. 2457T
auccgcacaaucccuua

SEQ ID NO: 3830615 - RNA, 15 nt, Shigella flexneri 2a str. 2457T
auccgcaucacucca

SEQ ID NO: 3830616 - RNA, 14 nt, Shigella flexneri 2a str. 2457T
auccgccacuucuu

SEQ ID NO: 3830617 - RNA, 14 nt, Shigella flexneri 2a str. 2457T
auccgccagccaau

SEQ ID NO: 3830618 - RNA, 19 nt, Shigella flexneri 2a str. 2457T
auccgccaguuuguagcca

SEQ ID NO: 3830619 - RNA, 17 nt, Shigella flexneri 2a str. 2457T
auccgccauuucuccuc

SEQ ID NO: 3830620 - RNA, 13 nt, Shigella flexneri 2a str. 2457T
auccgcccacacc

SEQ ID NO: 3830621 - RNA, 18 nt, Shigella flexneri 2a str. 2457T
auccgcccucuuccacau

SEQ ID NO: 3830622 - RNA, 17 nt, Shigella flexneri 2a str. 2457T
auccgccgauguugcau

SEQ ID NO: 3830623 - RNA, 17 nt, Shigella flexneri 2a str. 2457T
auccgcgacuggcaugc

SEQ ID NO: 3830624 - RNA, 20 nt, Shigella flexneri 2a str. 2457T
auccgcgcgguagagaaguu

SEQ ID NO: 3830625 - RNA, 18 nt, Shigella flexneri 2a str. 2457T
auccgcgguaucgccguc

SEQ ID NO: 3830626 - RNA, 19 nt, Shigella flexneri 2a str. 2457T
auccgcuucgguauauuuc

SEQ ID NO: 3830627 - RNA, 22 nt, Shigella flexneri 2a str. 2457T
auccggauacagccccaggguu

SEQ ID NO: 3830628 - RNA, 18 nt, Shigella flexneri 2a str. 2457T
auccggauucaaaccuaa

SEQ ID NO: 3830629 - RNA, 12 nt, Shigella flexneri 2a str. 2457T
auccggcaagug

SEQ ID NO: 3830630 - RNA, 13 nt, Shigella flexneri 2a str. 2457T
auccggcaauaag

SEQ ID NO: 3830631 - RNA, 14 nt, Shigella flexneri 2a str. 2457T
auccggcaaugcgc

SEQ ID NO: 3830632 - RNA, 22 nt, Shigella flexneri 2a str. 2457T
auccggcaauuggugcacgaug

SEQ ID NO: 3830633 - RNA, 16 nt, Shigella flexneri 2a str. 2457T
auccggcacauuucac

SEQ ID NO: 3830634 - RNA, 15 nt, Shigella flexneri 2a str. 2457T
auccggcaccuuuuc

SEQ ID NO: 3830635 - RNA, 22 nt, Shigella flexneri 2a str. 2457T
auccggcaccuuuucaucaggu

SEQ ID NO: 3830636 - RNA, 20 nt, Shigella flexneri 2a str. 2457T
auccggcauaaacaaagugc

SEQ ID NO: 3830637 - RNA, 20 nt, Shigella flexneri 2a str. 2457T
auccggcauaaacuaagcgc

SEQ ID NO: 3830638 - RNA, 20 nt, Shigella flexneri 2a str. 2457T
auccggcaucaacaaagugc

SEQ ID NO: 3830639 - RNA, 23 nt, Shigella flexneri 2a str. 2457T
auccggcaucguuugcugccuuc

SEQ ID NO: 3830640 - RNA, 14 nt, Shigella flexneri 2a str. 2457T
auccggcaugaaca

SEQ ID NO: 3830641 - RNA, 20 nt, Shigella flexneri 2a str. 2457T
auccggcaugaacaaagcgc

SEQ ID NO: 3830642 - RNA, 20 nt, Shigella flexneri 2a str. 2457T
auccggcauuuuacgcauua

SEQ ID NO: 3830643 - RNA, 13 nt, Shigella flexneri 2a str. 2457T
auccggccuuccu

SEQ ID NO: 3830644 - RNA, 15 nt, Shigella flexneri 2a str. 2457T
auccggcucguaauc

SEQ ID NO: 3830645 - RNA, 23 nt, Shigella flexneri 2a str. 2457T
auccgguagguucaacaaagcgc

SEQ ID NO: 3830646 - RNA, 13 nt, Shigella flexneri 2a str. 2457T
auccgguguggca

SEQ ID NO: 3830647 - RNA, 18 nt, Shigella flexneri 2a str. 2457T
auccgguuaucagaagau

SEQ ID NO: 3830648 - RNA, 15 nt, Shigella flexneri 2a str. 2457T
auccguaaagcccau

SEQ ID NO: 3830649 - RNA, 18 nt, Shigella flexneri 2a str. 2457T
auccguaaagcccauacc

SEQ ID NO: 3830650 - RNA, 17 nt, Shigella flexneri 2a str. 2457T
auccgucacuucaggau

SEQ ID NO: 3830651 - RNA, 15 nt, Shigella flexneri 2a str. 2457T
auccguuucucuguu

SEQ ID NO: 3830652 - RNA, 16 nt, Shigella flexneri 2a str. 2457T
auccguuuuacuggga

SEQ ID NO: 3830653 - RNA, 16 nt, Shigella flexneri 2a str. 2457T
auccuaaacgcuggca

SEQ ID NO: 3830654 - RNA, 14 nt, Shigella flexneri 2a str. 2457T
auccuaaaggcaaa

SEQ ID NO: 3830655 - RNA, 15 nt, Shigella flexneri 2a str. 2457T
auccuaaaggcaaaa

SEQ ID NO: 3830656 - RNA, 20 nt, Shigella flexneri 2a str. 2457T
auccuaaaggcaaaaugcca

SEQ ID NO: 3830657 - RNA, 18 nt, Shigella flexneri 2a str. 2457T
auccuacgaccgcaugcg

SEQ ID NO: 3830658 - RNA, 14 nt, Shigella flexneri 2a str. 2457T
auccuauauuccuu

SEQ ID NO: 3830659 - RNA, 14 nt, Shigella flexneri 2a str. 2457T
auccucuauauuuc

SEQ ID NO: 3830660 - RNA, 19 nt, Shigella flexneri 2a str. 2457T
auccucuaucuguuugcca

SEQ ID NO: 3830661 - RNA, 18 nt, Shigella flexneri 2a str. 2457T
auccucuuugcuuccuga

SEQ ID NO: 3830662 - RNA, 23 nt, Shigella flexneri 2a str. 2457T
auccugaagacgccucgcauuuu

SEQ ID NO: 3830663 - RNA, 21 nt, Shigella flexneri 2a str. 2457T
auccugaauaacuggcgcgac

SEQ ID NO: 3830664 - RNA, 14 nt, Shigella flexneri 2a str. 2457T
auccugaaucaccu

SEQ ID NO: 3830665 - RNA, 14 nt, Shigella flexneri 2a str. 2457T
auccugagcagcca

SEQ ID NO: 3830666 - RNA, 23 nt, Shigella flexneri 2a str. 2457T
auccugagccaguuuuucuuuuu

SEQ ID NO: 3830667 - RNA, 19 nt, Shigella flexneri 2a str. 2457T
auccugaguuaagcaaaaa

SEQ ID NO: 3830668 - RNA, 15 nt, Shigella flexneri 2a str. 2457T
auccugauacagacc

SEQ ID NO: 3830669 - RNA, 21 nt, Shigella flexneri 2a str. 2457T
auccugauaggauuucugauu

SEQ ID NO: 3830670 - RNA, 17 nt, Shigella flexneri 2a str. 2457T
auccugcauguacgcgu

SEQ ID NO: 3830671 - RNA, 19 nt, Shigella flexneri 2a str. 2457T
auccugcccacuccagcua

SEQ ID NO: 3830672 - RNA, 16 nt, Shigella flexneri 2a str. 2457T
auccugccgagauaca

SEQ ID NO: 3830673 - RNA, 12 nt, Shigella flexneri 2a str. 2457T
auccugccgcag

SEQ ID NO: 3830674 - RNA, 19 nt, Shigella flexneri 2a str. 2457T
auccugcgcuuccugcaac

SEQ ID NO: 3830675 - RNA, 21 nt, Shigella flexneri 2a str. 2457T
auccugcugcacgcccugaua

SEQ ID NO: 3830676 - RNA, 16 nt, Shigella flexneri 2a str. 2457T
auccuggacuuuaaac

SEQ ID NO: 3830677 - RNA, 13 nt, Shigella flexneri 2a str. 2457T
auccuggcacagc

SEQ ID NO: 3830678 - RNA, 22 nt, Shigella flexneri 2a str. 2457T
auccuggcgaaaacgcccggca

SEQ ID NO: 3830679 - RNA, 18 nt, Shigella flexneri 2a str. 2457T
auccuggggguucaucac

SEQ ID NO: 3830680 - RNA, 16 nt, Shigella flexneri 2a str. 2457T
auccugguuauuucac

SEQ ID NO: 3830681 - RNA, 13 nt, Shigella flexneri 2a str. 2457T
auccugucaguuc

SEQ ID NO: 3830682 - RNA, 17 nt, Shigella flexneri 2a str. 2457T
auccuguuaagaagggc

SEQ ID NO: 3830683 - RNA, 20 nt, Shigella flexneri 2a str. 2457T
auccuguugcguuaagccau

SEQ ID NO: 3830684 - RNA, 18 nt, Shigella flexneri 2a str. 2457T
auccuguuuuuaagugau

SEQ ID NO: 3830685 - RNA, 22 nt, Shigella flexneri 2a str. 2457T
auccuucaaacguuuugcaauu

SEQ ID NO: 3830686 - RNA, 16 nt, Shigella flexneri 2a str. 2457T
auccuucacacugccu

SEQ ID NO: 3830687 - RNA, 17 nt, Shigella flexneri 2a str. 2457T
auccuucacacugccuc

SEQ ID NO: 3830688 - RNA, 19 nt, Shigella flexneri 2a str. 2457T
auccuucagcaacuuguuc

SEQ ID NO: 3830689 - RNA, 19 nt, Shigella flexneri 2a str. 2457T
auccuuccagcuccagccg

SEQ ID NO: 3830690 - RNA, 17 nt, Shigella flexneri 2a str. 2457T
auccuucuuuaugucgc

SEQ ID NO: 3830691 - RNA, 16 nt, Shigella flexneri 2a str. 2457T
auccuuuaccggaugu

SEQ ID NO: 3830692 - RNA, 15 nt, Shigella flexneri 2a str. 2457T
aucgaaaaugcgcau

SEQ ID NO: 3830693 - RNA, 16 nt, Shigella flexneri 2a str. 2457T
aucgaaaugaauagag

SEQ ID NO: 3830694 - RNA, 17 nt, Shigella flexneri 2a str. 2457T
aucgaacagaccaaacu

SEQ ID NO: 3830695 - RNA, 22 nt, Shigella flexneri 2a str. 2457T
aucgaagaacugcuggaagcug

SEQ ID NO: 3830696 - RNA, 18 nt, Shigella flexneri 2a str. 2457T
aucgaaguugucgauaaa

SEQ ID NO: 3830697 - RNA, 15 nt, Shigella flexneri 2a str. 2457T
aucgacagacgccag

SEQ ID NO: 3830698 - RNA, 19 nt, Shigella flexneri 2a str. 2457T
aucgacagcgccuuuucuu

SEQ ID NO: 3830699 - RNA, 16 nt, Shigella flexneri 2a str. 2457T
aucgacaguugcugcg

SEQ ID NO: 3830700 - RNA, 13 nt, Shigella flexneri 2a str. 2457T
aucgacaucaacg

SEQ ID NO: 3830701 - RNA, 22 nt, Shigella flexneri 2a str. 2457T
aucgaccaggccaucagcagcg

SEQ ID NO: 3830702 - RNA, 13 nt, Shigella flexneri 2a str. 2457T
aucgacgaaaugg

SEQ ID NO: 3830703 - RNA, 14 nt, Shigella flexneri 2a str. 2457T
aucgacgcaaacgc

SEQ ID NO: 3830704 - RNA, 16 nt, Shigella flexneri 2a str. 2457T
aucgacgcgccagcac

SEQ ID NO: 3830705 - RNA, 21 nt, Shigella flexneri 2a str. 2457T
aucgacgcguccaggcucgcc

SEQ ID NO: 3830706 - RNA, 15 nt, Shigella flexneri 2a str. 2457T
aucgacguucugcca

SEQ ID NO: 3830707 - RNA, 13 nt, Shigella flexneri 2a str. 2457T
aucgacugcaaac

SEQ ID NO: 3830708 - RNA, 16 nt, Shigella flexneri 2a str. 2457T
aucgacugcgcccuga

SEQ ID NO: 3830709 - RNA, 17 nt, Shigella flexneri 2a str. 2457T
aucgacuucgaagguuc

SEQ ID NO: 3830710 - RNA, 12 nt, Shigella flexneri 2a str. 2457T
aucgagaaucag

SEQ ID NO: 3830711 - RNA, 17 nt, Shigella flexneri 2a str. 2457T
aucggccuuccauaaug

SEQ ID NO: 3830712 - RNA, 17 nt, Shigella flexneri 2a str. 2457T
aucggcguacuggcaau

SEQ ID NO: 3830713 - RNA, 16 nt, Shigella flexneri 2a str. 2457T
aucggcugaacgugcu

SEQ ID NO: 3830714 - RNA, 13 nt, Shigella flexneri 2a str. 2457T
aucggcuuuggca

SEQ ID NO: 3830715 - RNA, 15 nt, Shigella flexneri 2a str. 2457T
aucgggagagauaag

SEQ ID NO: 3830716 - RNA, 18 nt, Shigella flexneri 2a str. 2457T
aucgggagagauaagaua

SEQ ID NO: 3830717 - RNA, 17 nt, Shigella flexneri 2a str. 2457T
aucgggauaucgccggu

SEQ ID NO: 3830718 - RNA, 20 nt, Shigella flexneri 2a str. 2457T
aucgggcgauuuugcuuuug

SEQ ID NO: 3830719 - RNA, 22 nt, Shigella flexneri 2a str. 2457T
aucgggcuauuuuuauugugcc

SEQ ID NO: 3830720 - RNA, 19 nt, Shigella flexneri 2a str. 2457T
aucggggauaagaauaucg

SEQ ID NO: 3830721 - RNA, 14 nt, Shigella flexneri 2a str. 2457T
aucgggggaagcug

SEQ ID NO: 3830722 - RNA, 14 nt, Shigella flexneri 2a str. 2457T
aucgggucaccgcc

SEQ ID NO: 3830723 - RNA, 16 nt, Shigella flexneri 2a str. 2457T
aucgggucaccgccga

SEQ ID NO: 3830724 - RNA, 13 nt, Shigella flexneri 2a str. 2457T
aucgggugaaguu

SEQ ID NO: 3830725 - RNA, 20 nt, Shigella flexneri 2a str. 2457T
aucggucagaucggcaagug

SEQ ID NO: 3830726 - RNA, 14 nt, Shigella flexneri 2a str. 2457T
aucggucgaugaaa

SEQ ID NO: 3830727 - RNA, 18 nt, Shigella flexneri 2a str. 2457T
aucggugaggaucaccag

SEQ ID NO: 3830728 - RNA, 13 nt, Shigella flexneri 2a str. 2457T
aucggugcaaaug

SEQ ID NO: 3830729 - RNA, 16 nt, Shigella flexneri 2a str. 2457T
aucggugcaaaugcca

SEQ ID NO: 3830730 - RNA, 13 nt, Shigella flexneri 2a str. 2457T
aucggugccuucg

SEQ ID NO: 3830731 - RNA, 23 nt, Shigella flexneri 2a str. 2457T
aucggugggcugacauuaucaga

SEQ ID NO: 3830732 - RNA, 20 nt, Shigella flexneri 2a str. 2457T
aucggugguguaaccuucac

SEQ ID NO: 3830733 - RNA, 20 nt, Shigella flexneri 2a str. 2457T
aucgguguguccauccauac

SEQ ID NO: 3830734 - RNA, 14 nt, Shigella flexneri 2a str. 2457T
aucguaaucagcau

SEQ ID NO: 3830735 - RNA, 21 nt, Shigella flexneri 2a str. 2457T
aucguaguuuuugcccaucau

SEQ ID NO: 3830736 - RNA, 14 nt, Shigella flexneri 2a str. 2457T
aucguauuucagac

SEQ ID NO: 3830737 - RNA, 21 nt, Shigella flexneri 2a str. 2457T
aucgucacgcgcgccaagccc

SEQ ID NO: 3830738 - RNA, 18 nt, Shigella flexneri 2a str. 2457T
aucgucaggaucagccau

SEQ ID NO: 3830739 - RNA, 16 nt, Shigella flexneri 2a str. 2457T
aucgucaguuuuucac

SEQ ID NO: 3830740 - RNA, 21 nt, Shigella flexneri 2a str. 2457T
aucguccacuugaaaauuaua

SEQ ID NO: 3830741 - RNA, 17 nt, Shigella flexneri 2a str. 2457T
aucguccgccagccuac

SEQ ID NO: 3830742 - RNA, 16 nt, Shigella flexneri 2a str. 2457T
aucgucucgauacgcc

SEQ ID NO: 3830743 - RNA, 17 nt, Shigella flexneri 2a str. 2457T
aucgucugcgccaccac

SEQ ID NO: 3830744 - RNA, 20 nt, Shigella flexneri 2a str. 2457T
aucgucugcgccaccacaac

SEQ ID NO: 3830745 - RNA, 19 nt, Shigella flexneri 2a str. 2457T
aucgugagcguauugguga

SEQ ID NO: 3830746 - RNA, 18 nt, Shigella flexneri 2a str. 2457T
aucgugauacaacugccg

SEQ ID NO: 3830747 - RNA, 16 nt, Shigella flexneri 2a str. 2457T
aucgugcgcgccguga

SEQ ID NO: 3830748 - RNA, 21 nt, Shigella flexneri 2a str. 2457T
aucgugcugguagaagcuggc

SEQ ID NO: 3830749 - RNA, 20 nt, Shigella flexneri 2a str. 2457T
aucguggccaugaccgccgc

SEQ ID NO: 3830750 - RNA, 15 nt, Shigella flexneri 2a str. 2457T
aucguggugaugauc

SEQ ID NO: 3830751 - RNA, 21 nt, Shigella flexneri 2a str. 2457T
aucguguggauaauccauccc

SEQ ID NO: 3830752 - RNA, 15 nt, Shigella flexneri 2a str. 2457T
aucguuaaauucuaa

SEQ ID NO: 3830753 - RNA, 20 nt, Shigella flexneri 2a str. 2457T
aucguuaaauucuaauguua

SEQ ID NO: 3830754 - RNA, 16 nt, Shigella flexneri 2a str. 2457T
aucguuaauuaacgcg

SEQ ID NO: 3830755 - RNA, 23 nt, Shigella flexneri 2a str. 2457T
aucguuacgccccgguuucucuu

SEQ ID NO: 3830756 - RNA, 15 nt, Shigella flexneri 2a str. 2457T
aucguucagggagua

SEQ ID NO: 3830757 - RNA, 18 nt, Shigella flexneri 2a str. 2457T
aucguuugcauccagcuc

SEQ ID NO: 3830758 - RNA, 13 nt, Shigella flexneri 2a str. 2457T
aucuaaaacccgg

SEQ ID NO: 3830759 - RNA, 12 nt, Shigella flexneri 2a str. 2457T
aucuaaaugcca

SEQ ID NO: 3830760 - RNA, 17 nt, Shigella flexneri 2a str. 2457T
aucuaaaugccacugaa

SEQ ID NO: 3830761 - RNA, 16 nt, Shigella flexneri 2a str. 2457T
aucuaacgcccgagcc

SEQ ID NO: 3830762 - RNA, 19 nt, Shigella flexneri 2a str. 2457T
aucuaauguuggugugaca

SEQ ID NO: 3830763 - RNA, 21 nt, Shigella flexneri 2a str. 2457T
aucuacacgcuaccaaaaaau

SEQ ID NO: 3830764 - RNA, 15 nt, Shigella flexneri 2a str. 2457T
aucuaccacugccug

SEQ ID NO: 3830765 - RNA, 21 nt, Shigella flexneri 2a str. 2457T
aucuaccguuacggcuggaag

SEQ ID NO: 3830766 - RNA, 19 nt, Shigella flexneri 2a str. 2457T
aucuacgcucucuucaaac

SEQ ID NO: 3830767 - RNA, 22 nt, Shigella flexneri 2a str. 2457T
aucuacucguuuauuaugccac

SEQ ID NO: 3830768 - RNA, 15 nt, Shigella flexneri 2a str. 2457T
aucuauagcacccgc

SEQ ID NO: 3830769 - RNA, 14 nt, Shigella flexneri 2a str. 2457T
aucuauccggcaua

SEQ ID NO: 3830770 - RNA, 15 nt, Shigella flexneri 2a str. 2457T
aucuaugguuuuuuc

SEQ ID NO: 3830771 - RNA, 23 nt, Shigella flexneri 2a str. 2457T
aucuaugguuuuuucuacacaga

SEQ ID NO: 3830772 - RNA, 20 nt, Shigella flexneri 2a str. 2457T
aucuaugucgcauccggcaa

SEQ ID NO: 3830773 - RNA, 20 nt, Shigella flexneri 2a str. 2457T
aucuauucaccgcaucaaua

SEQ ID NO: 3830774 - RNA, 19 nt, Shigella flexneri 2a str. 2457T
aucuauuucaggucaaaag

SEQ ID NO: 3830775 - RNA, 13 nt, Shigella flexneri 2a str. 2457T
aucucaauauuag

SEQ ID NO: 3830776 - RNA, 16 nt, Shigella flexneri 2a str. 2457T
aucucaaucuucacgu

SEQ ID NO: 3830777 - RNA, 23 nt, Shigella flexneri 2a str. 2457T
aucucacccauagauaccuucuu

SEQ ID NO: 3830778 - RNA, 22 nt, Shigella flexneri 2a str. 2457T
aucucagauaaaugcaaacgca

SEQ ID NO: 3830779 - RNA, 18 nt, Shigella flexneri 2a str. 2457T
aucucagcucauuaaaaa

SEQ ID NO: 3830780 - RNA, 20 nt, Shigella flexneri 2a str. 2457T
aucucagcucauuaaaaaua

SEQ ID NO: 3830781 - RNA, 13 nt, Shigella flexneri 2a str. 2457T
aucucaucagcgu

SEQ ID NO: 3830782 - RNA, 17 nt, Shigella flexneri 2a str. 2457T
aucuccagauaauuaug

SEQ ID NO: 3830783 - RNA, 16 nt, Shigella flexneri 2a str. 2457T
aucuccagcuauaacg

SEQ ID NO: 3830784 - RNA, 16 nt, Shigella flexneri 2a str. 2457T
aucuccagcugcucgc

SEQ ID NO: 3830785 - RNA, 17 nt, Shigella flexneri 2a str. 2457T
aucuccgcacagcgguu

SEQ ID NO: 3830786 - RNA, 18 nt, Shigella flexneri 2a str. 2457T
aucuccggcgguaaaugc

SEQ ID NO: 3830787 - RNA, 22 nt, Shigella flexneri 2a str. 2457T
aucuccggcgguaaaugcucau

SEQ ID NO: 3830788 - RNA, 17 nt, Shigella flexneri 2a str. 2457T
aucuccguuaaaggcaa

SEQ ID NO: 3830789 - RNA, 18 nt, Shigella flexneri 2a str. 2457T
aucuccugccaauacaaa

SEQ ID NO: 3830790 - RNA, 22 nt, Shigella flexneri 2a str. 2457T
aucuccugccaauacaaaauuu

SEQ ID NO: 3830791 - RNA, 13 nt, Shigella flexneri 2a str. 2457T
aucuccuugcugg

SEQ ID NO: 3830792 - RNA, 21 nt, Shigella flexneri 2a str. 2457T
aucucgccagagagcggagca

SEQ ID NO: 3830793 - RNA, 20 nt, Shigella flexneri 2a str. 2457T
aucucgccguggaugggacu

SEQ ID NO: 3830794 - RNA, 19 nt, Shigella flexneri 2a str. 2457T
aucucgcucaaaaauccag

SEQ ID NO: 3830795 - RNA, 15 nt, Shigella flexneri 2a str. 2457T
aucucgguggaaaau

SEQ ID NO: 3830796 - RNA, 16 nt, Shigella flexneri 2a str. 2457T
aucucgguggaaaaua

SEQ ID NO: 3830797 - RNA, 17 nt, Shigella flexneri 2a str. 2457T
aucucgguggaaaauag

SEQ ID NO: 3830798 - RNA, 18 nt, Shigella flexneri 2a str. 2457T
aucucguugaucacccac

SEQ ID NO: 3830799 - RNA, 18 nt, Shigella flexneri 2a str. 2457T
aucucuacaccaacgccc

SEQ ID NO: 3830800 - RNA, 23 nt, Shigella flexneri 2a str. 2457T
aucucuacagcgcccgccagcac

SEQ ID NO: 3830801 - RNA, 20 nt, Shigella flexneri 2a str. 2457T
aucucuacgacuugaaaaag

SEQ ID NO: 3830802 - RNA, 18 nt, Shigella flexneri 2a str. 2457T
aucucucaugucugccgc

SEQ ID NO: 3830803 - RNA, 21 nt, Shigella flexneri 2a str. 2457T
aucucucuugcuaucacccac

SEQ ID NO: 3830804 - RNA, 19 nt, Shigella flexneri 2a str. 2457T
aucucugcaacgucuuccc

SEQ ID NO: 3830805 - RNA, 20 nt, Shigella flexneri 2a str. 2457T
aucucugcaacgucuucccg

SEQ ID NO: 3830806 - RNA, 15 nt, Shigella flexneri 2a str. 2457T
aucucugcgcuaucc

SEQ ID NO: 3830807 - RNA, 16 nt, Shigella flexneri 2a str. 2457T
aucucugcgcuaucca

SEQ ID NO: 3830808 - RNA, 23 nt, Shigella flexneri 2a str. 2457T
aucuuucacaaagacgccaucaa

SEQ ID NO: 3830809 - RNA, 13 nt, Shigella flexneri 2a str. 2457T
aucuuucacgccc

SEQ ID NO: 3830810 - RNA, 16 nt, Shigella flexneri 2a str. 2457T
aucuuucagaaucagg

SEQ ID NO: 3830811 - RNA, 14 nt, Shigella flexneri 2a str. 2457T
aucuuucauuuccg

SEQ ID NO: 3830812 - RNA, 18 nt, Shigella flexneri 2a str. 2457T
aucuuuccggcagaagca

SEQ ID NO: 3830813 - RNA, 17 nt, Shigella flexneri 2a str. 2457T
aucuuucugcgcaucuu

SEQ ID NO: 3830814 - RNA, 21 nt, Shigella flexneri 2a str. 2457T
aucuuucugcgcaucuucccc

SEQ ID NO: 3830815 - RNA, 13 nt, Shigella flexneri 2a str. 2457T
aucuuucuucagc

SEQ ID NO: 3830816 - RNA, 15 nt, Shigella flexneri 2a str. 2457T
aucuuugaaaucacg

SEQ ID NO: 3830817 - RNA, 21 nt, Shigella flexneri 2a str. 2457T
aucuuugauugaagaaaucag

SEQ ID NO: 3830818 - RNA, 15 nt, Shigella flexneri 2a str. 2457T
aucuuuuacaagcaa

SEQ ID NO: 3830819 - RNA, 22 nt, Shigella flexneri 2a str. 2457T
aucuuuuacaagcaacuugcaa

SEQ ID NO: 3830820 - RNA, 13 nt, Shigella flexneri 2a str. 2457T
aucuuuucugagu

SEQ ID NO: 3830821 - RNA, 18 nt, Shigella flexneri 2a str. 2457T
aucuuuugucaugacuac

SEQ ID NO: 3830822 - RNA, 18 nt, Shigella flexneri 2a str. 2457T
augaaaaaaccagaaagg

SEQ ID NO: 3830823 - RNA, 22 nt, Shigella flexneri 2a str. 2457T
augaaaaaaccagaaagggaag

SEQ ID NO: 3830824 - RNA, 14 nt, Shigella flexneri 2a str. 2457T
augaaaacgccgga

SEQ ID NO: 3830825 - RNA, 18 nt, Shigella flexneri 2a str. 2457T
augaaaagucauccggcg

SEQ ID NO: 3830826 - RNA, 20 nt, Shigella flexneri 2a str. 2457T
augaaagccccaccagcaaa

SEQ ID NO: 3830827 - RNA, 21 nt, Shigella flexneri 2a str. 2457T
augaaagccccaccagcaaau

SEQ ID NO: 3830828 - RNA, 20 nt, Shigella flexneri 2a str. 2457T
augaaauaguugcauuccag

SEQ ID NO: 3830829 - RNA, 10 nt, Shigella flexneri 2a str. 2457T
augaaauuca

SEQ ID NO: 3830830 - RNA, 15 nt, Shigella flexneri 2a str. 2457T
augaacaaaauucca

SEQ ID NO: 3830831 - RNA, 14 nt, Shigella flexneri 2a str. 2457T
augaacaaagcgca

SEQ ID NO: 3830832 - RNA, 17 nt, Shigella flexneri 2a str. 2457T
augaacauugcugcuga

SEQ ID NO: 3830833 - RNA, 20 nt, Shigella flexneri 2a str. 2457T
augaacggugcgcaggcuuu

SEQ ID NO: 3830834 - RNA, 14 nt, Shigella flexneri 2a str. 2457T
augaacucgagaac

SEQ ID NO: 3830835 - RNA, 23 nt, Shigella flexneri 2a str. 2457T
augaacuggcuuucacaaggccg

SEQ ID NO: 3830836 - RNA, 20 nt, Shigella flexneri 2a str. 2457T
augaagaacaaguucaagau

SEQ ID NO: 3830837 - RNA, 14 nt, Shigella flexneri 2a str. 2457T
augaagacauaccc

SEQ ID NO: 3830838 - RNA, 13 nt, Shigella flexneri 2a str. 2457T
augaagcacugca

SEQ ID NO: 3830839 - RNA, 13 nt, Shigella flexneri 2a str. 2457T
augaagcccgcug

SEQ ID NO: 3830840 - RNA, 16 nt, Shigella flexneri 2a str. 2457T
augaagucugccguug

SEQ ID NO: 3830841 - RNA, 23 nt, Shigella flexneri 2a str. 2457T
augaauaccaagucucaagagug

SEQ ID NO: 3830842 - RNA, 19 nt, Shigella flexneri 2a str. 2457T
augaauauauccgaaaaag

SEQ ID NO: 3830843 - RNA, 21 nt, Shigella flexneri 2a str. 2457T
augaauaucaagaucaucaaa

SEQ ID NO: 3830844 - RNA, 13 nt, Shigella flexneri 2a str. 2457T
augaauauuccac

SEQ ID NO: 3830845 - RNA, 14 nt, Shigella flexneri 2a str. 2457T
augaaugauaaaau

SEQ ID NO: 3830846 - RNA, 15 nt, Shigella flexneri 2a str. 2457T
augaaugauaaaauu

SEQ ID NO: 3830847 - RNA, 22 nt, Shigella flexneri 2a str. 2457T
augaaugaugcggcgcuuucag

SEQ ID NO: 3830848 - RNA, 17 nt, Shigella flexneri 2a str. 2457T
augaauguuuuccugcu

SEQ ID NO: 3830849 - RNA, 21 nt, Shigella flexneri 2a str. 2457T
augaauguuuuccugcuucac

SEQ ID NO: 3830850 - RNA, 19 nt, Shigella flexneri 2a str. 2457T
augacaaacgcaaaacugc

SEQ ID NO: 3830851 - RNA, 21 nt, Shigella flexneri 2a str. 2457T
augacacaucaccuccagcga

SEQ ID NO: 3830852 - RNA, 14 nt, Shigella flexneri 2a str. 2457T
augacacguuuauu

SEQ ID NO: 3830853 - RNA, 20 nt, Shigella flexneri 2a str. 2457T
augacacuucagccaucaaa

SEQ ID NO: 3830854 - RNA, 17 nt, Shigella flexneri 2a str. 2457T
augacagggcgcgggca

SEQ ID NO: 3830855 - RNA, 19 nt, Shigella flexneri 2a str. 2457T
augacagucuggaagccag

SEQ ID NO: 3830856 - RNA, 20 nt, Shigella flexneri 2a str. 2457T
augacagucuggaagccagu

SEQ ID NO: 3830857 - RNA, 20 nt, Shigella flexneri 2a str. 2457T
augaccaaaaacauugccgu

SEQ ID NO: 3830858 - RNA, 12 nt, Shigella flexneri 2a str. 2457T
augaccacucau

SEQ ID NO: 3830859 - RNA, 15 nt, Shigella flexneri 2a str. 2457T
augaccccagguauc

SEQ ID NO: 3830860 - RNA, 19 nt, Shigella flexneri 2a str. 2457T
augaccgacguuaugcucg

SEQ ID NO: 3830861 - RNA, 18 nt, Shigella flexneri 2a str. 2457T
augaccgaggcgcggcga

SEQ ID NO: 3830862 - RNA, 17 nt, Shigella flexneri 2a str. 2457T
augaccgcuccgccauc

SEQ ID NO: 3830863 - RNA, 15 nt, Shigella flexneri 2a str. 2457T
augaccguuacugau

SEQ ID NO: 3830864 - RNA, 13 nt, Shigella flexneri 2a str. 2457T
augaccugcaaau

SEQ ID NO: 3830865 - RNA, 15 nt, Shigella flexneri 2a str. 2457T
augacgacaaggcag

SEQ ID NO: 3830866 - RNA, 18 nt, Shigella flexneri 2a str. 2457T
augacgaucgcagaaaaa

SEQ ID NO: 3830867 - RNA, 14 nt, Shigella flexneri 2a str. 2457T
augacggcugccau

SEQ ID NO: 3830868 - RNA, 22 nt, Shigella flexneri 2a str. 2457T
augacggucaucaccuccagcc

SEQ ID NO: 3830869 - RNA, 23 nt, Shigella flexneri 2a str. 2457T
augacuagcgccauaauaaucau

SEQ ID NO: 3830870 - RNA, 17 nt, Shigella flexneri 2a str. 2457T
augacuccaacuuacug

SEQ ID NO: 3830871 - RNA, 14 nt, Shigella flexneri 2a str. 2457T
augacuccagcgcc

SEQ ID NO: 3830872 - RNA, 14 nt, Shigella flexneri 2a str. 2457T
augacucgccgcug

SEQ ID NO: 3830873 - RNA, 23 nt, Shigella flexneri 2a str. 2457T
augacuggccggaagauaugcau

SEQ ID NO: 3830874 - RNA, 14 nt, Shigella flexneri 2a str. 2457T
augacuuaauaaaa

SEQ ID NO: 3830875 - RNA, 20 nt, Shigella flexneri 2a str. 2457T
augacuuucuggcacgaccu

SEQ ID NO: 3830876 - RNA, 18 nt, Shigella flexneri 2a str. 2457T
augagaaaauuucauuaa

SEQ ID NO: 3830877 - RNA, 15 nt, Shigella flexneri 2a str. 2457T
augagaacaguucag

SEQ ID NO: 3830878 - RNA, 15 nt, Shigella flexneri 2a str. 2457T
augagaauaaccagu

SEQ ID NO: 3830879 - RNA, 12 nt, Shigella flexneri 2a str. 2457T
augagaauaauc

SEQ ID NO: 3830880 - RNA, 22 nt, Shigella flexneri 2a str. 2457T
augagaauaaucaccuuuaacc

SEQ ID NO: 3830881 - RNA, 15 nt, Shigella flexneri 2a str. 2457T
augagacaacaacau

SEQ ID NO: 3830882 - RNA, 16 nt, Shigella flexneri 2a str. 2457T
augagagaaaaucaca

SEQ ID NO: 3830883 - RNA, 14 nt, Shigella flexneri 2a str. 2457T
augagauauuuaaa

SEQ ID NO: 3830884 - RNA, 19 nt, Shigella flexneri 2a str. 2457T
augagauauuuaaaugauu

SEQ ID NO: 3830885 - RNA, 16 nt, Shigella flexneri 2a str. 2457T
augagauauuuaaugg

SEQ ID NO: 3830886 - RNA, 19 nt, Shigella flexneri 2a str. 2457T
augagauauuucagagcuu

SEQ ID NO: 3830887 - RNA, 12 nt, Shigella flexneri 2a str. 2457T
augagcaccgca

SEQ ID NO: 3830888 - RNA, 18 nt, Shigella flexneri 2a str. 2457T
augagcaccgcaccuaaa

SEQ ID NO: 3830889 - RNA, 13 nt, Shigella flexneri 2a str. 2457T
augagcagaccaa

SEQ ID NO: 3830890 - RNA, 17 nt, Shigella flexneri 2a str. 2457T
augagcaguuugguuaa

SEQ ID NO: 3830891 - RNA, 13 nt, Shigella flexneri 2a str. 2457T
augagcgcaaaug

SEQ ID NO: 3830892 - RNA, 19 nt, Shigella flexneri 2a str. 2457T
augagcuuucgcuucuuga

SEQ ID NO: 3830893 - RNA, 18 nt, Shigella flexneri 2a str. 2457T
augaggcuuuaauaccug

SEQ ID NO: 3830894 - RNA, 15 nt, Shigella flexneri 2a str. 2457T
augagguagccugag

SEQ ID NO: 3830895 - RNA, 23 nt, Shigella flexneri 2a str. 2457T
augagguuugguagcaaaacaau

SEQ ID NO: 3830896 - RNA, 12 nt, Shigella flexneri 2a str. 2457T
augaguacagcg

SEQ ID NO: 3830897 - RNA, 17 nt, Shigella flexneri 2a str. 2457T
augagucggaccaucau

SEQ ID NO: 3830898 - RNA, 15 nt, Shigella flexneri 2a str. 2457T
augagugggaacggc

SEQ ID NO: 3830899 - RNA, 15 nt, Shigella flexneri 2a str. 2457T
augaguugaaaaccu

SEQ ID NO: 3830900 - RNA, 21 nt, Shigella flexneri 2a str. 2457T
augaguuuggugccacgcgca

SEQ ID NO: 3830901 - RNA, 22 nt, Shigella flexneri 2a str. 2457T
augaguuuggugccacgcgcau

SEQ ID NO: 3830902 - RNA, 15 nt, Shigella flexneri 2a str. 2457T
augauaaauccaucg

SEQ ID NO: 3830903 - RNA, 11 nt, Shigella flexneri 2a str. 2457T
augauaagccu

SEQ ID NO: 3830904 - RNA, 13 nt, Shigella flexneri 2a str. 2457T
augauaaucagaa

SEQ ID NO: 3830905 - RNA, 14 nt, Shigella flexneri 2a str. 2457T
augauaauuauuau

SEQ ID NO: 3830906 - RNA, 16 nt, Shigella flexneri 2a str. 2457T
augccaguaacucauu

SEQ ID NO: 3830907 - RNA, 14 nt, Shigella flexneri 2a str. 2457T
augccagucaguua

SEQ ID NO: 3830908 - RNA, 22 nt, Shigella flexneri 2a str. 2457T
augccagucccgcgacaaucgc

SEQ ID NO: 3830909 - RNA, 23 nt, Shigella flexneri 2a str. 2457T
augccaucauggcgaugagaauc

SEQ ID NO: 3830910 - RNA, 13 nt, Shigella flexneri 2a str. 2457T
augccauccgcau

SEQ ID NO: 3830911 - RNA, 22 nt, Shigella flexneri 2a str. 2457T
augccaucgcauagcgcaauaa

SEQ ID NO: 3830912 - RNA, 20 nt, Shigella flexneri 2a str. 2457T
augccaucuacacgcuacca

SEQ ID NO: 3830913 - RNA, 17 nt, Shigella flexneri 2a str. 2457T
augccaucugccagcaa

SEQ ID NO: 3830914 - RNA, 18 nt, Shigella flexneri 2a str. 2457T
augccaucugccagcaag

SEQ ID NO: 3830915 - RNA, 12 nt, Shigella flexneri 2a str. 2457T
augccauuugcc

SEQ ID NO: 3830916 - RNA, 20 nt, Shigella flexneri 2a str. 2457T
augcccauucaccgacguga

SEQ ID NO: 3830917 - RNA, 19 nt, Shigella flexneri 2a str. 2457T
augccccauugcaacgugg

SEQ ID NO: 3830918 - RNA, 12 nt, Shigella flexneri 2a str. 2457T
augcccccagca

SEQ ID NO: 3830919 - RNA, 16 nt, Shigella flexneri 2a str. 2457T
augcccgaugaccuug

SEQ ID NO: 3830920 - RNA, 19 nt, Shigella flexneri 2a str. 2457T
augcccgccgugcugccag

SEQ ID NO: 3830921 - RNA, 22 nt, Shigella flexneri 2a str. 2457T
augcccggccugugucacuuug

SEQ ID NO: 3830922 - RNA, 22 nt, Shigella flexneri 2a str. 2457T
augccgaaaaaagucauuacca

SEQ ID NO: 3830923 - RNA, 13 nt, Shigella flexneri 2a str. 2457T
augccgacgaugu

SEQ ID NO: 3830924 - RNA, 20 nt, Shigella flexneri 2a str. 2457T
augccgacggcgcacaggca

SEQ ID NO: 3830925 - RNA, 15 nt, Shigella flexneri 2a str. 2457T
augccgaguggcauu

SEQ ID NO: 3830926 - RNA, 19 nt, Shigella flexneri 2a str. 2457T
augccgauaaauacagcgu

SEQ ID NO: 3830927 - RNA, 22 nt, Shigella flexneri 2a str. 2457T
augccgaucaauuucacaguaa

SEQ ID NO: 3830928 - RNA, 14 nt, Shigella flexneri 2a str. 2457T
augccgaucaucau

SEQ ID NO: 3830929 - RNA, 23 nt, Shigella flexneri 2a str. 2457T
augccgaucgucugggcauugaa

SEQ ID NO: 3830930 - RNA, 23 nt, Shigella flexneri 2a str. 2457T
augccgaugccgacgauguuagc

SEQ ID NO: 3830931 - RNA, 21 nt, Shigella flexneri 2a str. 2457T
augccgcagcggcgauuucuu

SEQ ID NO: 3830932 - RNA, 20 nt, Shigella flexneri 2a str. 2457T
augccgccgaggauacagcc

SEQ ID NO: 3830933 - RNA, 18 nt, Shigella flexneri 2a str. 2457T
augccgccgcagaaaaag

SEQ ID NO: 3830934 - RNA, 12 nt, Shigella flexneri 2a str. 2457T
augccggaagcu

SEQ ID NO: 3830935 - RNA, 23 nt, Shigella flexneri 2a str. 2457T
augccggagucgcauuaacagcc

SEQ ID NO: 3830936 - RNA, 15 nt, Shigella flexneri 2a str. 2457T
augccggaugcggcg

SEQ ID NO: 3830937 - RNA, 18 nt, Shigella flexneri 2a str. 2457T
augccggaugcggcguaa

SEQ ID NO: 3830938 - RNA, 18 nt, Shigella flexneri 2a str. 2457T
augccggaugcggcguga

SEQ ID NO: 3830939 - RNA, 16 nt, Shigella flexneri 2a str. 2457T
augccggcaucaaacg

SEQ ID NO: 3830940 - RNA, 20 nt, Shigella flexneri 2a str. 2457T
augccggccagcgccaccac

SEQ ID NO: 3830941 - RNA, 21 nt, Shigella flexneri 2a str. 2457T
augccggguaauuucauuaaa

SEQ ID NO: 3830942 - RNA, 17 nt, Shigella flexneri 2a str. 2457T
augccgguagaagccag

SEQ ID NO: 3830943 - RNA, 18 nt, Shigella flexneri 2a str. 2457T
augccgguagaagccagu

SEQ ID NO: 3830944 - RNA, 20 nt, Shigella flexneri 2a str. 2457T
augccgguagaagccaguca

SEQ ID NO: 3830945 - RNA, 16 nt, Shigella flexneri 2a str. 2457T
augccgguggugaccu

SEQ ID NO: 3830946 - RNA, 16 nt, Shigella flexneri 2a str. 2457T
augccgguuaauacgc

SEQ ID NO: 3830947 - RNA, 17 nt, Shigella flexneri 2a str. 2457T
augccgucgaggaacau

SEQ ID NO: 3830948 - RNA, 21 nt, Shigella flexneri 2a str. 2457T
augccgugcagcacggagaga

SEQ ID NO: 3830949 - RNA, 24 nt, Shigella flexneri 2a str. 2457T
augccguuguucuacgugagagau

SEQ ID NO: 3830950 - RNA, 16 nt, Shigella flexneri 2a str. 2457T
augccguuugcugcau

SEQ ID NO: 3830951 - RNA, 16 nt, Shigella flexneri 2a str. 2457T
augccucgugcucaga

SEQ ID NO: 3830952 - RNA, 17 nt, Shigella flexneri 2a str. 2457T
augccucguuggucagc

SEQ ID NO: 3830953 - RNA, 13 nt, Shigella flexneri 2a str. 2457T
augccucuccugu

SEQ ID NO: 3830954 - RNA, 23 nt, Shigella flexneri 2a str. 2457T
augccugaugguguugcaccauc

SEQ ID NO: 3830955 - RNA, 21 nt, Shigella flexneri 2a str. 2457T
augccugcgacaagaauacaa

SEQ ID NO: 3830956 - RNA, 16 nt, Shigella flexneri 2a str. 2457T
augccuggcaaugcgc

SEQ ID NO: 3830957 - RNA, 21 nt, Shigella flexneri 2a str. 2457T
augccuugugggccugaaagc

SEQ ID NO: 3830958 - RNA, 22 nt, Shigella flexneri 2a str. 2457T
augccuugugggccugaaagcu

SEQ ID NO: 3830959 - RNA, 17 nt, Shigella flexneri 2a str. 2457T
augccuuguuugaucau

SEQ ID NO: 3830960 - RNA, 14 nt, Shigella flexneri 2a str. 2457T
augcgaaugccaau

SEQ ID NO: 3830961 - RNA, 14 nt, Shigella flexneri 2a str. 2457T
augcgacaacagaa

SEQ ID NO: 3830962 - RNA, 15 nt, Shigella flexneri 2a str. 2457T
augcgacaacagaaa

SEQ ID NO: 3830963 - RNA, 19 nt, Shigella flexneri 2a str. 2457T
augcgaccauaugaauaua

SEQ ID NO: 3830964 - RNA, 15 nt, Shigella flexneri 2a str. 2457T
augcgacccaugcac

SEQ ID NO: 3830965 - RNA, 17 nt, Shigella flexneri 2a str. 2457T
augcgagauguccccug

SEQ ID NO: 3830966 - RNA, 15 nt, Shigella flexneri 2a str. 2457T
augcgauggauuauc

SEQ ID NO: 3830967 - RNA, 22 nt, Shigella flexneri 2a str. 2457T
augcgcaguugcagcaagccau

SEQ ID NO: 3830968 - RNA, 20 nt, Shigella flexneri 2a str. 2457T
augcgcaucaaagccaggca

SEQ ID NO: 3830969 - RNA, 23 nt, Shigella flexneri 2a str. 2457T
augcgcaucaaagccaggcagaa

SEQ ID NO: 3830970 - RNA, 16 nt, Shigella flexneri 2a str. 2457T
augcgcauuaagccau

SEQ ID NO: 3830971 - RNA, 17 nt, Shigella flexneri 2a str. 2457T
augcgcauugccagagu

SEQ ID NO: 3830972 - RNA, 12 nt, Shigella flexneri 2a str. 2457T
augcgccagacu

SEQ ID NO: 3830973 - RNA, 15 nt, Shigella flexneri 2a str. 2457T
augcgccagcauccg

SEQ ID NO: 3830974 - RNA, 21 nt, Shigella flexneri 2a str. 2457T
augcgccagguaacgaagaug

SEQ ID NO: 3830975 - RNA, 23 nt, Shigella flexneri 2a str. 2457T
augcgccagguaacgaagauggc

SEQ ID NO: 3830976 - RNA, 14 nt, Shigella flexneri 2a str. 2457T
augcgcgaacugga

SEQ ID NO: 3830977 - RNA, 15 nt, Shigella flexneri 2a str. 2457T
augcgcgacaaaaau

SEQ ID NO: 3830978 - RNA, 12 nt, Shigella flexneri 2a str. 2457T
augcgcgucaga

SEQ ID NO: 3830979 - RNA, 13 nt, Shigella flexneri 2a str. 2457T
augcgcuggcagu

SEQ ID NO: 3830980 - RNA, 13 nt, Shigella flexneri 2a str. 2457T
augcgcugggcaa

SEQ ID NO: 3830981 - RNA, 21 nt, Shigella flexneri 2a str. 2457T
augcgcuucgcuuaccaugcc

SEQ ID NO: 3830982 - RNA, 19 nt, Shigella flexneri 2a str. 2457T
augcggagacucaaacccc

SEQ ID NO: 3830983 - RNA, 17 nt, Shigella flexneri 2a str. 2457T
augcggcguaaaugccu

SEQ ID NO: 3830984 - RNA, 16 nt, Shigella flexneri 2a str. 2457T
augcggcgugaaugcc

SEQ ID NO: 3830985 - RNA, 16 nt, Shigella flexneri 2a str. 2457T
augcggcguuaacgcc

SEQ ID NO: 3830986 - RNA, 13 nt, Shigella flexneri 2a str. 2457T
augcgggcgguaa

SEQ ID NO: 3830987 - RNA, 18 nt, Shigella flexneri 2a str. 2457T
augcggggauuacucccc

SEQ ID NO: 3830988 - RNA, 16 nt, Shigella flexneri 2a str. 2457T
augcgggugaacgcgu

SEQ ID NO: 3830989 - RNA, 22 nt, Shigella flexneri 2a str. 2457T
augcgguacugaccaucagcag

SEQ ID NO: 3830990 - RNA, 17 nt, Shigella flexneri 2a str. 2457T
augcgguggauccuguu

SEQ ID NO: 3830991 - RNA, 20 nt, Shigella flexneri 2a str. 2457T
augcguagcugagcaacaaa

SEQ ID NO: 3830992 - RNA, 16 nt, Shigella flexneri 2a str. 2457T
augcguugucgccauc

SEQ ID NO: 3830993 - RNA, 16 nt, Shigella flexneri 2a str. 2457T
augcguuuagccgccg

SEQ ID NO: 3830994 - RNA, 13 nt, Shigella flexneri 2a str. 2457T
augcuaaaaacau

SEQ ID NO: 3830995 - RNA, 14 nt, Shigella flexneri 2a str. 2457T
augcuaaaaacauc

SEQ ID NO: 3830996 - RNA, 19 nt, Shigella flexneri 2a str. 2457T
augcuaaaaacaucaugau

SEQ ID NO: 3830997 - RNA, 14 nt, Shigella flexneri 2a str. 2457T
augcuacaacaucg

SEQ ID NO: 3830998 - RNA, 21 nt, Shigella flexneri 2a str. 2457T
augcuauuggucggaucauuc

SEQ ID NO: 3830999 - RNA, 17 nt, Shigella flexneri 2a str. 2457T
augcucaacuacuccaa

SEQ ID NO: 3831000 - RNA, 22 nt, Shigella flexneri 2a str. 2457T
augcucacaaccccggcaaaug

SEQ ID NO: 3831001 - RNA, 18 nt, Shigella flexneri 2a str. 2457T
augcucagaugccugaug

SEQ ID NO: 3831002 - RNA, 12 nt, Shigella flexneri 2a str. 2457T
augcuccacgcu

SEQ ID NO: 3831003 - RNA, 21 nt, Shigella flexneri 2a str. 2457T
auggcugcgggcgaccaauca

SEQ ID NO: 3831004 - RNA, 18 nt, Shigella flexneri 2a str. 2457T
auggcuggcacaaaaaau

SEQ ID NO: 3831005 - RNA, 20 nt, Shigella flexneri 2a str. 2457T
auggcuggcuauacacaagg

SEQ ID NO: 3831006 - RNA, 17 nt, Shigella flexneri 2a str. 2457T
auggcuggggaauauuu

SEQ ID NO: 3831007 - RNA, 21 nt, Shigella flexneri 2a str. 2457T
auggcuguuuucagcaccaga

SEQ ID NO: 3831008 - RNA, 15 nt, Shigella flexneri 2a str. 2457T
auggcuucuuccccg

SEQ ID NO: 3831009 - RNA, 20 nt, Shigella flexneri 2a str. 2457T
augggcgaauaaaaagccua

SEQ ID NO: 3831010 - RNA, 17 nt, Shigella flexneri 2a str. 2457T
augggcgccauuuuuca

SEQ ID NO: 3831011 - RNA, 18 nt, Shigella flexneri 2a str. 2457T
auggggguccugagcacu

SEQ ID NO: 3831012 - RNA, 11 nt, Shigella flexneri 2a str. 2457T
augggguggaa

SEQ ID NO: 3831013 - RNA, 15 nt, Shigella flexneri 2a str. 2457T
augggucggcgauaa

SEQ ID NO: 3831014 - RNA, 19 nt, Shigella flexneri 2a str. 2457T
augggugacaucgcccuga

SEQ ID NO: 3831015 - RNA, 20 nt, Shigella flexneri 2a str. 2457T
augggugcaaugagaaugcg

SEQ ID NO: 3831016 - RNA, 17 nt, Shigella flexneri 2a str. 2457T
auggguuaacaucaugu

SEQ ID NO: 3831017 - RNA, 16 nt, Shigella flexneri 2a str. 2457T
augguaacaccagagu

SEQ ID NO: 3831018 - RNA, 16 nt, Shigella flexneri 2a str. 2457T
augguaggccggauaa

SEQ ID NO: 3831019 - RNA, 14 nt, Shigella flexneri 2a str. 2457T
auggucagccagcg

SEQ ID NO: 3831020 - RNA, 15 nt, Shigella flexneri 2a str. 2457T
auggucagcgccagg

SEQ ID NO: 3831021 - RNA, 23 nt, Shigella flexneri 2a str. 2457T
auggucagcuucaccuuccagua

SEQ ID NO: 3831022 - RNA, 20 nt, Shigella flexneri 2a str. 2457T
auggucgcaucauuuaaaaa

SEQ ID NO: 3831023 - RNA, 16 nt, Shigella flexneri 2a str. 2457T
auggucuguaccacca

SEQ ID NO: 3831024 - RNA, 14 nt, Shigella flexneri 2a str. 2457T
auggugaaaguaaa

SEQ ID NO: 3831025 - RNA, 22 nt, Shigella flexneri 2a str. 2457T
augguggcccggauucagauug

SEQ ID NO: 3831026 - RNA, 22 nt, Shigella flexneri 2a str. 2457T
auggugucgguauaccauuucu

SEQ ID NO: 3831027 - RNA, 18 nt, Shigella flexneri 2a str. 2457T
augguguuggcaaucagc

SEQ ID NO: 3831028 - RNA, 14 nt, Shigella flexneri 2a str. 2457T
augguguuuuccac

SEQ ID NO: 3831029 - RNA, 20 nt, Shigella flexneri 2a str. 2457T
augguuagccuguaauguca

SEQ ID NO: 3831030 - RNA, 22 nt, Shigella flexneri 2a str. 2457T
augguugaacuauaucccugcu

SEQ ID NO: 3831031 - RNA, 17 nt, Shigella flexneri 2a str. 2457T
augguuguaauccaccu

SEQ ID NO: 3831032 - RNA, 22 nt, Shigella flexneri 2a str. 2457T
augguuucacggcaccagccau

SEQ ID NO: 3831033 - RNA, 16 nt, Shigella flexneri 2a str. 2457T
augguuugggcguuac

SEQ ID NO: 3831034 - RNA, 18 nt, Shigella flexneri 2a str. 2457T
augguuuggucuccugca

SEQ ID NO: 3831035 - RNA, 16 nt, Shigella flexneri 2a str. 2457T
augguuuucaauuauc

SEQ ID NO: 3831036 - RNA, 12 nt, Shigella flexneri 2a str. 2457T
auguaaaaauac

SEQ ID NO: 3831037 - RNA, 13 nt, Shigella flexneri 2a str. 2457T
auguaaaaauacu

SEQ ID NO: 3831038 - RNA, 14 nt, Shigella flexneri 2a str. 2457T
auguaaaaauacug

SEQ ID NO: 3831039 - RNA, 20 nt, Shigella flexneri 2a str. 2457T
auguaaucuguugaaauaau

SEQ ID NO: 3831040 - RNA, 21 nt, Shigella flexneri 2a str. 2457T
auguaaucuguugaaauaaug

SEQ ID NO: 3831041 - RNA, 16 nt, Shigella flexneri 2a str. 2457T
auguaauuaagcgcaa

SEQ ID NO: 3831042 - RNA, 21 nt, Shigella flexneri 2a str. 2457T
auguaauuaagcgcaaaggcc

SEQ ID NO: 3831043 - RNA, 17 nt, Shigella flexneri 2a str. 2457T
auguacauggugcacau

SEQ ID NO: 3831044 - RNA, 21 nt, Shigella flexneri 2a str. 2457T
auguacucuuuauugcaaaca

SEQ ID NO: 3831045 - RNA, 16 nt, Shigella flexneri 2a str. 2457T
auguagcgcugcaaac

SEQ ID NO: 3831046 - RNA, 21 nt, Shigella flexneri 2a str. 2457T
auguaggguacagcacgauga

SEQ ID NO: 3831047 - RNA, 16 nt, Shigella flexneri 2a str. 2457T
auguagucaucugcac

SEQ ID NO: 3831048 - RNA, 13 nt, Shigella flexneri 2a str. 2457T
auguauaucggcc

SEQ ID NO: 3831049 - RNA, 13 nt, Shigella flexneri 2a str. 2457T
auguaugaaguac

SEQ ID NO: 3831050 - RNA, 19 nt, Shigella flexneri 2a str. 2457T
auguauggcgauagcccag

SEQ ID NO: 3831051 - RNA, 20 nt, Shigella flexneri 2a str. 2457T
auguauggcgauagcccaga

SEQ ID NO: 3831052 - RNA, 14 nt, Shigella flexneri 2a str. 2457T
augucacagccgca

SEQ ID NO: 3831053 - RNA, 18 nt, Shigella flexneri 2a str. 2457T
augucacccacuguggua

SEQ ID NO: 3831054 - RNA, 16 nt, Shigella flexneri 2a str. 2457T
augucagacaacaugc

SEQ ID NO: 3831055 - RNA, 20 nt, Shigella flexneri 2a str. 2457T
augucagggccaucgcgguu

SEQ ID NO: 3831056 - RNA, 14 nt, Shigella flexneri 2a str. 2457T
auguccauuauuuc

SEQ ID NO: 3831057 - RNA, 15 nt, Shigella flexneri 2a str. 2457T
auguccggaaauuug

SEQ ID NO: 3831058 - RNA, 16 nt, Shigella flexneri 2a str. 2457T
auguccugcggacagu

SEQ ID NO: 3831059 - RNA, 14 nt, Shigella flexneri 2a str. 2457T
auguccuuucaggg

SEQ ID NO: 3831060 - RNA, 21 nt, Shigella flexneri 2a str. 2457T
augucgagugaauaauugagg

SEQ ID NO: 3831061 - RNA, 18 nt, Shigella flexneri 2a str. 2457T
augucgauauccugcaaa

SEQ ID NO: 3831062 - RNA, 22 nt, Shigella flexneri 2a str. 2457T
augucgauauggggauccccau

SEQ ID NO: 3831063 - RNA, 16 nt, Shigella flexneri 2a str. 2457T
augucgcgcacuggau

SEQ ID NO: 3831064 - RNA, 15 nt, Shigella flexneri 2a str. 2457T
augucgcgccaggcg

SEQ ID NO: 3831065 - RNA, 16 nt, Shigella flexneri 2a str. 2457T
augucgcucaaugcgc

SEQ ID NO: 3831066 - RNA, 23 nt, Shigella flexneri 2a str. 2457T
augucgcucaaugcgcugagugu

SEQ ID NO: 3831067 - RNA, 18 nt, Shigella flexneri 2a str. 2457T
augucgcuguuucuggac

SEQ ID NO: 3831068 - RNA, 21 nt, Shigella flexneri 2a str. 2457T
augucgcuuccauugagaaag

SEQ ID NO: 3831069 - RNA, 18 nt, Shigella flexneri 2a str. 2457T
augucggaugcggcguga

SEQ ID NO: 3831070 - RNA, 16 nt, Shigella flexneri 2a str. 2457T
augucugaucggcaau

SEQ ID NO: 3831071 - RNA, 18 nt, Shigella flexneri 2a str. 2457T
augucugccgcaggaaag

SEQ ID NO: 3831072 - RNA, 15 nt, Shigella flexneri 2a str. 2457T
augucuggcagagcc

SEQ ID NO: 3831073 - RNA, 13 nt, Shigella flexneri 2a str. 2457T
augugaagaggaa

SEQ ID NO: 3831074 - RNA, 17 nt, Shigella flexneri 2a str. 2457T
augugaauggccagaca

SEQ ID NO: 3831075 - RNA, 21 nt, Shigella flexneri 2a str. 2457T
augugacccggcuggauacca

SEQ ID NO: 3831076 - RNA, 15 nt, Shigella flexneri 2a str. 2457T
augugauaaauacga

SEQ ID NO: 3831077 - RNA, 14 nt, Shigella flexneri 2a str. 2457T
augugauaaugccg

SEQ ID NO: 3831078 - RNA, 18 nt, Shigella flexneri 2a str. 2457T
augugaucuuuaucacac

SEQ ID NO: 3831079 - RNA, 15 nt, Shigella flexneri 2a str. 2457T
augugauuuugugaa

SEQ ID NO: 3831080 - RNA, 16 nt, Shigella flexneri 2a str. 2457T
augugcaccuuuucca

SEQ ID NO: 3831081 - RNA, 14 nt, Shigella flexneri 2a str. 2457T
augugcaguuccug

SEQ ID NO: 3831082 - RNA, 15 nt, Shigella flexneri 2a str. 2457T
augugcaguuccugc

SEQ ID NO: 3831083 - RNA, 16 nt, Shigella flexneri 2a str. 2457T
augugcaguuccugca

SEQ ID NO: 3831084 - RNA, 17 nt, Shigella flexneri 2a str. 2457T
augugcaguuccugcaa

SEQ ID NO: 3831085 - RNA, 21 nt, Shigella flexneri 2a str. 2457T
augugccagcuucccgcuggu

SEQ ID NO: 3831086 - RNA, 15 nt, Shigella flexneri 2a str. 2457T
augugccguaaccaa

SEQ ID NO: 3831087 - RNA, 19 nt, Shigella flexneri 2a str. 2457T
augugcuggauaacgacac

SEQ ID NO: 3831088 - RNA, 13 nt, Shigella flexneri 2a str. 2457T
auguggaaacagu

SEQ ID NO: 3831089 - RNA, 16 nt, Shigella flexneri 2a str. 2457T
auguggaaacagugau

SEQ ID NO: 3831090 - RNA, 16 nt, Shigella flexneri 2a str. 2457T
augugggcugccccag

SEQ ID NO: 3831091 - RNA, 21 nt, Shigella flexneri 2a str. 2457T
auguguaaguaaugacaaaau

SEQ ID NO: 3831092 - RNA, 18 nt, Shigella flexneri 2a str. 2457T
auguguuaaauauuuaaa

SEQ ID NO: 3831093 - RNA, 17 nt, Shigella flexneri 2a str. 2457T
auguguuaaaugauacc

SEQ ID NO: 3831094 - RNA, 17 nt, Shigella flexneri 2a str. 2457T
auguguuggcaccaucc

SEQ ID NO: 3831095 - RNA, 17 nt, Shigella flexneri 2a str. 2457T
auguguuuauaagccau

SEQ ID NO: 3831096 - RNA, 20 nt, Shigella flexneri 2a str. 2457T
auguuaaccgccugcgaguu

SEQ ID NO: 3831097 - RNA, 18 nt, Shigella flexneri 2a str. 2457T
auguuacgaccuuccuga

SEQ ID NO: 3831098 - RNA, 21 nt, Shigella flexneri 2a str. 2457T
auguuacgugaagucucaauu

SEQ ID NO: 3831099 - RNA, 17 nt, Shigella flexneri 2a str. 2457T
auguuaggcaagccaca

SEQ ID NO: 3831100 - RNA, 18 nt, Shigella flexneri 2a str. 2457T
auuaccguuaaaaccauc

SEQ ID NO: 3831101 - RNA, 22 nt, Shigella flexneri 2a str. 2457T
auuaccuuaucaaucucagcaa

SEQ ID NO: 3831102 - RNA, 13 nt, Shigella flexneri 2a str. 2457T
auuaccuucaaca

SEQ ID NO: 3831103 - RNA, 18 nt, Shigella flexneri 2a str. 2457T
auuacgaauauaaauauu

SEQ ID NO: 3831104 - RNA, 17 nt, Shigella flexneri 2a str. 2457T
auuacgacucaacccca

SEQ ID NO: 3831105 - RNA, 16 nt, Shigella flexneri 2a str. 2457T
auuacgccgagcgcca

SEQ ID NO: 3831106 - RNA, 18 nt, Shigella flexneri 2a str. 2457T
auuacgcucacugcaaaa

SEQ ID NO: 3831107 - RNA, 20 nt, Shigella flexneri 2a str. 2457T
auuacgcucacugcaaaaca

SEQ ID NO: 3831108 - RNA, 21 nt, Shigella flexneri 2a str. 2457T
auuacgcucggcaaagcgcug

SEQ ID NO: 3831109 - RNA, 13 nt, Shigella flexneri 2a str. 2457T
auuacgcuguuca

SEQ ID NO: 3831110 - RNA, 19 nt, Shigella flexneri 2a str. 2457T
auuacguccaucacaauca

SEQ ID NO: 3831111 - RNA, 21 nt, Shigella flexneri 2a str. 2457T
auuacgucuuuacuaaacggu

SEQ ID NO: 3831112 - RNA, 16 nt, Shigella flexneri 2a str. 2457T
auuacuaaaugugcaa

SEQ ID NO: 3831113 - RNA, 13 nt, Shigella flexneri 2a str. 2457T
auuacuacgguaa

SEQ ID NO: 3831114 - RNA, 14 nt, Shigella flexneri 2a str. 2457T
auuacuacgguaau

SEQ ID NO: 3831115 - RNA, 15 nt, Shigella flexneri 2a str. 2457T
auuacucaacgucaa

SEQ ID NO: 3831116 - RNA, 16 nt, Shigella flexneri 2a str. 2457T
auuacugacaauuugc

SEQ ID NO: 3831117 - RNA, 12 nt, Shigella flexneri 2a str. 2457T
auuacugagaac

SEQ ID NO: 3831118 - RNA, 22 nt, Shigella flexneri 2a str. 2457T
auuacugagcaauugcucauag

SEQ ID NO: 3831119 - RNA, 13 nt, Shigella flexneri 2a str. 2457T
auuacugauugcu

SEQ ID NO: 3831120 - RNA, 15 nt, Shigella flexneri 2a str. 2457T
auuacuggcgauugu

SEQ ID NO: 3831121 - RNA, 15 nt, Shigella flexneri 2a str. 2457T
auuacuuaacgucaa

SEQ ID NO: 3831122 - RNA, 21 nt, Shigella flexneri 2a str. 2457T
auuacuucuugaugcggauaa

SEQ ID NO: 3831123 - RNA, 18 nt, Shigella flexneri 2a str. 2457T
auuacuuuaagccuuccg

SEQ ID NO: 3831124 - RNA, 14 nt, Shigella flexneri 2a str. 2457T
auuacuuuauuuau

SEQ ID NO: 3831125 - RNA, 15 nt, Shigella flexneri 2a str. 2457T
auuacuuuauuuaua

SEQ ID NO: 3831126 - RNA, 23 nt, Shigella flexneri 2a str. 2457T
auuacuuuauuuauaucagugau

SEQ ID NO: 3831127 - RNA, 13 nt, Shigella flexneri 2a str. 2457T
auuagaaacagaa

SEQ ID NO: 3831128 - RNA, 20 nt, Shigella flexneri 2a str. 2457T
auuagacgaacguuuaauaa

SEQ ID NO: 3831129 - RNA, 13 nt, Shigella flexneri 2a str. 2457T
auuagauaaaaau

SEQ ID NO: 3831130 - RNA, 17 nt, Shigella flexneri 2a str. 2457T
auuagauaaaaaugaag

SEQ ID NO: 3831131 - RNA, 14 nt, Shigella flexneri 2a str. 2457T
auuagcaauauuuu

SEQ ID NO: 3831132 - RNA, 21 nt, Shigella flexneri 2a str. 2457T
auuagcaaugcgcuguaauuu

SEQ ID NO: 3831133 - RNA, 22 nt, Shigella flexneri 2a str. 2457T
auuagcaucgcgauggcaagcg

SEQ ID NO: 3831134 - RNA, 17 nt, Shigella flexneri 2a str. 2457T
auuagcauggccgccaa

SEQ ID NO: 3831135 - RNA, 22 nt, Shigella flexneri 2a str. 2457T
auuagcccaauaaucaccguga

SEQ ID NO: 3831136 - RNA, 20 nt, Shigella flexneri 2a str. 2457T
auuagccgguaaaucaccag

SEQ ID NO: 3831137 - RNA, 22 nt, Shigella flexneri 2a str. 2457T
auuagcguccggcugccagcca

SEQ ID NO: 3831138 - RNA, 17 nt, Shigella flexneri 2a str. 2457T
auuaggaauaaugucuu

SEQ ID NO: 3831139 - RNA, 20 nt, Shigella flexneri 2a str. 2457T
auuagggaucaucuuaacuu

SEQ ID NO: 3831140 - RNA, 17 nt, Shigella flexneri 2a str. 2457T
auuagugcugcuggaag

SEQ ID NO: 3831141 - RNA, 22 nt, Shigella flexneri 2a str. 2457T
auuauaauaagcgcaaggguaa

SEQ ID NO: 3831142 - RNA, 17 nt, Shigella flexneri 2a str. 2457T
auuauagacaucuuuau

SEQ ID NO: 3831143 - RNA, 14 nt, Shigella flexneri 2a str. 2457T
auuaucacucugcc

SEQ ID NO: 3831144 - RNA, 17 nt, Shigella flexneri 2a str. 2457T
auuaucagagauucuuu

SEQ ID NO: 3831145 - RNA, 15 nt, Shigella flexneri 2a str. 2457T
auuaucccgugcaca

SEQ ID NO: 3831146 - RNA, 18 nt, Shigella flexneri 2a str. 2457T
auuaucccgugcacaaau

SEQ ID NO: 3831147 - RNA, 21 nt, Shigella flexneri 2a str. 2457T
auuaucccgugcacaaauuuu

SEQ ID NO: 3831148 - RNA, 16 nt, Shigella flexneri 2a str. 2457T
auuauccgucagccac

SEQ ID NO: 3831149 - RNA, 18 nt, Shigella flexneri 2a str. 2457T
auuaucgacugcgcccug

SEQ ID NO: 3831150 - RNA, 17 nt, Shigella flexneri 2a str. 2457T
auuaucgcgucuaaauu

SEQ ID NO: 3831151 - RNA, 19 nt, Shigella flexneri 2a str. 2457T
auuaucgcgucuaaauuuu

SEQ ID NO: 3831152 - RNA, 17 nt, Shigella flexneri 2a str. 2457T
auuaucgucauggcugu

SEQ ID NO: 3831153 - RNA, 20 nt, Shigella flexneri 2a str. 2457T
auuaucguuacgacgcaauc

SEQ ID NO: 3831154 - RNA, 18 nt, Shigella flexneri 2a str. 2457T
auuaucucuugccaggcu

SEQ ID NO: 3831155 - RNA, 16 nt, Shigella flexneri 2a str. 2457T
auuaucugcaauuacu

SEQ ID NO: 3831156 - RNA, 19 nt, Shigella flexneri 2a str. 2457T
auuaucuggaauuccuuuc

SEQ ID NO: 3831157 - RNA, 11 nt, Shigella flexneri 2a str. 2457T
auuaucuggau

SEQ ID NO: 3831158 - RNA, 20 nt, Shigella flexneri 2a str. 2457T
auuaucuggcaagccugaaa

SEQ ID NO: 3831159 - RNA, 14 nt, Shigella flexneri 2a str. 2457T
auuaucugggcugc

SEQ ID NO: 3831160 - RNA, 18 nt, Shigella flexneri 2a str. 2457T
auuaucugggcugccuga

SEQ ID NO: 3831161 - RNA, 20 nt, Shigella flexneri 2a str. 2457T
auuaucuucaccguucguga

SEQ ID NO: 3831162 - RNA, 12 nt, Shigella flexneri 2a str. 2457T
auuaucuuuacu

SEQ ID NO: 3831163 - RNA, 15 nt, Shigella flexneri 2a str. 2457T
auuaucuuuauuauc

SEQ ID NO: 3831164 - RNA, 17 nt, Shigella flexneri 2a str. 2457T
auuaugacuccagcgcc

SEQ ID NO: 3831165 - RNA, 18 nt, Shigella flexneri 2a str. 2457T
auuaugacuccagcgcca

SEQ ID NO: 3831166 - RNA, 15 nt, Shigella flexneri 2a str. 2457T
auuaugaucaaaauc

SEQ ID NO: 3831167 - RNA, 22 nt, Shigella flexneri 2a str. 2457T
auuaugaucaaaaucauauaau

SEQ ID NO: 3831168 - RNA, 19 nt, Shigella flexneri 2a str. 2457T
auuaugcagccuuuuuuau

SEQ ID NO: 3831169 - RNA, 21 nt, Shigella flexneri 2a str. 2457T
auuaugcccuuucaauggaag

SEQ ID NO: 3831170 - RNA, 15 nt, Shigella flexneri 2a str. 2457T
auuauggcuauaaca

SEQ ID NO: 3831171 - RNA, 15 nt, Shigella flexneri 2a str. 2457T
auuaugucgauaucc

SEQ ID NO: 3831172 - RNA, 15 nt, Shigella flexneri 2a str. 2457T
auuauuaaauuuaau

SEQ ID NO: 3831173 - RNA, 12 nt, Shigella flexneri 2a str. 2457T
auuauuauaaua

SEQ ID NO: 3831174 - RNA, 17 nt, Shigella flexneri 2a str. 2457T
auuauuccauccugcuc

SEQ ID NO: 3831175 - RNA, 13 nt, Shigella flexneri 2a str. 2457T
auuauugagcgca

SEQ ID NO: 3831176 - RNA, 12 nt, Shigella flexneri 2a str. 2457T
auuauugccgca

SEQ ID NO: 3831177 - RNA, 20 nt, Shigella flexneri 2a str. 2457T
auuauuucaaugcauuauca

SEQ ID NO: 3831178 - RNA, 19 nt, Shigella flexneri 2a str. 2457T
auuauuugcgucagcucac

SEQ ID NO: 3831179 - RNA, 12 nt, Shigella flexneri 2a str. 2457T
auuauuuuaaau

SEQ ID NO: 3831180 - RNA, 19 nt, Shigella flexneri 2a str. 2457T
auuauuuuuaaacaucaaa

SEQ ID NO: 3831181 - RNA, 19 nt, Shigella flexneri 2a str. 2457T
auuauuuuugugaagaaua

SEQ ID NO: 3831182 - RNA, 18 nt, Shigella flexneri 2a str. 2457T
auuauuuuuuuaucauuu

SEQ ID NO: 3831183 - RNA, 15 nt, Shigella flexneri 2a str. 2457T
auucaaaauccgcca

SEQ ID NO: 3831184 - RNA, 13 nt, Shigella flexneri 2a str. 2457T
auucaaacgugaa

SEQ ID NO: 3831185 - RNA, 22 nt, Shigella flexneri 2a str. 2457T
auucaaagcgauuauagcuaac

SEQ ID NO: 3831186 - RNA, 22 nt, Shigella flexneri 2a str. 2457T
auucaaaguguugcaggaaaag

SEQ ID NO: 3831187 - RNA, 13 nt, Shigella flexneri 2a str. 2457T
auucaaauuaugu

SEQ ID NO: 3831188 - RNA, 18 nt, Shigella flexneri 2a str. 2457T
auucaacaccgaugcaau

SEQ ID NO: 3831189 - RNA, 15 nt, Shigella flexneri 2a str. 2457T
auucaacgucacugg

SEQ ID NO: 3831190 - RNA, 17 nt, Shigella flexneri 2a str. 2457T
auucaacgucacugggu

SEQ ID NO: 3831191 - RNA, 17 nt, Shigella flexneri 2a str. 2457T
auucaagaaacagcagu

SEQ ID NO: 3831192 - RNA, 18 nt, Shigella flexneri 2a str. 2457T
auucaagacaucaauaaa

SEQ ID NO: 3831193 - RNA, 12 nt, Shigella flexneri 2a str. 2457T
auucaagaucau

SEQ ID NO: 3831194 - RNA, 13 nt, Shigella flexneri 2a str. 2457T
auucaagaucaug

SEQ ID NO: 3831195 - RNA, 19 nt, Shigella flexneri 2a str. 2457T
auucaagauuagccugaau

SEQ ID NO: 3831196 - RNA, 15 nt, Shigella flexneri 2a str. 2457T
auucaaguaucuauu

SEQ ID NO: 3831197 - RNA, 21 nt, Shigella flexneri 2a str. 2457T
auucaauauauugcugaaaua

SEQ ID NO: 3831198 - RNA, 19 nt, Shigella flexneri 2a str. 2457T
auucgccugacgcaauaac

SEQ ID NO: 3831199 - RNA, 15 nt, Shigella flexneri 2a str. 2457T
auucgcgaugcugau

SEQ ID NO: 3831200 - RNA, 19 nt, Shigella flexneri 2a str. 2457T
auucgcuaacguuuuuaaa

SEQ ID NO: 3831201 - RNA, 20 nt, Shigella flexneri 2a str. 2457T
auucgcuccccugcaaauua

SEQ ID NO: 3831202 - RNA, 16 nt, Shigella flexneri 2a str. 2457T
auucgcugcugcggcg

SEQ ID NO: 3831203 - RNA, 18 nt, Shigella flexneri 2a str. 2457T
auucgcuggauuuuugac

SEQ ID NO: 3831204 - RNA, 22 nt, Shigella flexneri 2a str. 2457T
auucgcuuucggugcuauaacc

SEQ ID NO: 3831205 - RNA, 23 nt, Shigella flexneri 2a str. 2457T
auucgcuuucggugcuauaaccg

SEQ ID NO: 3831206 - RNA, 16 nt, Shigella flexneri 2a str. 2457T
auucggcaagauaaau

SEQ ID NO: 3831207 - RNA, 14 nt, Shigella flexneri 2a str. 2457T
auucggcaaucacc

SEQ ID NO: 3831208 - RNA, 16 nt, Shigella flexneri 2a str. 2457T
auucggcggcgugccu

SEQ ID NO: 3831209 - RNA, 14 nt, Shigella flexneri 2a str. 2457T
auucggcuccagau

SEQ ID NO: 3831210 - RNA, 22 nt, Shigella flexneri 2a str. 2457T
auucgggauugccagaugcgac

SEQ ID NO: 3831211 - RNA, 23 nt, Shigella flexneri 2a str. 2457T
auucggguacugaugagacaaca

SEQ ID NO: 3831212 - RNA, 19 nt, Shigella flexneri 2a str. 2457T
auucgucguauagaucacu

SEQ ID NO: 3831213 - RNA, 20 nt, Shigella flexneri 2a str. 2457T
auucgucguauagaucacuu

SEQ ID NO: 3831214 - RNA, 21 nt, Shigella flexneri 2a str. 2457T
auucguuuuucuucagcagcc

SEQ ID NO: 3831215 - RNA, 13 nt, Shigella flexneri 2a str. 2457T
auucuaagugaua

SEQ ID NO: 3831216 - RNA, 16 nt, Shigella flexneri 2a str. 2457T
auucuacagaaaugaa

SEQ ID NO: 3831217 - RNA, 20 nt, Shigella flexneri 2a str. 2457T
auucucaaaauacaguagaa

SEQ ID NO: 3831218 - RNA, 18 nt, Shigella flexneri 2a str. 2457T
auucucaauaaaaggaaa

SEQ ID NO: 3831219 - RNA, 17 nt, Shigella flexneri 2a str. 2457T
auucucaauaucaucau

SEQ ID NO: 3831220 - RNA, 17 nt, Shigella flexneri 2a str. 2457T
auucuccggcaggaaau

SEQ ID NO: 3831221 - RNA, 23 nt, Shigella flexneri 2a str. 2457T
auucucuuuucacgcaauaccug

SEQ ID NO: 3831222 - RNA, 16 nt, Shigella flexneri 2a str. 2457T
auucugaaaacggaca

SEQ ID NO: 3831223 - RNA, 21 nt, Shigella flexneri 2a str. 2457T
auucugaaaacggacaugcca

SEQ ID NO: 3831224 - RNA, 22 nt, Shigella flexneri 2a str. 2457T
auucugaaaacggacaugccau

SEQ ID NO: 3831225 - RNA, 15 nt, Shigella flexneri 2a str. 2457T
auucugacuggguca

SEQ ID NO: 3831226 - RNA, 22 nt, Shigella flexneri 2a str. 2457T
auucugacugucagaugcggcu

SEQ ID NO: 3831227 - RNA, 16 nt, Shigella flexneri 2a str. 2457T
auucugagagcaugaa

SEQ ID NO: 3831228 - RNA, 16 nt, Shigella flexneri 2a str. 2457T
auucugauccugcacu

SEQ ID NO: 3831229 - RNA, 23 nt, Shigella flexneri 2a str. 2457T
auucuggacgguggagcaacagg

SEQ ID NO: 3831230 - RNA, 17 nt, Shigella flexneri 2a str. 2457T
auucuggagcauggcug

SEQ ID NO: 3831231 - RNA, 18 nt, Shigella flexneri 2a str. 2457T
auucuggagcauggcugg

SEQ ID NO: 3831232 - RNA, 19 nt, Shigella flexneri 2a str. 2457T
auucuggauaaucaaugac

SEQ ID NO: 3831233 - RNA, 20 nt, Shigella flexneri 2a str. 2457T
auucuggcaccaccuggcuu

SEQ ID NO: 3831234 - RNA, 19 nt, Shigella flexneri 2a str. 2457T
auucuggugauugucuuuu

SEQ ID NO: 3831235 - RNA, 21 nt, Shigella flexneri 2a str. 2457T
auucuguguaaaugccuuucu

SEQ ID NO: 3831236 - RNA, 13 nt, Shigella flexneri 2a str. 2457T
auucuguucagua

SEQ ID NO: 3831237 - RNA, 12 nt, Shigella flexneri 2a str. 2457T
auucuguuuuau

SEQ ID NO: 3831238 - RNA, 23 nt, Shigella flexneri 2a str. 2457T
auucuuaaagucuuuguauuuau

SEQ ID NO: 3831239 - RNA, 20 nt, Shigella flexneri 2a str. 2457T
auucuuacguaauuuauaau

SEQ ID NO: 3831240 - RNA, 12 nt, Shigella flexneri 2a str. 2457T
auucuucaacaa

SEQ ID NO: 3831241 - RNA, 12 nt, Shigella flexneri 2a str. 2457T
auucuucaagug

SEQ ID NO: 3831242 - RNA, 13 nt, Shigella flexneri 2a str. 2457T
auucuucagcgac

SEQ ID NO: 3831243 - RNA, 20 nt, Shigella flexneri 2a str. 2457T
auucuucagcgacagggcca

SEQ ID NO: 3831244 - RNA, 22 nt, Shigella flexneri 2a str. 2457T
auucuugccaucaaucacuuug

SEQ ID NO: 3831245 - RNA, 14 nt, Shigella flexneri 2a str. 2457T
auucuuuuccucuc

SEQ ID NO: 3831246 - RNA, 20 nt, Shigella flexneri 2a str. 2457T
auucuuuugcagcagcguga

SEQ ID NO: 3831247 - RNA, 19 nt, Shigella flexneri 2a str. 2457T
auugaaaaagugccaaaaa

SEQ ID NO: 3831248 - RNA, 20 nt, Shigella flexneri 2a str. 2457T
auugaaaaagugccaaaaau

SEQ ID NO: 3831249 - RNA, 20 nt, Shigella flexneri 2a str. 2457T
auugaaacacuuaauggucu

SEQ ID NO: 3831250 - RNA, 20 nt, Shigella flexneri 2a str. 2457T
auugaaauagccaauacgau

SEQ ID NO: 3831251 - RNA, 21 nt, Shigella flexneri 2a str. 2457T
auugaaaucacuaacgacaua

SEQ ID NO: 3831252 - RNA, 16 nt, Shigella flexneri 2a str. 2457T
auugaacgguuaaucu

SEQ ID NO: 3831253 - RNA, 15 nt, Shigella flexneri 2a str. 2457T
auugaagauuuugcu

SEQ ID NO: 3831254 - RNA, 21 nt, Shigella flexneri 2a str. 2457T
auugaagauuuugcugugcuu

SEQ ID NO: 3831255 - RNA, 18 nt, Shigella flexneri 2a str. 2457T
auugaaugcggcaggcac

SEQ ID NO: 3831256 - RNA, 22 nt, Shigella flexneri 2a str. 2457T
auugacaaagugcgcuuuguuu

SEQ ID NO: 3831257 - RNA, 14 nt, Shigella flexneri 2a str. 2457T
auugaccccagcca

SEQ ID NO: 3831258 - RNA, 19 nt, Shigella flexneri 2a str. 2457T
auugacgccaaaauaacuu

SEQ ID NO: 3831259 - RNA, 17 nt, Shigella flexneri 2a str. 2457T
auugacguuccuuucuu

SEQ ID NO: 3831260 - RNA, 13 nt, Shigella flexneri 2a str. 2457T
auugagaaccaca

SEQ ID NO: 3831261 - RNA, 15 nt, Shigella flexneri 2a str. 2457T
auugagaaccacaau

SEQ ID NO: 3831262 - RNA, 23 nt, Shigella flexneri 2a str. 2457T
auugagacguaguauccacacca

SEQ ID NO: 3831263 - RNA, 13 nt, Shigella flexneri 2a str. 2457T
auugagcaccgcg

SEQ ID NO: 3831264 - RNA, 21 nt, Shigella flexneri 2a str. 2457T
auugagcauuggcaugcacgu

SEQ ID NO: 3831265 - RNA, 12 nt, Shigella flexneri 2a str. 2457T
auugagcugccc

SEQ ID NO: 3831266 - RNA, 17 nt, Shigella flexneri 2a str. 2457T
auugaggcgcugaaugu

SEQ ID NO: 3831267 - RNA, 17 nt, Shigella flexneri 2a str. 2457T
auugaguacggucugca

SEQ ID NO: 3831268 - RNA, 15 nt, Shigella flexneri 2a str. 2457T
auugaguuugaugac

SEQ ID NO: 3831269 - RNA, 18 nt, Shigella flexneri 2a str. 2457T
auugauaaccguacgcau

SEQ ID NO: 3831270 - RNA, 22 nt, Shigella flexneri 2a str. 2457T
auugauaaccguacgcaucacc

SEQ ID NO: 3831271 - RNA, 22 nt, Shigella flexneri 2a str. 2457T
auugauccccgcuuccugcagc

SEQ ID NO: 3831272 - RNA, 18 nt, Shigella flexneri 2a str. 2457T
auugauccgcgauaaguc

SEQ ID NO: 3831273 - RNA, 15 nt, Shigella flexneri 2a str. 2457T
auugaucucacaauc

SEQ ID NO: 3831274 - RNA, 18 nt, Shigella flexneri 2a str. 2457T
auugaucucguugaucac

SEQ ID NO: 3831275 - RNA, 19 nt, Shigella flexneri 2a str. 2457T
auugaugcacaccaucgcg

SEQ ID NO: 3831276 - RNA, 16 nt, Shigella flexneri 2a str. 2457T
auugaugcucuccgcc

SEQ ID NO: 3831277 - RNA, 14 nt, Shigella flexneri 2a str. 2457T
auugaugugaaaac

SEQ ID NO: 3831278 - RNA, 14 nt, Shigella flexneri 2a str. 2457T
auugauuaaaggaa

SEQ ID NO: 3831279 - RNA, 16 nt, Shigella flexneri 2a str. 2457T
auugauuaaaggaagg

SEQ ID NO: 3831280 - RNA, 21 nt, Shigella flexneri 2a str. 2457T
auugauucaucucuucuuccg

SEQ ID NO: 3831281 - RNA, 19 nt, Shigella flexneri 2a str. 2457T
auugauucgaucaaacaau

SEQ ID NO: 3831282 - RNA, 18 nt, Shigella flexneri 2a str. 2457T
auugauuuaacagcaaaa

SEQ ID NO: 3831283 - RNA, 18 nt, Shigella flexneri 2a str. 2457T
auugcaaacagagcgggc

SEQ ID NO: 3831284 - RNA, 15 nt, Shigella flexneri 2a str. 2457T
auugcaaaccucagg

SEQ ID NO: 3831285 - RNA, 21 nt, Shigella flexneri 2a str. 2457T
auugcaaagagaacugagcga

SEQ ID NO: 3831286 - RNA, 20 nt, Shigella flexneri 2a str. 2457T
auugcacaguauagcaucau

SEQ ID NO: 3831287 - RNA, 20 nt, Shigella flexneri 2a str. 2457T
auugcaccauccauuuuuca

SEQ ID NO: 3831288 - RNA, 16 nt, Shigella flexneri 2a str. 2457T
auugcaccgacuggcu

SEQ ID NO: 3831289 - RNA, 19 nt, Shigella flexneri 2a str. 2457T
auugcacguccgguggcau

SEQ ID NO: 3831290 - RNA, 15 nt, Shigella flexneri 2a str. 2457T
auugcacugcaucau

SEQ ID NO: 3831291 - RNA, 14 nt, Shigella flexneri 2a str. 2457T
auugcagacaaagu

SEQ ID NO: 3831292 - RNA, 16 nt, Shigella flexneri 2a str. 2457T
auugcagauaccacau

SEQ ID NO: 3831293 - RNA, 12 nt, Shigella flexneri 2a str. 2457T
auugcagcagcu

SEQ ID NO: 3831294 - RNA, 16 nt, Shigella flexneri 2a str. 2457T
auugcaggaagguuuu

SEQ ID NO: 3831295 - RNA, 23 nt, Shigella flexneri 2a str. 2457T
auuuaaacaccugggcaauggug

SEQ ID NO: 3831296 - RNA, 19 nt, Shigella flexneri 2a str. 2457T
auuuaaauugcgguuuuua

SEQ ID NO: 3831297 - RNA, 12 nt, Shigella flexneri 2a str. 2457T
auuuaacaccau

SEQ ID NO: 3831298 - RNA, 23 nt, Shigella flexneri 2a str. 2457T
auuuaacaccaucauauuuucca

SEQ ID NO: 3831299 - RNA, 15 nt, Shigella flexneri 2a str. 2457T
auuuaacagcaaaac

SEQ ID NO: 3831300 - RNA, 18 nt, Shigella flexneri 2a str. 2457T
auuuaaccaacaauaaaa

SEQ ID NO: 3831301 - RNA, 13 nt, Shigella flexneri 2a str. 2457T
auuuaacccugcg

SEQ ID NO: 3831302 - RNA, 20 nt, Shigella flexneri 2a str. 2457T
auuuaacccuucaagaauua

SEQ ID NO: 3831303 - RNA, 16 nt, Shigella flexneri 2a str. 2457T
auuuaaccugagcuug

SEQ ID NO: 3831304 - RNA, 22 nt, Shigella flexneri 2a str. 2457T
auuuaacucaccgaugaucgcc

SEQ ID NO: 3831305 - RNA, 14 nt, Shigella flexneri 2a str. 2457T
auuuaaucaguucu

SEQ ID NO: 3831306 - RNA, 21 nt, Shigella flexneri 2a str. 2457T
auuuaauggcgacauaaaaua

SEQ ID NO: 3831307 - RNA, 22 nt, Shigella flexneri 2a str. 2457T
auuuaauggcgacauaaaauaa

SEQ ID NO: 3831308 - RNA, 16 nt, Shigella flexneri 2a str. 2457T
auuuacacaauuuugu

SEQ ID NO: 3831309 - RNA, 17 nt, Shigella flexneri 2a str. 2457T
auuuacacaauuuugua

SEQ ID NO: 3831310 - RNA, 14 nt, Shigella flexneri 2a str. 2457T
auuuacacuucauc

SEQ ID NO: 3831311 - RNA, 20 nt, Shigella flexneri 2a str. 2457T
auuuaccagcauuuaagcau

SEQ ID NO: 3831312 - RNA, 23 nt, Shigella flexneri 2a str. 2457T
auuuacgccgacguuggcuauau

SEQ ID NO: 3831313 - RNA, 20 nt, Shigella flexneri 2a str. 2457T
auuuacgccgcauccggcaa

SEQ ID NO: 3831314 - RNA, 17 nt, Shigella flexneri 2a str. 2457T
auuuacguuuuaaaccu

SEQ ID NO: 3831315 - RNA, 13 nt, Shigella flexneri 2a str. 2457T
auuuacuacguaa

SEQ ID NO: 3831316 - RNA, 21 nt, Shigella flexneri 2a str. 2457T
auuuacucucaucaauaccug

SEQ ID NO: 3831317 - RNA, 15 nt, Shigella flexneri 2a str. 2457T
auuuagcaaauuuuu

SEQ ID NO: 3831318 - RNA, 15 nt, Shigella flexneri 2a str. 2457T
auuuagugaccaauc

SEQ ID NO: 3831319 - RNA, 20 nt, Shigella flexneri 2a str. 2457T
auuuauaaucuuuaaaaaaa

SEQ ID NO: 3831320 - RNA, 15 nt, Shigella flexneri 2a str. 2457T
auuuaucgacugcca

SEQ ID NO: 3831321 - RNA, 15 nt, Shigella flexneri 2a str. 2457T
auuuaucuucccagc

SEQ ID NO: 3831322 - RNA, 14 nt, Shigella flexneri 2a str. 2457T
auuuaucuucgagc

SEQ ID NO: 3831323 - RNA, 21 nt, Shigella flexneri 2a str. 2457T
auuuaucuuugauugaagaaa

SEQ ID NO: 3831324 - RNA, 13 nt, Shigella flexneri 2a str. 2457T
auuuaugacaaac

SEQ ID NO: 3831325 - RNA, 17 nt, Shigella flexneri 2a str. 2457T
auuuaugggguggaacg

SEQ ID NO: 3831326 - RNA, 20 nt, Shigella flexneri 2a str. 2457T
auuuauguggauauuauuaa

SEQ ID NO: 3831327 - RNA, 21 nt, Shigella flexneri 2a str. 2457T
auuuauuaucuggcaagccug

SEQ ID NO: 3831328 - RNA, 15 nt, Shigella flexneri 2a str. 2457T
auuuauucaaaccaa

SEQ ID NO: 3831329 - RNA, 16 nt, Shigella flexneri 2a str. 2457T
auuuauuggugagaac

SEQ ID NO: 3831330 - RNA, 21 nt, Shigella flexneri 2a str. 2457T
auuuauuuccuucgcuuuaau

SEQ ID NO: 3831331 - RNA, 20 nt, Shigella flexneri 2a str. 2457T
auuucaacagauuacauuaa

SEQ ID NO: 3831332 - RNA, 15 nt, Shigella flexneri 2a str. 2457T
auuucaacagguuuu

SEQ ID NO: 3831333 - RNA, 22 nt, Shigella flexneri 2a str. 2457T
auuucaacagguuuuguugccc

SEQ ID NO: 3831334 - RNA, 20 nt, Shigella flexneri 2a str. 2457T
auuucaauaucgccuuuugc

SEQ ID NO: 3831335 - RNA, 22 nt, Shigella flexneri 2a str. 2457T
auuucaauaucgccuuuugccc

SEQ ID NO: 3831336 - RNA, 20 nt, Shigella flexneri 2a str. 2457T
auuucaauaucguuaucacc

SEQ ID NO: 3831337 - RNA, 22 nt, Shigella flexneri 2a str. 2457T
auuucaaugcauuaucagagau

SEQ ID NO: 3831338 - RNA, 18 nt, Shigella flexneri 2a str. 2457T
auuucacaccaucaacaa

SEQ ID NO: 3831339 - RNA, 13 nt, Shigella flexneri 2a str. 2457T
auuucacaguaau

SEQ ID NO: 3831340 - RNA, 19 nt, Shigella flexneri 2a str. 2457T
auuucacaguaaugauuua

SEQ ID NO: 3831341 - RNA, 20 nt, Shigella flexneri 2a str. 2457T
auuucaccgucaucgacaaa

SEQ ID NO: 3831342 - RNA, 20 nt, Shigella flexneri 2a str. 2457T
auuucacuauguuaguuaca

SEQ ID NO: 3831343 - RNA, 15 nt, Shigella flexneri 2a str. 2457T
auuucacuucgccaa

SEQ ID NO: 3831344 - RNA, 21 nt, Shigella flexneri 2a str. 2457T
auuucacuugcuguaauuuca

SEQ ID NO: 3831345 - RNA, 18 nt, Shigella flexneri 2a str. 2457T
auuucagaaaguauauaa

SEQ ID NO: 3831346 - RNA, 19 nt, Shigella flexneri 2a str. 2457T
auuucagaauagacaaaaa

SEQ ID NO: 3831347 - RNA, 14 nt, Shigella flexneri 2a str. 2457T
auuucagccccagc

SEQ ID NO: 3831348 - RNA, 14 nt, Shigella flexneri 2a str. 2457T
auuucaucaccagc

SEQ ID NO: 3831349 - RNA, 14 nt, Shigella flexneri 2a str. 2457T
auuucauccaugcc

SEQ ID NO: 3831350 - RNA, 13 nt, Shigella flexneri 2a str. 2457T
auuucaucgccag

SEQ ID NO: 3831351 - RNA, 21 nt, Shigella flexneri 2a str. 2457T
auuucaucgccagcgaauucc

SEQ ID NO: 3831352 - RNA, 20 nt, Shigella flexneri 2a str. 2457T
auuucaucgcuacaccaauc

SEQ ID NO: 3831353 - RNA, 13 nt, Shigella flexneri 2a str. 2457T
auuucaucugccu

SEQ ID NO: 3831354 - RNA, 19 nt, Shigella flexneri 2a str. 2457T
auuucaucugccuuauuga

SEQ ID NO: 3831355 - RNA, 14 nt, Shigella flexneri 2a str. 2457T
auuucauguuugaa

SEQ ID NO: 3831356 - RNA, 13 nt, Shigella flexneri 2a str. 2457T
auuucauuauuca

SEQ ID NO: 3831357 - RNA, 17 nt, Shigella flexneri 2a str. 2457T
auuuccaccgcuauuga

SEQ ID NO: 3831358 - RNA, 14 nt, Shigella flexneri 2a str. 2457T
auuuccaccucccc

SEQ ID NO: 3831359 - RNA, 23 nt, Shigella flexneri 2a str. 2457T
auuuccacgccaagcucauaacg

SEQ ID NO: 3831360 - RNA, 15 nt, Shigella flexneri 2a str. 2457T
auuuccagaaaguga

SEQ ID NO: 3831361 - RNA, 18 nt, Shigella flexneri 2a str. 2457T
auuuccagcucaaagaua

SEQ ID NO: 3831362 - RNA, 22 nt, Shigella flexneri 2a str. 2457T
auuuccagggccucuccuuuac

SEQ ID NO: 3831363 - RNA, 19 nt, Shigella flexneri 2a str. 2457T
auuuccaguccagcugccg

SEQ ID NO: 3831364 - RNA, 20 nt, Shigella flexneri 2a str. 2457T
auuuccaguccagcugccgu

SEQ ID NO: 3831365 - RNA, 17 nt, Shigella flexneri 2a str. 2457T
auuuccauaccuaaaaa

SEQ ID NO: 3831366 - RNA, 13 nt, Shigella flexneri 2a str. 2457T
auuuccaucucca

SEQ ID NO: 3831367 - RNA, 16 nt, Shigella flexneri 2a str. 2457T
auuuccaucuccagcu

SEQ ID NO: 3831368 - RNA, 19 nt, Shigella flexneri 2a str. 2457T
auuuccauugcucuggcaa

SEQ ID NO: 3831369 - RNA, 14 nt, Shigella flexneri 2a str. 2457T
auuucccagcaaga

SEQ ID NO: 3831370 - RNA, 22 nt, Shigella flexneri 2a str. 2457T
auuucccagcaagaaccaugca

SEQ ID NO: 3831371 - RNA, 18 nt, Shigella flexneri 2a str. 2457T
auuuccccuguugcaaac

SEQ ID NO: 3831372 - RNA, 13 nt, Shigella flexneri 2a str. 2457T
auuucccgcucau

SEQ ID NO: 3831373 - RNA, 16 nt, Shigella flexneri 2a str. 2457T
auuucccggcacauac

SEQ ID NO: 3831374 - RNA, 16 nt, Shigella flexneri 2a str. 2457T
auuucccgucgaagac

SEQ ID NO: 3831375 - RNA, 13 nt, Shigella flexneri 2a str. 2457T
auuucccugacaa

SEQ ID NO: 3831376 - RNA, 16 nt, Shigella flexneri 2a str. 2457T
auuucccugacaaauc

SEQ ID NO: 3831377 - RNA, 15 nt, Shigella flexneri 2a str. 2457T
auuuccgccaaucaa

SEQ ID NO: 3831378 - RNA, 15 nt, Shigella flexneri 2a str. 2457T
auuuccgccaccuga

SEQ ID NO: 3831379 - RNA, 22 nt, Shigella flexneri 2a str. 2457T
auuuccgccaccugauccaucg

SEQ ID NO: 3831380 - RNA, 16 nt, Shigella flexneri 2a str. 2457T
auuuccgcgaaacagg

SEQ ID NO: 3831381 - RNA, 13 nt, Shigella flexneri 2a str. 2457T
auuuccgcugauu

SEQ ID NO: 3831382 - RNA, 23 nt, Shigella flexneri 2a str. 2457T
auuuccgcugauucaagauuagc

SEQ ID NO: 3831383 - RNA, 23 nt, Shigella flexneri 2a str. 2457T
auuuccggauacgguuuuuugaa

SEQ ID NO: 3831384 - RNA, 21 nt, Shigella flexneri 2a str. 2457T
auuuccggcggcggaaaguau

SEQ ID NO: 3831385 - RNA, 16 nt, Shigella flexneri 2a str. 2457T
auuuccgguacuggcu

SEQ ID NO: 3831386 - RNA, 23 nt, Shigella flexneri 2a str. 2457T
auuuccugacgucuggccucucu

SEQ ID NO: 3831387 - RNA, 23 nt, Shigella flexneri 2a str. 2457T
auuuccugcgugacuaaaacccu

SEQ ID NO: 3831388 - RNA, 16 nt, Shigella flexneri 2a str. 2457T
auuuccuuaaaaguga

SEQ ID NO: 3831389 - RNA, 15 nt, Shigella flexneri 2a str. 2457T
auuucgaagaaaccg

SEQ ID NO: 3831390 - RNA, 13 nt, Shigella flexneri 2a str. 2457T
auuucgagaaugu

SEQ ID NO: 3831391 - RNA, 20 nt, Shigella flexneri 2a str. 2457T
auuucgauagacucccagcc

SEQ ID NO: 3831392 - RNA, 15 nt, Shigella flexneri 2a str. 2457T
auuuugcuuccggca

SEQ ID NO: 3831393 - RNA, 17 nt, Shigella flexneri 2a str. 2457T
auuuugcuuuugauguu

SEQ ID NO: 3831394 - RNA, 19 nt, Shigella flexneri 2a str. 2457T
auuuuggcccgacgcuuga

SEQ ID NO: 3831395 - RNA, 15 nt, Shigella flexneri 2a str. 2457T
auuuuguaaaagaag

SEQ ID NO: 3831396 - RNA, 13 nt, Shigella flexneri 2a str. 2457T
auuuugugcagca

SEQ ID NO: 3831397 - RNA, 15 nt, Shigella flexneri 2a str. 2457T
auuuuuaaacaucaa

SEQ ID NO: 3831398 - RNA, 17 nt, Shigella flexneri 2a str. 2457T
auuuuuaaacaucaaac

SEQ ID NO: 3831399 - RNA, 23 nt, Shigella flexneri 2a str. 2457T
auuuuuaacuucgcguucugugg

SEQ ID NO: 3831400 - RNA, 14 nt, Shigella flexneri 2a str. 2457T
auuuuuaauuaaaa

SEQ ID NO: 3831401 - RNA, 18 nt, Shigella flexneri 2a str. 2457T
auuuuuacuccacuuccu

SEQ ID NO: 3831402 - RNA, 14 nt, Shigella flexneri 2a str. 2457T
auuuuuagcagaca

SEQ ID NO: 3831403 - RNA, 21 nt, Shigella flexneri 2a str. 2457T
auuuuuaugccggaucaggcg

SEQ ID NO: 3831404 - RNA, 18 nt, Shigella flexneri 2a str. 2457T
auuuuucaauauccaaca

SEQ ID NO: 3831405 - RNA, 18 nt, Shigella flexneri 2a str. 2457T
auuuuucacccuucaauc

SEQ ID NO: 3831406 - RNA, 17 nt, Shigella flexneri 2a str. 2457T
auuuuucacuuaaugaa

SEQ ID NO: 3831407 - RNA, 20 nt, Shigella flexneri 2a str. 2457T
auuuuucacuuaaugaauca

SEQ ID NO: 3831408 - RNA, 16 nt, Shigella flexneri 2a str. 2457T
auuuuuccagcauuuc

SEQ ID NO: 3831409 - RNA, 16 nt, Shigella flexneri 2a str. 2457T
auuuuucgcuaaaaaa

SEQ ID NO: 3831410 - RNA, 19 nt, Shigella flexneri 2a str. 2457T
auuuuucgugagagugaag

SEQ ID NO: 3831411 - RNA, 16 nt, Shigella flexneri 2a str. 2457T
auuuuugacuagugau

SEQ ID NO: 3831412 - RNA, 23 nt, Shigella flexneri 2a str. 2457T
auuuuuuaacugacuuucguuug

SEQ ID NO: 3831413 - RNA, 13 nt, Shigella flexneri 2a str. 2457T
auuuuuuauagua

SEQ ID NO: 3831414 - RNA, 21 nt, Shigella flexneri 2a str. 2457T
auuuuuuauuguccgguuuaa

SEQ ID NO: 3831415 - RNA, 12 nt, Shigella flexneri 2a str. 2457T
auuuuuucccau

SEQ ID NO: 3831416 - RNA, 20 nt, Shigella flexneri 2a str. 2457T
auuuuuuccgcaaaaacgac

SEQ ID NO: 3831417 - RNA, 16 nt, Shigella flexneri 2a str. 2457T
auuuuuucgacaucaa

SEQ ID NO: 3831418 - RNA, 22 nt, Shigella flexneri 2a str. 2457T
auuuuuuuaaucgucaguuuuu

SEQ ID NO: 3831419 - RNA, 22 nt, Shigella flexneri 2a str. 2457T
auuuuuuuaucauuucuggaag

SEQ ID NO: 3831420 - RNA, 18 nt, Shigella flexneri 2a str. 2457T
auuuuuuuauugauaaac

SEQ ID NO: 3831421 - RNA, 21 nt, Shigella flexneri 2a str. 2457T
auuuuuuuucaggaaauaaau

SEQ ID NO: 3831422 - RNA, 12 nt, Shigella flexneri 2a str. 2457T
auuuuuuuuccg

SEQ ID NO: 3831423 - RNA, 22 nt, Shigella flexneri 2a str. 2457T
auuuuuuuuccgguuaaccuuu

SEQ ID NO: 3831424 - RNA, 12 nt, Shigella flexneri 2a str. 2457T
caaaaaaacaua

SEQ ID NO: 3831425 - RNA, 19 nt, Shigella flexneri 2a str. 2457T
caaaaaaaccgccucaggc

SEQ ID NO: 3831426 - RNA, 21 nt, Shigella flexneri 2a str. 2457T
caaaaaacaaaccccguacag

SEQ ID NO: 3831427 - RNA, 21 nt, Shigella flexneri 2a str. 2457T
caaaaaacauugauuaaguga

SEQ ID NO: 3831428 - RNA, 19 nt, Shigella flexneri 2a str. 2457T
caaaaaaggccgcaggcug

SEQ ID NO: 3831429 - RNA, 17 nt, Shigella flexneri 2a str. 2457T
caaaaaaggcugacaaa

SEQ ID NO: 3831430 - RNA, 20 nt, Shigella flexneri 2a str. 2457T
caaaaaaggcugacaaauca

SEQ ID NO: 3831431 - RNA, 13 nt, Shigella flexneri 2a str. 2457T
caaaaaauagcaa

SEQ ID NO: 3831432 - RNA, 19 nt, Shigella flexneri 2a str. 2457T
caaaaaaucaacgacaaaa

SEQ ID NO: 3831433 - RNA, 12 nt, Shigella flexneri 2a str. 2457T
caaaaaaugaaa

SEQ ID NO: 3831434 - RNA, 14 nt, Shigella flexneri 2a str. 2457T
caaaaaaugaaacu

SEQ ID NO: 3831435 - RNA, 16 nt, Shigella flexneri 2a str. 2457T
caaaaacaucgcgaau

SEQ ID NO: 3831436 - RNA, 19 nt, Shigella flexneri 2a str. 2457T
caaaaacauugccguaagc

SEQ ID NO: 3831437 - RNA, 16 nt, Shigella flexneri 2a str. 2457T
caaaaacccuucuucc

SEQ ID NO: 3831438 - RNA, 20 nt, Shigella flexneri 2a str. 2457T
caaaaacgcgguugccagau

SEQ ID NO: 3831439 - RNA, 21 nt, Shigella flexneri 2a str. 2457T
caaaaacuaauucaccuugcu

SEQ ID NO: 3831440 - RNA, 13 nt, Shigella flexneri 2a str. 2457T
caaaaacuuccau

SEQ ID NO: 3831441 - RNA, 17 nt, Shigella flexneri 2a str. 2457T
caaaaacuucggcgcga

SEQ ID NO: 3831442 - RNA, 21 nt, Shigella flexneri 2a str. 2457T
caaaaaguaguuccagcauga

SEQ ID NO: 3831443 - RNA, 15 nt, Shigella flexneri 2a str. 2457T
caaaaaguccaaaag

SEQ ID NO: 3831444 - RNA, 17 nt, Shigella flexneri 2a str. 2457T
caaaaaguccaaaaggu

SEQ ID NO: 3831445 - RNA, 13 nt, Shigella flexneri 2a str. 2457T
caaaaauaaaugc

SEQ ID NO: 3831446 - RNA, 14 nt, Shigella flexneri 2a str. 2457T
caaaaauaaucauc

SEQ ID NO: 3831447 - RNA, 15 nt, Shigella flexneri 2a str. 2457T
caaaaauaaucaucu

SEQ ID NO: 3831448 - RNA, 21 nt, Shigella flexneri 2a str. 2457T
caaaaauaccaccaaugucga

SEQ ID NO: 3831449 - RNA, 12 nt, Shigella flexneri 2a str. 2457T
caaaaaucgaca

SEQ ID NO: 3831450 - RNA, 17 nt, Shigella flexneri 2a str. 2457T
caaaaaucgacagcagg

SEQ ID NO: 3831451 - RNA, 19 nt, Shigella flexneri 2a str. 2457T
caaaaaucgcaaauugacu

SEQ ID NO: 3831452 - RNA, 12 nt, Shigella flexneri 2a str. 2457T
caaaaaucggca

SEQ ID NO: 3831453 - RNA, 16 nt, Shigella flexneri 2a str. 2457T
caaaaaucggcaacau

SEQ ID NO: 3831454 - RNA, 18 nt, Shigella flexneri 2a str. 2457T
caaaaaucggcaacauua

SEQ ID NO: 3831455 - RNA, 21 nt, Shigella flexneri 2a str. 2457T
caaaaaucggcaacauuaaau

SEQ ID NO: 3831456 - RNA, 23 nt, Shigella flexneri 2a str. 2457T
caaaacacucuucaacacacuga

SEQ ID NO: 3831457 - RNA, 19 nt, Shigella flexneri 2a str. 2457T
caaaacagcgacaccagcc

SEQ ID NO: 3831458 - RNA, 20 nt, Shigella flexneri 2a str. 2457T
caaaaccacagugacccgca

SEQ ID NO: 3831459 - RNA, 20 nt, Shigella flexneri 2a str. 2457T
caaaaccgagaagcuuaccg

SEQ ID NO: 3831460 - RNA, 16 nt, Shigella flexneri 2a str. 2457T
caaaaccucuuccagc

SEQ ID NO: 3831461 - RNA, 21 nt, Shigella flexneri 2a str. 2457T
caaaaccucuuccagcagaua

SEQ ID NO: 3831462 - RNA, 12 nt, Shigella flexneri 2a str. 2457T
caaaaccugcuu

SEQ ID NO: 3831463 - RNA, 22 nt, Shigella flexneri 2a str. 2457T
caaaaccugguugguacugugg

SEQ ID NO: 3831464 - RNA, 17 nt, Shigella flexneri 2a str. 2457T
caaaacgaauaauugcu

SEQ ID NO: 3831465 - RNA, 16 nt, Shigella flexneri 2a str. 2457T
caaaacgugacagcau

SEQ ID NO: 3831466 - RNA, 20 nt, Shigella flexneri 2a str. 2457T
caaaacguggccuccaaaaa

SEQ ID NO: 3831467 - RNA, 14 nt, Shigella flexneri 2a str. 2457T
caaaacugccugau

SEQ ID NO: 3831468 - RNA, 20 nt, Shigella flexneri 2a str. 2457T
caaaagaugcgcugaguauc

SEQ ID NO: 3831469 - RNA, 20 nt, Shigella flexneri 2a str. 2457T
caaaagccccggaauucuca

SEQ ID NO: 3831470 - RNA, 22 nt, Shigella flexneri 2a str. 2457T
caaaagccccggaauucucaaa

SEQ ID NO: 3831471 - RNA, 13 nt, Shigella flexneri 2a str. 2457T
caaaagcugggau

SEQ ID NO: 3831472 - RNA, 18 nt, Shigella flexneri 2a str. 2457T
caaaaggcaauucaauua

SEQ ID NO: 3831473 - RNA, 14 nt, Shigella flexneri 2a str. 2457T
caaaagguccuuca

SEQ ID NO: 3831474 - RNA, 15 nt, Shigella flexneri 2a str. 2457T
caaaagguccuucag

SEQ ID NO: 3831475 - RNA, 17 nt, Shigella flexneri 2a str. 2457T
caaaaguagccauuuga

SEQ ID NO: 3831476 - RNA, 23 nt, Shigella flexneri 2a str. 2457T
caaaauaauaaauuaacugcgcg

SEQ ID NO: 3831477 - RNA, 13 nt, Shigella flexneri 2a str. 2457T
caaaauaccaaua

SEQ ID NO: 3831478 - RNA, 21 nt, Shigella flexneri 2a str. 2457T
caaaauacguucucaccucug

SEQ ID NO: 3831479 - RNA, 19 nt, Shigella flexneri 2a str. 2457T
caaaauagccaaucauucc

SEQ ID NO: 3831480 - RNA, 20 nt, Shigella flexneri 2a str. 2457T
caaaauagccaaucauuccc

SEQ ID NO: 3831481 - RNA, 18 nt, Shigella flexneri 2a str. 2457T
caaaauagguaucguaau

SEQ ID NO: 3831482 - RNA, 21 nt, Shigella flexneri 2a str. 2457T
caaaaucaggccgaggcacag

SEQ ID NO: 3831483 - RNA, 14 nt, Shigella flexneri 2a str. 2457T
caaaauccaccagu

SEQ ID NO: 3831484 - RNA, 19 nt, Shigella flexneri 2a str. 2457T
caaaauccauuuucuauuu

SEQ ID NO: 3831485 - RNA, 15 nt, Shigella flexneri 2a str. 2457T
caaaauccgccaccg

SEQ ID NO: 3831486 - RNA, 15 nt, Shigella flexneri 2a str. 2457T
caaaauccugccagc

SEQ ID NO: 3831487 - RNA, 16 nt, Shigella flexneri 2a str. 2457T
caaaaucguaagcagg

SEQ ID NO: 3831488 - RNA, 14 nt, Shigella flexneri 2a str. 2457T
caaaaucuucguua

SEQ ID NO: 3831489 - RNA, 17 nt, Shigella flexneri 2a str. 2457T
caaagcguuuugccagu

SEQ ID NO: 3831490 - RNA, 20 nt, Shigella flexneri 2a str. 2457T
caaagcugguggcaagaccu

SEQ ID NO: 3831491 - RNA, 18 nt, Shigella flexneri 2a str. 2457T
caaagcuguaucccagcc

SEQ ID NO: 3831492 - RNA, 18 nt, Shigella flexneri 2a str. 2457T
caaagcugucaccaauca

SEQ ID NO: 3831493 - RNA, 13 nt, Shigella flexneri 2a str. 2457T
caaaggccagcaa

SEQ ID NO: 3831494 - RNA, 14 nt, Shigella flexneri 2a str. 2457T
caaaggccagcaau

SEQ ID NO: 3831495 - RNA, 21 nt, Shigella flexneri 2a str. 2457T
caaaggccuugaacaaacaau

SEQ ID NO: 3831496 - RNA, 16 nt, Shigella flexneri 2a str. 2457T
caaaggcgugaacuuc

SEQ ID NO: 3831497 - RNA, 21 nt, Shigella flexneri 2a str. 2457T
caaaggcguuauacugcggca

SEQ ID NO: 3831498 - RNA, 10 nt, Shigella flexneri 2a str. 2457T
caaagggagc

SEQ ID NO: 3831499 - RNA, 21 nt, Shigella flexneri 2a str. 2457T
caaagggcgucgcuuaauuga

SEQ ID NO: 3831500 - RNA, 21 nt, Shigella flexneri 2a str. 2457T
caaaggguuuuugagucacau

SEQ ID NO: 3831501 - RNA, 22 nt, Shigella flexneri 2a str. 2457T
caaagguaauggucaguacgcc

SEQ ID NO: 3831502 - RNA, 18 nt, Shigella flexneri 2a str. 2457T
caaaguaaaaaagggcga

SEQ ID NO: 3831503 - RNA, 17 nt, Shigella flexneri 2a str. 2457T
caaaguacggacgcggc

SEQ ID NO: 3831504 - RNA, 16 nt, Shigella flexneri 2a str. 2457T
caaagugaauacagaa

SEQ ID NO: 3831505 - RNA, 17 nt, Shigella flexneri 2a str. 2457T
caaagugaauacagaac

SEQ ID NO: 3831506 - RNA, 21 nt, Shigella flexneri 2a str. 2457T
caaagugagcuuuguucaugc

SEQ ID NO: 3831507 - RNA, 19 nt, Shigella flexneri 2a str. 2457T
caaagugauauccaccgcg

SEQ ID NO: 3831508 - RNA, 20 nt, Shigella flexneri 2a str. 2457T
caaaguggaugaucgcggca

SEQ ID NO: 3831509 - RNA, 13 nt, Shigella flexneri 2a str. 2457T
caaaguuaccgga

SEQ ID NO: 3831510 - RNA, 20 nt, Shigella flexneri 2a str. 2457T
caaaguuugugaucuuuuuc

SEQ ID NO: 3831511 - RNA, 18 nt, Shigella flexneri 2a str. 2457T
caaauaaaaaaugagaau

SEQ ID NO: 3831512 - RNA, 12 nt, Shigella flexneri 2a str. 2457T
caaauaaaacau

SEQ ID NO: 3831513 - RNA, 13 nt, Shigella flexneri 2a str. 2457T
caaauaaaauccc

SEQ ID NO: 3831514 - RNA, 21 nt, Shigella flexneri 2a str. 2457T
caaauaaccgguauuacucca

SEQ ID NO: 3831515 - RNA, 22 nt, Shigella flexneri 2a str. 2457T
caaauaauuacuucgccggaau

SEQ ID NO: 3831516 - RNA, 21 nt, Shigella flexneri 2a str. 2457T
caaauacauugauauacagcc

SEQ ID NO: 3831517 - RNA, 19 nt, Shigella flexneri 2a str. 2457T
caaauacgcuuuuucccug

SEQ ID NO: 3831518 - RNA, 14 nt, Shigella flexneri 2a str. 2457T
caaauacugacugg

SEQ ID NO: 3831519 - RNA, 16 nt, Shigella flexneri 2a str. 2457T
caaauacuucaauaua

SEQ ID NO: 3831520 - RNA, 17 nt, Shigella flexneri 2a str. 2457T
caaauagccaauuccca

SEQ ID NO: 3831521 - RNA, 15 nt, Shigella flexneri 2a str. 2457T
caaauagccagcaga

SEQ ID NO: 3831522 - RNA, 20 nt, Shigella flexneri 2a str. 2457T
caaauagugccuggcugcgu

SEQ ID NO: 3831523 - RNA, 21 nt, Shigella flexneri 2a str. 2457T
caaauagugccuggcugcgug

SEQ ID NO: 3831524 - RNA, 20 nt, Shigella flexneri 2a str. 2457T
caaauauacauaaagucuuu

SEQ ID NO: 3831525 - RNA, 21 nt, Shigella flexneri 2a str. 2457T
caaauaucuauuucaggucaa

SEQ ID NO: 3831526 - RNA, 18 nt, Shigella flexneri 2a str. 2457T
caaauaucuuauagacua

SEQ ID NO: 3831527 - RNA, 13 nt, Shigella flexneri 2a str. 2457T
caaaucacccugu

SEQ ID NO: 3831528 - RNA, 13 nt, Shigella flexneri 2a str. 2457T
caaaucacuauua

SEQ ID NO: 3831529 - RNA, 20 nt, Shigella flexneri 2a str. 2457T
caaaucacuauuaaagaaag

SEQ ID NO: 3831530 - RNA, 16 nt, Shigella flexneri 2a str. 2457T
caaaucagaggcuguu

SEQ ID NO: 3831531 - RNA, 14 nt, Shigella flexneri 2a str. 2457T
caaaucaucaguac

SEQ ID NO: 3831532 - RNA, 16 nt, Shigella flexneri 2a str. 2457T
caaaucauccagaccg

SEQ ID NO: 3831533 - RNA, 16 nt, Shigella flexneri 2a str. 2457T
caaauccagcgccaca

SEQ ID NO: 3831534 - RNA, 18 nt, Shigella flexneri 2a str. 2457T
caaauccaucagaccuuc

SEQ ID NO: 3831535 - RNA, 18 nt, Shigella flexneri 2a str. 2457T
caaaucccgugaugcggu

SEQ ID NO: 3831536 - RNA, 14 nt, Shigella flexneri 2a str. 2457T
caaauccgcacuca

SEQ ID NO: 3831537 - RNA, 17 nt, Shigella flexneri 2a str. 2457T
caaauccgcacucaucu

SEQ ID NO: 3831538 - RNA, 15 nt, Shigella flexneri 2a str. 2457T
caaauccgcuguaau

SEQ ID NO: 3831539 - RNA, 15 nt, Shigella flexneri 2a str. 2457T
caaauccuucagacu

SEQ ID NO: 3831540 - RNA, 19 nt, Shigella flexneri 2a str. 2457T
caaaucgauaaaacuuccc

SEQ ID NO: 3831541 - RNA, 15 nt, Shigella flexneri 2a str. 2457T
caaaucgcggcagug

SEQ ID NO: 3831542 - RNA, 13 nt, Shigella flexneri 2a str. 2457T
caaaucgcugaau

SEQ ID NO: 3831543 - RNA, 16 nt, Shigella flexneri 2a str. 2457T
caaaucguauccggca

SEQ ID NO: 3831544 - RNA, 19 nt, Shigella flexneri 2a str. 2457T
caaaucguauccggcauua

SEQ ID NO: 3831545 - RNA, 22 nt, Shigella flexneri 2a str. 2457T
caaaucucccuugcgggaucag

SEQ ID NO: 3831546 - RNA, 19 nt, Shigella flexneri 2a str. 2457T
caaaucugauuaauauuga

SEQ ID NO: 3831547 - RNA, 13 nt, Shigella flexneri 2a str. 2457T
caaaucugccgau

SEQ ID NO: 3831548 - RNA, 14 nt, Shigella flexneri 2a str. 2457T
caaaucuuuucugc

SEQ ID NO: 3831549 - RNA, 15 nt, Shigella flexneri 2a str. 2457T
caaaugaacaccaaa

SEQ ID NO: 3831550 - RNA, 20 nt, Shigella flexneri 2a str. 2457T
caaaugaacaccaaacccug

SEQ ID NO: 3831551 - RNA, 12 nt, Shigella flexneri 2a str. 2457T
caaaugaggcuu

SEQ ID NO: 3831552 - RNA, 20 nt, Shigella flexneri 2a str. 2457T
caaaugcagcauugccugau

SEQ ID NO: 3831553 - RNA, 15 nt, Shigella flexneri 2a str. 2457T
caaaugcaucaguga

SEQ ID NO: 3831554 - RNA, 21 nt, Shigella flexneri 2a str. 2457T
caaaugcaucagugacaaauu

SEQ ID NO: 3831555 - RNA, 14 nt, Shigella flexneri 2a str. 2457T
caaaugcgccgcca

SEQ ID NO: 3831556 - RNA, 21 nt, Shigella flexneri 2a str. 2457T
caaaugcgcuuuauucagacg

SEQ ID NO: 3831557 - RNA, 16 nt, Shigella flexneri 2a str. 2457T
caaauggcaaugacua

SEQ ID NO: 3831558 - RNA, 18 nt, Shigella flexneri 2a str. 2457T
caaauguugcaucgccug

SEQ ID NO: 3831559 - RNA, 17 nt, Shigella flexneri 2a str. 2457T
caaauuaaacgggcgau

SEQ ID NO: 3831560 - RNA, 20 nt, Shigella flexneri 2a str. 2457T
caaauuacgauccaccaccg

SEQ ID NO: 3831561 - RNA, 19 nt, Shigella flexneri 2a str. 2457T
caaauucucuauuucaccc

SEQ ID NO: 3831562 - RNA, 12 nt, Shigella flexneri 2a str. 2457T
caaauucuuaau

SEQ ID NO: 3831563 - RNA, 17 nt, Shigella flexneri 2a str. 2457T
caaauucuucacggaaa

SEQ ID NO: 3831564 - RNA, 19 nt, Shigella flexneri 2a str. 2457T
caaauucuuuaucgauaaa

SEQ ID NO: 3831565 - RNA, 16 nt, Shigella flexneri 2a str. 2457T
caaauugacuacacca

SEQ ID NO: 3831566 - RNA, 15 nt, Shigella flexneri 2a str. 2457T
caaauugcaccaucc

SEQ ID NO: 3831567 - RNA, 17 nt, Shigella flexneri 2a str. 2457T
caaauuuugaacagaac

SEQ ID NO: 3831568 - RNA, 19 nt, Shigella flexneri 2a str. 2457T
caacaaaaaucucgacuuc

SEQ ID NO: 3831569 - RNA, 19 nt, Shigella flexneri 2a str. 2457T
caacaaaauagaauccgcg

SEQ ID NO: 3831570 - RNA, 15 nt, Shigella flexneri 2a str. 2457T
caacaaacgauuuau

SEQ ID NO: 3831571 - RNA, 14 nt, Shigella flexneri 2a str. 2457T
caacaaacgcugac

SEQ ID NO: 3831572 - RNA, 19 nt, Shigella flexneri 2a str. 2457T
caacaaagccacuuaauaa

SEQ ID NO: 3831573 - RNA, 12 nt, Shigella flexneri 2a str. 2457T
caacaaagcgcg

SEQ ID NO: 3831574 - RNA, 13 nt, Shigella flexneri 2a str. 2457T
caacaaaguugca

SEQ ID NO: 3831575 - RNA, 15 nt, Shigella flexneri 2a str. 2457T
caacaaauaaaagca

SEQ ID NO: 3831576 - RNA, 18 nt, Shigella flexneri 2a str. 2457T
caacaaauaaaagcaaaa

SEQ ID NO: 3831577 - RNA, 12 nt, Shigella flexneri 2a str. 2457T
caacaacaccca

SEQ ID NO: 3831578 - RNA, 13 nt, Shigella flexneri 2a str. 2457T
caacaacacccau

SEQ ID NO: 3831579 - RNA, 11 nt, Shigella flexneri 2a str. 2457T
caacaacgcaa

SEQ ID NO: 3831580 - RNA, 18 nt, Shigella flexneri 2a str. 2457T
caacaacgcaacuccagc

SEQ ID NO: 3831581 - RNA, 12 nt, Shigella flexneri 2a str. 2457T
caacaacugaaa

SEQ ID NO: 3831582 - RNA, 14 nt, Shigella flexneri 2a str. 2457T
caacaacugaaaaa

SEQ ID NO: 3831583 - RNA, 15 nt, Shigella flexneri 2a str. 2457T
caacaacugaaaaaa

SEQ ID NO: 3831584 - RNA, 16 nt, Shigella flexneri 2a str. 2457T
caacaacugaaaaaaa

SEQ ID NO: 3831585 - RNA, 10 nt, Shigella flexneri 2a str. 2457T
caacaacugg

SEQ ID NO: 3831586 - RNA, 16 nt, Shigella flexneri 2a str. 2457T
caacaaggcaucguga

SEQ ID NO: 3831587 - RNA, 15 nt, Shigella flexneri 2a str. 2457T
caacgacggccaguu

SEQ ID NO: 3831588 - RNA, 16 nt, Shigella flexneri 2a str. 2457T
caacgacggccaguug

SEQ ID NO: 3831589 - RNA, 18 nt, Shigella flexneri 2a str. 2457T
caacgacguaccaacuga

SEQ ID NO: 3831590 - RNA, 15 nt, Shigella flexneri 2a str. 2457T
caacgagauaaaauu

SEQ ID NO: 3831591 - RNA, 12 nt, Shigella flexneri 2a str. 2457T
caacgagccaau

SEQ ID NO: 3831592 - RNA, 14 nt, Shigella flexneri 2a str. 2457T
caacgaguaagagg

SEQ ID NO: 3831593 - RNA, 18 nt, Shigella flexneri 2a str. 2457T
caacgcaaagagagaagc

SEQ ID NO: 3831594 - RNA, 20 nt, Shigella flexneri 2a str. 2457T
caacgcaaagagagaagcca

SEQ ID NO: 3831595 - RNA, 16 nt, Shigella flexneri 2a str. 2457T
caacgcaaaggcuuuu

SEQ ID NO: 3831596 - RNA, 19 nt, Shigella flexneri 2a str. 2457T
caacgcaauaaacuucugg

SEQ ID NO: 3831597 - RNA, 20 nt, Shigella flexneri 2a str. 2457T
caacgcaauauccgccacuu

SEQ ID NO: 3831598 - RNA, 15 nt, Shigella flexneri 2a str. 2457T
caacgccagcagcag

SEQ ID NO: 3831599 - RNA, 17 nt, Shigella flexneri 2a str. 2457T
caacgcccagcgcgcgg

SEQ ID NO: 3831600 - RNA, 17 nt, Shigella flexneri 2a str. 2457T
caacgccccuucugccg

SEQ ID NO: 3831601 - RNA, 15 nt, Shigella flexneri 2a str. 2457T
caacgccgccagacc

SEQ ID NO: 3831602 - RNA, 16 nt, Shigella flexneri 2a str. 2457T
caacgccgccagacca

SEQ ID NO: 3831603 - RNA, 19 nt, Shigella flexneri 2a str. 2457T
caacgccguaaguaaggcg

SEQ ID NO: 3831604 - RNA, 23 nt, Shigella flexneri 2a str. 2457T
caacgccuaaacuaaucgacagu

SEQ ID NO: 3831605 - RNA, 20 nt, Shigella flexneri 2a str. 2457T
caacgccuuccgucagcaaa

SEQ ID NO: 3831606 - RNA, 14 nt, Shigella flexneri 2a str. 2457T
caacgccuucuucg

SEQ ID NO: 3831607 - RNA, 14 nt, Shigella flexneri 2a str. 2457T
caacgcgccaccga

SEQ ID NO: 3831608 - RNA, 13 nt, Shigella flexneri 2a str. 2457T
caacgcgcgguga

SEQ ID NO: 3831609 - RNA, 17 nt, Shigella flexneri 2a str. 2457T
caacgcugaauggcgau

SEQ ID NO: 3831610 - RNA, 18 nt, Shigella flexneri 2a str. 2457T
caacggaacgaaaaaaau

SEQ ID NO: 3831611 - RNA, 22 nt, Shigella flexneri 2a str. 2457T
caacggaccaauaaacgccagg

SEQ ID NO: 3831612 - RNA, 19 nt, Shigella flexneri 2a str. 2457T
caacggaggauuuuucgcg

SEQ ID NO: 3831613 - RNA, 15 nt, Shigella flexneri 2a str. 2457T
caacggauauuguuu

SEQ ID NO: 3831614 - RNA, 15 nt, Shigella flexneri 2a str. 2457T
caacggcaaacacgc

SEQ ID NO: 3831615 - RNA, 21 nt, Shigella flexneri 2a str. 2457T
caacggcaacaauucccgcag

SEQ ID NO: 3831616 - RNA, 19 nt, Shigella flexneri 2a str. 2457T
caacggccaaauauccgcg

SEQ ID NO: 3831617 - RNA, 18 nt, Shigella flexneri 2a str. 2457T
caacggcgagccagcgca

SEQ ID NO: 3831618 - RNA, 22 nt, Shigella flexneri 2a str. 2457T
caacggcggaucaccgcgucuu

SEQ ID NO: 3831619 - RNA, 15 nt, Shigella flexneri 2a str. 2457T
caacgggcugaagaa

SEQ ID NO: 3831620 - RNA, 18 nt, Shigella flexneri 2a str. 2457T
caacggugcggcucucuu

SEQ ID NO: 3831621 - RNA, 16 nt, Shigella flexneri 2a str. 2457T
caacgguucgccauca

SEQ ID NO: 3831622 - RNA, 18 nt, Shigella flexneri 2a str. 2457T
caacgguugcggaaccca

SEQ ID NO: 3831623 - RNA, 14 nt, Shigella flexneri 2a str. 2457T
caacguaacaaaac

SEQ ID NO: 3831624 - RNA, 15 nt, Shigella flexneri 2a str. 2457T
caacguaacaaaacu

SEQ ID NO: 3831625 - RNA, 17 nt, Shigella flexneri 2a str. 2457T
caacguacucugccacu

SEQ ID NO: 3831626 - RNA, 13 nt, Shigella flexneri 2a str. 2457T
caacguagccugc

SEQ ID NO: 3831627 - RNA, 17 nt, Shigella flexneri 2a str. 2457T
caacguaguaucguaau

SEQ ID NO: 3831628 - RNA, 13 nt, Shigella flexneri 2a str. 2457T
caacguauauaac

SEQ ID NO: 3831629 - RNA, 17 nt, Shigella flexneri 2a str. 2457T
caacguaucaucgcuga

SEQ ID NO: 3831630 - RNA, 19 nt, Shigella flexneri 2a str. 2457T
caacguaucaucgcugaac

SEQ ID NO: 3831631 - RNA, 19 nt, Shigella flexneri 2a str. 2457T
caacguauuacgaucaaga

SEQ ID NO: 3831632 - RNA, 21 nt, Shigella flexneri 2a str. 2457T
caacgugaccaguaccaccgc

SEQ ID NO: 3831633 - RNA, 21 nt, Shigella flexneri 2a str. 2457T
caacgugacucaauggcaucc

SEQ ID NO: 3831634 - RNA, 13 nt, Shigella flexneri 2a str. 2457T
caacgugcuucgc

SEQ ID NO: 3831635 - RNA, 22 nt, Shigella flexneri 2a str. 2457T
caacguggaacaaauagacaca

SEQ ID NO: 3831636 - RNA, 17 nt, Shigella flexneri 2a str. 2457T
caacgugguuugcggca

SEQ ID NO: 3831637 - RNA, 17 nt, Shigella flexneri 2a str. 2457T
caacguguuuguucaac

SEQ ID NO: 3831638 - RNA, 19 nt, Shigella flexneri 2a str. 2457T
caacguguuuguucaacga

SEQ ID NO: 3831639 - RNA, 21 nt, Shigella flexneri 2a str. 2457T
caacguucagcaucuggaaag

SEQ ID NO: 3831640 - RNA, 17 nt, Shigella flexneri 2a str. 2457T
caacucauuuacagaaa

SEQ ID NO: 3831641 - RNA, 14 nt, Shigella flexneri 2a str. 2457T
caacuccaccagca

SEQ ID NO: 3831642 - RNA, 16 nt, Shigella flexneri 2a str. 2457T
caacuccagaauaccg

SEQ ID NO: 3831643 - RNA, 23 nt, Shigella flexneri 2a str. 2457T
caacuccagcuuagcauccccau

SEQ ID NO: 3831644 - RNA, 15 nt, Shigella flexneri 2a str. 2457T
caacuccaucaagcu

SEQ ID NO: 3831645 - RNA, 19 nt, Shigella flexneri 2a str. 2457T
caacuccccgcauuuacuc

SEQ ID NO: 3831646 - RNA, 17 nt, Shigella flexneri 2a str. 2457T
caacucugggcugaaga

SEQ ID NO: 3831647 - RNA, 16 nt, Shigella flexneri 2a str. 2457T
caacucuuuuuccugc

SEQ ID NO: 3831648 - RNA, 12 nt, Shigella flexneri 2a str. 2457T
caacugacugac

SEQ ID NO: 3831649 - RNA, 21 nt, Shigella flexneri 2a str. 2457T
caacugacugacuucaacagg

SEQ ID NO: 3831650 - RNA, 17 nt, Shigella flexneri 2a str. 2457T
caacugauaaaccuuca

SEQ ID NO: 3831651 - RNA, 14 nt, Shigella flexneri 2a str. 2457T
caacugcauuauua

SEQ ID NO: 3831652 - RNA, 12 nt, Shigella flexneri 2a str. 2457T
caacugccugau

SEQ ID NO: 3831653 - RNA, 15 nt, Shigella flexneri 2a str. 2457T
caacugccugaugcg

SEQ ID NO: 3831654 - RNA, 17 nt, Shigella flexneri 2a str. 2457T
caacugcgacguggauc

SEQ ID NO: 3831655 - RNA, 23 nt, Shigella flexneri 2a str. 2457T
caacugcugacgcagauccugau

SEQ ID NO: 3831656 - RNA, 23 nt, Shigella flexneri 2a str. 2457T
caacugcugcgguugaacgccaa

SEQ ID NO: 3831657 - RNA, 14 nt, Shigella flexneri 2a str. 2457T
caacugcuguuaau

SEQ ID NO: 3831658 - RNA, 18 nt, Shigella flexneri 2a str. 2457T
caacugcuuuuugcucuc

SEQ ID NO: 3831659 - RNA, 21 nt, Shigella flexneri 2a str. 2457T
caacuggagcaggaacuuggc

SEQ ID NO: 3831660 - RNA, 19 nt, Shigella flexneri 2a str. 2457T
caacugggacaugauucau

SEQ ID NO: 3831661 - RNA, 22 nt, Shigella flexneri 2a str. 2457T
caacuguaacgcagaagguuau

SEQ ID NO: 3831662 - RNA, 20 nt, Shigella flexneri 2a str. 2457T
caacuuaacuugcuuaaaaa

SEQ ID NO: 3831663 - RNA, 23 nt, Shigella flexneri 2a str. 2457T
caacuuaacuugcuuaaaaaauc

SEQ ID NO: 3831664 - RNA, 17 nt, Shigella flexneri 2a str. 2457T
caacuuaagucuccauu

SEQ ID NO: 3831665 - RNA, 20 nt, Shigella flexneri 2a str. 2457T
caacuuaaucaucaaugcca

SEQ ID NO: 3831666 - RNA, 18 nt, Shigella flexneri 2a str. 2457T
caacuucaaggucaacau

SEQ ID NO: 3831667 - RNA, 13 nt, Shigella flexneri 2a str. 2457T
caacuucaugacc

SEQ ID NO: 3831668 - RNA, 18 nt, Shigella flexneri 2a str. 2457T
caacuucgauugcgugau

SEQ ID NO: 3831669 - RNA, 16 nt, Shigella flexneri 2a str. 2457T
caacuucgcuaaaucu

SEQ ID NO: 3831670 - RNA, 12 nt, Shigella flexneri 2a str. 2457T
caacuucugcug

SEQ ID NO: 3831671 - RNA, 13 nt, Shigella flexneri 2a str. 2457T
caacuugccggau

SEQ ID NO: 3831672 - RNA, 14 nt, Shigella flexneri 2a str. 2457T
caacuuucacgcgc

SEQ ID NO: 3831673 - RNA, 16 nt, Shigella flexneri 2a str. 2457T
caacuuucuuggcacc

SEQ ID NO: 3831674 - RNA, 15 nt, Shigella flexneri 2a str. 2457T
caagaacagccuuaa

SEQ ID NO: 3831675 - RNA, 20 nt, Shigella flexneri 2a str. 2457T
caagaacagccuuaaacuca

SEQ ID NO: 3831676 - RNA, 14 nt, Shigella flexneri 2a str. 2457T
caagaacgaugauu

SEQ ID NO: 3831677 - RNA, 22 nt, Shigella flexneri 2a str. 2457T
caagaacgcauaccccaucagc

SEQ ID NO: 3831678 - RNA, 17 nt, Shigella flexneri 2a str. 2457T
caagaauacagggaaag

SEQ ID NO: 3831679 - RNA, 20 nt, Shigella flexneri 2a str. 2457T
caagaaucaugccaaaaaua

SEQ ID NO: 3831680 - RNA, 17 nt, Shigella flexneri 2a str. 2457T
caagaaugaccgccugc

SEQ ID NO: 3831681 - RNA, 21 nt, Shigella flexneri 2a str. 2457T
caagacaucaauaaacaauga

SEQ ID NO: 3831682 - RNA, 16 nt, Shigella flexneri 2a str. 2457T
caagacgaaaaaugaa

SEQ ID NO: 3831683 - RNA, 16 nt, Shigella flexneri 2a str. 2457T
caagagacugcuggcu

SEQ ID NO: 3831684 - RNA, 15 nt, Shigella flexneri 2a str. 2457T
caagagcaaauaaaa

SEQ ID NO: 3831685 - RNA, 21 nt, Shigella flexneri 2a str. 2457T
caauaaugaugucaucaagcg

SEQ ID NO: 3831686 - RNA, 14 nt, Shigella flexneri 2a str. 2457T
caauaauggccuuu

SEQ ID NO: 3831687 - RNA, 17 nt, Shigella flexneri 2a str. 2457T
caauaauuucaacaggu

SEQ ID NO: 3831688 - RNA, 15 nt, Shigella flexneri 2a str. 2457T
caauaauuuuuucgc

SEQ ID NO: 3831689 - RNA, 17 nt, Shigella flexneri 2a str. 2457T
caauaauuuuuucgcca

SEQ ID NO: 3831690 - RNA, 21 nt, Shigella flexneri 2a str. 2457T
caauacaaaauuuaacaccau

SEQ ID NO: 3831691 - RNA, 20 nt, Shigella flexneri 2a str. 2457T
caauacaccuccggcugggc

SEQ ID NO: 3831692 - RNA, 22 nt, Shigella flexneri 2a str. 2457T
caauacagccagccagcaccag

SEQ ID NO: 3831693 - RNA, 23 nt, Shigella flexneri 2a str. 2457T
caauacagguuguugccuucacg

SEQ ID NO: 3831694 - RNA, 13 nt, Shigella flexneri 2a str. 2457T
caauacauagaaa

SEQ ID NO: 3831695 - RNA, 17 nt, Shigella flexneri 2a str. 2457T
caauacaucaauuuucc

SEQ ID NO: 3831696 - RNA, 17 nt, Shigella flexneri 2a str. 2457T
caauaccauuaucauug

SEQ ID NO: 3831697 - RNA, 13 nt, Shigella flexneri 2a str. 2457T
caauacccugacc

SEQ ID NO: 3831698 - RNA, 21 nt, Shigella flexneri 2a str. 2457T
caauaccgcccaccaccagcg

SEQ ID NO: 3831699 - RNA, 17 nt, Shigella flexneri 2a str. 2457T
caauaccgcccagacca

SEQ ID NO: 3831700 - RNA, 21 nt, Shigella flexneri 2a str. 2457T
caauaccgccugcaaauaaau

SEQ ID NO: 3831701 - RNA, 21 nt, Shigella flexneri 2a str. 2457T
caauaccgcguaauacaucag

SEQ ID NO: 3831702 - RNA, 12 nt, Shigella flexneri 2a str. 2457T
caauaccgucug

SEQ ID NO: 3831703 - RNA, 23 nt, Shigella flexneri 2a str. 2457T
caauaccuucugcgcccgcccgc

SEQ ID NO: 3831704 - RNA, 18 nt, Shigella flexneri 2a str. 2457T
caauacgauuaacgccag

SEQ ID NO: 3831705 - RNA, 16 nt, Shigella flexneri 2a str. 2457T
caauacgcccacguuu

SEQ ID NO: 3831706 - RNA, 17 nt, Shigella flexneri 2a str. 2457T
caauacugacaucagca

SEQ ID NO: 3831707 - RNA, 20 nt, Shigella flexneri 2a str. 2457T
caauacugacaucagcaucc

SEQ ID NO: 3831708 - RNA, 22 nt, Shigella flexneri 2a str. 2457T
caauacuggcaccgaagcccau

SEQ ID NO: 3831709 - RNA, 16 nt, Shigella flexneri 2a str. 2457T
caauacuuccgcuucc

SEQ ID NO: 3831710 - RNA, 19 nt, Shigella flexneri 2a str. 2457T
caauacuuucacaaaaaua

SEQ ID NO: 3831711 - RNA, 23 nt, Shigella flexneri 2a str. 2457T
caauacuuucacaaaaauaauuu

SEQ ID NO: 3831712 - RNA, 14 nt, Shigella flexneri 2a str. 2457T
caauagacaguucu

SEQ ID NO: 3831713 - RNA, 18 nt, Shigella flexneri 2a str. 2457T
caauagacaguucuuccu

SEQ ID NO: 3831714 - RNA, 13 nt, Shigella flexneri 2a str. 2457T
caauagcaacuga

SEQ ID NO: 3831715 - RNA, 14 nt, Shigella flexneri 2a str. 2457T
caauagcaacugau

SEQ ID NO: 3831716 - RNA, 22 nt, Shigella flexneri 2a str. 2457T
caauaguucuguugcugaaauu

SEQ ID NO: 3831717 - RNA, 16 nt, Shigella flexneri 2a str. 2457T
caauauauugcaauca

SEQ ID NO: 3831718 - RNA, 14 nt, Shigella flexneri 2a str. 2457T
caauaucaaauaaa

SEQ ID NO: 3831719 - RNA, 23 nt, Shigella flexneri 2a str. 2457T
caauauccaccgggguaaaucca

SEQ ID NO: 3831720 - RNA, 19 nt, Shigella flexneri 2a str. 2457T
caauauccgguucacuuca

SEQ ID NO: 3831721 - RNA, 13 nt, Shigella flexneri 2a str. 2457T
caauauccugacc

SEQ ID NO: 3831722 - RNA, 23 nt, Shigella flexneri 2a str. 2457T
caauauccugcgcuuccugcaac

SEQ ID NO: 3831723 - RNA, 15 nt, Shigella flexneri 2a str. 2457T
caauaugauaaaccu

SEQ ID NO: 3831724 - RNA, 13 nt, Shigella flexneri 2a str. 2457T
caauaugcauaaa

SEQ ID NO: 3831725 - RNA, 16 nt, Shigella flexneri 2a str. 2457T
caauauuaaucccugc

SEQ ID NO: 3831726 - RNA, 15 nt, Shigella flexneri 2a str. 2457T
caauauuaucgauuu

SEQ ID NO: 3831727 - RNA, 21 nt, Shigella flexneri 2a str. 2457T
caauauucuuuugcagcagcg

SEQ ID NO: 3831728 - RNA, 19 nt, Shigella flexneri 2a str. 2457T
caauauugaugcucacugc

SEQ ID NO: 3831729 - RNA, 11 nt, Shigella flexneri 2a str. 2457T
caauauuugca

SEQ ID NO: 3831730 - RNA, 12 nt, Shigella flexneri 2a str. 2457T
caauauuuugaa

SEQ ID NO: 3831731 - RNA, 19 nt, Shigella flexneri 2a str. 2457T
caauauuuuuaugccggau

SEQ ID NO: 3831732 - RNA, 14 nt, Shigella flexneri 2a str. 2457T
caaucaaaaaaggc

SEQ ID NO: 3831733 - RNA, 22 nt, Shigella flexneri 2a str. 2457T
caaucaaaaaaggcugacaaau

SEQ ID NO: 3831734 - RNA, 19 nt, Shigella flexneri 2a str. 2457T
caaucaaaaauggcuuuau

SEQ ID NO: 3831735 - RNA, 14 nt, Shigella flexneri 2a str. 2457T
caaucaaauacccu

SEQ ID NO: 3831736 - RNA, 15 nt, Shigella flexneri 2a str. 2457T
caaucaaauauucug

SEQ ID NO: 3831737 - RNA, 16 nt, Shigella flexneri 2a str. 2457T
caaucaaauauucugc

SEQ ID NO: 3831738 - RNA, 19 nt, Shigella flexneri 2a str. 2457T
caaucaaauauucugccca

SEQ ID NO: 3831739 - RNA, 22 nt, Shigella flexneri 2a str. 2457T
caaucaaauauucugcccaagc

SEQ ID NO: 3831740 - RNA, 12 nt, Shigella flexneri 2a str. 2457T
caaucaaaugac

SEQ ID NO: 3831741 - RNA, 19 nt, Shigella flexneri 2a str. 2457T
caaucaacaccacugccag

SEQ ID NO: 3831742 - RNA, 16 nt, Shigella flexneri 2a str. 2457T
caaucaaccagcacuu

SEQ ID NO: 3831743 - RNA, 15 nt, Shigella flexneri 2a str. 2457T
caaucacaaaaagua

SEQ ID NO: 3831744 - RNA, 17 nt, Shigella flexneri 2a str. 2457T
caaucacaaaaccgucg

SEQ ID NO: 3831745 - RNA, 15 nt, Shigella flexneri 2a str. 2457T
caaucacaauagaaa

SEQ ID NO: 3831746 - RNA, 16 nt, Shigella flexneri 2a str. 2457T
caaucacaucaccaua

SEQ ID NO: 3831747 - RNA, 21 nt, Shigella flexneri 2a str. 2457T
caaucacaucaucaucgccag

SEQ ID NO: 3831748 - RNA, 21 nt, Shigella flexneri 2a str. 2457T
caaucaccaugccgugaugcg

SEQ ID NO: 3831749 - RNA, 11 nt, Shigella flexneri 2a str. 2457T
caaucaccgca

SEQ ID NO: 3831750 - RNA, 17 nt, Shigella flexneri 2a str. 2457T
caaucaccgcaaacaua

SEQ ID NO: 3831751 - RNA, 17 nt, Shigella flexneri 2a str. 2457T
caaucaccgccagcaag

SEQ ID NO: 3831752 - RNA, 18 nt, Shigella flexneri 2a str. 2457T
caaucaccgccagcaagg

SEQ ID NO: 3831753 - RNA, 16 nt, Shigella flexneri 2a str. 2457T
caaucaccgccagcgg

SEQ ID NO: 3831754 - RNA, 17 nt, Shigella flexneri 2a str. 2457T
caaucaccgccagcggc

SEQ ID NO: 3831755 - RNA, 18 nt, Shigella flexneri 2a str. 2457T
caaucaccgccagcggcg

SEQ ID NO: 3831756 - RNA, 16 nt, Shigella flexneri 2a str. 2457T
caaucacgauagccag

SEQ ID NO: 3831757 - RNA, 15 nt, Shigella flexneri 2a str. 2457T
caaucacucaccugc

SEQ ID NO: 3831758 - RNA, 20 nt, Shigella flexneri 2a str. 2457T
caaucacuuccucaagcguu

SEQ ID NO: 3831759 - RNA, 21 nt, Shigella flexneri 2a str. 2457T
caaucagauaaaauacacuuu

SEQ ID NO: 3831760 - RNA, 12 nt, Shigella flexneri 2a str. 2457T
caaucagaugug

SEQ ID NO: 3831761 - RNA, 15 nt, Shigella flexneri 2a str. 2457T
caaucagcacacaua

SEQ ID NO: 3831762 - RNA, 14 nt, Shigella flexneri 2a str. 2457T
caaucagcaccgcg

SEQ ID NO: 3831763 - RNA, 12 nt, Shigella flexneri 2a str. 2457T
caaucagccaga

SEQ ID NO: 3831764 - RNA, 16 nt, Shigella flexneri 2a str. 2457T
caaucagcgcagcacc

SEQ ID NO: 3831765 - RNA, 19 nt, Shigella flexneri 2a str. 2457T
caaucagcgcagcacccag

SEQ ID NO: 3831766 - RNA, 14 nt, Shigella flexneri 2a str. 2457T
caaucaggcuaucg

SEQ ID NO: 3831767 - RNA, 21 nt, Shigella flexneri 2a str. 2457T
caaucagguaagcaaaggugc

SEQ ID NO: 3831768 - RNA, 22 nt, Shigella flexneri 2a str. 2457T
caaucagguaagcgauaaaaau

SEQ ID NO: 3831769 - RNA, 17 nt, Shigella flexneri 2a str. 2457T
caaucaguggcuugguu

SEQ ID NO: 3831770 - RNA, 13 nt, Shigella flexneri 2a str. 2457T
caaucauccauau

SEQ ID NO: 3831771 - RNA, 16 nt, Shigella flexneri 2a str. 2457T
caaucaucgaugcgau

SEQ ID NO: 3831772 - RNA, 14 nt, Shigella flexneri 2a str. 2457T
caaucauucccauu

SEQ ID NO: 3831773 - RNA, 13 nt, Shigella flexneri 2a str. 2457T
caauccagcccug

SEQ ID NO: 3831774 - RNA, 15 nt, Shigella flexneri 2a str. 2457T
caauccagcccugcc

SEQ ID NO: 3831775 - RNA, 23 nt, Shigella flexneri 2a str. 2457T
caauccaguacaugaagcacugc

SEQ ID NO: 3831776 - RNA, 13 nt, Shigella flexneri 2a str. 2457T
caauccccagaca

SEQ ID NO: 3831777 - RNA, 14 nt, Shigella flexneri 2a str. 2457T
caaucccccacuuu

SEQ ID NO: 3831778 - RNA, 14 nt, Shigella flexneri 2a str. 2457T
caauccccgccagc

SEQ ID NO: 3831779 - RNA, 18 nt, Shigella flexneri 2a str. 2457T
caauccccgccagcacga

SEQ ID NO: 3831780 - RNA, 16 nt, Shigella flexneri 2a str. 2457T
caauccccucuucagc

SEQ ID NO: 3831781 - RNA, 19 nt, Shigella flexneri 2a str. 2457T
caaucccggaagccaccac

SEQ ID NO: 3831782 - RNA, 18 nt, Shigella flexneri 2a str. 2457T
caaucccuuaguaacgcc

SEQ ID NO: 3831783 - RNA, 20 nt, Shigella flexneri 2a str. 2457T
caauuacugcauugaauuuc

SEQ ID NO: 3831784 - RNA, 22 nt, Shigella flexneri 2a str. 2457T
caauuagugggauucaccaauc

SEQ ID NO: 3831785 - RNA, 14 nt, Shigella flexneri 2a str. 2457T
caauuaucuggaau

SEQ ID NO: 3831786 - RNA, 20 nt, Shigella flexneri 2a str. 2457T
caauuaucuggaauuccuuu

SEQ ID NO: 3831787 - RNA, 22 nt, Shigella flexneri 2a str. 2457T
caauuaucuggaauuccuuucc

SEQ ID NO: 3831788 - RNA, 23 nt, Shigella flexneri 2a str. 2457T
caauucacacagugaaucucuua

SEQ ID NO: 3831789 - RNA, 20 nt, Shigella flexneri 2a str. 2457T
caauucacgaauauuucccg

SEQ ID NO: 3831790 - RNA, 13 nt, Shigella flexneri 2a str. 2457T
caauuccauuucc

SEQ ID NO: 3831791 - RNA, 21 nt, Shigella flexneri 2a str. 2457T
caauuccauuucccugacaaa

SEQ ID NO: 3831792 - RNA, 20 nt, Shigella flexneri 2a str. 2457T
caauucccggaccgucaucu

SEQ ID NO: 3831793 - RNA, 23 nt, Shigella flexneri 2a str. 2457T
caauucccggaccgucaucuucc

SEQ ID NO: 3831794 - RNA, 12 nt, Shigella flexneri 2a str. 2457T
caauuccuucug

SEQ ID NO: 3831795 - RNA, 16 nt, Shigella flexneri 2a str. 2457T
caauuccuucugggcg

SEQ ID NO: 3831796 - RNA, 20 nt, Shigella flexneri 2a str. 2457T
caauucgcgucggcgucagc

SEQ ID NO: 3831797 - RNA, 22 nt, Shigella flexneri 2a str. 2457T
caauucgcgucggcgucagcgc

SEQ ID NO: 3831798 - RNA, 15 nt, Shigella flexneri 2a str. 2457T
caauugaagaauauc

SEQ ID NO: 3831799 - RNA, 20 nt, Shigella flexneri 2a str. 2457T
caauugaagaauaucuucug

SEQ ID NO: 3831800 - RNA, 15 nt, Shigella flexneri 2a str. 2457T
caauugacaguuuau

SEQ ID NO: 3831801 - RNA, 19 nt, Shigella flexneri 2a str. 2457T
caauugcauauuucaacga

SEQ ID NO: 3831802 - RNA, 23 nt, Shigella flexneri 2a str. 2457T
caauugcgcaccagcuugcgaca

SEQ ID NO: 3831803 - RNA, 18 nt, Shigella flexneri 2a str. 2457T
caauugcgggccaaagac

SEQ ID NO: 3831804 - RNA, 21 nt, Shigella flexneri 2a str. 2457T
caauugcguuaaaaucagcgu

SEQ ID NO: 3831805 - RNA, 17 nt, Shigella flexneri 2a str. 2457T
caauugcucccugaaua

SEQ ID NO: 3831806 - RNA, 19 nt, Shigella flexneri 2a str. 2457T
caauuguucugcgcugaaa

SEQ ID NO: 3831807 - RNA, 19 nt, Shigella flexneri 2a str. 2457T
caauuuaccgacgcugcuc

SEQ ID NO: 3831808 - RNA, 23 nt, Shigella flexneri 2a str. 2457T
caauuuaccgacgcugcucaaag

SEQ ID NO: 3831809 - RNA, 16 nt, Shigella flexneri 2a str. 2457T
caauuuacgcuuuucu

SEQ ID NO: 3831810 - RNA, 19 nt, Shigella flexneri 2a str. 2457T
caauuuacguuuuaaaccu

SEQ ID NO: 3831811 - RNA, 13 nt, Shigella flexneri 2a str. 2457T
caauuucaucacu

SEQ ID NO: 3831812 - RNA, 15 nt, Shigella flexneri 2a str. 2457T
caauuucaucacuga

SEQ ID NO: 3831813 - RNA, 12 nt, Shigella flexneri 2a str. 2457T
caauuuccaguu

SEQ ID NO: 3831814 - RNA, 19 nt, Shigella flexneri 2a str. 2457T
caauuucccgcguccgcuc

SEQ ID NO: 3831815 - RNA, 14 nt, Shigella flexneri 2a str. 2457T
caauuucccgcuca

SEQ ID NO: 3831816 - RNA, 20 nt, Shigella flexneri 2a str. 2457T
caauuucucguuggucauca

SEQ ID NO: 3831817 - RNA, 22 nt, Shigella flexneri 2a str. 2457T
caauuucugugcagccaaaaau

SEQ ID NO: 3831818 - RNA, 13 nt, Shigella flexneri 2a str. 2457T
caauuugcccaug

SEQ ID NO: 3831819 - RNA, 20 nt, Shigella flexneri 2a str. 2457T
caauuugcuuaagccgcucu

SEQ ID NO: 3831820 - RNA, 20 nt, Shigella flexneri 2a str. 2457T
caauuuguagucauuuuuug

SEQ ID NO: 3831821 - RNA, 16 nt, Shigella flexneri 2a str. 2457T
caauuuucauugaaaa

SEQ ID NO: 3831822 - RNA, 20 nt, Shigella flexneri 2a str. 2457T
caauuuugcauucacccggg

SEQ ID NO: 3831823 - RNA, 17 nt, Shigella flexneri 2a str. 2457T
caauuuuguaggccgga

SEQ ID NO: 3831824 - RNA, 22 nt, Shigella flexneri 2a str. 2457T
caauuuuuaccgccgucgaugc

SEQ ID NO: 3831825 - RNA, 22 nt, Shigella flexneri 2a str. 2457T
cacaaaaaaucgugcugcaaua

SEQ ID NO: 3831826 - RNA, 14 nt, Shigella flexneri 2a str. 2457T
cacaaaaaccgcug

SEQ ID NO: 3831827 - RNA, 22 nt, Shigella flexneri 2a str. 2457T
cacaaaacggauguuucuucaa

SEQ ID NO: 3831828 - RNA, 13 nt, Shigella flexneri 2a str. 2457T
cacaaacaauuug

SEQ ID NO: 3831829 - RNA, 12 nt, Shigella flexneri 2a str. 2457T
cacaaacaucau

SEQ ID NO: 3831830 - RNA, 19 nt, Shigella flexneri 2a str. 2457T
cacaaacccagggccaacu

SEQ ID NO: 3831831 - RNA, 15 nt, Shigella flexneri 2a str. 2457T
cacaaacgccgugca

SEQ ID NO: 3831832 - RNA, 17 nt, Shigella flexneri 2a str. 2457T
cacaaacgccgugcaca

SEQ ID NO: 3831833 - RNA, 18 nt, Shigella flexneri 2a str. 2457T
cacaaacucuuuuccgga

SEQ ID NO: 3831834 - RNA, 13 nt, Shigella flexneri 2a str. 2457T
cacaaacuggcug

SEQ ID NO: 3831835 - RNA, 19 nt, Shigella flexneri 2a str. 2457T
cacaaagcuguaucccagc

SEQ ID NO: 3831836 - RNA, 16 nt, Shigella flexneri 2a str. 2457T
cacaaaguaaacaaua

SEQ ID NO: 3831837 - RNA, 17 nt, Shigella flexneri 2a str. 2457T
cacaaauacgcuuuuuc

SEQ ID NO: 3831838 - RNA, 16 nt, Shigella flexneri 2a str. 2457T
cacaaauagccagcag

SEQ ID NO: 3831839 - RNA, 21 nt, Shigella flexneri 2a str. 2457T
cacaacauucccaucaguagc

SEQ ID NO: 3831840 - RNA, 20 nt, Shigella flexneri 2a str. 2457T
cacaaccggaaccagcgccu

SEQ ID NO: 3831841 - RNA, 14 nt, Shigella flexneri 2a str. 2457T
cacaaccguccucc

SEQ ID NO: 3831842 - RNA, 17 nt, Shigella flexneri 2a str. 2457T
cacaaccugcacgaaac

SEQ ID NO: 3831843 - RNA, 18 nt, Shigella flexneri 2a str. 2457T
cacaacgagcgcaaugaa

SEQ ID NO: 3831844 - RNA, 15 nt, Shigella flexneri 2a str. 2457T
cacaacgcaauaaac

SEQ ID NO: 3831845 - RNA, 14 nt, Shigella flexneri 2a str. 2457T
cacaacgcuuucaa

SEQ ID NO: 3831846 - RNA, 16 nt, Shigella flexneri 2a str. 2457T
cacaacgcuuucaaca

SEQ ID NO: 3831847 - RNA, 22 nt, Shigella flexneri 2a str. 2457T
cacaacggcauuauucaucugg

SEQ ID NO: 3831848 - RNA, 14 nt, Shigella flexneri 2a str. 2457T
cacaacgugggccu

SEQ ID NO: 3831849 - RNA, 14 nt, Shigella flexneri 2a str. 2457T
cacaacuccauaca

SEQ ID NO: 3831850 - RNA, 22 nt, Shigella flexneri 2a str. 2457T
cacaacugcgaccguacaacca

SEQ ID NO: 3831851 - RNA, 23 nt, Shigella flexneri 2a str. 2457T
cacaacugcgaccguacaaccaa

SEQ ID NO: 3831852 - RNA, 19 nt, Shigella flexneri 2a str. 2457T
cacaacuggcuugguaaca

SEQ ID NO: 3831853 - RNA, 23 nt, Shigella flexneri 2a str. 2457T
cacaacuucgcgaacacccgacg

SEQ ID NO: 3831854 - RNA, 13 nt, Shigella flexneri 2a str. 2457T
cacaagaaauaua

SEQ ID NO: 3831855 - RNA, 18 nt, Shigella flexneri 2a str. 2457T
cacaagacuguaaauacu

SEQ ID NO: 3831856 - RNA, 17 nt, Shigella flexneri 2a str. 2457T
cacaagcauuaaggcaa

SEQ ID NO: 3831857 - RNA, 21 nt, Shigella flexneri 2a str. 2457T
cacaagccaggacgcagucca

SEQ ID NO: 3831858 - RNA, 22 nt, Shigella flexneri 2a str. 2457T
cacaagcgauaacucgcuuugc

SEQ ID NO: 3831859 - RNA, 17 nt, Shigella flexneri 2a str. 2457T
cacaaggccauugacgc

SEQ ID NO: 3831860 - RNA, 21 nt, Shigella flexneri 2a str. 2457T
cacaaguuguuuacaguauga

SEQ ID NO: 3831861 - RNA, 19 nt, Shigella flexneri 2a str. 2457T
cacaauacugaucaucauu

SEQ ID NO: 3831862 - RNA, 13 nt, Shigella flexneri 2a str. 2457T
cacaauauuuuua

SEQ ID NO: 3831863 - RNA, 19 nt, Shigella flexneri 2a str. 2457T
cacaaucaaauccugcauc

SEQ ID NO: 3831864 - RNA, 18 nt, Shigella flexneri 2a str. 2457T
cacaaucauccuaccgcc

SEQ ID NO: 3831865 - RNA, 20 nt, Shigella flexneri 2a str. 2457T
cacaaucauccuaccgccag

SEQ ID NO: 3831866 - RNA, 21 nt, Shigella flexneri 2a str. 2457T
cacaaucggcuuucaccgccu

SEQ ID NO: 3831867 - RNA, 19 nt, Shigella flexneri 2a str. 2457T
cacaaucucacccgcuuca

SEQ ID NO: 3831868 - RNA, 17 nt, Shigella flexneri 2a str. 2457T
cacaaugcuguaaccag

SEQ ID NO: 3831869 - RNA, 18 nt, Shigella flexneri 2a str. 2457T
cacaauggagcuaaacag

SEQ ID NO: 3831870 - RNA, 22 nt, Shigella flexneri 2a str. 2457T
cacaauggcacaaauggcaaug

SEQ ID NO: 3831871 - RNA, 15 nt, Shigella flexneri 2a str. 2457T
cacaauggucaacau

SEQ ID NO: 3831872 - RNA, 18 nt, Shigella flexneri 2a str. 2457T
cacaaugucacaaauaaa

SEQ ID NO: 3831873 - RNA, 12 nt, Shigella flexneri 2a str. 2457T
cacaauuaccuu

SEQ ID NO: 3831874 - RNA, 13 nt, Shigella flexneri 2a str. 2457T
cacaauugccgga

SEQ ID NO: 3831875 - RNA, 22 nt, Shigella flexneri 2a str. 2457T
cacacaagccgugaaucacucc

SEQ ID NO: 3831876 - RNA, 19 nt, Shigella flexneri 2a str. 2457T
cacacaauuaccuuccaca

SEQ ID NO: 3831877 - RNA, 14 nt, Shigella flexneri 2a str. 2457T
cacacacgcccagc

SEQ ID NO: 3831878 - RNA, 16 nt, Shigella flexneri 2a str. 2457T
cacacauuucucggua

SEQ ID NO: 3831879 - RNA, 18 nt, Shigella flexneri 2a str. 2457T
cacaccacaucgccgacc

SEQ ID NO: 3831880 - RNA, 22 nt, Shigella flexneri 2a str. 2457T
cacauucugcaucgcgcugaac

SEQ ID NO: 3831881 - RNA, 24 nt, Shigella flexneri 2a str. 2457T
cacauucugcaucgcgcugaacau

SEQ ID NO: 3831882 - RNA, 23 nt, Shigella flexneri 2a str. 2457T
cacauugauggcgcuuucguuuu

SEQ ID NO: 3831883 - RNA, 17 nt, Shigella flexneri 2a str. 2457T
cacauuguuaaagccuu

SEQ ID NO: 3831884 - RNA, 13 nt, Shigella flexneri 2a str. 2457T
cacauuucaauca

SEQ ID NO: 3831885 - RNA, 14 nt, Shigella flexneri 2a str. 2457T
cacauuuuccauca

SEQ ID NO: 3831886 - RNA, 20 nt, Shigella flexneri 2a str. 2457T
caccaaacgggcaagccagc

SEQ ID NO: 3831887 - RNA, 17 nt, Shigella flexneri 2a str. 2457T
caccaacccuuaccccu

SEQ ID NO: 3831888 - RNA, 15 nt, Shigella flexneri 2a str. 2457T
caccaacgacggcca

SEQ ID NO: 3831889 - RNA, 16 nt, Shigella flexneri 2a str. 2457T
caccaacgacggccag

SEQ ID NO: 3831890 - RNA, 23 nt, Shigella flexneri 2a str. 2457T
caccaauaccgcccaccaccagc

SEQ ID NO: 3831891 - RNA, 13 nt, Shigella flexneri 2a str. 2457T
caccaauacgcau

SEQ ID NO: 3831892 - RNA, 18 nt, Shigella flexneri 2a str. 2457T
caccaauagccgcgccga

SEQ ID NO: 3831893 - RNA, 23 nt, Shigella flexneri 2a str. 2457T
caccaaucaacaauugcgggcca

SEQ ID NO: 3831894 - RNA, 13 nt, Shigella flexneri 2a str. 2457T
caccaaucagcgg

SEQ ID NO: 3831895 - RNA, 18 nt, Shigella flexneri 2a str. 2457T
caccaaucagcggcguau

SEQ ID NO: 3831896 - RNA, 18 nt, Shigella flexneri 2a str. 2457T
caccaaucgucaaugccg

SEQ ID NO: 3831897 - RNA, 23 nt, Shigella flexneri 2a str. 2457T
caccaaugaaagccccaccagca

SEQ ID NO: 3831898 - RNA, 19 nt, Shigella flexneri 2a str. 2457T
caccaauggcuggccugga

SEQ ID NO: 3831899 - RNA, 22 nt, Shigella flexneri 2a str. 2457T
caccacaaacucuuuuccggaa

SEQ ID NO: 3831900 - RNA, 19 nt, Shigella flexneri 2a str. 2457T
caccacaacauucccauca

SEQ ID NO: 3831901 - RNA, 19 nt, Shigella flexneri 2a str. 2457T
caccacaccggaccagacg

SEQ ID NO: 3831902 - RNA, 17 nt, Shigella flexneri 2a str. 2457T
caccacacgaauuccaa

SEQ ID NO: 3831903 - RNA, 21 nt, Shigella flexneri 2a str. 2457T
caccacagacaaacagcucga

SEQ ID NO: 3831904 - RNA, 11 nt, Shigella flexneri 2a str. 2457T
caccacauucu

SEQ ID NO: 3831905 - RNA, 13 nt, Shigella flexneri 2a str. 2457T
caccaccagacgc

SEQ ID NO: 3831906 - RNA, 14 nt, Shigella flexneri 2a str. 2457T
caccaccagcaccg

SEQ ID NO: 3831907 - RNA, 15 nt, Shigella flexneri 2a str. 2457T
caccaccagcagcug

SEQ ID NO: 3831908 - RNA, 11 nt, Shigella flexneri 2a str. 2457T
caccaccauca

SEQ ID NO: 3831909 - RNA, 13 nt, Shigella flexneri 2a str. 2457T
caccacccugccc

SEQ ID NO: 3831910 - RNA, 24 nt, Shigella flexneri 2a str. 2457T
caccaccgacggacccgccggcgu

SEQ ID NO: 3831911 - RNA, 15 nt, Shigella flexneri 2a str. 2457T
caccaccgcaaaaua

SEQ ID NO: 3831912 - RNA, 20 nt, Shigella flexneri 2a str. 2457T
caccaccgcaaucgccagua

SEQ ID NO: 3831913 - RNA, 21 nt, Shigella flexneri 2a str. 2457T
caccaccgcaucggcaucaaa

SEQ ID NO: 3831914 - RNA, 19 nt, Shigella flexneri 2a str. 2457T
caccaccgcccguuccacc

SEQ ID NO: 3831915 - RNA, 18 nt, Shigella flexneri 2a str. 2457T
caccaccuaacccgcuac

SEQ ID NO: 3831916 - RNA, 16 nt, Shigella flexneri 2a str. 2457T
caccaccugcaucucc

SEQ ID NO: 3831917 - RNA, 14 nt, Shigella flexneri 2a str. 2457T
caccacgaaaacag

SEQ ID NO: 3831918 - RNA, 17 nt, Shigella flexneri 2a str. 2457T
caccacgaccacgaacg

SEQ ID NO: 3831919 - RNA, 18 nt, Shigella flexneri 2a str. 2457T
ggccuauuaugacuccag

SEQ ID NO: 3831920 - RNA, 18 nt, Shigella flexneri 2a str. 2457T
ggccucaugugaugguaa

SEQ ID NO: 3831921 - RNA, 20 nt, Shigella flexneri 2a str. 2457T
ggccucggguugaugguaaa

SEQ ID NO: 3831922 - RNA, 16 nt, Shigella flexneri 2a str. 2457T
ggccucuccucgcgag

SEQ ID NO: 3831923 - RNA, 16 nt, Shigella flexneri 2a str. 2457T
ggccucucuggccgcu

SEQ ID NO: 3831924 - RNA, 20 nt, Shigella flexneri 2a str. 2457T
ggccucucuggccgcuucca

SEQ ID NO: 3831925 - RNA, 12 nt, Shigella flexneri 2a str. 2457T
ggccugaaagcu

SEQ ID NO: 3831926 - RNA, 13 nt, Shigella flexneri 2a str. 2457T
ggccugaacaagc

SEQ ID NO: 3831927 - RNA, 15 nt, Shigella flexneri 2a str. 2457T
ggccugagaagcgca

SEQ ID NO: 3831928 - RNA, 23 nt, Shigella flexneri 2a str. 2457T
ggccugauaagcguagcgcauca

SEQ ID NO: 3831929 - RNA, 22 nt, Shigella flexneri 2a str. 2457T
ggccuggaauuacugauugcuc

SEQ ID NO: 3831930 - RNA, 20 nt, Shigella flexneri 2a str. 2457T
ggccuuaaugcccacgccgu

SEQ ID NO: 3831931 - RNA, 17 nt, Shigella flexneri 2a str. 2457T
ggccuuuuccuuucaga

SEQ ID NO: 3831932 - RNA, 18 nt, Shigella flexneri 2a str. 2457T
ggccuuuuuauuuauuca

SEQ ID NO: 3831933 - RNA, 13 nt, Shigella flexneri 2a str. 2457T
ggcgaaagaaaag

SEQ ID NO: 3831934 - RNA, 13 nt, Shigella flexneri 2a str. 2457T
ggcgaaaggcugg

SEQ ID NO: 3831935 - RNA, 19 nt, Shigella flexneri 2a str. 2457T
ggcgaacucuuccggcagg

SEQ ID NO: 3831936 - RNA, 15 nt, Shigella flexneri 2a str. 2457T
ggcgaagagaaagaa

SEQ ID NO: 3831937 - RNA, 22 nt, Shigella flexneri 2a str. 2457T
ggcgaagcgauucucgccgccc

SEQ ID NO: 3831938 - RNA, 21 nt, Shigella flexneri 2a str. 2457T
ggcgaaggcgcacugauucau

SEQ ID NO: 3831939 - RNA, 22 nt, Shigella flexneri 2a str. 2457T
ggcgacaaggcguugauuggcg

SEQ ID NO: 3831940 - RNA, 19 nt, Shigella flexneri 2a str. 2457T
ggcgacacaucuaaugcuu

SEQ ID NO: 3831941 - RNA, 18 nt, Shigella flexneri 2a str. 2457T
ggcgaccguucgccaggu

SEQ ID NO: 3831942 - RNA, 17 nt, Shigella flexneri 2a str. 2457T
ggcgacggcuggcaaaa

SEQ ID NO: 3831943 - RNA, 12 nt, Shigella flexneri 2a str. 2457T
ggcgagagcuuu

SEQ ID NO: 3831944 - RNA, 14 nt, Shigella flexneri 2a str. 2457T
ggcgagauaaugcg

SEQ ID NO: 3831945 - RNA, 19 nt, Shigella flexneri 2a str. 2457T
ggcgagcaacgcagcggcg

SEQ ID NO: 3831946 - RNA, 13 nt, Shigella flexneri 2a str. 2457T
ggcgaggcggggc

SEQ ID NO: 3831947 - RNA, 18 nt, Shigella flexneri 2a str. 2457T
ggcgagggaaccguccgc

SEQ ID NO: 3831948 - RNA, 14 nt, Shigella flexneri 2a str. 2457T
ggcgagggcaaacc

SEQ ID NO: 3831949 - RNA, 23 nt, Shigella flexneri 2a str. 2457T
ggcgaguauucuugcugauacuc

SEQ ID NO: 3831950 - RNA, 20 nt, Shigella flexneri 2a str. 2457T
ggcgauaaaguguugagcuu

SEQ ID NO: 3831951 - RNA, 18 nt, Shigella flexneri 2a str. 2457T
ggcgauaaucagcgccag

SEQ ID NO: 3831952 - RNA, 21 nt, Shigella flexneri 2a str. 2457T
ggcgauaaucagcgccagcgc

SEQ ID NO: 3831953 - RNA, 11 nt, Shigella flexneri 2a str. 2457T
ggcgauaaucu

SEQ ID NO: 3831954 - RNA, 15 nt, Shigella flexneri 2a str. 2457T
ggcgauacucugcca

SEQ ID NO: 3831955 - RNA, 15 nt, Shigella flexneri 2a str. 2457T
ggcgauauccagcgc

SEQ ID NO: 3831956 - RNA, 17 nt, Shigella flexneri 2a str. 2457T
ggcgauauccagcgcgg

SEQ ID NO: 3831957 - RNA, 15 nt, Shigella flexneri 2a str. 2457T
ggcgauaucuggauc

SEQ ID NO: 3831958 - RNA, 21 nt, Shigella flexneri 2a str. 2457T
ggcgauauuauccccugcgau

SEQ ID NO: 3831959 - RNA, 21 nt, Shigella flexneri 2a str. 2457T
ggcgaucgacgugggcguggg

SEQ ID NO: 3831960 - RNA, 14 nt, Shigella flexneri 2a str. 2457T
ggcgaugcggggug

SEQ ID NO: 3831961 - RNA, 22 nt, Shigella flexneri 2a str. 2457T
ggcgaugcggggugcaucgccc

SEQ ID NO: 3831962 - RNA, 15 nt, Shigella flexneri 2a str. 2457T
ggcgauguucugguc

SEQ ID NO: 3831963 - RNA, 13 nt, Shigella flexneri 2a str. 2457T
ggcgauuccacuc

SEQ ID NO: 3831964 - RNA, 14 nt, Shigella flexneri 2a str. 2457T
ggcgauucuuugcu

SEQ ID NO: 3831965 - RNA, 21 nt, Shigella flexneri 2a str. 2457T
ggcgauugucguguuaagccg

SEQ ID NO: 3831966 - RNA, 15 nt, Shigella flexneri 2a str. 2457T
ggcgcaagggcugga

SEQ ID NO: 3831967 - RNA, 19 nt, Shigella flexneri 2a str. 2457T
ggcgcaaggugugggcaau

SEQ ID NO: 3831968 - RNA, 21 nt, Shigella flexneri 2a str. 2457T
ggcgcaaugauaucgcuggca

SEQ ID NO: 3831969 - RNA, 16 nt, Shigella flexneri 2a str. 2457T
ggcgcaauggcgcaau

SEQ ID NO: 3831970 - RNA, 17 nt, Shigella flexneri 2a str. 2457T
ggcgcaccaguucgccg

SEQ ID NO: 3831971 - RNA, 23 nt, Shigella flexneri 2a str. 2457T
ggcgcacguucugucgcucugcu

SEQ ID NO: 3831972 - RNA, 11 nt, Shigella flexneri 2a str. 2457T
ggcgcagcgcg

SEQ ID NO: 3831973 - RNA, 12 nt, Shigella flexneri 2a str. 2457T
ggcgcagcgcgc

SEQ ID NO: 3831974 - RNA, 15 nt, Shigella flexneri 2a str. 2457T
ggcgcaggauaucgu

SEQ ID NO: 3831975 - RNA, 17 nt, Shigella flexneri 2a str. 2457T
ggcgcauguuggcgcgg

SEQ ID NO: 3831976 - RNA, 20 nt, Shigella flexneri 2a str. 2457T
ggcgcauguuggcgcgguga

SEQ ID NO: 3831977 - RNA, 14 nt, Shigella flexneri 2a str. 2457T
ggcgcgaaacauca

SEQ ID NO: 3831978 - RNA, 14 nt, Shigella flexneri 2a str. 2457T
ggcgcgauaaaaau

SEQ ID NO: 3831979 - RNA, 16 nt, Shigella flexneri 2a str. 2457T
ggcgcgauucggcucc

SEQ ID NO: 3831980 - RNA, 20 nt, Shigella flexneri 2a str. 2457T
ggcgcgcauucuggagcugg

SEQ ID NO: 3831981 - RNA, 12 nt, Shigella flexneri 2a str. 2457T
ggcgcgcgcuuu

SEQ ID NO: 3831982 - RNA, 16 nt, Shigella flexneri 2a str. 2457T
ggcgcggacgcacaua

SEQ ID NO: 3831983 - RNA, 14 nt, Shigella flexneri 2a str. 2457T
ggcgcggcccuggg

SEQ ID NO: 3831984 - RNA, 16 nt, Shigella flexneri 2a str. 2457T
ggcgcgggcaacagaa

SEQ ID NO: 3831985 - RNA, 12 nt, Shigella flexneri 2a str. 2457T
ggcgcgguuucu

SEQ ID NO: 3831986 - RNA, 23 nt, Shigella flexneri 2a str. 2457T
ggcgcguguuccagagaacgacc

SEQ ID NO: 3831987 - RNA, 22 nt, Shigella flexneri 2a str. 2457T
ggcgcguuaucagcaacuggca

SEQ ID NO: 3831988 - RNA, 19 nt, Shigella flexneri 2a str. 2457T
ggcgcuacaauugaucgca

SEQ ID NO: 3831989 - RNA, 19 nt, Shigella flexneri 2a str. 2457T
ggcgcuaucaauacuuucc

SEQ ID NO: 3831990 - RNA, 22 nt, Shigella flexneri 2a str. 2457T
ggcgcucgcgccgcauccgaca

SEQ ID NO: 3831991 - RNA, 20 nt, Shigella flexneri 2a str. 2457T
ggcgcucugcccaugcuggu

SEQ ID NO: 3831992 - RNA, 19 nt, Shigella flexneri 2a str. 2457T
ggcgcugcuuuccugcugc

SEQ ID NO: 3831993 - RNA, 23 nt, Shigella flexneri 2a str. 2457T
ggcgcuggcagaaggccgcagua

SEQ ID NO: 3831994 - RNA, 15 nt, Shigella flexneri 2a str. 2457T
ggcggaagagcacac

SEQ ID NO: 3831995 - RNA, 16 nt, Shigella flexneri 2a str. 2457T
ggcggaauagcguacg

SEQ ID NO: 3831996 - RNA, 17 nt, Shigella flexneri 2a str. 2457T
ggcggauggaguggggc

SEQ ID NO: 3831997 - RNA, 16 nt, Shigella flexneri 2a str. 2457T
ggcggcaaucgcugcu

SEQ ID NO: 3831998 - RNA, 21 nt, Shigella flexneri 2a str. 2457T
ggcggcaaugaaagcgagcga

SEQ ID NO: 3831999 - RNA, 24 nt, Shigella flexneri 2a str. 2457T
ggcggccggaugacagacuccgcu

SEQ ID NO: 3832000 - RNA, 15 nt, Shigella flexneri 2a str. 2457T
ggcggcgcgaggcga

SEQ ID NO: 3832001 - RNA, 15 nt, Shigella flexneri 2a str. 2457T
ggcggcgcgccaggc

SEQ ID NO: 3832002 - RNA, 14 nt, Shigella flexneri 2a str. 2457T
ggcggcgcgcgcug

SEQ ID NO: 3832003 - RNA, 13 nt, Shigella flexneri 2a str. 2457T
ggcggcgggcgca

SEQ ID NO: 3832004 - RNA, 18 nt, Shigella flexneri 2a str. 2457T
ggcggcguucagucgccg

SEQ ID NO: 3832005 - RNA, 19 nt, Shigella flexneri 2a str. 2457T
ggcggcuuagcugaucgac

SEQ ID NO: 3832006 - RNA, 12 nt, Shigella flexneri 2a str. 2457T
ggcgggaaaaau

SEQ ID NO: 3832007 - RNA, 21 nt, Shigella flexneri 2a str. 2457T
ggcgggaaaaaucuucgaucu

SEQ ID NO: 3832008 - RNA, 20 nt, Shigella flexneri 2a str. 2457T
ggcgggaagaacggcaacua

SEQ ID NO: 3832009 - RNA, 20 nt, Shigella flexneri 2a str. 2457T
ggcgggacagcauggggcug

SEQ ID NO: 3832010 - RNA, 23 nt, Shigella flexneri 2a str. 2457T
ggcgggcuuuuuuugccccagaa

SEQ ID NO: 3832011 - RNA, 22 nt, Shigella flexneri 2a str. 2457T
ggcggguuaaccagcaccagcu

SEQ ID NO: 3832012 - RNA, 16 nt, Shigella flexneri 2a str. 2457T
ggcgguaaaaucaucc

SEQ ID NO: 3832013 - RNA, 21 nt, Shigella flexneri 2a str. 2457T
ggcgguauagaucagacgaca

SEQ ID NO: 3832014 - RNA, 13 nt, Shigella flexneri 2a str. 2457T
ggcggucuggcga

SEQ ID NO: 3832015 - RNA, 23 nt, Shigella flexneri 2a str. 2457T
ggcggugucuaacgaugccagca

SEQ ID NO: 3832016 - RNA, 18 nt, Shigella flexneri 2a str. 2457T
gccaccagcgccgcgcca

SEQ ID NO: 3832017 - RNA, 18 nt, Shigella flexneri 2a str. 2457T
gccaccagcgucagaaac

SEQ ID NO: 3832018 - RNA, 16 nt, Shigella flexneri 2a str. 2457T
gccaccagcugacaau

SEQ ID NO: 3832019 - RNA, 13 nt, Shigella flexneri 2a str. 2457T
gccaccaggccac

SEQ ID NO: 3832020 - RNA, 18 nt, Shigella flexneri 2a str. 2457T
gccaccagugcaggcacc

SEQ ID NO: 3832021 - RNA, 13 nt, Shigella flexneri 2a str. 2457T
gccaccccacgau

SEQ ID NO: 3832022 - RNA, 23 nt, Shigella flexneri 2a str. 2457T
gccaccccacgauguauccggca

SEQ ID NO: 3832023 - RNA, 15 nt, Shigella flexneri 2a str. 2457T
gccacccgaucgcuc

SEQ ID NO: 3832024 - RNA, 21 nt, Shigella flexneri 2a str. 2457T
gccaccgaacaaaacagcgag

SEQ ID NO: 3832025 - RNA, 17 nt, Shigella flexneri 2a str. 2457T
gccaccgcacgcaggcc

SEQ ID NO: 3832026 - RNA, 15 nt, Shigella flexneri 2a str. 2457T
gccaccgcccagaga

SEQ ID NO: 3832027 - RNA, 23 nt, Shigella flexneri 2a str. 2457T
gccaccggcuuucgcuucaacca

SEQ ID NO: 3832028 - RNA, 23 nt, Shigella flexneri 2a str. 2457T
gccaccguguucaugaccgugau

SEQ ID NO: 3832029 - RNA, 13 nt, Shigella flexneri 2a str. 2457T
gccacgcaaacuu

SEQ ID NO: 3832030 - RNA, 23 nt, Shigella flexneri 2a str. 2457T
gccacgcacgccugcaucucuuc

SEQ ID NO: 3832031 - RNA, 19 nt, Shigella flexneri 2a str. 2457T
gccacgccacagccgagcg

SEQ ID NO: 3832032 - RNA, 19 nt, Shigella flexneri 2a str. 2457T
gccacgcgaaugugcguuu

SEQ ID NO: 3832033 - RNA, 15 nt, Shigella flexneri 2a str. 2457T
gccacgcugccgcgc

SEQ ID NO: 3832034 - RNA, 20 nt, Shigella flexneri 2a str. 2457T
gccacgcuucaaucugauau

SEQ ID NO: 3832035 - RNA, 23 nt, Shigella flexneri 2a str. 2457T
gccacggauauauccguggcuuu

SEQ ID NO: 3832036 - RNA, 14 nt, Shigella flexneri 2a str. 2457T
gccacggcuccagc

SEQ ID NO: 3832037 - RNA, 21 nt, Shigella flexneri 2a str. 2457T
gccacgguaucaagcccgccg

SEQ ID NO: 3832038 - RNA, 19 nt, Shigella flexneri 2a str. 2457T
gccacguacauuaaacgcc

SEQ ID NO: 3832039 - RNA, 13 nt, Shigella flexneri 2a str. 2457T
gccacuaacgcau

SEQ ID NO: 3832040 - RNA, 14 nt, Shigella flexneri 2a str. 2457T
gccacuaucgccau

SEQ ID NO: 3832041 - RNA, 18 nt, Shigella flexneri 2a str. 2457T
gccacuccacuggagacg

SEQ ID NO: 3832042 - RNA, 13 nt, Shigella flexneri 2a str. 2457T
gccacucgauacc

SEQ ID NO: 3832043 - RNA, 17 nt, Shigella flexneri 2a str. 2457T
gccacucgauaccagau

SEQ ID NO: 3832044 - RNA, 20 nt, Shigella flexneri 2a str. 2457T
gccacucggacaccucacca

SEQ ID NO: 3832045 - RNA, 17 nt, Shigella flexneri 2a str. 2457T
gccacugcccgagaaca

SEQ ID NO: 3832046 - RNA, 13 nt, Shigella flexneri 2a str. 2457T
gccacugcgccau

SEQ ID NO: 3832047 - RNA, 11 nt, Shigella flexneri 2a str. 2457T
gccacuggccc

SEQ ID NO: 3832048 - RNA, 15 nt, Shigella flexneri 2a str. 2457T
gccacuucaucgccc

SEQ ID NO: 3832049 - RNA, 17 nt, Shigella flexneri 2a str. 2457T
gccacuucuguuacucc

SEQ ID NO: 3832050 - RNA, 14 nt, Shigella flexneri 2a str. 2457T
gccacuucuuccag

SEQ ID NO: 3832051 - RNA, 14 nt, Shigella flexneri 2a str. 2457T
gccacuuucacgcc

SEQ ID NO: 3832052 - RNA, 17 nt, Shigella flexneri 2a str. 2457T
gccacuuucacgccgcc

SEQ ID NO: 3832053 - RNA, 18 nt, Shigella flexneri 2a str. 2457T
gccacuuucacgccgcca

SEQ ID NO: 3832054 - RNA, 22 nt, Shigella flexneri 2a str. 2457T
gccacuuucucacucaccgcag

SEQ ID NO: 3832055 - RNA, 14 nt, Shigella flexneri 2a str. 2457T
gccagaaaaccugg

SEQ ID NO: 3832056 - RNA, 18 nt, Shigella flexneri 2a str. 2457T
gccagaaaaccuggcgca

SEQ ID NO: 3832057 - RNA, 20 nt, Shigella flexneri 2a str. 2457T
gccagaaaaccuggcgcagu

SEQ ID NO: 3832058 - RNA, 21 nt, Shigella flexneri 2a str. 2457T
gccagaaaaccuggcgcagug

SEQ ID NO: 3832059 - RNA, 21 nt, Shigella flexneri 2a str. 2457T
gccagaaacaccguuaacguu

SEQ ID NO: 3832060 - RNA, 13 nt, Shigella flexneri 2a str. 2457T
gccagaaauccag

SEQ ID NO: 3832061 - RNA, 21 nt, Shigella flexneri 2a str. 2457T
gccagaaauggcccaaaaggc

SEQ ID NO: 3832062 - RNA, 21 nt, Shigella flexneri 2a str. 2457T
gccagaaccgcguagggcgga

SEQ ID NO: 3832063 - RNA, 14 nt, Shigella flexneri 2a str. 2457T
gccagaauagcgcc

SEQ ID NO: 3832064 - RNA, 13 nt, Shigella flexneri 2a str. 2457T
ggagcuaauaaug

SEQ ID NO: 3832065 - RNA, 19 nt, Shigella flexneri 2a str. 2457T
ggagcuccagguccuccug

SEQ ID NO: 3832066 - RNA, 16 nt, Shigella flexneri 2a str. 2457T
ggagcugugggguauu

SEQ ID NO: 3832067 - RNA, 18 nt, Shigella flexneri 2a str. 2457T
ggagcuucacccgcagca

SEQ ID NO: 3832068 - RNA, 15 nt, Shigella flexneri 2a str. 2457T
ggaggcgcugguaau

SEQ ID NO: 3832069 - RNA, 16 nt, Shigella flexneri 2a str. 2457T
ggaguaagaauaaaac

SEQ ID NO: 3832070 - RNA, 12 nt, Shigella flexneri 2a str. 2457T
ggaguaauaauu

SEQ ID NO: 3832071 - RNA, 19 nt, Shigella flexneri 2a str. 2457T
ggaguaguugaucgccccg

SEQ ID NO: 3832072 - RNA, 13 nt, Shigella flexneri 2a str. 2457T
ggaguccuuucgu

SEQ ID NO: 3832073 - RNA, 16 nt, Shigella flexneri 2a str. 2457T
ggaguggcgaaauugg

SEQ ID NO: 3832074 - RNA, 17 nt, Shigella flexneri 2a str. 2457T
ggaguggugaaacaggg

SEQ ID NO: 3832075 - RNA, 15 nt, Shigella flexneri 2a str. 2457T
ggaguugaucgccaa

SEQ ID NO: 3832076 - RNA, 18 nt, Shigella flexneri 2a str. 2457T
ggauaaacacucgcugug

SEQ ID NO: 3832077 - RNA, 15 nt, Shigella flexneri 2a str. 2457T
ggauaaagcaguuua

SEQ ID NO: 3832078 - RNA, 21 nt, Shigella flexneri 2a str. 2457T
ggauaaggcguuuacgccgca

SEQ ID NO: 3832079 - RNA, 20 nt, Shigella flexneri 2a str. 2457T
ggauaauacacuaacagaac

SEQ ID NO: 3832080 - RNA, 16 nt, Shigella flexneri 2a str. 2457T
ggauaauauuuuugcg

SEQ ID NO: 3832081 - RNA, 21 nt, Shigella flexneri 2a str. 2457T
ggauaauccgguuuacccgcu

SEQ ID NO: 3832082 - RNA, 12 nt, Shigella flexneri 2a str. 2457T
ggauacgccgca

SEQ ID NO: 3832083 - RNA, 18 nt, Shigella flexneri 2a str. 2457T
ggauagagcucauuucau

SEQ ID NO: 3832084 - RNA, 23 nt, Shigella flexneri 2a str. 2457T
ggauagccgcccccgacuccagc

SEQ ID NO: 3832085 - RNA, 15 nt, Shigella flexneri 2a str. 2457T
ggauagcgcugcugc

SEQ ID NO: 3832086 - RNA, 18 nt, Shigella flexneri 2a str. 2457T
ggauauccacccgcagcc

SEQ ID NO: 3832087 - RNA, 19 nt, Shigella flexneri 2a str. 2457T
ggauauccacccgcagcca

SEQ ID NO: 3832088 - RNA, 21 nt, Shigella flexneri 2a str. 2457T
ggauaucuucaaucagaugug

SEQ ID NO: 3832089 - RNA, 16 nt, Shigella flexneri 2a str. 2457T
ggauaugugaaauuua

SEQ ID NO: 3832090 - RNA, 18 nt, Shigella flexneri 2a str. 2457T
ggauauucaucuccagca

SEQ ID NO: 3832091 - RNA, 22 nt, Shigella flexneri 2a str. 2457T
ggaucaaggauugcagcacuga

SEQ ID NO: 3832092 - RNA, 20 nt, Shigella flexneri 2a str. 2457T
ggaucacaucauaaauaaga

SEQ ID NO: 3832093 - RNA, 19 nt, Shigella flexneri 2a str. 2457T
ggaucaccugcacaugcaa

SEQ ID NO: 3832094 - RNA, 22 nt, Shigella flexneri 2a str. 2457T
ggaucagaaugcgcucuuccgg

SEQ ID NO: 3832095 - RNA, 12 nt, Shigella flexneri 2a str. 2457T
ggaucagccgcu

SEQ ID NO: 3832096 - RNA, 13 nt, Shigella flexneri 2a str. 2457T
ggauccccugccc

SEQ ID NO: 3832097 - RNA, 17 nt, Shigella flexneri 2a str. 2457T
ggauccugagcaaacag

SEQ ID NO: 3832098 - RNA, 13 nt, Shigella flexneri 2a str. 2457T
ggaucgcagccga

SEQ ID NO: 3832099 - RNA, 16 nt, Shigella flexneri 2a str. 2457T
ggaucgguagaccgga

SEQ ID NO: 3832100 - RNA, 19 nt, Shigella flexneri 2a str. 2457T
ggaucgucaggaucagcca

SEQ ID NO: 3832101 - RNA, 20 nt, Shigella flexneri 2a str. 2457T
ggaucgucgcccgaugcaua

SEQ ID NO: 3832102 - RNA, 21 nt, Shigella flexneri 2a str. 2457T
ggaucguucacaugagagaaa

SEQ ID NO: 3832103 - RNA, 17 nt, Shigella flexneri 2a str. 2457T
ggaucucagcucauuaa

SEQ ID NO: 3832104 - RNA, 14 nt, Shigella flexneri 2a str. 2457T
ggaucugaugggau

SEQ ID NO: 3832105 - RNA, 20 nt, Shigella flexneri 2a str. 2457T
ggaucugcggguuagucugc

SEQ ID NO: 3832106 - RNA, 23 nt, Shigella flexneri 2a str. 2457T
ggaucugcggguuagucugcauu

SEQ ID NO: 3832107 - RNA, 18 nt, Shigella flexneri 2a str. 2457T
ggaucuggcuugccagca

SEQ ID NO: 3832108 - RNA, 15 nt, Shigella flexneri 2a str. 2457T
ggaucuuuugucaug

SEQ ID NO: 3832109 - RNA, 13 nt, Shigella flexneri 2a str. 2457T
ggaugaagugaag

SEQ ID NO: 3832110 - RNA, 14 nt, Shigella flexneri 2a str. 2457T
ggaugacacgcagg

SEQ ID NO: 3832111 - RNA, 13 nt, Shigella flexneri 2a str. 2457T
ggaugacgcguca

SEQ ID NO: 3832112 - RNA, 11 nt, Shigella flexneri 2a str. 2457T
ggaugauucac

SEQ ID NO: 3832113 - RNA, 21 nt, Shigella flexneri 2a str. 2457T
ggaugcaugauccggcaucuu

SEQ ID NO: 3832114 - RNA, 15 nt, Shigella flexneri 2a str. 2457T
ggaugccgaaaaaag

SEQ ID NO: 3832115 - RNA, 16 nt, Shigella flexneri 2a str. 2457T
ggaugccgaaaaaagu

SEQ ID NO: 3832116 - RNA, 14 nt, Shigella flexneri 2a str. 2457T
ggaugcgccagcau

SEQ ID NO: 3832117 - RNA, 12 nt, Shigella flexneri 2a str. 2457T
ggaugcgccauc

SEQ ID NO: 3832118 - RNA, 16 nt, Shigella flexneri 2a str. 2457T
ggaugcgccgucagag

SEQ ID NO: 3832119 - RNA, 18 nt, Shigella flexneri 2a str. 2457T
ggaugcgcuucgcuuauc

SEQ ID NO: 3832120 - RNA, 16 nt, Shigella flexneri 2a str. 2457T
ggaugcggcguaaaug

SEQ ID NO: 3832121 - RNA, 20 nt, Shigella flexneri 2a str. 2457T
ggaugcgggucaggccagga

SEQ ID NO: 3832122 - RNA, 19 nt, Shigella flexneri 2a str. 2457T
ggaugcguucgcaccaccg

SEQ ID NO: 3832123 - RNA, 13 nt, Shigella flexneri 2a str. 2457T
ggauggccgggca

SEQ ID NO: 3832124 - RNA, 19 nt, Shigella flexneri 2a str. 2457T
ggauggcgauacucugcca

SEQ ID NO: 3832125 - RNA, 20 nt, Shigella flexneri 2a str. 2457T
ggaugggcugucagcucauc

SEQ ID NO: 3832126 - RNA, 13 nt, Shigella flexneri 2a str. 2457T
ggaugugaugcau

SEQ ID NO: 3832127 - RNA, 20 nt, Shigella flexneri 2a str. 2457T
ggauguguuauucagcuggc

SEQ ID NO: 3832128 - RNA, 19 nt, Shigella flexneri 2a str. 2457T
ggauguucgacuuaacgcg

SEQ ID NO: 3832129 - RNA, 14 nt, Shigella flexneri 2a str. 2457T
ggauuaaaaaguaa

SEQ ID NO: 3832130 - RNA, 23 nt, Shigella flexneri 2a str. 2457T
ggauuacgacucaaccccagcca

SEQ ID NO: 3832131 - RNA, 13 nt, Shigella flexneri 2a str. 2457T
ggauuagccggau

SEQ ID NO: 3832132 - RNA, 14 nt, Shigella flexneri 2a str. 2457T
ggauuagcgaccga

SEQ ID NO: 3832133 - RNA, 19 nt, Shigella flexneri 2a str. 2457T
ggauuaugcccgcagcgca

SEQ ID NO: 3832134 - RNA, 18 nt, Shigella flexneri 2a str. 2457T
ggauucacguugauggua

SEQ ID NO: 3832135 - RNA, 15 nt, Shigella flexneri 2a str. 2457T
ggauugccagaugcg

SEQ ID NO: 3832136 - RNA, 16 nt, Shigella flexneri 2a str. 2457T
ggauugccgcuucauu

SEQ ID NO: 3832137 - RNA, 18 nt, Shigella flexneri 2a str. 2457T
ggauugcuccugcucauc

SEQ ID NO: 3832138 - RNA, 20 nt, Shigella flexneri 2a str. 2457T
ggauuuaagucgacgguaua

SEQ ID NO: 3832139 - RNA, 15 nt, Shigella flexneri 2a str. 2457T
ggauuuaaugccaau

SEQ ID NO: 3832140 - RNA, 17 nt, Shigella flexneri 2a str. 2457T
ggauuuaccuugcucau

SEQ ID NO: 3832141 - RNA, 14 nt, Shigella flexneri 2a str. 2457T
ggauuucauauccg

SEQ ID NO: 3832142 - RNA, 14 nt, Shigella flexneri 2a str. 2457T
ggauuucugauuau

SEQ ID NO: 3832143 - RNA, 21 nt, Shigella flexneri 2a str. 2457T
ggauuucugauuauggcggcg

SEQ ID NO: 3832144 - RNA, 19 nt, Shigella flexneri 2a str. 2457T
ggauuuucaccaucgccau

SEQ ID NO: 3832145 - RNA, 13 nt, Shigella flexneri 2a str. 2457T
ggauuuuuuauug

SEQ ID NO: 3832146 - RNA, 14 nt, Shigella flexneri 2a str. 2457T
ggauuuuuuuauuu

SEQ ID NO: 3832147 - RNA, 11 nt, Shigella flexneri 2a str. 2457T
ggcaaaaaaau

SEQ ID NO: 3832148 - RNA, 12 nt, Shigella flexneri 2a str. 2457T
ggcaaaaaaguc

SEQ ID NO: 3832149 - RNA, 13 nt, Shigella flexneri 2a str. 2457T
ggcaaaaaccaau

SEQ ID NO: 3832150 - RNA, 13 nt, Shigella flexneri 2a str. 2457T
ggcaaaaauaagg

SEQ ID NO: 3832151 - RNA, 12 nt, Shigella flexneri 2a str. 2457T
ggcaaaauaugu

SEQ ID NO: 3832152 - RNA, 23 nt, Shigella flexneri 2a str. 2457T
ggcaaaaucaucacucccuuucu

SEQ ID NO: 3832153 - RNA, 18 nt, Shigella flexneri 2a str. 2457T
ggcaaaaugcaucggcau

SEQ ID NO: 3832154 - RNA, 22 nt, Shigella flexneri 2a str. 2457T
ggcaaacaaacugcgauuuaac

SEQ ID NO: 3832155 - RNA, 13 nt, Shigella flexneri 2a str. 2457T
ggcaaacaccgcu

SEQ ID NO: 3832156 - RNA, 18 nt, Shigella flexneri 2a str. 2457T
ggcaaacagcacggucag

SEQ ID NO: 3832157 - RNA, 17 nt, Shigella flexneri 2a str. 2457T
ggcaaacaggcgcuggg

SEQ ID NO: 3832158 - RNA, 20 nt, Shigella flexneri 2a str. 2457T
ggcaaacaguuucugcagcu

SEQ ID NO: 3832159 - RNA, 13 nt, Shigella flexneri 2a str. 2457T
ggcaaacgcccuu

SEQ ID NO: 3832160 - RNA, 17 nt, Shigella flexneri 2a str. 2457T
ggcaaagugaauacaga

SEQ ID NO: 3832161 - RNA, 19 nt, Shigella flexneri 2a str. 2457T
ggcaaagugaauacagaac

SEQ ID NO: 3832162 - RNA, 14 nt, Shigella flexneri 2a str. 2457T
ggcaucagcagaau

SEQ ID NO: 3832163 - RNA, 18 nt, Shigella flexneri 2a str. 2457T
ggcaucauacacgccgcc

SEQ ID NO: 3832164 - RNA, 20 nt, Shigella flexneri 2a str. 2457T
ggcauccagguuucuuccag

SEQ ID NO: 3832165 - RNA, 18 nt, Shigella flexneri 2a str. 2457T
ggcaucccggcauaaccg

SEQ ID NO: 3832166 - RNA, 20 nt, Shigella flexneri 2a str. 2457T
ggcaucgccuucgcaaaaaa

SEQ ID NO: 3832167 - RNA, 13 nt, Shigella flexneri 2a str. 2457T
ggcaucgggcagc

SEQ ID NO: 3832168 - RNA, 15 nt, Shigella flexneri 2a str. 2457T
ggcaucggugcacaa

SEQ ID NO: 3832169 - RNA, 15 nt, Shigella flexneri 2a str. 2457T
ggcaucguguugaug

SEQ ID NO: 3832170 - RNA, 18 nt, Shigella flexneri 2a str. 2457T
ggcaucuucuccacgcca

SEQ ID NO: 3832171 - RNA, 14 nt, Shigella flexneri 2a str. 2457T
ggcaugaaugguca

SEQ ID NO: 3832172 - RNA, 14 nt, Shigella flexneri 2a str. 2457T
ggcaugacacagaa

SEQ ID NO: 3832173 - RNA, 16 nt, Shigella flexneri 2a str. 2457T
ggcaugacgcaggucg

SEQ ID NO: 3832174 - RNA, 18 nt, Shigella flexneri 2a str. 2457T
ggcaugcuguccagcagg

SEQ ID NO: 3832175 - RNA, 15 nt, Shigella flexneri 2a str. 2457T
ggcauggggucaggu

SEQ ID NO: 3832176 - RNA, 17 nt, Shigella flexneri 2a str. 2457T
ggcauggggucaggugg

SEQ ID NO: 3832177 - RNA, 22 nt, Shigella flexneri 2a str. 2457T
ggcauggggucaggugggacca

SEQ ID NO: 3832178 - RNA, 23 nt, Shigella flexneri 2a str. 2457T
ggcaugucgguuguacaaaaaau

SEQ ID NO: 3832179 - RNA, 19 nt, Shigella flexneri 2a str. 2457T
ggcauguguuagcccuguc

SEQ ID NO: 3832180 - RNA, 12 nt, Shigella flexneri 2a str. 2457T
ggcauuaaacau

SEQ ID NO: 3832181 - RNA, 22 nt, Shigella flexneri 2a str. 2457T
ggcauuacaagaaucaugccaa

SEQ ID NO: 3832182 - RNA, 13 nt, Shigella flexneri 2a str. 2457T
ggcauuagauauu

SEQ ID NO: 3832183 - RNA, 17 nt, Shigella flexneri 2a str. 2457T
ggcauuaucucuugcca

SEQ ID NO: 3832184 - RNA, 18 nt, Shigella flexneri 2a str. 2457T
ggcauucagauaauaggu

SEQ ID NO: 3832185 - RNA, 19 nt, Shigella flexneri 2a str. 2457T
ggcauugcaaugacgccga

SEQ ID NO: 3832186 - RNA, 20 nt, Shigella flexneri 2a str. 2457T
ggcauuggcauagugcugag

SEQ ID NO: 3832187 - RNA, 21 nt, Shigella flexneri 2a str. 2457T
ggcauuuacgccgcauccggc

SEQ ID NO: 3832188 - RNA, 18 nt, Shigella flexneri 2a str. 2457T
ggcauuugcuccagacgc

SEQ ID NO: 3832189 - RNA, 18 nt, Shigella flexneri 2a str. 2457T
ggcauuuggcucucgaug

SEQ ID NO: 3832190 - RNA, 18 nt, Shigella flexneri 2a str. 2457T
ggccaaaaaacagccccu

SEQ ID NO: 3832191 - RNA, 22 nt, Shigella flexneri 2a str. 2457T
ggccaaaaaacagccccugagc

SEQ ID NO: 3832192 - RNA, 15 nt, Shigella flexneri 2a str. 2457T
ggccaaagaccagga

SEQ ID NO: 3832193 - RNA, 17 nt, Shigella flexneri 2a str. 2457T
ggccaaagccgccgagc

SEQ ID NO: 3832194 - RNA, 14 nt, Shigella flexneri 2a str. 2457T
ggccaaaucgccau

SEQ ID NO: 3832195 - RNA, 20 nt, Shigella flexneri 2a str. 2457T
ggccaacgauaauucagcaa

SEQ ID NO: 3832196 - RNA, 19 nt, Shigella flexneri 2a str. 2457T
ggccaacgcccauaaugcg

SEQ ID NO: 3832197 - RNA, 12 nt, Shigella flexneri 2a str. 2457T
ggccaacuggca

SEQ ID NO: 3832198 - RNA, 14 nt, Shigella flexneri 2a str. 2457T
ggccaacuggcaaa

SEQ ID NO: 3832199 - RNA, 17 nt, Shigella flexneri 2a str. 2457T
ggccaauaacccgcugu

SEQ ID NO: 3832200 - RNA, 19 nt, Shigella flexneri 2a str. 2457T
ggccaauaacccgcuguaa

SEQ ID NO: 3832201 - RNA, 17 nt, Shigella flexneri 2a str. 2457T
ggccaauccagcccugc

SEQ ID NO: 3832202 - RNA, 14 nt, Shigella flexneri 2a str. 2457T
ggccaauuuggcug

SEQ ID NO: 3832203 - RNA, 16 nt, Shigella flexneri 2a str. 2457T
ggccaauuuggcugcc

SEQ ID NO: 3832204 - RNA, 16 nt, Shigella flexneri 2a str. 2457T
ggccaccagcguggca

SEQ ID NO: 3832205 - RNA, 14 nt, Shigella flexneri 2a str. 2457T
ggccacccuguacg

SEQ ID NO: 3832206 - RNA, 13 nt, Shigella flexneri 2a str. 2457T
ggccacggcgacc

SEQ ID NO: 3832207 - RNA, 16 nt, Shigella flexneri 2a str. 2457T
ggccagacauuauaaa

SEQ ID NO: 3832208 - RNA, 20 nt, Shigella flexneri 2a str. 2457T
ggccagauaagacgcgucag

SEQ ID NO: 3832209 - RNA, 14 nt, Shigella flexneri 2a str. 2457T
ggccagcagcagag

SEQ ID NO: 3832210 - RNA, 14 nt, Shigella flexneri 2a str. 2457T
ggccagcaggucaa

SEQ ID NO: 3832211 - RNA, 17 nt, Shigella flexneri 2a str. 2457T
ggccagcaugugguuac

SEQ ID NO: 3832212 - RNA, 14 nt, Shigella flexneri 2a str. 2457T
ggccagccagcaga

SEQ ID NO: 3832213 - RNA, 15 nt, Shigella flexneri 2a str. 2457T
ggccagccagcagag

SEQ ID NO: 3832214 - RNA, 14 nt, Shigella flexneri 2a str. 2457T
ggccagcgccacca

SEQ ID NO: 3832215 - RNA, 21 nt, Shigella flexneri 2a str. 2457T
ggccaguaagcaguccagcgc

SEQ ID NO: 3832216 - RNA, 23 nt, Shigella flexneri 2a str. 2457T
ggccaguaagcaguccagcgccu

SEQ ID NO: 3832217 - RNA, 15 nt, Shigella flexneri 2a str. 2457T
ggccaguuccgccgg

SEQ ID NO: 3832218 - RNA, 10 nt, Shigella flexneri 2a str. 2457T
ggccaguugc

SEQ ID NO: 3832219 - RNA, 19 nt, Shigella flexneri 2a str. 2457T
ggccaguuucauagugcaa

SEQ ID NO: 3832220 - RNA, 18 nt, Shigella flexneri 2a str. 2457T
ggccauacccgccagugc

SEQ ID NO: 3832221 - RNA, 19 nt, Shigella flexneri 2a str. 2457T
ggccauccgcgugacgcug

SEQ ID NO: 3832222 - RNA, 20 nt, Shigella flexneri 2a str. 2457T
ggccauccgcgugacgcugg

SEQ ID NO: 3832223 - RNA, 18 nt, Shigella flexneri 2a str. 2457T
ggccaugaccgccgcagc

SEQ ID NO: 3832224 - RNA, 15 nt, Shigella flexneri 2a str. 2457T
ggccaugcggcgagg

SEQ ID NO: 3832225 - RNA, 20 nt, Shigella flexneri 2a str. 2457T
ggccaugcugcuuuguaagu

SEQ ID NO: 3832226 - RNA, 15 nt, Shigella flexneri 2a str. 2457T
ggccauuacuacccu

SEQ ID NO: 3832227 - RNA, 17 nt, Shigella flexneri 2a str. 2457T
ggccauugaauauuuuu

SEQ ID NO: 3832228 - RNA, 23 nt, Shigella flexneri 2a str. 2457T
ggcccaacuguugauccaggagc

SEQ ID NO: 3832229 - RNA, 19 nt, Shigella flexneri 2a str. 2457T
ggcccagugagucggggcc

SEQ ID NO: 3832230 - RNA, 23 nt, Shigella flexneri 2a str. 2457T
ggcccagugagucggggccagca

SEQ ID NO: 3832231 - RNA, 17 nt, Shigella flexneri 2a str. 2457T
ggcccauuuucucggcu

SEQ ID NO: 3832232 - RNA, 19 nt, Shigella flexneri 2a str. 2457T
ggcccggauucagauugca

SEQ ID NO: 3832233 - RNA, 21 nt, Shigella flexneri 2a str. 2457T
ggcccuuccccuucucgucgg

SEQ ID NO: 3832234 - RNA, 18 nt, Shigella flexneri 2a str. 2457T
ggccgaauaccggcgucc

SEQ ID NO: 3832235 - RNA, 14 nt, Shigella flexneri 2a str. 2457T
ggccgagaggcuga

SEQ ID NO: 3832236 - RNA, 18 nt, Shigella flexneri 2a str. 2457T
gcauuuccgcugauucaa

SEQ ID NO: 3832237 - RNA, 17 nt, Shigella flexneri 2a str. 2457T
gcauuucgccaaaccaa

SEQ ID NO: 3832238 - RNA, 23 nt, Shigella flexneri 2a str. 2457T
gcauuucucacuuuucaccgcuu

SEQ ID NO: 3832239 - RNA, 19 nt, Shigella flexneri 2a str. 2457T
gcauuugagcaggaugccu

SEQ ID NO: 3832240 - RNA, 22 nt, Shigella flexneri 2a str. 2457T
gcauuugcaccgauugccggau

SEQ ID NO: 3832241 - RNA, 17 nt, Shigella flexneri 2a str. 2457T
gcauuugcuccagacgc

SEQ ID NO: 3832242 - RNA, 23 nt, Shigella flexneri 2a str. 2457T
gcauuuggacacccuugccggau

SEQ ID NO: 3832243 - RNA, 23 nt, Shigella flexneri 2a str. 2457T
gcauuuggcucucgaugccugau

SEQ ID NO: 3832244 - RNA, 16 nt, Shigella flexneri 2a str. 2457T
gcauuuguaggcagga

SEQ ID NO: 3832245 - RNA, 12 nt, Shigella flexneri 2a str. 2457T
gcauuuucucgc

SEQ ID NO: 3832246 - RNA, 19 nt, Shigella flexneri 2a str. 2457T
gcauuuucucgcggacugc

SEQ ID NO: 3832247 - RNA, 13 nt, Shigella flexneri 2a str. 2457T
gcauuuugcagau

SEQ ID NO: 3832248 - RNA, 19 nt, Shigella flexneri 2a str. 2457T
gcauuuugcggaucugcuc

SEQ ID NO: 3832249 - RNA, 13 nt, Shigella flexneri 2a str. 2457T
gcauuuugcugau

SEQ ID NO: 3832250 - RNA, 19 nt, Shigella flexneri 2a str. 2457T
gcauuuuuucacauguuca

SEQ ID NO: 3832251 - RNA, 15 nt, Shigella flexneri 2a str. 2457T
gccaaaauaacuuaa

SEQ ID NO: 3832252 - RNA, 16 nt, Shigella flexneri 2a str. 2457T
gccaaaauaacuuaau

SEQ ID NO: 3832253 - RNA, 11 nt, Shigella flexneri 2a str. 2457T
gccaaaaugcc

SEQ ID NO: 3832254 - RNA, 12 nt, Shigella flexneri 2a str. 2457T
gccaaaccacgg

SEQ ID NO: 3832255 - RNA, 21 nt, Shigella flexneri 2a str. 2457T
gccaaacccaccagcugauga

SEQ ID NO: 3832256 - RNA, 19 nt, Shigella flexneri 2a str. 2457T
gccaaacgcucccugccag

SEQ ID NO: 3832257 - RNA, 17 nt, Shigella flexneri 2a str. 2457T
gccaaagaccaggaaac

SEQ ID NO: 3832258 - RNA, 18 nt, Shigella flexneri 2a str. 2457T
gccaaagcggcaguuaaa

SEQ ID NO: 3832259 - RNA, 17 nt, Shigella flexneri 2a str. 2457T
gccaaagggcuggcaau

SEQ ID NO: 3832260 - RNA, 14 nt, Shigella flexneri 2a str. 2457T
gccaaauaaaaucc

SEQ ID NO: 3832261 - RNA, 14 nt, Shigella flexneri 2a str. 2457T
gccaaaucauccag

SEQ ID NO: 3832262 - RNA, 19 nt, Shigella flexneri 2a str. 2457T
gccaaaucauccagaccgc

SEQ ID NO: 3832263 - RNA, 21 nt, Shigella flexneri 2a str. 2457T
gccaaaucauccagaccgcuc

SEQ ID NO: 3832264 - RNA, 21 nt, Shigella flexneri 2a str. 2457T
gccaaaucauccagacugcuc

SEQ ID NO: 3832265 - RNA, 15 nt, Shigella flexneri 2a str. 2457T
gccaaauccagcgcc

SEQ ID NO: 3832266 - RNA, 18 nt, Shigella flexneri 2a str. 2457T
gccaaauccagcgccaca

SEQ ID NO: 3832267 - RNA, 17 nt, Shigella flexneri 2a str. 2457T
gccaaauccuuccagcu

SEQ ID NO: 3832268 - RNA, 23 nt, Shigella flexneri 2a str. 2457T
gccaaauccuuccagcuccagcc

SEQ ID NO: 3832269 - RNA, 16 nt, Shigella flexneri 2a str. 2457T
gccaaaugucaccagc

SEQ ID NO: 3832270 - RNA, 18 nt, Shigella flexneri 2a str. 2457T
gccaaaugucaccagccg

SEQ ID NO: 3832271 - RNA, 18 nt, Shigella flexneri 2a str. 2457T
gccaaaugucagcugcca

SEQ ID NO: 3832272 - RNA, 19 nt, Shigella flexneri 2a str. 2457T
gccaaauuuggugcucagu

SEQ ID NO: 3832273 - RNA, 14 nt, Shigella flexneri 2a str. 2457T
gccaacaaucucuu

SEQ ID NO: 3832274 - RNA, 17 nt, Shigella flexneri 2a str. 2457T
gccaacaaucucuucca

SEQ ID NO: 3832275 - RNA, 18 nt, Shigella flexneri 2a str. 2457T
gccaacaaucucuuccag

SEQ ID NO: 3832276 - RNA, 14 nt, Shigella flexneri 2a str. 2457T
gccaaccacaugau

SEQ ID NO: 3832277 - RNA, 21 nt, Shigella flexneri 2a str. 2457T
gccaaccccaauguagccgca

SEQ ID NO: 3832278 - RNA, 21 nt, Shigella flexneri 2a str. 2457T
gccaaccgauaucuuuccggc

SEQ ID NO: 3832279 - RNA, 13 nt, Shigella flexneri 2a str. 2457T
gccaaccgcggca

SEQ ID NO: 3832280 - RNA, 20 nt, Shigella flexneri 2a str. 2457T
gccaaccgucagauccgcca

SEQ ID NO: 3832281 - RNA, 11 nt, Shigella flexneri 2a str. 2457T
gccaaccugcg

SEQ ID NO: 3832282 - RNA, 16 nt, Shigella flexneri 2a str. 2457T
gccaaccugcugguca

SEQ ID NO: 3832283 - RNA, 21 nt, Shigella flexneri 2a str. 2457T
gccaaccuugcggaagcguca

SEQ ID NO: 3832284 - RNA, 14 nt, Shigella flexneri 2a str. 2457T
gccaacgcccagcg

SEQ ID NO: 3832285 - RNA, 21 nt, Shigella flexneri 2a str. 2457T
gccaacuucaugaccuuccag

SEQ ID NO: 3832286 - RNA, 13 nt, Shigella flexneri 2a str. 2457T
gccaagaaacacc

SEQ ID NO: 3832287 - RNA, 16 nt, Shigella flexneri 2a str. 2457T
gccaagauagaaccac

SEQ ID NO: 3832288 - RNA, 13 nt, Shigella flexneri 2a str. 2457T
gccaagcgccgcc

SEQ ID NO: 3832289 - RNA, 16 nt, Shigella flexneri 2a str. 2457T
gccaauaaaugccacc

SEQ ID NO: 3832290 - RNA, 18 nt, Shigella flexneri 2a str. 2457T
gccaauaaucgcgcuaau

SEQ ID NO: 3832291 - RNA, 22 nt, Shigella flexneri 2a str. 2457T
gccaauacaaaauuuaacacca

SEQ ID NO: 3832292 - RNA, 17 nt, Shigella flexneri 2a str. 2457T
gccaaucacucaccugc

SEQ ID NO: 3832293 - RNA, 18 nt, Shigella flexneri 2a str. 2457T
gccaaucagcagaaccgc

SEQ ID NO: 3832294 - RNA, 19 nt, Shigella flexneri 2a str. 2457T
gccaaucagcgcagcaccc

SEQ ID NO: 3832295 - RNA, 19 nt, Shigella flexneri 2a str. 2457T
gccaaucccggaagccacc

SEQ ID NO: 3832296 - RNA, 20 nt, Shigella flexneri 2a str. 2457T
gccaaucccggaagccacca

SEQ ID NO: 3832297 - RNA, 12 nt, Shigella flexneri 2a str. 2457T
gccaaucggcaa

SEQ ID NO: 3832298 - RNA, 19 nt, Shigella flexneri 2a str. 2457T
gccaaucucuacgacuuga

SEQ ID NO: 3832299 - RNA, 19 nt, Shigella flexneri 2a str. 2457T
gccaaucuucacaucauca

SEQ ID NO: 3832300 - RNA, 20 nt, Shigella flexneri 2a str. 2457T
gccaaucuucacaucaucau

SEQ ID NO: 3832301 - RNA, 20 nt, Shigella flexneri 2a str. 2457T
gccaaugaaguggcauccga

SEQ ID NO: 3832302 - RNA, 16 nt, Shigella flexneri 2a str. 2457T
gccaaugcaggcaucg

SEQ ID NO: 3832303 - RNA, 16 nt, Shigella flexneri 2a str. 2457T
gccaauguguuuauaa

SEQ ID NO: 3832304 - RNA, 23 nt, Shigella flexneri 2a str. 2457T
gccaauguguuuauaagccaugu

SEQ ID NO: 3832305 - RNA, 22 nt, Shigella flexneri 2a str. 2457T
gccaauuaaugcaccaacaaau

SEQ ID NO: 3832306 - RNA, 12 nt, Shigella flexneri 2a str. 2457T
gccaauugcugu

SEQ ID NO: 3832307 - RNA, 18 nt, Shigella flexneri 2a str. 2457T
gccacaaccguccuccgu

SEQ ID NO: 3832308 - RNA, 16 nt, Shigella flexneri 2a str. 2457T
gccacaacgcaauaaa

SEQ ID NO: 3832309 - RNA, 13 nt, Shigella flexneri 2a str. 2457T
gccacaacuucaa

SEQ ID NO: 3832310 - RNA, 17 nt, Shigella flexneri 2a str. 2457T
gccacaacuucaacguu

SEQ ID NO: 3832311 - RNA, 15 nt, Shigella flexneri 2a str. 2457T
gccacaauaaacgcg

SEQ ID NO: 3832312 - RNA, 20 nt, Shigella flexneri 2a str. 2457T
gccacaauacugaucaucau

SEQ ID NO: 3832313 - RNA, 14 nt, Shigella flexneri 2a str. 2457T
gccacaauauuccg

SEQ ID NO: 3832314 - RNA, 17 nt, Shigella flexneri 2a str. 2457T
gccacacaccgcaaacu

SEQ ID NO: 3832315 - RNA, 21 nt, Shigella flexneri 2a str. 2457T
gccacaccgaggcauucagcc

SEQ ID NO: 3832316 - RNA, 22 nt, Shigella flexneri 2a str. 2457T
gccacacgagucauuccggccc

SEQ ID NO: 3832317 - RNA, 21 nt, Shigella flexneri 2a str. 2457T
gccacagauaauaauguguuc

SEQ ID NO: 3832318 - RNA, 20 nt, Shigella flexneri 2a str. 2457T
gccacagcagccuucgccac

SEQ ID NO: 3832319 - RNA, 13 nt, Shigella flexneri 2a str. 2457T
gccacagccagcc

SEQ ID NO: 3832320 - RNA, 16 nt, Shigella flexneri 2a str. 2457T
gccacagccagccaac

SEQ ID NO: 3832321 - RNA, 20 nt, Shigella flexneri 2a str. 2457T
gccacagccgagcgccacca

SEQ ID NO: 3832322 - RNA, 20 nt, Shigella flexneri 2a str. 2457T
gccacagcgccagacacugg

SEQ ID NO: 3832323 - RNA, 19 nt, Shigella flexneri 2a str. 2457T
gccacaggcuuuccugaua

SEQ ID NO: 3832324 - RNA, 19 nt, Shigella flexneri 2a str. 2457T
gccacagggugaucaccag

SEQ ID NO: 3832325 - RNA, 13 nt, Shigella flexneri 2a str. 2457T
gccacauccgcgg

SEQ ID NO: 3832326 - RNA, 21 nt, Shigella flexneri 2a str. 2457T
gccacauccgcgguaucgccg

SEQ ID NO: 3832327 - RNA, 13 nt, Shigella flexneri 2a str. 2457T
gccacauccggca

SEQ ID NO: 3832328 - RNA, 18 nt, Shigella flexneri 2a str. 2457T
gccacauuagauaaaaau

SEQ ID NO: 3832329 - RNA, 17 nt, Shigella flexneri 2a str. 2457T
gccacauuccucuguca

SEQ ID NO: 3832330 - RNA, 20 nt, Shigella flexneri 2a str. 2457T
gccacauugcaucugauaac

SEQ ID NO: 3832331 - RNA, 18 nt, Shigella flexneri 2a str. 2457T
gccacauugcguccaggc

SEQ ID NO: 3832332 - RNA, 23 nt, Shigella flexneri 2a str. 2457T
gccacauugcugcacauccggua

SEQ ID NO: 3832333 - RNA, 14 nt, Shigella flexneri 2a str. 2457T
gccaccaccagcgu

SEQ ID NO: 3832334 - RNA, 18 nt, Shigella flexneri 2a str. 2457T
cuggcucaucgccuucca

SEQ ID NO: 3832335 - RNA, 14 nt, Shigella flexneri 2a str. 2457T
cuggcucugcacua

SEQ ID NO: 3832336 - RNA, 14 nt, Shigella flexneri 2a str. 2457T
cuggcucuuuuucg

SEQ ID NO: 3832337 - RNA, 23 nt, Shigella flexneri 2a str. 2457T
cuggcugacauaaacaccagcaa

SEQ ID NO: 3832338 - RNA, 23 nt, Shigella flexneri 2a str. 2457T
cuggcugagcaaacaguucugca

SEQ ID NO: 3832339 - RNA, 21 nt, Shigella flexneri 2a str. 2457T
cuggcugauaaaacucucauc

SEQ ID NO: 3832340 - RNA, 23 nt, Shigella flexneri 2a str. 2457T
cuggcugcguaagcgccaucuga

SEQ ID NO: 3832341 - RNA, 16 nt, Shigella flexneri 2a str. 2457T
cuggcuggcaucuuga

SEQ ID NO: 3832342 - RNA, 19 nt, Shigella flexneri 2a str. 2457T
cuggcuggcgguuuuucuu

SEQ ID NO: 3832343 - RNA, 17 nt, Shigella flexneri 2a str. 2457T
cuggcuguucugccucu

SEQ ID NO: 3832344 - RNA, 20 nt, Shigella flexneri 2a str. 2457T
cuggcuguuucgcuucuuca

SEQ ID NO: 3832345 - RNA, 13 nt, Shigella flexneri 2a str. 2457T
cuggcuucccggc

SEQ ID NO: 3832346 - RNA, 18 nt, Shigella flexneri 2a str. 2457T
cuggcuugccagccauga

SEQ ID NO: 3832347 - RNA, 16 nt, Shigella flexneri 2a str. 2457T
cugggaaaccuggaua

SEQ ID NO: 3832348 - RNA, 17 nt, Shigella flexneri 2a str. 2457T
cugggaaaccuggauau

SEQ ID NO: 3832349 - RNA, 22 nt, Shigella flexneri 2a str. 2457T
cugggaaaucaccaccagcacc

SEQ ID NO: 3832350 - RNA, 16 nt, Shigella flexneri 2a str. 2457T
cugggacgcagacugg

SEQ ID NO: 3832351 - RNA, 15 nt, Shigella flexneri 2a str. 2457T
cugggagaacgcugc

SEQ ID NO: 3832352 - RNA, 18 nt, Shigella flexneri 2a str. 2457T
cugggagaauugcgaauu

SEQ ID NO: 3832353 - RNA, 22 nt, Shigella flexneri 2a str. 2457T
cugggagaugauaaccccgcaa

SEQ ID NO: 3832354 - RNA, 14 nt, Shigella flexneri 2a str. 2457T
cugggcaacaaaac

SEQ ID NO: 3832355 - RNA, 14 nt, Shigella flexneri 2a str. 2457T
cugggcaaugcugu

SEQ ID NO: 3832356 - RNA, 19 nt, Shigella flexneri 2a str. 2457T
cugggcaugguggcccgga

SEQ ID NO: 3832357 - RNA, 19 nt, Shigella flexneri 2a str. 2457T
cugggccgccauccggcaa

SEQ ID NO: 3832358 - RNA, 14 nt, Shigella flexneri 2a str. 2457T
cugggccugcauau

SEQ ID NO: 3832359 - RNA, 17 nt, Shigella flexneri 2a str. 2457T
cugggccugcauaucgg

SEQ ID NO: 3832360 - RNA, 19 nt, Shigella flexneri 2a str. 2457T
cugggcgaugcuggcagaa

SEQ ID NO: 3832361 - RNA, 16 nt, Shigella flexneri 2a str. 2457T
cugggcgauuuccuuc

SEQ ID NO: 3832362 - RNA, 16 nt, Shigella flexneri 2a str. 2457T
cugggcgcaccugccc

SEQ ID NO: 3832363 - RNA, 19 nt, Shigella flexneri 2a str. 2457T
cugggcgcgcucagcgcca

SEQ ID NO: 3832364 - RNA, 19 nt, Shigella flexneri 2a str. 2457T
cugggcuaacacccgucgu

SEQ ID NO: 3832365 - RNA, 13 nt, Shigella flexneri 2a str. 2457T
cugggcugccuga

SEQ ID NO: 3832366 - RNA, 17 nt, Shigella flexneri 2a str. 2457T
cuggggaaaaugggcau

SEQ ID NO: 3832367 - RNA, 16 nt, Shigella flexneri 2a str. 2457T
cuggggauagaaacag

SEQ ID NO: 3832368 - RNA, 13 nt, Shigella flexneri 2a str. 2457T
cuggggccgucau

SEQ ID NO: 3832369 - RNA, 18 nt, Shigella flexneri 2a str. 2457T
cuggggcuugccagagca

SEQ ID NO: 3832370 - RNA, 19 nt, Shigella flexneri 2a str. 2457T
cuggggcuugccagagcag

SEQ ID NO: 3832371 - RNA, 17 nt, Shigella flexneri 2a str. 2457T
cuggggguucaucacca

SEQ ID NO: 3832372 - RNA, 12 nt, Shigella flexneri 2a str. 2457T
cuggguaacacc

SEQ ID NO: 3832373 - RNA, 21 nt, Shigella flexneri 2a str. 2457T
cuggguagaguuugaacucac

SEQ ID NO: 3832374 - RNA, 14 nt, Shigella flexneri 2a str. 2457T
cuggguauucagcg

SEQ ID NO: 3832375 - RNA, 21 nt, Shigella flexneri 2a str. 2457T
cugggugguugucgcacugcu

SEQ ID NO: 3832376 - RNA, 21 nt, Shigella flexneri 2a str. 2457T
cuggguuggguucacuuuccc

SEQ ID NO: 3832377 - RNA, 20 nt, Shigella flexneri 2a str. 2457T
cuggguuucgccugccagau

SEQ ID NO: 3832378 - RNA, 14 nt, Shigella flexneri 2a str. 2457T
cuggguuuucacag

SEQ ID NO: 3832379 - RNA, 16 nt, Shigella flexneri 2a str. 2457T
cugguaaaccuuccac

SEQ ID NO: 3832380 - RNA, 15 nt, Shigella flexneri 2a str. 2457T
cugguaacagugcac

SEQ ID NO: 3832381 - RNA, 16 nt, Shigella flexneri 2a str. 2457T
cugguaaucaccaccc

SEQ ID NO: 3832382 - RNA, 14 nt, Shigella flexneri 2a str. 2457T
cugguaccagcacc

SEQ ID NO: 3832383 - RNA, 17 nt, Shigella flexneri 2a str. 2457T
cugguacuggugcaaaa

SEQ ID NO: 3832384 - RNA, 20 nt, Shigella flexneri 2a str. 2457T
cugguagacguucaguuccg

SEQ ID NO: 3832385 - RNA, 15 nt, Shigella flexneri 2a str. 2457T
cugguagcaucugca

SEQ ID NO: 3832386 - RNA, 21 nt, Shigella flexneri 2a str. 2457T
cugguaguuguacaacugcuu

SEQ ID NO: 3832387 - RNA, 17 nt, Shigella flexneri 2a str. 2457T
cugguaucgcgccagcc

SEQ ID NO: 3832388 - RNA, 16 nt, Shigella flexneri 2a str. 2457T
cugguauuuugcgcuu

SEQ ID NO: 3832389 - RNA, 16 nt, Shigella flexneri 2a str. 2457T
cugguccuucaucuuc

SEQ ID NO: 3832390 - RNA, 16 nt, Shigella flexneri 2a str. 2457T
cuggucgcccuucauc

SEQ ID NO: 3832391 - RNA, 21 nt, Shigella flexneri 2a str. 2457T
cuggucggcaaacugcugaug

SEQ ID NO: 3832392 - RNA, 12 nt, Shigella flexneri 2a str. 2457T
cuggugaccugg

SEQ ID NO: 3832393 - RNA, 20 nt, Shigella flexneri 2a str. 2457T
cuggugauacaacgaccggc

SEQ ID NO: 3832394 - RNA, 13 nt, Shigella flexneri 2a str. 2457T
cuggugauugccg

SEQ ID NO: 3832395 - RNA, 16 nt, Shigella flexneri 2a str. 2457T
cuggugauugucuuuu

SEQ ID NO: 3832396 - RNA, 23 nt, Shigella flexneri 2a str. 2457T
cuggugauuucguccagcgaacc

SEQ ID NO: 3832397 - RNA, 18 nt, Shigella flexneri 2a str. 2457T
cuggugccaagcuccagc

SEQ ID NO: 3832398 - RNA, 21 nt, Shigella flexneri 2a str. 2457T
cuggugccaagcuccagcauc

SEQ ID NO: 3832399 - RNA, 17 nt, Shigella flexneri 2a str. 2457T
cuggugcuaacagcaau

SEQ ID NO: 3832400 - RNA, 14 nt, Shigella flexneri 2a str. 2457T
cuggugcuuuuuca

SEQ ID NO: 3832401 - RNA, 17 nt, Shigella flexneri 2a str. 2457T
cugguggaaaggacagu

SEQ ID NO: 3832402 - RNA, 17 nt, Shigella flexneri 2a str. 2457T
cugguggacaauacgcg

SEQ ID NO: 3832403 - RNA, 22 nt, Shigella flexneri 2a str. 2457T
cugguggcgagguaggcaguca

SEQ ID NO: 3832404 - RNA, 19 nt, Shigella flexneri 2a str. 2457T
cuggugggcggcgugauug

SEQ ID NO: 3832405 - RNA, 23 nt, Shigella flexneri 2a str. 2457T
cugguguucuuuuacgcuaccau

SEQ ID NO: 3832406 - RNA, 19 nt, Shigella flexneri 2a str. 2457T
cugguguugcccgaugacu

SEQ ID NO: 3832407 - RNA, 19 nt, Shigella flexneri 2a str. 2457T
cugguguugcuccccagaa

SEQ ID NO: 3832408 - RNA, 16 nt, Shigella flexneri 2a str. 2457T
cugguuaccaccugcu

SEQ ID NO: 3832409 - RNA, 16 nt, Shigella flexneri 2a str. 2457T
cugguuauauuucccc

SEQ ID NO: 3832410 - RNA, 21 nt, Shigella flexneri 2a str. 2457T
cugguuaucuuccaccaccac

SEQ ID NO: 3832411 - RNA, 17 nt, Shigella flexneri 2a str. 2457T
cugguuccugacuccug

SEQ ID NO: 3832412 - RNA, 13 nt, Shigella flexneri 2a str. 2457T
cugguucugcggg

SEQ ID NO: 3832413 - RNA, 23 nt, Shigella flexneri 2a str. 2457T
cugguucugcggguuagucugca

SEQ ID NO: 3832414 - RNA, 12 nt, Shigella flexneri 2a str. 2457T
cugguucuugcu

SEQ ID NO: 3832415 - RNA, 13 nt, Shigella flexneri 2a str. 2457T
cugguuucucuuc

SEQ ID NO: 3832416 - RNA, 14 nt, Shigella flexneri 2a str. 2457T
cugguuugccacgu

SEQ ID NO: 3832417 - RNA, 15 nt, Shigella flexneri 2a str. 2457T
cugguuuugaacagc

SEQ ID NO: 3832418 - RNA, 18 nt, Shigella flexneri 2a str. 2457T
cuguaaaucgccaugguc

SEQ ID NO: 3832419 - RNA, 20 nt, Shigella flexneri 2a str. 2457T
cuguaaauucucaauaucau

SEQ ID NO: 3832420 - RNA, 21 nt, Shigella flexneri 2a str. 2457T
cuguaacaaggugaaucaagc

SEQ ID NO: 3832421 - RNA, 15 nt, Shigella flexneri 2a str. 2457T
cuguaaccagcgcag

SEQ ID NO: 3832422 - RNA, 17 nt, Shigella flexneri 2a str. 2457T
cuguaaccagcgcagac

SEQ ID NO: 3832423 - RNA, 16 nt, Shigella flexneri 2a str. 2457T
cuguaacgccuuuucc

SEQ ID NO: 3832424 - RNA, 21 nt, Shigella flexneri 2a str. 2457T
cuguaacggagguacaaccgc

SEQ ID NO: 3832425 - RNA, 21 nt, Shigella flexneri 2a str. 2457T
cuguaacguugcugcgccgag

SEQ ID NO: 3832426 - RNA, 17 nt, Shigella flexneri 2a str. 2457T
cuguaagccaccgaaca

SEQ ID NO: 3832427 - RNA, 23 nt, Shigella flexneri 2a str. 2457T
cuguaauaccagccuucuucauc

SEQ ID NO: 3832428 - RNA, 14 nt, Shigella flexneri 2a str. 2457T
cuguaauccucuuu

SEQ ID NO: 3832429 - RNA, 13 nt, Shigella flexneri 2a str. 2457T
cuguaaugagaau

SEQ ID NO: 3832430 - RNA, 22 nt, Shigella flexneri 2a str. 2457T
cuguaaugucaucucuggcacg

SEQ ID NO: 3832431 - RNA, 23 nt, Shigella flexneri 2a str. 2457T
cuguaauugagaaccacaaugaa

SEQ ID NO: 3832432 - RNA, 15 nt, Shigella flexneri 2a str. 2457T
gauccaccaccgcaa

SEQ ID NO: 3832433 - RNA, 15 nt, Shigella flexneri 2a str. 2457T
gauccagcgcaauac

SEQ ID NO: 3832434 - RNA, 16 nt, Shigella flexneri 2a str. 2457T
gauccaggaacagaag

SEQ ID NO: 3832435 - RNA, 20 nt, Shigella flexneri 2a str. 2457T
gauccauaagguccuccagc

SEQ ID NO: 3832436 - RNA, 16 nt, Shigella flexneri 2a str. 2457T
gauccauacucuuucc

SEQ ID NO: 3832437 - RNA, 22 nt, Shigella flexneri 2a str. 2457T
gauccccugcgcggcgacuucc

SEQ ID NO: 3832438 - RNA, 14 nt, Shigella flexneri 2a str. 2457T
gaucccucuuucug

SEQ ID NO: 3832439 - RNA, 17 nt, Shigella flexneri 2a str. 2457T
gaucccuucgccgccgc

SEQ ID NO: 3832440 - RNA, 22 nt, Shigella flexneri 2a str. 2457T
gauccgcgauaagucuuugacu

SEQ ID NO: 3832441 - RNA, 16 nt, Shigella flexneri 2a str. 2457T
gauccgggcauauuuc

SEQ ID NO: 3832442 - RNA, 21 nt, Shigella flexneri 2a str. 2457T
gauccgggcuaaucgucaucg

SEQ ID NO: 3832443 - RNA, 17 nt, Shigella flexneri 2a str. 2457T
gauccuacacauacuua

SEQ ID NO: 3832444 - RNA, 17 nt, Shigella flexneri 2a str. 2457T
gauccugagccaguuuu

SEQ ID NO: 3832445 - RNA, 15 nt, Shigella flexneri 2a str. 2457T
gauccugcaacagca

SEQ ID NO: 3832446 - RNA, 16 nt, Shigella flexneri 2a str. 2457T
gauccugcacuuucag

SEQ ID NO: 3832447 - RNA, 22 nt, Shigella flexneri 2a str. 2457T
gauccuggcgaaaacgcccggc

SEQ ID NO: 3832448 - RNA, 15 nt, Shigella flexneri 2a str. 2457T
gauccuucuguucuu

SEQ ID NO: 3832449 - RNA, 16 nt, Shigella flexneri 2a str. 2457T
gauccuuuuucccaaa

SEQ ID NO: 3832450 - RNA, 15 nt, Shigella flexneri 2a str. 2457T
gaucgccaauaucaa

SEQ ID NO: 3832451 - RNA, 13 nt, Shigella flexneri 2a str. 2457T
gaucgccagguua

SEQ ID NO: 3832452 - RNA, 22 nt, Shigella flexneri 2a str. 2457T
gaucgccccggaagcaucaaac

SEQ ID NO: 3832453 - RNA, 20 nt, Shigella flexneri 2a str. 2457T
gaucgccgaagugaagagug

SEQ ID NO: 3832454 - RNA, 13 nt, Shigella flexneri 2a str. 2457T
gaucgcgcaguaa

SEQ ID NO: 3832455 - RNA, 19 nt, Shigella flexneri 2a str. 2457T
gaucgcgccaaucagcgca

SEQ ID NO: 3832456 - RNA, 21 nt, Shigella flexneri 2a str. 2457T
gaucgcgccagaaagcagcau

SEQ ID NO: 3832457 - RNA, 14 nt, Shigella flexneri 2a str. 2457T
gaucgcgccgccgc

SEQ ID NO: 3832458 - RNA, 17 nt, Shigella flexneri 2a str. 2457T
gaucgcggcauuaccgg

SEQ ID NO: 3832459 - RNA, 13 nt, Shigella flexneri 2a str. 2457T
gaucgcguaauaa

SEQ ID NO: 3832460 - RNA, 17 nt, Shigella flexneri 2a str. 2457T
gaucgcugcccugcugg

SEQ ID NO: 3832461 - RNA, 22 nt, Shigella flexneri 2a str. 2457T
gaucgcuuucagugucugcgcu

SEQ ID NO: 3832462 - RNA, 23 nt, Shigella flexneri 2a str. 2457T
gaucgcuuucgcuacuucaaaca

SEQ ID NO: 3832463 - RNA, 21 nt, Shigella flexneri 2a str. 2457T
gaucggacuucaugcgcagca

SEQ ID NO: 3832464 - RNA, 13 nt, Shigella flexneri 2a str. 2457T
gaucggcaaugag

SEQ ID NO: 3832465 - RNA, 18 nt, Shigella flexneri 2a str. 2457T
gaucggcguacuggcaau

SEQ ID NO: 3832466 - RNA, 18 nt, Shigella flexneri 2a str. 2457T
gaucgguaauugaucuca

SEQ ID NO: 3832467 - RNA, 22 nt, Shigella flexneri 2a str. 2457T
gaucguaagaauaaucaucggc

SEQ ID NO: 3832468 - RNA, 14 nt, Shigella flexneri 2a str. 2457T
gaucgugcucgaca

SEQ ID NO: 3832469 - RNA, 20 nt, Shigella flexneri 2a str. 2457T
gaucguggugaaggcacugg

SEQ ID NO: 3832470 - RNA, 15 nt, Shigella flexneri 2a str. 2457T
gaucgugugccacca

SEQ ID NO: 3832471 - RNA, 22 nt, Shigella flexneri 2a str. 2457T
gaucguguggauaauccauccc

SEQ ID NO: 3832472 - RNA, 13 nt, Shigella flexneri 2a str. 2457T
gaucguguggcgg

SEQ ID NO: 3832473 - RNA, 16 nt, Shigella flexneri 2a str. 2457T
gaucguguggcggcgu

SEQ ID NO: 3832474 - RNA, 14 nt, Shigella flexneri 2a str. 2457T
gaucguugaccuga

SEQ ID NO: 3832475 - RNA, 19 nt, Shigella flexneri 2a str. 2457T
gaucuaugucgcauccggc

SEQ ID NO: 3832476 - RNA, 13 nt, Shigella flexneri 2a str. 2457T
gaucucaaacggu

SEQ ID NO: 3832477 - RNA, 17 nt, Shigella flexneri 2a str. 2457T
gaucuccucaccauucc

SEQ ID NO: 3832478 - RNA, 14 nt, Shigella flexneri 2a str. 2457T
gaucucgucagcau

SEQ ID NO: 3832479 - RNA, 12 nt, Shigella flexneri 2a str. 2457T
gaucucuuccag

SEQ ID NO: 3832480 - RNA, 23 nt, Shigella flexneri 2a str. 2457T
gaucucuuccagugccucaagaa

SEQ ID NO: 3832481 - RNA, 15 nt, Shigella flexneri 2a str. 2457T
gaucucuucgccugc

SEQ ID NO: 3832482 - RNA, 14 nt, Shigella flexneri 2a str. 2457T
gaucugauucugau

SEQ ID NO: 3832483 - RNA, 15 nt, Shigella flexneri 2a str. 2457T
gaucugcgccugcac

SEQ ID NO: 3832484 - RNA, 18 nt, Shigella flexneri 2a str. 2457T
gaucuggaauggaaacag

SEQ ID NO: 3832485 - RNA, 21 nt, Shigella flexneri 2a str. 2457T
gaucuggaauggaaacagcac

SEQ ID NO: 3832486 - RNA, 15 nt, Shigella flexneri 2a str. 2457T
gaucuggaguuccug

SEQ ID NO: 3832487 - RNA, 23 nt, Shigella flexneri 2a str. 2457T
gaucuggcgcguuaucagcaacu

SEQ ID NO: 3832488 - RNA, 21 nt, Shigella flexneri 2a str. 2457T
gaucuugcgaccgcucuuuuu

SEQ ID NO: 3832489 - RNA, 20 nt, Shigella flexneri 2a str. 2457T
gaucuuuaucaaucaccgcu

SEQ ID NO: 3832490 - RNA, 17 nt, Shigella flexneri 2a str. 2457T
gaucuuucuucagccgu

SEQ ID NO: 3832491 - RNA, 23 nt, Shigella flexneri 2a str. 2457T
gaugaaaaaaccagaaagggaag

SEQ ID NO: 3832492 - RNA, 22 nt, Shigella flexneri 2a str. 2457T
gaugaaaagucauccggcguca

SEQ ID NO: 3832493 - RNA, 14 nt, Shigella flexneri 2a str. 2457T
gaugaaagaaaaaa

SEQ ID NO: 3832494 - RNA, 21 nt, Shigella flexneri 2a str. 2457T
gaugaaauagacauuacgcau

SEQ ID NO: 3832495 - RNA, 16 nt, Shigella flexneri 2a str. 2457T
gaugaaauaguugcau

SEQ ID NO: 3832496 - RNA, 18 nt, Shigella flexneri 2a str. 2457T
gaugaacggugcgcaggc

SEQ ID NO: 3832497 - RNA, 19 nt, Shigella flexneri 2a str. 2457T
gaugaaguccacgcgguag

SEQ ID NO: 3832498 - RNA, 22 nt, Shigella flexneri 2a str. 2457T
gaugacaaacuugauagaacaa

SEQ ID NO: 3832499 - RNA, 12 nt, Shigella flexneri 2a str. 2457T
gaugacagacuc

SEQ ID NO: 3832500 - RNA, 16 nt, Shigella flexneri 2a str. 2457T
gaugacagacuccgcu

SEQ ID NO: 3832501 - RNA, 21 nt, Shigella flexneri 2a str. 2457T
gaugacagucuggaagccagu

SEQ ID NO: 3832502 - RNA, 15 nt, Shigella flexneri 2a str. 2457T
gaugacauuaucugg

SEQ ID NO: 3832503 - RNA, 18 nt, Shigella flexneri 2a str. 2457T
gaugacauugaugcgcca

SEQ ID NO: 3832504 - RNA, 17 nt, Shigella flexneri 2a str. 2457T
gaugaccuugucaugca

SEQ ID NO: 3832505 - RNA, 21 nt, Shigella flexneri 2a str. 2457T
gaugacgcgucaggcgcguga

SEQ ID NO: 3832506 - RNA, 14 nt, Shigella flexneri 2a str. 2457T
gaugacugaacagg

SEQ ID NO: 3832507 - RNA, 21 nt, Shigella flexneri 2a str. 2457T
gaugacuggccggaagauaug

SEQ ID NO: 3832508 - RNA, 23 nt, Shigella flexneri 2a str. 2457T
gaugagcaaauccgcacucaucu

SEQ ID NO: 3832509 - RNA, 12 nt, Shigella flexneri 2a str. 2457T
gaugagcaucgu

SEQ ID NO: 3832510 - RNA, 23 nt, Shigella flexneri 2a str. 2457T
gaugaggcaccuguaguguguug

SEQ ID NO: 3832511 - RNA, 20 nt, Shigella flexneri 2a str. 2457T
gaugaggcguuaacagcgca

SEQ ID NO: 3832512 - RNA, 14 nt, Shigella flexneri 2a str. 2457T
gaugagggcgcuaa

SEQ ID NO: 3832513 - RNA, 17 nt, Shigella flexneri 2a str. 2457T
gaugaguugaaaaccuc

SEQ ID NO: 3832514 - RNA, 13 nt, Shigella flexneri 2a str. 2457T
gaugauaaaucca

SEQ ID NO: 3832515 - RNA, 22 nt, Shigella flexneri 2a str. 2457T
gaugauaaccccgcaauuucau

SEQ ID NO: 3832516 - RNA, 14 nt, Shigella flexneri 2a str. 2457T
gaugauauggucaa

SEQ ID NO: 3832517 - RNA, 15 nt, Shigella flexneri 2a str. 2457T
gaugauauguagacg

SEQ ID NO: 3832518 - RNA, 14 nt, Shigella flexneri 2a str. 2457T
gaugaucaacagca

SEQ ID NO: 3832519 - RNA, 19 nt, Shigella flexneri 2a str. 2457T
gaugaucaacagcaucauc

SEQ ID NO: 3832520 - RNA, 23 nt, Shigella flexneri 2a str. 2457T
gaugaucaacagcaucaucgcaa

SEQ ID NO: 3832521 - RNA, 12 nt, Shigella flexneri 2a str. 2457T
gaugaugccaag

SEQ ID NO: 3832522 - RNA, 18 nt, Shigella flexneri 2a str. 2457T
gaugaugccuacacgcca

SEQ ID NO: 3832523 - RNA, 14 nt, Shigella flexneri 2a str. 2457T
gaugauuaaagcau

SEQ ID NO: 3832524 - RNA, 16 nt, Shigella flexneri 2a str. 2457T
gaugauuacgcgcuca

SEQ ID NO: 3832525 - RNA, 14 nt, Shigella flexneri 2a str. 2457T
gaugcaacuguuuu

SEQ ID NO: 3832526 - RNA, 14 nt, Shigella flexneri 2a str. 2457T
gaugcacagaaccg

SEQ ID NO: 3832527 - RNA, 15 nt, Shigella flexneri 2a str. 2457T
gaugcacagcacgcu

SEQ ID NO: 3832528 - RNA, 21 nt, Shigella flexneri 2a str. 2457T
gaugcacugggagaacgcugc

SEQ ID NO: 3832529 - RNA, 15 nt, Shigella flexneri 2a str. 2457T
gaugcagcaucaugu

SEQ ID NO: 3832530 - RNA, 16 nt, Shigella flexneri 2a str. 2457T
gaugcagcguaaaccc

SEQ ID NO: 3832531 - RNA, 14 nt, Shigella flexneri 2a str. 2457T
gaugcaggccacca

SEQ ID NO: 3832532 - RNA, 17 nt, Shigella flexneri 2a str. 2457T
gaugccacaaacuggcu

SEQ ID NO: 3832533 - RNA, 23 nt, Shigella flexneri 2a str. 2457T
gaugccagaaagcguauccauca

SEQ ID NO: 3832534 - RNA, 13 nt, Shigella flexneri 2a str. 2457T
gaugccagcaccg

SEQ ID NO: 3832535 - RNA, 15 nt, Shigella flexneri 2a str. 2457T
gaugccagcgaagaa

SEQ ID NO: 3832536 - RNA, 18 nt, Shigella flexneri 2a str. 2457T
gaugccaguaauccggcu

SEQ ID NO: 3832537 - RNA, 17 nt, Shigella flexneri 2a str. 2457T
gaugccauuugccagac

SEQ ID NO: 3832538 - RNA, 13 nt, Shigella flexneri 2a str. 2457T
gaugcccagcuca

SEQ ID NO: 3832539 - RNA, 16 nt, Shigella flexneri 2a str. 2457T
gaugcccccagcagcg

SEQ ID NO: 3832540 - RNA, 21 nt, Shigella flexneri 2a str. 2457T
gaugccgauuguauacgcugg

SEQ ID NO: 3832541 - RNA, 15 nt, Shigella flexneri 2a str. 2457T
gaugccgccagaaau

SEQ ID NO: 3832542 - RNA, 18 nt, Shigella flexneri 2a str. 2457T
gaugccgcccucgcccgc

SEQ ID NO: 3832543 - RNA, 16 nt, Shigella flexneri 2a str. 2457T
gaugccgugcagcacg

SEQ ID NO: 3832544 - RNA, 15 nt, Shigella flexneri 2a str. 2457T
gaugccugaugcggc

SEQ ID NO: 3832545 - RNA, 23 nt, Shigella flexneri 2a str. 2457T
gaugccuugugggccugaaagcu

SEQ ID NO: 3832546 - RNA, 22 nt, Shigella flexneri 2a str. 2457T
gaugcgaucgcgaauaugcugg

SEQ ID NO: 3832547 - RNA, 14 nt, Shigella flexneri 2a str. 2457T
gaugcgauguaauc

SEQ ID NO: 3832548 - RNA, 13 nt, Shigella flexneri 2a str. 2457T
gaugcgccagcau

SEQ ID NO: 3832549 - RNA, 16 nt, Shigella flexneri 2a str. 2457T
gaugcgccagcauccg

SEQ ID NO: 3832550 - RNA, 13 nt, Shigella flexneri 2a str. 2457T
gaugcgcugcgcu

SEQ ID NO: 3832551 - RNA, 12 nt, Shigella flexneri 2a str. 2457T
gaugcgcuggcg

SEQ ID NO: 3832552 - RNA, 15 nt, Shigella flexneri 2a str. 2457T
gaugcgcuggcggcu

SEQ ID NO: 3832553 - RNA, 20 nt, Shigella flexneri 2a str. 2457T
gaugcggcgaaaacgccuua

SEQ ID NO: 3832554 - RNA, 14 nt, Shigella flexneri 2a str. 2457T
gaugcggcggacgu

SEQ ID NO: 3832555 - RNA, 12 nt, Shigella flexneri 2a str. 2457T
gaugcggcguaa

SEQ ID NO: 3832556 - RNA, 13 nt, Shigella flexneri 2a str. 2457T
gaugcggcgugaa

SEQ ID NO: 3832557 - RNA, 16 nt, Shigella flexneri 2a str. 2457T
gaugcggcgugaacgc

SEQ ID NO: 3832558 - RNA, 19 nt, Shigella flexneri 2a str. 2457T
gaugcggcgugaacgccua

SEQ ID NO: 3832559 - RNA, 20 nt, Shigella flexneri 2a str. 2457T
gaugcggcgugaacgccuua

SEQ ID NO: 3832560 - RNA, 21 nt, Shigella flexneri 2a str. 2457T
gaugcggcgugaacgccuuau

SEQ ID NO: 3832561 - RNA, 17 nt, Shigella flexneri 2a str. 2457T
gaugcggcgugaaugcc

SEQ ID NO: 3832562 - RNA, 20 nt, Shigella flexneri 2a str. 2457T
gaugcggcgugaaugccuua

SEQ ID NO: 3832563 - RNA, 14 nt, Shigella flexneri 2a str. 2457T
gaugcgggcgguaa

SEQ ID NO: 3832564 - RNA, 19 nt, Shigella flexneri 2a str. 2457T
gaugcgggugaacgcguua

SEQ ID NO: 3832565 - RNA, 17 nt, Shigella flexneri 2a str. 2457T
gaugcgguaaccuggca

SEQ ID NO: 3832566 - RNA, 14 nt, Shigella flexneri 2a str. 2457T
gaugcuaaaaacau

SEQ ID NO: 3832567 - RNA, 21 nt, Shigella flexneri 2a str. 2457T
gaugcuccacgcugcaucgcc

SEQ ID NO: 3832568 - RNA, 23 nt, Shigella flexneri 2a str. 2457T
gaugcuccacgcugcaucgccaa

SEQ ID NO: 3832569 - RNA, 15 nt, Shigella flexneri 2a str. 2457T
gaugcuccuggcgaa

SEQ ID NO: 3832570 - RNA, 15 nt, Shigella flexneri 2a str. 2457T
gaugcucgccaggcg

SEQ ID NO: 3832571 - RNA, 22 nt, Shigella flexneri 2a str. 2457T
gaugcucgccaggcguuugaaa

SEQ ID NO: 3832572 - RNA, 13 nt, Shigella flexneri 2a str. 2457T
gaugcucucauca

SEQ ID NO: 3832573 - RNA, 17 nt, Shigella flexneri 2a str. 2457T
gaugcuuugaccucccg

SEQ ID NO: 3832574 - RNA, 15 nt, Shigella flexneri 2a str. 2457T
gauggaaugagcauc

SEQ ID NO: 3832575 - RNA, 18 nt, Shigella flexneri 2a str. 2457T
gauggaauuucaucauca

SEQ ID NO: 3832576 - RNA, 14 nt, Shigella flexneri 2a str. 2457T
gauggacauucucc

SEQ ID NO: 3832577 - RNA, 18 nt, Shigella flexneri 2a str. 2457T
gauggaccgugccggacg

SEQ ID NO: 3832578 - RNA, 18 nt, Shigella flexneri 2a str. 2457T
gauggaguaguugaucgc

SEQ ID NO: 3832579 - RNA, 18 nt, Shigella flexneri 2a str. 2457T
gauggcaaaagugauauu

SEQ ID NO: 3832580 - RNA, 16 nt, Shigella flexneri 2a str. 2457T
gauggcaauuuucacu

SEQ ID NO: 3832581 - RNA, 22 nt, Shigella flexneri 2a str. 2457T
gauggcagaaacaguguauuuc

SEQ ID NO: 3832582 - RNA, 11 nt, Shigella flexneri 2a str. 2457T
gauggcagagu

SEQ ID NO: 3832583 - RNA, 19 nt, Shigella flexneri 2a str. 2457T
gauggcagaguugccaccc

SEQ ID NO: 3832584 - RNA, 18 nt, Shigella flexneri 2a str. 2457T
gauggcauacaacgccau

SEQ ID NO: 3832585 - RNA, 20 nt, Shigella flexneri 2a str. 2457T
gauggcaucaccaucgggcc

SEQ ID NO: 3832586 - RNA, 15 nt, Shigella flexneri 2a str. 2457T
gauggcauucucacu

SEQ ID NO: 3832587 - RNA, 21 nt, Shigella flexneri 2a str. 2457T
gauggcccacgacgucuccau

SEQ ID NO: 3832588 - RNA, 12 nt, Shigella flexneri 2a str. 2457T
gauggcccggcg

SEQ ID NO: 3832589 - RNA, 22 nt, Shigella flexneri 2a str. 2457T
gauggccgguuuguuauccacc

SEQ ID NO: 3832590 - RNA, 18 nt, Shigella flexneri 2a str. 2457T
gauggcgcaaugccaucc

SEQ ID NO: 3832591 - RNA, 21 nt, Shigella flexneri 2a str. 2457T
gauggcgcaaugccauccagc

SEQ ID NO: 3832592 - RNA, 19 nt, Shigella flexneri 2a str. 2457T
gauggcgcgcagaaagagg

SEQ ID NO: 3832593 - RNA, 16 nt, Shigella flexneri 2a str. 2457T
gauggcgcgcggcagg

SEQ ID NO: 3832594 - RNA, 21 nt, Shigella flexneri 2a str. 2457T
gauggcgcgcggcaggaagug

SEQ ID NO: 3832595 - RNA, 14 nt, Shigella flexneri 2a str. 2457T
gauggcgucgauaa

SEQ ID NO: 3832596 - RNA, 16 nt, Shigella flexneri 2a str. 2457T
gauggcuacguucugc

SEQ ID NO: 3832597 - RNA, 23 nt, Shigella flexneri 2a str. 2457T
gauggcuauuacuuuaagccuuc

SEQ ID NO: 3832598 - RNA, 23 nt, Shigella flexneri 2a str. 2457T
gaugggcaguugcgcgcgcaccu

SEQ ID NO: 3832599 - RNA, 19 nt, Shigella flexneri 2a str. 2457T
gaugguacgcguggacugg

SEQ ID NO: 3832600 - RNA, 20 nt, Shigella flexneri 2a str. 2457T
gaugguacuucaaucgccac

SEQ ID NO: 3832601 - RNA, 18 nt, Shigella flexneri 2a str. 2457T
gauggucagcuucaccuu

SEQ ID NO: 3832602 - RNA, 14 nt, Shigella flexneri 2a str. 2457T
gauggucgucaauc

SEQ ID NO: 3832603 - RNA, 19 nt, Shigella flexneri 2a str. 2457T
gaugguugcccugcuggug

SEQ ID NO: 3832604 - RNA, 15 nt, Shigella flexneri 2a str. 2457T
gaugguuuuauagcg

SEQ ID NO: 3832605 - RNA, 22 nt, Shigella flexneri 2a str. 2457T
gaugguuuuuggguucagcauu

SEQ ID NO: 3832606 - RNA, 23 nt, Shigella flexneri 2a str. 2457T
gauguaaucaacuccgccagcaa

SEQ ID NO: 3832607 - RNA, 11 nt, Shigella flexneri 2a str. 2457T
gauguaaugag

SEQ ID NO: 3832608 - RNA, 15 nt, Shigella flexneri 2a str. 2457T
gauguaauucagcca

SEQ ID NO: 3832609 - RNA, 22 nt, Shigella flexneri 2a str. 2457T
gauguacgcugccgcuucuucu

SEQ ID NO: 3832610 - RNA, 13 nt, Shigella flexneri 2a str. 2457T
gaugucagcacuu

SEQ ID NO: 3832611 - RNA, 22 nt, Shigella flexneri 2a str. 2457T
gaugucagcacuuccagcuccg

SEQ ID NO: 3832612 - RNA, 22 nt, Shigella flexneri 2a str. 2457T
gaugucagcgggaugccaguca

SEQ ID NO: 3832613 - RNA, 19 nt, Shigella flexneri 2a str. 2457T
gaugucgagguacgcucca

SEQ ID NO: 3832614 - RNA, 14 nt, Shigella flexneri 2a str. 2457T
gaugugaacccuga

SEQ ID NO: 3832615 - RNA, 18 nt, Shigella flexneri 2a str. 2457T
gaugugaacuugcucauc

SEQ ID NO: 3832616 - RNA, 18 nt, Shigella flexneri 2a str. 2457T
gaugugagcgauacccau

SEQ ID NO: 3832617 - RNA, 16 nt, Shigella flexneri 2a str. 2457T
gaugugauggccgcgc

SEQ ID NO: 3832618 - RNA, 17 nt, Shigella flexneri 2a str. 2457T
gaugugcaguuccugca

SEQ ID NO: 3832619 - RNA, 16 nt, Shigella flexneri 2a str. 2457T
gaugugccggauagcg

SEQ ID NO: 3832620 - RNA, 20 nt, Shigella flexneri 2a str. 2457T
gaugugcuucaucagacgcu

SEQ ID NO: 3832621 - RNA, 18 nt, Shigella flexneri 2a str. 2457T
gaugugggcaaucucacu

SEQ ID NO: 3832622 - RNA, 22 nt, Shigella flexneri 2a str. 2457T
gauguguuccgcaaucaaauga

SEQ ID NO: 3832623 - RNA, 14 nt, Shigella flexneri 2a str. 2457T
gauguucaauaaaa

SEQ ID NO: 3832624 - RNA, 18 nt, Shigella flexneri 2a str. 2457T
gauguugccacacgccca

SEQ ID NO: 3832625 - RNA, 17 nt, Shigella flexneri 2a str. 2457T
gauguuugcugcgacgc

SEQ ID NO: 3832626 - RNA, 15 nt, Shigella flexneri 2a str. 2457T
gauuaaaaucagaau

SEQ ID NO: 3832627 - RNA, 21 nt, Shigella flexneri 2a str. 2457T
gauuaaacaagguuugaaaaa

SEQ ID NO: 3832628 - RNA, 18 nt, Shigella flexneri 2a str. 2457T
gauuaaacuucaccagca

SEQ ID NO: 3832629 - RNA, 15 nt, Shigella flexneri 2a str. 2457T
gauuaaagaaaauaa

SEQ ID NO: 3832630 - RNA, 20 nt, Shigella flexneri 2a str. 2457T
gauuaacgcuuguaaaugaa

SEQ ID NO: 3832631 - RNA, 23 nt, Shigella flexneri 2a str. 2457T
gauuaacugggcgucaaagugaa

SEQ ID NO: 3832632 - RNA, 17 nt, Shigella flexneri 2a str. 2457T
gauuaagugaaccuuaa

SEQ ID NO: 3832633 - RNA, 18 nt, Shigella flexneri 2a str. 2457T
gauuaauaaaauuaucca

SEQ ID NO: 3832634 - RNA, 22 nt, Shigella flexneri 2a str. 2457T
gauuaauaaaauuauccagcuu

SEQ ID NO: 3832635 - RNA, 18 nt, Shigella flexneri 2a str. 2457T
gauuaauuucccaccacu

SEQ ID NO: 3832636 - RNA, 21 nt, Shigella flexneri 2a str. 2457T
gauuacauggacgaaaucuac

SEQ ID NO: 3832637 - RNA, 21 nt, Shigella flexneri 2a str. 2457T
gauuaccaauaucaaauaaaa

SEQ ID NO: 3832638 - RNA, 20 nt, Shigella flexneri 2a str. 2457T
gauuaccagcgacaucaccg

SEQ ID NO: 3832639 - RNA, 14 nt, Shigella flexneri 2a str. 2457T
gauuaccauuucac

SEQ ID NO: 3832640 - RNA, 16 nt, Shigella flexneri 2a str. 2457T
gauuacgccgguguca

SEQ ID NO: 3832641 - RNA, 14 nt, Shigella flexneri 2a str. 2457T
gauuacgucuuuac

SEQ ID NO: 3832642 - RNA, 22 nt, Shigella flexneri 2a str. 2457T
gauuacucgccuuucacacgcu

SEQ ID NO: 3832643 - RNA, 21 nt, Shigella flexneri 2a str. 2457T
gauuacucguuaucagaaccg

SEQ ID NO: 3832644 - RNA, 22 nt, Shigella flexneri 2a str. 2457T
gauuacugcaaacucaucgccg

SEQ ID NO: 3832645 - RNA, 15 nt, Shigella flexneri 2a str. 2457T
gauuacuguacagau

SEQ ID NO: 3832646 - RNA, 22 nt, Shigella flexneri 2a str. 2457T
gauuacuguacagauccgccau

SEQ ID NO: 3832647 - RNA, 14 nt, Shigella flexneri 2a str. 2457T
gauuacuuccuuca

SEQ ID NO: 3832648 - RNA, 13 nt, Shigella flexneri 2a str. 2457T
gauuacuuuauuu

SEQ ID NO: 3832649 - RNA, 20 nt, Shigella flexneri 2a str. 2457T
gauuagcccccguuuuguug

SEQ ID NO: 3832650 - RNA, 22 nt, Shigella flexneri 2a str. 2457T
gauuaguauugcggaacggcag

SEQ ID NO: 3832651 - RNA, 18 nt, Shigella flexneri 2a str. 2457T
gauuauauaauaugcauu

SEQ ID NO: 3832652 - RNA, 17 nt, Shigella flexneri 2a str. 2457T
gauuauauggaaaaaua

SEQ ID NO: 3832653 - RNA, 23 nt, Shigella flexneri 2a str. 2457T
gauuaucgacugcgcccugaacc

SEQ ID NO: 3832654 - RNA, 12 nt, Shigella flexneri 2a str. 2457T
gauuaucuucac

SEQ ID NO: 3832655 - RNA, 15 nt, Shigella flexneri 2a str. 2457T
gauuaugcacucagu

SEQ ID NO: 3832656 - RNA, 16 nt, Shigella flexneri 2a str. 2457T
gauuaugcccgcagcg

SEQ ID NO: 3832657 - RNA, 20 nt, Shigella flexneri 2a str. 2457T
gauuaugucgcucaaugugc

SEQ ID NO: 3832658 - RNA, 13 nt, Shigella flexneri 2a str. 2457T
gauuauucacaau

SEQ ID NO: 3832659 - RNA, 22 nt, Shigella flexneri 2a str. 2457T
gauuauugcuugaucaggaaau

SEQ ID NO: 3832660 - RNA, 20 nt, Shigella flexneri 2a str. 2457T
gauuauuucgcugcggauug

SEQ ID NO: 3832661 - RNA, 23 nt, Shigella flexneri 2a str. 2457T
gauuauuucgcugcggauuguca

SEQ ID NO: 3832662 - RNA, 19 nt, Shigella flexneri 2a str. 2457T
gauucaagauuagccugaa

SEQ ID NO: 3832663 - RNA, 15 nt, Shigella flexneri 2a str. 2457T
gauucacaguuaagu

SEQ ID NO: 3832664 - RNA, 16 nt, Shigella flexneri 2a str. 2457T
gauucacauccggcca

SEQ ID NO: 3832665 - RNA, 18 nt, Shigella flexneri 2a str. 2457T
gauucacgccaaccagcu

SEQ ID NO: 3832666 - RNA, 17 nt, Shigella flexneri 2a str. 2457T
gauucacuuucugaagg

SEQ ID NO: 3832667 - RNA, 12 nt, Shigella flexneri 2a str. 2457T
gauucagcaccg

SEQ ID NO: 3832668 - RNA, 18 nt, Shigella flexneri 2a str. 2457T
gauucagcaccuuaccuc

SEQ ID NO: 3832669 - RNA, 21 nt, Shigella flexneri 2a str. 2457T
gauucagcgucgucagcaguu

SEQ ID NO: 3832670 - RNA, 16 nt, Shigella flexneri 2a str. 2457T
gauucauacagcggcc

SEQ ID NO: 3832671 - RNA, 22 nt, Shigella flexneri 2a str. 2457T
gauucauccguuucccuguuca

SEQ ID NO: 3832672 - RNA, 23 nt, Shigella flexneri 2a str. 2457T
gauucauccguuucucuguucag

SEQ ID NO: 3832673 - RNA, 18 nt, Shigella flexneri 2a str. 2457T
gauucaucucuucuuccg

SEQ ID NO: 3832674 - RNA, 19 nt, Shigella flexneri 2a str. 2457T
gauucccagucauccggcu

SEQ ID NO: 3832675 - RNA, 18 nt, Shigella flexneri 2a str. 2457T
gauucccauuauuucaac

SEQ ID NO: 3832676 - RNA, 15 nt, Shigella flexneri 2a str. 2457T
gauucccccggugcc

SEQ ID NO: 3832677 - RNA, 13 nt, Shigella flexneri 2a str. 2457T
gauucccgggcac

SEQ ID NO: 3832678 - RNA, 15 nt, Shigella flexneri 2a str. 2457T
gauuccgccaguucu

SEQ ID NO: 3832679 - RNA, 15 nt, Shigella flexneri 2a str. 2457T
gauuccgccgccauu

SEQ ID NO: 3832680 - RNA, 21 nt, Shigella flexneri 2a str. 2457T
gauuccgccgccauugacguu

SEQ ID NO: 3832681 - RNA, 20 nt, Shigella flexneri 2a str. 2457T
gauuccucucauuuaaaauc

SEQ ID NO: 3832682 - RNA, 24 nt, Shigella flexneri 2a str. 2457T
gauuccugcgcuuccagcuccauc

SEQ ID NO: 3832683 - RNA, 13 nt, Shigella flexneri 2a str. 2457T
gauucgcccgcag

SEQ ID NO: 3832684 - RNA, 15 nt, Shigella flexneri 2a str. 2457T
gauucggcaaucacc

SEQ ID NO: 3832685 - RNA, 16 nt, Shigella flexneri 2a str. 2457T
gauucggccaguaacc

SEQ ID NO: 3832686 - RNA, 21 nt, Shigella flexneri 2a str. 2457T
gauucggcgcaaugauaucgc

SEQ ID NO: 3832687 - RNA, 21 nt, Shigella flexneri 2a str. 2457T
gauucggguucauguucagau

SEQ ID NO: 3832688 - RNA, 22 nt, Shigella flexneri 2a str. 2457T
gauucugagaaacucaguugau

SEQ ID NO: 3832689 - RNA, 17 nt, Shigella flexneri 2a str. 2457T
gauucugauugccgcuu

SEQ ID NO: 3832690 - RNA, 14 nt, Shigella flexneri 2a str. 2457T
gauugaauuagcaa

SEQ ID NO: 3832691 - RNA, 20 nt, Shigella flexneri 2a str. 2457T
gauugcaccaccagacgagc

SEQ ID NO: 3832692 - RNA, 18 nt, Shigella flexneri 2a str. 2457T
gauugcacuugcuuaaaa

SEQ ID NO: 3832693 - RNA, 19 nt, Shigella flexneri 2a str. 2457T
gauugcacuugcuuaaaau

SEQ ID NO: 3832694 - RNA, 21 nt, Shigella flexneri 2a str. 2457T
gauugcauaaugguggagugg

SEQ ID NO: 3832695 - RNA, 19 nt, Shigella flexneri 2a str. 2457T
gauugccagaugcgacgcu

SEQ ID NO: 3832696 - RNA, 24 nt, Shigella flexneri 2a str. 2457T
gauugcccuguuugucgaucauca

SEQ ID NO: 3832697 - RNA, 16 nt, Shigella flexneri 2a str. 2457T
gauugccgcgagaacu

SEQ ID NO: 3832698 - RNA, 19 nt, Shigella flexneri 2a str. 2457T
gauugccggaauggugcuu

SEQ ID NO: 3832699 - RNA, 18 nt, Shigella flexneri 2a str. 2457T
gauugccgugaaccugcg

SEQ ID NO: 3832700 - RNA, 17 nt, Shigella flexneri 2a str. 2457T
gauugcgaugguguucc

SEQ ID NO: 3832701 - RNA, 13 nt, Shigella flexneri 2a str. 2457T
gauugcggagaag

SEQ ID NO: 3832702 - RNA, 10 nt, Shigella flexneri 2a str. 2457T
gauugcuucu

SEQ ID NO: 3832703 - RNA, 13 nt, Shigella flexneri 2a str. 2457T
gauugcuucugcu

SEQ ID NO: 3832704 - RNA, 15 nt, Shigella flexneri 2a str. 2457T
gauugggauuaaagc

SEQ ID NO: 3832705 - RNA, 18 nt, Shigella flexneri 2a str. 2457T
gauuggucgcucgcgccg

SEQ ID NO: 3832706 - RNA, 14 nt, Shigella flexneri 2a str. 2457T
gauuguagaaaauc

SEQ ID NO: 3832707 - RNA, 11 nt, Shigella flexneri 2a str. 2457T
gauuguauuua

SEQ ID NO: 3832708 - RNA, 17 nt, Shigella flexneri 2a str. 2457T
gauugucauucgccuga

SEQ ID NO: 3832709 - RNA, 15 nt, Shigella flexneri 2a str. 2457T
gauugucgaucgcau

SEQ ID NO: 3832710 - RNA, 18 nt, Shigella flexneri 2a str. 2457T
gauugugacacgcgcgca

SEQ ID NO: 3832711 - RNA, 13 nt, Shigella flexneri 2a str. 2457T
gauuguuaaucac

SEQ ID NO: 3832712 - RNA, 19 nt, Shigella flexneri 2a str. 2457T
gauuguugauuaacaggcu

SEQ ID NO: 3832713 - RNA, 18 nt, Shigella flexneri 2a str. 2457T
gauuguuggcaaaaaaau

SEQ ID NO: 3832714 - RNA, 17 nt, Shigella flexneri 2a str. 2457T
gauuuaaaaaauggcca

SEQ ID NO: 3832715 - RNA, 23 nt, Shigella flexneri 2a str. 2457T
gauuuaaacaccugggcaauggu

SEQ ID NO: 3832716 - RNA, 16 nt, Shigella flexneri 2a str. 2457T
gauuuaacaucuccac

SEQ ID NO: 3832717 - RNA, 22 nt, Shigella flexneri 2a str. 2457T
gauuuaaccaacaauaaaauug

SEQ ID NO: 3832718 - RNA, 19 nt, Shigella flexneri 2a str. 2457T
gauuuaaucuguaucaggc

SEQ ID NO: 3832719 - RNA, 13 nt, Shigella flexneri 2a str. 2457T
gauuuaaugccaa

SEQ ID NO: 3832720 - RNA, 17 nt, Shigella flexneri 2a str. 2457T
gauuuaccguuaagcug

SEQ ID NO: 3832721 - RNA, 22 nt, Shigella flexneri 2a str. 2457T
gauuuaccguuaagcuggaaau

SEQ ID NO: 3832722 - RNA, 16 nt, Shigella flexneri 2a str. 2457T
gauuuacgcucuucca

SEQ ID NO: 3832723 - RNA, 20 nt, Shigella flexneri 2a str. 2457T
gauuuaucccaaccuaaaaa

SEQ ID NO: 3832724 - RNA, 16 nt, Shigella flexneri 2a str. 2457T
gauuuaugauauuuuu

SEQ ID NO: 3832725 - RNA, 19 nt, Shigella flexneri 2a str. 2457T
gauuucaacgauaaguggg

SEQ ID NO: 3832726 - RNA, 19 nt, Shigella flexneri 2a str. 2457T
gauuucauaacugauggca

SEQ ID NO: 3832727 - RNA, 12 nt, Shigella flexneri 2a str. 2457T
gauuucaucgcc

SEQ ID NO: 3832728 - RNA, 19 nt, Shigella flexneri 2a str. 2457T
gauuucaucgcccaggcaa

SEQ ID NO: 3832729 - RNA, 14 nt, Shigella flexneri 2a str. 2457T
gauuucaugaagcu

SEQ ID NO: 3832730 - RNA, 17 nt, Shigella flexneri 2a str. 2457T
gauuuccaucuccagcu

SEQ ID NO: 3832731 - RNA, 13 nt, Shigella flexneri 2a str. 2457T
gauuucccggcac

SEQ ID NO: 3832732 - RNA, 17 nt, Shigella flexneri 2a str. 2457T
gauuucgcagccauuac

SEQ ID NO: 3832733 - RNA, 19 nt, Shigella flexneri 2a str. 2457T
gauuucgccacccagcgcc

SEQ ID NO: 3832734 - RNA, 19 nt, Shigella flexneri 2a str. 2457T
gauuucguagacugcagcg

SEQ ID NO: 3832735 - RNA, 20 nt, Shigella flexneri 2a str. 2457T
gauuucguugugucgccagc

SEQ ID NO: 3832736 - RNA, 17 nt, Shigella flexneri 2a str. 2457T
gauuucuucaccagccu

SEQ ID NO: 3832737 - RNA, 22 nt, Shigella flexneri 2a str. 2457T
gauuucuucauuaaauuuccgc

SEQ ID NO: 3832738 - RNA, 17 nt, Shigella flexneri 2a str. 2457T
gauuugauggucucgcc

SEQ ID NO: 3832739 - RNA, 23 nt, Shigella flexneri 2a str. 2457T
gauuugcggaaguaguucaucaa

SEQ ID NO: 3832740 - RNA, 21 nt, Shigella flexneri 2a str. 2457T
gauuugcuucaauacgcucca

SEQ ID NO: 3832741 - RNA, 13 nt, Shigella flexneri 2a str. 2457T
gauuuggcugccg

SEQ ID NO: 3832742 - RNA, 13 nt, Shigella flexneri 2a str. 2457T
gauuugucagcag

SEQ ID NO: 3832743 - RNA, 19 nt, Shigella flexneri 2a str. 2457T
gauuugucgccugcaucac

SEQ ID NO: 3832744 - RNA, 20 nt, Shigella flexneri 2a str. 2457T
gauuugugcacgugccagau

SEQ ID NO: 3832745 - RNA, 17 nt, Shigella flexneri 2a str. 2457T
gauuuucaccagcaucg

SEQ ID NO: 3832746 - RNA, 20 nt, Shigella flexneri 2a str. 2457T
gauuuucaccagcaucgccg

SEQ ID NO: 3832747 - RNA, 16 nt, Shigella flexneri 2a str. 2457T
gauuuucaucuucuuc

SEQ ID NO: 3832748 - RNA, 19 nt, Shigella flexneri 2a str. 2457T
gauuuucuacuucuuucac

SEQ ID NO: 3832749 - RNA, 12 nt, Shigella flexneri 2a str. 2457T
gauuuucugcuc

SEQ ID NO: 3832750 - RNA, 13 nt, Shigella flexneri 2a str. 2457T
gauuuugcaauaa

SEQ ID NO: 3832751 - RNA, 14 nt, Shigella flexneri 2a str. 2457T
gauuuugcaauaau

SEQ ID NO: 3832752 - RNA, 23 nt, Shigella flexneri 2a str. 2457T
gauuuugccagcaugacuaccgg

SEQ ID NO: 3832753 - RNA, 17 nt, Shigella flexneri 2a str. 2457T
gauuuugcguucuucca

SEQ ID NO: 3832754 - RNA, 15 nt, Shigella flexneri 2a str. 2457T
gauuuugcugugcuu

SEQ ID NO: 3832755 - RNA, 18 nt, Shigella flexneri 2a str. 2457T
gauuuuuuauaguacuuc

SEQ ID NO: 3832756 - RNA, 16 nt, Shigella flexneri 2a str. 2457T
gauuuuuugccagcac

SEQ ID NO: 3832757 - RNA, 13 nt, Shigella flexneri 2a str. 2457T
gauuuuuuuaaua

SEQ ID NO: 3832758 - RNA, 22 nt, Shigella flexneri 2a str. 2457T
gcaaaaaaaacgggcauggugu

SEQ ID NO: 3832759 - RNA, 15 nt, Shigella flexneri 2a str. 2457T
gcaaaaaaaugcaca

SEQ ID NO: 3832760 - RNA, 22 nt, Shigella flexneri 2a str. 2457T
gcaaaaaaucgccgagcugaac

SEQ ID NO: 3832761 - RNA, 22 nt, Shigella flexneri 2a str. 2457T
gcaaaaacccuucuuccauacc

SEQ ID NO: 3832762 - RNA, 20 nt, Shigella flexneri 2a str. 2457T
gcaaaaacuuccauguguuu

SEQ ID NO: 3832763 - RNA, 13 nt, Shigella flexneri 2a str. 2457T
gcaaaaauaagcg

SEQ ID NO: 3832764 - RNA, 16 nt, Shigella flexneri 2a str. 2457T
gcaaaaauaaggcgga

SEQ ID NO: 3832765 - RNA, 20 nt, Shigella flexneri 2a str. 2457T
gcaaaaaucgacagcaggau

SEQ ID NO: 3832766 - RNA, 20 nt, Shigella flexneri 2a str. 2457T
gcaaaaccuaggucauuaaa

SEQ ID NO: 3832767 - RNA, 20 nt, Shigella flexneri 2a str. 2457T
gcaaaaccucuuccagcaga

SEQ ID NO: 3832768 - RNA, 14 nt, Shigella flexneri 2a str. 2457T
gcaaaaccugguug

SEQ ID NO: 3832769 - RNA, 23 nt, Shigella flexneri 2a str. 2457T
gcaaaacggcucuuauguccgga

SEQ ID NO: 3832770 - RNA, 19 nt, Shigella flexneri 2a str. 2457T
gcaaaauaaccggcaagca

SEQ ID NO: 3832771 - RNA, 15 nt, Shigella flexneri 2a str. 2457T
gcaaaauacaugacc

SEQ ID NO: 3832772 - RNA, 12 nt, Shigella flexneri 2a str. 2457T
gcaaaauaggua

SEQ ID NO: 3832773 - RNA, 19 nt, Shigella flexneri 2a str. 2457T
gcaaaauagucaucucuuc

SEQ ID NO: 3832774 - RNA, 18 nt, Shigella flexneri 2a str. 2457T
gcaaaaucguaagcagga

SEQ ID NO: 3832775 - RNA, 19 nt, Shigella flexneri 2a str. 2457T
gcaaaaucguaagcaggag

SEQ ID NO: 3832776 - RNA, 24 nt, Shigella flexneri 2a str. 2457T
gcaaaaucucacacucaugauccu

SEQ ID NO: 3832777 - RNA, 12 nt, Shigella flexneri 2a str. 2457T
gcaaaaugccag

SEQ ID NO: 3832778 - RNA, 20 nt, Shigella flexneri 2a str. 2457T
gcaaaauuuucauugccgca

SEQ ID NO: 3832779 - RNA, 18 nt, Shigella flexneri 2a str. 2457T
gcaaacaguaacccggca

SEQ ID NO: 3832780 - RNA, 18 nt, Shigella flexneri 2a str. 2457T
gcaaacaguucugcagcg

SEQ ID NO: 3832781 - RNA, 17 nt, Shigella flexneri 2a str. 2457T
gcaaaccagacgcgcgu

SEQ ID NO: 3832782 - RNA, 23 nt, Shigella flexneri 2a str. 2457T
gcaaaccaguacggcuucgauca

SEQ ID NO: 3832783 - RNA, 23 nt, Shigella flexneri 2a str. 2457T
gcaaaccaugacgcacuuucgcu

SEQ ID NO: 3832784 - RNA, 16 nt, Shigella flexneri 2a str. 2457T
gcaaacccaaccggua

SEQ ID NO: 3832785 - RNA, 15 nt, Shigella flexneri 2a str. 2457T
gcaaaccucaggaau

SEQ ID NO: 3832786 - RNA, 16 nt, Shigella flexneri 2a str. 2457T
gcaaaccugcaaugau

SEQ ID NO: 3832787 - RNA, 21 nt, Shigella flexneri 2a str. 2457T
gcaaaccuggcauguggcggc

SEQ ID NO: 3832788 - RNA, 19 nt, Shigella flexneri 2a str. 2457T
gcaaacuacaaauccaaca

SEQ ID NO: 3832789 - RNA, 15 nt, Shigella flexneri 2a str. 2457T
gcaaacuaucccagc

SEQ ID NO: 3832790 - RNA, 21 nt, Shigella flexneri 2a str. 2457T
gcaaacucaucgccgccaaac

SEQ ID NO: 3832791 - RNA, 19 nt, Shigella flexneri 2a str. 2457T
gcaaacucgcgcaggcuga

SEQ ID NO: 3832792 - RNA, 15 nt, Shigella flexneri 2a str. 2457T
gcaaacugaguggag

SEQ ID NO: 3832793 - RNA, 19 nt, Shigella flexneri 2a str. 2457T
gcaaacugccguugcugcc

SEQ ID NO: 3832794 - RNA, 11 nt, Shigella flexneri 2a str. 2457T
gcaaacugcug

SEQ ID NO: 3832795 - RNA, 21 nt, Shigella flexneri 2a str. 2457T
gcaaacuucuucaguuuuucc

SEQ ID NO: 3832796 - RNA, 21 nt, Shigella flexneri 2a str. 2457T
gcaaagagaacugagcgauca

SEQ ID NO: 3832797 - RNA, 14 nt, Shigella flexneri 2a str. 2457T
gcaaagagagaagc

SEQ ID NO: 3832798 - RNA, 15 nt, Shigella flexneri 2a str. 2457T
gcaaagagagaagcc

SEQ ID NO: 3832799 - RNA, 15 nt, Shigella flexneri 2a str. 2457T
gcaaagcaaauuuug

SEQ ID NO: 3832800 - RNA, 11 nt, Shigella flexneri 2a str. 2457T
gcaaagcccac

SEQ ID NO: 3832801 - RNA, 10 nt, Shigella flexneri 2a str. 2457T
gcaaagcgac

SEQ ID NO: 3832802 - RNA, 15 nt, Shigella flexneri 2a str. 2457T
gcaaagcgccagggc

SEQ ID NO: 3832803 - RNA, 19 nt, Shigella flexneri 2a str. 2457T
gcaaagcugucaccaauca

SEQ ID NO: 3832804 - RNA, 15 nt, Shigella flexneri 2a str. 2457T
gcaaaggaauggucg

SEQ ID NO: 3832805 - RNA, 14 nt, Shigella flexneri 2a str. 2457T
gcaaaggccagcaa

SEQ ID NO: 3832806 - RNA, 21 nt, Shigella flexneri 2a str. 2457T
gcaaaggguuuuugagucaca

SEQ ID NO: 3832807 - RNA, 23 nt, Shigella flexneri 2a str. 2457T
gcaaaggguuuuugagucacauu

SEQ ID NO: 3832808 - RNA, 15 nt, Shigella flexneri 2a str. 2457T
gcaaaguaauaauga

SEQ ID NO: 3832809 - RNA, 15 nt, Shigella flexneri 2a str. 2457T
gcaaaguagagcgaa

SEQ ID NO: 3832810 - RNA, 17 nt, Shigella flexneri 2a str. 2457T
gcaaaguagagcgaaac

SEQ ID NO: 3832811 - RNA, 19 nt, Shigella flexneri 2a str. 2457T
gcaaagugaauacagaaca

SEQ ID NO: 3832812 - RNA, 13 nt, Shigella flexneri 2a str. 2457T
gcaaauaaaacau

SEQ ID NO: 3832813 - RNA, 20 nt, Shigella flexneri 2a str. 2457T
gcaaauaaucccgcgcaaca

SEQ ID NO: 3832814 - RNA, 17 nt, Shigella flexneri 2a str. 2457T
gcaaauacaguugcgcc

SEQ ID NO: 3832815 - RNA, 19 nt, Shigella flexneri 2a str. 2457T
gcaaauacccaaaaaauag

SEQ ID NO: 3832816 - RNA, 12 nt, Shigella flexneri 2a str. 2457T
gcaaauaccgga

SEQ ID NO: 3832817 - RNA, 22 nt, Shigella flexneri 2a str. 2457T
gcaaauaccggacacacuucau

SEQ ID NO: 3832818 - RNA, 12 nt, Shigella flexneri 2a str. 2457T
gcaaauauuaau

SEQ ID NO: 3832819 - RNA, 15 nt, Shigella flexneri 2a str. 2457T
gcaaauauugcauug

SEQ ID NO: 3832820 - RNA, 12 nt, Shigella flexneri 2a str. 2457T
gcaaaucaccac

SEQ ID NO: 3832821 - RNA, 17 nt, Shigella flexneri 2a str. 2457T
gcaaaucacgcugcuga

SEQ ID NO: 3832822 - RNA, 19 nt, Shigella flexneri 2a str. 2457T
gcaaaucacgcugcugauu

SEQ ID NO: 3832823 - RNA, 21 nt, Shigella flexneri 2a str. 2457T
gcaaaucacgcugcugauuaa

SEQ ID NO: 3832824 - RNA, 17 nt, Shigella flexneri 2a str. 2457T
gcaaauccacguuccag

SEQ ID NO: 3832825 - RNA, 21 nt, Shigella flexneri 2a str. 2457T
gcaaauccacguuccagaucu

SEQ ID NO: 3832826 - RNA, 15 nt, Shigella flexneri 2a str. 2457T
gcaaauccgcacuca

SEQ ID NO: 3832827 - RNA, 19 nt, Shigella flexneri 2a str. 2457T
gcaaaucgaucucaaugag

SEQ ID NO: 3832828 - RNA, 20 nt, Shigella flexneri 2a str. 2457T
gcaaaucgaucucaaugagc

SEQ ID NO: 3832829 - RNA, 12 nt, Shigella flexneri 2a str. 2457T
gcaaaucgcggc

SEQ ID NO: 3832830 - RNA, 18 nt, Shigella flexneri 2a str. 2457T
gcaaaugauuagugccag

SEQ ID NO: 3832831 - RNA, 17 nt, Shigella flexneri 2a str. 2457T
gcaaaugccagauaaga

SEQ ID NO: 3832832 - RNA, 13 nt, Shigella flexneri 2a str. 2457T
gcaaaugcggaga

SEQ ID NO: 3832833 - RNA, 23 nt, Shigella flexneri 2a str. 2457T
gcaaaugcggagacucaaacccc

SEQ ID NO: 3832834 - RNA, 23 nt, Shigella flexneri 2a str. 2457T
gcaaauuauuugcguagucugac

SEQ ID NO: 3832835 - RNA, 21 nt, Shigella flexneri 2a str. 2457T
gcaaauucucuauuucacccg

SEQ ID NO: 3832836 - RNA, 20 nt, Shigella flexneri 2a str. 2457T
gcaaauucuugugcgggggc

SEQ ID NO: 3832837 - RNA, 19 nt, Shigella flexneri 2a str. 2457T
gcaaauugaggaucugcgc

SEQ ID NO: 3832838 - RNA, 18 nt, Shigella flexneri 2a str. 2457T
gcaaauugcauacugcga

SEQ ID NO: 3832839 - RNA, 12 nt, Shigella flexneri 2a str. 2457T
gcaacaaauaaa

SEQ ID NO: 3832840 - RNA, 14 nt, Shigella flexneri 2a str. 2457T
gcaacaacagcgcg

SEQ ID NO: 3832841 - RNA, 14 nt, Shigella flexneri 2a str. 2457T
gcaacaauggcauu

SEQ ID NO: 3832842 - RNA, 20 nt, Shigella flexneri 2a str. 2457T
gcaacagaaacgccauccag

SEQ ID NO: 3832843 - RNA, 12 nt, Shigella flexneri 2a str. 2457T
gcaacaggccag

SEQ ID NO: 3832844 - RNA, 15 nt, Shigella flexneri 2a str. 2457T
gcaacagguugcgcu

SEQ ID NO: 3832845 - RNA, 16 nt, Shigella flexneri 2a str. 2457T
gcaacaguaauaaugc

SEQ ID NO: 3832846 - RNA, 22 nt, Shigella flexneri 2a str. 2457T
gcaacagugaaacacaugguuu

SEQ ID NO: 3832847 - RNA, 13 nt, Shigella flexneri 2a str. 2457T
gcaacauaccgga

SEQ ID NO: 3832848 - RNA, 22 nt, Shigella flexneri 2a str. 2457T
gcaacauacugcccgagcgcca

SEQ ID NO: 3832849 - RNA, 23 nt, Shigella flexneri 2a str. 2457T
gcaacauauuccgcaccugccag

SEQ ID NO: 3832850 - RNA, 19 nt, Shigella flexneri 2a str. 2457T
gcaacaugaaacagaaaau

SEQ ID NO: 3832851 - RNA, 16 nt, Shigella flexneri 2a str. 2457T
gcaacaugcuggccuu

SEQ ID NO: 3832852 - RNA, 20 nt, Shigella flexneri 2a str. 2457T
gcaacauggauucgaugauc

SEQ ID NO: 3832853 - RNA, 20 nt, Shigella flexneri 2a str. 2457T
gcaacaugguuagcggaggc

SEQ ID NO: 3832854 - RNA, 14 nt, Shigella flexneri 2a str. 2457T
gcaacauguugaau

SEQ ID NO: 3832855 - RNA, 22 nt, Shigella flexneri 2a str. 2457T
gcaacauuaaauacagcuuaau

SEQ ID NO: 3832856 - RNA, 16 nt, Shigella flexneri 2a str. 2457T
gcaaccacaaccgccg

SEQ ID NO: 3832857 - RNA, 14 nt, Shigella flexneri 2a str. 2457T
gcaaccacaacgca

SEQ ID NO: 3832858 - RNA, 17 nt, Shigella flexneri 2a str. 2457T
gcaaccagcaggcuggu

SEQ ID NO: 3832859 - RNA, 23 nt, Shigella flexneri 2a str. 2457T
gcaaccagcccaugaaucagcaa

SEQ ID NO: 3832860 - RNA, 15 nt, Shigella flexneri 2a str. 2457T
gcaaccagcggcugc

SEQ ID NO: 3832861 - RNA, 18 nt, Shigella flexneri 2a str. 2457T
gcaaccagcggcugcuga

SEQ ID NO: 3832862 - RNA, 14 nt, Shigella flexneri 2a str. 2457T
gcaacccgccaggu

SEQ ID NO: 3832863 - RNA, 14 nt, Shigella flexneri 2a str. 2457T
gcaaccgagcgccc

SEQ ID NO: 3832864 - RNA, 23 nt, Shigella flexneri 2a str. 2457T
gcaaccgcugagcgauaaaauca

SEQ ID NO: 3832865 - RNA, 17 nt, Shigella flexneri 2a str. 2457T
gcaaccgguaaagaaga

SEQ ID NO: 3832866 - RNA, 15 nt, Shigella flexneri 2a str. 2457T
gcaaccguggugagu

SEQ ID NO: 3832867 - RNA, 22 nt, Shigella flexneri 2a str. 2457T
gcaaccguucggaaaaauauau

SEQ ID NO: 3832868 - RNA, 14 nt, Shigella flexneri 2a str. 2457T
gcaaccuaaccaaa

SEQ ID NO: 3832869 - RNA, 19 nt, Shigella flexneri 2a str. 2457T
gcaacgaacuaaccgcgcu

SEQ ID NO: 3832870 - RNA, 17 nt, Shigella flexneri 2a str. 2457T
gcaacgccguaagcgcg

SEQ ID NO: 3832871 - RNA, 23 nt, Shigella flexneri 2a str. 2457T
gcaacgccuaaacuaaucgacag

SEQ ID NO: 3832872 - RNA, 13 nt, Shigella flexneri 2a str. 2457T
gcaacgcgcguga

SEQ ID NO: 3832873 - RNA, 13 nt, Shigella flexneri 2a str. 2457T
gcaacgcggcggu

SEQ ID NO: 3832874 - RNA, 21 nt, Shigella flexneri 2a str. 2457T
gcaacgcuucguagaagccau

SEQ ID NO: 3832875 - RNA, 18 nt, Shigella flexneri 2a str. 2457T
gcaacggcggaucaccgc

SEQ ID NO: 3832876 - RNA, 21 nt, Shigella flexneri 2a str. 2457T
gcaacggcggaucaccgcguc

SEQ ID NO: 3832877 - RNA, 14 nt, Shigella flexneri 2a str. 2457T
gcaacggugcggcu

SEQ ID NO: 3832878 - RNA, 20 nt, Shigella flexneri 2a str. 2457T
gcaacgguugcggaacccag

SEQ ID NO: 3832879 - RNA, 12 nt, Shigella flexneri 2a str. 2457T
gcaacgucaguc

SEQ ID NO: 3832880 - RNA, 15 nt, Shigella flexneri 2a str. 2457T
gcaacgucuucccga

SEQ ID NO: 3832881 - RNA, 18 nt, Shigella flexneri 2a str. 2457T
gcaacgugguuugcggca

SEQ ID NO: 3832882 - RNA, 20 nt, Shigella flexneri 2a str. 2457T
gcaacguguuuguucaacga

SEQ ID NO: 3832883 - RNA, 22 nt, Shigella flexneri 2a str. 2457T
gcaacguuaccguaaccauaac

SEQ ID NO: 3832884 - RNA, 13 nt, Shigella flexneri 2a str. 2457T
gcaacguuccagc

SEQ ID NO: 3832885 - RNA, 14 nt, Shigella flexneri 2a str. 2457T
gcaacguuccagca

SEQ ID NO: 3832886 - RNA, 20 nt, Shigella flexneri 2a str. 2457T
gcaacucauuuacagaaacu

SEQ ID NO: 3832887 - RNA, 17 nt, Shigella flexneri 2a str. 2457T
gcaacuccaucaagcua

SEQ ID NO: 3832888 - RNA, 15 nt, Shigella flexneri 2a str. 2457T
gcaacuccggcgaaa

SEQ ID NO: 3832889 - RNA, 15 nt, Shigella flexneri 2a str. 2457T
gcaacucgacuggag

SEQ ID NO: 3832890 - RNA, 13 nt, Shigella flexneri 2a str. 2457T
gcaacucgaugcu

SEQ ID NO: 3832891 - RNA, 19 nt, Shigella flexneri 2a str. 2457T
gcaacucuuuuuccugcug

SEQ ID NO: 3832892 - RNA, 13 nt, Shigella flexneri 2a str. 2457T
gcaacugacggca

SEQ ID NO: 3832893 - RNA, 16 nt, Shigella flexneri 2a str. 2457T
gcaacugacuggcucu

SEQ ID NO: 3832894 - RNA, 12 nt, Shigella flexneri 2a str. 2457T
gcaacuggcaaa

SEQ ID NO: 3832895 - RNA, 15 nt, Shigella flexneri 2a str. 2457T
gcaacuggcaaaaac

SEQ ID NO: 3832896 - RNA, 14 nt, Shigella flexneri 2a str. 2457T
gcaacuguaacgca

SEQ ID NO: 3832897 - RNA, 22 nt, Shigella flexneri 2a str. 2457T
gcaacuguaacgcagaagguua

SEQ ID NO: 3832898 - RNA, 22 nt, Shigella flexneri 2a str. 2457T
gcaacuuaaucaucaaugccag

SEQ ID NO: 3832899 - RNA, 14 nt, Shigella flexneri 2a str. 2457T
gcaacuucaacgca

SEQ ID NO: 3832900 - RNA, 23 nt, Shigella flexneri 2a str. 2457T
gcaacuucucuuucggcagugcc

SEQ ID NO: 3832901 - RNA, 20 nt, Shigella flexneri 2a str. 2457T
gcaacuuuucaacaaauucu

SEQ ID NO: 3832902 - RNA, 13 nt, Shigella flexneri 2a str. 2457T
gcaagaaaugaca

SEQ ID NO: 3832903 - RNA, 15 nt, Shigella flexneri 2a str. 2457T
gcaagaccgcgacca

SEQ ID NO: 3832904 - RNA, 17 nt, Shigella flexneri 2a str. 2457T
gcaagacgaaaaaugaa

SEQ ID NO: 3832905 - RNA, 21 nt, Shigella flexneri 2a str. 2457T
gcaagacgaugacauuaucug

SEQ ID NO: 3832906 - RNA, 15 nt, Shigella flexneri 2a str. 2457T
gcaagagcaaauaaa

SEQ ID NO: 3832907 - RNA, 17 nt, Shigella flexneri 2a str. 2457T
gcaagagcaggcuuuug

SEQ ID NO: 3832908 - RNA, 18 nt, Shigella flexneri 2a str. 2457T
gcaagauaguuaaucaau

SEQ ID NO: 3832909 - RNA, 19 nt, Shigella flexneri 2a str. 2457T
gcaagaucgcgcaucagcu

SEQ ID NO: 3832910 - RNA, 15 nt, Shigella flexneri 2a str. 2457T
gcaagaugaauaaug

SEQ ID NO: 3832911 - RNA, 20 nt, Shigella flexneri 2a str. 2457T
gcaagauuuuguaggucgga

SEQ ID NO: 3832912 - RNA, 15 nt, Shigella flexneri 2a str. 2457T
gcaagccacaauaaa

SEQ ID NO: 3832913 - RNA, 12 nt, Shigella flexneri 2a str. 2457T
gcaagcccagcc

SEQ ID NO: 3832914 - RNA, 16 nt, Shigella flexneri 2a str. 2457T
gcaagccgucgugaau

SEQ ID NO: 3832915 - RNA, 19 nt, Shigella flexneri 2a str. 2457T
gcaagcgggcggugguauu

SEQ ID NO: 3832916 - RNA, 17 nt, Shigella flexneri 2a str. 2457T
gcaaggaaagccacugu

SEQ ID NO: 3832917 - RNA, 18 nt, Shigella flexneri 2a str. 2457T
gcaaggaaagccacugug

SEQ ID NO: 3832918 - RNA, 17 nt, Shigella flexneri 2a str. 2457T
gcaaggcaaucugcucu

SEQ ID NO: 3832919 - RNA, 14 nt, Shigella flexneri 2a str. 2457T
gcaaggccauccgc

SEQ ID NO: 3832920 - RNA, 21 nt, Shigella flexneri 2a str. 2457T
gcaaggcgagcgcggcuggcu

SEQ ID NO: 3832921 - RNA, 13 nt, Shigella flexneri 2a str. 2457T
gcaaggcgcgggu

SEQ ID NO: 3832922 - RNA, 20 nt, Shigella flexneri 2a str. 2457T
gcaaggcgcggguuucaaca

SEQ ID NO: 3832923 - RNA, 19 nt, Shigella flexneri 2a str. 2457T
gcaaggcuauucagcaguu

SEQ ID NO: 3832924 - RNA, 20 nt, Shigella flexneri 2a str. 2457T
gcaaggcuuucacgucagga

SEQ ID NO: 3832925 - RNA, 23 nt, Shigella flexneri 2a str. 2457T
gcaaggugaaagcaauuaacagu

SEQ ID NO: 3832926 - RNA, 24 nt, Shigella flexneri 2a str. 2457T
gcaagguggucagacggaacaucu

SEQ ID NO: 3832927 - RNA, 23 nt, Shigella flexneri 2a str. 2457T
gcaaguaauaauaucuccagcua

SEQ ID NO: 3832928 - RNA, 16 nt, Shigella flexneri 2a str. 2457T
gcaaguagcgccauac

SEQ ID NO: 3832929 - RNA, 18 nt, Shigella flexneri 2a str. 2457T
gcaagucggcaucgccac

SEQ ID NO: 3832930 - RNA, 22 nt, Shigella flexneri 2a str. 2457T
gcaagugcggcgcaccagcagg

SEQ ID NO: 3832931 - RNA, 19 nt, Shigella flexneri 2a str. 2457T
gcaaguuucgugcuuagau

SEQ ID NO: 3832932 - RNA, 18 nt, Shigella flexneri 2a str. 2457T
gcaauaaaauaucuucca

SEQ ID NO: 3832933 - RNA, 19 nt, Shigella flexneri 2a str. 2457T
gcaauaaaauaucuuccac

SEQ ID NO: 3832934 - RNA, 20 nt, Shigella flexneri 2a str. 2457T
gcaauaaacaagauaacaga

SEQ ID NO: 3832935 - RNA, 13 nt, Shigella flexneri 2a str. 2457T
gcaauaacacgcg

SEQ ID NO: 3832936 - RNA, 13 nt, Shigella flexneri 2a str. 2457T
gcaauaacacgcu

SEQ ID NO: 3832937 - RNA, 22 nt, Shigella flexneri 2a str. 2457T
gcaauaacucuuugaugaaaca

SEQ ID NO: 3832938 - RNA, 20 nt, Shigella flexneri 2a str. 2457T
gcaauaauccccgccaggau

SEQ ID NO: 3832939 - RNA, 15 nt, Shigella flexneri 2a str. 2457T
gcaauaaucucuaca

SEQ ID NO: 3832940 - RNA, 23 nt, Shigella flexneri 2a str. 2457T
gcaauaaucucuuuacccagcgg

SEQ ID NO: 3832941 - RNA, 21 nt, Shigella flexneri 2a str. 2457T
gcaauaaugccagucccgcga

SEQ ID NO: 3832942 - RNA, 19 nt, Shigella flexneri 2a str. 2457T
gcaauacccugacccagac

SEQ ID NO: 3832943 - RNA, 19 nt, Shigella flexneri 2a str. 2457T
gcaauaccgccguuaacac

SEQ ID NO: 3832944 - RNA, 12 nt, Shigella flexneri 2a str. 2457T
gcaauaccgcga

SEQ ID NO: 3832945 - RNA, 15 nt, Shigella flexneri 2a str. 2457T
gcaauaccuggcgca

SEQ ID NO: 3832946 - RNA, 19 nt, Shigella flexneri 2a str. 2457T
gcaauagacaguucuuccu

SEQ ID NO: 3832947 - RNA, 14 nt, Shigella flexneri 2a str. 2457T
gcaauagcacugcu

SEQ ID NO: 3832948 - RNA, 22 nt, Shigella flexneri 2a str. 2457T
gcaauagcggacacuaccauuu

SEQ ID NO: 3832949 - RNA, 13 nt, Shigella flexneri 2a str. 2457T
gcaauauauugaa

SEQ ID NO: 3832950 - RNA, 19 nt, Shigella flexneri 2a str. 2457T
gcaauauauugaauuugca

SEQ ID NO: 3832951 - RNA, 13 nt, Shigella flexneri 2a str. 2457T
gcaauaucgcggc

SEQ ID NO: 3832952 - RNA, 14 nt, Shigella flexneri 2a str. 2457T
gcaauauuacuuca

SEQ ID NO: 3832953 - RNA, 20 nt, Shigella flexneri 2a str. 2457T
gcaauauucauuaaaacuga

SEQ ID NO: 3832954 - RNA, 18 nt, Shigella flexneri 2a str. 2457T
gcaauauucuuuugcagc

SEQ ID NO: 3832955 - RNA, 20 nt, Shigella flexneri 2a str. 2457T
gcaaucaaauaccaccagcg

SEQ ID NO: 3832956 - RNA, 21 nt, Shigella flexneri 2a str. 2457T
gcaaucaaauaccaccagcga

SEQ ID NO: 3832957 - RNA, 23 nt, Shigella flexneri 2a str. 2457T
gcaaucaaauaccaccagcgaaa

SEQ ID NO: 3832958 - RNA, 13 nt, Shigella flexneri 2a str. 2457T
gcaaucacaucac

SEQ ID NO: 3832959 - RNA, 12 nt, Shigella flexneri 2a str. 2457T
gcaaucaccaga

SEQ ID NO: 3832960 - RNA, 16 nt, Shigella flexneri 2a str. 2457T
gcaaucacugccagaa

SEQ ID NO: 3832961 - RNA, 14 nt, Shigella flexneri 2a str. 2457T
gcaaucacuuccuc

SEQ ID NO: 3832962 - RNA, 15 nt, Shigella flexneri 2a str. 2457T
gcaaucacuuccuca

SEQ ID NO: 3832963 - RNA, 22 nt, Shigella flexneri 2a str. 2457T
gcaaucacuuccucaagcguuu

SEQ ID NO: 3832964 - RNA, 21 nt, Shigella flexneri 2a str. 2457T
gcaaucagauaaaauacacuu

SEQ ID NO: 3832965 - RNA, 12 nt, Shigella flexneri 2a str. 2457T
gcaaucaguggc

SEQ ID NO: 3832966 - RNA, 14 nt, Shigella flexneri 2a str. 2457T
gcaaucaucccagu

SEQ ID NO: 3832967 - RNA, 22 nt, Shigella flexneri 2a str. 2457T
gcaaucaucgaugcgaucauua

SEQ ID NO: 3832968 - RNA, 20 nt, Shigella flexneri 2a str. 2457T
gcaaucaucuuguaggccug

SEQ ID NO: 3832969 - RNA, 21 nt, Shigella flexneri 2a str. 2457T
gcaaucaucuuguaggccuga

SEQ ID NO: 3832970 - RNA, 17 nt, Shigella flexneri 2a str. 2457T
gcaaucauucccagacc

SEQ ID NO: 3832971 - RNA, 18 nt, Shigella flexneri 2a str. 2457T
gcaaucauucccagaccu

SEQ ID NO: 3832972 - RNA, 19 nt, Shigella flexneri 2a str. 2457T
gcaauccaccauuggcgca

SEQ ID NO: 3832973 - RNA, 20 nt, Shigella flexneri 2a str. 2457T
gcaauccagcucuuuuccag

SEQ ID NO: 3832974 - RNA, 15 nt, Shigella flexneri 2a str. 2457T
gcaauccccgccagc

SEQ ID NO: 3832975 - RNA, 22 nt, Shigella flexneri 2a str. 2457T
gcaauccgccgucgggucagcu

SEQ ID NO: 3832976 - RNA, 16 nt, Shigella flexneri 2a str. 2457T
gcaauccuaaaucgcu

SEQ ID NO: 3832977 - RNA, 22 nt, Shigella flexneri 2a str. 2457T
gcaaucgaccaggccaucagca

SEQ ID NO: 3832978 - RNA, 15 nt, Shigella flexneri 2a str. 2457T
gcaaucgacgccguu

SEQ ID NO: 3832979 - RNA, 14 nt, Shigella flexneri 2a str. 2457T
gcaaucgagcccag

SEQ ID NO: 3832980 - RNA, 22 nt, Shigella flexneri 2a str. 2457T
gcaaucgagcccagaugccgga

SEQ ID NO: 3832981 - RNA, 16 nt, Shigella flexneri 2a str. 2457T
gcaaucgcauagccag

SEQ ID NO: 3832982 - RNA, 16 nt, Shigella flexneri 2a str. 2457T
gcaaucgccagcggca

SEQ ID NO: 3832983 - RNA, 13 nt, Shigella flexneri 2a str. 2457T
gcaaucgccucca

SEQ ID NO: 3832984 - RNA, 16 nt, Shigella flexneri 2a str. 2457T
gcaaucggcugcaccu

SEQ ID NO: 3832985 - RNA, 20 nt, Shigella flexneri 2a str. 2457T
gcaaucggugcaaaugccag

SEQ ID NO: 3832986 - RNA, 21 nt, Shigella flexneri 2a str. 2457T
gcaaucuccguguaggccuga

SEQ ID NO: 3832987 - RNA, 16 nt, Shigella flexneri 2a str. 2457T
gcaaucugauugacau

SEQ ID NO: 3832988 - RNA, 14 nt, Shigella flexneri 2a str. 2457T
gcaaucugcuggca

SEQ ID NO: 3832989 - RNA, 11 nt, Shigella flexneri 2a str. 2457T
gcaaugaaauu

SEQ ID NO: 3832990 - RNA, 14 nt, Shigella flexneri 2a str. 2457T
gcaaugaagaaccg

SEQ ID NO: 3832991 - RNA, 18 nt, Shigella flexneri 2a str. 2457T
gcaaugaguggugaaaaa

SEQ ID NO: 3832992 - RNA, 14 nt, Shigella flexneri 2a str. 2457T
gcaaugaucucaau

SEQ ID NO: 3832993 - RNA, 13 nt, Shigella flexneri 2a str. 2457T
gcaaugcaggcac

SEQ ID NO: 3832994 - RNA, 17 nt, Shigella flexneri 2a str. 2457T
gcaaugccauccagcuu

SEQ ID NO: 3832995 - RNA, 14 nt, Shigella flexneri 2a str. 2457T
gcaaugccuucugg

SEQ ID NO: 3832996 - RNA, 19 nt, Shigella flexneri 2a str. 2457T
gcaaugcguagcugagcaa

SEQ ID NO: 3832997 - RNA, 20 nt, Shigella flexneri 2a str. 2457T
gcaauggccguuccggcaac

SEQ ID NO: 3832998 - RNA, 17 nt, Shigella flexneri 2a str. 2457T
gcaauguguggaugccu

SEQ ID NO: 3832999 - RNA, 16 nt, Shigella flexneri 2a str. 2457T
gcaauuaacagugaca

SEQ ID NO: 3833000 - RNA, 14 nt, Shigella flexneri 2a str. 2457T
gcaauuacaugcug

SEQ ID NO: 3833001 - RNA, 16 nt, Shigella flexneri 2a str. 2457T
gcaauuacaugcuggu

SEQ ID NO: 3833002 - RNA, 16 nt, Shigella flexneri 2a str. 2457T
gcaauuacccaguaga

SEQ ID NO: 3833003 - RNA, 22 nt, Shigella flexneri 2a str. 2457T
gcaauuacccaguagacagcaa

SEQ ID NO: 3833004 - RNA, 19 nt, Shigella flexneri 2a str. 2457T
gcaauuagcggcuggcugu

SEQ ID NO: 3833005 - RNA, 13 nt, Shigella flexneri 2a str. 2457T
gcaauucaauuaa

SEQ ID NO: 3833006 - RNA, 16 nt, Shigella flexneri 2a str. 2457T
gcaauuccagcgccag

SEQ ID NO: 3833007 - RNA, 17 nt, Shigella flexneri 2a str. 2457T
gcaauuccagcgccagu

SEQ ID NO: 3833008 - RNA, 16 nt, Shigella flexneri 2a str. 2457T
gcaauuccggugacca

SEQ ID NO: 3833009 - RNA, 17 nt, Shigella flexneri 2a str. 2457T
gcaauucggauguuagu

SEQ ID NO: 3833010 - RNA, 17 nt, Shigella flexneri 2a str. 2457T
gcaauugccagacaaca

SEQ ID NO: 3833011 - RNA, 17 nt, Shigella flexneri 2a str. 2457T
gcaauuggcgcaucaug

SEQ ID NO: 3833012 - RNA, 19 nt, Shigella flexneri 2a str. 2457T
gcaauuggucgcgcaaauu

SEQ ID NO: 3833013 - RNA, 18 nt, Shigella flexneri 2a str. 2457T
gcaauuggugcacgaugc

SEQ ID NO: 3833014 - RNA, 14 nt, Shigella flexneri 2a str. 2457T
gcaauugucgcaga

SEQ ID NO: 3833015 - RNA, 17 nt, Shigella flexneri 2a str. 2457T
gcaauugucgcagaagc

SEQ ID NO: 3833016 - RNA, 19 nt, Shigella flexneri 2a str. 2457T
gcaauuucacguucaccca

SEQ ID NO: 3833017 - RNA, 15 nt, Shigella flexneri 2a str. 2457T
gcaauuuccauugcu

SEQ ID NO: 3833018 - RNA, 22 nt, Shigella flexneri 2a str. 2457T
gcaauuuuccuugaaaaagagg

SEQ ID NO: 3833019 - RNA, 19 nt, Shigella flexneri 2a str. 2457T
gcaauuuuuaccggucagg

SEQ ID NO: 3833020 - RNA, 18 nt, Shigella flexneri 2a str. 2457T
gcaauuuuuccugguucu

SEQ ID NO: 3833021 - RNA, 14 nt, Shigella flexneri 2a str. 2457T
gcacaaaacagguc

SEQ ID NO: 3833022 - RNA, 14 nt, Shigella flexneri 2a str. 2457T
gcacaaaaccugcc

SEQ ID NO: 3833023 - RNA, 20 nt, Shigella flexneri 2a str. 2457T
gcacaaacauccaucugcuu

SEQ ID NO: 3833024 - RNA, 21 nt, Shigella flexneri 2a str. 2457T
gcacaaacauccaucugcuuu

SEQ ID NO: 3833025 - RNA, 15 nt, Shigella flexneri 2a str. 2457T
gcacaaaguggcggc

SEQ ID NO: 3833026 - RNA, 16 nt, Shigella flexneri 2a str. 2457T
gcacaaaguggcggcu

SEQ ID NO: 3833027 - RNA, 16 nt, Shigella flexneri 2a str. 2457T
gcacaaauagccagca

SEQ ID NO: 3833028 - RNA, 15 nt, Shigella flexneri 2a str. 2457T
gcacaacucggcggc

SEQ ID NO: 3833029 - RNA, 15 nt, Shigella flexneri 2a str. 2457T
gcacaauaaucagcc

SEQ ID NO: 3833030 - RNA, 18 nt, Shigella flexneri 2a str. 2457T
gcacaauacauagaaacu

SEQ ID NO: 3833031 - RNA, 16 nt, Shigella flexneri 2a str. 2457T
gcacaauauuuuuauc

SEQ ID NO: 3833032 - RNA, 14 nt, Shigella flexneri 2a str. 2457T
gcacaaucacguca

SEQ ID NO: 3833033 - RNA, 15 nt, Shigella flexneri 2a str. 2457T
gcacaaucacgucag

SEQ ID NO: 3833034 - RNA, 23 nt, Shigella flexneri 2a str. 2457T
gcacaaugcuuaaucgcggcggg

SEQ ID NO: 3833035 - RNA, 23 nt, Shigella flexneri 2a str. 2457T
gcacaauggagcuaaacagcgcu

SEQ ID NO: 3833036 - RNA, 13 nt, Shigella flexneri 2a str. 2457T
gcacacacugcuu

SEQ ID NO: 3833037 - RNA, 16 nt, Shigella flexneri 2a str. 2457T
gcacacacugcuuaac

SEQ ID NO: 3833038 - RNA, 18 nt, Shigella flexneri 2a str. 2457T
gcacacagggcgcuagcc

SEQ ID NO: 3833039 - RNA, 22 nt, Shigella flexneri 2a str. 2457T
gcacaccaggcucuuuaaacag

SEQ ID NO: 3833040 - RNA, 16 nt, Shigella flexneri 2a str. 2457T
gcacaccccggcggcc

SEQ ID NO: 3833041 - RNA, 17 nt, Shigella flexneri 2a str. 2457T
gcacaccgccgccgcca

SEQ ID NO: 3833042 - RNA, 23 nt, Shigella flexneri 2a str. 2457T
gcacaccugcauucgagccaagc

SEQ ID NO: 3833043 - RNA, 14 nt, Shigella flexneri 2a str. 2457T
gcacacgacauccg

SEQ ID NO: 3833044 - RNA, 15 nt, Shigella flexneri 2a str. 2457T
gcacacggauauugc

SEQ ID NO: 3833045 - RNA, 17 nt, Shigella flexneri 2a str. 2457T
gcacacugguucccaac

SEQ ID NO: 3833046 - RNA, 21 nt, Shigella flexneri 2a str. 2457T
gcacacugguucccaacaaca

SEQ ID NO: 3833047 - RNA, 22 nt, Shigella flexneri 2a str. 2457T
gcacacugguucccaacaacag

SEQ ID NO: 3833048 - RNA, 20 nt, Shigella flexneri 2a str. 2457T
gcacacuguucauuaaagcc

SEQ ID NO: 3833049 - RNA, 14 nt, Shigella flexneri 2a str. 2457T
gcacagaaccggag

SEQ ID NO: 3833050 - RNA, 17 nt, Shigella flexneri 2a str. 2457T
gcacagcacgcuuuuca

SEQ ID NO: 3833051 - RNA, 22 nt, Shigella flexneri 2a str. 2457T
gcacagcacgcuuuucagugcc

SEQ ID NO: 3833052 - RNA, 16 nt, Shigella flexneri 2a str. 2457T
gcacagcaggccaaga

SEQ ID NO: 3833053 - RNA, 15 nt, Shigella flexneri 2a str. 2457T
gcacagcaucaggcu

SEQ ID NO: 3833054 - RNA, 23 nt, Shigella flexneri 2a str. 2457T
gcacagcccgccgccauccugaa

SEQ ID NO: 3833055 - RNA, 14 nt, Shigella flexneri 2a str. 2457T
gcacaggcaucacu

SEQ ID NO: 3833056 - RNA, 18 nt, Shigella flexneri 2a str. 2457T
gcacagguggcaaacgcc

SEQ ID NO: 3833057 - RNA, 19 nt, Shigella flexneri 2a str. 2457T
gcacaguaaugcgccaggu

SEQ ID NO: 3833058 - RNA, 15 nt, Shigella flexneri 2a str. 2457T
gcacaguacgcgccc

SEQ ID NO: 3833059 - RNA, 19 nt, Shigella flexneri 2a str. 2457T
gcacaguauagcaucauaa

SEQ ID NO: 3833060 - RNA, 17 nt, Shigella flexneri 2a str. 2457T
gcacauaagucagcccg

SEQ ID NO: 3833061 - RNA, 15 nt, Shigella flexneri 2a str. 2457T
gcacauagcgugaca

SEQ ID NO: 3833062 - RNA, 18 nt, Shigella flexneri 2a str. 2457T
gcacauagcgugacacca

SEQ ID NO: 3833063 - RNA, 23 nt, Shigella flexneri 2a str. 2457T
gcacauagcgugacaccagcaca

SEQ ID NO: 3833064 - RNA, 15 nt, Shigella flexneri 2a str. 2457T
gcacaucaauuugcc

SEQ ID NO: 3833065 - RNA, 16 nt, Shigella flexneri 2a str. 2457T
gcacaucaucaaagcc

SEQ ID NO: 3833066 - RNA, 17 nt, Shigella flexneri 2a str. 2457T
gcacaucaucaaagcca

SEQ ID NO: 3833067 - RNA, 17 nt, Shigella flexneri 2a str. 2457T
gcacauccgcgucggca

SEQ ID NO: 3833068 - RNA, 20 nt, Shigella flexneri 2a str. 2457T
gcacaucgacggugacacuu

SEQ ID NO: 3833069 - RNA, 18 nt, Shigella flexneri 2a str. 2457T
gcacaucgcugugcugcu

SEQ ID NO: 3833070 - RNA, 17 nt, Shigella flexneri 2a str. 2457T
gcacaugaugauggcua

SEQ ID NO: 3833071 - RNA, 21 nt, Shigella flexneri 2a str. 2457T
gcacauuagcgaccuucugaa

SEQ ID NO: 3833072 - RNA, 15 nt, Shigella flexneri 2a str. 2457T
gcacauucugacugg

SEQ ID NO: 3833073 - RNA, 16 nt, Shigella flexneri 2a str. 2457T
gcacauugugcgccau

SEQ ID NO: 3833074 - RNA, 23 nt, Shigella flexneri 2a str. 2457T
gcacauuucagaaaguauauaaa

SEQ ID NO: 3833075 - RNA, 17 nt, Shigella flexneri 2a str. 2457T
gcaccaaacgggcaagc

SEQ ID NO: 3833076 - RNA, 21 nt, Shigella flexneri 2a str. 2457T
gcaccaaacgggcaagccagc

SEQ ID NO: 3833077 - RNA, 19 nt, Shigella flexneri 2a str. 2457T
gcaccaaagggcaaaguca

SEQ ID NO: 3833078 - RNA, 11 nt, Shigella flexneri 2a str. 2457T
gcaccaacaaa

SEQ ID NO: 3833079 - RNA, 14 nt, Shigella flexneri 2a str. 2457T
gcaccaacaaauag

SEQ ID NO: 3833080 - RNA, 16 nt, Shigella flexneri 2a str. 2457T
gcaccaacaaauagag

SEQ ID NO: 3833081 - RNA, 16 nt, Shigella flexneri 2a str. 2457T
gcaccaauauugacug

SEQ ID NO: 3833082 - RNA, 19 nt, Shigella flexneri 2a str. 2457T
gcaccaaucaccgccagca

SEQ ID NO: 3833083 - RNA, 15 nt, Shigella flexneri 2a str. 2457T
gcaccaauucaugag

SEQ ID NO: 3833084 - RNA, 17 nt, Shigella flexneri 2a str. 2457T
gcaccaccaaaaacgcc

SEQ ID NO: 3833085 - RNA, 19 nt, Shigella flexneri 2a str. 2457T
gcaccaccaaaaacgccau

SEQ ID NO: 3833086 - RNA, 14 nt, Shigella flexneri 2a str. 2457T
gcaccaccagcagc

SEQ ID NO: 3833087 - RNA, 14 nt, Shigella flexneri 2a str. 2457T
gcaccaccgcccgu

SEQ ID NO: 3833088 - RNA, 22 nt, Shigella flexneri 2a str. 2457T
gcaccaccuggcuugccgggcc

SEQ ID NO: 3833089 - RNA, 19 nt, Shigella flexneri 2a str. 2457T
gcaccacuuccggcaacaa

SEQ ID NO: 3833090 - RNA, 23 nt, Shigella flexneri 2a str. 2457T
gcaccacuuccggcaacaaugcc

SEQ ID NO: 3833091 - RNA, 22 nt, Shigella flexneri 2a str. 2457T
gcaccagaaaguuuuucaacac

SEQ ID NO: 3833092 - RNA, 14 nt, Shigella flexneri 2a str. 2457T
gcaccagcaacaag

SEQ ID NO: 3833093 - RNA, 22 nt, Shigella flexneri 2a str. 2457T
gcaccagcaacaagccagucca

SEQ ID NO: 3833094 - RNA, 13 nt, Shigella flexneri 2a str. 2457T
gcaccagcaacgc

SEQ ID NO: 3833095 - RNA, 22 nt, Shigella flexneri 2a str. 2457T
gcaccagccccuggaaaaagug

SEQ ID NO: 3833096 - RNA, 17 nt, Shigella flexneri 2a str. 2457T
gcaccaggcaguuuauc

SEQ ID NO: 3833097 - RNA, 18 nt, Shigella flexneri 2a str. 2457T
gcaccagggaaauaaucg

SEQ ID NO: 3833098 - RNA, 24 nt, Shigella flexneri 2a str. 2457T
gcaccaguggucuuuagacugcca

SEQ ID NO: 3833099 - RNA, 15 nt, Shigella flexneri 2a str. 2457T
gcaccaguucacccu

SEQ ID NO: 3833100 - RNA, 21 nt, Shigella flexneri 2a str. 2457T
gcaccaguucgccguacugac

SEQ ID NO: 3833101 - RNA, 21 nt, Shigella flexneri 2a str. 2457T
gcaccauccauuuuucacgca

SEQ ID NO: 3833102 - RNA, 17 nt, Shigella flexneri 2a str. 2457T
gcaccauccgcccacac

SEQ ID NO: 3833103 - RNA, 23 nt, Shigella flexneri 2a str. 2457T
gcaccaugucccggaacaggcag

SEQ ID NO: 3833104 - RNA, 11 nt, Shigella flexneri 2a str. 2457T
gcaccauucca

SEQ ID NO: 3833105 - RNA, 17 nt, Shigella flexneri 2a str. 2457T
gcaccauugcugccgcc

SEQ ID NO: 3833106 - RNA, 18 nt, Shigella flexneri 2a str. 2457T
gcaccauugcugccgcca

SEQ ID NO: 3833107 - RNA, 17 nt, Shigella flexneri 2a str. 2457T
gcaccauuuaaaucaau

SEQ ID NO: 3833108 - RNA, 12 nt, Shigella flexneri 2a str. 2457T
gcacccagcaau

SEQ ID NO: 3833109 - RNA, 19 nt, Shigella flexneri 2a str. 2457T
gcacccauuuauccagcgg

SEQ ID NO: 3833110 - RNA, 20 nt, Shigella flexneri 2a str. 2457T
gcacccauuuauccagcggc

SEQ ID NO: 3833111 - RNA, 14 nt, Shigella flexneri 2a str. 2457T
gcacccgccagcgc

SEQ ID NO: 3833112 - RNA, 18 nt, Shigella flexneri 2a str. 2457T
gcacccuauuuuuaccca

SEQ ID NO: 3833113 - RNA, 21 nt, Shigella flexneri 2a str. 2457T
gcacccuauuuuuacccaggc

SEQ ID NO: 3833114 - RNA, 22 nt, Shigella flexneri 2a str. 2457T
gcacccuauuuuuacccaggcc

SEQ ID NO: 3833115 - RNA, 23 nt, Shigella flexneri 2a str. 2457T
gcacccuauuuuuacccaggccu

SEQ ID NO: 3833116 - RNA, 15 nt, Shigella flexneri 2a str. 2457T
gcaccgaagcccauc

SEQ ID NO: 3833117 - RNA, 17 nt, Shigella flexneri 2a str. 2457T
gcaccgaccaucggcac

SEQ ID NO: 3833118 - RNA, 16 nt, Shigella flexneri 2a str. 2457T
gcaccgacgucgauau

SEQ ID NO: 3833119 - RNA, 18 nt, Shigella flexneri 2a str. 2457T
gcaccgcacagaccauca

SEQ ID NO: 3833120 - RNA, 14 nt, Shigella flexneri 2a str. 2457T
gcaccgcaccgccc

SEQ ID NO: 3833121 - RNA, 13 nt, Shigella flexneri 2a str. 2457T
gcaccgcagagau

SEQ ID NO: 3833122 - RNA, 16 nt, Shigella flexneri 2a str. 2457T
gcaccgccaaccagcg

SEQ ID NO: 3833123 - RNA, 15 nt, Shigella flexneri 2a str. 2457T
gcaccgccaccaccg

SEQ ID NO: 3833124 - RNA, 18 nt, Shigella flexneri 2a str. 2457T
gcaccgcgacaaucaggu

SEQ ID NO: 3833125 - RNA, 18 nt, Shigella flexneri 2a str. 2457T
gcaccggaacaacccagc

SEQ ID NO: 3833126 - RNA, 15 nt, Shigella flexneri 2a str. 2457T
gcaccggacacugcu

SEQ ID NO: 3833127 - RNA, 19 nt, Shigella flexneri 2a str. 2457T
gcaccggacuauccgccgc

SEQ ID NO: 3833128 - RNA, 17 nt, Shigella flexneri 2a str. 2457T
gcaccgggcuuccggca

SEQ ID NO: 3833129 - RNA, 20 nt, Shigella flexneri 2a str. 2457T
gcaccggugcgaacaaucac

SEQ ID NO: 3833130 - RNA, 15 nt, Shigella flexneri 2a str. 2457T
gcaccguaaacggcu

SEQ ID NO: 3833131 - RNA, 20 nt, Shigella flexneri 2a str. 2457T
gcaccguaucuucauugugc

SEQ ID NO: 3833132 - RNA, 14 nt, Shigella flexneri 2a str. 2457T
gcaccuaaagcgcg

SEQ ID NO: 3833133 - RNA, 14 nt, Shigella flexneri 2a str. 2457T
gcaccuacagccau

SEQ ID NO: 3833134 - RNA, 24 nt, Shigella flexneri 2a str. 2457T
gcaccugaguaauuaauacgccag

SEQ ID NO: 3833135 - RNA, 17 nt, Shigella flexneri 2a str. 2457T
gcaccuguaccagcccg

SEQ ID NO: 3833136 - RNA, 12 nt, Shigella flexneri 2a str. 2457T
gcaccuuuacca

SEQ ID NO: 3833137 - RNA, 17 nt, Shigella flexneri 2a str. 2457T
gcaccuuuucaucaggu

SEQ ID NO: 3833138 - RNA, 24 nt, Shigella flexneri 2a str. 2457T
gcaccuuuuccaccaauggcggaa

SEQ ID NO: 3833139 - RNA, 16 nt, Shigella flexneri 2a str. 2457T
gcacgaaaccacugca

SEQ ID NO: 3833140 - RNA, 14 nt, Shigella flexneri 2a str. 2457T
gcacgaaccagaga

SEQ ID NO: 3833141 - RNA, 23 nt, Shigella flexneri 2a str. 2457T
gcacgaauucaacgcguuuuuuc

SEQ ID NO: 3833142 - RNA, 16 nt, Shigella flexneri 2a str. 2457T
gcacgagaaaaaauga

SEQ ID NO: 3833143 - RNA, 18 nt, Shigella flexneri 2a str. 2457T
gcacgaugauauggucaa

SEQ ID NO: 3833144 - RNA, 23 nt, Shigella flexneri 2a str. 2457T
gcacgcagugguuaacaaucaca

SEQ ID NO: 3833145 - RNA, 15 nt, Shigella flexneri 2a str. 2457T
gcacgcccugauaaa

SEQ ID NO: 3833146 - RNA, 16 nt, Shigella flexneri 2a str. 2457T
gcacgccgacaaagau

SEQ ID NO: 3833147 - RNA, 17 nt, Shigella flexneri 2a str. 2457T
gcacgccggauuugaga

SEQ ID NO: 3833148 - RNA, 14 nt, Shigella flexneri 2a str. 2457T
gcacgcgcuucaca

SEQ ID NO: 3833149 - RNA, 20 nt, Shigella flexneri 2a str. 2457T
gcacgcguagagaauccagu

SEQ ID NO: 3833150 - RNA, 18 nt, Shigella flexneri 2a str. 2457T
gcacgcucuguucugcgc

SEQ ID NO: 3833151 - RNA, 16 nt, Shigella flexneri 2a str. 2457T
gcacgcuggagaacaa

SEQ ID NO: 3833152 - RNA, 14 nt, Shigella flexneri 2a str. 2457T
gcacgcuggcguca

SEQ ID NO: 3833153 - RNA, 16 nt, Shigella flexneri 2a str. 2457T
gcacggaaagcagcau

SEQ ID NO: 3833154 - RNA, 18 nt, Shigella flexneri 2a str. 2457T
gcacggauaccgcacgcu

SEQ ID NO: 3833155 - RNA, 23 nt, Shigella flexneri 2a str. 2457T
gcacggcaggaucugcgcggcaa

SEQ ID NO: 3833156 - RNA, 15 nt, Shigella flexneri 2a str. 2457T
gcacggugaagaagc

SEQ ID NO: 3833157 - RNA, 20 nt, Shigella flexneri 2a str. 2457T
gcacgguggucaggcgcgga

SEQ ID NO: 3833158 - RNA, 15 nt, Shigella flexneri 2a str. 2457T
gcacggugugcggca

SEQ ID NO: 3833159 - RNA, 18 nt, Shigella flexneri 2a str. 2457T
gcacgguuuuuccagcuc

SEQ ID NO: 3833160 - RNA, 19 nt, Shigella flexneri 2a str. 2457T
gcacguuagaaacaaaaaa

SEQ ID NO: 3833161 - RNA, 19 nt, Shigella flexneri 2a str. 2457T
gcacguugucagcaacugu

SEQ ID NO: 3833162 - RNA, 17 nt, Shigella flexneri 2a str. 2457T
gcacuacgcagggauau

SEQ ID NO: 3833163 - RNA, 17 nt, Shigella flexneri 2a str. 2457T
gcacuauacaaccagau

SEQ ID NO: 3833164 - RNA, 16 nt, Shigella flexneri 2a str. 2457T
gcacuaugugccagcu

SEQ ID NO: 3833165 - RNA, 23 nt, Shigella flexneri 2a str. 2457T
gcacuaugugccagcuucccgcu

SEQ ID NO: 3833166 - RNA, 16 nt, Shigella flexneri 2a str. 2457T
gcacuccugccaccac

SEQ ID NO: 3833167 - RNA, 18 nt, Shigella flexneri 2a str. 2457T
gcacucgcccugaccugc

SEQ ID NO: 3833168 - RNA, 16 nt, Shigella flexneri 2a str. 2457T
gcacucgcuggcacuc

SEQ ID NO: 3833169 - RNA, 23 nt, Shigella flexneri 2a str. 2457T
gcacucuccuccguuaaccugga

SEQ ID NO: 3833170 - RNA, 16 nt, Shigella flexneri 2a str. 2457T
gcacugaaagccgcag

SEQ ID NO: 3833171 - RNA, 12 nt, Shigella flexneri 2a str. 2457T
gcacugauucau

SEQ ID NO: 3833172 - RNA, 23 nt, Shigella flexneri 2a str. 2457T
gcacugauuuuuuccaacaggcg

SEQ ID NO: 3833173 - RNA, 19 nt, Shigella flexneri 2a str. 2457T
gcacugcaucaaugccgga

SEQ ID NO: 3833174 - RNA, 14 nt, Shigella flexneri 2a str. 2457T
gcacugccgcaucg

SEQ ID NO: 3833175 - RNA, 17 nt, Shigella flexneri 2a str. 2457T
gcacugcgcccgccagc

SEQ ID NO: 3833176 - RNA, 18 nt, Shigella flexneri 2a str. 2457T
gcacugcgcccgccagca

SEQ ID NO: 3833177 - RNA, 22 nt, Shigella flexneri 2a str. 2457T
gcacugcgcccgccagcaucgg

SEQ ID NO: 3833178 - RNA, 19 nt, Shigella flexneri 2a str. 2457T
gcacugcuuaaauuucuua

SEQ ID NO: 3833179 - RNA, 15 nt, Shigella flexneri 2a str. 2457T
gcacugcuugaagcg

SEQ ID NO: 3833180 - RNA, 14 nt, Shigella flexneri 2a str. 2457T
gcacuggcgagcgc

SEQ ID NO: 3833181 - RNA, 15 nt, Shigella flexneri 2a str. 2457T
gcacugguacucaac

SEQ ID NO: 3833182 - RNA, 16 nt, Shigella flexneri 2a str. 2457T
gcacuguuucgccagg

SEQ ID NO: 3833183 - RNA, 23 nt, Shigella flexneri 2a str. 2457T
gcacuuacagcaacgccuaaacu

SEQ ID NO: 3833184 - RNA, 14 nt, Shigella flexneri 2a str. 2457T
gcacuuaccuucac

SEQ ID NO: 3833185 - RNA, 14 nt, Shigella flexneri 2a str. 2457T
gcacuuacuuuccu

SEQ ID NO: 3833186 - RNA, 12 nt, Shigella flexneri 2a str. 2457T
gcacuucaacuu

SEQ ID NO: 3833187 - RNA, 21 nt, Shigella flexneri 2a str. 2457T
gcacuugcaggaacagugccu

SEQ ID NO: 3833188 - RNA, 17 nt, Shigella flexneri 2a str. 2457T
gcacuuucgccugcggc

SEQ ID NO: 3833189 - RNA, 13 nt, Shigella flexneri 2a str. 2457T
gcacuuuguccgc

SEQ ID NO: 3833190 - RNA, 18 nt, Shigella flexneri 2a str. 2457T
gcagaaaaaacaaacggc

SEQ ID NO: 3833191 - RNA, 16 nt, Shigella flexneri 2a str. 2457T
gcagaaacaaacgcaa

SEQ ID NO: 3833192 - RNA, 19 nt, Shigella flexneri 2a str. 2457T
gcagaaacauaauauaaau

SEQ ID NO: 3833193 - RNA, 20 nt, Shigella flexneri 2a str. 2457T
gcagaacggugcgaccaaac

SEQ ID NO: 3833194 - RNA, 18 nt, Shigella flexneri 2a str. 2457T
gcagaagcaaucauccca

SEQ ID NO: 3833195 - RNA, 15 nt, Shigella flexneri 2a str. 2457T
gcagaagcauuuuac

SEQ ID NO: 3833196 - RNA, 23 nt, Shigella flexneri 2a str. 2457T
gcagaagcauuuuacauccugau

SEQ ID NO: 3833197 - RNA, 15 nt, Shigella flexneri 2a str. 2457T
gcagaagcugcagga

SEQ ID NO: 3833198 - RNA, 20 nt, Shigella flexneri 2a str. 2457T
gcagaaguuguccaugugcu

SEQ ID NO: 3833199 - RNA, 20 nt, Shigella flexneri 2a str. 2457T
gcagaaugguaacaccagag

SEQ ID NO: 3833200 - RNA, 15 nt, Shigella flexneri 2a str. 2457T
gcagaaugguuucau

SEQ ID NO: 3833201 - RNA, 13 nt, Shigella flexneri 2a str. 2457T
gcagacaacccac

SEQ ID NO: 3833202 - RNA, 17 nt, Shigella flexneri 2a str. 2457T
gcagacaaucacaucac

SEQ ID NO: 3833203 - RNA, 21 nt, Shigella flexneri 2a str. 2457T
gcagacacgcaauaccagcuc

SEQ ID NO: 3833204 - RNA, 19 nt, Shigella flexneri 2a str. 2457T
gcagaccaauguuacgacc

SEQ ID NO: 3833205 - RNA, 14 nt, Shigella flexneri 2a str. 2457T
gcagaccagcaaaa

SEQ ID NO: 3833206 - RNA, 20 nt, Shigella flexneri 2a str. 2457T
gcagacccguuaagcguuca

SEQ ID NO: 3833207 - RNA, 11 nt, Shigella flexneri 2a str. 2457T
gcagacgccac

SEQ ID NO: 3833208 - RNA, 13 nt, Shigella flexneri 2a str. 2457T
gcagacugaauac

SEQ ID NO: 3833209 - RNA, 17 nt, Shigella flexneri 2a str. 2457T
gcagacuggauugccag

SEQ ID NO: 3833210 - RNA, 21 nt, Shigella flexneri 2a str. 2457T
gcagacuuuuugcggcagcaa

SEQ ID NO: 3833211 - RNA, 20 nt, Shigella flexneri 2a str. 2457T
gcagagaaaauaucccguca

SEQ ID NO: 3833212 - RNA, 20 nt, Shigella flexneri 2a str. 2457T
gcagagaaacgccagcagca

SEQ ID NO: 3833213 - RNA, 21 nt, Shigella flexneri 2a str. 2457T
gcagagaaacgccagcagcag

SEQ ID NO: 3833214 - RNA, 17 nt, Shigella flexneri 2a str. 2457T
gcagagaucgccccggc

SEQ ID NO: 3833215 - RNA, 22 nt, Shigella flexneri 2a str. 2457T
gcagagaucgccccggcaagaa

SEQ ID NO: 3833216 - RNA, 20 nt, Shigella flexneri 2a str. 2457T
gcagagaugcccauucaccg

SEQ ID NO: 3833217 - RNA, 14 nt, Shigella flexneri 2a str. 2457T
gcagagccugaaua

SEQ ID NO: 3833218 - RNA, 18 nt, Shigella flexneri 2a str. 2457T
gcagaguuguucugcgac

SEQ ID NO: 3833219 - RNA, 13 nt, Shigella flexneri 2a str. 2457T
gcagauaaauauc

SEQ ID NO: 3833220 - RNA, 21 nt, Shigella flexneri 2a str. 2457T
gcagauaaauaucaaucccau

SEQ ID NO: 3833221 - RNA, 18 nt, Shigella flexneri 2a str. 2457T
gcagauacauugccacca

SEQ ID NO: 3833222 - RNA, 23 nt, Shigella flexneri 2a str. 2457T
gcagauacauugccaccaccagc

SEQ ID NO: 3833223 - RNA, 15 nt, Shigella flexneri 2a str. 2457T
gcagauaccacauca

SEQ ID NO: 3833224 - RNA, 21 nt, Shigella flexneri 2a str. 2457T
gcagauaccacaucaacccgc

SEQ ID NO: 3833225 - RNA, 17 nt, Shigella flexneri 2a str. 2457T
gcagauaucccgccagc

SEQ ID NO: 3833226 - RNA, 23 nt, Shigella flexneri 2a str. 2457T
gcagauaucccgccagcaccagc

SEQ ID NO: 3833227 - RNA, 16 nt, Shigella flexneri 2a str. 2457T
gcagaucaaauucaau

SEQ ID NO: 3833228 - RNA, 24 nt, Shigella flexneri 2a str. 2457T
gcagaucaaauucaaugacaguau

SEQ ID NO: 3833229 - RNA, 14 nt, Shigella flexneri 2a str. 2457T
gcagauccugauuu

SEQ ID NO: 3833230 - RNA, 17 nt, Shigella flexneri 2a str. 2457T
gcagaucggcauucaca

SEQ ID NO: 3833231 - RNA, 19 nt, Shigella flexneri 2a str. 2457T
gcagaugaagcuggcaaag

SEQ ID NO: 3833232 - RNA, 20 nt, Shigella flexneri 2a str. 2457T
gcagaugaagcuggcaaagu

SEQ ID NO: 3833233 - RNA, 22 nt, Shigella flexneri 2a str. 2457T
gcagauuagccgguaaaucacc

SEQ ID NO: 3833234 - RNA, 20 nt, Shigella flexneri 2a str. 2457T
gcagauuucuucuggcuacu

SEQ ID NO: 3833235 - RNA, 16 nt, Shigella flexneri 2a str. 2457T
gcagcaaacgaaagca

SEQ ID NO: 3833236 - RNA, 18 nt, Shigella flexneri 2a str. 2457T
gcagcaaauagccgagcg

SEQ ID NO: 3833237 - RNA, 23 nt, Shigella flexneri 2a str. 2457T
gcagcaaauagccgagcgcguua

SEQ ID NO: 3833238 - RNA, 18 nt, Shigella flexneri 2a str. 2457T
gcagcaaccgguaaagaa

SEQ ID NO: 3833239 - RNA, 19 nt, Shigella flexneri 2a str. 2457T
gcagcaaccgguaaagaag

SEQ ID NO: 3833240 - RNA, 21 nt, Shigella flexneri 2a str. 2457T
gcagcaacgaugacaucgcag

SEQ ID NO: 3833241 - RNA, 15 nt, Shigella flexneri 2a str. 2457T
gcagcaacggcaguu

SEQ ID NO: 3833242 - RNA, 17 nt, Shigella flexneri 2a str. 2457T
gcagcaacucuuuuucc

SEQ ID NO: 3833243 - RNA, 13 nt, Shigella flexneri 2a str. 2457T
gcagcaagccauc

SEQ ID NO: 3833244 - RNA, 21 nt, Shigella flexneri 2a str. 2457T
gcagcaaggcuauucagcagu

SEQ ID NO: 3833245 - RNA, 16 nt, Shigella flexneri 2a str. 2457T
gcagcaagucggcauc

SEQ ID NO: 3833246 - RNA, 16 nt, Shigella flexneri 2a str. 2457T
gcagcaaucacugcca

SEQ ID NO: 3833247 - RNA, 20 nt, Shigella flexneri 2a str. 2457T
gcagcacccugaguuuucag

SEQ ID NO: 3833248 - RNA, 20 nt, Shigella flexneri 2a str. 2457T
gcagcacuacaccccagcgu

SEQ ID NO: 3833249 - RNA, 14 nt, Shigella flexneri 2a str. 2457T
gcagcacugauaau

SEQ ID NO: 3833250 - RNA, 20 nt, Shigella flexneri 2a str. 2457T
gcagcagaaagcgacuuugc

SEQ ID NO: 3833251 - RNA, 14 nt, Shigella flexneri 2a str. 2457T
gcagcagagaaaau

SEQ ID NO: 3833252 - RNA, 17 nt, Shigella flexneri 2a str. 2457T
gcagcagagaaaauauc

SEQ ID NO: 3833253 - RNA, 19 nt, Shigella flexneri 2a str. 2457T
gcagcagagaaaauauccc

SEQ ID NO: 3833254 - RNA, 23 nt, Shigella flexneri 2a str. 2457T
gcagcagccaguuguugauaagc

SEQ ID NO: 3833255 - RNA, 22 nt, Shigella flexneri 2a str. 2457T
gcagcagccgguauccagcgcg

SEQ ID NO: 3833256 - RNA, 15 nt, Shigella flexneri 2a str. 2457T
gcagcagccugcgcu

SEQ ID NO: 3833257 - RNA, 17 nt, Shigella flexneri 2a str. 2457T
gcagcagcgcaauucgc

SEQ ID NO: 3833258 - RNA, 12 nt, Shigella flexneri 2a str. 2457T
gcagcagcgcgc

SEQ ID NO: 3833259 - RNA, 16 nt, Shigella flexneri 2a str. 2457T
gcagcagcgcgcccgg

SEQ ID NO: 3833260 - RNA, 13 nt, Shigella flexneri 2a str. 2457T
gcagcagcgguug

SEQ ID NO: 3833261 - RNA, 22 nt, Shigella flexneri 2a str. 2457T
gcagcagcguuucgaacaggcc

SEQ ID NO: 3833262 - RNA, 21 nt, Shigella flexneri 2a str. 2457T
gcagcaggaucuccagcuccc

SEQ ID NO: 3833263 - RNA, 20 nt, Shigella flexneri 2a str. 2457T
gcagcagucaggcgcgcggu

SEQ ID NO: 3833264 - RNA, 22 nt, Shigella flexneri 2a str. 2457T
gcagcauauaguuuugcauggc

SEQ ID NO: 3833265 - RNA, 13 nt, Shigella flexneri 2a str. 2457T
gcagcaucaccgg

SEQ ID NO: 3833266 - RNA, 16 nt, Shigella flexneri 2a str. 2457T
gcagcaucgccaggau

SEQ ID NO: 3833267 - RNA, 13 nt, Shigella flexneri 2a str. 2457T
gcagcaucgucau

SEQ ID NO: 3833268 - RNA, 15 nt, Shigella flexneri 2a str. 2457T
gcagcaucgucauca

SEQ ID NO: 3833269 - RNA, 11 nt, Shigella flexneri 2a str. 2457T
gcagcaugcac

SEQ ID NO: 3833270 - RNA, 15 nt, Shigella flexneri 2a str. 2457T
gcagcaugcacccuc

SEQ ID NO: 3833271 - RNA, 16 nt, Shigella flexneri 2a str. 2457T
gcagcaugcacccuca

SEQ ID NO: 3833272 - RNA, 22 nt, Shigella flexneri 2a str. 2457T
gcagcaugcacccucaauaacu

SEQ ID NO: 3833273 - RNA, 18 nt, Shigella flexneri 2a str. 2457T
gcagcaugcaucccgccg

SEQ ID NO: 3833274 - RNA, 18 nt, Shigella flexneri 2a str. 2457T
gcagcauguguaaccgcu

SEQ ID NO: 3833275 - RNA, 18 nt, Shigella flexneri 2a str. 2457T
gcagcauucagguugauc

SEQ ID NO: 3833276 - RNA, 12 nt, Shigella flexneri 2a str. 2457T
gcagccaaaaau

SEQ ID NO: 3833277 - RNA, 19 nt, Shigella flexneri 2a str. 2457T
gcagccaaaaaugacgccc

SEQ ID NO: 3833278 - RNA, 20 nt, Shigella flexneri 2a str. 2457T
gcagccacacguuaaugcaa

SEQ ID NO: 3833279 - RNA, 13 nt, Shigella flexneri 2a str. 2457T
gcagccagcgcgc

SEQ ID NO: 3833280 - RNA, 16 nt, Shigella flexneri 2a str. 2457T
gcagccagcgcgccuu

SEQ ID NO: 3833281 - RNA, 19 nt, Shigella flexneri 2a str. 2457T
gcagccagggucaacauaa

SEQ ID NO: 3833282 - RNA, 18 nt, Shigella flexneri 2a str. 2457T
gcagccaguuaaccugcu

SEQ ID NO: 3833283 - RNA, 17 nt, Shigella flexneri 2a str. 2457T
gcagccaucaccacgcu

SEQ ID NO: 3833284 - RNA, 16 nt, Shigella flexneri 2a str. 2457T
gcagccaucacugacu

SEQ ID NO: 3833285 - RNA, 18 nt, Shigella flexneri 2a str. 2457T
gcagcccauucuccgagg

SEQ ID NO: 3833286 - RNA, 13 nt, Shigella flexneri 2a str. 2457T
gcagccccgccgg

SEQ ID NO: 3833287 - RNA, 22 nt, Shigella flexneri 2a str. 2457T
gcagccgcauuuuuucuucagu

SEQ ID NO: 3833288 - RNA, 19 nt, Shigella flexneri 2a str. 2457T
gcagccgguauccagcgcg

SEQ ID NO: 3833289 - RNA, 15 nt, Shigella flexneri 2a str. 2457T
gcagccgucauugaa

SEQ ID NO: 3833290 - RNA, 20 nt, Shigella flexneri 2a str. 2457T
gcagccgucgccaguaccag

SEQ ID NO: 3833291 - RNA, 14 nt, Shigella flexneri 2a str. 2457T
gcagccgugcccaa

SEQ ID NO: 3833292 - RNA, 19 nt, Shigella flexneri 2a str. 2457T
gcagccgugcccaacugcc

SEQ ID NO: 3833293 - RNA, 20 nt, Shigella flexneri 2a str. 2457T
gcagcgauucaacaguagcc

SEQ ID NO: 3833294 - RNA, 17 nt, Shigella flexneri 2a str. 2457T
gcagcgcaaucgccucc

SEQ ID NO: 3833295 - RNA, 14 nt, Shigella flexneri 2a str. 2457T
gcagcgccaaucgc

SEQ ID NO: 3833296 - RNA, 14 nt, Shigella flexneri 2a str. 2457T
gcagcgccagcgaa

SEQ ID NO: 3833297 - RNA, 16 nt, Shigella flexneri 2a str. 2457T
gcagcgccagcgaagc

SEQ ID NO: 3833298 - RNA, 16 nt, Shigella flexneri 2a str. 2457T
gcagcggcgaucguga

SEQ ID NO: 3833299 - RNA, 17 nt, Shigella flexneri 2a str. 2457T
gcagcgucacucgcugc

SEQ ID NO: 3833300 - RNA, 17 nt, Shigella flexneri 2a str. 2457T
gcagcgucgcaucaggc

SEQ ID NO: 3833301 - RNA, 13 nt, Shigella flexneri 2a str. 2457T
gcagcgucuucug

SEQ ID NO: 3833302 - RNA, 18 nt, Shigella flexneri 2a str. 2457T
gcagcgugauccaccccu

SEQ ID NO: 3833303 - RNA, 18 nt, Shigella flexneri 2a str. 2457T
gcagcgugcucucaaaua

SEQ ID NO: 3833304 - RNA, 19 nt, Shigella flexneri 2a str. 2457T
gcagcguuaaugauauccc

SEQ ID NO: 3833305 - RNA, 23 nt, Shigella flexneri 2a str. 2457T
gcagcguucauaaauacagagca

SEQ ID NO: 3833306 - RNA, 16 nt, Shigella flexneri 2a str. 2457T
gcagcguuuccagcca

SEQ ID NO: 3833307 - RNA, 21 nt, Shigella flexneri 2a str. 2457T
gcagcuccaccgauuuugaga

SEQ ID NO: 3833308 - RNA, 12 nt, Shigella flexneri 2a str. 2457T
gcagcuccagcc

SEQ ID NO: 3833309 - RNA, 21 nt, Shigella flexneri 2a str. 2457T
gcagcucgcguucggaaauau

SEQ ID NO: 3833310 - RNA, 12 nt, Shigella flexneri 2a str. 2457T
gcagcugagaaa

SEQ ID NO: 3833311 - RNA, 12 nt, Shigella flexneri 2a str. 2457T
gcagcugcgcau

SEQ ID NO: 3833312 - RNA, 20 nt, Shigella flexneri 2a str. 2457T
gcagcuuaaucauaauguug

SEQ ID NO: 3833313 - RNA, 14 nt, Shigella flexneri 2a str. 2457T
gcagcuuagaaauu

SEQ ID NO: 3833314 - RNA, 15 nt, Shigella flexneri 2a str. 2457T
gcagcuuaucuuuuu

SEQ ID NO: 3833315 - RNA, 18 nt, Shigella flexneri 2a str. 2457T
gcagcuuaucuuuuucgg

SEQ ID NO: 3833316 - RNA, 13 nt, Shigella flexneri 2a str. 2457T
gcagcuucacaaa

SEQ ID NO: 3833317 - RNA, 23 nt, Shigella flexneri 2a str. 2457T
gcagcuucacaaaggcuugcugc

SEQ ID NO: 3833318 - RNA, 20 nt, Shigella flexneri 2a str. 2457T
gcagcuucucgugaaacuca

SEQ ID NO: 3833319 - RNA, 23 nt, Shigella flexneri 2a str. 2457T
gcagcuugcuguuucgcugacga

SEQ ID NO: 3833320 - RNA, 15 nt, Shigella flexneri 2a str. 2457T
gcagcuuucagcagc

SEQ ID NO: 3833321 - RNA, 16 nt, Shigella flexneri 2a str. 2457T
gcagcuuucagcagcg

SEQ ID NO: 3833322 - RNA, 14 nt, Shigella flexneri 2a str. 2457T
gcaggaaaaaagcg

SEQ ID NO: 3833323 - RNA, 20 nt, Shigella flexneri 2a str. 2457T
gcaggaaaacaauguucauc

SEQ ID NO: 3833324 - RNA, 19 nt, Shigella flexneri 2a str. 2457T
gcaggaaaagguaggccug

SEQ ID NO: 3833325 - RNA, 18 nt, Shigella flexneri 2a str. 2457T
gcaggaaaaucagcauca

SEQ ID NO: 3833326 - RNA, 22 nt, Shigella flexneri 2a str. 2457T
gcaggaacagugccucgcuaau

SEQ ID NO: 3833327 - RNA, 12 nt, Shigella flexneri 2a str. 2457T
gcaggaacugcu

SEQ ID NO: 3833328 - RNA, 17 nt, Shigella flexneri 2a str. 2457T
gcaggaauaaucagcaa

SEQ ID NO: 3833329 - RNA, 20 nt, Shigella flexneri 2a str. 2457T
gcaggaaucacguaggccug

SEQ ID NO: 3833330 - RNA, 21 nt, Shigella flexneri 2a str. 2457T
gcaggaaucacguaggccuga

SEQ ID NO: 3833331 - RNA, 17 nt, Shigella flexneri 2a str. 2457T
gcaggagauaauauccu

SEQ ID NO: 3833332 - RNA, 20 nt, Shigella flexneri 2a str. 2457T
gcaggagcagccccugcgcc

SEQ ID NO: 3833333 - RNA, 21 nt, Shigella flexneri 2a str. 2457T
gcaggagcgauuaugaaacaa

SEQ ID NO: 3833334 - RNA, 23 nt, Shigella flexneri 2a str. 2457T
gcaggaucgacugcaaaccauga

SEQ ID NO: 3833335 - RNA, 20 nt, Shigella flexneri 2a str. 2457T
gcaggauguuccggcaaagu

SEQ ID NO: 3833336 - RNA, 21 nt, Shigella flexneri 2a str. 2457T
gcaggauuucuucaccagccu

SEQ ID NO: 3833337 - RNA, 23 nt, Shigella flexneri 2a str. 2457T
gcaggcaaccguucggaaaaaua

SEQ ID NO: 3833338 - RNA, 18 nt, Shigella flexneri 2a str. 2457T
gcaggcacaaaaccugcc

SEQ ID NO: 3833339 - RNA, 18 nt, Shigella flexneri 2a str. 2457T
gcaggcaccagccccugg

SEQ ID NO: 3833340 - RNA, 16 nt, Shigella flexneri 2a str. 2457T
gcaggcaucaaugaaa

SEQ ID NO: 3833341 - RNA, 16 nt, Shigella flexneri 2a str. 2457T
gcaggcaucaucagau

SEQ ID NO: 3833342 - RNA, 20 nt, Shigella flexneri 2a str. 2457T
gcaggccggguuuucucccu

SEQ ID NO: 3833343 - RNA, 20 nt, Shigella flexneri 2a str. 2457T
gcaggccugauaagcgcagc

SEQ ID NO: 3833344 - RNA, 20 nt, Shigella flexneri 2a str. 2457T
gcaggcgauccuguucaaac

SEQ ID NO: 3833345 - RNA, 14 nt, Shigella flexneri 2a str. 2457T
gcaggcgcaauggc

SEQ ID NO: 3833346 - RNA, 17 nt, Shigella flexneri 2a str. 2457T
gcaggcgcaauggcgca

SEQ ID NO: 3833347 - RNA, 19 nt, Shigella flexneri 2a str. 2457T
gcaggcggauugcuucugc

SEQ ID NO: 3833348 - RNA, 15 nt, Shigella flexneri 2a str. 2457T
gcaggcggcuucgca

SEQ ID NO: 3833349 - RNA, 19 nt, Shigella flexneri 2a str. 2457T
gcaggcguaacacucgugc

SEQ ID NO: 3833350 - RNA, 18 nt, Shigella flexneri 2a str. 2457T
gcaggcuaguaaaaagca

SEQ ID NO: 3833351 - RNA, 15 nt, Shigella flexneri 2a str. 2457T
gcaggcucagacuga

SEQ ID NO: 3833352 - RNA, 23 nt, Shigella flexneri 2a str. 2457T
gcaggcuguuaccccugcggccg

SEQ ID NO: 3833353 - RNA, 14 nt, Shigella flexneri 2a str. 2457T
gcaggcuucaacac

SEQ ID NO: 3833354 - RNA, 21 nt, Shigella flexneri 2a str. 2457T
gcaggcuucaacacaggccgg

SEQ ID NO: 3833355 - RNA, 22 nt, Shigella flexneri 2a str. 2457T
gcaggcuucaacacaggccggc

SEQ ID NO: 3833356 - RNA, 18 nt, Shigella flexneri 2a str. 2457T
gcaggcuuuagcuaauca

SEQ ID NO: 3833357 - RNA, 23 nt, Shigella flexneri 2a str. 2457T
gcagggcaaacagcacggucagg

SEQ ID NO: 3833358 - RNA, 13 nt, Shigella flexneri 2a str. 2457T
gcagggcaucaag

SEQ ID NO: 3833359 - RNA, 14 nt, Shigella flexneri 2a str. 2457T
gcagggccaccagc

SEQ ID NO: 3833360 - RNA, 22 nt, Shigella flexneri 2a str. 2457T
gcagggccguuuucguuacucc

SEQ ID NO: 3833361 - RNA, 14 nt, Shigella flexneri 2a str. 2457T
gcagguaagaguuu

SEQ ID NO: 3833362 - RNA, 14 nt, Shigella flexneri 2a str. 2457T
gcagguauaccgga

SEQ ID NO: 3833363 - RNA, 13 nt, Shigella flexneri 2a str. 2457T
gcaggucaaagca

SEQ ID NO: 3833364 - RNA, 20 nt, Shigella flexneri 2a str. 2457T
gcaggucaugguaggccgga

SEQ ID NO: 3833365 - RNA, 23 nt, Shigella flexneri 2a str. 2457T
gcaggucgcccggauuacagcuc

SEQ ID NO: 3833366 - RNA, 17 nt, Shigella flexneri 2a str. 2457T
gcagguuccacggcaug

SEQ ID NO: 3833367 - RNA, 15 nt, Shigella flexneri 2a str. 2457T
gcagguuuaaccauc

SEQ ID NO: 3833368 - RNA, 13 nt, Shigella flexneri 2a str. 2457T
gcaguaaaccacc

SEQ ID NO: 3833369 - RNA, 14 nt, Shigella flexneri 2a str. 2457T
gcaguaaaccaccc

SEQ ID NO: 3833370 - RNA, 15 nt, Shigella flexneri 2a str. 2457T
gcaguaaaccaccca

SEQ ID NO: 3833371 - RNA, 16 nt, Shigella flexneri 2a str. 2457T
gcaguaaaccacccac

SEQ ID NO: 3833372 - RNA, 19 nt, Shigella flexneri 2a str. 2457T
gcaguaaaccacccaccag

SEQ ID NO: 3833373 - RNA, 22 nt, Shigella flexneri 2a str. 2457T
gcaguaaaccgucagcaccagg

SEQ ID NO: 3833374 - RNA, 20 nt, Shigella flexneri 2a str. 2457T
gcaguaaggucaucaaucau

SEQ ID NO: 3833375 - RNA, 18 nt, Shigella flexneri 2a str. 2457T
gcaguaauaccagaccuu

SEQ ID NO: 3833376 - RNA, 21 nt, Shigella flexneri 2a str. 2457T
gcaguaaucggcgaaaccgcg

SEQ ID NO: 3833377 - RNA, 21 nt, Shigella flexneri 2a str. 2457T
gcaguaccaccggacgcacac

SEQ ID NO: 3833378 - RNA, 12 nt, Shigella flexneri 2a str. 2457T
gcaguaccagau

SEQ ID NO: 3833379 - RNA, 17 nt, Shigella flexneri 2a str. 2457T
gcaguaccuccuucaca

SEQ ID NO: 3833380 - RNA, 13 nt, Shigella flexneri 2a str. 2457T
gcaguacgccacc

SEQ ID NO: 3833381 - RNA, 17 nt, Shigella flexneri 2a str. 2457T
gcaguacggcagcaauc

SEQ ID NO: 3833382 - RNA, 22 nt, Shigella flexneri 2a str. 2457T
gcaguagaucuuauaugcgucu

SEQ ID NO: 3833383 - RNA, 20 nt, Shigella flexneri 2a str. 2457T
gcaguagcgucgccagcagu

SEQ ID NO: 3833384 - RNA, 19 nt, Shigella flexneri 2a str. 2457T
gcagucaccugcccuccgg

SEQ ID NO: 3833385 - RNA, 19 nt, Shigella flexneri 2a str. 2457T
gcagucaccugcggugcag

SEQ ID NO: 3833386 - RNA, 17 nt, Shigella flexneri 2a str. 2457T
gcagucagguucagcgu

SEQ ID NO: 3833387 - RNA, 16 nt, Shigella flexneri 2a str. 2457T
gcagucauaaaaucaa

SEQ ID NO: 3833388 - RNA, 15 nt, Shigella flexneri 2a str. 2457T
gcagucauaaccagu

SEQ ID NO: 3833389 - RNA, 14 nt, Shigella flexneri 2a str. 2457T
gcagucuucccagc

SEQ ID NO: 3833390 - RNA, 19 nt, Shigella flexneri 2a str. 2457T
gcagugaucgugugccacc

SEQ ID NO: 3833391 - RNA, 18 nt, Shigella flexneri 2a str. 2457T
gcagugcacgaaccagag

SEQ ID NO: 3833392 - RNA, 10 nt, Shigella flexneri 2a str. 2457T
gcagugccag

SEQ ID NO: 3833393 - RNA, 22 nt, Shigella flexneri 2a str. 2457T
gcagugggcguuggucagcgga

SEQ ID NO: 3833394 - RNA, 18 nt, Shigella flexneri 2a str. 2457T
gcaguggguaagccagac

SEQ ID NO: 3833395 - RNA, 14 nt, Shigella flexneri 2a str. 2457T
gcaguggugcggcu

SEQ ID NO: 3833396 - RNA, 19 nt, Shigella flexneri 2a str. 2457T
gcagugguuaacaaucaca

SEQ ID NO: 3833397 - RNA, 23 nt, Shigella flexneri 2a str. 2457T
gcaguguuuguuaaaacuuucca

SEQ ID NO: 3833398 - RNA, 19 nt, Shigella flexneri 2a str. 2457T
gcaguuccccggcgcggug

SEQ ID NO: 3833399 - RNA, 16 nt, Shigella flexneri 2a str. 2457T
gcaguucccuacucuc

SEQ ID NO: 3833400 - RNA, 12 nt, Shigella flexneri 2a str. 2457T
gcaguuccugca

SEQ ID NO: 3833401 - RNA, 22 nt, Shigella flexneri 2a str. 2457T
gcaguucgggccgaucauacga

SEQ ID NO: 3833402 - RNA, 21 nt, Shigella flexneri 2a str. 2457T
gcaguucgucgcguuugcccg

SEQ ID NO: 3833403 - RNA, 18 nt, Shigella flexneri 2a str. 2457T
gcaguucugccaggcugg

SEQ ID NO: 3833404 - RNA, 21 nt, Shigella flexneri 2a str. 2457T
gcaguucugccaggcuggcag

SEQ ID NO: 3833405 - RNA, 17 nt, Shigella flexneri 2a str. 2457T
gcaguucuggcaccgga

SEQ ID NO: 3833406 - RNA, 17 nt, Shigella flexneri 2a str. 2457T
gcaguuucaccagcagu

SEQ ID NO: 3833407 - RNA, 14 nt, Shigella flexneri 2a str. 2457T
gcaguuucgcgacc

SEQ ID NO: 3833408 - RNA, 15 nt, Shigella flexneri 2a str. 2457T
gcaguuucugauacu

SEQ ID NO: 3833409 - RNA, 21 nt, Shigella flexneri 2a str. 2457T
gcaguuucugauacugcuccg

SEQ ID NO: 3833410 - RNA, 21 nt, Shigella flexneri 2a str. 2457T
gcaguuugcgguguguggcug

SEQ ID NO: 3833411 - RNA, 24 nt, Shigella flexneri 2a str. 2457T
gcaguuugguuaagucacgggcag

SEQ ID NO: 3833412 - RNA, 16 nt, Shigella flexneri 2a str. 2457T
gcaguuuuuuaacgcc

SEQ ID NO: 3833413 - RNA, 12 nt, Shigella flexneri 2a str. 2457T
gcauaaaaauau

SEQ ID NO: 3833414 - RNA, 15 nt, Shigella flexneri 2a str. 2457T
gcauaaauaccggca

SEQ ID NO: 3833415 - RNA, 23 nt, Shigella flexneri 2a str. 2457T
gcauaaccagagagcuuauccag

SEQ ID NO: 3833416 - RNA, 22 nt, Shigella flexneri 2a str. 2457T
gcauaacccguauguucccacc

SEQ ID NO: 3833417 - RNA, 15 nt, Shigella flexneri 2a str. 2457T
gcauaacucaccauc

SEQ ID NO: 3833418 - RNA, 13 nt, Shigella flexneri 2a str. 2457T
gcauaagccaccu

SEQ ID NO: 3833419 - RNA, 22 nt, Shigella flexneri 2a str. 2457T
gcauaagccgucccuaccggua

SEQ ID NO: 3833420 - RNA, 21 nt, Shigella flexneri 2a str. 2457T
gcauaaucaccaucagcagca

SEQ ID NO: 3833421 - RNA, 22 nt, Shigella flexneri 2a str. 2457T
gcauaaucaccaucagcagcaa

SEQ ID NO: 3833422 - RNA, 21 nt, Shigella flexneri 2a str. 2457T
gcauaaucauuacaaccgcug

SEQ ID NO: 3833423 - RNA, 15 nt, Shigella flexneri 2a str. 2457T
gcauaaucggcuggg

SEQ ID NO: 3833424 - RNA, 22 nt, Shigella flexneri 2a str. 2457T
gcauaaucggcuggguuuccgg

SEQ ID NO: 3833425 - RNA, 15 nt, Shigella flexneri 2a str. 2457T
gcauaaugcagccau

SEQ ID NO: 3833426 - RNA, 17 nt, Shigella flexneri 2a str. 2457T
gcauaaugcagccaucc

SEQ ID NO: 3833427 - RNA, 21 nt, Shigella flexneri 2a str. 2457T
gcauaaugugcgcacauugcc

SEQ ID NO: 3833428 - RNA, 15 nt, Shigella flexneri 2a str. 2457T
gcauaauuuccagca

SEQ ID NO: 3833429 - RNA, 14 nt, Shigella flexneri 2a str. 2457T
gcauacaacgccau

SEQ ID NO: 3833430 - RNA, 16 nt, Shigella flexneri 2a str. 2457T
gcauacaacgccauga

SEQ ID NO: 3833431 - RNA, 19 nt, Shigella flexneri 2a str. 2457T
gcauacaacgccaugaaga

SEQ ID NO: 3833432 - RNA, 13 nt, Shigella flexneri 2a str. 2457T
gcauacccagaac

SEQ ID NO: 3833433 - RNA, 22 nt, Shigella flexneri 2a str. 2457T
gcauacccagaacuaucauacu

SEQ ID NO: 3833434 - RNA, 18 nt, Shigella flexneri 2a str. 2457T
gcauaccggacgacggca

SEQ ID NO: 3833435 - RNA, 23 nt, Shigella flexneri 2a str. 2457T
gcauaccuucacagaaggccagg

SEQ ID NO: 3833436 - RNA, 20 nt, Shigella flexneri 2a str. 2457T
gcauaccuuccagcgcguuc

SEQ ID NO: 3833437 - RNA, 23 nt, Shigella flexneri 2a str. 2457T
gcauacggaauagcuuaccgguc

SEQ ID NO: 3833438 - RNA, 15 nt, Shigella flexneri 2a str. 2457T
gcauacggugaaagu

SEQ ID NO: 3833439 - RNA, 20 nt, Shigella flexneri 2a str. 2457T
gcauacucuccuccagguua

SEQ ID NO: 3833440 - RNA, 17 nt, Shigella flexneri 2a str. 2457T
gcauacugaaccacgga

SEQ ID NO: 3833441 - RNA, 18 nt, Shigella flexneri 2a str. 2457T
gcauacuuucaucaaacg

SEQ ID NO: 3833442 - RNA, 22 nt, Shigella flexneri 2a str. 2457T
gcauagccaccuggcugcguuu

SEQ ID NO: 3833443 - RNA, 16 nt, Shigella flexneri 2a str. 2457T
gcauagccccagcgca

SEQ ID NO: 3833444 - RNA, 12 nt, Shigella flexneri 2a str. 2457T
gcauagcuggcg

SEQ ID NO: 3833445 - RNA, 13 nt, Shigella flexneri 2a str. 2457T
gcauaggcauuaa

SEQ ID NO: 3833446 - RNA, 17 nt, Shigella flexneri 2a str. 2457T
gcauagguugaaauaaa

SEQ ID NO: 3833447 - RNA, 15 nt, Shigella flexneri 2a str. 2457T
gcauauaccacaccc

SEQ ID NO: 3833448 - RNA, 16 nt, Shigella flexneri 2a str. 2457T
gcauaucagcaacucu

SEQ ID NO: 3833449 - RNA, 13 nt, Shigella flexneri 2a str. 2457T
gcauauccaggcu

SEQ ID NO: 3833450 - RNA, 17 nt, Shigella flexneri 2a str. 2457T
gcauaucgacgaaccau

SEQ ID NO: 3833451 - RNA, 19 nt, Shigella flexneri 2a str. 2457T
gcauaucgguaaaugcuuu

SEQ ID NO: 3833452 - RNA, 19 nt, Shigella flexneri 2a str. 2457T
gcauaucuucaacgcaccc

SEQ ID NO: 3833453 - RNA, 14 nt, Shigella flexneri 2a str. 2457T
gcauaugcggugcg

SEQ ID NO: 3833454 - RNA, 16 nt, Shigella flexneri 2a str. 2457T
gcauaugcuuugccgu

SEQ ID NO: 3833455 - RNA, 19 nt, Shigella flexneri 2a str. 2457T
gcaucaaacgguugauaaa

SEQ ID NO: 3833456 - RNA, 19 nt, Shigella flexneri 2a str. 2457T
gcaucaaccaacaccuguu

SEQ ID NO: 3833457 - RNA, 21 nt, Shigella flexneri 2a str. 2457T
gcaucaagaaugcucgcuggc

SEQ ID NO: 3833458 - RNA, 16 nt, Shigella flexneri 2a str. 2457T
gcaucaauaacccugg

SEQ ID NO: 3833459 - RNA, 16 nt, Shigella flexneri 2a str. 2457T
gcaucaauaccgcgua

SEQ ID NO: 3833460 - RNA, 15 nt, Shigella flexneri 2a str. 2457T
gcaucaaugccggac

SEQ ID NO: 3833461 - RNA, 13 nt, Shigella flexneri 2a str. 2457T
gcaucaauugcua

SEQ ID NO: 3833462 - RNA, 14 nt, Shigella flexneri 2a str. 2457T
gcaucacaucgcug

SEQ ID NO: 3833463 - RNA, 17 nt, Shigella flexneri 2a str. 2457T
gcaucacgaauccgcac

SEQ ID NO: 3833464 - RNA, 19 nt, Shigella flexneri 2a str. 2457T
gcaucacuacaaccgggau

SEQ ID NO: 3833465 - RNA, 14 nt, Shigella flexneri 2a str. 2457T
gcaucacuccacac

SEQ ID NO: 3833466 - RNA, 15 nt, Shigella flexneri 2a str. 2457T
gcaucacuuccagua

SEQ ID NO: 3833467 - RNA, 21 nt, Shigella flexneri 2a str. 2457T
gcaucacuucuuuguucggca

SEQ ID NO: 3833468 - RNA, 23 nt, Shigella flexneri 2a str. 2457T
gcaucagacaaaugucacugcuu

SEQ ID NO: 3833469 - RNA, 17 nt, Shigella flexneri 2a str. 2457T
gcaucagacauuauugc

SEQ ID NO: 3833470 - RNA, 15 nt, Shigella flexneri 2a str. 2457T
gcaucagaucggcag

SEQ ID NO: 3833471 - RNA, 12 nt, Shigella flexneri 2a str. 2457T
gcaucagauggg

SEQ ID NO: 3833472 - RNA, 16 nt, Shigella flexneri 2a str. 2457T
gcaucagcaacacgcu

SEQ ID NO: 3833473 - RNA, 22 nt, Shigella flexneri 2a str. 2457T
gcaucagcagaaucgcaaccag

SEQ ID NO: 3833474 - RNA, 14 nt, Shigella flexneri 2a str. 2457T
gcaucagcagcacg

SEQ ID NO: 3833475 - RNA, 14 nt, Shigella flexneri 2a str. 2457T
gcaucagcgccacc

SEQ ID NO: 3833476 - RNA, 17 nt, Shigella flexneri 2a str. 2457T
gcaucagcgccaccagc

SEQ ID NO: 3833477 - RNA, 20 nt, Shigella flexneri 2a str. 2457T
gcaucagcgccaccagcgcc

SEQ ID NO: 3833478 - RNA, 14 nt, Shigella flexneri 2a str. 2457T
gcaucaggcaaucu

SEQ ID NO: 3833479 - RNA, 17 nt, Shigella flexneri 2a str. 2457T
gcaucaggccaaacaga

SEQ ID NO: 3833480 - RNA, 23 nt, Shigella flexneri 2a str. 2457T
gcaucaggcguucgcggcggcac

SEQ ID NO: 3833481 - RNA, 21 nt, Shigella flexneri 2a str. 2457T
gcaucaggcuaaucgccaggc

SEQ ID NO: 3833482 - RNA, 16 nt, Shigella flexneri 2a str. 2457T
gcaucagggcgcuggc

SEQ ID NO: 3833483 - RNA, 21 nt, Shigella flexneri 2a str. 2457T
gcaucagucacgacaaagaca

SEQ ID NO: 3833484 - RNA, 20 nt, Shigella flexneri 2a str. 2457T
gcaucagucucaaaccggcu

SEQ ID NO: 3833485 - RNA, 22 nt, Shigella flexneri 2a str. 2457T
gcaucaguucggaaacagugcu

SEQ ID NO: 3833486 - RNA, 14 nt, Shigella flexneri 2a str. 2457T
gcaucaucgauacc

SEQ ID NO: 3833487 - RNA, 16 nt, Shigella flexneri 2a str. 2457T
gcaucaucgcaaugau

SEQ ID NO: 3833488 - RNA, 16 nt, Shigella flexneri 2a str. 2457T
gcaucauggaagcaau

SEQ ID NO: 3833489 - RNA, 23 nt, Shigella flexneri 2a str. 2457T
gcaucauuuaaaaagaaaaaacu

SEQ ID NO: 3833490 - RNA, 13 nt, Shigella flexneri 2a str. 2457T
gcauccagcguuc

SEQ ID NO: 3833491 - RNA, 16 nt, Shigella flexneri 2a str. 2457T
gcauccauaucgccau

SEQ ID NO: 3833492 - RNA, 15 nt, Shigella flexneri 2a str. 2457T
gcaucccagaaaaaa

SEQ ID NO: 3833493 - RNA, 21 nt, Shigella flexneri 2a str. 2457T
gcaucccauuucuccagcagu

SEQ ID NO: 3833494 - RNA, 14 nt, Shigella flexneri 2a str. 2457T
gcaucccgcaccag

SEQ ID NO: 3833495 - RNA, 17 nt, Shigella flexneri 2a str. 2457T
gcaucccgcaccagcgg

SEQ ID NO: 3833496 - RNA, 16 nt, Shigella flexneri 2a str. 2457T
gcaucccggcagcccc

SEQ ID NO: 3833497 - RNA, 22 nt, Shigella flexneri 2a str. 2457T
gcaucccggcagccccaaacag

SEQ ID NO: 3833498 - RNA, 21 nt, Shigella flexneri 2a str. 2457T
gcaucccgguaucaaagcgcc

SEQ ID NO: 3833499 - RNA, 22 nt, Shigella flexneri 2a str. 2457T
gcaucccgguaucaaagcgcca

SEQ ID NO: 3833500 - RNA, 23 nt, Shigella flexneri 2a str. 2457T
gcaucccgguaucaaagcgccag

SEQ ID NO: 3833501 - RNA, 19 nt, Shigella flexneri 2a str. 2457T
gcauccgaagaaccacaga

SEQ ID NO: 3833502 - RNA, 18 nt, Shigella flexneri 2a str. 2457T
gcauccgacaaggcauca

SEQ ID NO: 3833503 - RNA, 14 nt, Shigella flexneri 2a str. 2457T
gcauccgacaucaa

SEQ ID NO: 3833504 - RNA, 17 nt, Shigella flexneri 2a str. 2457T
gcauccggcaauaagca

SEQ ID NO: 3833505 - RNA, 18 nt, Shigella flexneri 2a str. 2457T
gcauccggcaaucggugc

SEQ ID NO: 3833506 - RNA, 19 nt, Shigella flexneri 2a str. 2457T
gcauccggcaaucggugca

SEQ ID NO: 3833507 - RNA, 21 nt, Shigella flexneri 2a str. 2457T
gcauccggcaauucucucuga

SEQ ID NO: 3833508 - RNA, 18 nt, Shigella flexneri 2a str. 2457T
gcauccggcaauugugau

SEQ ID NO: 3833509 - RNA, 21 nt, Shigella flexneri 2a str. 2457T
gcauccggcaauugugauggu

SEQ ID NO: 3833510 - RNA, 20 nt, Shigella flexneri 2a str. 2457T
gcauccggcauaaacaaagc

SEQ ID NO: 3833511 - RNA, 14 nt, Shigella flexneri 2a str. 2457T
gcauccggcaucaa

SEQ ID NO: 3833512 - RNA, 21 nt, Shigella flexneri 2a str. 2457T
gcauccggcauuugagcagga

SEQ ID NO: 3833513 - RNA, 20 nt, Shigella flexneri 2a str. 2457T
gcauccgggauggucagcgg

SEQ ID NO: 3833514 - RNA, 21 nt, Shigella flexneri 2a str. 2457T
gcauccggucagacaacuucc

SEQ ID NO: 3833515 - RNA, 17 nt, Shigella flexneri 2a str. 2457T
gcauccggugauuuuca

SEQ ID NO: 3833516 - RNA, 21 nt, Shigella flexneri 2a str. 2457T
gcauccgugguggcagccagc

SEQ ID NO: 3833517 - RNA, 21 nt, Shigella flexneri 2a str. 2457T
gcauccuggcuguuacucaac

SEQ ID NO: 3833518 - RNA, 20 nt, Shigella flexneri 2a str. 2457T
gcauccuggggguucaucac

SEQ ID NO: 3833519 - RNA, 22 nt, Shigella flexneri 2a str. 2457T
gcaucgacaguuucaccugcug

SEQ ID NO: 3833520 - RNA, 13 nt, Shigella flexneri 2a str. 2457T
gcaucgaccagga

SEQ ID NO: 3833521 - RNA, 22 nt, Shigella flexneri 2a str. 2457T
gcaucgcaaaccagacgcgcgu

SEQ ID NO: 3833522 - RNA, 20 nt, Shigella flexneri 2a str. 2457T
gcaucgcaacaugcuggccu

SEQ ID NO: 3833523 - RNA, 18 nt, Shigella flexneri 2a str. 2457T
gcaucgccaguuuugcca

SEQ ID NO: 3833524 - RNA, 19 nt, Shigella flexneri 2a str. 2457T
gcaucgccaguuuugccag

SEQ ID NO: 3833525 - RNA, 15 nt, Shigella flexneri 2a str. 2457T
gcaucgccauaauaa

SEQ ID NO: 3833526 - RNA, 22 nt, Shigella flexneri 2a str. 2457T
gcaucgcccaggcgaccaggcc

SEQ ID NO: 3833527 - RNA, 12 nt, Shigella flexneri 2a str. 2457T
gcaucgccgcua

SEQ ID NO: 3833528 - RNA, 23 nt, Shigella flexneri 2a str. 2457T
gcaucgcgacagugcauaaauac

SEQ ID NO: 3833529 - RNA, 18 nt, Shigella flexneri 2a str. 2457T
gcaucgcgaccaaucaca

SEQ ID NO: 3833530 - RNA, 16 nt, Shigella flexneri 2a str. 2457T
gcaucgcgauggcaag

SEQ ID NO: 3833531 - RNA, 23 nt, Shigella flexneri 2a str. 2457T
gcaucggcaaaacgguaguugaa

SEQ ID NO: 3833532 - RNA, 22 nt, Shigella flexneri 2a str. 2457T
gcaucggcaaucacaucaccau

SEQ ID NO: 3833533 - RNA, 17 nt, Shigella flexneri 2a str. 2457T
gcaucgggcagcaucgc

SEQ ID NO: 3833534 - RNA, 18 nt, Shigella flexneri 2a str. 2457T
gcaucggucagacccagu

SEQ ID NO: 3833535 - RNA, 22 nt, Shigella flexneri 2a str. 2457T
gcaucggugaggaucaccaguc

SEQ ID NO: 3833536 - RNA, 18 nt, Shigella flexneri 2a str. 2457T
gcaucguaguuuuugccc

SEQ ID NO: 3833537 - RNA, 22 nt, Shigella flexneri 2a str. 2457T
gcaucguauugguacauaacac

SEQ ID NO: 3833538 - RNA, 18 nt, Shigella flexneri 2a str. 2457T
gcaucguauuucagaccu

SEQ ID NO: 3833539 - RNA, 15 nt, Shigella flexneri 2a str. 2457T
gcaucguccgccagc

SEQ ID NO: 3833540 - RNA, 15 nt, Shigella flexneri 2a str. 2457T
gcaucucaaucgcac
